United States Patent 9,782,462 (MODIFIED POLYNUCLEOTIDES FOR THE PRODUCTION OF PROTEINS ASSOCIATED WITH HUMAN DISEASE) - sequence listing, part 125

SEQ ID NO: 242117 - DNA, 10995 bp, Artificial Sequence
  Description of Artificial Sequence: Synthetic coding sequence
atggtacgggagactagacacctgtgggtaggtaatctgccagagaatgtgcgggaggagaagatcatcgagcacttcaaacggtacggacgcgttgagtcagtgaagatcttaccaaagcgtgggtctgagggcggagtagctgcgtttgtggatttcgtagacatcaaatccgctcagaaagcccataactccgttaataaaatgggagatcgggacctgcgaaccgactacaacgagcccggtaccattccctcagccgctcgcggactagatgataccgtgtcaattgcctcccgctcccgcgaggtcagcggatttcgaggcggaggcggtgggcctgcctacggtcctccacctagtctgcatgccagggaggggaggtacgagcgcaggctagatggggcatccgataatcgggagcgcgcttatgagcatagcgcgtacggacaccacgagaggggtaccggcggtttcgaccgaacccggcactacgaccaggattattatcgagacccgagggaaaggacactacagcacggactctattatgcttctcgcagccgctctccaaaccgctttgacgcgcatgaccccaggtacgagcctcgagctcgggagcagttcactcttccaagtgttgtgcatagagacatttatcgtgatgatatcacacgagaggtgagaggccgtcggccagaacgtaactaccagcactcccgtagtcgcagtccccatagctcccaaagccgtaaccagagtccccagagactggcatctcaagcctctcgtcccacccgtagccccagtgggtcagggtccagatcaaggagcagtagcagcgacagtatctccagcagctcaagtaccagtagcgattcctccgattcatccagtagttcctctgacgactctcctgctaggtccgtgcaatctgccgcagttccggctccaacctctcagctcctgagctcgctggaaaaagacgaacctagaaagtcttttgggatcaaagtccaaaacttacccgtgagaagtaccgacactagccttaaagatgggttattccatgagtttaagaagtttggtaaggttactagtgtgcagattcacggaacctccgaggaaaggtacggtttagtgttttttaggcagcaggaagaccaggagaaagcactcaccgctagcaagggtaagctgttcttcggaatgcagattgaggtgaccgcctggattgggcctgagacagagtctgagaatgaattcagacccctggatgaacgtatagacgagttccacccaaaagcaacaaggaccctttttatcgggaatctggaaaaaacgactacataccacgatttgcgcaatattttccagcgtttcggtgagattgtggacatcgatatcaaaaaagtcaatggagtgcctcagtacgcctttctccaatattgcgatatcgcctctgtctgcaaggcgataaagaaaatggatggcgaatatctcggtaataatcgcttgaagttgggattcggaaaaagtatgcctaccaactgcgtgtggctggacggactcagtagcaacgtctccgaccagtacctcacccgacacttctgcaggtatggacccgttgttaaggtggtctttgaccgcctaaaaggcatggccctggtgctgtacaacgagattgaatacgcgcaggccgcagtcaaagaaacaaaagggaggaagatcggcggtaacaagattaaggtggactttgctaatcgcgaatctcagcttgccttttaccactgtatggaaaaaagtggccaggatataagggatttctatgaaatgcttgcggaaaggcgcgaggagcgaagggcttcctatgattacaatcaggatcggacgtactacgaaagcgtgcgtacccctggcacgtaccctgaggattccaggagagattacccagccagggggcgtgagttttactcagagtgggaaacttaccaaggcgattattatgagtctcggtattatgacgatccacgcgaataccgggactaccgcaacgacccatacgagcaggatatcagggagtattcctaccgacagagggagagagaacgggagcgcgaaaggtttgaatctgatcgagatagggaccacgaaaggcgtcccatcgaacggtcccagagccccgtacacctgaggcgaccgcagtccccaggggctagcccaagtcaggccgagagactgccaagcgattctgagcgaaggctctacagtaggtccagtgaccggagcggcagctgttccagtttgtccccccctcgctatgagaagctggacaaaagccggcttgaacgatatacaaaaaacgaaaaaacagataaggaaagaactttcgaccccgaacgtgtcgaaagggaacgtaggctgatcagaaaggaaaaggtggagaaggacaagacagataagcaaaagagaaaggggaaagtgcactccccttcgagtcaaagttccgagaccgatcaggaaaacgaacgcgagcagagcccagagaagccaagatcctgtaataagctgtcaagagagaaggcagacaaggagggcattgccaaaaatcgcctggaactaatgccttgtgtcgtactgacccgcgtgaaagagaaggagggcaaggtcatagatcataccccagttgagaaactgaaagctaagttagacaacgataccgtaaaatcttcagctcttgatcaaaagttacaggttagccagaccgaaccagctaagtcagatctttcaaaactggaaagcgtcagaatgaaggtgccaaaagaaaagggtctgtcctcacatgtggaggtggtggaaaaggagggacgactgaaggccaggaaacacctcaaacctgaacagcccgcagacggcgtatccgccgtcgatctggagaaactcgaggccagaaagcgtaggtttgccgactctaacttgaaagcggagaaacagaagccggaagttaaaaagtcaagtcctgagatggaagatgctcgggtactcagcaagaagcagccagacgtgagtagtagagaggttatcctgctgcgcgagggggaagcagagaggaagcccgtgagaaaagaaattctcaagagagaatccaaaaagattaagctggatcggctaaataccgtcgcttcccctaaagattgtcaagaactggcctccatttccgtcgggtcagggtctaggccttcaagcgacctgcaagccaggctgggtgagttagcaggagagagtgtcgagaatcaggaggtccagagcaagaaaccaattccgagtaaaccccagttgaaacagctgcaggttcttgacgaccagggccctgagcgagaggatgttcgcaaaaactattgttcattgcgcgacgaaacaccagagcgcaagtctgggcaggagaagtcccattcagttaatacggaggagaaaattggaatcgatatcgatcacacgcagagctaccggaaacagatggagcagagccggagaaaacagcagatggaaatggagattgcgaagtccgaaaaattcgggagtccaaagaaagacgtggacgagtatgagaggcggagcctcgtgcatgaggtcggtaagcccccacaggacgtgaccgatgacagcccgccatccaagaaaaagcggatggatcacgtggactttgacatctgcaccaaacgagaacgaaattacagatcctctcgacagataagcgaggatagcgagcggaccggtgggtctccgagcgtacgtcacggcagtttccacgaagatgaagatcccatcggatcccctagactcctttccgtgaaaggctctccaaaagtcgacgaaaaggtcctcccatactccaatattaccgtccgggaggaaagcctcaagttcaacccctacgactcaagccgaagagagcagatggccgacatggccaaaattaagctgtcagttcttaactctgaggatgagctgaatcggtgggattcccagatgaagcaggatgctggcagattcgacgtgagctttcccaatagcataattaagagagatagcctgaggaagaggtctgttcgcgatttggaaccaggggaggtgccctctgatagcgatgaagacggagagcacaagtcacattcacccagagcctcagctctgtacgagtccagcaggctgagcttcctgttaagggacagagaagacaaacttcgggagagagatgagaggctgagttcctctttggagcgcaataagttttattcgttcgctcttgataaaaccattaccccagataccaaagctctgctagaaagagctaagagcctgagctcctcccgggaggagaactggtcattcttggattgggacagccgttttgcgaactttcggaacaataaagacaaggaaaaggtggactccgctcccagaccaataccctcatggtatatgaagaaaaaaaagattcgaacagattctgaggggaagatggatgataagaaggaggaccacaaggaggaagaacaggagagacaggaactctttgccagtagatttctccacagcagcatatttgagcaagactcaaaacgtctacaacatcttgaacgtaaggaagaggactctgattttatatctggcagaatctacggcaagcagacttccgaaggagcaaacagcactaccgactccatccaggagcctgtggtgttgttccattctaggtttatggagttaaccagaatgcagcagaaagagaaggaaaaagatcagaaacccaaagaagttgaaaagcaggaggacaccgaaaaccaccccaagactccagaaagcgccccagagaataaagattctgagctgaaaactcccccatctgtgggcccaccgtcagttacagtagtgacgctggagtccgccccatctgccttagagaagacaactggtgacaagactgtcgaggctcccctggtgactgaagagaaaaccgtcgagccagccactgtctcagaagaggcgaagcctgctagcgagcctgctccggctcctgtggaacaactcgagcaggtggacttgcccccaggggcagaccctgacaaagaggcagcaatgatgccggcaggcgtggaggaaggctcaagcggggatcaaccgccatatctggatgcaaagccccctacaccaggtgcctcattcagccaagccgagtcaaacgttgatccagagccggatagcacgcagcctcttagcaagcctgcccagaaatccgaggaggccaatgaaccaaaggccgagaaaccagacgccaccgccgatgctgaacccgatgccaaccaaaaagccgaggccgctcccgagagtcagcccccagcctcagaggacctcgaggtggaccccccagtggctgctaaagataaaaaaccaaacaaaagcaagcggtctaagaccccggtgcaggcagccgcagtatcaatcgtcgaaaaacccgtgacgcgaaaatcggaacgcattgaccgcgagaaactcaagaggagtaactcccctcggggagaggcccagaagctattagagctcaaaatggaggcggagaagataacaagaaccgctagtaaaaattcagccgcagacttggagcatcctgagcccagtctacctttatcccgcactaggagacgaaatgtgagaagcgtttatgccacaatgggagaccacgagaaccgaagccccgtcaaggagcccgtggagcagccacgagtcacacggaaaagactcgagcgagagctccaggaggctgctgcagtccctacaacccctcgcagaggacggccacctaaaactagaagaagggccgatgaggaagaagaaaatgaagccaaagagcccgcagaaactttgaagccccctgaaggctggagaagcccaaggagccagaagactgccgcaggtggagggccacaaggtaagaagggtaagaacgaaccgaaggtggatgcgacacgtcccgaagccacaacggaagtaggtccacaaatcggcgtcaaagaatccagtatggaacccaaggcagccgaagaagaggctgggtcagaacagaaacgagatagaaaggatgcaggcacagacaaaaacccgcctgagacagctcctgtagaagttgtggagaaaaaaccagctcccgagaaaaattcgaagtccaaacgaggacgctctagaaacagtcgcttagcggttgataaatctgcctccttgaagaacgtcgacgccgctgtgtcacctaggggagccgcagcacaggctggggagcgggaaagcggcgtagtcgccgtatctccagaaaagtccgaatcacctcaaaaggaagatgggctgtcatctcaattaaagtcagaccctgtggatcctgataaggaacccgagaaggaagacgtctccgcttctgggccatctccagaggcgacccaacttgccaaacagatggagttagaacaggccgtcgagcatatagcgaagctcgccgaagcctcagccagcgcagcctacaaggcggacgctcctgaaggcctggcccctgaggatcgggataagcctgcccatcaggcctccgaaactgaactggccgctgctatcggaagcatcatcaatgacatttccggtgagccagaaaacttcccagcccctccgccatacccaggggagtcccaaactgaccttcagccgcctgctggggctcaggcacttcagcctagcgaagagggaatggagacggatgaagccgtaagcgggatactggagacggaagcggcaacggaatcttcacgcccacccgtgaatgcccctgaccctagtgcgggtcccacagacaccaaagaggctcgcggaaatagttccgaaactagtcactccgtgccggaggcgaaaggatctaaggaggttgaggtcaccttggtacgcaaagacaaaggcaggcagaaaactactcggagccggaggaagcgtaatacaaataagaaggtggtcgctcctgtagaatcacacgttccagagagtaaccaggcccagggggaatcaccggcagccaatgaaggcacaactgtccagcatccagaggccccacaggaggagaaacagtctgaaaaaccacacagcactccgcctcagtcttgtacttctgatttgtctaagataccgagcacagagaattcatctcaggagattagtgtcgaggaacggacaccgacaaaggcctctgtgcctcccgatctgccacctcccccacagcctgccccagtcgacgaagagccgcaggcacggttcagggtgcatagtattattgaaagcgatccggtcacgccaccgtccgatccaagtatccccattcccaccctcccctccgtcactgctgccaagcttagccctcccgtggcaagcgggggaatccctcatcaatccccacccacgaaagtgaccgagtggattaccaggcaggaggagccacgagctcagtccacgccttccccggctctgccacctgataccaaagcctctgatgtcgacacaagctccagcacactcagaaagatcctcatggaccctaaatatgtgtcggccacaagtgtgacttcaactagcgttaccaccgcaattgcggagcctgttagtgccgctccatgcctgcatgaagcgcctccaccgccagttgatagtaagaaacctctcgaggaaaaaacagctcctccggtgactaataactccgagatccaggctagcgaggttctggtggctgctgacaaagagaaggtcgctcccgtgattgcccctaagattacctcagtcatcagcagaatgcccgtgtccattgatctagaaaattcgcagaagatcacactcgctaaaccggctccacaaactctgacagggctcgtttccgctctcacgggcctggtaaacgtcagtttggtacctgtgaacgccttgaaaggccctgtgaaaggttctgtcacaactctgaaatctctggttagcactcccgctggccctgttaacgtgcttaagggcccagtcaatgtactgacagggccagtcaacgtcctgactactccagtgaatgctaccgttggcactgttaatgccgcaccgggaacggtaaacgccgctgccagtgccgtgaacgcaaccgcatcagcagtgaccgttaccgcgggagctgtgactgcagccagtggaggagtgaccgctactactggcacggtgaccatggccggagccgtgattgctcccagcacgaaatgtaagcagcgcgcatcagctaatgaaaacagcagattccacccgggatcgatgccggttatcgacgaccgcccagcagatgctggatccggagccggactgcgcgtcaacacctccgagggcgtagttctattatcctattccggtcagaagacggaggggccacaaaggatctccgccaagataagccagatcccgccagcgagcgccatggacatagagtttcagcagagcgtgagtaaaagccaagtcaagcccgatagcgtcacagcaagccaacctcctagcaagggtccgcaagctcctgccggttatgccaatgtggcgacccactccactctggtcctcaccgcccagacttataacgcatctccggtcatttcctcagtgaaagcagatcgcccttccctcgaaaagccagaacctattcacctctccgtttccactcccgttacccagggcggaaccgttaaagttctcacccaggggattaatactccgcctgtgctggtccataaccagctagtgcttacccccagcatcgtgacaacaaacaagaagcttgctgatccggtgactctgaagatcgagacaaaggtcttgcagcccgctaacctgggctcaaccctgaccccccatcaccctcctgctctcccctcaaagctccccaccgaagtgaatcacgtgcccagcggcccaagcattcctgccgaccgcacggttagccatctggcagcggctaagctggatgctcattccccccgaccctctggcccaggcccatcaagctttcctcgggcttcgcacccttcttccactgccagcaccgccctgagcacgaacgccacggtgatgctcgccgcaggtattccagtcccacagttcatcagtagcatccatccagagcagtctgtgattatgcccccacactcgatcacccaaaccgtaagcctttcgcacctttctcagggggaagtgagaatgaatacaccgaccctgccatcaatcacttattcgattagacctgaggctctccactcacctagagcaccgctccagccgcagcagatcgaggttagagccccacagagagccagcaccccgcagcctgctcctgctggcgtcccggctctcgcatcacagcacccacccgaagaagaagtgcattatcacctacctgtggcgagagccacggcgcctgttcagtccgaagtcctggttatgcagtccgagtaccgactgcatccatacaccgtcccacgagatgtccggatcatggtgcatcctcacgttaccgctgtctccgaacaaccccgagcggcagacggggtcgtcaaggtgccccctgcttcaaaggcccctcagcagcccggaaaggaggccgctaagacaccagacgccaaggcagcgcctactccaacgccggctccagtaccagtccccgtgccactgcccgctcctgccccagccccacacggcgaggctagaattctgaccgttacaccgtccaatcaactccagggcctgcccctcacgcccccagtcgtggttactcatggtgtgcaaattgtgcactcgagcggagaattattccaggaataccggtacggggatatccggacctaccacccgccagcacaattgacacacacacaattccccgcagcaagttcagtggggttgccttctaggactaaaactgccgcacaggggccaccccctgagggcgagccattacagcctccccagccagttcagtctactcagccggctcagccagctccaccatgccctccctcacagttgggccagcctggacagcccccttcttctaagatgcctcaagtctcccaggaagccaagggaactcagactggggtggaacagcctcggttacccgcagggcctgcaaatcgacctcctgaacctcacacacaggttcagcgagcgcaggcggaaactggcccaacgagcttcccgtcgccagtctctgtaagtatgaagccggacttgcctgttagcttgcccacccagacagcaccgaagcagcccttgttcgtgccaactacctctgggcctagcaccccacctggtctggttctgcctcataccgagttccagcccgcacccaaacaggattcctccccacatttgacgtcacagaggcccgttgatatggtccagctgttgaaaaagtatcctatcgtctggcaaggattactggctctcaagaacgacaccgccgcagtgcagctccactttgtgtctgggaacaatgtgttggctcaccggagtctgccacttagcgagggcggacctccattgcgtatcgcacagaggatgcggctggaggccacccagttggaaggggtggccagacgcatgacagtcgagacagactattgtctgcttctggccctgccatgtggaagggaccaggaggatgtggtgtcacaaacagaaagtttgaaggctgccttcataacctacctgcaggctaagcaggccgctggtatcattaatgttcccaatccaggttctaaccagcccgcatacgtcctgcagatttttccaccctgcgaattctccgagtcacatctttcccggctggctcctgacctgctggcttcgatcagcaatatctctcctcatctaatgatcgtgatcgcgtctgtttaa

SEQ ID NO: 242118 - DNA, 1122 bp, Artificial Sequence
  Description of Artificial Sequence: Synthetic coding sequence
atgaacgtagataaatttctcatcgtttgctacctgaagaaagaggtgtggggatttgaatcctattccttatccggcacaacctgcttccagtggaattactttgtatggagtctgcgcttctttttttcttgtggatcatcaaaataccacctcacccccctccccatcaagaaggttgattatccacacaaacgcggacagaactggggctcctacgtacataactctcttcctaggttcaactgggattatcggtcctgtttccacacttggaaacgcgcatctgacaacagagaacgggcatacgaacactcagcatatgggcaccatgaacggggaactggaggatttgacagaactcgtcactacgaccaggactactatagggaccccagagagcgaactctacaacatggcctgtactacgctagccggagtcggtcccccaaccgattcgacgcccacgatcctaggtacgagcccagagctcgcgagcaattcactctcccatccgtcgtccacagagatatataccgtgatgacatcacacgggaagtgcgaggaagacgacccgaacggaattaccagcatagccggagcaggtcaccacatagctcacagagtaggaaccagtccccacagaggcttgctagccaagcctctagacctacgagatctccatccggtagtggtagtcggtcgcgctcctcctcatccgactccatcagttcaagctcatctacgagtagcgatagcagtgattccagtagtagtagttccgacgattctccagctcggtctgtgcagtcggccgcagttcctgcgcctacttcacagctcctgtcaagcctggagaaagacgaaccaagaaaatccttcggaattaaagtgcaaaacttacctgtgaggtcgaccgatacctctctgaaggatggcctgtttcacgaatttaaaaagttcggcaaagtcactagcgtgcaaatccatggtacaagtgaagagcgatacggcctggtcttttttaggcagcaggaagatcaggaaaaggcacttaccgccagcaagggcaaactgttttttggcatgcagattgaggtgaccgcctggattggtccgtag

SEQ ID NO: 242119 - DNA, 894 bp, Artificial Sequence
  Description of Artificial Sequence: Synthetic coding sequence
tagcaggcctcccgacctactagaagcccaagcggcagcgggtctcgttcccgatcctcatcctctgatagcatctcctcatcaagcagtacatcctcagatagtgactcttccagtagcagtagcgacgattcgccagctcgctctgtccaatctgccgctgtgccagctcctacatctcagctccttagctcccttgagaaggacgagccgaggaagtcttttggaatcaaggtgcaaaacttgcctgtgcgcagcactgacacttccctgaaggacggactgtttcatgagtttaagaagtttggtaaggtaacatcagttcaaatccacggaacctcagaggagaggtacggcttagtcttctttcggcagcaggaggaccaggagaaggctttgaccgccagtaaaggtaagctgttcttcggtatgcagatagaggttaccgcctggataggtcccgagactgaatcagaaaacgagtttagaccactggatgaacggatagacgagtttcaccccaaagccaccagaacgctattcatcgggaacctggagaaaacaacaacataccacgatcttaggaatatatttcagcggttcggggaaattgtggatatcgatataaaaaaggtaaatggggtacctcagtacgcgtttttgcagtactgcgatatcgcaagcgtctgtaaagccataaagaagatggacggggagtacctcgggaataatcgactcaagctcggcttcgggaaatctatgcctactaattgtgtttggctggatgggctgtcgagtaatgtttctgatcagtatctgacacggcacttttgtagatatggcccagtggttaaagtagtgttcgatagacttaagggaatggccctggtatag

SEQ ID NO: 242120 - DNA, 885 bp, Artificial Sequence
  Description of Artificial Sequence: Synthetic coding sequence
atgagtccacggggaaccggttgcagcgctgggttgctgatgactgtgggctggctcttactcgccggattgcaatccgccagaggtactaacgtcactgctgctgtgcaggacgccggtttggctcatgaaggcgagggggaagaggaaaccgaaaataacgattccgagaccgctgagaactatgccccaccagagaccgaagatgtgtcaaaccgaaatgtggtgaaggaggttgaattcggcatgtgtacggtgacctgcggtattggtgtacgggaggtcatcttaactaatggctgtcccggaggcgaaagcaagtgcgtagtgcgggtagaggaatgccgcggaccgacagactgtggttggggcaagccgatttcggagagcctggagtcggtcaggcttgcttgcattcacacgtcacccctgaacagattcaagtacatgtggaagctgctcaggcaggatcaacagagtatcatcctggtaaacgatagcgccattctggaggttagaaaagagtctcatccattggctttcgagtgtgataccctggacaacaacgaaatcgtggcaacaataaaattcaccgtgtacaccagctccgagcttcagatgaggcgttcaagtctgccagcaactgacgccgctcttatttttgtactgacgatcggagtcatcatctgtgtctttatcatcttcctccttatatttataattatcaattgggctgctgtgaaagccttttggggggcaaaagctagcactcctgaagtgcagtcagaacagtcttccgttagatacaaggattcaacttcattagatcagttaccaaccgagatgcctggagaagacgatgcactgtctgagtggaacgagtag

SEQ ID NO: 242121 - DNA, 648 bp, Artificial Sequence
  Description of Artificial Sequence: Synthetic coding sequence
atggtttccgcactaaggggggctcccctcattcgagtgcatagctcacctgtttcttctcctagtgttagcggtccccgtagactcgtgtcatgcctgtcctcacagtccagcgccctgagccaatctggtggaggctcaacttcagccgcagggatcgaggctcgcagcagggcgctgaggagacgatggtgtccagccggaatcatgctgctagccctggtgtgtctgctgtcctgtcttcttccatcatctgaagccaaactatacgggagatgtgaacttgctcgcgttctgcacgatttcggactggacggctacagaggctattcactggcggactgggtgtgccttgcctatttcacttctggatttaatgcggctgccctggactacgaagcagatggctccacaaacaatggcatctttcagattaatagcaggagatggtgctccaatttaacacccaatgtgccgaacgtttgtagaatgtactgttctgaccttctaaatccgaacttgaaggacactgtaatctgcgctatgaagattacacaggagccacagggtctgggctattgggaggcatggagacaccactgtcagggcaaggatttgacagaatgggtcgacgggtgtgacttctag

SEQ ID NO: 242122 - DNA, 627 bp, Artificial Sequence
  Description of Artificial Sequence: Synthetic coding sequence
atgattcaggaagatcacgagggaagtcaagatggcggagttcatagctctcccgtgtcttcacccagcgtttccggacctagaaggcttgtgagctgcctgagttcgcagtctagcgctctaagtcagagcggcggagggtccactagcgccgctggcattgaggccaggtccagagcactgcgacgaagatggtgtcctgcgggaataatgctattagcactagtttgcctgctgtcgtgcctgctgcctagtagcgaagccaagttgtacggaagatgcgagctggcgagggtgcttcacgacttcgggctggacgggtatcgcggttatagtctggccgattgggtttgtcttgcatacttcacttccggttttaatgcagccgctctggattatgaggccgatggtagcacaaacaatgggatttttcaaattaacagtaggagatggtgttctaacctgacccccaatgttcctaacgtgtgccggatgtattgctccgatctgctgaatcctaacttaaaggatacggtcatctgcgcgatgaagattacccaggaaccacagggacttggctactgggaggcctggagacaccactgtcagggaaaagacctgacctag

SEQ ID NO: 242123 - DNA, 339 bp, Artificial Sequence
  Description of Artificial Sequence: Synthetic coding sequence
atggtttccgcactcagaggggctccactgattcgcgtctgcctcgcctactttacctccgggttcaacgccgctgccctggactacgaagctgatgggagcacaaataacgggattttccagataaatagccggaggtggtgctcaaatttgacacctaatgtacctaacgtgtgccgcatgtattgctctgacctgctgaatcctaacctgaaagacacagtgatctgtgctatgaagatcacccaggagccacaaggactgggctactgggaggcctggagacaccactgtcagggcaaggacctgacggaatgggtggatggatgcgacttctag

SEQ ID NO: 242124 - DNA, 372 bp, Artificial Sequence
  Description of Artificial Sequence: Synthetic coding sequence
atgacaagcgggtggaccgatacaggcgacactgcctggctgaccgcctatgcgctcccttacgctggagtgtgtctcgcttattttaccagcgggttcaacgccgcagctctcgactatgaagcagacggctctaccaacaacgggattttccagatcaattcccgccgttggtgtagtaaccttactccaaacgttcctaatgtgtgccgtatgtattgctcagaccttctcaaccccaacctgaaggatacagtgatctgcgccatgaagatcacccaggagccacagggcctcggttattgggaggcgtggcgacaccactgccagggaaaagacttgacggaatgggtagatggatgcgacttttag

SEQ ID NO: 242125 - DNA, 375 bp, Artificial Sequence
  Description of Artificial Sequence: Synthetic coding sequence
atggtgctctgttggttacttctcctggtgatggctctccctccaggaacgaccggcgttaaagattgcgtcttttgcgagctaacggacagcatgcagtgcccaggtacatatatgcattgtggcgatgatgaggactgcttcaccgggcacggagtcgcaccaggcacgggccctgttatcaataagggctgcttgcgggcaaccagctgtggactcgaagaaccggtgagctacagaggcgtgacatactcgcttactacaaattgctgcacagggcgattgtgcaatcgggctccttccagccagacagtaggggctacaacttctttggctctgggcctggggatgctactgccaccaagattactgtag

SEQ ID NO: 242126 - DNA, 480 bp, Artificial Sequence
  Description of Artificial Sequence: Synthetic coding sequence
atgaaggcctgggggacagttgtggttacgttggcaacattaatggtggtgactgtagacgctaagatctacgagcgatgcgaactggccgcaaggctagagcgggctgggctaaacggttacaaaggctacggcgtgggagactggttgtgtatggctcactatgagtcaggctttgatacagccttcgttgaccataatccagacggatcatcagagtatggtattttccagctgaatagcgcctggtggtgtgacaatggtattacacctacgaaaaacctgtgccacatggattgtcatgacctactaaaccggcatatcctggacgacatccgatgcgcgaaacagattgtttcctcccagaatggcttgagtgcgtggaccagctggagactacattgcagtggtcacgacctcagcgagtggcttaagggctgcgatatgcatgttaagattgatcctaaaattcacccctag

SEQ ID NO: 242127 - DNA, 480 bp, Artificial Sequence
  Description of Artificial Sequence: Synthetic coding sequence
atgaaggcctggggaactgtggtggtaacattagcaaccctcatggttgtgacagtcgacgccaagatttacgaacgttgtgagttagccgcaagactggagcgcgcaggcctgaacgggtataaagggtacggcgtgggcgattggctctgcatggcacactacgaaagtggctttgacaccgcattcgtggatcacaatcctgacggctcttcagaatatggcatttttcagcttaactcagcctggtggtgcgacaacgggattactcctacgaaaaacttgtgtcacatggattgccatgacctgctcaatagacacatcctggatgatatccgatgcgcaaagcagattgtgtccagccagaacggactgagcgcctggacttcatggagactccattgctccggtcacgacctctcggagtggttaaaagggtgcgacatgcacgtgaaaatcgatcccaagatccatccatag

SEQ ID NO: 242128 - DNA, 3207 bp, Artificial Sequence
  Description of Artificial Sequence: Synthetic coding sequence
atgaggtccgcagcgaaaccctggaacccggcaatccgcgctggaggacacgggcctgatcgggtccggcctctccctgccgctagctccggcatgaaatcatccaagagtagcacatctttggcctttgaatcaaggcttagtcgcctgaagcgagcgagtagtgaagacaccctgaataaaccgggttccacagccgcttccggagtggtacggttaaagaaaacagccaccgcgggagctattagtgaactgactgagtcacgtctccggagcggaacaggggcttttacgacaaccaagcgaaccgggatcccagccccaagggaattctctgtcactgttagcagagaaaggtccgttcctagaggtccctcaaacccaagaaagagcgtcagctccccaacctcatccaacacgcccactcctactaaacatctccgtacgccaagcacaaagccaaaacaggagaacgaaggcggtgaaaaggctgcactggaatcccaggtccgggagctgttggccgaggcaaaagctaaagactccgaaatcaaccgtctgcggtcagagctcaagaagtacaaagaaaaacgcactctgaacgccgaaggcacagatgcactcggccctaacgtggatggcacttcagtctcccccggagacactgagcctatgatcagggcgcttgaggagaaaaacaaaaatttccagaaggagctctctgatctggaggaggaaaaccgggtgctcaaggaaaaactcatctaccttgagcatagccccaattctgagggggcagcctcccatactggtgatagtagctgtcccacgtccattactcaggagtctagctttggttccccaaccggcaatcagatgtcgagcgatatagatgaatacaagaagaatatccatggtaatgccttacggaccagcgggtcctcctcaagcgacgtgactaaagcttccttatcacctgatgcatctgactttgagcatatcaccgccgaaaccccttcacgcccattgtcttccacctcgaacccctttaaatcatctaaatgttccaccgcagggtccagccccaacagcgtgagtgagctgagcctcgcctcacttactgagaagattcagaaaatggaagaaaatcaccactcaacagccgaggagctacaagccactctgcaggagctaagcgatcagcagcagatggtgcaggaacttacggctgagaatgagaagctggttgatgaaaagaccatcctcgagacctcttttcaccaacaccgggagcgcgctgagcaactgtcccaggagaacgagaaactcatgaatcttctgcaggagagagtaaagaatgaagagcccacgacacaggagggaaagattatcgaactagagcagaagtgcaccgggattttggaacaaggcagatttgaacgggaaaaactattaaacatccagcagcagctgacctgctctctgaggaaagtggaagaggagaatcagggagctctggagatgattaagcgcctgaaagaggagaacgagaaactaaacgaatttctggagttggagcgccacaacaataatatgatggctaagacgctggaggaatgccgcgttactctggagggacttaaaatggagaacggatcgcttaagtcacacttacaaggggaaaagcaaaaagctactgaagctagtgccgttgaacagactgcagaatcgtgtgaggttcaggaaatgcttaaagtggccagggcagagaaggatctcctcgaacttagctgcaatgagcttaggcaggagctgctaaaagccaacggcgaaataaaacacgtgagttcccttcttgccaaagtcgaaaaagactattcttacctcaaagagatttgcgatcaccaggctgagcaattgagtagaaccagtctgaaactgcaggaaaaggcatcagaaagcgacgcagagatcaaggacatgaaagagactatcttcgagttagaagaccaagtggagcagcaccgcgcagtgaagctgcataacaaccagcttatcagcgagctggagtctagcgtgattaagctagaggagcagaaatcagacctcgagaggcaattgaagaccctcaccaagcagatgaaggaggaaaccgaggaatggcgccgttttcaggcagacctccagacagcagtagtcgtagctaatgatattaaatgtgaggctcaacaggaacttcgaacagtgaagcgaaagctattggaagaggaagagaagaacgctagactccagaaagagctcggcgacgtgcaggggcacgggagagtagtgacttcacgagccgctccacccccagtggatgaagagcctgagagctcagaggtagacgctgccggtcgctggccaggggtttgtgtttccagaaccagccccacacctcctgagtcggctaccaccgtgaagagcctgattaaatcttttgatttgggaagacccggaggtgccggtcagaatatcagtgtgcataagacgcctaggtctccactgtctggcatccccgtgcgcacagcccctgcagctgctgtctcacccatgcaacggcacagtacatactcctcagtgcgcccagcatcccgaggtgtcacacagcgcctagacctcccagacttgccgttgtcagatatacttaagggtcgaactgagaccctcaagcccgatccgcaccttcgaaaatctccttcactcgaaagcctgtcacggcctccttcccttggcttcggcgacacacggctgctatctgcttcgacacgcgcatggaaacctcagtcaaaactttccgtcgaacgaaaggatccactggccgctctggccagggagtatggcggttccaagagaaatgcgctgctgaaatggtgccagaagaagacccaagggtacgctaatattgacattacgaatttctcatccagttggtccgatggtctcgctttctgcgccttgcttcatacatatttgccggcacacataccttaccaggagctgaatagccaagagaagaagcggaatctgttacttgccttcgaggcagccgagtctgtggggattaaaccctcccttgagctgtcagagatgctttacaccgatagacctgattggcagtcagtaatgcagtatgtagcccaaatctataaatactttgagacgtag

SEQ ID NO: 242129 - DNA, 2112 bp, Artificial Sequence
  Description of Artificial Sequence: Synthetic coding sequence
atgggaaaccacagtgggcgtccagaggaccccgaacccggtgccttcaccacgacaaaaagaacgggcattcccgctccaagagagttttccgtgacagtgagcagggagaggagcgttccgagaggaccatcaaacccacggaaaagcgtcagctcaccaacttcctcgaatacccccactccaacgaaacatctgcgcacaccctctacaaagcctaaacaggaaaatgaggggggtgagaaggcggctctggaatctcaggtgcgcgagctgctggccgaggccaaggcaaaggattccgagatcaatagattgcggagcgaactcaagaagtacaaagagaagcgcaccttaaacgctgaaggcactgatgcattggggcctaacgtcgatggtacctccgtgtcacctggagacaccgagcctatgattcgggctttggaggaaaaaaacaagaactttcagaaggaactgagcgatttagaggaagaaaatagagtgctcaaggaaaagctcatttacttagagcatagccctaacagtgaaggggcagctagtcatacaggcgatagctcttgcccaacttcaatcactcaggagagctctttcgggagtcccacaggtaaccaaatgtccagtgacattgatgaatataagaagaacatccacggtaacgcactgaggacatccggaagcagtagttccgacgtgaccaaagccagtcttagccctgacgcatccgacttcgaacatattactgctgagactccaagcaggccactgtcttccacaagcaacccctttaaatcaagcaagtgcagtacagccggttcatccccgaatagcgtatctgaactcagcctcgcttctctcaccgaaaaaatacagaaaatggaggaaaaccaccactcaacagccgaagagctgcaggctacattacaggagctgagtgaccagcagcagatggtgcaggagctgactgccgagaatgagaagttggtcgatgagaaaaccatcctggaaacgtcctttcaccagcatcgggagcgggctgagcagttgagccaggagaacgagaagcttatgaatttgctgcaggaaagggtgaaaaacgaggagccgacaacccaggaaggaaagataatagagctggaacagaagtgcactggaatcctggagcagggacggtttgaacgcgaaaagttgttaaacatccaacaacagctgacatgctccctacgaaaagtggaagaggagaaccagggagcactcgaaatgatcaaaagactcaaggaagaaaacgaaaagctgaatgagtttttagaattggagaggcacaataataacatgatggcaaagactctggaagaatgtagagtcacactagaggggctgaagatggagaacggaagcttaaaatcacacttgcaaggcgagaaacagaaggctacagaggcctcagcggtggagcagactgctgagagttgcgaggtgcaggagatgttaaaggttgccagagcagaaaaggacctgctggagctctcctgtaatgagttgcggcaggagcttcttaaggcaaacggagaaattaagcacgtaagctccttgttggcgaaggttgaaaaagactacagttatctcaaagaaatctgcgaccaccaggctgaacagctgtcacgcacatcactgaaacttcaggagaaggctagcgaatctgatgccgaaatcaaagatatgaaagaaaccatctttgaattggaggaccaggtggagcagcatcgggcagttaaattgcacaataaccagcttatcagcgagttggagtcctcagtgataaagctggaggagcagaaatccgacttggagcggcagctcaagacgcttaccaagcagatgaaagaagaaacggaagaatggcggagattccaggcggatctgcaaactgcagtagtagtggccaatgacatcaagtgcgaagcacagcaagagctacgcaccgttaagaggaagctattagaggaggaagagaaaaatgctcgacttcagaaggagctaggcgacgtccagggccatggaagagtggtaacatctcgagcagccccaccatag

SEQ ID NO: 242130 - DNA, 2130 bp, Artificial Sequence
  Description of Artificial Sequence: Synthetic coding sequence
atggggaaccattccggacgccctgaggaccccgagcctggagcgtttaccaccacaaagcgaacagggatccctgcgcctagggaattcagcgtcactgtttccagggagcggtctgtgcccagggggccaagcaacccaaggaagagtgtgtcctccccaacttcttcaaacacgccaacccctaccaagcatctcagaacacccagtacgaagcccaagcaagaaaatgagggcggtgaaaaagctgcgctggagtcccaagtgagagaactccttgctgaggccaaggctaaagactctgagatcaaccgactccgctctgagttgaaaaagtataaggaaaaacgaacactcaatgcagaagggacggacgcacttggaccgaatgtggatggtacatcggtaagccccggagacacggagcctatgattagggctctagaggagaaaaataagaatttccaaaaggaactgagtgacttggaagaagagaacagggtccttaaagaaaaactgatctaccttgaacactctccaaattctgagggtgccgcatcacataccggagattcatcctgccctacttctattactcaggagtcgagctttggctctcccactgggaaccagatgtcttctgacatagatgaatacaagaaaaacatccatggcaatgccctcaggacctcaggctctagctccagcgatgtcaccaaggcttccctgagtcccgacgcttcagatttcgagcacatcacagccgaaacaccttccagaccactgagctcgacgagcaaccccttcaagtcttctaagtgctccacagcaggttcatcacctaactcggtgagcgagctgtccctggctagcctaacagagaaaatacagaaaatggaggagaaccaccacagtactgctgaggagttacaggcaacactgcaggaactgagcgaccagcaacaaatggtgcaggaacttaccgctgagaacgagaagcttgtcgacgagaaaacgatcttggaaacaagctttcaccagcatagggagcgcgctgaacagctttctcaggaaaacgagaagttgatgaacctgctccaggagagggtgaagaacgaagagccaacaacccaagaaggaaagattattgaactcgagcaaaagtgcacgggcattctggaacagggccgattcgaaagagagaagctcctaaatatccaacaacagctgacatgttccttgaggaaggtagaggaagagaaccagggggctttagagatgatcaaaagactgaaggaggaaaatgagaaactaaatgaatttcttgaactcgagagacacaataacaatatgatggctaagactctggaggagtgccgcgtcactctcgaaggccttaaaatggaaaacggatccctgaagagccatctgcaaggcgaaaaacagaaagcaaccgaggcttcggcggtggaacagactgccgaatcgtgtgaggtgcaggagatgttgaaggttgctcgggctgaaaaggatctgctggagctcagctgcaatgagcttaggcaagagctcctgaaagctaatggcgagatcaagcacgtttcctctctgctcgctaaggtcgagaaggattatagctatctcaaagaaatctgcgaccaccaggccgagcaattgagtagaacctcattgaagctgcaagagaaagccagcgagtccgatgccgaaatcaaagatatgaaggagactatatttgaattggaggaccaggtagaacagcatcgggcagtaaaattgcacaacaatcaactgataagcgagctcgagtcctctgtaatcaagctcgaagagcagaagagtgatcttgaaagacagctcaaaaccctgacaaaacagatgaaagaggagactgaagagtggcgccgatttcaggcggacctccagaccgcggtcgtcgtcgctaatgacataaaatgtgaggctcagcaggagctacgtacagtgaagagaaaattactcgaagaggaagaaaagaacgcccgtctccagaaggagctgggagacgtccagggccatggtcgggtggtgacatcccgagctgctccacctagcctgggtagtgtgtcatag

SEQ ID NO: 242131 - DNA, 2964 bp, Artificial Sequence
  Description of Artificial Sequence: Synthetic coding sequence
atgggaaatcattccgggaggcctgaggatcccgagccgggtgcattcactaccaccaagaggactggtattccagccccacgggaattttccgtaactgtttcccgcgaacgttcagtgcctcgaggcccaagcaatccaaggaagtccgtcagctcccctacaagcagtaatacaccaaccccaacgaaacatctcaggacgccatccaccaagcctaagcaggagaacgagggcggagagaaggctgccctcgaaagtcaagtgcgagagctgttagcagaagccaaggccaaagatagcgagatcaacaggctgagatctgagctgaaaaaatacaaggagaagagaactctgaatgcagaaggcacagacgctctcggtcctaatgtcgatggcacttcagtgtcccctggagatacggaaccaatgatccgagcactggaagaaaaaaataagaacttccagaaagaactctccgatttggaagaagaaaatcgtgtgctcaaagaaaagctcatctacctggaacattcacccaattcagaaggcgctgctagccacactggagacagcagctgccccacatctattacccaggaatctagcttcggttctcccacagggaaccaaatgtcttccgacatagacgagtacaaaaaaaacattcacggaaacgcactgaggacgagtggcagtagttcaagcgatgtcaccaaagctagcctgtcacctgacgccagcgatttcgagcacattactgctgagaccccatccaggcccttgagctccacatccaacccgttcaaaagctccaagtgtagcacggcaggctccagccccaatagcgtttccgagctgtcgctcgcctcactcacagagaagattcagaagatggaggagaatcatcattcaacagccgaagagctgcaggccaccctgcaagagctgtctgaccagcagcagatggtacaggaactcaccgccgagaacgaaaagttggtggacgaaaaaacaatcctggaaacttcatttcaccagcaccgcgaaagggcggaacagctgtcccaagagaacgagaagttgatgaacctcctgcaagaaagggtgaaaaacgaagaaccgactacccaggaagggaaaatcattgaactggagcagaagtgtactggcattctggaacaagggagatttgaacgggagaagctactgaacatccaacagcaattgacctgcagtttgcgcaaggtggaagaagagaatcagggagccctcgagatgatcaagaggcttaaagaggagaatgagaagttaaatgagtttctggagcttgaacgacacaataacaatatgatggcaaaaactcttgaggagtgcagggtgacactcgaaggcctgaagatggagaatggcagtttgaagagccacttacaaggcgagaaacagaaggcgacagaggcgagcgcagtggaacagactgccgaatcttgtgaggtccaggaaatgcttaaagttgctcgggcagaaaaggatttactggagctctcttgcaacgagctgaggcaggaacttctgaaagctaacggagaaattaagcatgtctcaagcctcctcgcaaaggtggagaaggattacagttatctgaaagaaatttgcgatcaccaagcagaacagctgtcaagaacgtcactgaaattgcaggaaaaggcctccgagagtgatgccgagattaaagatatgaaggagacaattttcgaactggaagaccaggtagagcagcacagggccgtaaagctgcacaataatcaactgatctctgaactggaatcctcagtgattaagctcgaagagcagaaaagcgacttggagagacagttaaagacactcactaaacagatgaaagaagaaacggaagaatggagacgcttccaggctgacttacagacggccgttgtcgtggctaacgacattaagtgtgaggctcaacaggaacttcgtacggtgaagaggaagctactggaagaggaggaaaagaatgcgagactgcagaaagagctgggagacgttcaaggccacggtcgggtcgtaacctcccgtgctgccccacctcccgtggacgaggagccagaatcaagcgaggtagatgcagctggtcgttggccgggagtttgtgtcagcaggactagccccaccccacccgagagcgcgacaactgtgaagtccttaataaaaagcttcgacctggggaggccaggcggagcaggacagaatataagcgttcacaaaacaccacgctcccctctgtctgggattccagtgaggacagctccagcagccgcagtgtcccctatgcaacggcacagcacctattcgagtgtacggcctgcatcccgcggagtaacacaacgccttgacttgcccgatttgcccttatctgacattctgaaggggaggacagaaactcttaagcccgatccgcatctgaggaaatcaccttctttggagtctctctccagacctccaagcttgggattcggggatactaggctgctaagcgctagcacccgggcttggaaaccgcagtctaaacttagcgttgaaaggaaagaccctttggcagcacttgcacgagaatatggtgggagcaaaagaaatgctttactgaaatggtgtcagaaaaagactcagggttatgccaacatcgatattactaattttagttcaagctggtccgacgggcttgccttctgcgctctcttgcacacatatctaccggcacatatcccctaccaggagctgaactcccaggaaaaaaaacggaacctcttattggcttttgaggctgctgaaagcgtcggaataaagccatccttagagctgagcgagatgctgtataccgatagacccgattggcagagtgtgatgcaatacgtggctcagatctacaaatatttcgaaacatag

SEQ ID NO: 242132 - DNA, 2373 bp, Artificial Sequence
  Description of Artificial Sequence: Synthetic coding sequence
atgcggtccgcggcaaagccttggaaccctgctattagagctgggggtcacggcccagacagggtcagacctctccccgcagcctcttcgggcatgaagtcgagcaagtcctccacaagtttagcattcgagtctcggctttcccgcctcaaacgggcaagctccgaggacacgctgaacaaaccgggatctaccgccgcaagtggagtcgtgcggctcaagaagacagccactgccggagcgatctccgaactgacagagagccggctgaggtcgggaactggcgctttcactaccaccaagaggactggcattcccgctcccagggagttctcagtcaccgtgtccagggaaaggagtgtgcccagggggccttccaaccctagaaaatccgttagtagcccaacctcatccaacacacccacccccacaaagcatctgcgtacccctagtactaagccaaagcaggagaatgaaggaggggagaaggcggctctggaatctcaggtgcgcgagttgttggccgaggctaaagctaaagattccgagatcaatcgcctgcggtccgagctgaagaagtataaggaaaagcgtactttaaatgctgagggaacggacgctctgggacctaacgtggatggcacctctgtgtcaccaggtgatacagagccaatgatacgggctctggaggagaaaaataaaaactttcagaaagagttaagcgatctcgaggaggaaaatcgagtcctcaaagaaaaacttatctacttagagcacagcccaaatagtgaaggagcggctagtcacaccggtgattcatcctgtcctacttcaattacccaggaaagctcattcggttcccctacagggaatcaaatgagttccgatattgatgaatataagaaaaatattcacggtaacgcactccgtacatctggatcttcttcctcggacgtgacaaaggcatctttatcccctgatgctagtgactttgagcatattactgcagagaccccatcacggcctctcagttctacctccaaccctttcaaaagtagtaagtgcagcaccgcagggtcaagccctaactctgtcagcgagctgtcactggctagtctgaccgagaaaatccaaaagatggaggaaaatcatcactccacagcagaagaactccaggccactctgcaagagttgtccgatcagcagcagatggtgcaggaattgactgctgagaatgaaaaactcgtcgacgaaaaaacaatccttgaaactagtttccatcagcacagagaacgggctgaacagctttctcaggagaacgagaaactcatgaatcttctgcaagaaagggtgaaaaacgaggagccaactactcaggagggcaaaattattgagctcgaacagaagtgtacaggaattcttgaacaaggaaggtttgagcgcgagaaactgttgaatattcagcagcagctgacctgcagcctgaggaaggtcgaggaagagaatcagggagccctcgaaatgattaagaggctgaaagaggagaatgaaaaactcaacgagtttctggagctcgagaggcacaataacaacatgatggccaagaccctggaggaatgccgggtgacacttgaggggctaaaaatggaaaatggttctctgaagtcacatttgcagggagagaaacaaaaagccacagaggctagtgccgtggaacaaaccgccgagtcttgcgaggtgcaagagatgcttaaagtggcacgcgctgagaaggacctgctggagctcagttgtaacgaactccgccaagagctcctgaaggccaatggtgagattaaacatgtgtctagtctccttgcgaaggtggagaaagattatagctatttaaaggagatctgcgaccatcaggccgagcagttgtctcgcacatccctgaagttgcaagaaaaggctagtgagagtgatgccgaaattaaggatatgaaggagaccatcttcgaactggaagatcaagtcgagcaacacagagcagttaagctgcataacaaccaacttatctcggaacttgaatctagtgtgatcaaattggaggaacaaaagagcgatttggagcgtcagttgaaaaccttgaccaaacagatgaaggaggaaactgaagagtggagaagatttcaggccgatctccaaacagctgtggtggtggcgaacgacataaagtgcgaggctcagcaggaactgcgaaccgtgaaacgaaaactgctggaggaggaggaaaaaaacgcccgtctccagaaagagcttggagatgtgcagggacacggcagagttgtgacctccagagcggcaccaccttcgctgggtagcgtgagctag

SEQ ID NO: 242133 - DNA, 3090 bp, Artificial Sequence
  Description of Artificial Sequence: Synthetic coding sequence
atgagaagtgccgctaaaccctggaacccagcaatacgggcagggggacacggccctgatagggtgcggccactaccagccgcatcatctggtatgaaaagttccaagagtagtacatccttggcctttgaatccaggctctctcgcctcaaaagggctagttcggaagatacactcaacaaaccaggtagcaccgctgcctccggtgttgtcaggctcaaaaaaacagctacggccggagcgatttccgagcttacagagtcccggctgcgatctgggacgggggctttcaccacaacaaaaaggactggtataccagcccctcgcgaattttctgttactgtaagccgagaacgcagcgtacctagggggccatcgaaccctcggaaatccgtcagctctccaacctcctctaatacacccacacccaccaagcacctgagaacaccaagtaccaagcctaagcaggaaaacgagggcggagaaaaagccgcactggaatctcaggtgagagagttgttagctgaagccaaggccaaagatagtgaaatcaataggcttcgtagcgagttaaaaaagtacaaggaaaagcgcaccctgaatgctgaagggaccgacgccctggggcctaatgttgatggaaccagcgttagcccaggagatactgaacccatgatcagggccctcgaggaaaagaacaagaattttcagaaggagttgtcggacctcgaggaggagaatcgggtgctcaaggaaaagctcatttacctcgagcacagcccaaatagcgagggagccgcatcccataccggggactcctcttgcccgacaagcattacccaagagagcagcttcggctctcctacaggtaaccagatgagctccgatattgacgaatacaagaagaatattcatggcaatgctctgagaactagtggctccagctcgtccgatgtaactaaagcttcactgagcccggacgcctcagacttcgagcatatcactgctgaaacgccatctaggcctctgagctcaacgtcaaaccccttcaaatcaagcaagtgttccactgccggatcctctcccaatagcgtgagcgaactctcgttggcgtccctgacagagaagattcaaaagatggaggaaaaccatcacagcacagcagaagaattgcaggcaacacttcaggaattaagcgaccaacaacagatggtgcaggagctcactgcggagaacgagaagctggtcgacgagaagactattctggaaacttctttccaccagcaccgagagcgggcagagcagctgagccaggaaaatgagaaactcatgaacttactgcaggaaagggtgaagaatgaggaacccaccactcaagagggcaaaattatagaactggagcagaaatgcaccggtatactggagcagggccgtttcgagcgggagaaactgctcaacattcagcagcaactcacttgctctctcagaaaggtcgaagaggaaaatcagggagctctcgagatgatcaaaaggctaaaggaggaaaacgaaaagctgaatgaatttctcgagcttgagcggcacaataataatatgatggcgaagactctggaggagtgtagagtcacattagaggggttgaaaatggaaaacggctctctcaagtctcacctccaaggcgagaaacagaaggctacggaggccagcgccgtggagcagaccgcagagtcgtgtgaggtccaagaaatgctgaaagtggctcgggctgaaaaggacttgctcgaactgtcctgtaacgagcttaggcaagagcttctcaaagctaatggagagataaaacacgtatcaagcctgcttgcaaaggtggagaaggattatagctatcttaaggaaatctgcgatcatcaggccgaacagctttcccgtacctctctgaagttgcaggagaaggcctcggagagcgacgcggaaatcaaagacatgaaagaaacaatctttgaactagaggatcaggtcgagcagcatagggctgtgaagctccataataatcaattgatatctgaattggaatcttctgtcattaagttggaggagcagaaatcagacttagaaaggcaactgaagacgctgacaaagcagatgaaggaggaaaccgaagagtggcggcgatttcaagccgatttgcagactgcagtggtggtcgcgaacgacattaaatgcgaagcccagcaagagttacgaactgtgaaacgaaagctgctggaagaagaagagaagaatgccagacttcagaaggaactcggcgacgtacaagggcatggaagagtcgtcactagccgagccgctcctcctcctgtcgacgaggaacctgagtcaagtgaggtggatgccgcaggaagatggcctggtgtgtgtgtgtcccggacctcaccgactccccctgagtccgctaccactgtgaaatcgttgatcaaaagttttgaccttgggcgacccggaggggctggacagaatatttcagtgcacaagacccctcgatctccgctgtccggtattcctgtgcggaccgcacccgctgctgctgtgtcccccatgcagagacattccacctattcttccgtgcggccagcctccaggggtgtaactcaaagactggacttgcccgatctgcctctgtctgacattctcaaggggagaacagaaacccttaaacctgatccacaccttcgcaagagtccatcattagagagccttagccggccaccatctctgggtttcggggatacaaggcttctgagcgcctcgaccagggcctggaagccacagagcaagctctcagttgaacggaaggaccctcttgctgccttagcccgagaatatggtggtagtaagagaaacgccttgctcaagtggtgccagaagaagactcagggatacgctaagaggaaccttcttttggcattcgaggctgcggagtctgtcgggatcaagccatcccttgagctgtccgaaatgctatacacagatcggccagactggcaaagtgtgatgcagtacgtggcccagatatacaagtattttgaaacatag

SEQ ID NO: 242134 - DNA, 237 bp, Artificial Sequence
  Description of Artificial Sequence: Synthetic coding sequence
atgcggagcgcagccaagccttggaaccccgctataagggccggtggccacggtcctgaccgggtcagacccctcccagccgcttcctctggtatgaagtcttcaaagtcaagtactagccttgcttttgagagccgcctgtcaaggctgaagcgggcttcatcagaggacactcttaacaagcctggaagtaccgccgcttctggcgtcgtaaggctgaagaaaacagcaacatag

SEQ ID NO: 242135 - DNA, 1227 bp, Artificial Sequence
  Description of Artificial Sequence: Synthetic coding sequence
atgaaggagacgatcttcgaactggaggaccaggttgagcaacacagagctgtcaagctgcataataaccagctcatcagcgagctggagagttccgttataaagctcgaggaacagaaatccgatctggaacgccagctgaagaccttaacaaaacagatgaaagaagagaccgaggaatggagacggtttcaagccgacctgcagacggccgtcgtagtcgcaaatgacattaagtgcgaggcacagcaggagctgcggacagttaagagaaagctgctggaggaggaggagaaaaacgccaggctacaaaaggagcttggagatgtgcagggacatgggagggtagtgaccagccgcgctgctcctcctcccgtagacgaagagcccgaaagctccgaagtggatgcggctggtcggtggcctggagtttgtgtgtcccgcactagtcccaccccacccgagagtgctaccaccgtgaagtctctgatcaaaagcttcgatctgggccgacccggaggtgccggtcagaacatttccgtgcacaagactccacgcagtcccctgtcaggcattccggtgcggaccgctccagcagccgctgtctcccccatgcagaggcacagcacatacagctccgtccggcctgcttctcgaggagtgactcagcggcttgatctcccagacctccccttgtccgacattctgaagggacgcacagaaacgctgaaacccgacccccatttgcggaagagcccgtctttggagagtttatccaggccccctagtctggggttcggcgatacaagactgctatctgcctctacccgagcatggaaacctcagtcgaagctttccgtggaacggaaggaccccctagccgctctggctagagagtatggaggatccaagcgcaatgccttattaaaatggtgccaaaagaagacccaggggtacgccaatattgatatcactaacttctcgagttcttggtctgatgggctggccttttgtgctcttctgcatacctatctgcccgcacacatcccctatcaggagctgaattcccaggaaaagaagcggaacctccttcttgcttttgaggccgctgagtcagtagggattaagccatcattagaactctctgagatgctttatacagaccggcctgactggcagagtgtcatgcagtacgtggcacaaatttataaatactttgagacctag

SEQ ID NO: 242136 - DNA, 3354 bp, Artificial Sequence
  Description of Artificial Sequence: Synthetic coding sequence
atgaaaaaggcgtcccgaagtgtaggttccgtccccaaggtctccgccataagtaaaacgcagaccgccgaaaagataaagccagaaaactcatctagcgcgtctactggtgggaagcttgtgaaacccggaactgctgccagcctttccaagacgaaatcttctgacgatctgctggcgggtatggcgggtggcgtgaccgtcaccaacggggtgaaagggaagaagagtacctgcccaagcgccgcaccttcagcgagcgccccagctatgacaacggtggagaataagtctaaaatatcaaccggcaccgcctcgtcaaccaagcgctccacatccacagggaacaaagagtctagctcaactcgcgaacggctaagggaaaggacccgcttaaatcagagcaaaaagctcccatccgcagggcagggggctaatgatatggcccttgcaaagaggagcagatctcgcacggctacggagtgcgatgttcggatgagcaagtctaaaagtgacaatcagatcagcgaccgcgctgcactcgaggctaaggtgaaggacctattaactctcgcaaagactaaagacgtggagatccttcatctaaggaacgagctgcgggacatgagggcgcagctgggaatcaatgaggaccatagcgaaggcgatgagaaaagcgagaaggagaccatcatggcacatcagcctacggatgtggagagtaccttactccagctgcaggagcagaacaccgcgattagagaggagttaaaccagctgaaaaatgagaacaggatgctgaaagacagactgaatgccctgggattctcactggagcaaaggttggacaatagcgaaaagttgttcgggtatcagtcactttcccccgagataacacctgataatcaatccgatggcggaggtacacttaccagctctgtggaaggttcggccccaggatctgtggaagatctactgagccaggatgagaacactcttatggaccatcagcatagtaatagcatggacaacctagactcggagtgcagtgaggtttaccagccccttacatctagtgatgatgcccttgatgcgccttcaagttcagagtctgaaggaatccctagcatcgagaggtccagaaaaggctcgtccggtaacgcctctgaggtgagtgtcgcctgtctgactgaaaggattcatcagatggaagaaaatcaacattctacatcggaagagttgcaggccacattgcaggagcttgcagacttacagcagattacccaggagttgaatagtgaaaacgaacgcctgggcgaagagaaggtgattctgatggaatcactttgccagcagtccgataaattggaacactttagtcggcagattgagtatttcagaagcctgctcgacgaacatcacatttcttatgtgattgacgaggacgtgaagtctggacgctatatggagctggaacagcgctacatggatcttgccgagaatgctaggttcgagagggagcaattactgggtgttcaacagcacctcagtaataccttgaaaatggcagagcaggacaacaaggaagcacaggagatgatcggggcactgaaggagcggtcacaccatatggagcgcattattgagagtgagcaaaaggggaaggcagctctcgcagccaccttggaggaatataaagctaccgtggcttcagaccagatagagatgaacagactcaaggctcagcttgaaaacgaaaaacaaaaggtcgctgaactgtactctatccacaattctggcgataagagtgacatacaagacttgctggagtcagtccggctcgataaagaaaaagccgaaacactggcatctagcctgcaggaggacttagcacacacccgcaacgacgccaacaggctacaagatgctatcgccaaagtggaagacgaatacagggcatttcaagaggaagctaaaaaacaaatcgaagatcttaatatgacactcgagaagttacggtcagaccttgacgagaaggagacggaaaggtcagatatgaaggaaaccatcttcgaactcgaagacgaggtggagcagcaccgggcagtgaaactccatgacaacctgattatatcggacctggaaaacacagtcaagaagctgcaggaccagaagcacgatatggagcgggagataaagactctgcataggcgcctgagggaagagtccgccgagtggcgtcagttccaggccgacctgcagaccgctgtggtgattgccaacgatattaagagcgaggcacaagaggaaatcggcgacctcaaacggcgattgcacgaggcccaggagaagaacgaaaaactcaccaaagaattggaagagatcaagtcaaggaaacaagaggaagaaagagggagggtgtataattatatgaatgcagtagagcgagatttagcagctttacgacaggggatggggttgtctcgcagatcttcgaccagcagcgagcccacaccaaccgtgaaaactctcattaaatcatttgattcagcgtctcaggtgccaaacccagccgcagctgcgatccctcggaccccactgtccccgagtcccatgaagactccaccagctgccgctgtcagtcctatgcagagacattcaataagtggcccaattagcacttcaaagcccctgacggcactcagcgacaagcggcctaattacggcgagattcctgtccaggagcaccttctacgtacaagctcagcgtcacgacctgcatcccttcctcgagtaccagcgatggagagcgcgaaaacacttagcgtcagtaggcgttcctctgaggaagtaaaaagggacatctctgcccaagagggggcttcgcccgcttcccttatggccatgggcactacctcaccacaattaagtttatcttcttcccctacagcttccgtaacgccgactacccggtctagaatccgagaggagagaaaggatccgttgtctgcgctagctagagaatacggcggttcgaaacgcaatgctctcttgaaatggtgccagaagaagactgagggctaccagaatatcgatatcacaaatttttcatcttcgtggaatgatgggctggcgttctgtgctctcctccatacatatctgcccgcacacattccttatcaggaactaaattcacaggacaagaggaggaattttatgttagcatttcaagccgcagaatccgtgggaattaagagcactctggatattaatgaaatggtgcgcaccgagcgccctgactggcaaaatgtcatgctgtacgtaactgctatctataaatacttcgagacttag

SEQ ID NO: 242137 - DNA, 2820 bp, Artificial Sequence
  Description of Artificial Sequence: Synthetic coding sequence
gtccccgaagccgtgcgatggggctatttcatacctgaacagtctcagttcgcctgtaagtgcatcacaaagcgccagccccgaatgaaaaaagcgtcccgtagtgtggggtctgtcccaaaggttagcgccatttccaaaacccaaaccgctgaaaaaatcaaacctgagaattccagctcagcaagcaccggagggaaattagttaagcctggtaccgccgctagcctgagcaaaaccaaatcttctgacgacctccttgctggcatggccggaggggtgacggttactaacggtgtcaaagggaagaagtctacctgcccgtcggccgctccatcagcttctgcacctgccatgaccaccgtcgaaaataagtcaaagatcagcactgggacagctagttcaaccaagcgtagcaccagcaccggaaacaaggagagttcatcaacacgggagcgtctccgagaaaggacacgcctgaaccaaagcaaaaagctgcctagcgctggtcagggcgcaaacgacatggcactagccaagagatcgcggtcgcgaacagcaacagagtgtgacgtgcgaatgagtaaaagcaagtccgacaaccaaatctctgacagggccgctctcgaagctaaggtgaaagacctgctcactttggcgaaaacaaaggacgtcgaaatccttcacctgagaaatgagcttcgcgatatgagagcacagctgggtataaatgaggatcatagtgagggcgacgaaaaaagcgagaaggagaccatcatggcacaccagcctaccgacgtcgagtccacattgctgcagctccaggaacagaacactgccatccgagaagagctcaaccaactgaagaatgagaacaggatgcttaaagaccgccttaatgcgctggggttctcattggagcagaggctggacaacagcgaaaagctgttcggttatcagtcgctgtcacccgaaatcactcctgataatcagagtgacggcggaggaacgctgaccagctccgtagagggaagtgccccaggttctgtggaggatctgctgagccaggacgagaacacactgatggatcatcagcatagcaactcgatggacaatctggattccgagtgttccgaggtttaccaaccattgacctcttccgatgatgcactggatgcccctagctcctctgagtccgaagggattccctccatagaaagatctcggaagggcagcagcggcaacgcttcagaagtaagcgtcgcctgcctgacagagcgaatccatcagatggaggaaaatcagcacagcacatccgaagaactacaggcgaccttgcaagagctagccgacctgcagcaaattactcaggagcttaattccgaaaatgagcggctgggagaggaaaaggtcatcctgatggaaagtctgtgccagcagtccgacaagctggagcacttcagtcggcagatcgaatacttccgaagccttctggacgaacatcatatatcttacgtgattgatgaagacgttaagtcaggacgctacatggagttggaacaaagatatatggaccttgccgagaatgctcgctttgagcgcgagcagctcttgggggttcagcagcatctcagtaatactctgaagatggcagaacaggacaataaggaggctcaagaaatgatcggcgctctcaaggaacgcagccatcatatggaaagaattatcgagagtgagcagaagggtaaagctgccctggccgcaacactggaggaatacaaagcgactgtggcctccgaccagatcgagatgaatcgcctgaaggctcaacttgagaacgaaaagcagaaggtcgccgagctgtacagtattcacaattcaggggataaaagtgatattcaagatctcctggaaagcgtcagactcgataaggaaaaggccgagactttagcttctagtctgcaggaggacctggctcacaccagaaatgatgcaaacagactccaggacgccatcgctaaagtggaagatgaataccgcgctttccaagaagaggccaaaaaacaaatcgaggatctgaacatgacactcgagaagctcaggtcagacttggacgaaaaggaaactgagagaagcgacatgaaagaaacaatcttcgagttagaagatgaggtagagcagcacagagctgtaaagctacatgataacctcattatttccgacctggagaacactgtgaaaaagttgcaggaccagaaacacgacatggaacgcgaaattaagactctacacaggagactgagggaggagtccgctgagtggagacagttccaggcagacctgcaaaccgccgtggtgattgccaacgacatcaagtccgaagcacaggaagaaattggggacctcaagcgccgactgcatgaggctcaggaaaaaaacgagaaactaaccaaggagttggaagagattaaaagtaggaaacaggaagaggagcgtggccgtgtctacaattacatgaacgctgttgaacgggaccttgctgccctgagacagggcatgggactgtcacggaggtcttcaaccagttccgagcctacacctacggtgaaaaccttgatcaagagtttcgatagtgctagccaggtaccaaatccagccgctgccgctatcccccgtactcctttgagtccatccccaatgaaaactccacctgcggcagccgtctccccaatgcagatggagtcatcctccgtggcccacgctggtatgcaatggagagatctcggatccctgcagcctcttccaccaggtttcaaatag

SEQ ID NO: 242138 - DNA, 2370 bp, Artificial Sequence
  Description of Artificial Sequence: Synthetic coding sequence
atgaaaaaggcaagtcgatctgtgggaagcgtccctaaagtttctgctatttccaaaacacagacagcagaaaagatcaagcctgagaattcttcatcagcttccacaggcggaaagttggtcaaacccggtacagccgctagcctgtccaaaacgaaaagtagtgacgatctccttgctggcatggctggcggtgtgacagtaacaaacggggttaagggtaaaaaaagcacttgtccgtctgcagccccttccgcctcagccccagccatgactacggtggagaataagagcaagatctccacagggacagcgagttcaaccaagaggagcacctcaaccggaaacaaagagagtagctctacccgcgaacgtctccgcgaacgaacacgcttaaatcagtctaaaaagctacctagtgctgggcagggggctaatgacatggctctggccaagcgcagtcggagccgtacagccactgaatgtgatgtgagaatgagcaagagcaagagcgacaaccagattagcgatagagctgcacttgaagccaaagtgaaggacctcctaacccttgccaagactaaggacgtagagatactgcacctgagaaacgagttgagagatatgcgtgcccagctgggcattaacgaagatcactccgagggggatgagaagagcgagaaggaaaccataatggcacaccaaccaaccgatgttgagagtaccttactgcaattgcaagagcagaacacagccattagagaagagctcaaccaactcaaaaatgagaataggatgttaaaggatcggttgaatgccttgggcttcagtctggaacagcgcctcgataattccgagaagctttttggctaccagtcgcttagcccagaaattacccctgacaatcagtccgatgggggaggcacactgacatcctcagtggaaggcagtgccccagggagcgttgaagatcttctatcccaagatgagaacaccctcatggaccaccaacactcaaactccatggataaccttgactccgagtgttccgaggtttatcagcctttgaccagcagcgatgatgcgctcgacgctccatcctcctctgaatcggaggggattcccagtattgagaggtctcgtaaaggatctagcggtaacgcctctgaggtctccgtcgcctgcctaactgagcgcattcaccaaatggaagagaaccagcattctacttctgaggagctgcaagccacactgcaggagctggcagaccttcagcagatcacccaagagttgaatagcgagaatgagagactgggggaggaaaaagtgatcctcatggagtccctctgccagcagtcagacaagctcgagcatttctccagacagatcgagtattttcggtctctgctggatgagcaccacatctcttatgtgatcgacgaagatgttaagagcggcaggtatatggaactggagcaacggtacatggacttggcagaaaatgctcgattcgaacgagaacagctactgggggtgcagcaacacctcagtaacacattgaaaatggcggaacaggataacaaagaggcgcaggaaatgatcggggcactcaaggaacgaagtcatcacatggagagaatcatagagtctgaacaaaaaggtaaagctgctctcgctgcaaccctggaagagtacaaagcaacggtggcatccgaccagattgagatgaacaggctgaaggcgcaactggaaaatgaaaagcagaaggtggctgagctgtactctatacataactctggcgacaaatccgatatccaggatctgttagagagtgtcagacttgacaaggaaaaggcggagacattagcatcctccctgcaagaagacttagcacatactcggaatgatgcaaatcgcctgcaggatgctattgctaaagtggaagacgaatatcgggcttttcaagaggaagcaaaaaaacagatcgaagaccttaacatgacgctggaaaagctgcggtcggatctcgatgaaaaagaaaccgaacggtctgacatgaaggaaacaattttcgagctggaagatgaggtcgaacagcaccgagcagtgaaactgcatgataatttgatcatttctgacctcgaaaatacagtgaaaaagttgcaggatcaaaagcacgacatggaaagggaaatcaaaacacttcaccgcagacttcgggaggagtcagccgagtggaggcagttccaggccgatctgcagactgcagtcgtgattgcaaacgacatcaagtccgaggcccaggaggaaattggggacctgaaaaggcgcctgcacgaagcacaagagaaaaacgagaagcttacctag

SEQ ID NO: 242139 - DNA, 3354 bp, Artificial Sequence
  Description of Artificial Sequence: Synthetic coding sequence
atgaaaaaagccagccggagcgtcggtagcgtgccaaaggtgtccgcaatttccaaaactcagacagcagagaaaatcaaacccgaaaactcaagttccgcttcgacaggtgggaaactagtgaagccaggcactgctgcatccctgtccaagactaaatcttctgatgacctgcttgctgggatggctgggggagttactgttaccaacggcgtgaagggtaaaaaatcgacatgtccctccgccgctccctctgcgtctgcacccgcaatgacaacagtcgaaaacaagtctaaaattagcaccggcaccgcttcatccacgaagagatctaccagcactggcaacaaggagtcatcatccacacgcgaaagactgagggaacgcacccggttgaatcaaagtaagaaactgccatccgccggacagggcgcaaacgacatggccctcgcaaagcgcagtcggtctcgtacagcaacggagtgcgacgttcggatgtcaaagagcaaatccgataaccagatttctgacagggcggcattagaggcaaaggtaaaagatctgcttacactcgctaaaacgaaagacgtggagatcttgcacctgaggaacgagttaagggatatgcgggcacagctagggatcaacgaagatcactcggaaggagatgagaaatccgaaaaggaaactataatggctcatcagcccacggatgtggagagtacactcctgcagctccaggagcagaatacggcaatccgggaggaattgaatcagctgaagaacgaaaacaggatgctgaaggaccgactgaacgcattaggcttttctctcgagcagcgattagacaatagcgagaaactcttcggctaccagtctttgagccctgagatcacccccgacaatcaaagcgatggaggcggaaccctgacctccagtgtggaaggcagcgcacctgggtccgttgaagaccttctctcccaggacgaaaacaccttaatggaccatcagcactccaattctatggataacttggactctgaatgctctgaggtgtaccagcctctaacctcctccgacgatgctttggatgccccaagctcaagtgagagtgagggtatcccttccatcgaacggagtcgaaagggctctagcggcaatgctagtgaggtttcagtagcatgccttacagagcgaatccaccaaatggaagagaatcagcactccacgagcgaggagctgcaggcaaccctgcaggagctcgccgaccttcagcagatcacacaggaactgaattccgaaaacgaacgcctgggtgaggaaaaggtgattctgatggaaagcctgtgccagcaatcagacaaactggaacatttcagtcggcaaattgagtacttcaggtcactactagatgaacaccacatatcttatgtgatagatgaggacgtgaagtctggcagatatatggagctcgagcagaggtatatggacctcgctgaaaacgccaggttcgagagggagcaacttctgggcgtgcagcaacacctgtcgaacacacttaagatggctgagcaggataacaaagaagcccaagaaatgatcggcgctctgaaagaacgttcacatcatatggaaagaataatcgaatccgagcagaaggggaaggccgctttggcggctactcttgaggaatataaggcgaccgtggcctctgaccagattgaaatgaatcgcctcaaggcgcagttggagaatgagaaacagaaagtggccgagctgtactcaattcataatagcggggataagtctgatattcaggaccttctggagtcggtccggctcgacaaagagaaagcagaaactctcgcgagcagcttgcaggaagatcttgcgcatacccggaatgatgcaaaccgattgcaagacgcaattgccaaggttgaagacgagtatcgcgctttccaagaagaggccaagaagcagatcgaagacctcaatatgacacttgagaaactgcgaagcgacctagacgaaaaggagacagagagaagcgacatgaaagaaacgattttcgagcttgaggatgaggtagagcagcacagagcagtgaagctccatgacaacctgatcataagtgacctggagaacacggtcaagaagctgcaggaccaaaaacatgacatggaacgggagataaagaccctccaccgacggctgagagaagagtccgctgaatggaggcaatttcaagctgacctgcaaacggcagtcgtgatcgccaatgacatcaagtctgaagctcaggaagaaatcggggatctcaagaggcgcctccatgaagcacaggagaaaaacgaaaaactgactaaggaactggaagagattaaatcacgtaagcaggaggaggaacggggacgggtctataattacatgaatgcagtcgaacgcgacctcgccgcactgcgtcagggaatgggactttctagaaggagcagtacgagctcggagcccacccctaccgtaaagaccctcattaagtccttcgattcagccagccaggtccccaacccggcagcagctgccatccctaggacaccactgtcaccttcccccatgaaaactccaccagcggcagccgtcagtcctatgcagcgacacagcatcagcggccctatatcaacttctaaaccgctgacggccctatcagacaagcgccctaactatggcgagatacccgtccaggagcaccttctcagaacatcatccgcttctagaccagcctccctgcccagagtcccggctatggaatctgctaaaactctctcagtgtcacgcagaagtagtgaggaggtgaaacgcgacatatctgcacaggaaggtgcttcacctgccagcctcatggcaatggggacaaccagtccccagttatcattgtcaagttcccctacagcgagcgtcacgccaaccacaaggtcccgtatcagagaggaacgaaaggatcctctgagtgctttggccagggagtatggcggttcaaagcgaaatgctctgttaaagtggtgtcaaaagaagactgaaggctatcagaatatagatatcacgaatttctcttctagttggaatgatggccttgccttttgcgctctcctccatacctatctgccggcacatattccttatcaagagctcaatagccaggataagcggaggaatttcatgctggcctttcaggcagctgagtccgtggggatcaaaagtaccttggacattaacgaaatggtccggacagaacggccagactggcaaaacgtaatgctttatgtaaccgctatatacaagtactttgaaacttag

SEQ ID NO: 242140 - DNA, 3237 bp, Artificial Sequence
  Description of Artificial Sequence: Synthetic coding sequence
atgaagaaggcatctcgatcagtggggtctgtaccaaaagtttccgcaattagcaaaacgcagaccgccgagaagataaagcccgagaactcctcctcggccagtaccggaggaaaactggtgaagccgggaactgcggcttccctgtcaaagacgaaatcctcggacgacctacttgccggaatggccggtggagtgaccgtgactaatggcgtgaagggaaaaaaaagcacttgcccgagcgccgcacccagcgccagcgcccctgcaatgaccaccgtcgagaacaagtcaaagattagtacggggaccgcctcatccaccaaacggagcaccagcacgggaaacaaggaatccagcagcactcgtgagcggctgcgcgaaagaacacgactaaatcagagcaagaagctgcccagtgccggtcagggggctaatgacatggctctggccaaaagatctagatcacggaccgctacggagtgtgacgtcaggatgtccaaaagtaaatccgacaaccagatctccgacagggccgctctggaggccaaggtcaaggatttgctaactctcgcaaaaactaaggatgttgaaatcttacatctcagaaacgaattaagggacatgagggcacaattgggaattaacgaggaccattccgagggggacgagaagagcgagaaagagacgatcatggcacaccagcccaccgacgttgagtcaacactactgcagctgcaggagcagaacactgcgatccgggaggaactgaatcagttgaagaacgagaataggatgctgaaggaccgcttgaatgcacttggcttttctttagagcagaggctggacaatagtgaaaagctattcggataccaatcactgtcgcccgagattactcctgacaaccagagtgatggcggtggaaccctgacatcctcagtggagggctcagcgccagggagtgtggaggacctactgagccaggatgagaatacgctcatggatcatcaacactcaaactcgatggacaatctcgactccgagtgcagcgaagtgtaccagccacttacctcctccgatgacgcactcgacgccccttcctctagcgaatctgagggaatacccagcatcgagcgtagccggaaaggttcatccgggaacgctagtgaagtgtcagtggcatgcctgaccgagaggattcaccagatggaggaaaatcagcactcaacctctgaggagttgcaagctaccttgcaggagttggccgacctgcagcagatcactcaggagctgaactccgaaaacgaaagactgggcgaggaaaaggtgattttaatggagtctttgtgtcagcagagcgacaagttggaacacttcagtagacaaatcgagtactttcggagtcttctcgacgagcaccatatctcttatgtaattgatgaagacgtgaagtcaggaagatacatggagctggaacaaagatatatggatcttgccgagaatgcaagatttgagcgggaacaactactcggcgtgcagcaacatctctcaaacaccttgaagatggctgaacaggataacaaggaagcacaggaaatgatcggggctctcaaggagcgtagccaccacatggagcgcattatcgagagtgagcaaaaggggaaagctgctctggctgctacccttgaggaatacaaggccaccgtggcttcagaccagatcgaaatgaatcgtctgaaggcacagctggaaaatgagaaacaaaaggtggccgagctctattctatccataactcgggagataagagcgatatccaagacctcctggagtctgtcaggttggataaggagaaggctgagacattggcatcttctttacaggaagacctggcccacaccagaaatgatgctaaccggttacaggacgcgatcgcgaaggtcgaagacgaatacagggcttttcaggaggaagccaaaaagcagattgaggacctaaatatgacgctggaaaaactcagaagtgatttggatgaaaaagagaccgaacggtccgatatgaaggaaaccatcttcgagcttgaggatgaggtggagcagcaccgcgctgtaaaattacacgacaacctgataatctccgacttggaaaacactgttaaaaagttgcaagaccagaagcacgacatggaacgggagatcaagactttgcaccggaggcttagagaggagagtgccgaatggcggcagttccaggccgatctgcagaccgccgttgtaatcgcaaacgatattaagtcggaagcacaagaggagatcggagatctgaagcgtaggctccatgaagcccaggaaaagaacgaaaaactcactaaagaactggaagaaattaagagcaggaaacaggaggaggaacgaggcagggtctataactacatgaacgcagtggaaagagatctggcggcactgcggcaagggatgggcctgtctagaagatcatcaacaagctctgagccaacccccacagtgaaaactttaatcaagtctttcgattccgcgtcccaggtgccaaatccagcggctgccgcaatcccaagaaccccattatcaccttcccctatgaagacgcctcctgctgctgcagtcagcccaatgcagcggcattccatttccgggcctatcagcaccagtaagccacttactgccctgtcagataaacggccaaactacggtgagatccccgtccaggagcaccttctccgcacaagtagcgcgtcgaggcccgcaagcctcccacgggtgcctgcaatggaatccgcaaaaaccctttctgtttcaagaagaagctcagaggaggtcaaacgcgacattagcgcccaagagggcgcatctccagcttcactgatggctatggggacaaccagccctcagctctcactgtcttcatctcccacagcttccgtgacaccgacaactcgtagccgcattcgcgaggaaaggaaggatcctctatctgctctcgccagggaatatggtgggagtaaacggaacgcacttttaaaatggtgtcaaaagaagacagagggataccaacgccgtaatttcatgctcgcatttcaggctgcggagtctgttggaattaaatcgaccctagacatcaatgagatggttaggacagagcggcctgactggcaaaacgtgatgctgtatgtcaccgcaatctacaaatatttcgaaacgtag

SEQ ID NO: 242141 - DNA, 2781 bp, Artificial Sequence
  Description of Artificial Sequence: Synthetic coding sequence
atgaccaccaaagactatccctctctttgggggtttggcacaactaagacattcaaaatccccatagaacacctggattttaaatacattgagaaatgctcagacgtcaaacacttggagaagatcctttgcgtcctaaggtccggcgaggagggttactacccggagttgaccgaattctgcgagaagcatcttcaggccttggcgcctgagtccagggccctgcgcaaggataagcccgcagccaccgccgcatcatttactgctgaagaatgggagaagatcgatggagacatcaaatcttgggtgtctgagattaagaaggaggaagacaaaatgcactttcacgaaactgagactttccctgccatgaaggataacttgccccctgttagaggatctaatagctgcctgcacgttggaaaggagaagtatagcaaacgaccaaccaagaagaaaaccccaagagattacgcggaatgggacaaatttgacgttgagaaggagtgcttaaaaatagatgaagattacaaggaaaagaccgtgatcgataaatcccatctctccaaaatcgaaacacgcattgacactgcgggtctcacagagaaagaaaaagactttctcgcaacgcgcgagaaagaaaaaggaaacgaagccttcaactcaggtgactacgaggaggccgtgatgtactacacacgtagcatctccgctctccctaccgttgtggcttacaataacagagcccaggctgagataaagctacaaaattggaattcggcattccaggattgcgagaaggtgttggaactggagcccggtaatgtgaaggccttgctgcgccgagctaccacatataagcaccaaaataagctgcgcgaggccacagaggacttatcaaaggtattggatgtagagcctgataacgatctagccaagaagaccttatctgaggttgagcgggacctgaaaaattccgaagccgctagcgagactcagacaaaggggaagcggatggttattcaggagattgagaactccgaagacgaagaggggaaaagcgggagaaaacacgaggacggcggtggagacaaaaaacctgctgaacctgcaggagcagccagagctgcgcagccttgcgtgatgggcaatattcagaaaaaacttacgggcaaggccgagggaggcaaaagacctgcaagaggcgctccacaacgaggacagaccccagaagccggagctgataagagatctcctagaagggcttccgccgcagccgcagccggagggggagctaccggccacccaggcggtgggcaaggcgcagaaaacccagcaggactgaaatctcagggcaacgagttgtttcgtagtgggcagttcgccgaagcggcagggaaatactctgcagccattgcccttctggagcctgctggatctgagatcgccgacgacttgtccatactgtactcaaatcgtgcggcttgttacctgaaagagggcaactgttctggctgcattcaggactgcaaccgggctctggagctgcacccattcagtatgaagcctctgctgaggcgtgccatggcatacgagacactggaacagtatggaaaggcttacgtcgactacaaaacagtgctgcagatagattgcggactgcagctggcaaatgattccgtcaaccgtctgtccaggatcctgatggaactggacggaccaaactggagagagaagctaagccccatccccgctgtcccagcaagcgtccctctccaggcctggcacccggcaaaggagatgataagcaagcaggcgggagactcttctagccacaggcaacagggtataacagacgagaaaacttttaaggcattaaaagaagagggtaaccagtgtgtgaatgataagaattacaaagacgctctaagcaagtacagtgaatgtttaaaaatcaataacaaagaatgtgcaatttataccaaccgtgcgctgtgttatctgaagctttgccagttcgaagaagctaagcaggattgcgaccaagccctgcagctggcagacggcaatgtgaaagctttctatcgacgggcactggcccacaaaggcctcaaaaactatcaaaagtcactgattgatttgaacaaagtaatcctgctggacccaagcatcattgaagcaaaaatggaattagaagaggttactaggcttcttaacctcaaggacaagacagctcccttcaacaaggagaaggagaggagaaaaattgagatccaggaggtgaatgaggggaaagaagaacctggccgtcctgcaggcgaagttagcatgggatgtctggcgagtgaaaaaggtggtaagagcagtcggtcaccggaagaccctgaaaagttgccgattgccaagcctaataacgcatatgaatttggacagataattaacgccctgtctaccaggaaggataaggaggcctgcgcacacctgctcgccatcaccgcaccaaaggaccttccaatgttcttgtcaaataagctggaaggagacacatttctgctgcttattcagtccctgaaaaacaacctgattgagaaggatccaagtctcgtttatcaacatctgttgtacctatctaaagcagagcgattcaagatgatgcttacacttatcagcaaaggtcagaaggagctgatcgagcagctcttcgaggacctgagcgatacacccaacaaccacttcactctagaggatatccaagccttaaagcggcagtatgagttgtag

SEQ ID NO: 242142 - DNA, 2781 bp, Artificial Sequence
  Description of Artificial Sequence: Synthetic coding sequence
atgaccaccaaggattatcctagtttatggggcttcgggaccactaagacattcaaaatccccatcgagcacctggattttaagtacatcgaaaagtgcagtgatgtgaaacatctggagaagattctgtgtgtacttagatctggtgaagaaggctattatcccgaactgaccgaattctgtgagaagcacctgcaggccctcgcaccggagagtcgcgcactcaggaaagacaaaccagccgcaaccgctgcttcatttaccgctgaagaatgggaaaagatcgatggagacatcaagtcatgggtgtctgagattaagaaagaggaagacaaaatgcatttccatgagaccgaaacttttccagccatgaaagataacctaccccctgttcggggtagcaactcctgtctccacgttggaaaagaaaagtacagcaagcgacccacgaaaaagaagacccctcgtgactacgcagagtgggacaagttcgacgtggagaaggaatgcctgaagatagacgaagactacaaggaaaaaactgttattgacaagtcgcatctctctaagatagagacacggatcgacaccgctggtctcacagagaaggaaaaggatttcctggccacaagagagaaagagaaaggaaacgaagctttcaactccggcgactacgaagaagccgtgatgtactacacccgatccatttccgcgcttcctacagtggtagcatacaataaccgagctcaggccgaaattaagctccagaactggaactctgcatttcaagattgcgagaaagtactggagctggagcccggaaacgtgaaagccctgctccggcgtgccacgacatataaacatcagaacaaactccgggaggcaacagaggacctgagcaaggtgttagacgtggaacccgacaacgacctagccaagaagactctatcagaagtggagcgcgatcttaagaacagcgaagctgctagcgaaacacagactaaaggaaaacgaatggtcattcaggaaattgagaacagcgaggatgaggagggcaagtctggcagaaaacacgaagacggaggaggcgacaaaaagcctgccgagcccgctggagctgccagggctgcccagccctgcgtgatgggaaatatccagaagaagcttaccggcaaggccgaaggcggtaagagaccagctagaggcgctccacaaagaggccaaactccagaggccggagctgataaaagatcccctaggagggcttctgcagcggctgcggcaggcggaggagctactggccatcctgggggagggcaaggggcagaaaatccggctgggctgaagtcacaaggcaatgagctgtttagaagcggccagttcgccgaggccgcaggtaagtactcggctgcgatcgctctgctcgaacccgctggttctgagatcgcggatgacctttcaatcctgtactcaaaccgcgcagcttgttaccttaaagaaggcaactgctcgggttgtatacaagactgtaacagggctcttgagctccatccttttagtatgaagcccctgctgaggagagctatggcttacgagacactagagcagtacggcaaagcttacgtggattataagactgtcttacaaatcgattgtgggctgcagcttgccaacgatagcgtcaatcgcctctcccgcatcctcatggagctcgacggtcccaactggagagaaaaattatctcccatccccgctgtccctgccagtgtgccactgcaagcctggcacccggcaaaggaaatgatcagcaaacaggccggagacagcagcagtcaccgacagcagggaatcaccgacgagaagacgtttaaagcgctcaaagaggagggaaaccagtgtgttaatgataaaaattacaaggatgccctcagcaagtatagtgagtgccttaagatcaacaataaagagtgtgcaatatataccaaccgagcactatgctacctaaaattgtgccagttcgaagaggccaaacaggattgcgaccaggctcttcaacttgcagatggaaatgtcaaggccttctatcgcagagcccttgcgcataagggtctgaagaattaccagaagagcctgatcgaccttaacaaagtgattctgctggaccctagtatcatcgaagctaagatggaattggaggaggtgaccagacttcttaaccttaaggataaaactgcgccatttaacaaggaaaaggagcgcagaaagatagaaattcaagaagtgaacgagggcaaagaggagcccggtcgaccggcaggcgaggtgtcaatggggtgtcttgcatctgagaagggcggaaagtcttcgcggtcacccgaggatcctgagaaactgcccatcgccaagcccaacaacgcatatgaattcggacagataataaacgcgctgtctacccggaaagacaaagaggcctgtgcccacttgctcgcaataactgctcccaaggatctgccaatgttcctttcaaacaaactcgagggggatacctttctgctactgatccaaagcttaaaaaacaatctcatcgaaaaggaccccagtctggtttatcaacacctgctgtatctctctaaggctgaacggtttaaaatgatgctgacactgattagcaaaggtcagaaagaactgattgaacagttgttcgaagacttatccgacaccccaaacaaccatttcacactggaggatatccaggcccttaagcggcagtacgagctgtag

SEQ ID NO: 242143 - DNA, 1044 bp, Artificial Sequence
  Description of Artificial Sequence: Synthetic coding sequence
atggctgctcaaagggggatgccatcttccgctgtaagggtgctggaagaggcccttggaatggggcttaccgcagccggagacgcacgcgacaccgcagacgctgtcgcagcagagggagcgtactatctcgaacaggtgacaattaccgaggcatctgaggatgattatgaatatgaggagatccccgacgacaattttagcataccagagggcgaggaggacctggccaaagcaatccagatggcacaggaacaggctactgacacagaaatcctggagagaaagaccgttctccctagtaaacatgcagtcccagaagtcatcgaagatttcctctgcaacttccttatcaaaatgggtatgacacggacactagactgctttcagtccgagtggtacgaacttattcaaaaaggcgtcactgagctgcgtactgtgggtaacgtcccagatgtgtatacccagatcatgcttctcgagaacgagaacaaaaatctcaaaaaggatctgaagcattacaaacaagccgctgataaagctagagaggacctgctcaaaatccaaaaagagagggatttccatagaatgcatcacaagagaatagtccaggagaaaaacaagcttatcaatgatctgaaaggattaaagctccactacgcatcctacgagcctaccatccgggtcctccacgaaaagcaccatactctacttaaggagaaaatgttgacttccctcgagcgcgacaaagtcgtcggccagatctctggcctacaggaaacgctgaagaaactccagcgaggccattcctaccacggccctcaaattaaggtggaccacagccgtgagaaagagaacgcgcctgagggtccaacacaaaaggggctacgcgaagctcgggagcagaataaatgtaaaactaagatgaagggaaacaccaaacagtggacggggaacagccagacgtggaataagacagtgccactgcaagatactattgggagacggcaggaaaataattctgcacaccagcacatcgactag

SEQ ID NO: 242144 - DNA, 1896 bp, Artificial Sequence
  Description of Artificial Sequence: Synthetic coding sequence
atggctgcccagcgtggaatgccttcgtccgccgtcagggtcttggaggaggccctgggcatggggctgacagctgcaggagatgcccgtgatacagccgacgcagtggctgctgaaggcgcttactacctggagcaggtcaccataactgaggcgtccgaggacgactacgagtacgaggagattcccgacgataatttctctatccctgaaggtgaggaggatctggcaaaggccattcaaatggcacaggagcaggctaccgacactgaaatactcgaaagaaagaccgtcttgcccagcaagcatgccgtgcccgaggtaattgaggactttctgtgcaatttcctgatcaaaatgggaatgactagaaccctggactgttttcagagcgaatggtacgagctgattcaaaagggagtcactgagcttcggaccgttggaaatgtgcccgacgtgtatacccagatcatgctgctggagaacgaaaacaagaatttaaagaaggacttgaaacactacaagcaggcggctgataaagcgcgtgaagacttactgaaaattcagaaggagagggattttcacaggatgcatcataaaaggattgtgcaggagaaaaataagctgatcaatgacttgaaaggactgaaacttcattatgcatcctacgaaccaacaattagggtcctgcatgaaaaacaccatactctactcaaagagaaaatgctgacttcccttgagcgagataaggtggttggacagatttctgggctacaggaaacccttaagaaactacagagaggccacagctatcatgggccacagatcaaggttgaccacagccgcgagaaggagaacgcacctgaaggccctactcagaaaggcctaagggaggcacgcgagcagaataagtgcaaaaccaagatgaagggcaatacaaaggattccgaattccctattgatatgcagcctaatcccaatttgaatgtctcaaaagaatccttgagtcccgcaaagttcgactacaaattaaagaatattttcaggctgcatgaattgcctgtgtcatgtgtgtcaatgcagccccacaaggacattttagtgtcatgtggggaagatcgtttatggaaagtgcttgggctccctaagtgtaacgttttgctgaccggcttcggacacactgattggctgtctgactgttgctttcacccctcaggcgacaagcttgccaccagcagcggagatactaccgttaagttgtgggacctgtgtaagggagactgcatactgaccttcgagggtcacagcagggctgtgtggagttgcacatggcactcctgcggcaattttgttgccagttcctcacttgataagacatcaaagatttgggatgttaattcagagcggtgtaggtgcaccttgtacggccacaccgattcggtgaacagtattgagtttttccctttttctaataccctgctgacaagtagtgcagacaaaacactcagcatttgggatgcccgaaccggtatctgcgaacaaagcctctacggccacatgcactctattaatgacgcaattttcgatccaagagggcatatgatcgctagctgtgatgcatgtggcgtcactaagctctgggattttcggaagctcctgccaatcgtgtccatcgacatagggccatcaccgggaaacgaggtcaattttgattctagtggccgtgtcttggcccaagcttcaggcaacggtgtcattcacttgttagacctgaaaagcggggaaatccacaaactgatgggacacgaaaacgaggctcacactgtagtgttctcccatgatggagagatattattcagcggcggttcagatggcacggtacgaacgtggtcctag

SEQ ID NO: 242145 - DNA, 1614 bp, Artificial Sequence
  Description of Artificial Sequence: Synthetic coding sequence
atgacaatgaatatgaagcgataccagatgactatattagctagccagaaggtgaagaaaatctggcagaagcagtttagatggcccaaaaacagactgcaaatcctcaagttttggtatgagttaatccagaagggggtcaccgagctgcgcacagtgggaaacgttccagatgtgtatacacagattatgctgctcgaaaacgaaaataaaaatctcaaaaaagacctgaagcactacaagcaagctgctgacaaggcaagagaagacctgctcaagatccagaaagaaagggacttccatcgcatgcaccacaaaagaatcgttcaggagaaaaataaactgataaacgatctcaagggtctcaaattgcattacgcctcgtacgagccaacaataagggttctgcacgagaaacaccacaccttgcttaaggagaaaatgctgacttcccttgaacgagataaagtagtgggacagatctccgggttacaagaaacattaaagaagctgcagcgcggtcactcctaccatggacctcagataaaggtagatcattcccgggagaaggaaaatgcaccagaaggacctacacaaaagggtctgcgggaggctcgggaacagaacaagtgtaaaacaaagatgaagggtaacacaaaggattctgagtttcccattgacatgcagcccaacccgaacctgaatgtgagcaaagaatcactgtctcctgccaaatttgactacaagcttaaaaacattttcaggctgcatgaactgcccgtgtcttgtgtctccatgcagccccataaggatatacttgtcagctgtggagaggatcggctttggaaggtgttggggcttcccaaatgcaacgtgctgcttacaggattcggtcatactgattggctcagcgattgttgcttccaccctagcggagacaagttggcgacgtcgagtggggacacaacagtcaagctctgggacttgtgtaaaggagactgtatactcacctttgaaggtcacagcagagcagtttggtcatgtacatggcattcgtgtggcaattttgtggccagttcctctcttgacaagacatcaaagatctgggacgtgaatagcgagaggtgtcgttgcactctgtatgggcatacagactctgttaatagtatcgaattcttcccgtttagcaacacactgctcacgtctagcgctgataaaaccctgagcatttgggatgcacggacaggtatctgtgaacagtcactctatgggcacatgcactcaatcaatgatgcaatctttgatcctcgaggccacatgattgcctcctgcgacgcgtgcggtgtgacaaagctgtgggatttcaggaagctactccccatcgtttctatcgacatagggccttcccccggaaacgaagtgaatttcgactccagcggcagggttctcgctcaggcctctggcaacggggtgatccatctattggacctcaagtcgggcgaaatccacaaacttatgggacacgagaatgaggcccacactgtggttttttcccatgatggagaaatcctgttttctggaggctccgacggcaccgtgagaacctggagttag

SEQ ID NO: 242146 - DNA, 756 bp, Artificial Sequence
  Description of Artificial Sequence: Synthetic coding sequence
atgggggttggtaccaaggcccgagcgtctcactggcgacggctgttaagcctgggtgctactccagaagaacccctgctggatttcaaaatcccagatgacaatttttctattccagagggcgaggaagatctggcgaaggctattcagatggcacaggagcaggcgacagacactgagatcctggaacgcaagacggtattgccatcgaagcatgctgtgcctgaggtgatcgaggattttttgtgcaatttcctcattaagatggggatgaccagaacccttgactgcttccaatccgagtggtatgagctgatccaaaaaggtgttacagagcttcgaactgtgggcaacgtgccagacgtatacacgcagatcatgttattggagaacgaaaacaagaatctaaaaaaagacctcaaacactacaagcaggctgctgacaaagctagggaagacttattaaagattcagaaagagagggacttccaccgtatgcaccataagcgcatcgtgcaagagaagaataagctcatcaacgaccttaagggactgaagctgcactacgcttcttacgagccaacaattagggtcctgcacgagaagcatcatacccttctaaaggaaaaaatgctcacatccctggagcgagataaagtggtcggccaaatctccggccttcaagaaactctgaaaaagctgcagagaggacattcctatcacgggcctcagatcaaaggcaaatgcaagatgtag

SEQ ID NO: 242147 - DNA, 552 bp, Artificial Sequence
  Description of Artificial Sequence: Synthetic coding sequence
atggcagctcagaggggcatgccatcttctgccgtgagagtgcttgaggaagccctggggatgggactgaccgctgccggagacgcacgggatactgctgatgccgtggcagctgagggcgcatactacctggaacaggtgacaataactgaggcctcagaagacgattatgagtacgaggaaattccagacgacaactttagtatcccggagggcgaagaggatctggccaaggctatacagatggctcaggagcaggccactgacactgaaatcctggaacgcaaaacagttttacccagcaagcatgcagtgcctgaggtgattgaagactttctctgcaactttctgatcaagatgggcatgacccggacactggactgctttcagtccgagtggtacgaattgattcaaaaaggcgtcaccgagctacgtaccgtggggaacgtccccgatgtgtacacgcagatcatgcttctcgaaaatgagaacaagaatctgaagaaagacttgaagcattacaaacaggctgcagaatatgtcatcttctag

SEQ ID NO: 242148 - DNA, 768 bp, Artificial Sequence
  Description of Artificial Sequence: Synthetic coding sequence
gacagtgaatttccaatcgatatgcagccgaacccgaacctgaatgtgtctaaagagtctttgtcaccagctaagttcgattataaactgaagaacatcttccggctccatgagctgccagtgtcatgcgtgtctatgcagccgcataaagacatccttgtgtcatgtggcgaggaccgactctggaaggtcctgggattgccaaagtgcaacgttctgcttacaggctttggtcatactgattggttgtctgactgctgtttccaccctagtgaaagatgtaggtgtacactgtacgggcatacagactccgttaattctatagaattttttccattttccaatactctgttaacctccagtgccgacaaaacccttagtatttgggatgcccgaacaggaatctgtgagcagtccctgtatggacatatgcattccataaatgatgcaattttcgatccccgagggcacatgatcgcaagctgtgacgcatgtggggtgaccaagttgtgggatttccggaagctgttaccgatcgtgtccattgatattggcccatcccccggaaacgaagtgaacttcgacagctctggcagggtactggcccaggcatctggaaatggggtgattcacctcttggatctgaagtccggggagatacataaactcatggggcatgagaatgaagcccatactgtagtcttttcgcacgacggggagatcctctttagcgggggtagtgacggaaccgtcaggacctggtcttag

SEQ ID NO: 242149 - DNA, 1314 bp, Artificial Sequence
  Description of Artificial Sequence: Synthetic coding sequence
atgaggaggagctctcgaccaggatcagcttcttcttctcgcaagcatacacctaacttctttagcgaaaacagttctatgtctatcacatcggaggatagcaagggactgcgctctgctgagcccggtccaggagagccggaaggacggagagccagggggccttcttgtggagagcccgctctgtcagcaggggttccgggagggactacctgggccggttcttctcagcagaagcctgcccctcggtctcataattggcagactgcttgtggagctgccactgtgcgcggtggagcatccgagcctactggcagtcctgtggtgagcgaggagccacttgacctgttgccaacccttgacctgcgacaggaaatgcctccgccacgtgtattcaaatcattcctgtctctgttgtttcaaggtctgagcgttttgctaagtctcgcaggagacgtattggtgtccatgtatcgcgaggtgtgtagcatacgattcctgttcacagcagtctccttactgagcctttttctgtctgccttctggctcgggctcctgtatctggtaagtccactggagaacgagccaaaagaaatgctgacattaagcgaataccatgaaagagtgaggagccagggtcagcaactccaacaactacaggcagaactggataaactccacaaggaggtgtctacagtaagagcggctaacagcgaacgagtggccaagctcgtgttccagagacttaacgaggactttgttagaaaaccagactacgctctgtcatccgtgggcgcatctatcgacctgcagaaaacctcccatgattatgcggatagaaatactgcttacttttggaaccggttctctttttggaattacgcacgacccccaactgttattctcgagcctcatgttttcccgggaaactgctgggcgttcgagggagaccaaggtcaggtagtcatccagttacccggtagggtccagttgagcgacatcacactccaacatcctccacctagcgtggagcatacagggggtgccaattccgcaccacgcgacttcgctgttttcggacttcaggtctacgacgagaccgaagtgtcattggggaagtttactttcgatgtggagaagtccgaaatccaaaccttccatctccagaatgatcctcccgctgcatttcctaaggtcaaaatccagatcctgtctaattggggacatccgagatttacctgtttgtatagagtgcgagcccatggcgtgcgcacctctgaaggagccgagggttccgcccaaggaccacattag

SEQ ID NO: 242150 - DNA, 1377 bp, Artificial Sequence
  Description of Artificial Sequence: Synthetic coding sequence
atgagccagcgtcaggtgctgcaggtctttgagcagtatcaaaaagcccgaacccagttcgtccagatggttgctgagttagcaaccaggccgcagaatattgagaccctgcagaacgccggtgtgatgagtctgctacgaaccctgcttctagacgtagtgcctaccattcagcaaacggccgcacttgccctaggcaggctagccaattacaatgatgatctggccgaggccgtggtgaagtgcgacattctgccccagctggtgtattctcttgcagaacaaaatcgtttctacaaaaaagcagcagcattcgttctgcgtgcggttggtaaacattctccacagctcgctcaggccattgttgactgcggagcgttggacacactggtgatctgtctggaggacttcgacccgggagtgaaagaagccgctgcgtgggcactgaggtacatagccagacataacgcggaactgtctcaggccgtcgtggatgccggagctgtccccctcctggttctgtgcatacaggaaccagagattgcgctcaaacggattgctgcttctgccctgtcagatattgccaaacactcccccgagctcgctcagactgtggtggatgcaggtgccgttgctcacttggcccagatgatcctgaacccagatgccaagctaaaacatcagatactcagcgcgctgtcacaggtttcgaaacactccgttgacctcgcagaaatggttgtggaggctgaaattttccccgtagtactgacctgtctaaaagataaagacgaatacgttaagaagaatgcttccactctgataagagagattgcgaagcacaccccagaactcagtcagctcgtggtcaacgccggaggggtagcggctgttatcgattgtataggatcttgcaaaggtaatacgcgactgcctggtattatgatgcttggctacgtggctgctcattcagagaacctggccatggccgtcatcatttctaagggtgtacctcagctatccgtctgcttgagcgaagagccggaagaccacatcaaagctgctgctgcctgggccctgggacagatagggcgtcacactcctgagcacgcaagggccgtcgccgttacaaacacactccctgttctgctttctttatatatgagtacagaatccagtgaggacctccaggttaagtcaaaaaaggccattaaaaacatcttacaaaagtgcacgtaccttcctgccctcgagccttttctgtacgacgcacctccaaatattttaaagcacgtggtgggccagttttctaaagtgttgtttccttggattttcagatacacatctgcggagggaggtcagctctcaacgacatag

SEQ ID NO: 242151 - DNA, 813 bp, Artificial Sequence
  Description of Artificial Sequence: Synthetic coding sequence
atgtcacagaggcaggtactccaagtgtttgaacagtaccagaaggctagaacccagtttgttcagatggtagcggaattggctaccaggccccagaacatagaaaccttgcagaacgcaggggtcatgagtctgctgaggactctgctgttggacgtcgtgcctaccattcaacagacggccgcactcgccttgggaagactggcaaactacaatgatgacttagctgaagcggtggtaaaatgtgacatcctcccacagttagtctattcactggctgaacagaacggagtcccccagctgtctgtctgcctctctgaagagcctgaggatcacatcaaagccgctgcagcctgggccctgggccagatcggcaggcacacgccagaacatgcccgagcagtggctgtaacaaacacactgccagttctgctgtctttgtatatgtcaaccgagagctcagaagacctgcaggtgaagtctaagaaggccattaagaacatcctgcagaagtgcacctatctacccgctctggagccatttctttacgacgctcctcccaatatcctgaagcatgtcgtggggcaatttagtaaagttcttccccatgatagcaaggccagacggctgtttgtcaccagcggtggcctgaaaaaggtgcaggagattaaggcagagcctggcagtctactgcaggagtatattaatagcataaatagttgttatcctgaggagattgtgcgttattactctcctggctacagtgataccctactgcagagagtggactcataccagccattaaataactag

SEQ ID NO: 242152 - DNA, 1758 bp, Artificial Sequence
  Description of Artificial Sequence: Synthetic coding sequence
atgtcccagcgacaagtgctccaggtgttcgagcagtaccagaaggccagaacgcagttcgttcagatggtggccgaactcgccactcgaccacagaatatcgaaactttgcagaacgccggtgaaccgggtgctcgcacgccagtggctcctcgagccttgtcaccacgccgtctgcggccagctgccctgccagttgaactgcttggatcccgctccgtgggcaccggcgttcgaaagagtatccactccttccagagggtgtttggcggacaggctgagcgtgtgaagctgccagatggctgtggtcgatgcgctctctccctgtttccttccagtctgcacaccggagtgatgagtctactcaggactcttctccttgacgtcgtgccaactatacagcaaaccgctgcgctcgcactgggccgacttgccaattacaacgatgacctggcggaggcggtggtgaagtgcgatatacttccacagcttgtgtattctctggccgaacagaatcggttctataagaaagcagctgcctttgtgttgcgcgctgttggaaaacacagcccccagctcgcgcaggcaattgtcgactgcggtgccttagatactctggtgatctgtctggaggactttgatccaggcgtaaaagaggcagctgcctgggctcttagatatatagctcgccacaatgccgagttgagtcaggcagtggttgacgccggagcagtgcctctgctcgtgttgtgtattcaggagcctgagatcgcactgaagcgcattgccgcatctgctctctccgacatcgccaaacacagccctgaacttgcccagactgtcgttgatgcgggtgcggtcgcccaccttgctcagatgattctcaatccagacgcaaagctaaagcaccagattcttagcgccctttcacaggttagcaagcactcagtcgacctcgccgagatggtggtcgaagctgaaattttccctgtggtcctcacgtgcctaaaggataaggacgagtacgtgaagaagaatgcctccaccttgattagggaaatcgctaagcacacacccgagttgtctcaactggtggtgaacgccggtggcgtggcggcagttatcgattgcatcgggtcttgcaagggaaatacccgcctcccgggtataatgatgctgggctatgtcgcagcgcactccgaaaacttggccatggccgttataatatctaaaggtgtgccacagctgagtgtttgtctgtccgaggaaccagaagaccacatcaaagcggcagctgcctgggcgcttggtcagattggcagacatacccctgagcatgctagagcggtcgcagtaacaaacactctcccggtcctcttgtccctgtatatgtccaccgaatcctccgaggatttgcaagtcaagagcaagaaggcaatcaagaatatacttcagaagtgcacctacctgccagcactcgagccgttcttgtatgacgcccctcctaatattttgaagcacgtggttggacagttttctaaagttttgcctcacgactccaaggctagaagactgtttgttactagcggcggtctcaagaaggttcaggaaatcaaggctgagccgggaagcctgctgcaggagtatataaacagcatcaactcctgctaccctgaggagattgtgcggtactactctccaggctactcagacactcttctgcagcgggttgacagttatcagcccttgaataactag

SEQ ID NO: 242153 - DNA, 1530 bp, Artificial Sequence
  Description of Artificial Sequence: Synthetic coding sequence
atgagccagcgccaggtgctgcaggtctttgagcagtatcaaaaggccaggacccagtttgtgcagatggtcgctgagctcgctacgcgcccacagaacatcgaaaccctgcagaatgctggcgtcatgtcactgctgcgtactctcttactcgatgtagtgcccacgattcagcaaactgctgcactcgcccttggcaggcttgccaactataatgatgacctggcagaggccgtggtgaaatgcgacattctgccacagttggtgtattcactggctgagcagaatcggttctacaaaaaggctgctgcctttgtcttacgggctgtcggcaagcactcaccccaactcgcccaggctatcgtagattgtggagcgctggatactctggtgatttgtctagaggacttcgaccctggtgtcaaggaggcggctgcttgggctctgcgatatatcgcacggcacaacgccgagctatcccaagccgtggttgacgctggtgcagtgcccctactggtattgtgtatacaggagcccgaaatcgcccttaagaggattgcagctagcgcactcagcgacattgctaagcattcccccgaactggcacaaactgttgttgacgctggcgctgtggcacatttggctcagatgattctgaacccagatgccaaactgaaacatcaaattttgtcagcattgtcccaggtgagtaagcacagtgttgacctagccgagatggtggttgaagcagagatttttcccgttgtccttacatgccttaaggataaagatgagtacgtgaaaaagaacgcttccactcttatcagggagattgcgaagcacactccagagctgagccagctagttgtcaacgccggaggtgtcgccgcagtgatagactgcataggttcttgtaaaggcaataccagactgcccggtatcatgatgctggggtatgttgcggctcattctgagaatctcgcaatggctgttatcatctcgaagggagttccccagctatcagtgtgcctgtccgaagagccagaggaccatattaaagctgccgctgcctgggcactgggccagattgggaggcacacacccgagcatgcacgggcagtcgctgtgaccaataccttaccggttttgctctcactgtacatgtctactgaatcaagcgaagatctgcaagtaaagagcaaaaaagccattaagaatattctgcaaaagtgcacatacttaccggcactggaaccgtttctttacgacgctcccccaaacattctgaaacatgtggtcgggcagtttagcaaggtgcttccacacgactccaaagcacggagactgttcgtgacatctggcggactgaagaaagtgcaggagatcaaggccgagcctggttctctgctgcaggagtatattaatagtattaacagttgctatcctgaggagatcgtcagatattattccccaggttattctgatactttactgcaacgtgtggattcttaccagccattaaacaattag

SEQ ID NO: 242154 - DNA, 741 bp, Artificial Sequence
  Description of Artificial Sequence: Synthetic coding sequence
atgtcacaaagacaggtgctgcaggtctttgagcaatatcagaaggcacggacgcaattcgtccagatggtagcggagcttgcaacccgcccacagaatattgagaccctgcagaatgcaggagaaccaggtgctcgtacgcctgtcgcgccaagagccctgagccccagacgcctcagaccagctgcactgccggtagagctgcttggttcaagaagcgtcgggaccggggtgaggaagtctattcacagctttcagagggtgttcggcggtcaggccgaacgcgtcaagctacctgacggttgcggcaggtgcgccctcagcttgttcccctctagcctccacaccggagtaatgagcctgctccgcactctgctactcgacgttgtgcctaccattcaacaaaccgcggctctcgctcttggaagacttgccaattacaatgatgacctggctgaggctgtggttaagtgcgacattctacctcagctggtatatagcttggcagaacagaatagattctacaaaaaggccgctgccttcgttcttagagccgtgggcaaacattctcctcagttggcccaggcgattgtagactgcggcgctctcgacacccttgttatatgcctggaggactttgaccctggggtcaaggaagctgctgcctgggcacttaggtatattgcccgtcataacgcggagctgagccaggccgtggtagacgccggtgccgttccatag

SEQ ID NO: 242155 - DNA, 576 bp, Artificial Sequence
  Description of Artificial Sequence: Synthetic coding sequence
atgtctcagaggcaggtactgcaagtattcgagcagtaccaaaaggcgaggacccagtttgtccagatggtggccgagttggcaacaaggccccagaatattgaaacactgcagaacgcgggagtgatgtccctcctgcggaccctgcttttggacgtggtccccaccattcagcagacggccgctcttgcactgggcaggctggctaactacaacgatgatctggccgaggcagtggtgaagtgtgatattctgcctcagctcgtctactctttagccgaacagaatggcgtgccccagctatcagtatgcctcagtgaagagccagaggatcatattaaagctgcagctgcctgggctctcggtcagattggacgccatacaccagaacacgctcgtgccgttgccgtgaccaatacgctgcccgttctgctttctttgtacatgtccacagagagcagtgaggatctgcaggttaaatccaaaaaggccatcaaaaacatactccaaaagtgcacttatctgcctgccttggagcccttcttgtatgatgccccaccaaatattctcaaatag

SEQ ID NO: 242156 - DNA, 1455 bp, Artificial Sequence
  Description of Artificial Sequence: Synthetic coding sequence
atgcactcactcaccatggatctttggattccaaacgggcaggcgggtgtcatgtcccttctcaggacacttctgctggatgtggtccccactatacagcagaccgcagcacttgccctcggcaggctggcaaactataatgacgatctggccgaagctgtggtcaaatgcgatatactcccacagctagtgtactccctcgctgagcagaatcgattctacaaaaaggcagccgcttttgtgctgagagcagtcgggaagcatagcccacaactggctcaggctattgtcgactgtggggcactcgatacccttgtgatctgtctggaggattttgaccccggtgtcaaggaagctgccgcatgggccctaaggtacatagcaaggcataatgccgagctgtcacaggccgtcgtggacgcgggtgccgtcccactgttggttctgtgcatacaagagcctgagatcgcgctgaagcgtatcgcggcatcggcactgtcagatattgcaaaacattcacccgaactcgcgcaaacagtagttgatgcgggagcagtagcacatcttgcgcagatgattctcaacccggacgcgaaactgaagcatcaaatactctccgcactttcccaggtaagcaagcattcagtcgatctcgcagagatggtcgtggaagccgaaatcttcccagtagtactgacctgtctgaaagataaggacgagtacgtgaagaagaacgccagcactctgatcagggaaatagccaagcatacccccgagctgagtcagttagtggtcaatgcaggaggcgtggcagcagttatcgactgcataggctcttgcaaggggaacacccgccttcccggtattatgatgctaggttatgttgcagcgcactccgagaatctggccatggcagtcattatttcaaaaggagtacctcaactgagcgtttgcctgagcgaggagccagaagaccacatcaaagctgcagcggcatgggctctgggccagatcggtcgccacactcctgaacatgctagggctgtcgccgttacaaacacattgcccgtactgctttctctgtatatgtccacagagtcttccgaagatttgcaggtgaaatctaaaaaggctattaagaacatattgcagaagtgcacctacctaccagctctggaaccattcttatatgatgcacctcccaacatactaaagcacgtagtcggacaattcagtaaagttctgccccatgactcaaaagctaggcggctgttcgtcacttccggagggctcaagaaggtacaagagatcaaagccgagcccggatccctgcttcaagagtatatcaattctattaacagctgttacccagaggagatcgtgagatattactctcctggttactccgacacactcctgcaacgagtcgacagttatcaacctctgaacaactag

SEQ ID NO: 242157 - DNA, 1506 bp, Artificial Sequence
  Description of Artificial Sequence: Synthetic coding sequence
atggagacaaatgaatcgacagagggctctagatctcgatccagaagtctggatatccaaccttcgtccgagggcctaggaccaacaagcgagccatttccgagtagcgacgactccccaagaagcgccctcgcagcagctacagcagcggctgcagccgcagctagcgcagccgcagccaccgccgctttcacaactgccaaggctgccgcactaagcaccaaaaccccagcaccgtgtagtgagttcatggaacctagcagtgatcccagtcttctgggcgagccctgcgcgggacccggtttcactcataatattgcccacggctcactgggttttgagcctgtgtacgtgtcttgcatagcccaggacacttgcactaccacagatcactcctcaaatccaggtccagtccccggttcttcttcggggcctgttcttgggtcttcctcaggggcagggcatggctctggcagcggttctggccctgggtgcggaagcgtcccaggtagtgggtcaggcccaggccctgggtccgggcctggcagtggtccgggacatggaagcgggtctcatcctggtcccgcaagcggacccggtcccgatactggcccagatagcgaattaagcccatgtatcccacctggctttaggaatctggtggctgacagggtgcctaattatacaagttggagccagcattgcccctgggagccacaaaaacaacccccatgggaatttctccaggttctggaacctggggcacgtggcttatggaagcccccagacatcaagggcaaattgatggtgtgctacgaaacgctccctcgtggtcaatgtttactgtataactgggaggaagagcgagcgactaatcacctggatcaagtcccaagcatgcaagacggctcagagtcctttttctttcgccacgggcatagaggcctcttaaccatgcagctgaaatcacctatgccatcctccactactcagaaagattcctaccagcctcctggaaatgtctactggccgcttagaggcaagcgcgaggctatgttggagatgctgttacagcaccagatctgtaaagaggttcaagctgagcaggaacctactcgcaagctgttcgaggtggaatcggtgacacaccacgactaccgtatggagctggcacaagcagggaccccagctcctactaagccacatgattacaggcaggagcagccagaaacattctggatccagagagcaccccaactgcccacctggtggcctctgcctacccaagtgcctgcggctgaagattacttgacatggaaagagtgggggttcactggcgtccaggaagtcctgtctgccctgctgcgggctactccgggtgaatatagtgtcaacatatgcggcatgaacgagcacccagtatgcagccggacctggactaacagactctgccaccaagagatgggctctaagaaaactgtgacacaggaggaccgagggtggtag

SEQ ID NO: 242158 - DNA, 1458 bp, Artificial Sequence
  Description of Artificial Sequence: Synthetic coding sequence
atggagactaatgaaagcactgagggaagccgttcgcgcagccggagccttgacatccagcccagttctgagggcctcggcccaaccagtgagccctttccctcctctgacgacagtcctcggtccgctctggcagccgctactgctgcagcggcagctgctgccagcgcagccgcagccaccgctgccttcactactgccaaggccgcagccctttcgaccaagacaccagccccatgctctgaattcatggaaccttcgagcgacccgtctctgctgggagagccctgcgcgggaccaggcttcacacacaatattgctcacggcagtctcggctttgaacccgtgtacgtgagctgtattgcccaggatacctgtactactaccgaccacagctccaaccctggtcctgtgccaggatctagctctggcccagtattaggaagcagttctggagctggccatgggtcgggtagtggaagtgggccagggtgcggttccgtgcctggttcaggctcggggcctgggcctgggagtggacccggatccggtcctggccacggttctggctctcacccgggacccgcttccggacctggcccagatacaggaccagatagcgaattaagcccctgcatcccaccaggcttcagaaacctggtcgccgatagggtgcctaattacacttcatggtctcaacattgtccctgggagcctcaaaagcaacccccatgggaattcctacaagttctggagcccggagctagaggactgtggaagcctccagatataaaggggaaactcatggtctgctatgaaacacttcccagaggccagtgcctcctgtataattgggaagaggaacgcgcaactaatcacctggaccaggtacccagcatgcaagatggttctgagagttttttttttcgacatggtcatcggggactgctgactatgcagttgaaaagccctatgcctagcagcaccacacagaaggactcataccagcctcctggcaatgtgtactggcccctgcgtgggaagagggaggccatgctagagatgctcctgcagcaccagatatgtaaggaagtccaagcggaacaagaaccaacacgtaaactgttcgaagtagagtccgttacacatcacgattacaggatggagttggctcaggcaggcaccccggctcccaccaagccccatgactatcgccaggaacagccagagactttctggatccagcgggctccacagctgcccggagtctcgaacattagaacactcgacaccccctttcgcaaaaattgctccttcagtactccagtgcctctcagcctcgggaagctcctaccctatgaacccgagaactacccctaccaactgggggagatctcttccttaccatgtcccggagggaggctcggaggcggaggaggcagaatgacccccttctag

SEQ ID NO: 242159 - DNA, 1281 bp, Artificial Sequence
  Description of Artificial Sequence: Synthetic coding sequence
atggaaactaatgaatccacagagggcagtagatcccggagtcggagcctggacattcagccaagctctgaaggactgggacctacatccgagcctttcccctccagcgacgattcccctaggtctgcccttgccgctgccactgccgctgctgcagcagccgcatctgctgcggctgccactgctgcctttacaaccgccaaggctgccgcactaagcacaaagacgcccgctccctgtagcgaattcatggagccaagcagcgacccgagtttactgggggagccatgcgcgggtcccggatttacacacaacattgcccatgggtctctgggttttgaacctgtgtacgtaagctgcatcgctcaggacacgtgcacaactacagatcacagttcaaatcccggtcctgtgcccggaagctcctccgggccagttttgggatcaagctccggagcgggtcatggctctggttccgggtcaggacccggatgcggatctgtgcctggctccggtagcggccctgggccaggcagcggacctgggtccgggcctggccacggctccggctcacatccaggcccagcctctgggccagggccagataccggtcccgattctgagctgtccccttgcattcctcctggattccggaacctggttgctgatcgcgtccccaactacacaagctggtcgcagcactgcccttgggaaccacaaaaacagcctccctgggagtttctgcaagtgctggaacccggagcaaggggcctgtggaagcctcctgatatcaaagggaaactcatggtgtgctacgagacactgcctcgtgggcaatgcctattatacaactgggaggaagaacgggcaaccaaccacctagatcaggtgccctcgatgcaagacggcagcgaaagtttcttctttcgccatggccatcgaggcctgctcacaatgcagcttaagagtcctatgccaagttcgactacccaaaaggactcctaccagccgcctgggaacgtgtattggccacttcgtggcaagagagaagccatgttagaaatgttgttgcaacaccagatttgcaaggaggtgcaggcagagcaggagcccacaagaaagctttttgaggtcgagtcagtaactcaccacgactatcgcatggaattagcacaggctggcacccccgcacctacgaaaccacacgactacagacaggaacaacctgagaccttctggattcagcgtgctccccaacttcccgtatgtgagggtgattag

SEQ ID NO: 242160 - DNA, 3966 bp, Artificial Sequence
  Description of Artificial Sequence: Synthetic coding sequence
atggagctggaagatggtgttgtctaccaggaagagcccggaggcagcggcgcagtgatgtccgagagggtctctgggctggccggaagcatctacagggagtttgagcggttgattggcagatacgacgaggaagtagtaaaggaactgatgccgctcgtggtggctgtgctggagaacttggactctgtttttgctcaagaccaggaacaccaggttgagctggagctcctgagagacgataatgagcagctgatcactcagtatgaacgcgagaaggctcttagaaaacacgcagaggaaaagtttatagagtttgaggactctcaggagcaggaaaagaaggacctccagactcgcgtggagtcattggaatcccagaccagacaactggaactgaaagctaaaaattacgccgaccagatttcacgactcgaagaacgcgaggccgagttaaaaaaggaatacaatgcgctgcaccaacgccacaccgagatgatccataattatatggagcatctcgagcggacaaaattacatcagctctccggcagcgaccagttagaatccaccgcacactcccgtatccgcaaagagaggcccatcagtttgggtatcttcccgctacctgccggagatgggctgctaacccctgatgcacaaaagggcggagagacacctggaagcgagcagtggaaattccaggagttatcccagcccaggtctcacacgtccctgaaagtcagcaattctcctgagccgcagaaggctgtcgagcaggaggatgaactatcagacgtgagccaggggggatcaaaagctactaccccagcaagtacggccaattcggatgttgctacaattcctacagacacacccctgaaggaggagaatgaagggtttgtgaaagtaacagatgcccctaacaaatcagaaatctcaaaacacattgaagttcaggtcgcccaggagacaagaaatgtcagcacagggtctgccgaaaacgaagaaaagagtgaggtgcaagctataatagagagcactccagagctagatatggacaaggacctgtctgggtataagggttcatctacacccaccaagggaattgagaataaagccttcgaccgtaacaccgaatcactgtttgaggagctcagctctgccggtagtggtctgataggtgatgtggacgagggggctgacctgctgggtatggggagagaagtggaaaacctgatactcgaaaatacacagctgctcgaaaccaaaaatgcactgaatattgtaaagaatgacctgatagctaaagttgatgaactgacctgcgagaaggacgtccttcagggggagctggaagctgtgaaacaggcgaaactgaagctggaggaaaagaatcgtgagctggaagaagaacttcggaaagctcgagcagaagccgaggatgcccgacaaaaagccaaagatgacgacgattcagatataccaacagcccagcggaaaagattcactagagtggagatggcgcgagtgctgatggaaaggaaccagtacaaggaaaggctgatggagctccaggaggccgtgagatggacagagatgattagggcctcaagggagaatcccgcaatgcaggaaaaaaagcggagtagcatttggcagttcttctctcgactcttttcgagcagcagtaataccactaagaagccggaacctccagtgaatctgaagtacaatgccccaacatcgcatgtaacaccgtcagtgaagaagcgtagctccactctttcccagttgcctggcgataagtccaaagccttcgatttcctaagcgaagagacggaggcatcgctggcgagccgaagagagcagaagcgcgagcaatatcgtcaagttaaggcccatgtgcagaaggaagacggaagggtccaggccttcggatggagccttccccagaaatataagcaggtaaccaacggtcaaggagagaataaaatgaagaacctgcctgtgcccgtgtatctaagaccactggacgagaaagatactagcatgaaactctggtgcgccgtcggggtcaatttgagcgggggaaaaacaagggacggtggctcggtggtcggcgcttctgtattctataaggatgtggctggactagacacagagggatccaaacaacgtagcgctagccagtcctccctggacaagctggaccaagagctgaaggagcagcagaaagaattaaagaaccaggaggagctgtcaagcctcgtctggatctgcacctctactcactcagcaaccaaagtgctgattatcgacgcagtacagccgggtaacattcttgatagtttcaccgtctgtaattcacacgtgctgtgtatcgcgtcggtacccggtgccagagagaccgattacccagccggagaagaccttagtgagtctggccaggtcgataaggcttcactttgcgggagcatgaccagtaattcctctgctgaaactgactcacttctgggcggaattacggtggtgggatgttcagcggaaggtgtgaccggcgctgcaacaagcccctctactaacggcgcatctcccgtgatggataaacccccagaaatggaggcagaaaacagcgaggtggacgagaacgtccccacagccgaggaagccaccgaagccactgagggcaatgctggatccgcagaagacacagttgacatttcacagaccggggtatacacagagcatgttttcaccgatcccttaggcgtgcagatccctgaggacttaagccccgtctaccagagttctaacgattcagatgcttacaaggaccagatttctgttttgcccaatgagcaggatttagtgcgggaggaggcgcagaaaatgagctcactgcttcctactatgtggctgggcgcacaaaatggctgcttatatgttcactcctccgtagctcaatggcgcaagtgcctgcactccatcaaacttaaggactcaatcctctcgatcgtgcatgtgaaggggatcgttctagtcgccttggccgatggaacactggccatctttcataggggtgtcgacggtcagtgggacctttccaattaccacctcctggatcttggaaggccacatcactctattagatgcatgaccgtggtgcacgataaggtgtggtgcggatatcgtaacaaaatctacgtggtacagccaaaagctatgaagatcgagaaatcctttgacgctcacccaagaaaagagtcccaagtacggcagctcgcctgggtgggcgacggtgtttgggtgtctatccgactcgactctaccctgagactctaccatgctcatacctatcagcatctccaagatgtggacattgagccttatgttagtaaaatgttaggaactggcaagctgggcttctcgtttgttcgaataaccgcgctcatggtctcgtgtaacagactttgggtgggcacgggcaatggcgtaatcataagcattcctctcaccgagacaaacaaaacgagcggggtgccgggtaacagaccgggttctgtcattcgagtgtatggagatgagaattccgataaggtgacccctggaacatttattccttattgttctatggcccacgcacagctgtgcttccacgggcacagggacgcagtcaaattctttgtggccgtccccggacaggtaatctcaccccagagcagctcctccggcacagatctgaccggtgataaagccggtccttctgcacaggagcctggttcacagactcctctgaagtcaatgctggtaatttccggcggtgaagggtacattgattttcggatgggggatgaagggggtgagagcgaattgctgggagaggaccttccacttgaaccgtcggtgacaaaggcagagagaagtcacctcatcgtctggcaggtcatgtatggcaatgagtag

SEQ ID NO: 242161 - DNA, 3924 bp, Artificial Sequence
  Description of Artificial Sequence: Synthetic coding sequence
atggaactcgaagatggagtagtgtatcaagaggagccaggcggaagtggcgctgtcatgtcagaacgcgtcagcgggctcgccggatcgatttaccgcgaatttgaaagacttattggcagatacgatgaagaggtcgtcaaggagctgatgcccctcgtggtggccgttctggagaatttggacagcgtgttcgcacaagatcaggaacaccaggtggagctcgaacttttgagagatgataatgagcagctgataacacagtatgagcgggaaaaagcgctgcgcaaacacgcggaagaaaaattcattgaatttgaagactctcaggaacaggagaaaaaagacttgcagactcgcgtcgagtccctagagagccagacccggcaattggagttgaaggcaaaaaactacgccgaccagataagcaggcttgaggaacgtgaagcagagttgaagaaggaatataacgccctgcaccagagacacactgaaatgatccataactacatggaacacctcgaacgcactaagctgcaccaactgagcggaagtgatcagctcgaaagtaccgctcactcccgcatcaggaaagagcgcccaattagcctaggtatttttcctctcccagcaggcgatggacttctgacgcccgatgctcagaagggaggcgagacccccggttcagagcagtggaagtttcaggagctctctcaaccgcgaagccacacaagtctaaaggacgaactctcagacgtgagtcaagggggtagcaaagccaccacacctgcatctaccgcaaactctgacgttgccacgattcctaccgacacaccactgaaagaagagaatgagggatttgtgaaagtcaccgacgcgccaaataaatcggagatcagtaagcacattgaggtgcaggtggctcaggaaaccagaaacgttagcacaggtagtgcggaaaatgaggaaaagtccgaagtgcaagctataatcgagagcacgccagagctggatatggataaagacctcagcgggtacaaggggagctctacccctacaaaggggattgaaaataaggccttcgaccgcaatacagagtctctgttcgaggagttgtcgtccgccggaagcggtctgatcggcgatgtagacgagggtgctgaccttctggggatgggcagggaggtggagaaccttattctcgagaacacccagcttctagaaacaaagaacgcactcaacatcgttaaaaacgacctgattgcaaaggtagatgagctgacctgcgagaaggacgttctgcagggcgaactggaagccgtgaaacaagcaaagctgaagcttgaagagaaaaatcgcgagcttgaagaggagttacgtaaggcacgggcagaggccgaagatgccaggcagaaggccaaggacgatgatgacagcgacatacctactgcacagagaaagagattcacccgggttgagatggcaagggttctcatggagcggaatcaatataaagagagactgatggaactacaagaggccgtgaggtggactgagatgatcagggcttcaagggagaaccccgctatgcaggagaagaagcggagcagtatttggcagtttttttctaggctttttagtagttcttcaaacaccaccaaaaaacctgaacctcccgttaatctcaagtacaatgctccgacgagtcatgtgacaccttcggtgaagaagcgcagttccactttaagccagttgccaggagataaatcaaaagcattcgatttcctttccgaagagactgaagcctcacttgcctcccgcagggagcagaaaagggaacagtacagacaagtgaaggcccacgtacagaaagaggacggacgggttcaggcgtttggctggtccttaccacagaaatataaacaggtgacaaacggacagggggaaaacaagatgaaaaacctacctgtgccggtgtacctccgaccattggacgaaaaagatacaagcatgaaactatggtgcgcggtgggggtaaatttaagtggagggaaaacacgcgacggcggatcagtagtgggggcatcagtgttctataaagatgtggccggactggacactgaggggtcaaagcagaggtccgcctcccagtccagcctggataagttagaccaggaactcaaagaacagcagaaggaactcaagaatcaagaagagcttagctccctggtgtggatatgcaccagcacgcacagcgctacaaaggtactgattattgacgcagtacagcctgggaacattcttgacagctttactgtatgtaattctcacgttttatgtatcgccagcgttcctggggctagggaaaccgactatcctgctggtgaggatctgtccgagtcaggacaggtggataaggcctctctgtgtggctctatgacctctaatagctccgctgaaacagatagcctgctcggaggaattaccgtggtgggctgtagcgcagaaggcgttaccggcgcagcaacctcaccttctaccaacggcgcatcccctgtgatggacaaaccccctgaaatggaagccgagaattcagaagttgacgagaatgtgccaaccgccgaggaggctactgaagccaccgagggcaatgcgggtagtgcggaagacaccgtggatatcagtcaaaccggagtttatacggagcacgtcttcactgatcccctcggagtccaaatcccagaggacttgtcacctgtgtaccagtcttccaacgattcagatgcttacaaagaccagatttcagtgcttcctaacgaacaggatctggtgcgcgaagaggcccagaaaatgagctcacttctgcccacaatgtggctgggcgctcagaatggttgcctgtatgtgcattcttcagtcgcacaatggcgaaagtgcctgcactctattaagttaaaggattctatcctatctattgttcacgtgaaaggaatcgtgcttgttgctctggctgatggcactttagccatttttcaccggggagttgacggacaatgggatctgtctaactaccatcttctagacctgggaaggcctcatcattctatacggtgtatgacagtggtgcatgataaagtttggtgcggttataggaataaaatctatgtcgtccagccaaaggcgatgaagattgaaaaatcattcgatgctcatcccagaaaggagtcgcaggtcaggcaactcgcttgggtcggggatggggtatgggtgtcaatccggctggattctactctgagactgtaccacgcccacacctaccagcacttacaagatgtggatattgagccctacgtttcaaagatgctggggaccggcaagttaggcttttcattcgttcgtataacagcactgatggtaagctgtaatcgactatgggttgggactggcaacggggtgatcatcagcatcccccttacagagaccaacaagacgtccggagtgcccggtaaccgaccaggctctgtgatcagagtgtacggggacgagaacagtgacaaggtaacacccggtacatttatcccgtattgctccatggctcacgctcagctgtgtttccatggtcaccgcgatgccgtgaagtttttcgtggctgtgcccggtcaagtgatctccccacagtcatcttcatccggtacagacctgacgggcgacaaagccggtccatccgcccaagaacccggatcccaaactcctcttaaatcgatgttggtcatctctggcggtgaaggctatatcgattttcgcatgggcgacgagggaggggagtctgagcttcttggggaggacctgcccttggagccttccgtgactaaagcagagagatcacaccttatcgtttggcaagtcatgtatgggaatgaatag

SEQ ID NO: 242162 - DNA, 1908 bp, Artificial Sequence
  Description of Artificial Sequence: Synthetic coding sequence
tccctgaaagatgaactgtctgatgttagtcagggtggtagtaaagcaaccacacctgcgtctaccgccaactccgacgtggcaacgatcccaactgacaccccactgaaggaggagaatgagggctttgttaaagtgacagacgcaccaaacaaatctgaaatcagcaagcacatcgaagtccaggtcgcccaggagacacgaaacgtttccactgggagcgctgagaacgaagaaaagagcgaggtccaggcaattatcgaatctacccctgaactggacatggataaggacctgagtgggtataagggaagctccacacctactaaaggaatcgagaataaggccttcgatcggaacacagagtccctgtttgaaaaacgaagctccaccctatcccagctccccggagacaagtcaaaggccttcgactttttatcagaggagactgaggccagcttggcctcccggagagaacaaaaaagggaacagtaccgacaggtgaaggcacacgtgcagaaggaagacggcagggtacaggctttcgggtggagcctaccacagaagtacaagcaggttaccaacggccaaggagagaataaaatgaagaatctgcctgtccctgtctatctgaggcctctggacgaaaaagacacctctatgaaaaagctctggtgcgccgttggcgtgaatttgtcagggggtaaaacaagagatggcggttccgtggttggtgcgtctgtattttacaaggatgtggcaggcttagacactgagggctcaaagcagcggtctgctagccagtcgtccctcgacaagctcgatcaggagcttaaggaacagcagaaggagctgaagaaccaggaagaactctctagcctggtttggatatgtacatcaacgcactcagcgactaaggtgctcattattgatgccgtgcagcccggtaatattctcgactcgttcactgtatgtaattcacacgtcttgtgcattgccagcgtccctggagctcgtgagaccgactaccctgccggtgaagacctgagtgagtcaggccaagttgacaaagcctccctgtgcgggagcatgacttctaatagctctgctgagaccgatagtttgttgggagggatcacagttgtggggtgtagtgccgagggagtgacgggcgctgccacaagcccgagcactaatggtgccagccctgtgatggacaaacctcccgaaatggaagctgagaatagtgaggtcgatgagaacgtgccaaccgcagaagaagctacagaggcgactgagggcaacgccggatcggccgaggacacggtggatattagccagaccggggtgtacactgaacacgtctttaccgatccgcttggcgtgcagattcctgaagatctatcccccgtatatcagagctcaaatgatagtgatgcttataaggatcagataagcgtgttgcctaatgaacaggatctggtgcgtgaagaagcccagaagatgtcatccctgctaccaaccatgtggctcggtgcacaaaacggatgcttatacgtccactcaagcgtagctcaatggagaaaatgtttgcattccatcaagttgaaggacagtatactgagcatcgtgcacgtgaagggcatagtgctcgtcgccctggccgatggtaccctcgctatctttcataggggggtagatggccagtgggatctgtctaactaccacttgctggaccttgggagaccccaccactcaatcaggtgcatgactgtggtccacgacaaagtttggtgcggctaccgaaataaaatctacgtgctccattcttccctgggggacggtgctcggccatgtctgaaaactgataagcaagccaagaacagactcaaatccggatttcattag

SEQ ID NO: 242163 - DNA, 3207 bp, Artificial Sequence
  Description of Artificial Sequence: Synthetic coding sequence
agtttgaaggacgagctgagcgacgtgtcgcaaggcggaagcaaggctactacccccgcatcaactgccaattccgacgtggccacgatccctactgacactcccttgaaagaggagaacgaggggttcgtgaaagtgacagacgccccaaataaatcggagatctcaaaacatattgaggtgcaggtggcacaagagacaaggaacgtctccaccggatctgccgaaaacgaagaaaagtctgaagtgcaggccatcatcgagagtaccccagaactggacatggataaggacttatcaggctataagggctcatctacccctactaaaggaatcgagaacaaggcttttgatcggaatactgagagtttatttgaggagctatccagtgctggatcaggactaataggcgatgtggacgaaggcgctgacctgctcgggatggggagggaggttgagaatttaattctggagaatactcaactcctagaaaccaaaaacgctttgaacatcgtcaaaaacgatctgatcgccaaggtggatgagctgacatgtgaaaaggatgtccttcagggagaactggaggccgtgaagcaggccaagctgaagctagaggagaagaacagggaattggaagaggaattaagaaaggctagggctgaagccgaagatgcacgtcaaaaagcaaaggatgacgatgattcagacattcctactgcccagaggaagcgcttcacccgtgtggagatggcacgtgttctgatggaaagaaaccagtataaggagcgacttatggagctacaagaggccgtgcgctggactgaaatgattcgggcttcccgcgagaaccccgctatgcaggagaagaagcgaagttcgatatggcagtttgtgcccacacgatttagtaggctattctcgagctcttccaatactaccaagaagccagaacccccagtcaacttgaaatataacgcgccaacgagccacgtcactccctccgttaaaaagagaagctccacactttcccaactgccaggtgacaaatctaaagcttttgatttcctgagcgaagaaaccgaagcttcattggcttccagacgagagcaaaagcgtgaacagtacaggcaggtgaaggctcacgttcagaaggaggatggcagggtccaggcctttggatggtctctcccccaaaaatataagcaggtgacaaacggacagggagaaaacaaaatgaagaaccttccagtgcccgtttatctcagaccgctagacgagaaggacaccagcatgaagaaactgtggtgtgctgtcggagtgaacctatcaggaggtaagactcgcgacggcggtagcgtcgtgggagcatccgttttctacaaagacgtggccggattggataccgagggtagcaagcaaaggagtgcatctcaatcaagtctcgacaagctagatcaagagttgaaggagcagcagaaggagctcaagaatcaggaggagttgtcttcattggtatggatttgtacttctacgcatagcgctacaaaagttttgatcattgatgcggtgcagccaggcaacatactggattctttcaccgtgtgcaactcccacgtgctgtgtatcgcttcagtccccggtgcgcgtgagaccgactaccccgctggggaagacttatcagaatccggccaggtcgataaggcttcgttatgtggcagtatgacaagcaacagtagcgccgagacagactcactgctcggaggaataacagtggtgggttgcagcgctgaaggcgtgactggcgcagcaaccagcccttccaccaacggggcttcacccgtaatggataagccacccgagatggaggcagagaatagtgaagtggacgagaacgtccctaccgccgaggaggctacagaagcaacagagggcaatgccggttcggccgaggatactgtcgacatcagccagaccggcgtatataccgagcacgtgtttacagatccactgggtgtccaaattcccgaagatctttctccagtgtaccaatccagtaacgacagtgatgcctacaaggaccagatctcagtactgcctaacgaacaggacttagtgcgtgaggaggcccagaaaatgtcttcgctgctaccaacgatgtggttgggcgctcagaatggctgcctgtacgtgcacagtagtgtggcacaatggcgtaaatgcctgcactcaatcaaactgaaggactccatattgagcatagtgcatgttaagggtatcgtcctggtagccctcgccgacgggactttggctatctttcacagaggtgtggatgggcaatgggatctctccaattatcatttgttggacttggggagaccacatcactccattagatgtatgactgtggtgcatgacaaagtgtggtgtgggtaccgcaacaagatttacgttgtacagcctaaggccatgaagatcgaaaagtcattcgacgcccacccaagaaaagagagtcaggttcgccagctggcgtgggtgggggatggcgtctgggtatcaatccgcctcgactcaacactgagactttatcacgcacacacctaccagcacttacaagatgtagacatcgaaccgtacgtcagtaaaatgctgggaacaggaaaactcggcttttcatttgttcgaataaccgccctgatggtgtcttgcaatcggttgtgggtagggactgggaacggggttatcataagtattcccctgaccgagactaataagacctcaggggtgccagggaaccgacccggatccgtgatccgcgtctacggcgatgagaacagcgacaaggtgacccctggcacatttatcccctattgcagtatggcccacgctcagctctgttttcatggccaccgggacgccgtaaagtttttcgtagctgtgcccggacaagtaatttctccccagagttcctcatcaggaaccgatctgaccggggacaaagcaggcccatcagcccaggagcccggaagccagactcccttaaaatctatgctcgtgatctctggcggagagggatacatagattttcgcatgggggatgaaggaggcgagagcgaactgctgggagaggacctgcccttagagcctagcgtcaccaaggctgagcgctctcacctgattgtgtggcaggtgatgtacgggaacgaatag

SEQ ID NO: 242164 - DNA, 3237 bp, Artificial Sequence
  Description of Artificial Sequence: Synthetic coding sequence
tctgtgaaggtgtccaacagccctgagccccagaaggccgtggagcaggaagatgaactctcagacgtctcgcagggaggctcaaaggcgactaccccagcaagtaccgcaaattctgacgtagctacaattcccacggacactcccctgaaagaggagaacgagggctttgtgaaggttactgatgctccaaataagagtgaaatttccaagcacatagaggtgcaggtggcacaggaaaccagaaatgtctcgaccggcagcgcagaaaatgaggaaaaatctgaggtgcaggccatcatcgaaagtacccctgaactggacatggataaggatctgtctggctacaaaggtagttctacgcctacaaaagggattgagaataaagcgtttgatcgtaacactgagagcctcttcgaggagctaagcagtgcagggagcggtctcataggtgacgtagacgagggcgctgacctcttggggatgggccgagaggtggaaaacctcattttggaaaacacccagttgcttgaaactaaaaacgcccttaacatcgtgaagaacgatctaattgccaaagttgatgagcttacctgcgagaaggatgtcttgcagggcgaactggaagctgtgaagcaggcaaagctgaaactggaagaaaagaaccgtgagcttgaagaggagctcagaaaggccagagccgaagccgaagacgcgcgacagaaagctaaagatgacgacgactcagacatccctactgcccagcgcaaacgatttactagagtggagatggccagagtgcttatggaaagaaatcagtataaagagcgcttgatggaactgcaggaggctgtcaggtggacagagatgattcgggcatctcgagagaaccctgccatgcaggagaaaaagcgttcttccatctggcagtttttctctcggctgttttccagctctagcaatacaaccaagaaacccgagcccccagtgaacctcaaatataacgcacctactagccacgtgaccccgtctgtcaaaaagcgcagctcgactctaagccagctgcccggagacaagagtaaggcctttgactttctgagtgaagagaccgaagcttctctcgcatccagacgcgagcagaaaagagagcagtatagacaagtcaaggcgcacgtgcagaaggaggacggcagagtccaagcctttggctggagtcttccacaaaagtataagcaggtgacaaacggacagggagaaaataaaatgaagaacctgcccgtaccagtttacctcagaccactcgacgagaaggacacttcaatgaagaagctgtggtgtgccgtgggcgtaaacctatcaggcggtaagacccgtgacggcggaagcgtcgtgggagcgtccgtgttttacaaagacgtggcaggcctggatacagaagggtccaaacagaggtccgcgtcacagtcttctttggataagttagatcaggaactgaaggagcagcaaaaagagttaaaaaaccaggaagagctgagttccctcgtctggatttgcaccagcactcacagtgcaaccaaagtacttatcatcgacgcggtgcaacctggtaatatactggattcctttacagtttgcaactcgcatgtgttgtgcatcgcgagcgtgcctggggctagagagacggattaccctgcaggggaagacctgtcagaaagcgggcaggtggacaaagctagtttatgtggctctatgacttccaatagttccgctgagacggacagccttctcgggggtatcactgtcgtagggtgtagcgctgagggggtaacaggtgccgctacctcccccagtacgaacggtgctagtccagtcatggataagccccctgagatggaggccgagaactccgaagtggatgagaatgttcctactgctgaagaagccactgaagcgacagagggcaacgctggaagtgctgaagacaccgttgatattagtcaaacgggagtctataccgaacacgtgttcactgacccgctaggcgtgcagatcccagaggatctgtcacccgtctaccagtcgagcaatgactccgacgcgtacaaggaccagatctcggtgctgccaaacgagcaagacctggttagggaagaggcccaaaaaatgtcctcacttttaccgaccatgtggcttggagcccagaacgggtgtctgtacgtgcatagttccgtggctcagtggagaaagtgcttgcactcgatcaagttaaaggactccatcttgtctatcgtgcatgttaagggcatagtgttagtggcattggccgatgggacactggcgatcttccaccgtggagtcgacggccaatgggacctctccaactaccatctcctagatcttggccgtccacaccattctatccgttgtatgaccgtggtccacgacaaggtctggtgcggttaccgcaataagatctatgtggttcagccaaaagccatgaaaattgagaaaagcttcgacgcacacccacgtaaagaaagtcaagtacgccagcttgcctgggtgggagatggagtatgggtgagtatccggctcgactccacactccggctgtaccacgcccacacgtatcagcatcttcaggacgtggatatcgaaccctacgtgtccaagatgctcgggactggaaagctgggcttctcgttcgtgagaattactgccctcatggtctcttgtaatcgcctatgggtgggcactggtaatggggttattatttctatccccctgactgagactaataagacttccggcgtgcccggaaaccgccctgggtccgtaattcgggtgtacggcgacgagaactccgacaaagtgacccctggaaccttcattccatactgttccatggcgcatgcccagttgtgctttcacgggcaccgagatgcagtgaagttcttcgtggctgttcctggtcaagtgatttccccccagagtagttccagcggtacagatctgaccggagacaaagccggaccttctgcccaagaacctggttcacagacgcccctaaagtctatgctcgtcattagcggtggagagggctacatagatttcaggatgggcgatgaggggggtgaatcagagttgctaggagaagatctgccccttgagccttcggtaaccaaggccgaaaggagccaccttatagtttggcaggtgatgtacggaaatgagtag

SEQ ID NO: 242165 - DNA, 3936 bp, Artificial Sequence
  Description of Artificial Sequence: Synthetic coding sequence
atggaactggaagacggggttgtgtaccaggaagaacctggagggtccggggctgtcatgagcgagcgggtatctggcctcgctggctcgatataccgggaattcgagcggcttattggcaggtatgacgaggaagtggtcaaggagttgatgccgcttgtggtcgccgtcctggaaaacttggactctgtgtttgcccaggatcaggagcatcaggttgaactagaactactgcgggacgataacgaacaactgatcacacaatatgaacgcgagaaggcactgaggaagcacgctgaagaaaaattcatcgagttcgaagattctcaggaacaggagaaaaaagacctgcaaacccgggtcgaatctctggagagtcagacgcgccagctggagctgaaagctaagaactacgccgaccagattagccgcctcgaagagcgagaggctgagctcaaaaaggaatacaatgccctgcatcaacgccacactgaaatgattcataactatatggagcatctggaacggacaaaactccatcagctttcgggctctgatcaactggagtccactgcccacagtcggattagaaaagaacgccctatctccctgggcatcttccccttgcctgccggagacggcttactgacacccgacgcccaaaaaggcggtgaaacccccggtagtgagcaatggaagttccaggaactaagccaaccccgaagccataccagcttaaaggatgaactatccgatgtgagtcaaggcggtagcaaggcaactacgcccgcatcaacggctaactccgatgtggctacaattcccaccgacactccactaaaggaggagaatgaaggatttgttaaagtgactgacgcaccaaataagagtgagataagcaagcatatcgaggttcaggtagctcaggaaactcgcaacgtttccactgggagcgcggaaaacgaggagaagtccgaagtgcaggccattattgagtctacacccgaattagacatggataaggacctttcaggttacaaaggaagttctactcctactaaagggattgagaataaagccttcgaccgcaacaccgagagcctctttgaggaactgagctcagccggatccggcctcattggagacgtagatgagggcgcagacctcctcggtatgggtagagaggtggagaatctgattctcgagaatacccaactcctggaaaccaagaatgcactgaatattgttaagaacgacctcatagcgaaggtggacgagctgacatgtgagaaggatgttctgcagggtgaactcgaagccgttaagcaggccaagttaaaactggaggagaagaatcgggaactcgaagaagaattacggaaggcacgtgccgaagctgaggatgctcgtcagaaggcgaaagatgacgacgactcagacatcccaaccgcccagagaaagagatttaccagggtggaaatggctcgagtcctgatggaaaggaaccagtacaaggagagacttatggagctgcaggaggccgtgaggtggacagaaatgatccgcgcttcccgagagaacccggctatgcaagaaaaaaaacgctctagcatctggcagtttgttcccacacgtttctcacggcttttcagctctagctctaacaccacaaaaaagccagaaccccctgtaaacctgaagtataacgcacctaccagccatgtgaccccaagcgttaaaaagagaagcagcactctctcacagctgccaggcgataagagtaaggctttcgactttcttagcgaagagaccgaagctagtctggccagcagaagagaacagaaaagggagcagtataggcaggttaaagctcacgtgcaaaaggaggacggcagagttcaggcctttggctggtccttgccacagaagtacaagcaggttactaacggtcagggcgagaacaaaatgaaaaatttgcccgtgcccgtttacttgcgacccctcgacgagaaggatacctctatgaaactgtggtgtgctgtcggggtcaacctgagcgggggaaaaacacgggatgggggttctgttgtaggtgccagcgtgttctacaaggatgtggccggtctggatactgaaggcagcaagcaacggtccgcctcccaatccagcctggacaagttggaccaggagctgaaagaacaacagaaagagctaaagaaccaggaagagcttagttcgctggtatggatttgcacatcgacccatagcgcgactaaagtcctcatcatcgacgcagtgcaaccaggaaatatcctggactcttttacagtgtgcaactcacatgtgctgtgtatcgcttcagtgccgggtgcacgagagactgactaccctgccggtgaagatctgtcagaaagcggccaggtcgacaaggcgagcttatgcggtagcatgacctccaattcctcagccgagactgattccctgctaggcggtatcaccgttgtggggtgttctgcggaaggcgtgaccggcgctgcgacctccccttcaaccaacggggcatctcctgtgatggataagccacccgagatggaggcggaaaattctgaagtcgacgagaatgtgccaacggctgaagaggcaaccgaggctactgaagggaatgccggtagcgccgaagatacagtagatattagccagaccggggtctacacggagcatgtctttaccgatccccttggggttcagatacctgaagacctctcacctgtgtaccagtcatccaatgattccgatgcatacaaggaccaaatatccgtgttaccgaatgagcaagatctggttagggaggaggcccagaaaatgtcaagcctgctgcctacgatgtggttgggggctcagaacggctgtctctatgtgcactcgtctgtagcccagtggagaaaatgtctacacagcattaagctcaaagactcaatcctgagcattgtgcatgttaagggaattgtactcgtagcattggccgacgggacactggcgatctttcaccgcggagtcgatgggcaatgggaccttagcaattaccatttgctggacctgggcagacctcatcatagtattcgttgcatgaccgttgtccacgacaaggtgtggtgcgggtaccgcaataagatttatgttgtccagcccaaagcgatgaaaatcgagaaaagtttcgatgcccaccctaggaaagagagccaagtccgccagctagcctgggtgggggatggagtttgggtgtctattaggttggactctacactccgtttatatcacgcccacacctaccaacacctgcaagatgtcgacattgaaccttacgtatccaagatgttgggtaccggtaaattaggattctcttttgtgagaattaccgctctgatggtttcttgtaatcgactgtgggtggggacaggaaatggagtgatcatttctattcccctgaccgagaccaacaagacaagcggagtcccgggtaacagacccggttccgtgattcgggtgtacggcgacgagaattccgacaaagtgacccccggtacctttattccgtactgcagtatggcccacgcccagctgtgttttcatggacaccgggatgcagtgaaattcttcgtggccgtgcccggacaggtgatcagtccccaatctagttcgtcaggaacagatctaaccggcgacaaggccggaccttccgcacaagagcctgggtcacagacccctttgaagagtatgctggtgatctcgggcggtgaggggtatattgatttcagaatgggcgacgaaggaggcgagtcagagctcctgggagaggatttacctctggaaccgtcagtcaccaaagccgaaagaagtcacctgatcgtttggcaggtaatgtacggaaacgagtag

SEQ ID NO: 242166 - DNA, 3534 bp, Artificial Sequence
  Description of Artificial Sequence: Synthetic coding sequence
atgagcccaggctgcatgcttctgttcgtgtttggatttgtaggaggagcagtagtgatcaactcagcaatcctggtgtctctctctgtgctcctactagtgcattttagtatatcaacaggtgtcccagcactgactcagaacctgccacgcatcttgaggaaggagcgtccaattagtcttggcatcttccctctccccgctggtgatgggttgctgacaccagatgcccagaaggggggtgagactcctgggtcggagcaatggaagtttcaggagttgtcacagccaaggtcacatacaagtttgaaggatgagctgtcagatgtatcccaaggagggagcaaggccactaccccggcaagtaccgcgaacagcgatgtcgccacaatcccaacagatacaccacttaaagaggagaacgaagggttcgttaaagtaactgacgccccaaacaagtccgaaataagcaagcatatcgaagtacaggtcgcccaggagacccgcaacgtcagcaccgggtcagccgagaatgaggagaagagcgaggttcaggcaattattgaatccaccccggagctggacatggataaggatctatctggatacaagggctcgagcaccccgaccaaggggatagagaataaggctttcgacagaaacaccgagtcacttttcgaggagctgagttcagctggatctggcctgatcggggacgtggatgaaggagccgatttactgggcatgggaagggaagtggagaacttgatcctcgagaacacccagttgcttgaaaccaaaaatgcactgaatattgtgaagaacgacttgatcgccaaggtggatgaactcacttgcgagaaggacgtactgcagggcgagttggaagccgtgaagcaggctaagcttaaacttgaagaaaagaaccgagaattggaagaagagctgcgaaaagcacgcgcagaggccgaggatgctcgtcaaaaggcaaaggacgatgatgactccgacataccgacagcccaacggaagcggttcacgcgtgtggaaatggcacgagttctgatggaacgcaaccaatataaagaaagactgatggaactccaagaggcagtccgctggaccgagatgatccgcgcttcacgagagaatccggcaatgcaggagaagaagcgaagcagcatctggcaattctttagcaggctgttctcctcctcctccaatacgacaaagaagccagagcccccagtgaatctgaagtacaatgcaccgacatcccacgtgacaccatcggtcaaaaagagaagcagcaccctcagccagctcccaggcgataaatccaaggctttcgacttcctgagtgaggaaacggaggcatcgctcgccagccgcagagagcaaaagcgggagcagtaccgacaggtgaaggcacacgtccaaaaagaagacgggagggtgcaggctttcggctggtctctgccccagaagtataaacaagtgactaacgggcaaggcgagaacaagatgaaaaatctgcccgtgcctgtgtacctccgcccactcgacgagaaagatacctcaatgaagttatggtgtgctgttggggtgaatctgagtggcggtaagacccgcgacgggggaagcgtagtaggggctagtgtattctataaggatgttgcaggattggataccgaggggtccaaacaaagaagtgctagccagagcagcctggacaagcttgatcaggagttgaaggaacagcagaaagaactgaaaaaccaagaagagctgagttccctggtctggatatgtacatccacccactcggctacgaaagtgcttatcatcgacgccgtgcaacctggaaacatattagattcatttactgtatgtaattcccacgttctctgtattgcgtccgttccaggtgccagggagactgattacccagccggagaggacctgagtgagagtgggcaggttgataaagccagcttatgtggaagcatgacttcgaattcaagcgccgaaactgactcattgctgggtggcataactgtcgtggggtgtagcgcggagggagtcaccggggcagccaccagcccaagtaccaacggtgcatcgcccgtgatggataaaccgcctgagatggaagccgagaatagcgaagttgatgagaatgtaccaactgctgaggaagcaactgaagcaaccgaaggaaacgccggaagcgccgaggacacggtcgatatcagccaaaccggcgtgtataccgaacatgtttttacagatccgctgggagtccagattcccgaagatttgtctcctgtataccagtctagcaatgattcagacgcttataaagaccagatttctgtgttgccaaacgagcaggacctggtgcgggaagaagctcagaaaatgtctagccttctcccaaccatgtggctgggagctcagaatggctgtttatacgtgcactctagcgtggcccagtggcgcaaatgtctgcatagtattaagctgaaagatagcatactgtccattgttcatgtgaagggtattgttctggtggcgctggctgatggaaccttggccatcttccacaggggggttgacgggcaatgggacctgtctaactaccacctgctggacctgggacggccacaccatagcatccgctgtatgactgtggtgcatgataaggtgtggtgcggatatcgaaataagatatacgtcgtgcagccaaaggcgatgaaaatagaaaagtctttcgacgctcacccgaggaaagagtcccaggttagacagctggcctgggtgggtgacggcgtgtgggtatccattcgcctggatagtacgctccggctgtatcacgcacacacctatcaacatttgcaagatgtggacatcgagccgtacgtttctaagatgttaggcaccggcaaactgggatttagcttcgtccgaatcactgcactgatggtcagttgtaaccgtttgtgggtggggacggggaatggcgtgattatcagcattcctctgactgagaccgttatccttcatcagggcagattgcttggccttcgagcaaataaaacttccggagtgcctggtaaccgccctggcagtgtcatccgcgtctatggtgacgagaatagcgacaaagtcacacccggaacttttattccttactgcagtatggcgcatgcccagctttgctttcacggacaccgtgatgcagtcaaatttttcgtggccgtgcccggtcaggtgataagccctcagtcatctagctccggcacggacttaacaggcgacaaagccggaccttcagcacaggagccagggtctcagacaccactgaagtcgatgctagtcatctccggaggggagggctatattgatttccgcatgggagatgagggaggggagagcgaactcctcggtgaggatctccccctggagccttctgtgactaaggccgagaggagccacctcattgtgtggcaagtgatgtacggtaatgagtag

SEQ ID NO: 242167 - DNA, 2760 bp, Artificial Sequence
  Description of Artificial Sequence: Synthetic coding sequence
atggtgatgcgatggggggaacgcaacgatgtgatagcttgggaacttctgcaggatggggtggaaaacgccttgaacatcgtgaaaaatgacctcatcgccaaggtagatgagctgacttgcgagaaggatgtgctccagggcgaactggaggccgttaagcaggctaaactgaaattggaagagaagaaccgcgagcttgaggaggagctgaggaaggctagagcagaagctgaggacgcgaggcaaaaggctaaagatgacgacgattccgacatcccaacggctcagagaaaaaggtttacccgggttgagatggcccgagtgctgatggagagaaaccagtacaaggaacgcctcatggagttgcaggaggccgtccgctggaccgagatgatccgggctagccgcgaaaacccagccatgcaagagaagaagaggtcctcaatatggcaattcttttcaaggctgttcagcagttcctccaatacaaccaaaaagcccgaacccccagtcaatttaaaatacaatgctcccacgtcgcatgtcactccgtcagtgaaaaaaaggagctccaccctgagccagttgcccggagataaatcaaaagcatttgatttcttgtcagaggaaactgaggcttctttggcaagtagacgcgaacagaagagagagcaatatagacaagtaaaggcacacgtacagaaggaggacggtagagtccaagcgttcggttggtctctcccacagaagtacaagcaagtgacaaacggccagggcgagaacaaaatgaaaaaccttccggttcccgtgtacctgagaccgttagatgaaaaggacactagtatgaaattgtggtgcgctgtaggcgtcaatttgtcgggaggcaaaacacgggatggagggagcgttgtaggggcaagcgtgttctataaggacgtcgcaggcttagacaccgagggatccaagcagaggtcggcgtcccagtcatccctcgacaaactggatcaggagctgaaagaacagcagaaggaattaaagaatcaggaggaactcagcagtctagtgtggatttgtacaagcacgcactcagcaaccaaggtgcttatcatcgatgctgttcagcccggaaatatactggattcatttacagtttgcaattcccacgtcctctgcatcgcttccgtccccggagcgcgagaaacggattaccctgcgggtgaggacctgtcagagtccggccaggttgataaagcttctctgtgcggctctatgacatccaacagttccgctgaaaccgatagcctactgggcggaatcactgtcgttggatgctctgctgagggagttaccggcgctgccacctcaccctccacaaacggcgcttctcccgtgatggacaagccacccgaaatggaggcagaaaattccgaggtggacgagaatgtgcccactgccgaagaagccacagaggcaacagaggggaacgctgggtcagccgaagatactgtcgatatttctcagaccggagtctatactgagcatgttttcaccgatcccttaggggtccagatccctgaggacttgagtcccgtgtaccagtcatccaacgatagcgacgcgtacaaggaccagatttcagtcttgccgaacgagcaggatcttgtcagggaggaggcccagaagatgtccagccttctgcccacaatgtggctcggggctcagaatggctgcttgtacgtccattccagcgtcgcacaatggcgaaagtgcctgcacagcatcaaacttaaggacagcattttgagcattgtccatgtgaaaggcatcgtgttggtcgccctagccgacggcaccctcgcgattttccacagaggtgtggatgggcagtgggatctgtcaaattatcacctcctggatctcgggaggccacaccactcgatcagatgcatgaccgttgttcacgataaggtctggtgcgggtatcggaataagatttacgtcgtccagcccaaggccatgaagatcgagaagtctttcgatgcccatcccaggaaggagtcccaagttcgccaactggcatgggtcggagacggtgtgtgggtatcaatccgtttggactctactcttcgcctttaccatgcccatacctaccagcacctccaagacgtcgacatcgagccatatgtttcgaagatgcttgggaccgggaaactcgggttttccttcgtgagaatcacagcgttgatggttagctgtaaccgactctgggtaggcacagggaacggggtgatcattagcattcccctgaccgaaaccaataagaccagtggcgtacccggaaataggcctgggtcagtcatccgagtttatggtgacgaaaactccgacaaagtaaccccagggacattcattccctattgtagcatggcccacgcccagctttgcttccacgggcaccgggacgccgtgaagttcttcgttgctgtgccaggacaggtgatttctcctcagtcctcaagcagtggtacggacctgacgggggataaggccggtccatcagcgcaagagcctgggagccagaccccacttaagagcatgctcgtcataagcggcggagagggatatatcgatttccgaatgggtgacgagggtggggagtctgagctcctcggggaggacctgccacttgaaccatccgttacaaaagctgaacgaagtcatttgattgtttggcaagtcatgtacgggaatgaatag

SEQ ID NO: 242168 - DNA, 825 bp, Artificial Sequence
  Description of Artificial Sequence: Synthetic coding sequence
atggaactcgaagatggagtggtgtatcaggaggagccaggcggatccggcgctgtgatgtcggaacgagtgagcggtcttgccggtagcatctaccgtgagttcgagcggttaattggcaggtacgatgaagaagtggtgaaagaattgatgcctttagtagtggctgtgttagagaatctggacagcgtgttcgcccaagaccaggaacaccaggtcgaacttgagctcctccgggatgataatgaacagctcataacacagtacgagcgggaaaaggctctaagaaaacatgcagaggagaagttcattgagttcgaggatagtcaggagcaggagaagaaagatctacaaactcgggtggaaagcttggagtcccagacaaggcagctcgaactgaaggccaagaattatgctgaccagagcgctatgagccctggctgtatgcttctgttcgttttcggcttcgttggcggagctgtggttatcaactctgcaattttggtgtctttatctgtactcctgctggtgcacttctccattagcactggcgtccccgctttaacccaaaatctgccccgaattctccgcaaagagcgtcctatcagtctaggaattttcccactgccagcaggcgacggcctgctgacacctgacgcccagaaaggcggtgagacacccggatctgagcagtggaaattccaagaactgtcacagcctcggtcccacacaagcctgaaagtatccaactcgccagagcctcagaaagccgtcgagcaagaagtccgaatggtgctgttgaacattctgcagaaagtttattag

SEQ ID NO: 242169 - DNA, 1053 bp, Artificial Sequence
  Description of Artificial Sequence: Synthetic coding sequence
atgaagccattagttctcttagtcgcacttctgctctggccctctagtgtgcccgcatatccctccattaccgtaactcccgatgaagagcagaatctcaatcactacattcaagtgctcgaaaaccttgtgaggtccgtcccgagcggggaacctggaagggagaaaaaaagcaactctccgaagcacgtgtactctattgccagcaagggctctaagttcaaagagttagtgacccatggggatgccagtacagagaacgatgttttgacaaatcccatctctgaggaaacaaccaccttccccaccggtggttttactcccgagataggcaaaaagaagcatactgaaagcaccccattctggagtattaaacccaacaatgtgagtattgttctgcacgctgaggagccatatatcgaaaacgaggagcctgaacctgagcccgaacctgccgcaaaacaaactgaggccccaaggatgcttcccgtggtgaccgaaagtagcacctctccttacgttacctcatataagagcccagttaccacactggacaagtctaccggaataggaatttccactgaatctgaggatgtgccccaactttctggcgagaccgctatcgaaaagccagaggaatttggaaaacaccctgaaagctggaacaatgatgatatcctcaaaaaaatcctggacattaacagtcaggtacagcaggcgctgctgagtgataccagcaatcccgcttatagagaagacatcgaagcaagcaaggatcatctcaagcgcagcctcgcccttgcggctgctgctgagcataagttgaagaccatgtataagtcgcagctactccccgttggacggacatcgaataaaatcgacgacatcgagaccgttattaacatgctgtgcaattctcgttcgaagttgtatgaatacttggacatcaaatgcgtcccccctgaaatgcgggagaaggcggcaacagtgtttaacacccttaagaatatgtgccgctcacgtcgtgtgactgccctgctcaaggtctactag

SEQ ID NO: 242170 - DNA, 711 bp, Artificial Sequence
  Description of Artificial Sequence: Synthetic coding sequence
atggccagctctgtggacgaggaggccctacaccaactgtatctttgggtggataacatccctttaagccggcctaaacgaaacctgagcagagacttctcagacggagtgctggttgcggaagttattaagttttattttcctaagatggtcgagatgcataactatgtgccggctaactcgctacagcagaagttatctaattgggggcacctgaatagaaaggtgcttaagcggttgaacttcagtgtgccagatgacgttatgagaaagattgcccagtgcgccccaggcgtggtagagctagtactgattccactgagacagcgcttggaagagaggcagagaaggcggaaacagggagcaggcagccttcaagagcttgccccacaagatggtagcggctacatggacgtcggagtgtcacagaaggccaggggcgagggagtaccagacccacaggggggagggcagttgtcatgggatagaccaccagcacctcgcccacctgcatacaatcgcgctttgcaaggggacccttctttcgtactccagattgccgaaaaggagcaggagctgctcgctagccaggaaacggtgcaggtgctgcaaatgaaggtccgcagactggagcacctgctgcagttgaaaaatgtgagaatcgaagatctcagcaggcgtctccaacaagctgaacggaagcagcgatag

SEQ ID NO: 242171 - DNA, 351 bp, Artificial Sequence
  Description of Artificial Sequence: Synthetic coding sequence
atgtgcgatcagacaaagcattctaagtgttgtccagcaaagggaaaccagtgctgcccacctcagcaaaatcagtgttgtcaatctaaaggcaatcagtgctgccctcctaagcagaatcagtgctgccaacctaagggaagtcagtgttgtccccctaagcataaccactgctgtcagccgaagcctccttgttgcattcaagcacggtgttgcggcctggagaccaaaccagaggtctcacctcttaacatggagagtgagcccaattcaccacaaacgcaggataagggctgccagactcaacagcagccccacagtccacagaacgaatctagaccatccaaatag

SEQ ID NO: 242172 - DNA, 294 bp, Artificial Sequence
  Description of Artificial Sequence: Synthetic coding sequence
atggataaacagtcaagtgctgggggagtgaaacggtccgtgccctgcgactcaaacgaggcaaatgagatgatgcctgaaacgcccactggggattccgacccgcagcctgctcccaagaagatgaagacatctgagagctccacaatcctcgtggtacgataccgcaggaacttcaaaagaacgagccctgaagaactcttaaacgatcacgcccgagagaatcgtattaatccccttcagatggaggaggaggaattcatggaaatcatggtagagattcccgctaagtag

SEQ ID NO: 242173 - DNA, 2019 bp, Artificial Sequence
  Description of Artificial Sequence: Synthetic coding sequence
atgcggagtattcggtcctttgctaatgatgaccgtcatgtcatggtcaagcattccacaatttatccttctccagaggaattggaagcagtgcagaacatggtgagtacagtcgagtgtgctctgaagcacgtctctgattggctagacgaaaccaataagggtactaagactgagggggaaactgaggtgaagaaagatgaagctggggaaaattatagcaaagaccagggcggaagaaccctgtgtggtgtcatgaggatcggattagtcgcgaagggactgttgatcaaagacgatatggacctggagctcgttctcatgtgcaaggacaaaccaaccgaaactctgctaaatacggtgaaagacaacttgcctattcaaattcagaagttgaccgaagaaaagtaccaggtcgagcaatgcgtaaacgaggccagtattatcatcagaaacaccaaagaacctacactcaccctaaaagtgatactgacctccccactaatccgagacgagctagagaagaaagacggagaaaacgtgtccatgaaggacccacctgatttactcgacagacaaaaatgcttgaacgctctagcctctttgcggcatgctaaatggttccaggctagggccaacggcttaaaatcttgcgtcattgtgctgaggattttacgcgatctttgcaacagagtgcccacatgggcgcctcttaaaggatggccacttgaactgatctgcgagaaatctattggaacatgtaaccggcctttaggcgcaggcgaagctctcaggagagttatggaatgccttgccagcggtatcttgctgccagggggacctggccttcacgacccgtgtgaacgcgacccaaccgacgccctaagctacatgactattcagcagaaggaagacattactcactctgcacagcacgccctgcggctgtccgcctttggccagatctataaagtgctagaaatggaccccctaccaagcagtaaacctttccagaaatactcatggtctgtgaccgacaaggaaggtgcgggttcaagcgctctgaaaagaccttttgaggatgggctcggggacgataaagatcctaacaagaaaatgaagaggaacctgcgcaaaattttagatagcaaggccattgacttgatgaacgccctcatgcggctgaatcagatccgcccaggcctgcaatataaattgctttcccagtccgggccagtccacgccccagtgttcactatgagcgtggacgtggacgggaccacgtatgaggcttcgggtccttcaaagaaaacagccaaactacacgtcgccgtgaaggtactgcaggcaatgggatatcctactggatttgatgctgatatcgagtgcatgtctagtgatgagaaatctgacaacgaaagcaagaatgaaacagtgagctcaaattccagtaataatactggcaacagcaccacagagacctccagtacactggaggtcagaacccaggggccaatactgactgcgagtggaaagaatccagtgatggagttgaacgaaaaacgcaggggtctgaaatacgagctaatatccgaaaccgggggatctcacgacaagcggttcgttatggaggttgaggttgacggccagaagttccggggagctggaccgaacaaaaaggtggcaaaggcctctgccgcactggcagccttagaaaagctcttcagtggacccaatgctgcaaataacaagaaaaagaagattataccccaagctaaaggggtggtcaacacagctgtgagtgcagccgtgcaagcagtcaggggacggggtagaggtaccctgactagaggagcctttgttggcgctaccgccgctcctggctatatcgcccctgggtatgggactccatacgggtattcaacagccgctcccgcttacggcttaccaaaacgcatggttttactgcccgtaatgaagtttcctacttatcccgtgccccactactctttcttttag

SEQ ID NO: 242174 - DNA, 1977 bp, Artificial Sequence
  Description of Artificial Sequence: Synthetic coding sequence
atggtgaagcattccacaatctacccaagcccagaagagctggaggcagtgcagaatatggtgagcacagtggagtgtgctctaaagcacgtgtcagattggttggatgaaacaaacaaggggaccaaaaccgagggcgaaaccgaggtgaagaaagatgaggcaggtgagaattacagcaaagatcagggaggccgaacactgtgcggcgtaatgcgaatcggcctagtggcaaaggggttgttgatcaaagacgatatggacctggaacttgttctgatgtgcaaagacaaaccgacagagacactactgaacacagtgaaggacaatctccccattcagattcagaaacttaccgaggaaaagtaccaggtggagcaatgtgtgaacgaagcctccattatcatccgcaatacgaaggaacccaccctgactctgaaagtaatcctgacctccccgttgatcagggatgaactcgagaaaaaagatggtgagaatgttagcatgaaagaccctccagatttgctagaccgccagaagtgcctgaatgccctggcaagcctcagacacgctaaatggttccaggcccgagcaaacggattaaaatcctgcgtgattgtgctgaggatccttagagacctctgcaaccgggttccgacttgggccccactcaagggctggcctctggagctgatctgcgaaaagtctattggcacttgtaaccgccctctcggcgctggcgaggcccttaggagagtcatggaatgcctcgcgagtggtatcctcctccctggcggacctggactccacgatccttgtgagcgagatcccactgacgctctatcatacatgactatccaacagaaagaggacatcacacactcagctcagcacgcactgcgcttgtcagctttcgggcagatttacaaggttcttgagatggatcccctcccatccagcaagccattccagaagtactcttggagcgttactgataaggagggcgctggttccagtgctctgaagaggccgttcgaggacggtctcggggacgacaaagatccgaataagaagatgaagaggaatctgcgcaagattctcgacagcaaagctatcgacctgatgaatgcgctaatgcgattgaatcagatccgccctggactgcagtacaagctgctgagccagtccggcccagtccatgcccctgtgttcaccatgagcgtggatgttgatggaacaacatatgaagcttcaggaccgtcaaaaaaaacagccaagctacatgtggcggtcaaggtgctgcaggcaatgggctacccgactggcttcgacgccgatatcgagtgtatgtcaagtgacgaaaaatcagacaacgagtcgaagaatgaaacagtgagctctaatagttctaacaacacgggtaatagtacgactgagacatctagcaccctggaggtgcggactcaaggtcccatcttaacagccagcgggaagaaccccgtcatggagttgaatgagaagcgtcggggtttgaagtacgagttaattagcgagacgggcggaagccatgacaaaaggtttgtcatggaagtggaggtggacggacaaaagtttcgcggtgcagggccaaacaagaaagtggcaaaggcctccgccgcactggctgcgctggagaaactgttttccggcccaaatgccgcaaataacaaaaaaaaaaaaatcatccctcaggccaaaggagttgtgaatacggcagtgagcgcggctgtgcaagcagtgaggggacggggacgcggtacactaacgcgcggtgctttcgtgggagccacagcagcccctggttacatagctccgggttacggcaccccctatggatatagtactgccgctcctgcttacggtcttccaaaacgcatggtcctgttgcccgtaatgaaatttcctacatatcctgttcctcactatagcttcttttag

SEQ ID NO: 242175 - DNA, 285 bp, Artificial Sequence
  Description of Artificial Sequence: Synthetic coding sequence
atgcgcagcatccgaagcttcgccaacgatgaccgccatgttatggtgaagcactccaccatctacccctccccagaagagctggaagccgtccagaatatggtttccaccgtggagtgcgcactgaagcatgtgtccgattggttggacgaaactaataaaggcacaaagactgagggcgaaacggaggtgaaaaaagacgaggctggggagaactattccaaatggagcgacatagtctggtgtaacgaagactggccgggttgtaagcgcctcgctgactag

SEQ ID NO: 242176 - DNA, 2019 bp, Artificial Sequence
  Description of Artificial Sequence: Synthetic coding sequence
atgagatccataagaagcttcgcaaacgacgacaggcacgtcatggttaaacattcaacgatttatccttcaccagaggagctggaggccgttcagaatatggtctctacagtggaatgcgctctgaaacatgtgtctgattggctagacgaaacaaacaaaggtacgaagaccgaaggcgagacagaggtgaagaaagacgaagcaggcgagaactactctaaggaccaggggggaaggaccctgtgcggggtcatgaggatcgggctggtcgcgaagggccttctgatcaaagacgacatggacctagaactagtgttaatgtgcaaggacaaacctaccgaaactctcctgaataccgttaaggacaacctcccgattcaaattcaaaagctgactgaagaaaaatatcaagtagaacagtgtgtgaatgaagcctcgattatcatccgaaacacaaaagaacccacattaacattaaaggtgattctcacaagtcctctaattagggacgaattggagaaaaaggacggggagaatgtgtctatgaaggatcctccggacctcctagatagacaaaaatgcctgaacgctctggctagtctgcgccacgcgaaatggtttcaggccagggcaaacggcctcaagtcatgtgtcatcgtcctgcgcatcttgagagatttgtgtaaccgtgtgcccacgtgggcccctcttaaagggtggcccctcgagctgatttgtgagaagagtatcggcacttgtaataggccactgggcgcaggcgaggccctccgccgtgtcatggaatgcctcgcctccggcattctgttaccgggagggcctggtctgcacgatccatgcgaacgggaccccaccgacgccctctcctatatgacaatccagcagaaggaggatataacacacagcgcccaacacgctctgaggttaagtgccttcggccagatatataaagttctcgagatggaccccctgcccagcagtaagccatttcaaaaatacagctggagtgtgactgacaaggagggagcaggctcttctgcactgaagaggcctttcgaggacggcctgggagatgataaggatccaaacaagaagatgaaaagaaatctgagaaaaattctcgattcgaaagccatcgatctaatgaatgcgttgatgagactgaatcagatccgtccgggtctccagtataaactactgtctcaaagcggacctgtccacgctccagtctttacaatgtcagttgacgtagatggaacgacttacgaagcttctggtccttccaaaaaaactgccaaacttcatgtggcagtgaaagtcctgcaggccatgggttacccaactggctttgatgctgatatcgagtgcatgtccagcgacgagaagtctgacaacgaatcgaagaatgagactgtttcttcgaactcttctaataacacaggtaacagtaccactgagacgagcagtaccctggaagtgagaacacagggaccaattctcactgcaagcggcaaaaatccggtcatggagctgaatgagaagcgcagaggactcaagtatgagttaatcagcgaaacaggcggaagccacgacaagcgctttgtaatggaagtggaggtcgatggtcagaaatttagaggggctgggcctaacaaaaaagtagccaaagccagtgccgctctggccgcactggagaaattatttagcgggccaaatgccgctaacaacaagaagaaaaagatcatacctcaggccaaaggtgttgtgaacacagccgtttccgcggctgtacaggcagtgcggggtagggggagggggactttgacccgcggtgcattcgtgggcgcaacagccgcacccggatacatagcgccaggctacgggaccccatacggctacagtaccgccgcacctgcatatgggctgccaaaaagaatggtgctccttccagttatgaaatttccaacttatcctgtgcctcactattcctttttctag

SEQ ID NO: 242177 - DNA, 225 bp, Artificial Sequence
  Description of Artificial Sequence: Synthetic coding sequence
atgcggtccatcagaagctttgctaacgatgatcgtcacgtcatggttaagcatagtaccatctacccatcaccagaggagctggaggccgtgcagaacatggtgtctaccgtggagtgtgctctcaaacacgtctccgattggctggatgagacaaacaaaggaacaaagacggaaggggaaaccgaggtcaagaaggacgaggccggtgaaaactattcctag

SEQ ID NO: 242178 - DNA, 1776 bp, Artificial Sequence
  Description of Artificial Sequence: Synthetic coding sequence
atgtccctcctaacaaactatgagggccttcgccaccagatcgaacgtctggtgcgcgaaaatgaagagctaaagaaactcgtgcgacttatcagggagaaccatgagctgaaaagcgcaatcaagactcaggccggtggtctgggcatctcggggttcacatcgggccttggggaagccacggccggactttcatcgagacagaacaatggagtcttcttgcccccttccccagcagtggctaacgaacgcgtgctggaagaagtggggatcatggccctagcacccctggccgaaatgcttacatctttgcaaccttctgcaacccccggaagcctgatgtcgccccttacaggtacgctgagcacactgctatctggcccagcccctacatcccagagcagccctttgacttcttttcttactagccctattgcagggccactcactggaactttggcgtcctccctgggcctgccgtcgactggcactctgacccccagttccctcgtggccggacctgtcgcaatgtcccagagtagcccactcatcgcacccgttatgggcaccgtcgcagtgagcctctccagcccactgctgagtagtacagcgacgccacctggcgtcagtcagaatttactcgctaatccgatgagcaatctggtactgccagaggctcccagattaaggctggccgagccactccggggagggccaaccggaccccagtcacctgcctgcgtggtgccaactgccaccactaaggtgcccctgagtaccgagccaccccaatctacccaggatccggagcctttatcaatggctttcgctggagcaccactgcagacttctactcccatcggagccatgggtacgcctgcgcctaaaactgcattttcctttaatactagcgacacgcaggctcaaccttccgctgcacaggagcaggtggtgccagcgagcgtgccaacttccccaacaacctctccaacagtgactgtcttggcctcagcgcctgcactggcccctcaggtggctacttcctatacacccagttctaccacacatatcgcccagggagctccgcatccaccctctcgtatgcacaattcaccgacacaaaatctgcccgtcccccattgtcctccgcataacgctcacagcccaccacgcactagttcaagccctgcttccgtaaacgattcccgcggtccccgaacaacggagccttcaactaagtctatgatggaggtggagcgtaaactggcgcaccggaagactagcaagtttccggaaaaccccagggaatccaaacagcttgcttgggagcggctggtcggggaaatcgcattccaactcgaccgaagaatccttagtagtatcttccccgagagggtccggctgtacggcttcactgtgtcaaatattccggagaagatcatccaggcttcccttaatccgagtgaccacaaattagatgagaagctgtgtcaaagattgactcagcgctatgtcagtgtgatgaataggctccagtcactgggctataacggcagggtgcatccggctcttactgaacagttagtgaatgcctacggcatattgcgagagcgacccgaactagccgcatcagaggggggtccctacaccgtggacttcctccaacgggtagtggtggaaacagtgcaccccggaatgctggccgatgccctgctgctgttgtcctgcctctcacagctggcccatgatgatggcaaacccatgttcatttggtag

SEQ ID NO: 242179 - DNA, 1326 bp, Artificial Sequence
  Description of Artificial Sequence: Synthetic coding sequence
atgtccctgttaacaaattacgagggcctgaggcatcagatcgagagacttgtgagagaaaacgaggagttaaagaagctcgtgcgtttgatcagagagaaccacgagctgaagtctgcaatcaaaacacaggctggtgggttaggcataagtgggttcacctccggtctcggcgaagctactgcgggactgagcagtcgccagaataatggcgtttttctgccccctagtccagccgtcgccaatgagcgcgtgctggaggaggtaggaataatggccctcgccccattagcagaaatgctgaccagcctgcaacccagtgcaaccccagggtcattaatgagtcccttgactggcaccctttcaaccctcctttctgggccagccccaaccagccagtcgagtcctctcacttcttttctcacctctcccatcgccggacctctcacgggtacgcttgcatccagcctgggcctgccaagcaccggaaccctcactccaagctccctcgtggctggcccagtcgcgatgtcacagtccagtcctctgatcgccccagtaatgggcacggtggccgtctctttatctagcccattgttgtccagtacggctacgccgcctggagtgagccaaaacttgctggcaaaccccatgagcaatctggttttacctgaggccccaagactccggctcgcagaacctttgagggggggaccaacgggaccccagtcccctgcttgcgtggtgcctaccgcgacaaccaaggtcccactgtcaaccgagccccctcaatccacccaggatccagagcctctctctatggctttcgctggagctcccctacagactagcacacctatcggcgcaatgggcacaccggctcctaaaacagccttctccttcaacactagcgatacgcaagctcaaccaagcgccgcacaggagcaggtcgtaccagcgagtgttccaacgagccccacaacgtctcctactgtgacagttttggcctccgcgccagcactggctcctcaggttgcgacctcctacacaccttccagcacaacacacatcgcacagggagcacctcaccccccatcgcgtatgcacaactcccccacacagaatcttccagtgccccattgccctccacacaacgctcattcacctcctagaacgtcctcaagccctgccagcgtgaacgactcgagaggcccaagaacgacagagccttccactaaatcaatgatggaggtggagcgcaagctggctcaccgaaaaactagcaaattccccgagaatcctcgcggattccctgagcctcagtag

SEQ ID NO: 242180 - DNA, 573 bp, Artificial Sequence
  Description of Artificial Sequence: Synthetic coding sequence
atgagttcttccgccttaacatgcggctccacactggaaaaatcaggcgacacatgggaaatgaaggctctggacagtagtaggttggtcccgtggcccccacgaggattgggtagttcaacacagcatcctaacaaaccacattgtgctttagccagctgccaggggcctggagttctgcccggagccgcatcggccctgcccgagctgacatttcagggcgacgtatgccagagtgaaacctgccagcggtatcttcaagccgctatttccctcgacatcgctgtgtctcagataaacctgctcggtagacctagttctcccccagcactcctgattcaacaggggagctgcgaacaggttattcataactctactccccagttcctgggcatggaagatggagacaatgaacgtaccacgggatggctctggagactgtgcgaagacattgatgccgaaccgtcctccactggctgctcccgctccaaccaattgacttttacagaggggtgttttgtgcggtccctcagtactgtgtattctaacacacacattcacactcacttatag

SEQ ID NO: 242181 - DNA, 1791 bp, Artificial Sequence
  Description of Artificial Sequence: Synthetic coding sequence
atgggctttattatccacattcaacaggtcaagaaacagcgcaagaagctcgatcaaggactgatcttgaagaaggagaagtaccggaaagagaagaagtgcgcatcactgagctttgaggtgtcaagcgacggtggcacggaaccctctgccctggtggacgataatggaagcgaggaggatttctcatatgaagacctgtgccaggcgtcaccgagatatctgcagcccggaggagaacagttagcaatcaacgagctgatttccgatggtaacgtggtctgcgccgaagctctctgggatcacgtgacaatggacgaccaggaactaggctttaaagccggagacgtaatccaggtgctagaagcgagcaataaggattggtggtgggggcgttccgaggacaaggaagcctggtttcccgctagttttgtgcgtctgcgggttaatcaggaagaactctccgaaaatagctcttccacccctagtgaagagcaggatgaagaggcaagtcaaagccgccatcggcattgcgaaaataaacagcaaatgagaaccaacgtgattagggaaataatggacactgagagggtgtacatcaagcatctcagggatatatgcgagggttatatcagacagtgtcggaagcataccggcatgtttaccgtggcccaacttgctactatatttggaaacatcgaagacatctacaaatttcaaagaaagttcctgaaagatttggaaaagcagtacaataaagaagaacctcacttgtcggagatcggctcatgttttctacagaaccaggaagggttcgctatctattcagagtactgtaacaaccaccctggcgcttgcctcgagctggccaatctcatgaagcaaggaaagtatcgccacttctttgaagcgtgccgcctcttacaacagatgatcgatattgctattgacggatttttgctgactcctgtgcagaaaatttgtaaatatcccctgcagttggcagaattgcttaagtatactactcaagagcatggcgactattctaatatcaaggcggcatacgaagctatgaaaaatgtggcttgcctcatcaacgaaaggaagcgcaagcttgagtctatcgacaagattgcacgctggcaggtaagtatagtgggctgggaggggctggatattctggatagatcaagtgaattgattcattccggcgagctaaccaagattacaaaacaggggaagtctcagcagaggaccttcttcctgttcgatcaccaactggtgagctgcaagaaagacctcctgcgaagggacatgttatactataagggaaggctcgacatggatgagatggagctcgtggatctgggggacggacgggacaaagactgtaacctgagcgtgaagaacgcatttaagcttgttagcagaactacagacgaggtgtatctgttctgcgcgaaaaagcaggaggacaaggcgagatggctacaggcctgcgctgacgagcggagacgtgtccaagaagacaaggagatggggatggaaatttctgagaaccaaaagaaactggcgatgctgaacgcccagaaagcaggccatggtaagagcaagggttataacaggtgcccagtggcccctccacaccagggtttacacccgatccatcagcgtcatatcaccatgcccacttcggtgcctcagcagcaggtgtttggcctggccgaacccaagcggaagtcctccttgttttggcatactttcaaccgactgacccctttccgcaaatag

SEQ ID NO: 242182 - DNA, 1959 bp, Artificial Sequence
  Description of Artificial Sequence: Synthetic coding sequence
atgacttcagcatcacccgaagaccagaatgcacccgtaggttgtcccaaaggggctcgcagaaggagacctatctctgtgatcgggggtgtgtcactgtacggcacaaaccagactgaggaactcgataacctgctcacccaacctgcgagccgtccacccatgccagcccaccaggtaccaccctacaaggcggtgtcagccaggttcagaccctttaccttttcgcagtcgacccccatcggactagaccgagtggggagaaggaggcagatgcgggcttccaacgttagctctgatggagggacagagcctagtgccctcgtcgatgacaacggcagcgaggaggacttctcctatgaggacttgtgtcaagcttcccctagatacttgcagcctggcggagagcagctggccatcaacgagctgatctccgacggcaacgtcgtatgcgcagaggccttgtgggaccatgtgacaatggacgatcaagagctgggatttaaagcaggggacgttatacaggtcctggaggcttccaacaaagactggtggtgggggagatctgaggataaagaagcttggtttcccgcttccttcgtgcggctcagagtgaaccaggaggagctaagcgagaattcatcaagcaccccgtctgaggaacaggacgaggaggccagccagtctcggcaccgacactgcgaaaataagcagcaaatgagaactaatgtcatcagagagatcatggatacggagcgagtctatataaagcacttaagagacatttgtgaaggctacatccggcagtgtcgcaagcatactggcatgttcactgttgcccagctggctacaatcttcgggaacattgaggatatttacaagttccaaagaaagttcctgaaagacctggaaaagcagtacaacaaagaggagccacacctttccgagataggaagttgctttttacagaatcaagagggattcgcgatttatagtgaatactgtaacaaccacccaggagcctgtctcgagctggctaacctcatgaaacaaggcaaatatagacactttttcgaggcgtgtcgtctactgcagcaaatgattgacatcgctattgacggttttctgttaacgcccgttcagaagatctgtaagtatccattacaactcgctgagcttttgaagtatactacacaggagcacggagattattcaaacattaaggcagcctacgaggccatgaagaatgttgcatgtctgatcaacgagagaaaacgaaagctggagtcgattgacaaaatagctaggtggcaagttagcatcgtgggctgggagggcctggatatcctggatcgcagtagcgagcttattcacagcggcgaactgactaaaatcacgaaacaaggcaagtcccagcagcgaacctttttcctgttcgaccatcagctggtatcctgtaaaaaggaccttctgcgcagggacatgttatattataagggccgactggatatggacgagatggaacttgtggatctgggcgacggcagggacaaagattgcaatttgagtgtgaagaatgccttcaagttagtgtcaagaactacagacgaggtgtatcttttttgtgcaaagaaacaggaagacaaggctaggtggcttcaggcttgtgccgatgaacggaggcgcgtacaggaggataaggagatggggatggagatctccgaaaaccaaaaaaaactggctatgctcaatgcccagaaagctggacacggtaagagtaaaggctacaaccggtgcccagtggctcctccccatcagggactgcaccctatccaccagcgacatatcactatgccaaccagtgttccccagcaacaggtgtttgggctcgctgagcccaagcggaaaagcagcctgttttggcatacctttaatcgtcttaccccctttcgcaaatag

SEQ ID NO: 242183 - DNA, 3834 bp, Artificial Sequence
  Description of Artificial Sequence: Synthetic coding sequence
atgacacaggccgcagtgagaccctgggctccctgtttggagaacatgacgacagccccaaacggactcggccctggccctgctgctccatgcgccggtagcgacctaaaggacgccaagatggtgactagcctcgcttgtggtaatggagtgtgcggttgctcgcctggcggagatactgacactcaggaagccaagctttcaccggctaaactggtacgtctgttctcgacatcgcggaagaggactggcgctcacccggaacggcctcacagtatggtgctcgtgggcaacagctcaacctggaacaccctagcctctttccgcaaaatgggatcttttaaaaagctcaaaagcagcgtgctaaaggggatccaatctagggaaggatcgaatgcgtgttccaaaggtgaagcctccgaacacgggctcggcaaatcaattccaaatggagccgtgccgggagcgcaagctagtaggggctctccactcgccccagggcctgcctgtggcgctctgcggcctgccgaatggggtacattggacggatccgacttagaagatactgacgacgcttttcaacggagcacacatcgatctaggtctctcagacgggcttacgggcttggcaggatctgcttactggacgctccccaaaatcatgccacccccacaatcgccaccggtcaggtacctgccgtgtgcgaaatcctggtccgggatccagagaacaacagcatgggataccgacggtcaaagtccactgacaacctggccttcctgaaaaaaagcagctttaaacgcaaaagtacttcaaatctggctgacctgagaaccgcccatgatgcccgtgtgcctcaacgaaccctgagtagctcttccaccgactcccagaagctcggaagcggtcgaaccaaacgatggcggagcccaattagagcaaaagacttcgatagagtttttaagctagtatcaaatgttacagaggctgcctggcgaagggaatccccgagatcaggagcacccagtcctggggaagctagtctcagactacaggcccactccagattgcatgatgattattcccggagagtgtcccggtcaacagaacaagattcaaggaggggtggggcagtcatgcatggcaccaccgcaacgtgcactgttgcccctggttttggttccgctactagcaaaggtccccacctagacgccgacactgctgtgttccctctcgagactaagtctagctgggctgtggaatccgacagctcatgcacgtgtagctccctgccgtctccgatagtccaggatgtgctgtccaaggattcctgtgaccctaacgcagggtcacagcttaccttcgacccagagcagccacctacccccctgcgccctaccacccccaaaccacaatcaccacagtctccacagagccctggcgcaggaagcgcaagttgtcactccaaccactctgctctgtccgccaacagtgaggaatccgagggacgagctgaggagcccgctcagagggagcccggacccgtgagtctgcaggatccactcgaagcaacgcacggagacgaaggtagcaaggacctgctcgtgaatataggcgtggctgccggaccggaggagaaagaaaaagaagaggtcgtgccagacggcccatggcgccgatcatcttcacaggacgaagagcgcactgaagcacagagaacccccaagagacgatggggaagcggaagacgacctcggcctaggccgtttagcgactatgggcagctagcctcacggagtctctccattcctgaagacagtgtggctgcagatccacagaaggaggaccgcgtagacgaagacccgcaagcatcgatgactagcgcctcgccagaagaccaaaatgctccagtggggtgtcccaaaggagcacgcaggaggcggcctatatctgtgatcggaggcgtgagcctgtacggaacaaatcagacagaagaattggataaccttctaactcagcctgcgtcgcggcctccaatgcccgcacatcaggtaccaccctacaaggcggtatctgccagattccgcccatttaccttcagccagagtacccccatcgggctggatcgcgttggccgaaggcgacagatgcgtgcctccaatgtcagtagcgacggcggtactgagccgtctgccctggtggacgacaatggaagtgaggaagatttcagctacgaggacctgtgtcaagctagccccaggtacctccagccaggaggggaacaactggctatcaatgagctgatctcagatggcaacgtggtttgtgcagaggctctctgggatcacgtgaccatggacgaccaggaactcggctttaaggccggtgacgtaatacaggtgctagaagcctctaataaggactggtggtggggccgaagcgaggacaaggaggcctggtttccggcttcctttgtgagactgagagtgaaccaggaggagctgtccgagaactcgtcttcgacaccatcagaagagcaggatgaggaggcctctcagagtagacacagacattgcgagaataaacagcagatgagaacaaacgtgattcgggaaatcatggatacagagcgggtgtatatcaagcatctgcgcgacatctgcgagggctacattagacaatgccggaaacacacaggcatgttcacagtcgctcagctcgctaccattttcggcaatattgaggacatctacaagttccagcgaaagtttttaaaagacctcgaaaagcaatacaacaaagaggagccgcacctctcagagattggctcctgctttctgcagaatcaagagggtttcgccatatactccgagtactgtaacaatcaccctggggcttgtctggagctggctaacctgatgaagcaggggaagtaccggcatttcttcgaagcatgtagactgctacaacagatgattgatatcgccatagacggatttctgctcacccctgtccagaaaatctgcaaatatcccctgcagctggcagaactcctgaagtacacaactcaagaacacggggattactctaatatcaaagccgcttacgaggctatgaagaacgtggcatgcttaatcaacgaacgcaagaggaaacttgaatcaatcgacaaaatagctcggtggcaggtcagcatcgtcggatgggagggactggacatcctcgaccgctcaagcgaactgatacattccggagaactcaccaagataaccaagcaggggaaatcacagcaacgaacctttttcctttttgaccatcagctcgtctcgtgcaagaaagacctgctccgcagggatatgctttattataagggtcggctggacatggacgagatggaactggtcgatctaggagatggtcgggataaggactgtaatctgtccgtgaagaatgcatttaagctggtctcgcgcaccaccgatgaagtttatcttttctgtgctaaaaagcaggaggataaggcccgttggctgcaggcttgtgcagacgaacggcgacgggtccaggaagacaaagaaatgggaatggagatctctgaaaaccaaaaaaaattggccatgctaaatgcccagaaggccggtcacggcaagtccaagggctacaacaggtgtcccgttgcacctccacatcagggcctgcatccgatacaccagcggcacatcacaatgcccactagtgtccctcagcagcaggtgtttggattagccgaaccaaagcgtaagtcctctctgttctggcacactttcaatagactcactccctttcgtaaatag

SEQ ID NO: 242184 - DNA, 3948 bp, Artificial Sequence
  Description of Artificial Sequence: Synthetic coding sequence
tgacccgtcgctactcaagaacccgatgtccagggacgctgcgaatgtcaggatgggattccaggcgacgaaggacttgagttgcgctctgcggactctgccgtaccagtcgctatgacacaggcagctgtccgaccctgggcaccttgtcttgaaaatatgaccaccgcccctaatggtctgggcccaggccctgctgctccctgcgccggatccgacctgaaagatgccaagatggtcacatcgttagcttgtggcaatggagtgtgcggctgctctccaggaggggatacagacacccaggaggccaagctctctccggctaagcttgtgaggctcttctcaaccagcaggaaaagaactggcgcacaccccgaaaggccccatagtatggtgttggttggtaactcatccacttggaacacgctggcgagctttcgaaagatgggcagcttcaagaaactgaagtccagcgttctcaagggcatccagtctagagaagggagtaacgcctgtagtaaaggcgaggcttccgagcacggcctgggaaaatctattccaaacggggcagtgcccggtgctcaagcttccaggggttccccactggctccaggccctgcgtgcggtgccttacggcctgccgaatggggtaccctggatggcagcgatctcgaggacacggatgacgcctttcaaaggtctacccaccgctcgcggtcgctccgtcgcgcttacggcctgggcaggatctgtctgctcgatgccccacagaaccatgcaacccccaccatagctacagggcaagtgccagccgtctgtgaaattctggtaagagacccagaaaataatagcatgggttacagacgttccaaaagtacggataatctagcatttctaaaaaagtcctctttcaagcggaagtccaccagtaatctggccgatctccggaccgcacacgacgcacgtgtcccgcagagaacgctttcgtcaagtagtactgattcgcagaaactgggttcggggagaactaaaaggtggaggtcccctataagggcaaaggactttgacagggtatttaagctggttagtaatgtcacagaagccgcatggaggcgggaaagtccacgaagcggggcacctagcccaggagaagcttctcttcgcttgcaggcccacagccgtttgcatgatgattactcaaggagagtcagccgatccaccgagcaggatagccgtagggggggtgccgtaatgcacgggaccaccgcaacatgcacagtggcccctggattcggctcagccaccagtaaggggcctcacctcgacgccgataccgcagtgttcccacttgagacgaaaagttcgtgggccgtcgagagtgatagtagttgcacatgtagttcactgccatcccctattgttcaggacgtgctttccaaagattcttgtgaccccaacgccggttcgcagttgaccttcgaccccgagcagccaccgactcctctgaggccaaccacaccaaaacctcagtctccccaaagccctcagtcacccggtgccggaagcgcgtcttgtcatagcaatcacagtgcactatcagctaacagcgaagagagcgagggaagggccgaagagcctgcacagcgtgagccaggcccagtctctctacaagaccccctggaagctacgcatggggacgaaggcagcaaggacttgctggtgaatattggtgttgccgctggacccgaagagaaggaaaaggaggaagtggtgcccgacgggccttggcgacggagctcttctcaagatgaggagcgcactgaagcccagcggacgcctaagcgcaggtggggctccggaagaagaccacgcccacgccctttcagtgattacggccagctcgcgtctagatcgcttagcatacctgaagatagcgtggcagcagatcctcagaaagaagacagagtggatgaagatcctcaggcgtcgatgacctccgcctctcccgaggatcaaaacgctccagtcggctgtcccaagggcgctaggaggcgccgacctatatctgtcattggaggggtttctctctatggaacaaatcagaccgaggagctggacaatctgcttacacagcctgcgtctcggcctcctatgcctgcccaccaggtgcccccatataaggccgtaagcgcacgattcaggcccttcacattcagtcagtccacccccattgggcttgaccgagtggggagacgccgacagatgagagcatccaatgtcagctctgacgggggaactgagccctctgccctggtggacgataatgggtctgaagaagatttctcttatgaagacctgtgtcaggctagtccacggtatctccagccgggaggggagcagctggccataaatgaattgatctcagatgggaatgtcgtctgcgctgaagccctgtgggaccatgttacgatggatgaccaagagttagggttcaaggcaggagatgtaatccaggtcttagaagccagcaacaaggattggtggtgggggcgttcagaggacaaggaggcgtggttccccgcttccttcgtcaggctgcgggtgaaccaggaggagctttcagagaatagcagctctactccctcggaagaacaagatgaggaagcatcccagagtcgacacagacactgcgagaacaaacaacaaatgcgtacaaatgttattcgcgaaatcatggacactgagcgagtgtatattaaacatttgcgagatatctgtgagggatatatcagacagtgtagaaagcataccggaatgttcacggtggcccaactggcgacaattttcggcaacattgaggatatatataaatttcagcggaaatttttgaaagatctagagaaacagtataacaaggaagagccccacttgtctgaaatcggcagctgcttcctgcagaatcaggaagggttcgccatttacagcgaatattgcaataaccatcccggtgcatgtctagaactggcgaacctgatgaaacagggcaagtacaggcactttttcgaggcctgccgcctgctccagcagatgatcgatatcgccatagatggatttctgctcaccccggtgcagaaaatctgtaaatatcctctgcagctcgccgagctgctgaagtatacaacacaagaacacggggattacagcaatattaaggccgcttatgaggctatgaagaatgtggcatgcctgatcaatgagcggaagcgtaagctggagagcatcgataaaatcgctcggtggcaggtctcaattgttggatgggaggggctggacatcctggatagatcctccgagcttattcactctggagagctaactaaaattacaaagcaagggaagagtcagcagcgaacattctttctgtttgaccaccagctcgtctcgtgcaaaaaggatctattaaggagagatatgctttattacaaggggcgactggacatggacgagatggagctggtggatctgggggatggcagggataaggattgcaacttaagcgtcaagaacgctttcaagctcgttagccgcactaccgatgaggtgtacctattttgcgctaagaaacaggaagataaggccaggtggttgcaggcctgcgcagacgagcgacgcagagttcaggaggataaggagatgggcatggagatctccgaaaaccaaaaaaaactggctatgctcaatgctcagaaggccggacatggcaagtctaagggttacaacaggtgcccagtggcccctccccaccagggactgcacccgatccaccaaagacacattactatgcccacttcagtccctcaacagcaagtctttggtctggcagagcctaaaagaaagtctagtcttttctggcacacctttaatcggctgaccccgttccgtaagtag

SEQ ID NO: 242185 - DNA, 1851 bp, Artificial Sequence
  Description of Artificial Sequence: Synthetic coding sequence
atgccagcccatcaggtacctccttataaagcggtctcagccagattcagaccatttaccttttcccaatctacaccaattggcctcgatcgcgtaggaagacgccgtcaaatgcgcgcttccaacgtctcttccgacgggggtacagagcctagcgctctcgtcgacgataatggctctgaggaagacttctcttacgaggacctatgtcaggccagtccacgttatcttcagccaggcggtgagcagttggctatcaatgagcttatttcagatggtaacgttgtgtgcgcagaagctctctgggaccatgtcaccatggatgatcaggaactgggattcaaggcaggagacgtgatccaagttctcgaagctagtaacaaagattggtggtggggtcggagcgaggacaaagaggcatggtttccggcttctttcgtgagactgcgagtgaatcaggaggagttatctgagaactcatcatctaccccctccgaagagcaggatgaggaagcctcccaatccagacacaggcactgtgagaataaacaacagatgcgaaccaacgttataagggagatcatggacaccgagcgtgtgtacattaagcatctgcgggacatttgtgaaggatacatccggcagtgtcggaagcacactgggatgttcactgtggcgcaacttgctactatctttggcaacatcgaagatatctataaattccagcgaaaattcctgaaggatctcgaaaagcaatacaataaggaagaaccgcatctgtccgagataggctcctgcttcctccagaaccaggagggcttcgccatttattcggagtattgcaacaaccatccaggggcttgcctcgaactggccaacctgatgaagcaggggaaatacaggcatttcttcgaagcttgtaggcttcttcagcagatgatagatatcgctattgacggtttccttctcactcccgttcagaaaatctgtaagtatccattgcagcttgctgagctgcttaaatacacaactcaggagcatggagattattccaatatcaaagccgcttacgaagcaatgaagaacgtggcctgcctgatcaacgagagaaaaaggaaactggagtccattgataagatcgcgaggtggcaagtctctatagtgggctgggaggggctcgacattctagaccgctcaagcgagctcatccacagcggagagcttacaaagatcacaaaacagggtaaatcacagcaacgcactttcttcctcttcgaccatcaattggtgtcttgcaagaaggatctgcttaggcgggacatgctgtactataaaggtagactcgacatggatgaaatggagctggtagatctaggagatggaagagacaaggactgcaacctctcagtcaagaacgcttttaaacttgtttctagaacaacagacgaggtatacttgttctgtgccaaaaaacaggaagataaagcaaggtggttgcaggcctgcgccgacgaaagacgaagagtccaggaggataaggagatgggcatggaaatttcggagaaccagaagaaattggccatgcttaacgcacaaaaagccggtcatggaaagtcgaaggttaggctgcagcaggttccctgtggccctactgctcctggacctgcccctcatcctcccgctccgcaccactatgcccacaagcgtccaccagcagccggactctggcccggagggacacaggaagaggtgctcgcgttgcttgcacacctgcagcaggcacatcccctaccagaaatgaagaccggagggtgtgcctccatggagttgggggtgaagcgtcggaattag

SEQ ID NO: 242186 - DNA, 1710 bp, Artificial Sequence
  Description of Artificial Sequence: Synthetic coding sequence
atggatgctggtagctcccggtccttagagaatgccgtaaaccgcatttaccatgatcaactggttccaaagatcaacactagcaagaaaatgtcaacgctcgcacacccccctaacatcctcgaaatgagccaggagatcaagaagaactgcggcggaaaacaggtggaaatcactctggagcggactaagatgacaaaaggcatcaaggagaaacagtccaacgacctcgaaaaagcagcctttaagcggaaggcagaaggagaggagaaacctacacgtaaaaagcaagctaagatcaccgagctggataaccagcttatcacaatgccgctgcctcacattcccttgaagaatataatggatgttgagatgaaactggtttacattgacgaaatgggtgtcaggtatgaatttgtagagtctttcatgtctactggctcacaaccaacttgccaggctgccgagattgtggacccattgagcgtccacaacttttcatttctcccacaaatcgacaagtggctgcaggtggcccttaaagacgctagctcatgctaccggcagaagaagtatgccctcgcagcgggtcaatttagaaccgcactggaactctgttctaaaggagccgtcctgggcgagccttttgatgcgccagccgaggatattgcctccgttgcaagttttatcgaaactaagctggtgacctgttacttgaggatgcgtaagcccgatctggccttgaaccacgctcaccgcagtattgttctgaatcccgcatactttcggaatcatctaaggcaagcgaccgtgttccgctgcttagagaggtatagtgaggccgcacgtagcgctatgatagctgattacatgttttggctgggcggtggacgcgaagagagcatctctaagctgattaagctttactggcaggctatgattgaagaggctattaccagggcagaatcctttagtgtgatgtacaccccatttgcaaccaagatacgggctgacaaaatcgagaaggtaaaggatgccttcaccaagacacatcccgcatacgcagaatatatgtacacagacttgcaagcacttcacatgctgcctcagactgtagattggtcatccttcccaccgcagcagtacctgctaaccctggggttcaagaacaaggatgatgggaaattcctggagaagatatcatcgcggaaattgcctatcttcactgaacataagaccccctttggcctgaccagggaagatacggtcagacagatggagactatggggaagcgtattcttccaattctggattttattcgatcgacacagttgaatggatcatttccagcaagttcaggagtgatggagaagcttcaatatgcctcactgctgtcccagttgcagagggtgaaggagcagagtcaggtcatcaaccaagctatggcggaacttgcaactataccctacctgcaagatatcagccaacaagaggctgaactgctacagtcgttaatggctgacgccatggatacccttgagggacgcaggaataataatgagcgtgtatggaatatgatacagaaggttggtcagatcgaagattttttatatcagttggaggactccttcttgaaaactaagaaacttagaactgctaggaggcagaagaccaagatgaaacgcttacagactgtgcagcagcggtag

SEQ ID NO: 242187 - DNA, 1086 bp, Artificial Sequence
  Description of Artificial Sequence: Synthetic coding sequence
atggctacgctagccaggctgcaggccagatcgtcgacagtgggaaaccagtactactttagaaattctgtggtggatccgtttcggaagaaagaaaatgatgctgcagtcaagatccagtcttggttccgcggatgccaggtcagggcctacatacgacacctgaaccgtattgtgacaataatacaaaaatggtggagatcctttctcggaaggaagcaatatcagctaaccgtgcaggtggcatattataccatgatgatgaatctgtataacgcgatggccgttcgcatccaacgaagatggaggggctaccgggtaaggaaatacctcttcaactattactatcttaaggagtacctcaaagtggtgagcgaaacaaatgacgccataaggaaggcactggaggagtttgccgagatgaaggaacgggaggagaaaaaggctaacctcgagcgcgaagaaaaaaaacgcgattatcaggcccgtaaaatgcactacttgctgagtactaaacagattccaggcatctacaattctccgtttcggaaagaacctgatccttgggaacttcaattacaaaaggcaaagccattgacgcaccggagaccaaaggtcaaacaaaaggattccacaagcctcaccgactggctcgcctgtacttcagcacggtcatttccccgtagcgagatcctaccaccaattaatcggaagcagtgccagggccctttccgcgacattacggaagtgctggagcagaggtacagaccgcttgagcccaccctccgagtagcagaacccatagacgaactcaagctcgcacgggaggagttgcggagagaggaatggctccaaaatgtgaatgacaatatgtttttgccattctctagttaccataagaacgagaagtatatccccagcatgcatctgagttcaaagtatgggcctatctcatacaaggaacagtttcggagcgagaaccccaagaagtggatctgcgataaggattttcaaaccgtcctcccaagctttgaactcttcagcaaatatggtaaattatacagtaaggccggtcaaatcgtgtag

SEQ ID NO: 242188 - DNA, 1617 bp, Artificial Sequence
  Description of Artificial Sequence: Synthetic coding sequence
atggccgagaacctgaagcgcctggtaagtaatgagaccctcagaacattacaggaaaagctggatttttggttgaaggaatataataccaacacttgtgaccagaatttaaatcactgcctagagcttatcgagcaggtggccaaagtgcaggggcagttgttcggaatcctcacagctgcagcacaggaggggggacgaaacgatggtgtggaaacaatcaagtcccgactgctcccatggttggaggcgagttttacagcagctagtcttggcaagtccgtggatagtaaagttccatccctgcaggacacatttgatagagaacgtcacaaggatccctcaccccgtgaccgcgacatgcagcaattggatagcaaccttaactcaacccgatcccagtgtaaccaggtgcaggacgatctcgtcgagacagaaaagaatctggaggagtccaagaataggtcagcaatcagccttctggcggcagaggaggaaatcaatcagctgaagaagcagctcaaaagcctacaggcacaagaggacgctcggcatcgcaacactgaccagagatcttccgagaatcggcgaagcgagccttggagtttggaggaaagaaaacgcgagcaatggaattcactcaagcaaaacgccgatcaacaggacactgaggcgatgtcggactataagaagcagttgcggaatctgaaggaggaaattgccgttctgagcgcggagaaatcagctctgcaaggacgctccagccgctctagatccccgtcacctgcaccacggagcaggtcgtgctcacggtcacgctcagccagcccaagtaccgccgtgaaagtgcgcagaccgtctcctaaccgttctaaactgagcaatgtcgcaaggaaggctgccttgctgagtcgattttctgactcatattctcaggcacgtttagacgctcagtgtctgctccggagatgtatcgataaagctgagaccgttcagcggattatttatattgctacagtggaagccttccacgtggcaaagatggctttccgtcacttcaagatccacgtgcgaaagtctcttacaccgtcatatgtgggctcgaacgattttgaaaacgccgtactcgactacgtcatctgtcatctcgacctgtatgactctcagtcttcagtgaatgatgttataagggcgatgaatgtgaacccgaaaatatccttccccccagtcgtggatttttgcctgttgtcggacttcatacaggaaatctgttgcattgccttcgccatgcaagcccttgagccccctcttgacattgcttacggcgcagatggtgaggtttttaatgattgtaagtatcggaggagttatgacagtgatttcactgcacctcttgtcctgtatcacgtttggcctgcgctgatggaaaatgattgtgtgatcatgaaaggagaagcagtgaccagacggggagccttttggaactctgtgcgcagcgtgtccaggtgtagatcccggtcactgagccctatttgtcctaggtcacagattggcctgaatactatgagccgtagccgttcaccctccccaatccgctgtggtctgccccgattctag

SEQ ID NO: 242189 - DNA, 504 bp, Artificial Sequence
  Description of Artificial Sequence: Synthetic coding sequence
atgattatcacgacttggatcgtgtacatattagcaaggaagggcgtcggcctcccattcctgcctatcacctcttccgacattgacgtggtcgagagcgaagccgtttccgtcctccaccactggctgaaaaagactgaggaagaagcatcacggggaatcaaggagaaattaagcatcaaccatccgtcacaaggcgtgcgagagaaaatgagcaccgactcccctccaacccacggtcaggacatacatgttacaagagatgttgtgaagcaccatctttctaagagtgacttacttgccaaccagtcccaggaagtgctcgaggagaggacccgaatccagttcatccggtggtctcacaccagaatcttccaggtgccctccgaaatgacagaagatatcatgcgcgaccgaatcgagcaggtgagacgctccatctctcgattgaccgacgtgtccgcgcaggacttctcaatgaggccgtcttcaagtgactgttag

SEQ ID NO: 242190 - DNA, 504 bp, Artificial Sequence
  Description of Artificial Sequence: Synthetic coding sequence
atgatcatcacaacttggattgtgtacattttagcgagaaaaggcgttggacttcctttcctaccaatcacaagctctgatattgacgtggtggaatcagaagcagtgtcagttctgcaccattggctgaagaagactgaagaggaggcatccagaggaattaaggagaaacttagcataaaccatccgtcccagggcgtgcgagagaagatgtcgaccgactcacctccgacacatgggcaggacattcatgtgaccagagacgtggtaaagcaccatctgagtaaatcagatcttctggccaaccagagtcaagaagtcctggaggagcggaccagaattcaatttattaggtggagccatacaagaattttccaggttccgagcgagatgaccgaggatattatgcgggatagaatcgagcaggtgcgtcgatcgatctcaagactgaccgacgtcagcgcccaggatttctctatgcgcccatccagctcagactgctag

SEQ ID NO: 242191 - DNA, 1563 bp, Artificial Sequence
  Description of Artificial Sequence: Synthetic coding sequence
atgggcaagcctagcagcatggacacaaaatttaaagacgatctcttcagaaagtatgttcagtttcacgagtctaaagtggataccaccacgagcagacagcgaccaggatccgacgagtgtcttcgagtggcagcctccactttactgtcccttcataaggtggaccctttttatcggttccgcttaattcaattctacgaggtggtggagagcagtcttaggtctctgagctccagttccctgcgcgctctgcacggtgccttctcaatgttagaaacggtaggcatcaatctgttcttgtacccctggaaaaaggaatttaggagcattaaaacatatactggaccattcgtgtactatgtaaagagcacattgcttgaggaagatattcgagcgatcttgagctgtatgggctacaccccagaactcggaactgcctacaagctacgagagctcgtggaaactttgcaggtgaagatggtgagcttcgaactgtttttggccaaggtcgaatgtgaacaaatgctggagatacattcacaggtaaaggacaaaggatattccgagctagatatcgttagcgagcgaaagtcgtccgctgaagacgtgcgtgggtgcagcgacgctttgaggagacgtgccgaaggcagggagcacttgacagcaagcatgtcccgggtggctctccagaaaagcgcttcggaacgagctgccaaggattactacaaacctcgggttacaaagcccagccggtcagtagacgcctacgacagctattgggaatctagaaagccgccactcaaggcgtcattgagcctcaggaaggaacctgtggctaccgacgtgggcgatgaccttaaggacgagattattcggccaagtcccagcttgctcaccatggcatcatccccccacggctctcccgatgttctgcctcctgctagcccatcgaatggcccagctttgcttagaggtacctactttagcacgcaggatgatgtcgatctgtatactgactccgagcccagagcaacctaccggagacaggatgccctgagacctgacgtctggttgctccggaacgacgcccattcactataccacaaaagaagtcctccggctaaagaaagcgctttgagcaaatgtcaatcttgcggactctcctgcagtagcagcctgtgccagaggtgcgactctttgttgacatgcccccctgccagtaaaccctcagctttccccagcaaggcaagcacacacgatagtttagcccatggcgcaagcttaagagagaaatacccgggtcagactcaggggttggatcgcctgccccaccttcactcaaaaagtaagccctcaaccacccctacttcccgatgtgggttttgcaaccgcccaggtgctaccaacacctgtactcagtgttctaaggttagctgcgacgcctgtctgagtgcctaccattacgacccctgctacaagaaaagcgagctgcataaattcatgccaaacaatcagctgaattataagtccactcaacttagtcacttggtgtaccgctag

SEQ ID NO: 242192 - DNA, 1563 bp, Artificial Sequence
  Description of Artificial Sequence: Synthetic coding sequence
atgggcaagccctccagtatggacactaagttcaaggatgacttgtttcggaaatacgtgcagtttcacgagtctaaagttgacaccacaactagtcgccagcgcccaggttctgatgagtgcttacgggttgcagctagcaccttgctgagcttgcacaaagtggatcctttctataggttccggctgatccagttttacgaggtggtggaatcttctttgcggtccctatcgtcatcttcactccgggctctgcacggcgcttttagtatgttggagaccgtgggcatcaacctcttcctgtacccctggaagaaagagtttaggtctataaaaacctatacggggccttttgtgtactatgtgaagtccactttgcttgaggaagatattagggcaatcctttcctgtatggggtacacccccgaactgggaacagcttacaaacttcgcgaacttgttgagacactgcaagtcaaaatggtttcatttgagctgttcttagccaaggtggagtgcgagcagatgcttgagatccactcccaggtgaaagacaagggatatagcgagctcgatattgtgtccgaacgcaagagcagtgcagaagacgttagaggctgcagtgacgctctgcgaagacgggctgagggcagggagcacctcaccgcctcgatgagccgcgtcgcactgcaaaagagcgcctcggaacgggcagccaaagattactacaagcccagagtgactaagcctagccgcagcgtagatgcctacgattcttactgggagagccgaaagcccccactcaaggcatcactgtccctccgcaaagaaccagtggcaaccgatgtcggcgatgatctaaaggatgagattattcgcccaagtcccagcctcctcacgatggccagcagtcctcatgggtctcctgatgtgctgccccctgcttcacctagtaatggtcccgcacttctgcgcggtacctacttttcgacccaggacgatgtggacctttatacagacagtgaaccacgcgctacctataggagacaggatgcacttcgccctgatgtctggcttctgcgcaacgacgcccatagtctctaccataagcgctccccacctgctaaagaaagcgcactctctaagtgccagtcctgtggactaagttgctcctcctcactgtgtcagagatgtgattcactcttgacgtgtccacccgctagtaaaccctctgccttcccctcaaaggcttccactcatgactctctggcacatggagccagcttgcgggaaaagtatccgggtcagactcagggtctggatagactcccccatctgcacagtaaatcaaaacccagtacgacccccacgtcaagatgcggcttttgcaaccggccaggcgcaaccaatacttgcacacagtgctctaaagtatcctgtgacgcgtgcctgagcgcctatcactacgatccctgctacaagaagtccgagcttcacaaatttatgcccaataatcaactcaattacaagtccacccaactctctcacctcgtttatcgatag

SEQ ID NO: 242193 - DNA, 1152 bp, Artificial Sequence
  Description of Artificial Sequence: Synthetic coding sequence
atgggttacacacccgaactgggtactgcctataaactgcgggaattggtggaaaccctgcaggttaagatggtatccttcgaactgtttctggctaaagtcgagtgtgagcagatgttggagatacatagccaggtaaaggataagggttattcagaattggacatcgtttcagaacgcaagagcagcgccgaggatgtgcggggatgctcagacgccctgaggcgacgagctgaggggagggagcatttaaccgcttctatgagtcgggtggcgctgcagaagtcggcttctgagcgggcagcaaaagactattacaagcccagagtgaccaaaccctctcggagtgtcgatgcctacgactcctactgggaatcacgcaaaccgccactcaaggctagtctttccctgcggaaggagccagtggccacggatgtgggtgacgacctaaaagatgagatcatccggccatccccgtctctcttgaccatggcctcctcaccgcacggctcccctgatgtgctgccccctgctagcccatcgaatggacctgccctgctcagagggacctacttttcgactcaggacgacgttgatctatatactgatagcgagcctcgcgcaacctatagaagacaagatgctctgcgtccagatgtttggttgcttcggaatgatgcacattccctttaccacaagcggtcaccacctgcgaaagagagcgcgctatctaagtgtcagagttgcggtttaagttgctcttcatctctgtgccagaggtgcgatagtctcttgacttgtcctccagctagcaagcctagcgcgttcccgtctaaggcctctactcatgacagcctggctcacggggcatctctccgggaaaaataccccggacagacccagggacttgaccggctgccccacctccattccaagtccaaacccagcactactccgacatccaggtgcggtttctgcaatcggcctggggcaacaaatacctgtacccagtgcagcaaggtgtcttgtgacgcctgcctttctgcatatcattatgatccctgctataagaagagtgaactgcacaagtttatgccaaacaatcagttgaactataaatccacacagctttcccatctcgtatatcgatag

SEQ ID NO: 242194 - DNA, 2409 bp, Artificial Sequence
  Description of Artificial Sequence: Synthetic coding sequence
atgctaggagcgagagcttggctgggacgcgtgctgttacttcctcgcgcaggtgcaggcctggcagcaagccggcgttgtcctggtgtctggcctcgcacttggccacatcgttcaccatcccgcggatcatcttctagagataaggaccgaagtgcgaccgtgtcctcttcagtgccgatgccagctgggggaaaggggagccacccctcatccacaccccagagggtgcccaatcgcctgatccacgaaaaatcaccgtatctgctccagcacgcgtacaacccggttgattggtacccctggggacaggaagccttcgacaaagctcgtaaggagaacaaacccatattccttagcgtgggctatagcacttgtcattggtgtcatatgatggaagaagagtcctttcagaacgaggagataggaagactcctctctgaggatttcgtctccgtcaaggtggatcgagaggaacgccctgacgtcgacaaagtgtatatgacattcgtgcaagccacgagcagtggcggaggttggcccatgaatgtttggctgactcctaatctgcagccatttgttggcggaacatacttccctccagaggacggtctgacccgcgtcggatttagaactgttctgttgcgaatccgcgagcagtggaaacagaataaaaacacgctgctggagaacagccaacgggttacaaccgctcttctggcaagatccgaaatatccgtgggagaccggcaactcccaccatccgccgcaacagttaacaatagatgtttccagcagctcgatgaaggatacgatgaagagtacggcggattcgctgaggcacccaagttccccacccctgtgatcctatcttttctcttttcttactggctgagtcaccggcttactcaggatgggtcccgcgcacagcagatggctctgcacacactgaagatgatggcgaacgggggaataagagatcatgtgggacagggattccaccgttactcaaccgaccggcaatggcacgtccctcactttgagaagatgctctatgatcaggcccaactcgccgttgcttattcccaggcattccagctgagcggggatgaattttactctgacgtcgcaaagggcatccttcagtacgtcgctaggtcgctctcccaccgctccgggggtttctactctgccgaggatgcagattcacctccagaaaggggccagagacccaaagagggggcttattacgtttggactgtcaaagaagtccagcagctgctcccagagcctgtgctgggggcaactgaaccattgacttccggccaactcctcatgaagcactatggactaacagaagcaggtaacatttcgccttcgcaagaccctaaaggagagctccaggggcagaacgtgctgacagttcgatattcgcttgagttaactgctgccaggttcggtcttgacgtggaggcagtccggactcttctgaatagcggactggagaagctttttcaggccagaaagcacaggccaaaaccccatctagacagcaagatgttagccgcttggaacggactgatggtgagcggttatgcagtgaccggtgcagttcttgggcaggatcgcctcatcaactatgctacaaacggcgctaagttcctgaagcgtcatatgttcgatgtcgcctcgggacgactcatgagaacttgttataccggcccaggcggaactgtggaacacagcaaccctccatgttggggatttctggaagattatgcgttcgtggtgcgtgggctgctcgacctctacgaggccagccaggagagcgcttggctcgagtgggcgctgcgactgcaggatacccaagataagctattctgggattcccaaggcggtggctacttctgttcagaggcagagctgggcgctgggcttccccttcggctgaaagatgatcaggacggggctgaaccatccgctaactccgtctcggctcataatctgttgcgcctccatgggtttacaggccacaaggactggatggacaaatgcgtgtgcctgttaaccgcgttctccgagcgtatgagaagagtgcctgtagctctgcccgaaatggtgagagccctgagtgcacagcagcaaaccttaaagcaaatagtgatatgtggcgacaggcaagccaaagacactaaggcactggttcagtgcgttcactctgtgtacatcccgaataaggtgctaatccttgcagatggagatccttcctcatttctctctcgacagctgccttttctctctactttaaggcgattagaggatcaggccacagcctacgtctgcgagaatcaggcatgttcagtacctatcaccgacccgtgtgaactcagaaagctcctgcacccctag

SEQ ID NO: 242195 - DNA, 2361 bp, Artificial Sequence
  Description of Artificial Sequence: Synthetic coding sequence
atgctgggcgcaagagcctggctgggtagagtgctgctgctgccgagggctggagcaggtctggctgcctcgagaaggggctcatcgtccagggataaagacaggtccgcaaccgtgagcagttctgtacctatgcctgcaggcggaaaggggtctcaccctagctcaaccccccagcgagttcctaatcgactgattcacgagaagagcccatatctgcttcagcacgcctataaccccgtagactggtacccctgggggcaggaagcctttgacaaggctagaaaggaaaacaagcccatctttcttagtgtcggctatagcacatgccattggtgccatatgatggaagaggaaagttttcagaatgaggagattgggagacttctgagcgaagattttgtgagcgtgaaagttgacagagaggagaggcccgacgtggacaaggtgtacatgacctttgttcaagccacctcttccggcggagggtggccaatgaatgtgtggctaacacccaatctgcaaccatttgtggggggtacatattttccgcctgaagacggactgaccagggtcgggttccgcacggttctgttaaggattcgcgaacagtggaagcagaacaagaacaccctgctggagaactcacaaagggtgactacagccctcttggcgaggagtgaaatcagcgtaggtgacaggcagctgccaccctccgccgctaccgtcaacaaccgctgcttccaacaacttgatgaagggtacgacgaggagtatggcggattcgccgaagcacccaagttccccacgcccgtcattctttcctttctgttcagctactggctgagtcacagacttactcaggacggaagcagggcccagcagatggcattacatactcttaagatgatggcaaacggaggaattcgggaccatgttggccaagggtttcacagatacagtactgataggcagtggcacgtaccccatttcgagaaaatgctttatgatcaggcacagcttgccgtggcctacagccaagccttccagttaagcggagacgaattttattccgatgtggccaagggcatcttgcagtacgtggccaggagcttatctcacagaagtggtgggttctatagcgccgaggacgccgatagccctcccgaacgtggacaacgccctaaggaaggagcctactatgtttggaccgtgaaggaagtccagcaactgcttccagaacctgtactgggggcaactgaacctctgacctcaggtcagcttctgatgaaacattatggattaaccgaagctgggaacatcagcccttctcaagaccccaagggggaactacaaggccagaatgtgctcaccgtgcgctatagtcttgaacttaccgcagcaagatttggacttgatgtggaagcagtgcgcaccttactgaactccggcttggagaaattgttccaggccaggaaacacagaccaaaacctcatctcgacagtaaaatgctagccgcttggaacggcctgatggttagcggctacgccgtcacaggcgctgtattaggccaagatcggctcataaattatgccactaatggtgccaaatttctgaagcggcatatgttcgacgttgcctctggcagactgatgcgaacttgctataccgggcctggtggaactgtggaacattccaaccctccctgttggggcttcctcgaggactatgcctttgttgtgcgcggactcctagacttgtacgaggcctctcaggagtcagcatggttggagtgggcgttgcgtctgcaggatacacaggataagctcttttgggatagccaggggggaggctacttttgcagcgaagcagagctgggcgctggcctgccactcaggcttaaggacgatcaggatggagctgagccttcggctaatagtgtgagcgctcacaacctgctgagactgcacggattcactggacataaagactggatggacaagtgtgtgtgcctgttaacggctttttccgagaggatgagaagagtccccgtggcactgcccgagatggtgagggccctgtcagcccagcagcaaaccctcaagcagattgttatctgtggggaccgacaagccaaggataccaaggcgctggttcagtgcgtgcattcggtttatattcctaacaaggtgctcattctcgccgacggagatcccagctcattcctgagtagacagctgccctttttgagcaccttgaggagacttgaagaccaagccacagcctacgtgtgtgagaaccaggcctgctccgtccccatcaccgacccgtgcgaactccgtaaactcctgcatccctag

SEQ ID NO: 242196 - DNA, 2229 bp, Artificial Sequence
  Description of Artificial Sequence: Synthetic coding sequence
atgcccgcagggggaaagggttcccacccaagttccaccccgcaacgagtgcccaatcgactcattcatgaaaaaagtccctatttactgcagcacgcatataaccctgttgattggtacccctgggggcaggaagctttcgataaagcaagaaaagagaataagcccatcttcctgtctgtgggttattccacctgccattggtgtcatatgatggaggaagaatcctttcaaaatgaagaaatcggccgtctgctcagtgaggatttcgtgagcgtcaaggttgatcgggaggagcgcccagacgtggacaaggtgtacatgacctttgtacaggctacctcatccggcggaggttggcccatgaatgtgtggttgacccccaacctccagccctttgtcgggggaacctattttccacccgaagacgggttgacccgagtcggatttaggacagtcctcctgaggatccgcgaacagtggaaacaaaacaaaaacacactgttggaaaactcccagagggtaaccactgctctcctggccagaagtgagatatcagtaggagacaggcagttacccccttccgctgccaccgttaataataggtgctttcaacagctggacgagggttacgatgaggagtacggcggatttgcagaggctccaaaatttcccacccctgtgatcttatccttcctgttctcctactggctgagtcaccgtctgactcaggatggcagcagggctcagcaaatggccctccataccttgaaaatgatggcaaatgggggtatcagggaccacgtcggccaaggctttcaccgatactcaacggacagacagtggcatgtaccgcatttcgagaaaatgctgtatgatcaggcccagttagctgtcgcatacagccaagcttttcaactctctggcgacgagttttacagtgatgtagcaaaagggatcctgcagtatgtggcgaggagtctgtcgcaccgcagcggtggtttctattctgccgaggatgccgattctccaccagaacgcggtcaacggccaaaagagggcgcttattacgtctggaccgttaaggaagttcagcagttgttacctgagcccgtgctgggcgctaccgaacccctgacttcaggtcagctactcatgaagcactacggactaactgaggccggtaatattagcccaagtcaggatcctaagggtgagctgcaagggcagaacgttctgacagtgagatattctctcgagctgacagcagctcggttcggcctggatgtggaagccgttcgaacacttctaaatagcggactcgagaagctttttcaagctcgcaagcaccggcctaaaccccacctggacagtaagatgctcgctgcctggaacggcctaatggtgagtggttatgcggttacaggcgctgtcctcggccaagacaggctcataaactacgcgaccaacggagcaaagttcctcaaacgccatatgttcgatgtagcctcaggcagacttatgaggacctgttataccggcccaggtggaacagtggaacactcgaacccgccatgttggggctttctggaagattatgcgtttgtcgtcagaggcttgctcgatttatatgaggcttcccaggagagcgcctggttggaatgggcccttaggctgcaggatacgcaggataagcttttttgggacagtcagggaggcggatatttctgctctgaggctgaactcggagccggactgcccttaaggctaaaagatgaccaggacggcgctgagccaagcgctaattccgtgagcgcccataatcttctgaggttgcacggatttacaggacataaggattggatggataaatgtgtgtgtcttctcactgcattcagcgaacgaatgcgtagggtgcctgtcgctcttcctgagatggtgcgcgctttgtcagctcagcagcagacccttaagcagatcgtcatttgtggcgaccgccaggcaaaagataccaaggccctggtccagtgtgttcactcggtgtatatcccaaacaaggtgctcatcctggccgatggcgacccttcttcattcctatcacgccaactgccttttctgtccactctaagacggcttgaagatcaggcaactgcttatgtgtgcgagaaccaagcctgcagtgtgcccatcaccgacccatgcgaactgcgcaaactgctgcatccctag

SEQ ID NO: 242197 - DNA, 228 bp, Artificial Sequence
  Description of Artificial Sequence: Synthetic coding sequence
ggacagggccaccagggccctggccaatgcgtccacagcgtgtatattcctaataaggtgctcattctcgccgatggcgacccatcctcattcctgtcacgacagcttcctttcctttctaccctgcgccgtttggaagaccaagcaacagcctacgtgtgtgagaaccaagcctgctccgtacctattaccgacccctgcgagctgcgaaagctgctgcacccatag

SEQ ID NO: 242198 - DNA, 132 bp, Artificial Sequence
  Description of Artificial Sequence: Synthetic coding sequence
atgctgggagccagagcctggctcggccgagtgctgctgctgcccagggctggggctgggctagcagccagccgtagaagcgcgtgttccccaacgagccgcttgaactccctgcggtcgctcatcccttag

SEQ ID NO: 242199 - DNA, 918 bp, Artificial Sequence
  Description of Artificial Sequence: Synthetic coding sequence
atggcagcagctggccaggagaagggctacctgacacagaccgccgcagctttagataagtctccaagcctctctccgcagctagcagccccaatccgcggacgccctaagaaatgccttgtatacccacacgcccctaaatcctcaagactgtccagaagcgtcttgcgatggctgcagggcctggacctgagctttttccctcgcaatataaacagagacttttccaacggcttcctcatagccgaaattttctgtatctactatccgtgggaactcgaactgtcaagcttcgaaaacgggactagtctcaaagtgaagctagataactgggcacagctagagaagttcttggcacggaagaaatttaagctgcccaaagagctcatccacggcactatacattgcaaagccggtgttcccgaaattttaattgaggaagtttacaccctgctcactcatcgcgaaatcaagagcattcaggatgacttcgtgaatttcaccgactactcttatcagatgaggctgcctctcgtatctaggagtacggtgtctaagtcaattaaggacaacatacgcctgtctgagttgttgtcgaatccaaatatgctgaccaatgagctgaaagccgagtttctgatcctgctacatatgctacaacggaagctggggagaaagcttaatcccgaatggtttgacgtcaagcctactgtgggggaggttacgctgaaccacctaccagcccaggcctctgggcgtaggtacaatttaaaagtaaagaggggtcgtgttgtgccagtcctgcccaacattggatccggaggcagctcccaccgagaaattcatgtgaaacaggccggtcagcattcctattattcggctatgaagccaattagaaatatggataagaaaccctag

SEQ ID NO: 242200 - DNA, 2682 bp, Artificial Sequence
  Description of Artificial Sequence: Synthetic coding sequence
atgtcttccaaaaaaaatcgaaagcggctgaaccagtcagctgaaaacggaagctccctgccttctgctgcgagttcctgtgcagaagcccgagctccctccgccggaagcgacttcgcggctacgagtggaacgctgacagtcaccaatctactggaaaaagtggacgataaaattccaaagaccttccaaaattctctgattcacctgggactgaacacaatgaaatccgcaaatatttgcataggacggcctgtactgctcacttcgctgaatggcaaacaggaagtctacaccgcatggcccatggccggatttccaggagggaaggttggtctctcagagatggctcagaaaaatgtaggcgtcagacccggtgatgccatccaggtccagcctctggtgggcgcagtcctccaggccgaggaaatggatgtggccctatccgacaaagatatggaaattaatgaagaggagctcacggggtgcattctcagaaagctggacggtaagatcgtcctgccgggaaatttcctctactgtaccttctacggcagaccctataagctgcaggtgctcagagttaagggcgcagacggcatgatcctaggaggcccacagagtgacagtgataccgatgcccagcgcatggcattcgagcagtcctcaatggagacttctagccttgaactcagtctgcagctgtcgcagctggatctagaagacacccaaattccaacctcgaggagtacaccttacaagccgatagacgatagaattactaacaaagcctcagacgtcctgcttgatgtcacacagagccctggagacggatctggtctgatgctggaggaagtgaccggcttgaaatgcaattttgagtcagctagagagggaaacgagcagctcaccgaggaggaacgtttactgaagttctcaatcggggcaaaatgcaacactgataccttttatttcatttctagcaccacaagggtgaattttacagagatcgataaaaacagcaaagaacaagacaatcagttcaaggtgacctacgacatgattggcggtctgtcctcccaactgaaggccatccgggagatcatcgaactaccactcaaacagccagaattgttcaagtcgtatgggatacccgctccaagaggggtcctactctacgggcctccaggtacgggaaagacaatgatcgccagagccgtagctaacgaagtgggcgcttatgtgtccgtaatcaacggacccgagatcatttccaagttttacggggaaaccgaagcaaaactgaggcagattttcgctgaggccaccctgcgacacccctctattatattcatagacgagctggacgcactgtgcccaaaaagggaaggggctcagaatgaagtcgagaagcgtgtagtggcctccctgctgacgttgatggatggcattgggtccgaggtgtcagagggccaggtcctggtgctcggagccactaatagacctcatgccctggacgcagctcttagacgcccaggcaggttcgacaaagagattgaaatcggagtgccgaatgcccaggacagactggacattctccaaaaactgctgcggcgtgtgccacacctgttgacagaagccgaactgctacagctggccaactcagctcatggatatgtgggagcggatctcaaggttctgtgcaacgaggccggactatgcgctctgcgccgaatactcaagaagcagcctaacctgcctgatgtgaaggtggcaggacttgtaaagatcacactgaaagacttcctgcaggctatgaacgacatccgaccctctgccatgagggagatcgccattgacgtccctaatgtatcgtggagtgacatcggaggcttggaatcaatcaaactgaagctggagcaggccgtggaatggcctctgaagcacccagaatcatttatccggatgggaatccagccgcctaaaggagtcctgctgtacggcccacctggatgttctaagactatgatcgctaaggctctggccaatgagagcggcctcaatttcctagcaattaaaggtccggaattgatgaacaagtacgtgggcgagtccgagcgtgctgttcgggagactttcagaaaagcccgtgcggtggccccatcaataatcttctttgatgagttggatgcccttgccgtggaaaggggctcaagccttggggcaggaaatgtggccgatagagtccttgcccagttattaacagagatggatggcattgaacagctgaaggatgtgaccatcctcgcggctaccaatcggcctgaccggattgacaaggcgctgatgcgccctgggcgtatcgataggattatctacgtccctctccccgacgcagctacaaggcgggaaatttttaaactgcagtttcacagcatgccagttagtaacgaagtggatctggacgaacttatcctccagaccgatgcctattctggcgcagagatcgtggctgtttgccgcgaggctgcccttctggcactcgaggaagatatccaggctaatttgatcatgaagcgccactttacgcaggctttaagcacggtgacacccaggatccccgagagcctcaggagattttatgaggactaccaagagaaaagtggcctgcatactctttag

SEQ ID NO: 242201 - DNA, 750 bp, Artificial Sequence
  Description of Artificial Sequence: Synthetic coding sequence
atgcagctggataaatttatctaccacttggcgcctgtcgagaaatctcacggtcgcctgcagaaccggacctcccgctcgcagaagaagaagtctaagagccctgagaggtcgaagtattgcataaacgccaagaactacgagcagcccaccatcagtagtaagtcccacagcccttccccttatacgaagagaagaatgtgcgaactgagtgaagacacgcggcgtagactcgcacacttgaacctgggaccctatgagttcaaaaaagagacagataagcccccattcgtcattcgccacgtggaccctccatctccacgggcagacactcttttgggaagcagtgggagagattgtgaaagggacgggtggtcccgtgtccacaatgatcactcccacttaggctgctgtcgaccaaaagattacaaggttataaggacaccccacgggcgagattttgatgattctctggagaagtgcgaggagtatcttagccctcgaagctgttctaagcctagacattctgcccgaacactgctggtgcactcggcaccatcaactatgcctaagcattcaccaagccctgttctcaatagagcatccctgagggaaaggtttcatagcgactggtgttctccaagtaactgcgatgaaatccacgacagggacgagcgcgacctcgaaaaggatgatgaactggagctgaagcggtctctcttgtgccgcgactccgcctacgatagctag

SEQ ID NO: 242202 - DNA, 1419 bp, Artificial Sequence
  Description of Artificial Sequence: Synthetic coding sequence
atgcctaaagtcaaggccctccagtgtgcactggcgctcgagatttcaagcgtgacctgccctggagtggtcctgaaggacaaggaggatatctatctaagtatctgtgtgttcggccagtacaaaaaaacccaatgcgtgcctgcgacatttcccctagtgttcaatgcgaggatggttttcgaaaaggtgttccccgatgccgtagatcctggggacgtagtgacccagctcgaatatgatactgctgtgttcgaattgatccagctggtgccgccagtgggtgagaccttatcaacctatgatgaaaatacgcgggatttcatgttcccaggccctaaccaaatgtccggccatcatgatagcaaccgacaggtaaccatgagacgaatatctggacttagaggaaacgcccctcgtcttgagttcagcaccacctccgtcatcacagagtgccttatcagcagtaggaagtgtcatactcaggataagttcatctaccaccttgctccagtcgagaaatcacatgggagactccagaatagaactagtaggtcccaaaaaaaaaaatcaaagagccctgagcgctctaagtattgcattaatgccaagaactacgagcagcccactattagtagcaaatctcattctccgtctccctatactaagagacgcatgtgcgagctcagcgaggacaccagaagaagactcgcacacctcaacctgggcccttatgaatttaagaaggagaccgacaagccgcctttcgtgattaggcatgtcgacccacccagcccacgtgcggatacgctacttgggtccagtggtcgtgattgtgagcgggacggatggagcagggtgcataacgatcatagtcaccttggttgctgtcgaccaaaagattataaagttataaggacacctcatggacgcgatttcgacgactctctcgagaaatgcgaggaatatctgagcccccgttcgtgctcaaagcccagacactccgcaagaacacttttagtgcatagcgccccatccaccatgccaaaacattcaccttcgccagtgcttaaccgggcaagcctcagagagaggtttcattccgactggtgcagcccgtccaattgtgacgaaatccacgaccgggacgagcgtgatttggaaaaggatgacgagcttgagttgaaacgttccctgctttgtagggatagtgcctacgatagcgatccagagtacagtagttgtcagcagcctagaggtactttccacttggacgacggggaatattggagtaatagggcagcctcatataagggtaaatcgcaccgcccaatcttcgagaacagcatggacaaaatgtaccggaacctgtacaaaaaggcatgctcaagcgcatcccacacacaggaatcattctag

SEQ ID NO: 242203 - DNA, 1467 bp, Artificial Sequence
  Description of Artificial Sequence: Synthetic coding sequence
atgcctaaagtcaaagccctgcagtgcgctctggcactggaaatcagttccgtgacctgtccaggagttgtcctcaaggacaaggaagatatctatctatctatctgcgtgttcggacagtacaagaagacacagtgtgtgcccgcaacattccccctagtgttcaatgctcgaatggtgtttgaaaaggtctttccggacgccgtggatcctggggacgtagtgacccagttggaatacgacactgccgtctttgagctgatacagctggttccacctgtgggcgagaccctttcaacgtacgatgagaatacaagggattttatgtttccgggtcctaaccaaatgagtggccaccatgatagcaacaggcaggtcaccatgcgaaggatatcggggctgcggggaaatgcaccaaggcttgaatttagcactacatccgtgattactgaatgcctaattagtagtagaaagtgtcacacccaggataaattcatataccatcttgcccctgtcgagaaatctcatggtaggctgcagaataggacgtccaggagccagaaaaagaaatctaagtcaccagagagaagcaaatactgcatcaacgccaaaaattatgaacaacctaccatatcttcgaaatctcactccccgagtccttataccaagcgtagaatgtgtgaactgtcagaggatacccggaggcgtctggcccacttaaacctgggtccttacgaatttaagaaggaaaccgataaaccccctttcgtgataagacacgtcgaccctccatcacccagggcggacactctgttgggaagttccggccgtgactgcgagagagatggctggtcccgtgtgcacaatgatcactcacatctggggtgttgccgaccaaaagactacaaggtgattcgcactccacacggacgggactttgacgactccttggagaaatgtgaggagtacctctctcctagaagctgcagcaagcccaggcattccgcacggactctcctagtgcacagcgcaccttctacgatgcccaagcatagtccatctccagttctgaacagagcctcactcagggaaagattccactccgattggtgctcacctagcaactgtgacgagattcacgatagagtgaagaatgtcttaaaaagccaccaggcacatcagagacacctgtacgatgagagggaccttgaaaaagacgatgagctggagttgaagagatctctcttgtgtcgagactctgcatacgactctgacccagaatactcttcctgtcagcagccacggggtactttccacctcgatgacggagaatactggagcaatcgggctgcttcctataagggcaagtcccatagaccaatcttcgaaaacagcatggataaaatgtatagaaacctgtacaagaaggcatgttctagcgcttcccatacccaggagagtttctag

SEQ ID NO: 242204 - DNA, 1251 bp, Artificial Sequence
  Description of Artificial Sequence: Synthetic coding sequence
atggtctttgaaaaagttttccccgatgctgtggatccaggagacgtcgtgacacagcttgaactcggcgaaaccttatcaacttatgatgagaacacgagggatttcatgttccccggtccgaaccagatgagtgggcatcacgatagcaaccggcaagtgacaatgcgcaggatatctggccttcggggaaatgcccctcgcctggagttttccaccacctccgtgattaccgaatgtctcatcagctcccgaaagtgtcatacacaggacaaatttatctatcacctcgctccggtagaaaagagccacggcagactacagaaccgaacatcaaggtctcagaagaaaaaatctaagagtcctgaacgttcaaagtactgtatcaatgctaaaaactatgaacagcccactatctccagcaagtcccattctccatctccctatacgaaacggaggatgtgtgagctgagcgaagatacgagacggagactggcacacctgaacctaggtccttatgaatttaaaaaagagacagataaacccccatttgtgatcagacatgtcgacccgcctagccccagggcggacacgttgctcggaagctctggtcgcgattgcgagcgtgacgggtggagtcgcgtgcacaatgatcactcgcaccttggctgttgtagaccaaaagattacaaggtgatccgcacaccgcacggccgtgattttgatgactccctcgagaaatgcgaagagtacctctcaccccgaagctgtagcaaaccacgtcacagcgcacggacgttactggtgcactccgcaccatcaacaatgcccaagcattccccaagcccagtgctgaaccgtgctagcctgcgtgagcgtttccacagcgactggtgctctccttccaattgcgatgaaatccacgacagggttaaaaatgtgcttaagagtcaccaggcccaccaaagacacctgtatgacgagcgcgacctcgagaaggacgatgagctggagcttaagcgaagccttctgtgtcgtgacagcgcctacgactctgatcccgaatacagttcgtgtcaacaacctagaggcacatttcatctggacgacggggagtactggtccaatagggcagcctcatacaaaggaaagtcccatagaccaattttcgagaattccatggataaaatgtatcggaatttgtacaagaaagcctgcagctctgcgagtcacacgcaggaatcattttag

SEQ ID NO: 242205 - DNA, 1377 bp, Artificial Sequence
  Description of Artificial Sequence: Synthetic coding sequence
atggatgggagcaggagagtgcgggcaacaagcgttctgcccaggtatggccctccttgtctctttaaaggccacctcagcacaaaaagtaacgctttctgtacagatagcagctccctgcggttgtccacgcttcagctggttaagaaccacatggccgtccattataacaagatcctttctgctaaggccgctgtggactgtagcgtgcccgttagtgtctccacttcaatcaagtatgcagatcagcagagacgggaaaaactaaagaaagagctcgcacaatgtgagaaagagttcaagctgaccaaaactgcaatgcgcgctaactataagaataatagcaaatccctcttcaacaccctccaaaagccatcaggtgaaccccagatcgaggatgatatgctgaaggaggagatgaatggattttccagtttcgcaagaagccttgtgccaagttccgagcgcctgcatctctctctgcacaagagcagcaaagtcatcacgaatgggcctgaaaagaatagttcatcctcgcccagctcagtcgattatgctgcctctggtccacgaaagttgtcgagcggggctctctatggaaggcggcctcgcagcacctttcctaactcccatagattccagttggtaattagcaaggccccaagcggagacctgcttgataagcacagtgagctgttttccaataagcagctcccattcacacccagaactttgaaaactgaagccaaaagtttcctctcccagtataggtactacactccagctaaacggaaaaaagactttaccgaccaacgaatcgaagctgagactcagactgaattgtcgttcaagtccgagctgggaactgccgaaaccaaaaacatgacggattctgagatgaacataaaacaggcctctaattgtgtcacatacgacgctaaggagaagatcgcaccattacccctcgagggacacgactctacctgggatgagataaaagacgacgccctccagcattcaagcccgagggccatgtgtcagtattctctaaaaccgccttctacccgaaaaatctatagcgatgaagaggagttactgtatctgtcttttatcgaggatgtgaccgacgagatcttgaagctcggtctgttcagcaatagattcctggaaaggttatttgaacggcatattaagcagaacaaacacctggaggaggaaaagatgaggcacctacttcacgtcctgaaagtggatctggggtgcacaagcgaggaaaacagcttctcgagcgtgaaaggagacaataaccacgacatggaacttagtacactcaaaattatggagatgtcaattgaggactgcccgcttgacgtttag

SEQ ID NO: 242206 - DNA, 1704 bp, Artificial Sequence
  Description of Artificial Sequence: Synthetic coding sequence
atggatggaagtcggagggtcagggccactagcgtcctccctcgctatggaccaccatgccttttcaagggacatctgagcacgaagtccaatgctgccgtcgactgcagtgtacctgtcagcgtgtctacaagcataaagtatgctgatcaacagagaagagaaaaactgaagaaagaactcgcccagtgtgagaaggaattcaaattgactaagacggccatgcgagcgaactataaaaacaactccaagagcttgtttaatacactgcagaagccgagcggggagccccaaatagaagacgacatgctgaaggaagagatgaatgggttctcctcatttgcgagaagcctggtaccttcttctgaacggttgcatctctcactccacaaaagctcaaaagtgatcaccaacgggcctgaaaagaacagctcatcatcaccatcatccgtcgactacgctgcttctgggcctaggaagctctcttccggggctctctacggcaggcgtcctagaagtactttccccaatagtcatcggttccagctcgttatcagtaaggccccatccggcgacttactcgacaaacacagcgagcttttttccaataagcaattgccattcacaccaagaactttgaaaacagaggccaaatcttttctgtcacagtaccgctactacacaccagctaagagaaagaaagactttaccgaccagcggatcgaggctgagacacagacagagctttcctttaagtcagagctgggcactgcagagactaagaacatgaccgatagtgagatgaatatcaagcaggcttcaaattgcgtcacctacgatgccaaagaaaaaatcgcacccctgcctcttgagggccatgatagtacctgggacgaaattaaggacgatgccttgcagcactcttcaccccgtgccatgtgtcagtacagcctaaaacccccaagtaccaggaagatctatagtgacgaagaagaattgctttatctctcattcattgaggacgtgacggatgagattctgaagctgggactgttctctaaccgattcttagagagactctttgaacggcacataaaacagaataaacatctggaggaggaaaaaatgcggcacttgttgcacgtgctgaaggttgatctgggatgtaccagcgaagagaattctgtcaagcagaatgacgtggatatgctcaacgtctttgacttcgaaaaggctgggaactctgaaccaaacgagcttaagaacgagagcgaggtcaccattcagcaagaacgacagcagtatcagaaggcccttgatatgctgctctctgcccctaaagatgaaaacgagatttttccatccccaaccgaattttttatgccaatctacaagagcaagcatagcgaaggtgtgatcatccagcaggtgaacgatgagacaaatctggagacttcaactctggatgagaatcacccatccatcagtgactctctgacagacagagagacatcagtcaacgtgatcgagggagatagcgatcctgaaaaggttgagatctccaacggcctgtgcggtctcaatacttctccatctcaatccgtgcagttttcatccgtcaagggggataacaaccatgatatggaacttagcaccctgaaaattatggaaatgagcatcgaggattgcccgctggacgtgtag

SEQ ID NO: 242207 - DNA, 1800 bp, Artificial Sequence
  Description of Artificial Sequence: Synthetic coding sequence
atggatgggtccagacgagttcgggcaacttctgtgctgccccgatacgggcctccctgcctatttaagggacacctatccactaagagtaatgccttttgcactgattcaagtagtctccgactaagtacactgcagttagttaagaaccatatggctgtccattataataaaatcctctctgccaaggcggctgtcgattgctctgtgccggtgtcggtgagcactagtataaagtacgccgatcagcagcggcgagaaaagctcaaaaaagagcttgcacagtgtgaaaaagaattcaaacttaccaagaccgcaatgcgcgcaaactacaaaaataattccaaatctctgtttaataccttgcagaaaccctcaggagagccgcagattgaagacgacatgttgaaggaagagatgaacggcttctccagcttcgctagaagtttggttcctagctcagagcgcctgcacctgtcactccacaaaagttcaaaagtaattacaaatggtccggagaagaatagctcatcctctccgtctagcgtcgactatgccgcaagcggccctcggaaattgagctcaggcgctctgtacggcagacggcctaggtctacattccctaactcacacaggtttcagttagtcatatccaaggctccttcaggagacctgcttgataagcactccgagctgttcagcaacaagcaactgcctttcacgcccaggacacttaagacggaggctaagtctttcttatctcagtacagatattataccccagcaaaaagaaaaaaggatttcacagatcagcgaatagaagccgagactcagacggagctttctttcaaaagcgaattgggtacagcggaaacaaagaacatgaccgattccgaaatgaatatcaagcaggccagcaattgtgtgacttatgatgctaaagagaaaatagcgcctttgcccctcgagggacacgacagtacttgggatgagattaaggacgatgccctccaacattccagtccacgtgcaatgtgccaatatagcttgaagccacctagtacaaggaagatctattctgatgaggaggaactcttatatctaagcttcatcgaggacgtgactgatgagatcttgaaactgggcctgttttctaaccgttttctcgagcgcctgttcgagcgtcacattaagcagaacaagcatcttgaagaggagaaaatgagacatttgcttcacgtcctgaaagtagacttggggtgcacaagcgaagaaaattctgttaaacagaatgatgtagacatgttgaacgtcttcgatttcgaaaaagccggaaacagcgagccaaatgagctcaagaatgagtccgaagtcactattcagcaagaaagacaacaataccagaaagcgctggacatgctcctgtctgccccaaaagacgagaatgagatcttccccagtcctacggaattttttatgcccatctacaagagcaaacatagtgagggcgtaattattcaacaggttaacgacgaaactaacttggaaacgagtaccctggacgagaaccatccatctattagcgactccctcactgaccgcgagacatcggtgaacgtgatagagggcgatagtgaccccgaaaaggttgagatctctaatggcttgtgcgggctgaatactagtccaagccagagcgtgcaattctcaagtgtgaaaggcgataacaaccatgacatggaactcagtacactgaagattatggagatgtcgatcgaggattgccccttggacgtgtag

SEQ ID NO: 242208 - DNA, 1704 bp, Artificial Sequence
  Description of Artificial Sequence: Synthetic coding sequence
atggacgggtcacgacgggtgcgcgctacctccgtcctgccgcgatatggcccaccttgtctattcaagggacatctgtcaactaagtcaaatgccgcagtagattgcagcgtgcctgtctcagtgtcaacttcgatcaagtatgccgaccagcaacggagagagaagctgaagaaggaactggcgcagtgtgaaaaggagtttaaactgaccaaaactgctatgcgcgcaaactataagaacaattccaagtcacttttcaatacactccagaagccgtcaggagagccgcagatcgaagacgacatgttgaaggaagagatgaacggcttttcttcattcgccagatccctggtcccctcctctgaaaggttgcatctttccctgcataagtcttctaaggttattacaaacggcccagagaaaaactcctcaagcagcccgtctagtgttgactatgcggcatctggcccacgaaaattgagtagcggcgctctttatggccgtcggccacgcagcaccttcccaaactcccaccgcttccaactggtgatctccaaggcaccttctggcgacctgctagataaacacagcgagctgtttagcaataagcagttgccctttacacctagaactttgaagactgaggcaaagagctttctatcacaatataggtactacaccccggctaagcggaagaaggatttcactgatcaaagaatagaggcagaaacccagaccgaactttcattcaagagcgaactgggtactgctgaaaccaagaacatgacagattcagaaatgaatataaagcaagccagcaactgcgtcacctacgacgctaaagaaaaaatcgctccactgccgctggaaggacacgacagtacatgggatgagataaaggatgacgctcttcagcattcatcaccaagagccatgtgccagtatagtttaaagcctccttccacgcgtaagatctatagcgatgaggaagagctgctttacctttcttttatcgaggatgtgacggatgaaatactgaagttaggcctctttagtaacagattcctggagagactttttgagcgccacattaaacagaacaagcacctggaagaagaaaaaatgcgccatctcttgcacgtgctgaaagtagacctcgggtgcacttctgaggaaaactccgtgaaacagaatgacgtggatatgttgaatgtttttgactttgagaaagcaggtaacagcgagccaaatgagttgaaaaacgagtcagaggtgaccatacaacaggagcgccagcaataccagaaggcactggatatgctccttagcgctcctaaggacgaaaacgaaatcttcccttctccaacagagttctttatgcctatctacaaaagcaaacattccgagggcgttattattcaacaagtcaacgatgaaactaatttagaaacttctactctggatgaaaaccacccttctatcagcgacagccttactgacagagagacaagtgtgaatgtgattgagggtgactcggaccctgagaaggtagaaataagcaatggattgtgtggcctgaacactagtccaagccagtccgtgcaattcagctctgtgaagggtgataataaccacgacatggaactcagtaccctcaagatcatggaaatgtctatcgaggactgccccctggacgtctag

SEQ ID NO: 242209 - DNA, 318 bp, Artificial Sequence
  Description of Artificial Sequence: Synthetic coding sequence
atggcccctgctggaatgtcaggggcacaggacaactcatgtctgtaccaggaaatcgcgccttcttttcagagattgccttgtcccagaacatcttctcgtcacttctccgaggctatgacctgcccttgcggctggaggccattcaaagggggtcctggaggtctgaaggggcctgtttggcctgccaaagaggaaaactcctgtagtcatgggagaatacaaagggttcagaggcgacgggtcccatcagcaagcccactcatccagaaaatcaatcgaaggtcggtgctcttccatccttactgttggagctag

SEQ ID NO: 242210 - DNA, 1638 bp, Artificial Sequence
  Description of Artificial Sequence: Synthetic coding sequence
atgtctaggaagcagaatcaaaaggactcatcgggcttcattttcgaccttcagtcaaacaccgtgcttgctcagggcggagcttttgagaacatgaaagaaaaaatcaatgccgttcgcgctattgtgccaaacaagtcgaataatgaaatcattctcgtgcttcaacattttgacaactgcgtggataaaactgttcaggccttcatggaaggctctgcaagcgaggtgctgaaagaatggactgtgactggaaagaaaaagaataagaagaagaaaaataaaccaaagccagccgcagaaccgtctaatggcatccccgattcaagcaaatcagtttctattcaggaagaacaatctgctccatccagcgaaaaaggcggaatgaacggataccatgtgaacggggctatcaacgacaccgagtcagtggattcattgtccgaggggctcgaaacactgagcattgacgccagagaactcgaggaccccgagtccgctatgctggatacgctggataggacgggctctatgcttcaaaatggagtgtccgacttcgagaccaagagtctgaccatgcattccattcacaactcacagcagccaaggaacgctgccaagtctttatcacggccaaccacggagacgcagttctcaaatatgggaatggaggatgttcctctagctacctcgaaaaagttgagtagcaatattgagaagtcggtgaaagatcttcagaggtgtacggtctctctggcacgctaccgcgtggtcgtgaaggaggagatggatgcatcaatcaaaaaaatgaaacaagcttttgcagagctggagagttgcctgatggaccgggaggtcgcacttctagccgagatggacaaagtgaaggcggaagcgatggagatccttctctctagacagaagaaagctgaattgctgaagaagatgactcacgtcgcagtgcagatgtccgaacagcagctcgttgaactgagagcggacatcaaacactttgtcagcgaacggaaatacgacgaggacctgggtcgggtggcaaggtttacgtgcgatgtcgagacgcttaaaaagagtatcgatagcttcggccaggtctcccacccaaagaattcctattccaccaggtcgcggtgctctagtgtcacctctgtgtccctcagcagtccaagtgacgcctccgctgcctcatcaagcacttgcgcgagccctccatccttgacatctgcgaacaagaaaaactttgcccctggcgaaactccagcggcaattgctaactcttccgggcagccatatcaacccttacgggaggtgctgccagggaatcgtcggggaggacagggttatagacctcagggccagaaatcaaatgaccctatgaatcagggcaggcatgacagcatgggaaggtacagaaattcatcgtggtatagctctggatctcgttaccagtccgcacccagccaggcgcctggcaataccatcgaaagaggtcagactcattcagctgggaccaatgggactggggtcagcatggaaccatcaccacctactccctcttttaaaaaaggtcttcctcagcggaagcccagaacctcccaaacagaagcggttaattcttag

SEQ ID NO: 242211 - DNA, 1638 bp, Artificial Sequence
  Description of Artificial Sequence: Synthetic coding sequence
gtctctaaaaaaaagaagaagaaggacagtagcggctttatctttgatctccaaagtaatactgtcctggctcagggtggtgcgttcgagaacatgaaagagaaaatcaacgcggtgcgagctattgtacccaacaagagcaataacgagattatcctcgttctccagcattttgataactgtgtggataaaaccgttcaggcattcatggaaggatctgcatccgaggtgcttaaggagtggaccgtgacaggcaaaaaaaagaataagaagaagaagaataagcctaagcctgccgcagaacctagtaatggaattcctgacagtagcaagagtgtaagcattcaggaagagcagtcggccccaagtagcgaaaagggcggtatgaacggataccatgtgaacggggcaattaacgatacggaaagcgtggattccctcagtgaaggccttgagacgctgagcatcgacgccagagagttagaggatccggaatccgccatgctcgacactctggatagaaccggatcaatgctccagaacggggtgtccgactttgagacaaaaagccttacaatgcactcaattcataattctcaacagccccgaaacgctgcgaaatcactgagtaggcctaccactgagactcagttctccaacatgggcatggaagacgtgcctctggctaccagcaagaaactctcctccaatatagaaaaaagtgtcaaggatctacagcgctgcacagtctccctggccagatatcgggtcgtcgtgaaagaggaaatggatgcttccattaaaaaaatgaagcaggcttttgctgagctggagtcctgccttatggaccgggaggtggccttgctagcggaaatggacaaagtcaaggctgaggccatggaaattctcctcagtagacagaagaaggccgagctgctgaaaaaaatgacacacgtcgccgtgcagatgagcgaacagcagctggtggagctgagagcagacataaagcactttgtgtccgaacggaagtacgacgaagacctgggtcgggtggccaggttcacctgcgatgtcgaaactcttaaaaagtctatcgactctttcggacaggtgtctcatccaaaaaattcttactcaacgcgatctaggtgctcttctgtgactagtgtctcactctcttcaccatctgacgccagcgcggcaagctcttccacatgtgcttctcccccttccctaacctctgcgaataaaaagaatttcgctccaggagagaccccagcagccattgctaattcctccgggcaaccttatcagcccctgcgggaggttctgccgggtaacaggcgagggggacagggttacaggcctcaaggtcaaaaatccaacgatccaatgaaccagggaaggcatgattccatgggcaggtaccggaattcttcctggtatagttcaggctctaggtaccagagtgcaccaagtcaggctccaggtaatactatcgagcgcggacaaacacattcggccggtacaaacgggaccggcgtgagtatggaaccctcccccccaacgccttccttcaaaaaaggcttaccccagaggaagcctcggacctcccagactgaggccgtcaactcatag

SEQ ID NO: 242212 - DNA, 27 bp, Artificial Sequence
  Description of Artificial Sequence: Synthetic coding sequence
atgagtagaaagcagaatcaaaaatag

SEQ ID NO: 242213 - DNA, 27 bp, Artificial Sequence
  Description of Artificial Sequence: Synthetic coding sequence
atgtcacgtaaacagaaccagaagtag

SEQ ID NO: 242214 - DNA, 204 bp, Artificial Sequence
  Description of Artificial Sequence: Synthetic coding sequence
atgagccggaagcaaaatcaaaaagactcctccggctttatctttgacctgcagtccaacacagttctcgcccagggcggagcctttgaaaatatgaaagaaaagattaatgcagtccgcgctattgtgcccaacaagtcgaataacgagattatactcgtgcttcagcattttgataattgtgtagacaaaacagtgcagtag

SEQ ID NO: 242215 - DNA, 102 bp, Artificial Sequence
  Description of Artificial Sequence: Synthetic coding sequence
atgtcaaggaaacagaatcagaaagacagttccggattcattttcgatctgcagagcaacactgtgctcgctcagggcggagctttcgaaaacatgaaatag

SEQ ID NO: 242216 - DNA, 18 bp, Artificial Sequence
  Description of Artificial Sequence: Synthetic coding sequence
atgagccgaaagcagtag

SEQ ID NO: 242217 - DNA, 111 bp, Artificial Sequence
  Description of Artificial Sequence: Synthetic coding sequence
atgagtagaaaacagaaccagaaagactcctccggctttatctttgaccttcagtcaaacacggtgctggctcagggaggggcattcgaaaatatgaaagagaaagtttag

SEQ ID NO: 242218 - DNA, 201 bp, Artificial Sequence
  Description of Artificial Sequence: Synthetic coding sequence
atgtctaggaagcaaaatcaaaaagattcaagtggttttatctttgacctgcagagcaacactgtgctggcccagggaggggcttttgagaatatgaaggagaaaatcaacgccgtgcgcgcaatcgttcctaacaaatcgaacaacgagataatcctggttctccagcacttcgataactgcgtagacaagaccgtttag

SEQ ID NO: 242219 - DNA, 105 bp, Artificial Sequence
  Description of Artificial Sequence: Synthetic coding sequence
atgagcagaaagcagaatcagaaagactcttctggttttatattcgacctccagtctaacactgtactggctcaaggcggtgccttcgaaaatatgaaagagtag

SEQ ID NO: 242220 - DNA, 297 bp, Artificial Sequence
  Description of Artificial Sequence: Synthetic coding sequence
atgtccagaaaacagaaccaaaaggacagctcagggttcattttcgacctacagtcaaacaccgtgctcgcacaagggggagcctttgagaatatgaaggaaaagattaacgctgtgcgggcaatcgtccctaacaagagtaataacgaaatcatattagttttgcagcactttgacaattgcgtggataagaccgtacaagccttcatggagggttccgcctccgaggtgttgaaagagtggacagtgaccggaaagaagaagaacaagaagaaaaaaaacaaacctaaaccatag

SEQ ID NO: 242221 - DNA, 225 bp, Artificial Sequence
  Description of Artificial Sequence: Synthetic coding sequence
atgtctcggaagcagaaccagaaggatagtagtggctttatatttgatctgcagtccaatactgtgctggcccagggcggagcttttgaaaacatgaaggaaaaaataaacgccgtgagggccatcgtgcccaataaaagcaataacgagattattttagtattgcagcattttgacaattgtgttgacaaaaccgttcaggctttcatggaaggctctgcctag

SEQ ID NO: 242222 - DNA, 33 bp, Artificial Sequence
  Description of Artificial Sequence: Synthetic coding sequence
atgagtcgtaaacagaaccagaaggattcctag

SEQ ID NO: 242223 - DNA, 1638 bp, Artificial Sequence
  Description of Artificial Sequence: Synthetic coding sequence
atgtccaggaaacagaaccagaaagacagcagcggattcatcttcgatctacagtctaatacagtattggcgcaggggggtgcatttgaaaatatgaaagaaaagattaatgccgtaagagccattgtccctaataagtcaaataacgagatcattttagtgttgcaacacttcgacaactgtgtggacaagacggtgcaggcattcatggaaggctccgcctccgaagtgctgaaggagtggactgtaactggtaaaaagaagaataagaaaaaaaaaaacaaaccaaagcctgcagccgagccttcaaatggcattcccgatagctccaaaagtgtctccattcaggaagaacagagtgccccatcttccgaaaaaggaggtatgaacggctatcacgtcaacggggctattaacgacaccgaatcagtcgatagtttgagcgaaggcttagagacactgagtattgacgccagggagttggaggatcccgagtccgcaatgcttgacacccttgatcgaaccggatcaatgcttcagaatggcgtctcagactttgaaactaaatccctgactatgcatagtatccacaattcacaacagccacgaaatgctgccaagagcctttcgcgacccactaccgagacccaattcagtaacatgggaatggaagatgtaccgctggccacctccaaaaaattgagcagcaatatcgagaagagtgttaaagacctgcagagatgcaccgttagcctggccagatacagagtggttgttaaggaggagatggacgcctcaattaagaaaatgaaacaggcgttcgcagagctggaaagctgtctgatggacagggaagtcgctcttctcgcagagatggacaaggttaaggccgaggcaatggagattctcttgagtcgccagaagaaggcggaactactaaagaaaatgacacacgtggcggttcaaatgtcagagcagcagctggttgagctgagagccgatatcaagcacttcgtgagtgaacggaaatacgatgaggacctggggcgtgtcgcccgtttcacttgtgatgttgaaaccctgaagaagagcatcgattcatttgggcaggtgtcccacccgaaaaatagctactcaacccggtctcggtgtagctcagtgactagtgtgtccctgagtagtccatctgatgcctctgcagctagcagctcgacatgcgctagcccacctagcctgacgtcggctaacaagaagaactttgcacccggagaaacaccagctgcaatcgccaactctagtgggcagccctaccagccgttgcgtgaagttctcccaggcaaccggagaggcggtcaaggctaccgacctcagggacagaaaagtaatgatcccatgaaccaggggaggcatgactccatgggccgataccgcaattcgtcctggtatagctccggctcaagataccagtcagctccttcccaggcaccgggaaatacaatagaaagaggccagacgcacagcgctggaaccaacggtactggcgtcagcatggagccttcccctcctactccatcattcaagaagggcctgccccagcgtaagccacggacaagtcagacagaggcggtgaatagttag

SEQ ID NO: 242224 - DNA, 1638 bp, Artificial Sequence
  Description of Artificial Sequence: Synthetic coding sequence
atgtcccggaagcagaatcagaaggattcatctgggtttatattcgacctacagtctaatacagtgttggcccagggcggagccttcgagaacatgaaagagaaaatcaatgcagtcagggcgatcgttcctaacaagagtaacaatgagataatcctggtactacagcactttgataattgtgtggacaagacggtgcaggccttcatggaaggctccgcctccgaagttctcaaggaatggaccgttacgggaaagaagaaaaataaaaaaaaaaaaaataaacccaaacccgcagccgaaccctctaatggcattccagactcgtctaaatcggttagcatccaggaggaacagtcagccccttccagtgagaagggcggtatgaacgggtatcatgttaatggtgccatcaacgacaccgagagcgtggacagcctgtccgagggtctcgaaacactgtccatcgacgcacgtgaactcgaagatcccgaatccgcaatgctagacactctagaccgcaccggctcaatgctccaaaatggcgtgagtgactttgaaactaaatctcttaccatgcattccattcacaacagccagcaaccacgcaatgccgctaagtcactgtctcgccctaccacagagactcaattctccaacatgggaatggaggacgtgccattagcgacatccaagaagctgtcctctaacatcgaaaaatcagttaaggacttgcaaagatgtaccgtgtcactagcgaggtaccgcgttgtcgtaaaggaggaaatggatgcttctattaagaagatgaagcaggcatttgcagaacttgagtcgtgcctgatggaccgagaggtcgcacttcttgccgagatggataaggtgaaggccgaagccatggagatacttttgtcgagacagaagaaggccgagctgctgaagaagatgacccacgtggctgtgcaaatgtccgaacagcaattggtggagttgcgtgcggatattaaacatttcgtctccgagcggaagtatgatgaggatctgggaagagtggccagattcacgtgcgatgtcgagacactgaagaagtctatagatagctttgggcaggttagccaccccaagaattcttattcaacgcgtagtaggtgctcctcagtcacaagcgtctccttgagtagcccatcagacgcctccgctgctagttcctccacctgtgcgtctcccccatcgttgacatccgccaataaaaaaaactttgcgcctggggaaactccagccgctatcgcaaacagttcaggccagccttatcagcctctaagagaagtcttgcccggtaaccgcagaggcggacaggggtacagaccccagggacaaaaaagcaacgatccaatgaatcagggcagacatgatagtatggggagatacagaaatagctcctggtatagtagtggctccagatatcaatctgcccctagccaggctcccggaaacacaatcgaaaggggccagacccactccgctggtaccaacggaaccggggtcagtatggagccatcccccccaacaccctcctttaagaaaggtcttccacagcggaaaccaagaacttctcagactgaggccgtgaactcatag

SEQ ID NO: 242225 - DNA, 1677 bp, Artificial Sequence
  Description of Artificial Sequence: Synthetic coding sequence
atggctgagcttaacacgcacgttaacgttaaagagaagatctacgccgtgcgatctgtcgtacccaataagtccaataacgagatcgtactggtcctgcaacagttcgacttcaatgtggacaaagctgtgcaggctttcgtggacgggtccgccatacaagtgttgaaggagtggaacatgacaggaaaaaagaagaacaataagcgaaagagatcaaagtcaaagcaacaccagggtaacaaggacgctaaagataaagtggaaaggcctgaagccggacccctgcagcctcagcccccacagatccaaaatggccctatgaacgggtgcgagaaagatagcagctctaccgattccgccaatgagaaaccagccctgatacccagagagaagaaaatctccatactcgaagaaccttctaaggctttgagaggagtgacagaaggtaaccggctcttacagcagaaacttagcttagacggaaatcctaagcctatacatgggactactgagaggtctgacgggcttcagtggtccgcggagcaaccatgtaacccaagtaagcccaaggcaaaaacttctccagtaaaaagcaatacccctgcggcacatcttgagatcaaacccgatgaattagccaagaagcgaggccctaatattgaaaagagcgtgaaggacctgcagcgctgtacagtcagcttaaccagatatagggtaatgatcaaggaggaggtagactcatccgtgaagaagatcaaggcagcctttgcagaacttcacaactgcattatagacaaggaggtgtctctgatggccgagatggataaagtcaaagaagaagccatggaaatcctcactgctcggcagaagaaagccgaagaactgaaaaggttgaccgacctggcctctcagatggcggaaatgcagctcgccgagctcagagccgagataaaacatttcgtgagcgaacgcaaatacgacgaggaattgggcaaagccgctcgattcagctgcgatatcgagcagctgaaggcgcagattatgctctgcggggagataactcatccaaaaaacaattatagttcccgcaccccctgtagctctcttctgccactgctcaatgcgcacgccgcaactagcggaaagcagagcaacttttctcgaaagagtagtacccacaacaagccttcagaaggcaaagccgctaacccaaaaatggtgtcttccctgccatcaactgccgatccgagtcaccagactatgcccgcaaacaaacagaacggttcgtcaaatcaaagacgcaggtttaatccgcagtaccacaacaatagactcaatggccctgcaaagagccaggggagtggtaacgaagcagagccattgggaaagggaaactcacgacatgagcatcgccgtcagcctcacaatggattcaggcctaaaaataaaggaggagccaagaatcaagaggcatctctgggcatgaaaacacctgaagctcccgcacacagtgaaaaaccaaggaggagacagcacgctgcggacactagcgaagcccgtcccttccggggttccgtggggcgagttagccaatgcaatttatgcccaacacggattgaggtgagcaccgatgccgcagtcttgtcagtgcccgctgttacactagtggcctag

SEQ ID NO: 242226 - DNA, 1470 bp, Artificial Sequence
  Description of Artificial Sequence: Synthetic coding sequence
atggccgagctgaatacacacgtcaacgtaaaagaaaagatctatgcggtcaggtctgtcgtacctaacaaaagcaacaatgagatcgtacttgtgctccagcagttcgacttcaacgtagataaggccgtccaggcattcgtggatggttccgctatccaggtactgaaggagtggaacatgacaggcaaaaaaaagaataataaacgtaaacgcagtaaatctaaacaacaccagggcaataaagatgctaaggacaaggtggagcgcccagaggcgggaccgctgcaacctcagccccctcagatccagaatgggcctatgaatgggtgcgagaaggactcatcaagtaccgacagcgccaatgagaaacccgctctgataccgagagaaaaaaagatctctattttggaggagccaagtaaggccttgcgcggagtcacaggacccaatattgagaagtccgtgaaagacttacagcgttgtacagtgtctctgacccggtatcgggtgatgattaaggaagaggtggactctagcgttaagaagattaaagccgcttttgcagaactgcacaactgtataatcgacaaagaagtgagcctgatggcagagatggataaggttaaggaggaggcaatggaaattcttacagccaggcaaaagaaagctgaagaactcaaaaggcttacagacttagcgtcccagatggccgaaatgcagttggctgagttaagggctgagatcaagcacttcgtgtcggagcgaaagtatgacgaggaactggggaaagcggcacgcttctcttgcgatatcgaacagctcaaggcccagattatgttatgcggagagatcacacaccctaagaataactactctagcagaaccccgtgcagcagtctgctacccctactcaacgcccacgctgccacatctggtaaacagagcaatttttctcgtaagtccagcacccacaataaaccatcagaaggtaaagccgctaatcccaagatggtgtctagtctacccagtactgctgacccgagtcaccagacgatgcctgccaacaaacagaatggtagttcaaatcagcgcagaagattcaacccacaatatcataacaatagattgaacggaccggcaaagtcccagggatcaggcaacgaagccgaaccattggggaagggtaactcaaggcacgaacacaggagacagccacacaacggattcaggccgaagaacaaagggggtgccaagaatcaggaggcatctcttggcatgaagacaccagaggccccagcgcacagcgaaaaaccccgtaggagacaacacgctgccgatacgagcgaggctaggccgtttagaggatccgtaggccgtgtgtcacagtgcaacctgtgcccaacgcgaattgaggtcagcaccgacgcagcagtgctgtctgtccctgcagtgaccctggtggcctag

SEQ ID NO: 242227 - DNA, 1677 bp, Artificial Sequence
  Description of Artificial Sequence: Synthetic coding sequence
atggcagagttgaatacccacgtaaatgtgaaagagaagatttatgcggtgaggagtgtggtgcctaataagtccaataatgagattgtactcgtgctgcaacagttcgacttcaatgttgataaggccgttcaagccttcgtggatggttccgccattcaagtccttaaggagtggaatatgacaggcaaaaagaagaataacaagcggaagagatccaagagtaagcagcaccaggggaataaggacgctaaggataaagtagaaaggcctgaggcgggtcctctgcagcctcagccgccacagatccagaacgggcctatgaatggctgcgagaaggactccagtagtaccgattccgctaacgagaaaccagccctcattcccagggagaaaaaaatcagtatcctcgaagagccctctaaggcacttcgcggtgtgactgagggaaatcgtctgcttcaacagaaactttcactggacggtaaccctaagccaatccatggaacaacggagcggagcgacggtctgcagtggtccgcggagcagccctgcaatccatccaaaccaaaagcgaaaacctcccccgtaaaatcaaacacaccggcagcccatctcgaaatcaaacctgatgagctggcaaagaagagaggtcctaacatcgagaaatcggtcaaggacttacagcgatgcactgtcagcctgactagatatagagtgatgataaaggaggaggtcgattcatccgtgaaaaaaataaaagcagccttcgctgaactgcataattgcattattgacaaggaagtatccctgatggcagaaatggataaagttaaagaggaagccatggagatcttgaccgccaggcaaaaaaaagccgaggagctgaaacggctcacagacctcgctagtcaaatggcagagatgcagctagccgagctgagggccgagatcaagcacttcgtgagcgagagaaaatacgatgaagaattaggcaaggctgcgagattcagctgtgacattgagcagctgaaagcacagattatgctgtgcggcgagatcactcacccaaagaataattacagctctagaaccccatgctcctcactgctcccactactgaacgcgcatgcagcaacctccggtaagcagtccaacttctctagaaaatcaagcactcataataagccctccgaggggaaagccgctaaccccaaaatggtgagctcactccccagcactgctgacccctcccatcagacaatgccagctaacaaacaaaacggctcatccaaccagcgacgccgattcaacccccaataccacaataaccggttaaacggcccagcaaagtctcagggctcgggtaacgaagcagaacctctgggcaagggcaattccagacatgagcaccgacggcaaccgcacaatggattcaggcccaagaataaggggggtgccaaaaaccaggaagcctcattgggaatgaaaacacccgaagcccctgcacactctgagaagccacggcgtcggcagcatgccgcagatacgtctgaagctaggcccttccgaggttctgtcggaagggtcagccaatgtaacctgtgccccacacggattgaggttagtaccgacgccgctgttttaagtgtcccagccgtgacactggtggcctag

SEQ ID NO: 242228 - DNA, 1701 bp, Artificial Sequence
  Description of Artificial Sequence: Synthetic coding sequence
atggcctacagcaccaggtctaaaatggccgagctcaatacacacgttaacgtgaaggagaaaatttatgctgtgcgctccgtggttcccaataagtcaaataatgaaatcgtcttagtccttcagcagtttgactttaacgtggacaaggccgtgcaggcctttgtggatggttctgcaatccaggtccttaaagagtggaatatgacgggcaagaagaagaacaataagagaaaaagaagtaaatccaagcaacatcaaggaaataaagacgctaaggacaaggtggagaggccggaggcagggccactgcaaccccaaccgccacagatacagaatggcccaatgaacggttgtgagaaagacagctcctccacagactctgcaaacgaaaagccagccctaattcctagggaaaaaaagatcagcatacttgaggagccttccaaagcactccggggagtgacagaagggaaccgcctccttcagcagaaactgagcctggatggaaaccccaaacccattcatgggacaaccgagcggagcgatgggctgcagtggagtgccgagcagccatgcaacccatctaaaccaaaagctaagacatcccctgtgaagtctaacactccagccgctcacctggaaattaagcccgatgaattagcaaagaagcgcggacccaatatagagaagtctgtgaaggacctgcagcgatgtaccgtgtccctgacaaggtacagagtgatgattaaagaggaggtcgattcatccgtcaaaaaaattaaggccgcatttgcggaactgcacaattgcatcatcgacaaagaggtgtcattaatggccgagatggataaggtgaaagaggaagcaatggaaatcctaaccgcacggcagaagaaggccgaggaactcaagagactgacagatctagccagtcagatggcggagatgcaactagccgaactacgcgctgagattaaacatttcgtcagcgagcgaaaatatgacgaggagcttgggaaggcggcaaggttctcttgcgatatagaacaacttaaagcacaaataatgctttgcggagagataacccaccctaagaacaactatagctcacggacaccgtgtagcagcctgttgcctctgctgaatgctcatgcagccaccagcggaaagcagagtaacttctcccgaaagtcctcgacccacaataagcccagcgaaggcaaggcagcaaacccgaagatggtttcatctctccctagcaccgcagacccttcccaccagactatgcccgctaacaaacaaaatgggtcaagtaatcaaagaaggcgcttcaaccctcagtaccacaacaacaggctgaatggcccagcaaagtcccagggctctggaaacgaggccgagccgttgggcaaaggaaactccaggcatgaacacagacggcagccccataacgggtttaggcctaaaaacaagggaggcgcaaagaatcaagaggcaagcctaggcatgaagacacctgaggctccggcacactctgagaagccacggagacgccaacacgctgccgataccagtgaggcgagaccttttcggggatccgtgggtagggttagtcagtgtaacctctgccccactcgtattgaggtctccactgacgcagctgtgctgtcagtcccagccgtgaccttggtggcatag

SEQ ID NO: 242229 - DNA, 801 bp, Artificial Sequence
  Description of Artificial Sequence: Synthetic coding sequence
atggctgagctgaacactcacgtcaacgttaaggaaaaaatatatgccgtgcggagtgtcgtgccgaataagagcaacaacgaaatagtgcttgtcctgcaacaattcgacttcaacgtcgacaaggccgtccaagcctttgtcgacgggtctgcaattcaagtgttaaaggagtggaacatgacgggcaagaaaaagaacaataaaagaaaaaggagtaagagtaaacagcaccaagggaataaagacgctaaggataaagtcgagcggccagaggctgggcctttgcagccacaaccaccacaaatccagaacggccctatgaatgggtgtgagaaggactcaagttcaacagacagcgccaatgagaaacctgcattgatccctcgcgagaagaagattagcatcctggaagagccgtccaaagcactccggggtgtgactggtcccaacatcgaaaaaagcgtgaaggacttgcagagatgcacggtgagcctgacgcgctaccgcgtgatgattaaggaagaggtggactcaagtgtcaaaaaaattaaggcagcctttgccgagctccataattgtattattgataaagaggtctcccttatggcggagatggataaagtgaaagaggaggccatggaaatcctgaccgctcgacagaagaaggctgaggagctcaaacggctgacagacttggcttctcagatggcagaaatgcagctcgctgaactgcgggctgaaatcaagcactttgtcagcgaacggaagtatgatgaggagctgggcaaagctgcctag

SEQ ID NO: 242230 - DNA, 1677 bp, Artificial Sequence
  Description of Artificial Sequence: Synthetic coding sequence
atggctgaactgaatacacacgtgaatgttaaagagaagatctatgcggtgcgtagtgtggtcccaaacaagagcaacaacgaaattgttttggtactgcaacagttcgattttaacgtggacaaggctgttcaggcttttgtggatgggagcgccatccaagtactaaaggagtggaacatgactggtaagaaaaaaaacaacaaacgtaaaagatcgaaaagtaaacagcatcagggaaataaggacgccaaggataaggttgagaggccagaggctggtccccttcagcctcaaccgccacagatccaaaacggtcccatgaatggttgtgaaaaagattcgtcttccacagactctgctaatgaaaaacccgcactgatcccaagagagaagaaaatctccatccttgaggagccttccaaagcactccgcggtgtcactgaggggaatcgcctgctgcagcagaaactatcactagacggtaaccccaaaccaatccatggtacaaccgagaggtctgatggtctgcagtggagtgcagagcaaccttgcaacccaagtaagcccaaggcaaagacaagccctgtaaagagtaacacaccagcagcccatttagagatcaaaccagacgagctggccaagaaacggggaccaaacatcgagaaatctgtgaaagacctgcagcgctgcaccgtgtccctgactagatacagggtgatgataaaggaagaagtcgattctagtgtaaaaaaaattaaagccgcttttgccgagctgcacaattgtataatcgataaggaagtctcccttatggcagagatggataaggtcaaggaggaggctatggagatcctcactgcccgacagaaaaaggcagaggaactaaagagattgacagacttggcaagccagatggcagagatgcaactggcagagctccgtgcggaaataaagcactttgtctcagaaaggaagtatgatgaggaattgggtaaggccgctaggttcagctgcgacatcgaacagttgaaggctcaaatcatgctgtgcggcgagataacacaccccaagaataactattctagccgcacaccttgcagtagtctgctgcccctgctgaatgctcatgctgctacaagcggcaaacaatccaacttctcacggaagagctcaacccacaataagccttcagagggcaaggccgctaatcccaaaatggttagctctctgccgtccacggccgacccgtcacaccagaccatgcccgcaaacaagcagaacggcagttcgaatcagcgacgaaggttcaaccctcaataccacaacaacaggcttaacggccctgcaaaatcacaggggagcggcaatgaggccgaacctctgggaaagggaaactctcgccatgagcacaggagacagccgcacaacggatttcggccaaagaacaagggcggtgctaaaaaccaggaagccagcctcggaatgaaaacccccgaggctcctgcgcattctgaaaaacccagaaggcgtcagcacgccgcagacacttctgaagctagacccttccggggatcagtcggacgggtgagtcaatgtaacctgtgtccaacccggattgaggtctccaccgatgccgctgtgctttccgtgccagccgtcaccctggtggcttag

SEQ ID NO: 242231 - DNA, 1767 bp, Artificial Sequence
  Description of Artificial Sequence: Synthetic coding sequence
atggatcccttttgccactcctctagcgaaacacggctgctgagcggaactttgctgtggataccacgtgcctacagcacacgaagcaaaatggctgagttgaatactcatgtaaacgtcaaagaaaagatctatgcagtgcggtctgtggttccaaacaagtccaacaacgagatcgtgctggtgttgcagcaatttgacttcaacgtcgataaagccgtccaggcattcgtagatgggtcagccattcaggtgctcaaagagtggaacatgaccgggaagaagaaaaacaacaagcgcaagcggtctaaatctaaacagcaccaggggaataaggacgctaaagacaaggtggaacggccagaggccggacctcttcaaccgcaaccccctcagattcagaacggaccaatgaacggctgtgagaaggactctagtagtaccgattccgccaacgaaaagcctgccctgattccacgcgagaagaagatctctatcttggaggaacctagcaaggcattgagaggcgtgaccgaagggaatcggttgcttcagcaaaagctgagcctggacgggaaccctaagcctattcatggtacaaccgagagaagtgacggtctccaatggtccgcggaacagccctgtaacccgtctaagccgaaagccaagactagccctgtaaagagtaacactccggcagcccatctcgagattaagcccgacgagctcgccaagaagcggggacccaacatagagaagtctgtcaaagatctccagcggtgcaccgtcagtcttacccggtacagggttatgatcaaagaagaggtggactcttccgtaaagaagatcaaggcagcttttgccgaactgcacaattgtatcatagataaggaagtgtctctcatggccgaaatggacaaagtgaaggaagaggctatggagatcttgaccgcacggcaaaagaaggcagaggaactcaaacggctgacagacctcgcatctcagatggctgagatgcaactcgctgaacttagggccgaaatcaaacatttcgttagtgaacgcaaatacgacgaagagctcggaaaagccgctcgtttcagctgtgatattgaacagctgaaagcacagattatgctttgtggtgaaatcactcatcccaaaaacaattactcatcgcgtacaccttgttccagcctgctacccctcctgaacgcacacgccgcaaccagtggaaagcagtctaacttctctagaaagagcagtactcataacaaacctagcgagggcaaggcagcaaaccccaaaatggtttcttctttacccagcacagcagacccctcacaccaaactatgcctgcgaataaacaaaacggttcatcaaaccaacgccgacggtttaacccccaataccataataatagactcaatgggcctgccaaatcgcagggatccggcaacgaggctgagcccttggggaagggcaactcccgccacgaacacagacgacagccacacaacggtttcaggcctaagaacaagggtggagctaagaatcaggaggccagccttggtatgaagacgcctgaggcccctgcacattccgagaaacccaggcgcaggcagcatgccgcagacactagcgaagcaagaccctttagaggcagtgtggggcgagtcagccagtgtaacctctgccccacgcggatagaagtaagtacagacgcagcagtactcagcgttccagcagtgacccttgtagcctag

SEQ ID NO: 242232 - DNA, 1677 bp, Artificial Sequence
  Description of Artificial Sequence: Synthetic coding sequence
atggccgagctgaacacccacgtgaatgtgaaggaaaagatttatgcagtcagaagtgttgttcccaataagagtaacaatgaaatcgtcttagtcctgcaacaatttgacttcaatgttgataaggcagtccaggctttcgtggacggaagcgcgattcaggtcttgaaagaatggaatatgacgggaaagaaaaagaacaacaagcggaaacgttcaaagtccaaacagcatcaaggaaataaggacgcaaaggacaaagtggagagacccgaggcaggccctctgcagccacagcccccacagattcagaacggtcccatgaatggatgtgaaaaagattcctcttctaccgattcagcaaatgagaagcccgcactgatccctagagaaaaaaaaattagtatactggaggaaccctcgaaggctctgaggggcgttactgagggcaatagactgttgcagcagaagctaagtctagacggtaatcccaagcccattcatggtacaaccgagcgttccgatggccttcagtggagcgccgagcagccctgcaatccaagcaaacccaaagccaagacctcacctgtgaagtctaatacaccggcagctcacctcgaaattaagccggacgaattagccaaaaagaggggcccaaacatagaaaaaagtgtgaaagacctccagaggtgtactgtgagcctgacacgttacagagtgatgatcaaagaggaggtcgattctagtgttaagaagatcaaggctgcgttcgccgagcttcacaattgcatcattgacaaggaggtgtctttaatggccgagatggacaaagtcaaagaggaggcaatggaaatactgactgcgaggcaaaagaaagctgaagaactcaagaggctaaccgacttagccagccagatggccgagatgcagctggctgagttgagggccgaaatcaagcattttgtgtcagagcgaaagtacgacgaagagctcggcaaggccgctaggttttcctgcgatatcgaacagctcaaagcacagataatgctgtgtggtgagatcacgcaccccaaaaataactacagctcccggaccccttgtagctctctgctccctttgctcaacgcccacgcagcaactagtggaaagcaatccaacttttctagaaagagctccacccacaacaaaccatccgagggtaaagccgcaaaccccaagatggtgtcctccctacccagtacagctgacccgtcccatcagactatgcctgccaataaacagaatggatcctccaaccaacgcagacgcttcaacccacagtaccacaataaccggctgaatgggcctgccaaatcacaggggagcggaaatgaagccgagcctctgggcaaaggaaacagtaggcacgaacaccgaaggcagcctcataacggctttaggccaaaaaacaaagggggtgcaaagaaccaggaagctagccttggcatgaaaaccccggaggcccctgcccactccgagaagccacggcgacggcagcacgccgcagatacctcagaggctagacctttcagaggatccgtgggaagggtctcacagtgtaatctttgccccacgagaatagaggttagcacggatgcagccgtactgagtgtccccgcagtaactttagttgcctag

SEQ ID NO: 242233 - DNA, 465 bp, Artificial Sequence
  Description of Artificial Sequence: Synthetic coding sequence
atggccgagctgaatactcacgttaatgtgaaggagaaaatttacgctgttaggtccgtcgtgcccaataagtccaataatgagatcgttctcgtgcttcaacaattcgacttcaacgtagacaaagccgtccaggcgtttgtggatgggtctgctattcaagtcctcaaggaatggaacatgacaggtaagaagaagaataacaagaggaaaagatctaagagtaagcagcaccagggaaacaaggatgccaaagataaagtggaacgtcccgaggccggaccgctgcaaccgcagccccctcagatccagaatggaccgatgaatgggtgtgagaaggattcgtcgtcaactgattcggcgaatgaaaagcccgctctcatacctagagaaaaaaagattagtatccttgaagaaccctctaaggccctcagaggtgtgactgaggggaaccggctgttgtag

SEQ ID NO: 242234 - DNA, 423 bp, Artificial Sequence
  Description of Artificial Sequence: Synthetic coding sequence
atggcagagttgaatacgcatgtcaacgttaaagaaaaaatctacgctgttcgctccgtggtaccaaacaagagcaataacgaaatagtccttgtgctccagcagttcgattttaacgtggataaagctgtgcaggcatttgtggacggatccgcaatccaagttcttaaggagtggaacatgacgggcaaaaagaaaaacaacaagcgtaaacgaagtaaaagtaaacagcatcagggcaataaggacgcgaaggacaaagtcgaaagaccggaggctggaccccttcagcctcagccaccccaaatccagaatggaccaatgaatggctgcgaaaaggacagctcaagtaccgactccgcgaacgagaaaccggctctgatcccaagagagaaaaagatttcaattctggaggagccgtag

SEQ ID NO: 242235 - DNA, 42 bp, Artificial Sequence
  Description of Artificial Sequence: Synthetic coding sequence
atggcggagctcaatacccatgtgaatgttaaagagaaatag

SEQ ID NO: 242236 - DNA, 285 bp, Artificial Sequence
  Description of Artificial Sequence: Synthetic coding sequence
atggctgagctaaacacacatgtgaacgtgaaagaaaagatctacgccgtcagaagtgtcgtcccaaataagtccaataacgaaatcgtgctcgtgctgcaacagtttgatttcaatgtggacaaggcagtacaagccttcgtagatggcagtgctatccaggtcctgaaagaatggaatatgaccggcaaaaaaaaaaataacaagaggaagaggagcaagagtaaacaacaccagggaaacaaggatgcaaaggataaagttgagcgcccagaagccggttag

SEQ ID NO: 242237 - DNA, 348 bp, Artificial Sequence
  Description of Artificial Sequence: Synthetic coding sequence
atggccgaactgaacacacacgtgaacgtcaaggaaaaaatttacgcagtgcggtcagtcgtccctaataagagcaacaatgaaattgtgttggtgttacagcagtttgacttcaacgtggataaggccgtacaggctttcgtggatggatccgccatccaggtattgaaggagtggaacatgactggcaaaaagaaaaacaataaacgtaagcgcagcaagagcaaacagcaccagggtaataaggatgctaaggataaggtggaacgaccggaagcaggcccacttcaacctcagcctccacagatccagaatgggcctatgaacgggtgtgaaaaggattcctag

SEQ ID NO: 242238 - DNA, 72 bp, Artificial Sequence
  Description of Artificial Sequence: Synthetic coding sequence
atggcagagcttaacacccacgtgaatgttaaggagaagatctatgcagtcaggtctgtagtgcccaattag

SEQ ID NO: 242239 - DNA, 522 bp, Artificial Sequence
  Description of Artificial Sequence: Synthetic coding sequence
atggccgagctaaacacccatgtgaacgtcaaggaaaaaatctacgccgtgcggtctgtcgtgcccaacaagtccaataatgagatagtgcttgttctccagcaatttgactttaatgtggataaggccgtgcaggccttcgtagacggctcagctatacaagtactgaaagagtggaacatgacaggaaagaaaaaaaataacaagcggaaaagaagcaaaagcaaacaacatcaaggcaacaaggatgctaaagataaagtcgaacgtccggaggcagggccactgcagccacagccaccacagatccaaaacggccctatgaatggatgtgaaaaggattcttcgagcaccgactccgctaatgaaaaaccggctctgatcccgagagagaaaaagatctcaattctggaggagccctcgaaagcccttaggggggtcacggggcctaacatcgagaaatccgtcaaggacctccaacgctgcaccgtgtccctaactcgctatcgcgtgatgatttag

SEQ ID NO: 242240 - DNA, 1677 bp, Artificial Sequence
  Description of Artificial Sequence: Synthetic coding sequence
atggcagaactgaacacgcacgttaatgtaaaagaaaagatctacgccgtccgttcagtggtgccgaataagtccaacaacgaaattgttttggttttgcaacagtttgactttaacgtggacaaagccgtccaggccttcgtagatgggtcagcaatccaggtcttgaaggaatggaatatgacagggaaaaagaaaaataacaagcgaaagaggtctaagtccaagcagcaccagggcaataaggacgcaaaggacaaggtggaacgcccagaggcgggtcccctccaaccacaaccaccgcaaatccagaatggccctatgaacggatgtgagaaagacagttcttcaactgacagcgccaacgagaaaccagccctgatcccccgagagaaaaaaattagcatcctcgaagagccctcaaaggccctccgtggggtcacggaaggaaatcgactgctgcaacaaaaactatccctggatggcaacccgaaaccaatccacgggactaccgaacgctccgatgggctgcagtggtccgcagagcagccgtgtaatccaagcaagccaaaggccaagacttcacccgttaaatccaacacacctgcagcacacctggaaattaagcccgacgaactggcgaaaaaaagaggacccaatatcgagaagtcagtgaaggacctccagaggtgtacagtgagtctgaccaggtatagggttatgattaaagaagaagtggattcttctgtaaagaagatcaaggcggctttcgcagagctgcataattgcatcattgacaaagaagtgtctctcatggcggagatggacaaagtgaaagaggaggctatggagattctaacagccaggcagaagaaagccgaggagctgaagaggcttaccgacctagcctctcagatggccgaaatgcagctggcagaactacgggctgagattaagcacttcgtgtcggaacgcaaatatgatgaagaactgggcaaagcggctcgctttagctgcgatatcgagcagctgaaggctcagatcatgctatgcggtgaaataacacatccaaagaacaactactcttcaaggaccccttgctccagcttgttgccactcctcaacgcccacgctgcgacctcagggaaacagtccaattttagcagaaaatccagcactcacaacaagcctagcgaaggaaaggctgccaatcccaaaatggttagctctcttccaagtaccgccgacccttcccaccagaccatgccggctaacaagcaaaacggctctagtaatcagcgtcggcgattcaacccccagtaccataacaacagactaaacggcccagccaagagccagggctcgggaaacgaggccgaacctctgggaaagggaaactcccgacatgaacaccggaggcagccgcataacggatttcggcctaaaaacaaggggggagcgaaaaaccaggaggcgtctctgggcatgaaaacgcctgaggcacccgctcatagtgagaaacctcgcagaagacagcatgctgctgacaccagtgaggccagacccttcaggggtagcgtaggtagggtctcacagtgtaatctgtgcccgacacgtattgaagtgagcacagacgccgctgttcttagcgtgcccgctgttacgcttgtcgcctag

SEQ ID NO: 242241 - DNA, 567 bp, Artificial Sequence
  Description of Artificial Sequence: Synthetic coding sequence
atggctgagctgaatacccacgtcaatgtgaaggaaaaaatttatgccgtgaggtccgtcgtaccgaataaatctaataacgaaattgtgctagtgctgcagcagttcgacttcaatgtggacaaagccgttcaggcatttgtcgacggatccgccatccaagtcctgaaggaatggaatatgaccggaaaaaagaaaaataataagcgcaaaaggtctaagtcaaaacagcaccagggcaacaaggacgcaaaagacaaggttgagagacccgaagccggaccactgcagccgcagcccccacagattcagaacggacccatgaatggctgtgaaaaggattcctcctctacagactctgctaacgaaaagcccgcactgatcccacgggaaaaaaagattagtatcctcgaagagccttctaaggccctgcggggagttaccgagggaaatcggctgttgcagcaaaaactcagcctcgatgggaacccaaagcctatccacggaaccacagagaggtctgatggattacagtggagcgcagagcagccttgcaacccaagttag

SEQ ID NO: 242242 - DNA, 909 bp, Artificial Sequence
  Description of Artificial Sequence: Synthetic coding sequence
atggaacctggcccagacggtccagccgcttccggacccgctgccattcgggaaggctggtttcgcgaaacctgcagtttgtggcccggtcaggcattgtctcttcaggtggaacaactcctccatcatcgtcgctcccgctaccaggatatcctagtcttcagatccaaaacgtacgggaatgtgctggtcctggacggggttatccagtgtaccgaacgggacgaattcagttatcaggaaatgatcgctaacctgcccctatgctcacaccctaatccgcgaaaagtccttataataggtggcggagacggtggcgtgctccgggaagtcgtgaagcaccctagtgtggaatctgttgtgcagtgcgagattgatgaggacgtcattcaagtttcaaaaaagttcttacccggaatggccatcgggtacagctcctcgaaactgaccctgcacgtgggcgacggctttgaatttatgaagcagaatcaagacgcctttgacgtgatcatcaccgattcctctgatcctatgggtccggctgagagcctgtttaaagagagttactaccaactgatgaagaccgcattgaaggaggacggcgtgctgtgctgccaaggtgagtgccagtggcttcatctagaccttattaaagagatgcgccagttttgtcagtccctgtttccggtcgtagcttatgcgtattgcaccatccccacttacccaagtggccagattggatttatgctctgtagcaagaaccctagcactaactttcaggagcctgtgcaacctcttacacagcagcaggtggcccagatgcagctgaagtactataatagtgatgttcaccgggcagctttcgtgctcccagagttcgctagaaaggcgctgaacgatgtgtcttag

SEQ ID NO: 242243 - DNA, 600 bp, Artificial Sequence
  Description of Artificial Sequence: Synthetic coding sequence
gaggagcctccaccacccaccgtgcaagtgcaggggcctgggcctcagcgtgaagaaaagcagaagacaaaaatggccaaatttgtgattaggcccgcaactgccgcagactgcagcgacatcctgcggctgataaaagagcttgctaaatacgaatatatggaagagcaggttatcctgacagagaaagatctgctggaggacggatttggcgagcacccattctatcattgtctagtagcagaagtcccaaaggaacactggacacccgagggaaatccctctcccttcccggaagctagagagaccaaatgttactactttacatatgatccgtggattgggaaactgctctatttagaggatttttttgtcatgagcgactaccggggtctgtggcacagaatccgaaacagcgaagagtctaaaccgggatgcaatgaggtttctctggccgcatgcaccagctgggccgagtggaatgagccctccatcaatttctacaagaggaggggagcatctgatctttcctcggaggagggctggcggctgttcaaaatcgacaaagaatacctcctgaaaatggccaccgaagagtag

SEQ ID NO: 242244 - DNA, 453 bp, Artificial Sequence
  Description of Artificial Sequence: Synthetic coding sequence
atggccaaattcgtcatccgacctgccacggccgcagattgctcagacatcctgcggctcatcaaagagctggctaaatacgagtatatggaagagcaagtaatattgactgagaaaggcaacagtacagtcgcaggccgtggcacctctgttcgctgcctgtcaccttctcctaggcctttgccacctctgttgcccctgctggctgacctcctggaagatggtttcggagagcacccattctatcactgtctggtggctgaagtgcccaaggagcattggactcccgaaggaaacccctcacccttcccagaggcacgcgagaccaaatgttacgtgcgtagttccgtgggttgcgtggagccgctgacaactcaggctgaggtgaccgagaatctggaccggaagaacagccagcaggtgttcaagctgctccggaagaagaagaactag

SEQ ID NO: 242245 - DNA, 363 bp, Artificial Sequence
  Description of Artificial Sequence: Synthetic coding sequence
atggctaaatttgtcataaggcctgcaactgcagcagactgttcagacatactgcggctgatcaaggagctagccaagtatgaatacatggaagagcaagtcatcctcacagaaaaggaccttttggaggatggcttcggcgaacacccattttatcactgtttggtggccgaagtgcccaaggagcactggaccccagagggaaacccttcaccgtttccagaggctagggagaccaaatgttatgtgcggagtagcgttggctgcgttgagcccctcacgacccaggccgaggtgaccgagaacctcgaccgtaagaattcccagcaagtgtttaaactcttgaggaagaaaaaaaactag

SEQ ID NO: 242246 - DNA, 432 bp, Artificial Sequence
  Description of Artificial Sequence: Synthetic coding sequence
atggccaaatttgtaatcagaccagctacagctgccgattgctcggacatcctgaggctgatcaaagagttggcaaaatacgagtatatggaagagcaggtcatccttaccgagaaagggcatagtattgtcggcttcgccatgtattactttacatatgacccgtggattggcaaactcctatacctcgaggatttcttcgtgatgagcgattatcgcggattcgggattgggtccgagatcttaaaaaatctatctcaggtggcaatgcgttgcagatgttcaagcatgcactttctagtcgcagaatggaacgaaccctctataaatttttataaacggagaggagccagcgatttgtcttcagaagaagggtggagattgttcaagatcgataaagagtatctgctcaagatggcaaccgaagaatag

SEQ ID NO: 242247 - DNA, 516 bp, Artificial Sequence
  Description of Artificial Sequence: Synthetic coding sequence
atggctaaattcgtgataaggccagccactgccgctgattgctccgacattcttaggctgatcaaagagctcgccaagtatgagtacatggaagaacaggtcattcttacagaaaaggatctgctcgaagatggtttcggcgagcaccccttctatcattgcctggtggccgaagtgcctaaggagcattggactcccgaagggcacagcatcgtgggatttgccatgtattactttacctacgacccttggatcggaaaattgttgtacctagaggattttttcgtgatgtccgactatagggggttcgggatcgggtccgaaatcttaaagaacctgtcccaggtggccatgagatgccgctgctctagcatgcatttcctagtggccgagtggaacgaaccttcgattaatttctacaagagaagaggggcttccgatctctccagtgaggaagggtggcggctatttaaaatcgacaaggagtatctgcttaaaatggcaacggaggaatag

SEQ ID NO: 242248 - DNA, 513 bp, Artificial Sequence
  Description of Artificial Sequence: Synthetic coding sequence
atggctagtgtgcgcataagggaggccaaggaaggtgattgtggcgatatcctcagactcataagggagttagccgaatttgagaagttgtccgaccaggtcaagattagcgaagaagctctgagagccgacggcttcggggacaatcctttctaccattgtctggttgcggagatactgcccgctcccggaaagttgcttggtccatgtgtggtgggatacggcatctactatttcatttacagtacatggaaaggaagaacgatatacctcgaggatatatacgtgatgcccgagtatcgcggacagggcattggatcgaaaatcattaaaaaagtagctgaggtggccctagacaagggttgttcccagtttagactggcagttctcgattggaaccaaagagctatggacctgtacaaggcgttgggagctcaggacctcactgaggccgaagggtggcacttcttctgcttccagggggaagcgacacgaaagctggctgggaagtag

SEQ ID NO: 242249 - DNA, 750 bp, Artificial Sequence
  Description of Artificial Sequence: Synthetic coding sequence
atgccagggcagaggatcgcatcactggcatattctttactgccctatggcgctggaatacccgctccactcacacggccaagattgccacggaggccgcctcggctaccgccaccacgtagccttcggctgttccgcattcaagtacgccgtcccttcaagggttcttcctgtcggctccggggacccggaacactggtacctgatagcggggatccggacggcttccgggctgatcctaggggacagggcggacggctgtggaggtaccccgaagctgattctggcgaggattgtcggcctgagctggccgagttcgagaagctaagcgaccaggtaaagatttccgaggaagccctgagggctgacgggttcggtgataatcccttttaccactgcctagttgccgagattctgcctgctccgggaaaactgctcggcccttgtgtggtaggctacgggatttattactttatttattcaacctggaaaggtagaacaatctacctggaggatatctacgtaatgcccgagtatagaggacagggaattgggtccaagattataaaaaaggtggctgaggtggccctggacaagggatgctcccagttccggctagcagtccttgactggaaccagagagcaatggatctgtacaaagcattaggcgctcaagacttgaccgaagcagaggggtggcacttcttttgctttcagggagaggccacgagaaaactcgcaggtaaatag

SEQ ID NO: 242250 - DNA, 942 bp, Artificial Sequence
  Description of Artificial Sequence: Synthetic coding sequence
atggctgctgcccgacactccactctggacttcatgctgggggcaaaggcagatggcgaaactatactcaagggactacagagtatttttcaagagcagggtatggccgagtcagttcacacttggcaggaccacgggtacctagctacgtacaccaacaaaaacggacggctgccccctattgtgagagggggagcgattgaccgttattggcctacagccgacgggagacttgttgagtatgacattgacgaggtcgtgtacgatgaggatagcccataccagaacattaagattttgcacagcaaacagtttggcaacatcctaatactgtcaggcgacgtcaacctcgccgaaagcgacctggcttatactagagcaattatggggtcaggaaaggaggattacacgggaaaagatgtcctcatcttaggagggggagacggaggcatcttgtgtgagatcgtcaagctgaagccaaagatggtcaccatggtggaaattgaccagatggtgatcgacggctgcaagaaatacatgagaaaaacgtgtggcgacgtgctggacaatctgaagggagattgttaccaggtgcttatagaggactgtatccccgttttgaagcgctatgccaaagagggcagggaatttgattacgttatcaacgacctaaccgccgtgcccattagcactagccccgaggaggatagcacttgggagttccttagactgattctggacctatcaatgaaagtcctaaaacaggacggcaagtattttacccaggggaactgcgtaaatctgaccgaagcgctgtcattgtatgaagagcagctggggaggctgtattgtcccgttgagttcagtaaggaaatcgtgtgtgttccctcctatttggagctttgggtcttttacaccgtttggaagaaagctaagccctag

SEQ ID NO: 242251 - DNA, 1101 bp, Artificial Sequence
  Description of Artificial Sequence: Synthetic coding sequence
atggctgccgcaaggcactcaacgctggacttcatgctgggggcaaaagccgatggcgaaacgatattgaagggactccagtcaatctttcaggaacaaggaatggctgagtccgtgcatacttggcaggatcacggctacctggccacgtataccaataagaatggctctttcgccaacttgaggatttacccccacggcttggttttgttagacctccagtcctacgatggcgacgcccagggtaaggaagagattgacagcatcctgaataaggtcgaagaaaggatgaaggagctgagccaggactctaccggtagggtcaaaaggttgccacccattgtgcgcggaggagcaattgatcgatattggccgactgctgacggacgtcttgttgagtatgacattgatgaggtagtctacgatgaagactctccatatcagaatatcaagatccttcactcaaaacagtttggaaatatcttgatactgagtggagatgtcaatctggccgaatcagacttagcgtacaccagggccattatgggcagcggaaaagaggattacactggtaaggacgtgctgattctggggggaggagacggtggtatactatgcgagatcgtcaaactgaaacctaagatggtgaccatggtggagatcgaccagatggtgatcgacggatgcaagaaatacatgcgaaagacctgcggggatgtactcgataatctgaaaggagactgctaccaggttctaatcgaagactgcatccccgtgcttaaaaggtatgccaaggaaggtcgggagtttgactatgtgattaatgatctcaccgccgtgccaatctccaccagccccgaggaggactcgacttgggaatttctccgactgatcctggacctctccatgaaggtgcttaagcaggatggaaagtacttcactcagggtaactgtgttaacttaaccgaagctctgtcactgtatgaggagcagcttggtagactgtattgtcctgtggagttctcgaaggagattgtgtgcgtgcccagctacttggagctgtgggtgttctacacagtgtggaagaaagctaaaccatag

SEQ ID NO: 242252 - DNA, 828 bp, Artificial Sequence
  Description of Artificial Sequence: Synthetic coding sequence
atgaaagagctgagtcaggacagcactggcagagtcaaacgactgcctcctatcgtaaggggaggcgctatcgatcgttactggcccacagctgacggcaggttggtggaatatgacatcgacgaagtggtttatgatgaggactccccgtatcaaaacatcaaaattcttcacagtaagcaattcggaaatattctgattctgtccggggacgtgaacttggccgagtccgacctggcttacacgcgagcaatcatggggagcggcaaggaggactatacaggcaaggacgtgcttatcctaggaggaggcgacggtggaattctgtgcgagatcgtgaagcttaagcccaagatggtgacaatggtggagatcgatcagatggtgatcgatggctgtaagaagtacatgagaaagacctgtggagatgttctcgacaacctgaaaggcgactgttaccaggtgttgatagaagactgcatcccagtcctgaagcgttatgccaaggaaggccgtgaatttgattacgtcatcaacgaccttaccgccgtgccaatttcaacatcaccagaagaggactccacctgggaattcctccggttgattctggacctgtcaatgaaggttctgaagcaggacgggaagtacttcacacaggggaactgtgtcaacctgactgaggcgctttctttgtacgaggagcaactaggacggctctattgtccagtggaattcagcaaagagatagtatgtgttccctcttacctagaacttttcctcttgcagttctggcgcgttaggtcatcaaagtgcgcgttggagggttag

SEQ ID NO: 242253 - DNA, 936 bp, Artificial Sequence
  Description of Artificial Sequence: Synthetic coding sequence
taaggtggcagggccgaagccgcactgcttctggcccctcgaagtgtacccgcagccgctagaggcctgcaggggcagtcacgggtgccggctggaagggccgctctgccaggacccggaagaccacccgcattaccacggggattagccgcattcgctcttccactcggagagagccccggttgcagagccagggccgaccctccatgggacgaagggtgtagagactgtggaggtgcccgacgagatccgaggggagagccaggcctcggtgcgtgtgccgaaagaggatgtccacgggacctgttcctgtttctgcaagccgctgacggggaaaccattctgaaaggcttgcagagcatattccaggaacaaggcatggccgaatccgtgcacacctggcaggatcacggatacctggccacctacaccaacaagaacgggtctttcgccaacttaaggatctatccccatggtttggtgttgctggacctgcagtcctatgatggggacgcccagggaaaggaggagatcgactctattctgaacaaggtagaggagagaatgaaagaactgtcacaggactcaaccggtcgagtgaagaggctacccccaatagtgcgaggcggtgccatcgaccgttactggcctactgcggatggacgactggttgagtacgacattgatgaggtggtctacgacgaggattccccatatcagaatatcaaaatccttcactctaagcagttcgggaacattttgattctgagcggcgatgtcaatctcgcggaatccgacctcgcgtatactcgcgcaataatgggcagtgggaaggaggattacactgggaaagatgtgctgatccttggtgggggtgacggcggtatcttgtgcgagattgttaaactaaagcccaaaatggtgacgatggtttag

SEQ ID NO: 242254 - DNA, 3801 bp, Artificial Sequence
  Description of Artificial Sequence: Synthetic coding sequence
agggaagccacgccacctttgagagggttaccggctcctcctagacacgccccttttcccgctggtagattcgagccccctcgaacaaaacagggcggacggggatcacatactccttgggtgtacgtcatcaatgacctaggtatagaggaaaacctcaaaaatgacggaaaacctaaatgtcagactggcggaaaatccaagaggaccatccaaggaacacataagacaaccaagcagcaatcaaccgcggtggactgtaagataacctccagcactacgggcgacaagcactttgacaagagccctaccaagacccgccatccacggaaaatcgatctgcgggcacgatattgggcctttctgtttgataatctgcgcagggcggtggatgaaatctacgtcacttgtgagagtgaccagagcgtcgtcgaatgtaaggaggtactgatgatgctggataattacgtccgcgattttaaagcactgatagactggatacagctgcaggagaagctggaaaagaccgatgctcaatcccggcctactagcctcgcgtgggaagtgaagaagatgtctccagggaggcatgttataccaagtccttcgacggaccgaattaatgtcaccagtaacgctcgccgatctctgaattttggtggtagtactggcaccgttcccgctccacggctggccccaacaggagtttcttgggctgacaaggtgaaagctcaccatacaggctctactgcctcctccgagataactcctgcacaatcctgtcctcctatgaccgtgcaaaaggccagccgcaagaacgagcgaaaagacgccgaaggatgggagacagtgcaaaggggcagacctatcagatcacggtctacagctgtgatgcccaaggtatctttagcaactgaggcaacccggtccaaggacgattcagataaggaaaatgtatgcctgctgcccgacgagagcatacagaagggtcagtttgtgggagacggcactagcaacactattgaaagtcatcctaaggattctctacattcctgtgaccaccccctggccgagaaaacccagtttacagtgtctaccctggatgatgtgaagaactcaggatcgattcgggataattatgtgcgaacatcagagatatcggctgtgcatattgacactgagtgcgtgtctgttatgcttcaggcaggaactcctcccttacaggttaacgaggagaaatttccggcagagaaagcgagaatcgagaacgagatggatccctccgacatatcgaatgtgtccgccgcaaacctgagcatggcagaggttttggcaaaaaaagaggagctggcagacaggctggaaaaggctaacgaggaagccatagcatccgctatcgctgaagaggaacagctgacgagggagatcgaagccgaagagaacaacgacattaacatagaaaccgacaatgattcagatttctccgcttccatgggatcaggaagcgtcagcttttgtggcatgagtatggactggaatgacgtactggccgactacgaggcaagagagtcctggaggcaaaacacctcttggggcgatatcgttgaagaagagcccgctcgacctcccggtcacggaatacacatgcatgagaagctttcttccccttctcgaaagcgcaccattgccgaatcgaagaaaaagcatgaagagaaacaaatgaaagcacagcagttgagagagaaactcagagaagaaaaaaccctgaaactgcagaagcttctggagagggagaaggacgtccgaaagtggaaggaggagctgctggaccaacggaggcgcatgatggaagagaagttgctccacgccgagtttaagagagaggttcagctgcaggctatcgtgaagaaggcccaggaggaggaggccaaggtcaatgagattgcattcattaacaccctcgaagcacagaataagcgccatgatgtgttaagtaagctcaaggagtacgagcagaggttgaacgaattacaggaagagcgccagcggaggcaggaggaaaaacaggcacgcgacgaagcagtccaagaacgaaaaagagctcttgaggctgaaagacaggccagagtggaagagctgttaatgaagcggaaggagcaggaagctcggatagagcaacagagacaagaaaaggagaaggccagggaggatgcggcacgcgagagggccagggatcgggaagaaaggctggcagcgttaactgccgcacagcaggaagctatggaagagctccagaagaagattcagctcaagcatgacgagtctatccggagacacatggagcagatcgagcagagaaaggaaaaagcagccgagctctcgtccggcaggcatgctaatactgactacgctcctaaactgacaccttacgaacggaagaagcaatgcagcttgtgcaatgttctcatttcctctgaggtgtatctattttcccatgtcaaggggaggaaacaccaacaggcagtgcgggagaacacaagcatccaaggccgtgagctgtccgacgaagaagtcgagcacctcagtttaaaaaagtatattattgatatcgtggtggagagtacagcccctgctgaggccttgaaagacggggaagagagacagaagaacaagaagaaggcgaagaaaataaaagcccgtatgaacttcagggctaaagagtacgagagtctgatggaaactaaaaactcgggcagcgacagcccctacaaggctaaactgcagagactagccaaggatctgttgaaacaggtgcaggtacaagactcgggcagttgggcgaacaataaggtttctgcccttgacaggaccctcggcgagataactaggatcctggagaaagaaaacgtggccgatcaaatcgcctttcaggcagctggagggctgaccgctctggaacatatcctccaggctgtggtaccggcaacaaatgttaacactgtgctcagaatccccccaaaatccttgtgtaacgccatcaatgtctacaaccttacgtgcaacaattgcagcgagaattgcagcgacgtgctgttctcaaataaaatcacctttctgatggacctcctgatccaccagctcactgtctacgtgcctgacgagaataatacgattctgggcagaaacacgaataagcaggtctttgagggccttacaaccggactgttaaaggtgagcgcggtggtgcttggttgcctcatcgccaatagacccgatggcaattgccaacccgcaacgccaaagattcctacgcaagagatgaagaacaaaccgtctcaaggcgacccttttaacaaccgcgtgcaggacctgatctcctacgtcgttaacatgggcttgatcgataaactgtgcgcctgcttcctgagtgtccaggggccagtagatgagaatccgaagatggctatatttcttcagcatgctgctgggttgctccacgccatgtgcacattatgcttcgccgtaacgggcagatcctacagtattttcgacaataacaggcaggatccaaccggtctcaccgccgctcttcaggctacagatttggcaggggttctgcacatgctctactgtgtgctgttccacggtacaatccttgacccatccacagcctcaccaaaagaaaactatacccaaaacaccatacaggttgcaatacagagcctgcgcttttttaactccttcgccgcattacatcttcctgcttttcaggtgcccagtatcggcctgtacagatgttag

SEQ ID NO: 242255 - DNA, 4203 bp, Artificial Sequence
  Description of Artificial Sequence: Synthetic coding sequence
atgatggccagctttcagcggtccaacagccatgacaaggtccgtaggattgttgccgaggagggacgcactgcgaggaacctaattgcatggtcagtacccctggagagtaaggatgatgacggaaaacctaagtgccagacaggtgggaagtcaaagaggaccattcaaggaacccacaagaccactaagcaatcaactgccgtggattgcaaaatcacctcctccaccaccggcgacaaacacttcgacaagagtccaacaaaaacccgccatcctagaaaaatcgatctccgcgctcggtactgggcgtttctttttgataacctgcgcagggcggttgatgagatctatgtgacgtgcgagtcagaccaatccgtcgtggagtgcaaggaagttctgatgatgctcgacaattatgttagggactttaaggctctgatcgactggatacagctgcaggagaaacttgagaagacagacgcccaatctcggccaacttcgcttgcctgggaggtgaagaagatgtctcctggacgccacgttatcccgtctccttcaacggatcgcatcaatgtaacctccaacgcacgcaggtccctgaatttcgggggtagcactggcaccgtgcccgctcccaggctcgccccaactggggtgagctgggctgacaaggtcaaggcacaccacacgggcagcacagcgtcctccgaaatcactccggcacagtcttgtccaccaatgactgttcaaaaggcctcccggaaaaacgagcggaaagacgccgaggggtgggagactgtgcaacggggaagacctatcaggtccagatctaccgcagtgatgcccaaagtgagcctggcaaccgaggcaacacgatctaaggacgattcagacaaggaaaacgtctgtctgctgcctgacgaatccatccagaaaggtcaatttgtaggggacggtacaagtaatactatcgagtcccacccaaaggactccctacacagctgcgaccaccccctcgctgagaaaactcagtttactgtgagcactctggatgacgtcaaaaatagcggttccattagagataattacgtgaggacaagcgagattagcgccgtccacatcgacaccgagtgtgtgtcagtcatgcttcaggcagggaccccccctctgcaggtgaatgaagaaaagttcccagcagagaaggcaaggatcgagaatgagatggacccttctgacatctcgaactcaatggcagaggtcctcgccaaaaaagaagaattggccgataggttagaaaaggcaaatgaagaggccatcgcttcggccatcgccgaggaagaacagcttacccgcgagattgaggcagaggagaacaacgacatcaatattgagactgacaacgattccgacttctctgctagcatgggttccggctccgtttccttttgtggcatgagtatggactggaatgatgtgcttgcagattacgaagcaagggagtcatggaggcagaatacttcctggggtgacatcgtcgaagaagagcccgcacggcctcccggacacggcatccacatgcatgagaagctgtcctcaccttctaggaagcgtactattgcagagtccaagaagaaacatgaagaaaagcagatgaaagcccaacagctacgcgagaaacttagagaagaaaaaacattaaaacttcagaagctacttgagcgggagaaggacgtgcgaaaatggaaggaagaactgctggatcagcgccgtcggatgatggaagagaaactgctacatgcggaatttaaaagagaagtacagttgcaggcaattgtcaagaaggcccaggaggaggaagccaaggtgaacgagatagcttttattaatacactcgaagctcagaataaaaggcacgacgtgctgtcaaagctaaaagaatatgaacagcgtctgaacgaattgcaggaagagcggcagaggcgacaggaagagaagcaggcccgtgacgaggccgtccaagagcgcaagagggctctggaggcagaaaggcaagcgagagtggaagagttgctgatgaagagaaaggagcaagaggcacggattgaacagcagcgccaggagaaggagaaggccagggaggacgctgccagagaacgggctcgcgacagggaagagaggctcgccgctctgacagcagcacagcaggaggccatggaggaactgcagaagaagatccagctgaaacacgacgaaagcatacggagacatatggagcagatagagcagaggaaggagaaggccgcagagctgagtagcggaagacacgcaaatacagattatgcgcctaaattgactccttacgagcgtaagaagcagtgttccctctgcaatgtattgatctcctccgaggtatatctgttctcccacgtgaagggaagaaaacaccagcaggcggttagagaaaacacgagcattcagggacgagagttgtcggacgaggaggtggagcacttgagcctgaagaagtacataatcgatatcgttgttgagtccaccgcacccgcagaggcgttaaaagatggggaggagcggcagaaaaataaaaaaaaggctaaaaagattaaggctcggatgaacttccgagctaaggagtacgaaagcctgatggaaaccaaaaatagcggctctgatagcccatataaggccaagcttcaaaggctggccaaggacttgcttaagcaggtgcaggtccaggatagcggcagttgggctaataacaaggtgtccgcattggatcgcaccctgggagagatcacacgcatcctggagaaggagaacgtggctgatcaaatcgcttttcaggcagctggcggtttgactgctctggagcacatccttcaagcagtggtccccgctaccaacgtcaatacagttcttagaattccacctaagagcttatgtaatgccatcaacgtgtacaatctgacatgtaacaattgctcagaaaactgctctgacgtgctgtttagcaacaagatcacttttcttatggacctgttgattcatcaactgactgtttacgtgccagatgaaaataatactattctggggagaaataccaataaacaggtgttcgagggtctgaccacagggctgctcaaagtctctgccgttgtgcttggctgcctgatcgctaaccggccagacggaaattgccagccagccacccccaagatcccaacccaagagatgaaaaacaagcccagtcagggtgaccctttcaataacagggtgcaggatcttattagctacgtggtgaatatgggactgattgacaaactgtgcgcctgcttcctgtcagtccagggaccggtggatgaaaaccccaagatggccatctttctccagcacgcagccggtctactgcatgccatgtgcaccctttgtttcgcagtgacgggaaggagttactctattttcgacaataaccggcaagatcctaccggtctcactgccgcactacaagccacagatctggcaggcgtcctgcatatgctgtattgcgtgctgttccacggaaccatcctggatcctagtaccgcctcccctaaggaaaactatacacagaatacaattcaggttgctatccagtctctgcggtttttcaactcgttcgctgccctccatctgccagctttccaaagcatcgtcggggctgagggactttccttggctttcagacacatggcgagctcattactgggacactgctcccaggtgagctgcgagtctctgttacatgaggtgattgtctgtgttggatacttcaccgttaatcacccagacaaccaggttatcgttcagtccggtaggcaccctactgtgctgcagaagctatgccagctgccatttcagtatttcagcgatcctcgtctcattaaggttctgttcccgtcacttatcgccgcttgctataacaatcatcaaaacaagattattctcgaacaggaaatgagctgtgtgctgttggcgaccttcatccaggacctagcacagacccctgggcaggctgaaaatcagccttaccagcctaagggtaagtgccttggtagccaggattacttggagctggcaaaccggtttccccaacaggcctgggaagaggcacggcagttcttccttaagaaggagaagaagtag

SEQ ID NO: 242256 - DNA, 3465 bp, Artificial Sequence
  Description of Artificial Sequence: Synthetic coding sequence
atgaaaacaaagtatattttttgcaatatcaccgagagaaaagacgccgagggatgggaaacagtccaacggggtagacccatccgcagccgctcaacagccgttatgcctaaagtctcccttgccaccgaggcaacacgcagcaaggacgactcagacaaagaaaacgtgtgcttgttgcccgatgagagcatacagaagggacaatttgtcggggatggcacctctaataccattgaatcccatcccaaagatagcttgcactcttgcgatcatccacttgcagagaaaactcagtttaccgtgagcacgttggacgatgtgaagaactccggaagcattcgcgacaattacgttcgcacctctgaaatcagcgcagtccacatcgacaccgagtgcgtatctgtcatgctgcaggctggaacccctcccttgcaggttaacgaggagaaatttccagcagagaaagccaggatcgaaaacgagatggatccttccgacatcagcaatagcatggccgaggttctggccaaaaaggaagagctggcagatagactggagaaggctaacgaggaggccattgcgtcagccattgcagaggaggaacagttaacacgggagatcgaagcagaggaaaacaatgacattaatatcgaaacagataacgacagcgacttttccgccagcatgggttccgggagcgtgagtttttgtggcatgtccatggactggaacgacgtacttgccgactatgaagcacgggagtcctggaggcagaatacaagctggggggacattgtggaggaggagccagcacggccaccaggccacgggattcatatgcacgaaaagctttcaagcccgagccgcaaaaggacgatagctgaatcaaaaaagaaacacgaagaaaagcagatgaaggctcagcagcttcgagagaagctgagagaagaaaagacgttaaaacttcagaagctgctggagcgcgagaaagacgtgagaaagtggaaggaagagctcctggatcagagacgtaggatgatggaagaaaagttgctgcacgcggagttcaagcgcgaagtacagcttcaggctatcgttaagaaagcccaagaggaggaagccaaagtcaatgaaatcgcctttatcaacacgctagaagcacagaacaagcgacatgacgtactgtcgaaactgaaggagtacgagcagaggctgaacgaacttcaggaggaaaggcaacgaaggcaggaagaaaaacaggccagagacgaggccgtccaggaaagaaagagggccctcgaagcagagaggcaggcccgagttgaggaactcctgatgaagagaaaggaacaggaggcaaggattgagcaacagcgccaggaaaaggagaaggctcgggaagatgctgcaagggagcgagccagagacagggaggagagactggctgcactgactgccgcacagcaggaagcgatggaagaactccaaaagaaaattcagctgaaacacgatgagagtattagaagacatatggagcagattgagcagcgcaaggaaaaagctgcggaactgtcctcaggccgacacgcgaataccgactacgcacccaagttgaccccttacgagcggaagaaacagtgcagcctgtgcaatgtattgatcagcagcgaagtataccttttctctcatgtcaaaggccgaaaacaccagcaagcggtacgggagaacaccagtattcaagggagggagctgagcgacgaggaggtggaacatctttctctgaagaagtacatcatcgacatcgtagtggagagcacagcacccgcagaagctctgaaagacggtgaggagcgccaaaagaacaaaaaaaaagccaaaaagataaaagctcgtatgaactttcgagctaaggagtatgagtccctgatggaaactaagaatagtggttccgacagtccgtacaaagcgaagctgcagcggttggccaaggatctcctcaaacaggtccaggtccaggattcagggtcttgggctaataataaggtgagcgctctggacaggaccttaggcgaaatcacccggattctggagaaagaaaacgtggccgatcagatagcttttcaggccgctggcggactgaccgccctcgagcacatccttcaggccgtggtgcccgcaaccaacgtgaatacagtccttcgaatccctccgaagtccctgtgtaatgctattaatgtgtacaatctgacctgtaataattgtagcgaaaattgttccgacgtgttattttcgaacaagataacctttctcatggacttgctcattcatcagctgactgtttatgttcctgacgagaataatactatactaggcagaaacactaacaaacaagtattcgaaggactgacaacgggactgcttaaagtgagtgcagtggtcctcggatgtttgatagctaaccgccctgacggaaattgccagcccgcaacccccaagatcccaacacaggagatgaaaaacaagccttctcagggagatccctttaataacagagtgcaggatctgataagctacgtggttaacatgggcttgattgataaactgtgtgcatgcttcctctctgtgcaaggccctgtagacgagaaccctaagatggcaatatttctccagcacgccgcaggactcctccatgcaatgtgcacactgtgctttgctgtgactggtcggagctattcaatctttgacaacaaccgccaagaccccacaggtctgactgccgctttgcaggctacagatctggccggtgttctacacatgctctactgtgtgctgttccatgggaccattctagaccctagcactgcctcacctaaggagaattatacccagaatacgatccaggtggccatccagagtctgagattttttaatagtttcgccgcactacacctacccgctttccagtccatcgttggcgctgagggactctccttggccttccggcacatggcctcgtcactgctcggacactgtagccaggtgagctgtgagtctctactgcatgaagttatcgtatgcgtgggttacttcactgtgaaccaccctgacaatcaggtcatcgttcagtccggacggcaccctacagtacttcagaagctttgtcagctcccctttcagtattttagtgatccccgactgatcaaggtgctgtttccttccctgatcgccgcttgctacaacaaccatcaaaacaagatcattttggagcaagagatgtcatgcgtgctgctggcgacctttatccaggacctggcccaaaccccagggcaggcagagaaccagccataccagcccaaggggaagtgtctcggatcccaggactaccttgaattggcaaacagattcccccagcaagcgtgggaagaggcgcgacagttcttcctgaaaaaagaaaaaaagtag

SEQ ID NO: 242257 - DNA, 4203 bp, Artificial Sequence
  Description of Artificial Sequence: Synthetic coding sequence
atgatggcaagtttccagcgaagcaattcccacgacaaagtgaggcggatagtggccgaggagggaaggaccgcacgtaatctgattgcatggtcagtgcctctagaatctaaagatgacgatgggaagcccaagtgtcagactggcggtaagtcgaagaggacaattcaaggcacacacaagacaaccaagcagagcactgcggttgattgcaagattacatcctcgacaaccggggataagcatttcgataaatccccaacaaaaacaaggcatccacggaaaatcgacctgcgagcgagatactgggcgttcctgtttgacaaccttagacgggctgtggatgagatatatgtgacttgtgagtccgatcagagtgtcgtagagtgcaaagaagtgttgatgatgctggataactatgtgagggatttcaaagcattaattgattggatccaattacaagaaaagctggagaagaccgacgcacagtccagacccacatctctggcatgggaggttaagaaaatgagccctgggagacatgtgatcccgtcacccagtaccgacaggattaatgtcacatcaaacgccagaaggagcctgaattttggaggaagtacgggcaccgtgccagcgccacggctcgcacctactggcgtcagttgggctgacaaagtaaaggctcaccatacgggcagtaccgccagctccgaaattactcctgcacagtcttgccccccaatgaccgtccaaaaggccagtcgcaagaacgagcgaaaagacgccgaggggtgggagaccgttcagcgtggacgcccaattcggagcaggtcaaccgcagtaatgcctaaggtgtcactggctacagaggcaacccggtccaaagatgattcagataaggagaacgtgtgtcttctccccgacgaaagcatacagaaggggcagttcgtaggagatggcacatccaataccatagagtctcacccaaaagactcactgcacagctgtgatcatcccctggccgaaaagactcagttcaccgttagcactctcgatgatgtgaaaaatagcgggtcaatacgggacaactatgtacggaccagcgaaattagcgcagttcatattgacacagaatgcgtgtccgttatgttgcaagcgggaacacctcccctgcaggtcaatgaggagaagttccctgccgagaaggccaggattgagaacgaaatggatcccagtgatatctccaactcaatggcagaggtcttggcgaaaaaggaggagcttgcagatagattggagaaggccaatgaggaggctatagcatccgctatcgccgaagaggagcagttgactcgcgagatcgaagcagaggagaataatgacattaatatcgaaacagataacgacagtgacttttccgcgagcatgggttctggctcagtgtccttttgcgggatgtcgatggactggaacgacgtcctggcagattacgaagctcgggaatcctggaggcagaacacatcttggggtgatattgtggaagaggaaccagccagaccccctggccatggaatccatatgcatgagaagctgtcctctccatcacggaagagaacaatcgcagaaagtaaaaaaaagcatgaggaaaagcagatgaaggctcagcaactgagagaaaagctcagggaagaaaagacactgaagttacagaaactgctcgagagagaaaaggacgtcagaaagtggaaggaggaacttctggaccagcgcagacgcatgatggaggagaaactcctgcacgctgagtttaagagagaggtccaactgcaggccatcgtgaagaaggcccaggaggaggaggccaaggttaatgaaattgctttcatcaacactttggaggcccagaacaagcgccatgatgtcttgtctaaattgaaggaatacgaacagaggctgaatgaacttcaggaagaacggcagcgaaggcaagaagagaaacaagccagagacgaagccgtccaggagcgtaagcgcgctctagaagccgaaaggcaggctcgcgtggaagaactactcatgaagcggaaggagcaggaagcccgtatcgagcagcagcggcaggagaaggagaaagcgcgagaggacgctgcaagagaacgggctagagatcgggaggagagactggcggctttgacggctgctcagcaggaggccatggaagagctacaaaagaaaatccagctgaagcatgatgaatcgatccggagacacatggaacagatcgagcaaaggaaggagaaagccgctgagctgtcctccggtcggcacgccaatacagattacgcccctaagctaactccatacgagcgaaaaaagcaatgttcactgtgcaatgtgctgatctcgagcgaggtgtacctgtttagtcacgtgaagggtcgcaaacaccagcaagctgttcgcgaaaataccagcatccaaggccgagaattgtctgatgaggaggttgagcatctcagtctcaaaaagtatatcattgatattgtggtggaatccacagccccagccgaagctctgaaggacggtgaagagagacagaaaaacaaaaaaaaagcaaaaaagattaaggcaagaatgaattttcgcgctaaggagtacgaatccctgatggaaacgaagaacagtggaagcgacagtccgtacaaagcaaagctccagaggctggctaaagacctgttgaagcaagttcaggttcaagactccgggtcctgggcgaataataaggtgtctgccctggaccgtactctgggggagattacaaggattctagagaaagagaacgtggccgaccagatagcgttccaagcagcaggcggtctcaccgctcttgagcatattcttcaggcagtagtaccagcgactaatgtgaacacagttctccgaatcccaccgaaatcactatgcaatgccatcaatgtgtacaaccttacctgcaacaattgttccgaaaattgctcggatgtgttgttttccaacaagatcacttttctgatggatctgttgatccaccagctaacagtgtacgtgccggacgagaacaataccatcttgggtcgaaatactaacaaacaggtgttcgagggattgaccacagggttactcaaagtctccgcagttgtcctcggatgcctcatcgcaaatcgtcctgatggcaattgccaaccggctacccccaaaatcccgacacaggagatgaaaaataagccctcccaaggggacccattcaacaatagagtccaggatttaatttcatatgtcgttaacatgggccttatcgacaagctatgtgcttgtttcctaagtgtgcagggaccagtggacgagaatcccaagatggctatcttcctgcagcacgccgcaggcctcctgcacgctatgtgtaccttgtgctttgccgtcacagggcgatcctactcaattttcgacaataatagacaggaccccacaggcctgaccgccgctctgcaggcgaccgatctcgccggtgtcttgcacatgttgtattgtgtgctcttccatggcaccatcctcgacccatcaactgcctcacccaaggaaaactatactcagaacaccatccaagtggcaatccaatcgctccgctttttcaactctttcgcagcgctgcacctgcccgcttttcagtcaatcgtgggcgcagagggtctgagtctggcattcagacacatggcaagctcccttctgggacactgttcccaggtgagttgtgagtctcttctgcatgaggtgattgtctgcgtaggatattttactgtgaaccacccagacaaccaggtcatcgtacagtcaggcaggcatcccactgtattgcagaagctgtgccagctccccttccagtactttagcgatcctcgcctgattaaagtcctgttcccctctctgattgctgcatgttacaacaaccatcaaaataagatcattctggagcaagagatgtcttgtgtccttttggccacgtttatccaagaccttgctcagacccccggtcaggccgaaaatcagccctatcagccaaagggtaagtgcttgggctcccaggactatctggaattagcgaacaggttcccccagcaggcatgggaagaagctaggcagtttttcttgaagaaggagaaaaagtag

SEQ ID NO: 242258 - DNA, 1233 bp, Artificial Sequence
  Description of Artificial Sequence: Synthetic coding sequence
atgcaccgaaaacatctgcaggaaattcctgacctgagctccaatgtcgctacctcatttacttgggggtgggactccagcaagacttctgagctcctgtccggcatgggcgtttctgctctcgaaaaggaggagcccgattctgaaaatattcctcaagagctcctgagcaacctcggacatcccgaatcccctcctagaaagcggttgaagtccaagggcagcgataaagattttgtgatcgtacgtcggcctaaactcaacagggagaatttccccggagtgtcttgggactctctccctgacgaattgctgctgggtatctttagctgtctctgtcttcctgagctgctcaaagtgagcggagtgtgtaaacggtggtatagattggccagcgacgaatctctctggcaaacattagacctcaccggaaaaaatctccatccagacgtgacaggccgattgctttctcagggggttatcgccttccggtgtccgagaagtttcatggaccagccgctcgccgaacactttagcccatttagggtgcagcatatggacctcagtaactcagttatcgaggtgagtacgctgcacggaattctctcccagtgctccaaactgcagaatctcagcctggaaggactgagactttcagatcctatcgtcaacaccctggcgaaaaatagtaatctggttcgattgaacctgtccggctgtagcggcttcagcgaatttgccctgcagactctattgagctcctgtagccggctggatgagctcaatctatcgtggtgtttcgatttcaccgaaaaacacgtgcaggtagcggtggcccacgttagcgagactattacccaactgaacctatccgggtaccgtaaaaacttgcagaaatcagatctttccaccctggtgcgacgctgccctaacctggtgcacctggatttatccgatagtgtgatgctcaaaaacgattgtttccaggaattttttcaactcaactacttacaacatttgtctctttcccgctgctacgatattatccctgagacactactgctcgtaacgcgcgctggagtgcgtatcagattagactcggatatcgggtgcccacagacctataggacctccaagctcaaatcttcccacaagttgttctgtcagcatgtgcgggttatttgcatatttgtttgtgatttctatttctaccgtcttgtgcttaaacaatag

SEQ ID NO: 242259 - DNA, 1275 bp, Artificial Sequence
  Description of Artificial Sequence: Synthetic coding sequence
atgcatcggaaacacctgcaggaaatcccagatctgtcatctaatgtggctactagtttcacctggggatgggactcatctaagacaagtgaactattatcaggaatgggtgtgtcagcactggagaaagaagaaccagatagcgagaacatcccgcaggaacttttgtctaacctggggcacccagagtcacccccacgaaaacgcctgaagagcaagggctccgacaaggactttgtgatcgttaggaggccgaagctgaatcgggagaacttccctggtgtgagctgggattccctgccggatgagttactgctcggtatctttagttgtctatgtttgccagaactgttgaaggtcagcggtgtgtgcaagcggtggtatcggctcgcttctgacgaatccctctggcagactctggacctgactggtaagaatctccaccccgacgtgacaggacggctcctgtcacagggggtgattgctttccggtgccccagatcctttatggatcaaccattggccgaacactttagcccattccgggtgcagcacatggacctttcaaattccgtgattgaggtctccaccttacacgggattctctcccagtgttccaagttacagaacttgagcctcgaaggacttcgactctcagatcccattgttaatactctagccaagaattcaaatctcgtgaggctcaacctctctgggtgttctggcttcagcgagtttgcactacagactctgctgagctcatgtagcagactggacgaacttaacctctcttggtgcttcgacttcactgagaaacatgtgcaagtggcagtggcccacgtgtcagagaccattacccagctaaacctgagtgggtacagaaagaatctgcaaaaatcagaccttagcacgctggtgcgcagatgtcccaatctggttcatctagatttatctgatagcgtaatgctcaaaaacgattgttttcaggagttttttcaactcaattacctacagcacctgtccctctcacggtgctacgatatcatcccagagaccctcctggagctgggtgaaatcccgactctgaagactctccaggtgtttggcatcgtcccagacggaactctgcagctcctgaaggaggcactgccccatctgcagattaactgttctcacttcacaacgatcgcacggccaacaatcggtaacaagaagaatcaggaaatctggggaatcaaatgcaggctgaccctacaaaaacctagttgcctctag

SEQ ID NO: 242260 - DNA, 1173 bp, Artificial Sequence
  Description of Artificial Sequence: Synthetic coding sequence
atgcatcggaagcatttacaagagaaggaagagcccgactcagaaaacatccctcaagagctcctgagtaacctgggacatcccgagtcaccacctagaaagagattaaaatccaaggggagcgataaggacttcgtgatcgtcaggaggcccaaattaaatagggagaatttccccggtgtctcgtgggactccctgcctgacgagcttctcctgggtatctttagctgtctgtgtctcccagaactgctgaaggtgtcaggtgtgtgtaagagatggtatcgactcgcatccgacgagtccctgtggcagaccctagatctgactgggaaaaatctgcacccagatgtcactggccgactgcttagtcagggcgttatcgcattccgctgccctagaagctttatggatcagcctctggcagaacattttagcccctttcgggttcagcatatggacctgtccaattcagttatcgaggtgtctaccttgcacggtattttatctcaatgctctaaactacagaacttgtccttggaaggcttacggctctcagacccgatcgtaaacacactggccaaaaatagcaatttggttagactgaatctgtctggctgttcaggattcagtgaatttgctctgcagacactgctgtcatcatgcagtcggcttgatgagctaaacctgagctggtgtttcgactttactgaaaaacatgtgcaagtggccgtggcccatgtcagcgaaactattactcagttgaatttatctggctaccggaagaacctgcaaaaatcagacctaagcacgctcgtccggagatgccctaatctggtgcatctggatctgtccgatagcgtgatgctgaaaaacgattgtttccaggagttctttcagcttaattatcttcagcatttgtctctgtctcgctgttatgatatcatcccagaaacgttactggagctgggagaaataccaacgctcaaaacgctgcaggtatttggtatcgttccagacggcaccctccaactgctgaaagaggcccttccccacttgcagataaattgtagtcactttactaccatcgctaggcctactataggtaacaaaaagaaccaggagatatggggaataaaatgcagactgaccctgcagaaacctagctgtttatag

SEQ ID NO: 242261 - DNA, 633 bp, Artificial Sequence
  Description of Artificial Sequence: Synthetic coding sequence
atggatcagcctctggccgaacacttctctaccctggcgaagaattcaaatctggtgaggttaaacctgtcgggctgctctggcttttcggaatttgctctgcagaccctcctttcttcgtgttctcgtctcgatgagctgaatctgtcctggtgcttcgactttacggagaaacatgtgcaagtggcagtagcacatgtttcggaaacgatcacacagctcaatttatcaggttaccgtaaaaatttgcagaaaagtgatctttctacccttgtgagacgatgcccaaaccttgtgcatctcgacctctccgatagcgtaatgctaaagaacgactgttttcaggaattcttccaactgaattacctccaacacttaagtctttctaggtgttatgatattatccccgagacacttctcgagctgggagagatcccgactttaaaaacactgcaggtgttcggaatcgtcccagacggaaccttgcaactgctcaaggaagccctgcctcacctgcagatcaactgttcccactttactaccatcgcaagacccaccatcggaaacaaaaagaaccaggaaatctgggggatcaaatgccggctaactttgcagaaacccagctgtttgtag

SEQ ID NO: 242262 - DNA, 1362 bp, Artificial Sequence
  Description of Artificial Sequence: Synthetic coding sequence
atggctctggtgcgcgcacttgtctgctgcctgctcaccgcctggcattgtcgaagcggcctggggctccccgtcgctcccgcaggcggtcggaacccccctccagccatcggacagttctggcatgttactgatttacacctggatcctacgtatcatattaccgatgatcatactaaggtgtgcgcctcgagcaagggagcgaacgcatctaaccccggaccctttggagacgtcctgtgtgatagcccgtatcaattgattctctctgcctttgacttcatcaaaaactctggtcaggaagcttcatttatgatttggacgggagactctccgccacacgtgcccgtgcccgagcttagtacagacactgtcattaacgtcatcaccaatatgacaaccaccattcaatctctgttccctaatctccaggtgtttccagctctaggcaatcacgactactggccccaggaccagctacccgttgtcacatccaaagtctataatgccgtagcaaacttgtggaagccttggctggatgaggaagcaataagcaccctccgcaaggggggattttatagccagaaggtgaccaccaaccccaatttaagaataatctccctcaacactaacctctactacggtcccaacatcatgacactcaataagaccgacccagccaatcaattcgagtggttggaatctacgctgaacaatagccagcagaacaaagaaaaggtgtatatcatcgcccacgtcccagttggctacctgcccagcagccagaacatcaccgcaatgcgtgagtactataatgaaaagctgatagatatctttcagaaatacagtgacgtgattgcgggtcagttctacggacatacccacagggactccattatggtcttgtcagacaagaagggttctcctgtgaattctttgttcgtcgccccagcggttacccctgtgaaaagcgtgcttgagaagcagaccaacaaccctggcattcggctcttccaatatgatcctcgcgactacaagctcttggacatgctccaatactacctgaacctgactgaggctaacctcaaaggtgaatcaatctggaaattggagtacatccttacacagacatatgatattgaagatctccaacccgaatcactctatggtctggctaagcaattcaccattctggatagcaaacagtttatcaaatactataactacttcttcgtaagttacgactccagcgttacttgtgacaaaacctgtaaagccttccagatatgtgccatcatgaacctggacaatatctcttacgccgattgccttaaacaactgtacataaaacacaactattag

SEQ ID NO: 242263 - DNA, 969 bp, Artificial Sequence
  Description of Artificial Sequence: Synthetic coding sequence
atgacgacaacaattcagtcactttttcccaatttacaggtgtttcccgctctcggcaaccacgattattggccccaggaccagctgccggtggttactagcaaagtctacaacgccgttgccaatttatggaaaccgtggttggacgaggaagccatatccaccctcaggaaaggtggcttttattcacagaaagtcacaaccaacccaaatcttagaatcattagtctgaataccaatctatattatggtccaaacatcatgactctgaataaaacagaccctgctaaccagttcgaatggcttgagagtaccctgaacaatagtcaacaaaataaagagaaagtctacataattgcccatgttccagtaggttaccttccaagtagtcagaacatcacagctatgagggagtattacaatgaaaaactgatcgacatttttcaaaagtactctgatgtaattgccggtcagttctatggacacactcatagggatagcattatggtcctgagtgataagaagggtagtcccgtgaacagcctgttcgtcgcccctgcagtgacacccgtgaagtcagtgctggagaaacagactaacaatccgggtattcgactttttcagtacgacccgagagattacaagttgctggatatgctgcagtattacttaaatctaactgaggccaacttgaagggtgagtctatctggaaattggagtatattttaacgcagacgtatgatattgaggacctgcagcccgagtccctgtacgggctggctaaacagttcacgatcctcgacagcaagcaatttattaagtactataactacttttttgtgtcttatgattcatccgtgacctgcgacaaaacgtgcaaagcttttcaaatctgtgccataatgaacctggacaatatctcctatgcagattgtttgaagcagctgtacatcaagcacaattactag

SEQ ID NO: 242264 - DNA, 726 bp, Artificial Sequence
  Description of Artificial Sequence: Synthetic coding sequence
atgaaggaagtcgtgtattggagccccaagaaagttgccgattggcttcttgagaatgcaatgcccgagtattgcgaacctcttgaacattttacaggccaagacctgataaatttgacccaggaagactttaagaagcctcctctgtgtcgggtctcatccgacaacggacagcgactgttagatatgattgaaaccctgaagatggagcaccatctcgaggcccataaaaacggccacgccaacggccatttaaacatcggtgtggatatccctacaccggacggatcctttagcatcaagatcaaacctaatggcatgccgaacggctaccgaaaagaaatgattaagattcccatgccagagctggagcgatcccagtatcccatggagtggggcaagacattcctggcattcttgtatgcgctatcttgctttgtgctgacaaccgtgatgatttccgtagttcatgagagggttcctcctaaagaggtccaaccgcctcttcccgacacatttttcgatcattttaatagggtacagtgggctttttcaatatgcgaaattaatggtatgatcttggttggcctttggctgatccaatggctcctattgaagtataaggacgttgggaatgagtccagagtggtgatgattttcctgtcgatagtgcatccagtactcttgctggggtctatcgctggctttctaagcctgagtctttag

SEQ ID NO: 242265 - DNA, 1242 bp, Artificial Sequence
  Description of Artificial Sequence: Synthetic coding sequence
atgaaggaggtcgtctattggtctccaaagaaggtggccgattggctcctggaaaacgctatgcccgagtactgtgagccactggaacactttacaggtcaggacctgattaacctcacacaggaggacttcaagaaacctccactgtgcagagtgagctccgacaatggtcagagactgctcgatatgatcgaaacactgaagatggaacaccacctggaagcccacaaaaatgggcatgctaatggccacctgaacatcggggtagacatacctacaccggacggatctttttccattaagattaagcctaacggaatgcccaacggttatcgcaaggagatgatcaagattccaatgccggaactggagcgctctcagtaccccatggagtggggtaagactttcctggcgtttctctatgcgctatcttgttttgttttgaccactgtaatgatttccgtggtccacgaacgagtgccgcctaaggaggttcagccacccttacctgacacattttttgatcactttaatcgggtgcagtgggccttttcaatctgcgagattaatggcatgattttggtggggctctggttgatacaatggctgctgctcaagtataaatccataatttccagaaggttcttttgtattgtaggaacactgtacctttaccggtgcattaccatgtatgtcacaaccctgccagtgccagggatgcactttaattgtagtcccaagctgtttggggattgggaagcgcagcttcgtagaatcatgaagctgattgcagggggagggctttccattaccggttcccataacatgtgtggggactatctttactccggacacactgtgatgctcaccttgacgtatctgttcataaaggaatactcgccaaggaggctttggtggtaccactggatatgctggttgctgtccgtggtcgggatcttttgcatacttctggctcatgatcactatactgtggatgtcgttgttgcttactatattacaacccggctcttttggtggtaccacactatggcaaatcaacaggtgctcaaggaagcaagtcaaatgaatctgctggccagagtatggtggtatagaccattccaatactttgagaaaaatgtgcaagggatcgtgccacggagctaccattggcctttcccgtggccagtggtgcatctgtcaagacaggtcaagtactctcggctggttaacgacacctag

SEQ ID NO: 242266 - DNA, 642 bp, Artificial Sequence
  Description of Artificial Sequence: Synthetic coding sequence
acctacatgtatatctctaacaaatctattatttcaagaaggtttttttgtatcgtggggactctttatctgtacaggtgtatcacaatgtacgtgactacactgcccgtgcccggaatgcatttcaattgttccccaaagttattcggcgactgggaagcgcagcttcgtcggattatgaaattgattgccggaggtggtttgagcatcacaggctctcacaacatgtgcggtgattatctgtactccggccacactgtgatgctcacactgacctatctgttcatcaaggaatattcaccacgtaggctgtggtggtatcattggatttgctggctcctcagcgtcgtgggcatattttgcatactcctggcacatgaccactacactgttgatgtggtcgtcgcatattacattaccacgcgactgttctggtggtatcacacaatggccaaccagcaggtgttgaaagaagcttcccagatgaatcttctcgccagagtatggtggtaccgccctttccaatattttgagaagaatgtccagggcatcgtcccacggtcttatcattggccatttccatggcctgtagtgcacttatctaggcaagtgaagtattctagattagttaacgatacctag

SEQ ID NO: 242267 - DNA, 735 bp, Artificial Sequence
  Description of Artificial Sequence: Synthetic coding sequence
atgggtgggcgtggaggagggggacggagccgccagctgccaggtagatttagggcgcctgcagccaggtggcccggaggcaggtggttgcctggagctccccgaactgtgacatggagcattattagtagaagatttttttgcattgtgggtacactctatctgtacaggtgcatcacaatgtatgtcactaccctcccagtgcccggtatgcacttcaattgttcgcccaagttgttcggggattgggaggctcaactacggaggatcatgaaacttattgccggagggggactcagcatcacgggttcccataacatgtgcggggattatttgtattccggtcacactgttatgctgacactgacatacctgtttattaaggaatactcaccccgtagactgtggtggtatcattggatctgttggctcctgtccgttgtcgggatcttctgtatccttttagcccatgaccattacaccgtggacgtggttgtcgcctattatataacaacaaggctcttctggtggtatcatacaatggccaaccagcaggtgctgaaagaagcctcccagatgaatctgctggcaagagtttggtggtaccgccctttccagtatttcgaaaagaacgttcagggcatagtgcccaggagttaccattggccctttccgtggccagtggtgcacctgagcagacaggtgaaatattcacgcttggtgaatgatacctag

SEQ ID NO: 242268 - DNA, 1098 bp, Artificial Sequence
  Description of Artificial Sequence: Synthetic coding sequence
atggacatcatcgagactgccaagctggaagagcatttggagaaccagccttcggatcctacaaacacatacgccagaccagccgagcctgtggaggaagaaaataaaaacgggaatggtaaacccaagagtctttcatctggcctaagaaagggtacaaaaaaatatcctgactatatacagatcgccatgcctactgaatcaaggaataagttcccattggaatggtggaagaccggaattgcgttcatctatgccgttttcaatcttgtcctgacaaccgtgatgatcactgttgtacacgaaagagtcccacccaaagagctgagtccacccctgcccgataagttttttgattatatagatcgagtgaagtgggctttctcagtgtctgagataaacggaatcatcctcgtgggtctgtggattacacaatggctctttctacggtacaagtccatagtgggtcggaggttttgttttataattgggaccctgtatctctacagatgcataactatgtatgtcaccaccctgccggtgccgggtatgcattttcagtgtgctcccaagttgaatggcgacagtcaggctaaggtacaacggatacttaggctcatatcgggtgggggtctgtccattacgggatcccacatcctatgcggagactttttattcagtggccacaccgtgacattgacgttaacttacttgttcataaaggagtactcccccaggcacttttggtggtatcacctgatctgctggctgctgtccgcagccggtatcatttgcatccttgttgctcacgagcactatacgattgatgtgattatagcgtattacattactactcggttgttttggtggtaccacagtatggctaacgaaaaaaatctgaaggtgagttcacagacgaatttcctgtcgcgggcttggtggtttcctattttctatttctttgagaaaaacgtccagggttctatcccatgttgcttctcctggcccctatcatggccgcctgggtgcttcaagagcagttgcaaaaaatattcgcgcgttcagaagattggtgaagataatgaaaagagcacttag

SEQ ID NO: 242269 - DNA, 1098 bp, Artificial Sequence
  Description of Artificial Sequence: Synthetic coding sequence
atggacattatcgagaccgctaagcttgaggaacatctggagaatcaacctagtgacccaactaacacatatgccagacccgcagagcccgttgaagaagaaaacaagaacggcaatgggaaacccaagagcctctccagtgggctaaggaaaggcacaaagaaatatcctgattatattcagatcgctatgcccaccgaatcacggaataaattccctttagaatggtggaagacaggtattgcgtttatttatgctgttttcaacctagttctgacaaccgtgatgatcacagtagtgcatgagagggttccccctaaagagctgtccccaccattgcctgataagtttttcgattatattgatcgtgtaaagtgggcttttagtgtatcggagataaacggaatcattctagtcggcctgtggattactcaatggcttttcttgagatacaagtccattgtgggtaggagattctgttttatcattggaacgctttacctctaccggtgcataacgatgtacgtgaccaccctacccgttcctggcatgcattttcagtgtgccccaaagcttaacggcgatagtcaagccaaagtacaacggattctgaggctcatttccggcggaggcctcagcatcaccggatcccacatcctttgcggagattttttattctctggccatacggtgactctcacacttacttaccttttcatcaaagagtatagccctcgacacttctggtggtaccatttaatctgctggctgctatctgctgctggtattatatgtatccttgtagcacacgagcactacacaatcgatgtgataatcgcctactacattaccacccgactcttttggtggtaccacagcatggcaaacgagaagaatctcaaagtctcctctcagaccaattttctgtctcgcgcttggtggtttcccattttttacttctttgagaaaaacgtccagggctctattccctgctgtttctcctggccgcttagttggccgcctggctgttttaaaagcagctgtaaaaagtacagccgcgtccagaaaataggggaggacaatgagaaaagcacctag

SEQ ID NO: 242270 - DNA, 1098 bp, Artificial Sequence
  Description of Artificial Sequence: Synthetic coding sequence
atggacattatcgagacagcaaagctcgaagaacaccttgagaatcagccttccgacccgacaaacacttacgccagacctgctgaacccgtggaggaagagaataagaatggcaatggaaagcccaaatcgctcagctccggcctgagaaagggcaccaagaaatacccagattacatccagatcgcgatgccaacagagagtcgcaacaaattccccctcgaatggtggaaaactggtatagcgtttatctacgcagtttttaatctggtacttaccacagtgatgatcaccgtcgtgcacgagcgtgtccctccaaaggagttgtctccgccactccccgataaattcttcgactacattgaccgagttaagtgggcgttttccgtgagtgagattaatgggatcattctggttggcctctggattacccagtggctgttcttgaggtacaaatctattgttggaagacgcttttgcttcattattggtaccctctatctgtaccgctgcattacaatgtatgtgaccacgctacctgtaccgggaatgcactttcagtgcgctcctaagttgaacggggactcccaggctaaggtccagcgcatcctgaggctaatctcgggtgggggactcagtattaccgggtcacacatcttgtgcggtgacttccttttctctggacatacagtgaccctgaccctcacttacctattcattaaagagtattcgccacgccatttttggtggtaccatttgatctgctggttgctcagcgctgctggaatcatctgtatcttagtggctcacgaacactacacaattgatgttatcatagcctactacatcacgacgcggctgttctggtggtatcactccatggccaacgagaaaaacctcaaggtttcgtcacaaaccaattttctgagccgcgcttggtggtttccaatcttctactttttcgagaaaaatgtgcagggaagtattccctgttgtttctcttggcccttatcttggcctcccggttgctttaaatcatcctgcaagaaatacagcagggtccaaaagattggcgaagataacgaaaagtcaacatag

SEQ ID NO: 242271 - DNA, 135 bp, Artificial Sequence
  Description of Artificial Sequence: Synthetic coding sequence
atggatatcatcgaaacagccaagttggaagagcatttggagaatcagccgtctgaccccaccaatacttacgcccgaccagctgaacccgtggaagaggagaacaaaaacgggaacgggaagcctaaatcatag

SEQ ID NO: 242272 - DNA, 105 bp, Artificial Sequence
  Description of Artificial Sequence: Synthetic coding sequence
atggacattatcgaaacagctaaactcgaggagcacctggagaaccagcccagcgatcctacaaatacctacgcccgtccagcagagcccgtcgaggaagagtag

SEQ ID NO: 242273 - DNA, 1326 bp, Artificial Sequence
  Description of Artificial Sequence: Synthetic coding sequence
atgtcactgcgccaaagactggcacagttggtggggagactgcaggatccacagaaagttgccagatttcagcgtctttgtggggtggaagcacctcctcgcagatccgcggatcgccgtgaagacgagaaggcagaggcaccacttgctggcgatcccagattgcgtggtcggcaacccggtgccccagggggtccacaaccccctgggtccgatcgaaaccaatgccctgccaaacccgatggcggaggagccccaaacggcgtccggaacggactcgccgctgaactcggcccagccagccccagacgtgctggggctctaaggcgaaactctctgaccggcgaggagggtcagctggccagagtgtcaaattggcccctctattgcttgttctgtttcggtaccgaactgggaaatgaactcttttatatcctctttttccctttctggatctggaacctagatccattggtgggcaggcggctggtggtgatttgggtattggttatgtatcttggacagtgcactaaggatataattaggtggcccagacctgcctcaccgcctgtcgtgaagctggaggtgttctacaactcagagtactcaatgccaagtacacatgcaatgtctggcacagctattcccatttccatggtgctgctcacctatggcagatggcaatacccgttgatatacggactgatcctgataccgtgttggtgtagccttgtttgcctgagcagaatctacatgggcatgcatagcatcctggatataattgccggattcctctacacgattctgatcttagctgtcttttaccctttcgtagacctcatcgacaactttaatcagacccacaagtatgcacctttcattatcattgggctgcacctggctcttggcattttcagcttcaccctcgacacctggagtaccagccggggagatactgccgagatattgggttccggggctggcattgcttgcggctctcacgtcacctataatatgggactggtgctcgaccctagcctcgataccctcccgcttgcaggaccccctatcacggtgactttattcggtaaagccattctgcgcattctgattggaatggtgtttgtcctgattattcgcgacgttatgaagaagattacaattccacttgcctgcaagatattcaacatcccttgtgatgatatccggaaagctcggcagcatatggaagtcgagttgccctatcgctatattacctacggcatggtgggcttttctattacttttttcgtcccctacatcttcttcttcattggtatcagctag

SEQ ID NO: 242274 - DNA, 1200 bp, Artificial Sequence
  Description of Artificial Sequence: Synthetic coding sequence
atggcagaactcttgaggtctttgcaggactcacagttggtggccaggtttcagaggaggtgcgggctgttcccagctcccgacgagggtcccagggagaacggagcagatccaactgagagggccgctcgggtccccggagtcgagcatctgcccgctgccaacgggaaaggaggagaggctcccgcaaatggcctccgcagagcggcagcacctgaagcctatgttcaaaagtatgttgtgaaaaattacttctattattatctgtttcaatttagcgctgcactgggacaggaggttttttatattactttcctcccatttacgcattggaacatcgacccttacctgagtagacgcttaattataatctgggttcttgtgatgtatattggacaggtcgccaaggacgtcttgaagtggcctcggccatcatctccacccgtcgtaaagttggaaaaacgccttattgcggagtatgggatgccctctacacatgcgatggcagccaccgccatcgcattcactctgctcatttccaccatggatcgctaccagtaccctttcgtgctgggactggtgatggcggtggttttttctacgctggtttgcctgagccggctctacaccggtatgcacacggtgctagatgttctgggcggtgtgctgatcacggccctgcttattgtgctgacttatcccgcatggacattcatcgactgcctggacagtgcctctccattgtttcccgtgtgtgtgatcgttgtgccgttcttcctttgctataactaccctgtttctgattattactctccaaccagggcagatacgaccactatactggccgctggagccggtgtgacgattgggttttggatcaatcacttctttcagctggtcagtaaaccggcagaatctctgccagtgatacaaaatatcccccctctgacaacatatatgctggtgctgggtcttactaagtttgccgtggggatcgtactaatacttctggttagacagctggtgcagaatctgagcttgcaggttctgtactcttggttcaaagtcgtcaccaggaataaggaagcaaggcggaggctcgaaatcgaggtaccttacaaatttgtgacatacacttctgtgggcatttgcgccacaacgtttgtgcccatgctacaccgatttctcggtctgccatag

SEQ ID NO: 242275 - DNA, 1062 bp, Artificial Sequence
  Description of Artificial Sequence: Synthetic coding sequence
atgggttcactctatagcgagtacctgaatccaaacaaggttcaggagcattataactacacaaaagagaccctggagacccaggaaactacctccaggcaagttgcctccgcctttattgtcattctgtgctgtgccattgtcgtagaaaacctactggttcttatcgccgtcgcccgaaacagcaagtttcacagcgccatgtatctgttcctgggcaacctggcggcttctgacctactcgctggcgtggcctttgtggccaataccttgttatctggctctgtgacgctgcgattaacgcccgtgcagtggttcgccagagaggggtcagctttcatcacactgtctgccagcgtgttctcattgttggctattgccattgaacgacatgttgcaatagcaaaggtcaaactgtatggtagcgacaaaagttgccgaatgctgctgctcattggcgctagttggctgatctcgttggttctggggggtctgcctatcctggggtggaattgtttagggcatctcgaagcctgtagcactgtgctccccctgtacgccaaacattacgtcttgtgcgtggtcacaatttttagtataatcctgcttgctatagttgctctttatgtcagaatctattgcgtggtccggtctagccatgccgacatggccgcaccccagacactcgctctactaaaaactgttacaattgtcttgggagtctttatagtgtgctggttaccggcattctcaatcctattactggactatgcctgccccgttcatagctgtccaatcctctacaaggcccactatttcttcgctgtctcaacactgaattcactcctgaaccctgtcatctacacttggcggtcacgagaccttcgcagggaggtcttgcggccactgcagtgttggcgcccaggcgtcggcgtgcagggcaggcggagaggcggaactcctggccaccatttattgccgctccggagctctagctcactggagcgcggaatgcacatgcctacaagcccaaccttcctggaggggaatacggttgtctag

SEQ ID NO: 242276 - DNA, 1137 bp, Artificial Sequence
  Description of Artificial Sequence: Synthetic coding sequence
atggctactgccctaccgccacgtctccagcccgttagaggaaatgagacattacgggagcattaccagtatgtagggaagctggcagggcgtttgaaggaagccagtgaagggtccaccctgaccaccgtcctattcctagtgatctgctcctttatcgtgctcgagaacttgatggtcttgattgcaatatggaagaataacaaattccacaaccgaatgtatttttttatcggcaatctcgcattgtgtgatttgttagccggtattgcttataaggtcaatatactcatgtctggcaaaaaaaccttttcgctgagtcccactgtgtggttcttgagagaaggaagtatgttcgtcgctcttggagcttccacctgcagcctactcgccatcgcgatagaacgccacctgaccatgatcaagatgcggccatacgacgcaaacaaaaggcacagggtttttctgctcatcgggatgtgctggttgattgctttcaccctgggagcactgcccatactagggtggaactgcctgcacaatctgccggactgtagtacaatcttgcccctttattctaagaaatatatcgctttctgtatctcaatttttaccgcaattcttgttactattgttatcctctatgctcggatctattttttagtcaaaagttccagcaggaaggtggctaatcataataactccgagaggtctatggccctcctccggacagtggtaattgtagtctcagtatttatcgcctgctggtccccactctttattctttttcttattgatgtagcatgtcgagtccaggcgtgtcctatattgttcaaagcgcagtggttcatagtattggctgttctcaattctgcaatgaacccagtcatatacacacttgcttccaaggaaatgagacgggcatttttccgtctggtctgtaattgcctggttagaggacgcggagccagggccagtccaatccaacccgcactggatccaagcagaagtaaatcaagttcatccaacaacagcagccacagcccaaaggtaaaagaggacctgccacatacagccccatcttcttgcattatggacaagaacgccgcattgcagaatggcatcttctgtaactag

SEQ ID NO: 242277 - DNA, 1137 bp, Artificial Sequence
  Description of Artificial Sequence: Synthetic coding sequence
atggctaccgcactgcctccccgactgcaacccgtaaggggcaatgaaacactgagggaacactatcaatatgtggggaaattggcagggaggctgaaggaagcaagtgaagggtctaccctcactaccgtgctgtttcttgtaatttgttcttttatcgttctggaaaacctgatggtgctgatcgctatctggaaaaacaataaattccataatcgtatgtatttcttcatcggaaatttggcattgtgcgatttgctcgccggaattgcttacaaagtgaatatcctgatgtctgggaaaaaaacgttctctcttagcccgactgtgtggtttctgagggagggttcaatgtttgttgccctgggagctagtacttgctcattactggcaattgcgatcgagcgccacctgactatgataaagatgcgaccgtacgatgccaataaaaggcatcgcgtctttctactgattgggatgtgttggctcattgccttcaccctgggcgctctgcccatcctcgggtggaactgcctccataacctgccggactgctcgaccatcctgcccctgtactctaagaaatatattgccttttgtattagtatttttactgccattctcgtgaccattgttatcctatatgccaggatctactttctggtcaaatcttccagcagaaaggtggcaaatcataacaattccgagagaagtatggcacttctgagaaccgtagttatcgtggtttccgtgttcattgcttgttggagcccgttgttcatcctgtttctgatcgacgtagcctgtagggtgcaggcatgtccaattttattcaaggcacagtggtttattgttctggccgtactaaattcggccatgaatccagtgatttataccctagctagcaaggagatgcgcagagcattttttcgactagtttgcaattgcttggtgagaggtagaggtgcacgggcttctcctattcagccagcactggacccttctagatctaagagtagctccagcaataattcctcccactcgccgaaagtgaaagaagacctgccgcacaccgccccttccagttgcatcatggataaaaacgccgcactgcagaatggaatattctgcaattag

SEQ ID NO: 242278 - DNA, 1155 bp, Artificial Sequence
  Description of Artificial Sequence: Synthetic coding sequence
atgaacgccacgggtactccggtggcacccgaatcatgccagcagctggctgctggtggacactcccggctgatagtactccactataaccattctgggagactagcgggacgagggggtcccgaagatggcggactgggtgcgctgcggggattgagtgtggctgccagctgtctagtggtcctggaaaatctgttggtgctggcagctataacctcccacatgcgctcaagaagatgggtttactactgtctggtcaatatcaccctgagtgacctgctgaccggtgctgcctatctagcaaatgtgctgctcagcggcgcacggaccttccggttagcccctgctcaatggtttcttcgggaggggctgctgttcacagctcttgcagcctcaaccttctctctgctgttcaccgcaggcgagcgattcgccacgatggttcggccagttgcagagagtggcgctactaagacctctagagtctatgggttcatcgggctgtgttggcttctagcagcccttctgggtatgctccccctgttgggatggaactgtttgtgtgcattcgacagatgtagcagcctgttaccgctctatagcaagcggtacatcctgttctgtcttgtgatctttgccggtgtgctagcgacaataatggggctctatggggctattttccggttggtgcaggctagcggccagaaagccccacggcctgctgctcggcgaaaggcgaggcgactgctgaagacagtccttatgattttactggcgttcctcgtctgttgggggcctttgtttggtctgcttctggcggacgtgtttggatcaaacctgtgggcccaggaatatcttcgtgggatggactggatactggccctggctgtgcttaattccgcagttaatcctattatttacagcttccggtcacgggaagtatgtcgagcagttctttcattcctgtgttgtggctgcctgcggttagggatgagggggccaggagactgcctagcccgagcagtggaggctcactctggcgcatctaccacagattcctccctacgcccaagagactcgttccgcggtagccggtccttatccttccgaatgagggagccactgtcatcaatcagtagcgtgcggtccatctag

SEQ ID NO: 242279 - DNA, 1197 bp, Artificial Sequence
  Description of Artificial Sequence: Synthetic coding sequence
atggagagcggcctactgagaccagctccggtgtctgaggttatagtgttacactataattacaccggcaaactgcggggagcgagatatcaaccaggagccggactgcgggctgatgccgtcgtgtgcttggctgtgtgcgcattcatcgtccttgagaacctggctgtcctgcttgtgttagggaggcatccaagattccatgctccaatgttcctgctgctgggctccttaactctttcagacctgctcgctggcgctgcctacgctgccaatatcctcctgagtggaccgctgacacttaaactctctccagcactgtggttcgctcgtgagggaggagttttcgtggcactgaccgcctcagtactgtctttgctggcgatcgcactcgaaagatcgctcacgatggccagacgaggacccgcacccgtttcgagtcggggtcgcacccttgccatggctgccgctgcctggggggtgtcacttcttctagggctcttgccggctcttggatggaactgtctcggacgacttgacgcctgcagcactgtgctcccgctttatgcaaaagcatatgtgcttttttgtgtcttagcctttgttggaattctggctgctatctgcgctctgtatgctaggatctattgccaagtgcgcgctaacgctaggcgcctcccagcccgtcccggaaccgctgggactacttccacgagagcacgcaggaagccacggagtctggccctacttcgtacattatcagttgtactcctagcgtttgtggcctgttggggtcccttgtttttgctgctccttctcgatgtggcctgccccgcacgaacttgtccggtgttgctccaggccgaccctttcctaggccttgctatggccaatagcctgctgaacccgatcatctacaccctgactaacagggatctgagacatgcactgttaagattagtgtgctgtggaagacacagctgcggacgcgacccgtccggatcccagcaatcagcaagcgctgccgaggcttctggagggcttagaagatgcctccctcccggactggatggctcctttagcggcagcgaacgctcatcccctcaacgggatggactggacaccagcggcagcactggctcacccggtgcacctaccgcggctcgcactttagtaagcgaacccgcagccgactag

SEQ ID NO: 242280 - DNA, 933 bp, Artificial Sequence
  Description of Artificial Sequence: Synthetic coding sequence
atggagagcggcctgctgcggccagcaccagtgtctgaggtgattgtcctccactataactataccggaaagttgcgtggcgcaagataccaacccggagccggtctgcgagcagacgctgttgtgtgtctggcagtttgtgcgtttatagtcttggagaacctggctgtcttactggttcttgggaggcacccacgattccatgctcctatgtttctcctgttgggctcactgacgctgtcagatctgctcgctggcgcagcctatgcagctaacatactcctgtccggtccactgacactgaagttaagcccagctctgtggtttgccagggagggcggagtatttgtggctctcactgcctcggtgcttagtctcctggccatcgccctggagaggtcccttacaatggccagaaggggtccggcacctgtcagctcaagaggccgaacccttgctatggccgcagctgcctggggcgtctcgttactcctaggtctgctgcctgctctgggatggaactgtttaggcagacttgatgcttgttccactgtgttgcctctttacgccaaagcctacgttctgttctgtgtcctcgctttcgtgggaatattggcagctatttgcgcactgtacgccctggctggtctcgcagcccatgctcagagaggcgcaccagggttgtgtgggatgttaggaccaccccttcccgcagccgtcgctcggagaggcgtgcccggagctcatctgtcatgcacaccagctggaagatctctgcccggtaccggccatggacagctaacctccgagcctcaccacttgcacgctcaccagcccaggccagctccacgagctcctgccccagggctgctacgtactcctttattgcggcagcggcctgagtggcttcccgcagtgggtgaacgcggttag

SEQ ID NO: 242281 - DNA, 1197 bp, Artificial Sequence
  Description of Artificial Sequence: Synthetic coding sequence
atggagagtggcctcctgaggccagccccagtctccgaggtgattgtgctccactacaactatacgggaaagctgagaggcgctcggtaccagccaggggctggcttgcgagcagacgcagtggtctgtctcgccgtttgtgcattcattgtcttggaaaacctggccgtcttactggtgcttgggcgacatccaaggttccatgcaccgatgtttctgctacttgggtccttaaccctgagcgaccttctcgcaggtgctgcttatgcggcaaatatcctattgagcggaccactgacactgaaattaagtcccgctctctggtttgcccgtgagggcggagtcttcgttgctttaacagctagtgtcctaagtttgctggcaatcgctctagagagatccctgactatggcaagacgtggaccagcacccgtatcttctaggggaaggactttagccatggctgccgctgcatggggcgtttcgttattgttagggctgctgcccgctctcggttggaactgtctggggagactcgacgcatgctccaccgtgctacctctgtatgccaaagcctacgtgttattctgcgtccttgcatttgtgggcatactcgcagcgatctgcgcactgtacgctcgcatttattgccaggtgcgtgctaatgctaggaggctaccagcccgacccggtaccgctgggacgactagcactagggcgagaaggaaaccacggagcctggcccttcttcgcacgctttctgtggtgttgctggcatttgttgcgtgttggggtcccctgttcctcttgctgttgctggacgtggcatgtcctgctagaacttgcccggtgctgctccaagcagatcccttcctcggactggccatggctaattctcttctgaaccctatcatctataccctcactaatcgcgacctgcgccacgccttactcaggcttgtgtgctgcggaaggcacagctgcggcagagatcccagcggttcacagcagtcagcttctgccgcagaggcctccgggggtctgcgaaggtgcttacctccgggactggacggtagcttctccggctctgagcgctcttccccccagcgcgacggcttagacacgagcggttccaccgggtcaccaggggctccaactgccgctcgaacacttgtctccgaaccagccgcagattag

SEQ ID NO: 242282 - DNA, 5015 bp, Artificial Sequence
  Description of Artificial Sequence: Synthetic coding sequence
atggatggtaattccctgctctctgtcccatccaatctcgaatcatcacgcatgtatgacgtgttggagcctcaacagggacggggatgcggtagttcgggtagtggacccggaaactcaataactgcttgtaaaaaggtgctcagatcaaattctttactagagtccaccgactactggttgcagaaccagagaatgccctgccagatcggatttgtcgaagacaagagtgagaattgcgctagcgtttgcttcgtcaacttagacgttaacaaagacgagtgctccacggaacacctacagcaaaaacttgtcaatgtgagtccggatttacccaagctgatcagtagcatgaacgtgcagcagcctaaggaaaacgagattgtggtcctaagcggtctcgcttctggaaacctgcaggcagactttgaggtgtcccagtgtccctggctgcccgatatctgcctggtacagtgcgctcgtggcaataggccaaattctaccaattgcataatattcgagattaataaattcctcatcggcctggagctggttcaagaaaggcaactgcacttggagaccaacatcctgaagctggaggacgacaccaattgctcgttgagcagcatcgaagaggatttcttgacggcctctgaacacctcgaggaggaatcagaagtggacgagagtaggaacgactatgaaaacatcaacgtgtcggccaacgtgctggaaagcaagcaattgaaaggcgcaacccaagtcgaatggaattgcaacaaagagaagtggttatacgcccttgaagacaaatacatcaataagtaccccacacctctgattaaaaccgaaaggagcccagaaaacctcactaaaaacactgcactacagtcactcgacccaagcgccaagccatcacagtggaagagggaggcggtgggtaatgggaggcaggctacccattattaccatagcgaggccttcaaaggacagatggagaaatcccaagctctatacattccgaaggacgcttacttctctatgatggacaaagacgttccatcagcatgcgccgtggcagaacagaggtctaatttgaatcccggtgaccatgaggacacaaggaatgcactacctcctaggcaggatggcgaagtgacaacagggaagtacgccacaaatttggccgagtccgttctgcaagatgccttcatcaggttgtcccaatcacagtccacattgccccaagaaagtgcggtaagcgtctcggtggggtcttccttgcttccttcatgctatagcactaaagatacagtcgtgagcagaagctggaatgagctccccaaaattgtggtggtgcagtcccctgatggctctgacgccgcaccccagccgggaatctcctcttggccagagatggaagtgtcggttgaaacttcttctatcttaagcggggaaaactcttctcgacaacctcagtcagcgttagaggtggcactcgcatgtgccgcaacagtcatcgggacgataagctctcctcaggccactgagagactgaagatggagcaggtagtaagtaattttccgccagggagtagtggggctcttcagacacaagcccctcaagggctaaaggaaccctccattaacgaatacagctttccgtctgcactctgtggaatgacccaggttgcaagtgcagtcgcggtctgcggcctgggtgaaagggaggaggtcacatgctctgtggcaccgagcggctctcttccaccggctgcagaagcctctgaggcgatgcctccgctatgtggactcgcatctatggaactggggaaggaagcaatagccaaaggactgttgaaggaggcggctttggtgctgacccggccaaacacttatagttcgatcggggacttcttggactccatgaaccgcaggattatggaaacagcttccaaaagccaaaccttgtgttcggagaatgtggtacgtaatgaacttgcccatacactgtcaaacgtaatacttcgacactctatcgacgaggtgcatcataagaatatgatcattgatcccaacgacaacaggcactccagcgaaatacttgacacgctgatggagtcgactaaccagctgttgcttgatgtaatctgctttacctttaaaaagatgagccatatcgttaggcttggagagtgccccgctgtgctcagcaaggaaaccatccgaaggcgagaaacagaacctagctgccagccaagtgatccaggggcaagccaggcctggactaaggcaaccgagtcctcaagttcaagtccactgtcaaactcgcacaacactagccttgtgattaacaatctagtcgacggcatgtattccaagcaagacaaaggaggcgttagacctgggctgttcaagaatccgactctgcagtcacaactgagtcggtcccacagggtgcctgattcttccactgctactacctcctcgaaagagatctatctgaagggcattgccggagaggatacgaagagtcctcaccactcagagaacgaatgtcgcgcaagctccgaaggtcagcgttcccccacggtgtctcagtcccgtagtggttcccaggaagctgaagagtctatccacccaaacacccaggaaaaatacaactgcgctacatctaggatcaatgaggtgcaagtgaacctgagcctcttaggagatgacttattgctgcccgctcagtctacgctgcagaccaagcacccagatatatattgcattactgatttcgctgaagagctcgcagataccgtagtcagtatggctacagagatcgctgccatatgcctagacaacagcagtggcaagcagccgtggttttgcgcctggaaacgtggcagcgaattcctcatgacccccaacgtaccgtgcagaagcctcaaaagaaaaaaggagagccaaggatcagggactgccgtgcggaagcacaagccccctagattgagcgagattaaacgtaaaacggatgagcacccagagcttaaagagaaattgatgaaccgggtcgtggatgaatccatgaacttggaggacgtgccagacagcgtgaacctgttcgcaaatgaagtcgcagccaaaattatgaaccttaccgaattctccatggtcgacggaatgtggcaggcgcaggggtacccacggaaccgtctcctgagcggggatagatggtcacggctcaaggcatcttcttgcgagtccattccagaggaggattccgaagccagggcgtatgttaacagtttgggactcatgagtacattaagtcaacccgttagcagggctagctctgtgtccaaacagagctcctgcgagagtattaccgacgagttcagcaggttcatggtgaaccagatggagaatgagggtcgcggattcgagttgcttctggactattatgctggtaagaacgcttctagtatcctaaattctgccatgcagcaagcctgcagaaaaagcgatcacctctccgtgagacctagttgtccctccaaacagtcaagtaccgagagcatcacagaggaattctatcgctatatgctgagagacatagaacgtgatagtcgagaatctgcatcgtccagaaggtcctcacaagattggaccgctgggctactgagcccttccttacggtcccctgtttgccatagacaaagcagtatgccagacagccggtcaccctgtagccgcctcacggtgaacgtgcctattaaggctaacagcctcgacggatttgcccaaaattgtcctcaggacttcctgagcgtgcaaccagtgtcatccgccagctcttccgggctgtgtaagagcgattcttgcctttatcgcagaggaggcacagaccacattaccaatatgctgatccatgagacatgggctagctcaattgaggctctgatgaggaagaataagattattgttgacgatgcggaggaggccgacacggaacctgtgagtggcggaagccctagccaagccgagaaatgcgctaaccgactcgccgcttcgcgtatgtgttcagggccaaccttgttggtgcaggaaagtcttgactgccctcgaaaagattcggtcaccgagtgcaaacagcctcccgtgtcttctctgtccaagaccgcatctctgacaaaccacagccccctggatagtaagaaagagacaagttcctgccaggatccagtgcccatcaaccacaaacgcaggtcattatgcagcagggaggtgcccctgatacaaattgaaactgatcagagggaggcctgcgctggggagcctgaaccctttctgtctaagagttctcttctggaagaggctgagggacacagcaatgataaaaatataccggatgtcgttcgaggcggagacaccgccgtttctgcgtgtcagatccacagcgacagcctggacaccagagatgtgcctgaagcagaggcgtctactgaagctcgcgcacccgatgaggcacctaatccgccaagctcatccgaagagtcaaccggatcatggacacagctggcaaacgaggaggacaatccggacgacacaagtagtttcctgcaactaagtgaacgctcgatgagcgagctcgtggaagagaagaagattctgaaaggacaaagcgagtcaactgaggcaccggcttcaggcccacccacggggaccgcttctccccagcgctctttgctcgtgatcaatttcgacctcgaacctgagtgcccagatgccgagctgagggctaccctgcagtggattgctgccagtgaattaggaataccaaccatctactttaagaagtctcaggaaaatcgaattgagaagttcctagacgtcgtccagcttgtgcataggaaatcgtggaaggttggcgacattttccatgccgtcgtgcaatattgcaagatgcacgaggagcagaaagatgggagactgtctttattcgattggctgttagagctaggcta

SEQ ID NO: 242283 - DNA, 5102 bp, Artificial Sequence
  Description of Artificial Sequence: Synthetic coding sequence
atggacggcaactcactcctgagcgtaccttccaatctggagagttccagaatgtacgacgtgctcgagcctcaacagggcaggggatgtgggtccagtgggagtggccctgggaatagcatcacagcctgcaagaaggtactgaggtcaaattccttactggaatcaacagattattggctgcagaaccagaggatgccatgccagattggtttcgtcgaggataagtccgaaaactgcgcttcagtctgtttcgtgaatctggatgtgaacaaagacgaatgctccactgagcatctgcaacagaaactggtcaacgtgtctccggacctgcccaagttgatcagtagtatgaacgtgcagcagcccaaagaaaatgagatcgtcgtactgagcgggctggctagtggtaacctgcaggcagactttgaagtgagccagtgtccctggttgccagatatatgtttggtgcaatgcgccagagggaatcggcctaactccactaactgtattatcttcgagatcaataagttcctgattggcctggagttagtacaggaacggcaactgcatcttgagacaaacatacttaagcttgaggatgatacaaactgctccctgtcaagcatcgaggaagattttctgaccgcatctgaacatcttgaggaagaatcggaagtcgatgagagtaggaacgactacgaaaacatcaacgtcagcgccaatgtactggagtccaagcagctgaagggggcaactcaagtcgaatggaattgtaataaagaaaaatggctgtacgcactcgaggataagtacataaataaatatcctacgccacttatcaagacagagcgctccccagagaatctcacaaagaataccgccctgcagagcttggacccttctgccaaaccttcccaatggaaaagagaggctgttgggaacggaagacaggcgacacattactatcattctgaggcattcaagggacaaatggagaaatctcaggctttgtacattccgaaagacgcctacttttctatgatggacaaagatgtgccatccgcatgcgctgtcgctgagcaaaggtctaatttgaatccaggagatcatgaggacaccagaaacgccctgccaccacgccaagatggcgaggttaccactggcaagtacgccacgaacctggcagagtctgttctgcaggacgctttcattagactctcccagagccagtcaacactcccacaggaaagtgccgtgagtgttagcgtgggcagttccttgctccccagctgctactcaaccaaggatactgtggtcagtagatcctggaacgagttacccaagattgtcgttgttcaatctcctgatgggagcgatgcggctcctcagcccggaatttccagttggcctgaaatggaggttagcgtagaaacgtcctcaattttgtcaggcgaaaactcctcccggcaaccccagtcagctctggaggtagcacttgcctgcgcagcgacagtgattgggacgattagctcgccgcaggcaacagaacggttaaagatggagcaggtggtcagcaatttccccccagggagtagtggcgcactccagacccaagcaccgcaaggactgaaggagccaagtattaacgagtattcgtttcctagcgccttatgcggaatgacccaggtggcctccgctgtggctgtctgcgggctgggcgagcgagaagaagtgacttgctcagtggctcccagcggctccctcccaccagcagccgaggctagtgaagcgatgcctccgctctgcggactggcctccatggaattgggcaaggaggcgattgcaaaaggacttctgaaggaggctgctctggtgctgacgcggcctaacacttacagttctatcggagattttctagactctatgaacagaaggatcatggagactgcttccaagtcacagacactgtgttcggagaatgtcgtccgcaatgagctcgcacatactctaagtaatgttatattgaggcattctatagatgaggtgcaccacaagaatatgataatcgaccccaatgataatcggcatagttccgaaatactggataccttaatggagtccaccaatcagttattactggacgttatctgcttcacgttcaagaagatgagtcacattgtccgcctaggggagtgtcccgcagtgctttccaaggaaaccataagacgacgggaaacagaaccgtcatgtcaaccgagcgatcctggggcatcccaggcgtggactaaagctacagaatctagtagctcctctccactgtccaactctcataacaccagcctcgtcatcaataaccttgtcgacggcatgtactcaaagcaggataaggggggagtgcgccctggcctgttcaagaaccctactctgcagagtcagctcagtcggtcccatagagtgcctgactcctcaacagccaccaccagttcaaaggaaatctacctgaaaggcatcgcaggggaggatacgaaaagcccccaccactcagaaaacgagtgtagagccagcagcgaaggacaaagaagtccaaccgtctcccagtcccggagcggttcccaggaggcagaagaatcgatccaccccaatacccaagagaaatataactgcgcaacttctcgaattaacgaagttcaggtgaacctgtcgcttttgggtgacgacctgctgctcccagcacagtccacccttcaaacgaaacatccggacatatattgcattacagacttcgccgaagaattagcggataccgtcgtgtcgatggctactgagatcgcggctatctgtctggataactcttctggaaaacagccctggttttgtgcgtggaagagagggtccgagttccttatgacacctaatgtgccctgcagaagcctcaaaagaaagaaagagtctcaaggtagtggcacggccgtgcggaagcacaagccacctcgcctatctgaaatcaagcggaagactgacgagcaccccgaactgaaggaaaaacttatgaacagagtggtggacgagtccatgaacttggaagacgtgcccgactcagtcaatctttttgccaacgaggtagcagccaagattatgaatctgactgagttctcaatggtggacggcatgtggcaggcccagggatatccaaggaataggctcctgtcaggagataggtggtccaggttgaaggcatcctcatgcgaatccatacccgaggaggattccgaagcccgtgcctatgtcaattccctcggccttatgtctacactcagtcagcctgtatcaagggcatcaagtgtttctaagcaatcgagttgtgaatccattacagacgagttcagccgttttatggtaaatcaaatggaaaacgagggtcgaggattcgaactgcttttggattattatgcagggaagaacgcatcaagcatcctgaactcagctatgcagcaagcatgccggaagtcagatcacctttctgtccgccctagttgtccttccaagcagagtagtactgagtctataactgaggaattctaccgctacatgctcagggatattgagagagacagtcgtgagagtgccagcagcagacgctcctcacaagactggacggcgggtctgctgtcaccttcactcagaagtcccgtttgtcataggcagtccagcatgccagattcccgatctccgtgtagccgactaacagtgaatgtacccatcaaggctaactcactggacggctttgcacaaaactgcccgcaggactttttgagtgtgcaacccgtgtcaagtgcgtcaagcagcggactgtgcaaatctgatagctgcctgtacagacgtggaggtaccgatcatataactaacatgttaatccacgagacctgggctagttccatcgaggctctgatgaggaagaataagataatcgtagatgatgctgaggaggctgataccgagcccgtgagcggcggaagcccttctcaagccgagaagtgtgcaaatcggctggctgcttctagaatgtgttccggccctacattactggttcaggaatcccttgactgtcctagaaaagatagcgtgacagagtgcaagcagccccctgtgtcttcactcagtaaaactgcgtcgctgactaatcacagccccttggactcgaaaaaggagacaagctcatgtcaggatcctgtgcctataaatcataagcgtagatctctgtgcagcagagaggtcccactgatccagatcgaaacagatcagagagaagcatgcgctggcgagcccgaaccctttctgtctaaatcttctttactggaggaagccgaaggtcactctaatgacaaaaacatccccgacgtggtcagagggggagatactgctgtgtcagcatgtcagatccattcggacagcctggacacgagagacgtgccagaggcagaggcatcaacagaagctagggccccagacgaagctccgaacccgccttctagtagcgaagagagcaccgggtcatggacccaattggccaatgaggaagacaaccccgacgacaccagctctttcctccagctgtctgaacggagcatgtcaaacggtaactcaagcgcaacgagctcactggggattatggacctggacatataccaggagtctatgcccagctccccaatgatcaatgagctcgtcgaagaaaaaaagatactaaaagggcagtctgaatctacggaggcccctgcctctggacccccaaccgggactgctagtccccagagaagtctgctcgttattaacttcgacctagaaccagaatgtccagacgccgagctgcgcgctacgctacagtggattgctgcttcggagctgggaattcccactatatattttaagaaaagccaggaaaatcggatcgaaaaatttttggatgtagttcagttggtccataggaaatcatggaaggtgggcgatattttccatgccgtggttcagtactgtaagatgcacgaggaacagaaagatgggagactgtccctattcgactggttgttggaacttggcta

SEQ ID NO: 242284 - DNA, 789 bp, Artificial Sequence
  Description of Artificial Sequence: Synthetic coding sequence
atgctcgcgctggaggcggctcagctggatggaccccatttctcttgcctataccctgacggagtcttctatgatctggatagttgtaagcattcaagttaccccgattcagagggggctcctgattctttgtgggactggaccgtggctcctccggtcccagctaccccctatgaagccttcgatcctgccgcagccgctttttcccatcctcaagctgctcagctctgctacgagccacccacatactcgcctgctggaaatctggaactcgcaccatctctcgaggcacctggccctggtctcccagcatacccgacagagaattttgctagccagaccctggtgccaccagcttacgccccatacccttcccccgtgctttccgaagaggaagacctcccactggatagtcccgctctggaagtctctgacagcgaatccgatgaggccttggtcgccggacccgaagggaaaggatctgaggctggcacacgcaagaaactccggttataccaatttctgctgggcctgctcactcgcggagatatgcgcgaatgcgtttggtgggtggaacccggtgcgggagttttccagttcagcagtaagcacaaggagctgctcgcaaggagatggggtcagcaaaaggggaacaggaaacggatgacttatcagaagctggccagggctcttcggaattacgctaagacaggggaaatacgcaaagttaagagaaaactcacgtatcagttcgattctgccttacttcctgctgtgcgcagggcttag

SEQ ID NO: 242285 - DNA, 516 bp, Artificial Sequence
  Description of Artificial Sequence: Synthetic coding sequence
atggcctcatccatgacttggaccgctgcctcaatacccgcaactctgattcagcggggactgcttaccctcgtccctcctgcatacgctccctacccttccccagtattgtccgaggaggaggacttgccccttgattcccctgccctggaggtatctgactccgagagcgacgaagccctggtggccggtcccgaaggcaaaggatccgaggctggaacccgcaaaaaacttcgcttatatcagtttctcctaggattgctcactcgcggagacatgcgcgagtgcgtgtggtgggtggaacccggagctggcgtgtttcagttctcttctaagcacaaggagttgttagccagacggtggggtcagcagaagggaaacagaaaaaggatgacgtaccagaaactggccagagctcttagaaactacgcgaagactggtgaaattcggaaggtgaaacgaaagttgacttatcagttcgattcggcacttctgccagccgtcaggagggcatag

SEQ ID NO: 242286 - DNA, 747 bp, Artificial Sequence
  Description of Artificial Sequence: Synthetic coding sequence
atgacttgcgttgaacaagacaagctgggccaggctttcgaggatgccttcgaggtgctgagacagcattccacaggggacctgcaatattctcctgattacaggaactacctggccctgattaaccacaggccccatgttaagggcaattctagttgctacggtgtgctgcctacagaagagccagtgtacaactggaggaccgtgatcaatagcgctgccgatttctatttcgaggggaatatccatcagtcactacaaaacattaccgagaatcaactggtgcagcccactctgctgcaacagaaaggcggaaaaggcagaaagaaactgagactgttcgagtacctacatgaatcattatacaaccctgagatggctagctgcatccagtgggtggacaaaacgaagggcatattccagttcgtctcgaaaaataaggaaaaactggcagaactctggggcaaacgtaaagggaaccgcaagaccatgacctatcagaaaatggctcgcgctctacgaaattatgggaggagtggcgaaataactaaaataaggagaaaattgacctatcaatttagcgaagccatcctccaaagattgtctccttcctacttcttaggaaaggaaatcttctactcgcagtgcgtacaacccgatcaggagtatctgagtctgaataactggaatgctaattacaattatacttacgcgaactaccacgagctcaatcatcacgactgctag

SEQ ID NO: 242287 - DNA, 747 bp, Artificial Sequence
  Description of Artificial Sequence: Synthetic coding sequence
atgacatgcgtagagcaggacaagctcggtcaggcattcgaagacgcattcgaagtcctccgtcagcacagcacgggcgacctccaatatagtcccgattaccggaattacctggctttgattaaccacagacctcacgtcaagggcaattcatcatgttatggggtgctgcctaccgaagaaccagtctataattggcgaacagtgatcaactccgccgcagacttctattttgagggcaacattcatcagagtctccagaacattaccgaaaaccagctggtgcagcccacccttctccagcagaagggcggaaaggggaggaagaaactgaggctctttgaatacttgcatgaaagcctgtacaaccctgagatggctagttgtatacagtgggtagataaaacaaaaggcatcttccagtttgtgagtaaaaataaagagaaactggccgagctttgggggaaaagaaaaggaaaccgaaaaactatgacctaccagaaaatggctagggcgctgaggaattacggcagatcaggagaaattacaaagatccgcagaaagttgacatatcagttcagcgaggccattctgcaaagactgtctcccagttattttttgggaaaggagattttttactcacagtgtgtgcagccagaccaggagtacctgtctctgaataactggaatgccaactacaactatacctatgctaattaccacgaattgaatcaccatgactgctag

SEQ ID NO: 242288 - DNA, 2568 bp, Artificial Sequence
  Description of Artificial Sequence: Synthetic coding sequence
atgtccttcgttagagttaatagatgtggcccaagggtgggagtgagaaagacacccaaagtgaaaaagaagaagactagcgtcaaacaagaatgggacaacaccgtgacggacctcactgtccacagggccacgccagaagacctcgtgcgcaggcacgagatacacaagtccaagaatagagctctggtccattgggagctgcaagagaaagcacttaaaaggaagtggaggaaacagaagcctgaaacgttgaacttagaaaaacgtaggctcagcatcatgaaggagattctctcggaccagtatcagatgcaggacgtgctggagaaatctgaccacctgatcgccgcagctaaggaactctttccaaggcgcaggactggtttcccaaatgttactgtggcacctgacagctcccaggggcctattgtcgttaatcaggaccctatcactcagagtatcttcaacgaatccgttattgaaccacaagccctcaatgatgtagacggtgaggaagagggcaccgtgaatagccaatccggggagtcggagaatgagaatgagcttgataactctctcaacagccaatctaatactaacaccgatcgatttctccagcaactgaccgaggagaacttcgagcttatatcaaaattgtggactgacatccagcagaaaatcgctacccagagccagatcactccaccaggaacgccatcctctgccctgagctcgggggagcaacgcgcagctctgaatgccacgaatgctgttaagaggttacaaactcgcctccaacccgaagaatcaacagaaacgctggacagttcttatgtggtgggtcacgtgctaaactctcgaaagcagaagcaacttcttaacaaagtgaaacggaaaccaaatcttcacgccctttccaagcccaaaaaaaacatctcatctggttccactacatctgcagaccttcctaaccgcactaacagcaacctggatgtactgaagcacatgatccacgaagtggagcatgagatggaagagtatgagagatggactggtcgcgaagtgaaaggcttgcaatctagccaaggcctgacggggttcactctctcactcgtcagctccctctgcaggctggttagatatcttaaggagtcagagattcagttaagaaaggaggtggagactagacagcagcttgaacaggttttgggtgaccaccgagagctgattgacgccctgaccgcagaaatcttaaggctcagagaggaaaatgccgcaacccaagcacgactgcagcagtatatggtaacgaccgatgagcagctgattagcttaactcacgcgatcaaaaattgccctgtgatcaataatagacaggagattcaggcaagcgaatccggggcaactgggagacgcgtgatggactctccagagcgccctgtcgtaaacgccaatgttagcgtgccattgatgttccgagaggaagttgctgagttcccacaagaggaactgccggtcaaactgtctcaggtgccagatccaccggataacatgaatctggctaagaactttcctgcacacatcttcgagccggcagtgttactcactcccccaagacagaagtctaatctgaagttttctccgcttcaagacgttctgagacgtacagtgcagaccagacccgctccaaggctcccaccaaccgtggagataatcgagaaggagcagaactgggaggagaaaactctgcctatcgatacagacatccagaacagctccgaagagaatagattgttcacccagcgatggcgcgtgtcgcacatgggcgaggatcttgaaaataagacgcaggcacccttcgtgaacctgagccagcccttgtgtaattctcacagtaacactcagcagagcagatctcccaccttctcagaagagttgcccgtgctgggcgatggccaacagctgcgcaccaacgagtcccttatccagagaaaagacatcatgacacgcatcgctgacttaaccctccagaatagcgccattaaagctcacatgaacaacattatcgagcccagaggtgagcagggagacggtttacgggagctgaacaagcaggaaagtgcatccgacatgacctctacctttcctgtggcacagtctcttacgcccggaagcatggaagaacgtatcgctgagctgaataggcagtccatggaagccaggggtaaactgttacagctgatcgagcaacaaaagctggtggggctcaacctgtctcccccaatgagtcctgtccagctcccattaagggcgtggactgagggggcaaaaaggacaatcgaggtgtccattccaggagcagaggccccagaatccagtaaatgttcaacagtgagcccagtgagtgggatcaacacccgccgtagtagtggagcaacaggtaacagctgctctccactcaacgccacatccggaagcggcaggttcactccgcttaatccacgagcaaagattgaaaaacagaatgaggagggctggttcgctctgtctacacatgttagttag

SEQ ID NO: 242289 - DNA, 483 bp, Artificial Sequence
  Description of Artificial Sequence: Synthetic coding sequence
atgtcttttgtaagagtcaaccgatgcggacctcgggtgggcgtacgcaagactccgaaagtcaaaaagaagaagaccagcgttaagcaggaatgggataacactgtgacagatctgaccgttcatcgggcaacacctgaggatctcgtgcggaggcatgagattcacaagtccaagaaccgggctcttgtgcactgggagctgcaggaaaaagcccttaagcggaaatggagaaagcagaaaccggaaacgttaaacttggagaagaggaggctgagcataatgaaagagatactcagtgaccagtatcagatgcaggatgtgctggagaagtctgaccatctcatagctgctgcaaaagaactgttccccaggaggcggaccgggttccctaatgtcacagtcgcacccgactccagtcagggccctatcgtggtcaaccaggaccccatcacacagagcatctttaatgaatcagtttag

SEQ ID NO: 242290 - DNA, 522 bp, Artificial Sequence
  Description of Artificial Sequence: Synthetic coding sequence
atgtctttcgtgcgagttaatcggtgcggcccacgcgtgggcgtccgcaaaacacccaaggtgaaaaaaaaaaaaacttcggtcaaacaggagtgggacaatactgttacagatttgacagtacaccgagcaacccccgaagatttggtcaggagacacgaaattcacaaaagtaagaaccgcgcactggtgcattgggagttacaggaaaaagccctgaagaggaagtggaggaagcagaagcccgaaaccctgaatcttgagaagcgcagactgtctattatgaaagagattctgagtgaccagtatcagatgcaggatgtgcttgagaaatctgatcacctgattgcagctgcaaaggagctgttccccagaaggagaacggggtttccaaatgtgactgtcgccccagattctagccagggccctatcgtcgttaatcaagacccaatcacacagagtattttcaacgagtccgttattgagccccaggctctcaacgacgtcgacggcgaggagtag

SEQ ID NO: 242291 - DNA, 60 bp, Artificial Sequence
  Description of Artificial Sequence: Synthetic coding sequence
atgagtttcgttcgcgtcaataggtgtggtcctagggtaggggtgcgcaagaccccttag

SEQ ID NO: 242292 - DNA, 789 bp, Artificial Sequence
  Description of Artificial Sequence: Synthetic coding sequence
atgaagaccccatttggaaaaacccccggtcagagatcgcgcgcagatgcgggtcacgccggtgtgtccgcgaacatgatgaagaagagaacatcccacaaaaagcacaggagcagtgtgggccctagcaagcctgtatctcagccgaggaggaacatcgtggggtgtcggatccagcatgggtggaaggagggaaatgggccagtcacccaatggaagggcacagtgctggaccaggtccctgttaacccttccctctatctcattaagtacgatggcttcgattgcgtttacggcctggaactgaataaggatgaacgagtgtccgcactggaggttcttccagacagggtcgccacaagtcgtatatccgacgcccacttggccgatactatgataggcaaggcagtcgaacacatgtttgaaactgaggacgggagtaaagatgaatggcgcggaatggtgctggccagggcaccagtcatgaatacatggttttacattacttatgaaaaagaccccgttctatatatgtaccagctcctggatgactacaaagagggcgatctcaggataatgccagatagcaacgattcgccccctgccgagcgggagccaggcgaggtggtcgattcactggtggggaagcaggtggaatacgctaaggaggacggaagtaaacggacagggatggtgattcaccaggtcgaggcaaagcctagcgtgtacttcataaaattcgatgatgacttccatatttatgtatacgatctcgtgaaaacatcgtag

SEQ ID NO: 242293 - DNA, 789 bp, Artificial Sequence
  Description of Artificial Sequence: Synthetic coding sequence
atgaaaacccctttcggtaagacacccggacagaggagtcgggcagacgccggtcacgctggggtcagtgctaacatgatgaaaaagcggacatctcataaaaagcaccgcagttcagtcggcccttcaaaaccggtgtcacagccccgacgtaacattgtggggtgcagaattcagcatggctggaaagagggtaacggcccagtgacacaatggaaaggtacagtgctggatcaggtgcctgtgaatccatctttgtatctcattaaatatgacggctttgactgtgtgtatggtctggaactgaacaaagacgagcgggtaagcgcccttgaggtgctcccagatcgtgtggctaccagtagaatctcagacgctcacctggccgatactatgattggaaaggcggtagaacatatgtttgagactgaggacgggtcgaaggacgagtggcgtggaatggtgctagcacgcgcacccgtgatgaacacttggttttacatcacgtacgagaaggaccctgtcttatacatgtaccagctgctcgatgattataaggagggagacctgcgcattatgccagatagcaatgattcccctccagctgagcgcgagcctggggaagttgtcgactcgcttgtcggcaagcaggtcgagtacgccaaggaggatggctctaaacggacaggtatggtcattcaccaggtagaggccaaaccttccgtctactttatcaaattcgatgacgactttcatatttatgtgtacgaccttgtgaaaactagctag

SEQ ID NO: 242294 - DNA, 1587 bp, Artificial Sequence
  Description of Artificial Sequence: Synthetic coding sequence
atggccggtagcgacacagcccctttcctgagtcaggctgatgatccagatgacggacccgtgccgggaacacccggtcttccgggttcgacgggaaaccccaagtctgaggaacccgaagtccccgaccaagaagggctgcaacgcatcactgggttgtcccccggaagatccgccctaatcgtggcagtcctgtgttatattaacctcttgaactacatggatagattcactgtggctggcgtgttgcccgacatcgaacaattctttaacatcggtgattcgtcctccggtctgatacagaccgtatttatctcgagttacatggtgctggcccctgtgtttggctatctcggcgaccgttataatcgcaagtacttaatgtgtggtggcattgccttctggtctttggttacactcgggtcttcatttattccaggagaacacttctggctgctgctgctgactagggggctcgtcggggtaggcgaagcgagctacagcaccatcgcacctacactgatagccgatctcttcgtggcagaccagaggtcccgcatgctgtcgatattctattttgcaatccctgttggaagcggcctgggatacattgctgggtccaaagtaaaagacatggctggtgactggcactgggcccttcgtgtgacacctggcttgggagtagtcgctgttctgctactgttcctcgtcgtgagagagccgccaagaggcgctgtcgagcgacactccgatttacccccattgaatccaaccagttggtgggcagaccttagggcactggctaggaatccatcatttgtgctgtctagtctcggtttcaccgccgtggcctttgtcacgggctcactggccctgtgggctccggcatttttattaaggtcgagagtggtgctcggggagaccccaccttgtctcccaggcgattcttgtagcagctctgattccctaatcttcggcctcataacgtgtcttaccggagtcctcggggtggggctgggcgtggaaattagccgcaggctgcgacatagcaatccaagagccgatccgcttgtgtgtgcgactgggcttttgggctcagcaccgttcctcttcttgtctctcgcttgcgccaggggtagtatcgtggctacatacattttcattttcatcggcgaaacccttctgtcaatgaattgggcaatcgtggccgacattctcctgtacgtggtcatccccaccaggaggtctaccgcagaagcctttcagatcgttttgtcccaccttctgggggacgccggatcaccctacttaatcggcctgatttccgacaggctccggcgaaactggccaccttcattcctcagcgagtttcgagccttacagttttctctcatgctttgtgccttcgtgggggctcttgggggtgcagctttcttgggcacagccatctttatagaggctgatagacgcagagcgcagcttcatgtccaaggtttgctgcacgaagctggatcaacagacgaccggattgtcgttccgcagcggggtagaagcacgagagtaccggtggctagcgtgcttatttag

SEQ ID NO: 242295 - DNA, 1368 bp, Artificial Sequence
  Description of Artificial Sequence: Synthetic coding sequence
atggacagatttaccgtcgcgggtgttcttcctgacatcgagcagttcttcaatatcggcgattcaagcagcggtctgattcagacagtctttatatcttcttacatggtgctggcgccagtgttcgggtacctcggtgaccgctataacaggaagtatctgatgtgcggcggaattgccttttggtccctggttacgctgggcagctcttttataccgggagagcacttctggctcctactgctgacacggggactggtcggggttggtgaagcctcttactcgaccattgccccaacattaatagctgacctgtttgtggccgaccagagatcccggatgctgtcaatcttttatttcgctattcctgtgggctctggtctgggctacatcgcaggttctaaagttaaagacatggctggcgactggcactgggctctccgggtcacgccaggactgggagtcgttgcggtcctgctgttatttcttgttgttagagaaccccctagaggggctgtggagcgtcattcagacctgcccccactcaatcccaccagttggtgggccgacctcagggccctagctcgtaatccttcctttgttttgtcgagtctgggcttcaccgccgtggctttcgtgacgggcagtctggctttgtgggcacctgctttcctcctgagaagccgagtggtgctcggtgaaacgccgccatgcttaccgggagatagctgtagttcttccgactctcttatttttggtttaatcacatgcctgacaggagttctcggggtgggcctgggggtggaaatatcgagacgcctaagacatagcaacccacgagccgatccgctcgtgtgcgctacaggactgctcggctcggctccattcctctttttaagcctggcttgtgcacgaggttctatagtggccacatatattttcattttcattggggagactctgctgagcatgaactgggccattgtggcagatattttactctatgtcgtcattcctactagacgtagcacagccgaggcctttcagattgtgctttctcacttgctaggagacgcaggatccccgtatttgatcggtctgatttcagatagactcagacgcaactggcccccttcattcctttctgagttccgtgctcttcagttctcactgatgctgtgcgcgttcgtgggggctctcggaggcgcagcctttttgggtacggccatcttcatcgaggccgacagacggagagcacagcttcacgtgcaaggcctgctgcatgaagcaggctccacggacgaccggatcgtggtcccccagagggggagatccactagagtgcctgtggctagtgtacttatctag

SEQ ID NO: 242296 - DNA, 1431 bp, Artificial Sequence
  Description of Artificial Sequence: Synthetic coding sequence
atggctggaagcgacacagctcccttcttatctcaggccgacgacccagacgacggtcccgtgcccggaacccccggactaccaggaagcaccgggaatccaaagagtgaggaacccgaagtaccggaccaggaaggactgcagcggatcaccggactctctcccggaagaagcgctctcatcgttgcggtgctgtgctacataaatctccttaattacatggatcgcttcaccgtcgctggcgttctccccgacatcgagcaattcttcaatatcggggattcctcatctggactcattcaaacggtttttatttcatcatatatggttttggcccctgtctttggctatctgggcgataggtacaatcggaagtatttaatgtgcggtgggattgctttctggtccctagtcactctcgggtctagcttcattccgggagaacatttttggctcctgttacttacacgcggactcgtcggtgtgggggaggcgtcttattctacaatcgccccaacactgatagctgaccttttcgttgccgaccaacgatcccgcatgttgtcaatcttctatttcgcaatccctgtgggctctgggctgggctatattgctggatccaaagtgaaggatatggcaggcgattggcactgggcattgcgagtgacgccaggtctcggagtcgtcgccgtcctgctcctgttcttagtggttcgagagccccctcggggtgcggtggagcggcactcagatctgcccccactgaatcccacctcatggtgggcggatcttcgggctttggcacgtaacctaatttttggactgatcacatgtctgaccggggttcttggcgtgggtctgggtgtggaaatatctcgccgactacggcactcgaaccccagggctgaccccctcgtgtgtgctactggtctccttggcagtgctccttttctgtttttatctttggcctgcgctcggggatctatcgtggccacatatatctttatcttcataggtgagaccttgctgtccatgaattgggccattgtggctgatatactactatacgtggtcattcccacgcgcagaagcactgccgaggcttttcagattgtcctctcacatctcctgggcgatgccggatcaccttatcttatcgggctcatcagtgatcgactgcgcaggaactggcctccaagcttccttagcgagttccgtgctcttcagttctccctgatgctttgcgcgttcgtcggtgctcttggcggtgcggcattcttgggcactgcaatcttcattgaagccgaccggcgacgcgctcaactacacgtgcagggcctgctgcacgaagctgggtctactgacgaccggattgtcgttccacagcgtggaaggtcgacacgcgtccccgtggcatccgtgctgatctag

SEQ ID NO: 242297 - DNA, 1365 bp, Artificial Sequence
  Description of Artificial Sequence: Synthetic coding sequence
atggctggatcagacacggcgcctttccttagccaggctgacgatccagacgacggcccagtccccggaacacccggtctgcccggttcaaccggtaaccccaaaagcgaagaacccgaggtgcctgatcaggagggcctgcagcgtattacgggattgtcacctggtagaagtgccctcattgtcgccgtcctctgctacattaacctcttgaactacatggacaggttcactgtcgcagtcttcatcagttcctatatggtgctcgcccctgttttcggctacttaggggatcgttacaatcgcaaatacctgatgtgcggagggatcgctttttggtccctcgtgacactgggctcgtcctttatcccaggagagcacttctggctcctcttgttaactcgtggtcttgtgggcgtgggagaagccagctactcaaccatagctccaacgctgatcgctgatctgtttgtcgcagaccaaagatcccgtatgctttctatcttttacttcgcaatacccgttgggtcagggctcggatatatagccggatcaaaagtaaaggacatggccggagactggcattgggccctccgagtcacccctggccttggggttgtggcagtcttactcctctttcttgtggtacgagaaccgccaaggggagctgtggagagacacagcgacttaccacctctaaacccaacctcatggtgggccgacctgcgagctctggcgaggaatttgattttcggccttattacatgtctgacaggggtcctcggagtggggttgggggtcgagataagtaggagactgcggcacagcaaccccagggctgaccctttggtttgcgctactggcctcttggggtctgccccattcctgttcctttcgctggcatgtgctcgcggaagcattgtggcaacatacatattcatcttcataggagagacactcctgtccatgaactgggctattgttgctgatatactgctgtacgtcgtgattccaactcgtagatccacggccgaggcctttcagatcgtgctgagccatctgctgggagatgctggctcaccctaccttattgggttgattagcgatcgcctgcgcagaaattggccacccagcttcttgagtgagtttcgggcattacagtttagcctcatgctgtgtgccttcgtgggggcactcggcggagccgcattcttgggcacagccatcttcattgaggctgaccggcgtcgcgcacagctccatgtgcaggggctcctgcacgaggccggatctactgatgatcggattgtcgtgccacaaaggggccgaagtactcgcgtgccagtggcctctgttctaatctag

SEQ ID NO: 242298 - DNA, 1650 bp, Artificial Sequence
  Description of Artificial Sequence: Synthetic coding sequence
atgatgtgcctggaatgtgcatcggcagccgcaggcggagccgaagaagaagaggcagatgctgagagacggcgacgtcgacgtggagctcagaggggagccggaggctctggctgctgtggagcccgaggcgctggaggggctggagtgagcgccgcaggcgacgaagtgcagactctgtctggatcagtaaggcgcgcaccaaccgggccaccagggacacccggaactcctgggtgcgcagccaccgctaagggccctggggcacaacagccaaaacccgcttccctgggcaggggacggggagctgccgctgccatattgtccctaggcaacgtattaaactacttagacaggtatacggtggccggagtgctgctcgatatccagcaacattttggagttaaggataggggggctgggcttctgcagagcgtctttatctgctcatttatggtggctgccccaatatttggctacctgggcgatagatttaacaggaaggtgattctgtcttgcggcattttcttttggtcagcggttacattcagcagctctttcatcccccaacagtacttttggctgctagtgttgtcccggggacttgtgggcatcggggaggcctcttattccacgattgccccaacgatcatcggagacctctttaccaagaatacccggactctcatgctgagcgtgttctattttgccatccccctcggcagcgggctgggctacatcacgggatctagcgtgaaacaagctgccggagattggcactgggcgctgagagtgtctcctgtcctgggcatgatcactggcactctcatcctgattctcgtgcccgctacaaagagggggcatgcagatcagttaggcgatcagctgaaggctcgtactagctggctgcgtgacatgaaggcactgatccgcaatagaagttacgtgttctcatcgttggctacttcagccgtctcatttgcaactggtgcccttggcatgtggattcctctctacttacatcgagcccaagtcgtgcagaagaccgccgaaacgtgcaactccccaccatgtggggcaaaggacagccttatttttggagccattacctgctttaccggcttcctcggcgtagtgaccggggctggggctaccaggtggtgccgcttgaaaacccagcgcgctgatcctctcgtttgtgctgtgggcatgctgggctctgccatctttatatgcttaatctttgtggctgctaagtctagtatcgtgggcgcatatatctgcatattcgtgggagaaacgctgctgttcagtaattgggcgatcacagctgacatcttgatgtacgtcgtgatccccacgagacgcgctaccgctgtggcgttgcaatccttcactagtcatcttctgggtgacgccggttctccctacctcatcggattcatttccgacctgattcgccagtctactaaagactcccccctttgggaattcttatcactgggctacgccctgatgctctgcccttttgtcgtggtacttggcggtatgttctttcttgccactgccttatttttcgtgtctgatcgagccagggccgagcaacaagtgaaccagctcgcaatgccaccagcctccgtgaaagtttag

SEQ ID NO: 242299 - DNA, 1158 bp, Artificial Sequence
  Description of Artificial Sequence: Synthetic coding sequence
atgctggtgtgtttccgcctttactcttggcttttttttttgtcccggggaattgtcggcacaggtagtgcatcttattcaactattgcacccacagtattaggtgatctgtttgtcagggaccagagaacaagagtcctggccgtgttctacatcttcattcccgtaggatccgggttaggctatgtgttggggtctgcagtaaccatgctgactggaaactggcggtgggctttaagggtcatgccatgccttgaggcagtagctctaatcttgctgatactgctggtgcccgatcctcctaggggcgctgccgaaactcagggggagggagcggtaggaggattccgttcaagctggtgtgaagatgtgaggtatttgggaaaaaactggagcttcgtttggtcaaccctaggtgtcactgccatggcctttgtgacaggggctctcggcttttgggcacccaagtttttgttggaagcgagagtcgtccacggtctgcagcccccatgctttcaggagccttgttccaaccccgatagtctcattttcggagctctgaccattatgaccggagtgataggagtgatattaggagcagaggccgcacgacggtataagaaggtcattccgggtgctgagcccctgatctgcgcatcttctcttctggctactgcaccttgcctctacctggcgcttgtgttagcccctactactctcttggcctcatacgtgtttctgggtctcggggagctgttactaagctgtaactgggccgtggtggctgatatcctcctctccgtggtggtgccacggtgccggggaacagccgaggcattacagatcacagtcggtcatattctgggtgatgcaggatcaccgtatctgacaggattaatctcaagtgtcctcagagcacggaggcctgatagctaccttcagagatttagatccctacagcagtcttttctgtgttgcgctttcgtgatagcactcggtggcggttgttttctactaacggctctatacttggaacgcgacgaaactcgagcatggcaacctgtgactggcaccccggacagcaatgatgtggatagtaatgacctggaacggcaggggttgctgagcggtgcaggggcttcaacggaggagccatag

SEQ ID NO: 242300 - DNA, 1539 bp, Artificial Sequence
  Description of Artificial Sequence: Synthetic coding sequence
atggcagggggaatgagcgctgagtgccccgaaccaggccctgggggactccagggacagagtcctgggccagggcgtcaatgccctccccctatcacgccaactagctggagtcttccaccctggcgggcatatgtggcagccgcagtcctctgttacattaacctcctgaactacatgaattggtttatcattgcaggagtgctgcttgatatccaagaagtgttccaaatcagcgataatcacgccggactgttacagaccgtgttcgtgtcctgcctgcttctgtccgcgccagtttttggctatttaggtgatagacattccaggaaagccacaatgtccttcggcattctcctctggagtggggctggcctctcctcctcattcatctcccctcggtattcctggctattttttctaagtcgcggaatagtggggactggctcagcatcttattccaccatcgccccaaccgtgctcggggacttgtttgtgcgggaccagcggactagggttcttgcagttttctatattttcatcccagtggggtcaggtctgggctacgtcctgggcagcgccgtgaccatgctcactggcaactggaggtgggccttgcgtgtaatgccctgcctcgaagccgttgctctgatactgctcatcttactggtgcccgatccccctagaggggctgctgagactcagggggaaggtgctgtgggcggatttagatcatcatggtgtgaagacgtgcggtacctgggcaaaaactggtcctttgtatggagtaccctcggggttactgccatggctttcgtgaccggtgccctcgggttttgggccccaaagtttcttctcgaagctcgggttgtgcatggcctgcagcccccttgtttccaggagccctgtagtaaccccgatagtttaatattcggggcactgactattatgaccggagtgattggcgtgatcctcggtgcagaagcagctcgtcgctataaaaaggtgatacctggtgcagagccgctcatctgcgccagttcattactggccaccgccccttgtttgtatctggcactggtgctggctcccacaacacttctggctagttatgtgttcctgggattgggcgagctgctcctgtcatgcaactgggctgttgtagccgacatcctgctgtccgtggtggttcccaggtgcagaggcaccgctgaggcactgcagattacggtggggcatatcctgggcgatgcgggtagtccatatttgactggccttatatcatcagtcctgcgcgcacgacgcccagacagctatctgcagaggttccgctcactacaacaatcctttttgtgctgcgcattcgtgattgcccttggagggggatgttttctcctgaccgcgctctacctggagcgggacgagacgcgagcttggcagcctgtcacagggacccctgacagcaatgacgtggattccaatgatttggagaggcagggcctgctctcaggagcaggagcctccaccgaggaaccttag

SEQ ID NO: 242301 - DNA, 249 bp, Artificial Sequence
  Description of Artificial Sequence: Synthetic coding sequence
atggggcagactgctctagcagggggttcctcaagcacgccaacaccacaggcattatatcccgatctgagctgtccagaggggttggaggagctgctcagcgctccccctccagacctaggagcccagcgcagacatggttggaatccaaaggattgtagcgagaatatcgaagtgaaggagggcggtctctactttgagcgccgtccagtagcacagtccacagatggtgctagaggtaagagatag

SEQ ID NO: 242302 - DNA, 792 bp, Artificial Sequence
  Description of Artificial Sequence: Synthetic coding sequence
atgggtcaaaccgccctggcagggggaagcagctccacaccaacaccacaggccctgtatccagatctatcatgccccgagggtctggaagaactgctctccgcacctcctccagacctcggcgctcagagaaggcatgggtggaacccaaaggattgttccgaaaatatcgaagttaaagagggcggactctacttcgagagaaggccggtagcccagtcaactgacggtgcaaggggtaagagaggctacagcagggggctccacgcctgggagatatcctggccactggagcagcggggaacccacgcagttgtgggggtcgctactgccctggctcctttgcaaactgatcattacgcggctctgctcggatcgaattccgagtcttggggctgggacatcgggcgagggaaactttaccatcagagcaagggccctggggcaccccaatatcctgctggtacccagggtgagcagctggaggtcccagagcggcttctcgtcgtccttgacatggaagaaggaacgctgggctatgcaatcgggggaacttacctcgggccagcgttccgagggctcaaaggcagaacattatatcccgctgttagtgcagtgtggggacagtgtcaggttcgtattagatatctgggtgaaagacgtgccgaacctcacagcctgctgcacctgagccggctgtgtgtcaggcacaacctgggggatacccggctggggcaggtcagcgcgctccccctgcctcccgcaatgaagaggtatctcctgtaccagtag

SEQ ID NO: 242303 - DNA, 792 bp, Artificial Sequence
  Description of Artificial Sequence: Synthetic coding sequence
atgggtcagaccgcactcgccggtgggagcagctctacccccactcctcaggccctgtatcccgacctttcttgtccagaagggctggaggaactgctgagcgcccctccccctgatctgggagcacagcgccgacacggctggaatccaaaagactgttccgaaaatatcgaggtcaaggagggaggcctgtatttcgagaggaggcctgtcgctcagagcaccgacggagccagaggcaaacgcggttacagccgcggtctacacgcctgggagatctcatggccactggagcagaggggcacccacgcagttgtgggcgtggcaactgccctggcgccactccaaaccgaccactacgctgccctattagggtctaacagtgaatcgtggggctgggacattgggcgtgggaaattgtaccaccagagcaagggacccggagcccctcagtatccagctggcacgcagggggaacagctcgaggtcccagagagacttctggtggtgctcgatatggaggagggaacactggggtatgctattggaggaacctatctcggcccagctttccgcggactgaaagggagaactctatacccggcagtgtccgcggtgtggggacagtgccaggtccggatacgctacctcggtgagcgcagggcagagccccactccctgctacacctgtctcggctctgtgtacgccacaacctgggcgacactcggctgggacaggtgagcgctctccctctacccccagctatgaaacggtacctgctctatcagtag

SEQ ID NO: 242304 - DNA, 1068 bp, Artificial Sequence
  Description of Artificial Sequence: Synthetic coding sequence
atggccaggcgaccacgaaattcccgggcatggcatttcgttctgagtgcggctaggcgcgatgctgatgctcgggcagtcgccctggccggaagtactaattggggatacgacagtgacggccagcattcagattccgatagtgaccctgagtacagtacactgcctccaagcatccctagtgccgttccagttaccggagagtctttttgtgattgcgcaggtcagagcgaagcttcattttgcagctctcttcactccgctcatcgaggacgagactgtaggtgtggggaagaggatgaatattttgactgggtgtgggacgaccttaataagagcagtgctaccctcttgagttgtgataatcgaaaggtctctttccacatggaatatagctgtggaaccgccgcaatccggggtactaaggaacttggcgaagggcagcacttttgggagattaaaatgaccagcccagtgtacggaactgacatgatggtgggcattgggacttcagacgttgatctcgacaagtaccgccatacattttgttctctgttggggagagatgaagacagttggggtcttagttacaccgggctgcttcatcataagggtgataaaacttccttttcaagccgctttgggcagggtagtatcatcggtgtccacctggacacgtggcacggaactctgacatttttcaagaataggaagtgtattggggtggctgccaccaaactgcagaataagcggttctacccaatggtgtgtagcacagccgcacgcagctctatgaaagtcacaagatcttgcgcctctgccacgtccttacaatacctgtgttgccatcggcttagacagctcaggcccgactctggtgacacccttgaaggattacccttgccccctggacttaagcaggtgctccataataaacttggttgggtcctgtccatgagttgctcgaggagaaaagcacccgtgagcgacccgcaagccgcaacctctgcacacccttcttcccgcgagcctcgcccatgtcagaggaagcgatgccgccgaacctag

SEQ ID NO: 242305 - DNA, 480 bp, Artificial Sequence
  Description of Artificial Sequence: Synthetic coding sequence
atggaatactcatgcggcactgccgctataagggggaccaaggaactgggcgagggccagcacttctgggaaatcaagatgacctccccagtttacggtactctgacgttcttcaagaataggaaatgtattggagtcgccgctacaaaactgcagaacaagagattctaccctatggtgtgctcgacagctgcccgaagctctatgaaagtgactaggtcctgcgccagcgcaaccagtttgcagtatttgtgctgccacaggcttcgccagctgagaccagatagcggagatacactcgagggcctgcccctgccgcctggactcaaacaggtcctgcacaataaattggggtgggtactgtctatgtcctgcagccgtcgcaaggctccagtcagtgacccccaggcagctacttctgcccatcccagctcgcgggagcctcgtccctgtcagaggaaacggtgccggagaacatag

SEQ ID NO: 242306 - DNA, 1068 bp, Artificial Sequence
  Description of Artificial Sequence: Synthetic coding sequence
atggcgaggcggcctcgcaacagccgagcctggcactttgtactgagcgccgcaaggagagacgccgacgcacgcgctgtggccctggctggatctactaattggggatacgatagtgatggccaacactcagacagtgactctgatcctgaatattccacccttccgccttcgattcctagcgccgtccccgtgaccggggagagcttttgtgactgtgccggacagtctgaagcatccttctgtagctcactacattctgctcatcgcggtagagactgcagatgcggcgaggaagatgaatatttcgattgggtgtgggatgacctgaataaatcctccgctaccttgctttcttgcgacaatagaaaagtgtctttccatatggagtactcgtgtggtaccgctgctatcagaggcaccaaggagcttggcgagggtcagcacttctgggagatcaaaatgacaagtcccgtgtatggaacagatatgatggtggggattggaacgtctgacgtggatcttgacaagtacaggcatactttctgttcattgctagggcgtgatgaagatagctggggactgagttacacaggcctcctacatcacaaaggtgataaaaccagcttcagcagcagattcgggcaggggagcattatcggcgtccacctggacacttggcacggcacgctaacatttttcaaaaacagaaagtgcattggagtagccgctactaaacttcagaacaagcgcttctaccctatggtttgtagcaccgcagctcggagctccatgaaagtaacccgtagttgcgcgtcagccacaagcttgcagtacttatgctgccatcgcctgcgacagctcagacccgactccggagataccctggaaggcttgccattgccgccaggtctcaaacaggtgttgcataacaagctgggttgggtgttgagtatgtcttgtagtagacgaaaagccccagtgtctgatcctcaggccgctactagcgcacacccttcctcgcgagaaccccgtccatgccagcgcaagcggtgcaggagaacctag

SEQ ID NO: 242307 - DNA, 822 bp, Artificial Sequence
  Description of Artificial Sequence: Synthetic coding sequence
atgggccagaaattgagcgggtcattgaagagcgtggaggtccgagaacccgctttgcggcctgcaaagagagaattgcgcggagcagagccaggcagaccggctcgccttgaccagttactcgacatgcccgctgctggtctggcggtgcagctcagacacgcctggaatcctgaggatagaagcctgaacgtatttgtcaaggatgatgacaggctgacattccatagacaccccgtggcacagagtaccgacggcatacgcggtaaggttgggcacgcgaggggcctccatgcctggcagattaactggcccgctcggcagcgcggtacgcatgccgttgtgggggtggcgacagccagggcaccactccatagcgtcggctatacagcgctggttgggtctgacgctgagtcctgggggtgggatctcggtcgatctaggctctaccatgacgggaagaaccagcctggcgtcgcttatccggcttttctgggtccagacgaagctttcgccctccctgatagcctgcttgtcgttctggacatggatgaggggaccctttcttttatcgttgacggccagtacctcggagttgcattccggggtttgaaaggtaagaagctgtatccggtggtgagtgccgtgtgggggcactgcgaggtgacgatgagatacattaacgggcttgatcccgaaccactccctctgatggatctgtgtaggagatcaatccgaagcgccctgggaaggcagaggctccaggatattagcagtctacctctgccccaatctttgaagaattaccttcagtatcaatag

SEQ ID NO: 242308 - DNA, 1908 bp, Artificial Sequence
  Description of Artificial Sequence: Synthetic coding sequence
atggcctcctcaggaatggccgacagcgcaaatcacctgccatttttcttcggtaacatcactagagaggaggcggaggactatctcgtgcaagggggaatgtccgacgggctctacctgctgagacagtctagaaattatctgggaggtttcgcccttagcgtggcccatggacgtaaagcccaccactatactattgagcgagagctgaatggaacgtatgcaattgctggcggacgcacccatgcttccccggcagacctatgtcattatcacagtcaggagagcgacggcctggtgtgcctgctgaagaaaccatttaatcgcccacagggggtccagcccaaaactggcccattcgaagacctcaaggagaacctcatccgggagtacgtcaaacagacatggaaccttcagggccaagccctggagcaagccattatcagccagaaaccccaactggagaagctgatcgcaacaacggcgcacgaaaagatgccctggttccatggaaaaattagccgggaagagagtgagcagatcgtccttattgggagcaagacaaacggcaagttccttatcagagcgagggacaacaatgggtcctatgcgttgtgcctgttgcacgaagggaaggtgttacactaccgcatcgacaaagacaagactggcaagctctccattcctgaaggtaaaaagtttgatactctctggcagctcgtggagcactactcttataaggcagacggccttcttcgcgttctgactgttccttgccaaaagataggcacccagggcaacgtgaatttcggtggacgcccacagctcccgggaagtcaccccgcaacctggtcagcaggcggtatcatttcccgtattaagtcatattcctttcccaaacctggtcaccgtaagtcaagtcccgcacaggggaatcggcaggaatcgacggtcagtttcaatccttatgagcccgaactggccccttgggctgcagacaagggcccacaaagagaagcgctgcctatggacacagaggtatatgagtccccctacgctgatcctgaagaaatccgtccaaaggaggtgtatcttgataggaaacttctaaccctcgaagacaaggaattaggatcagggaatttcggtactgtgaaaaaagggtattaccagatgaaaaaagtggttaagactgttgcggtgaagatcttgaagaacgaggctaacgatcctgccctgaaagacgaattactggcagaggctaacgttatgcagcaattagataatccttacattgttagaatgattggaatttgcgaggccgagtcctggatgttagtgatggagatggccgaactcgggcctcttaacaagtatctgcaacagaacagacacgtgaaagacaagaatataatcgaactcgtgcaccaagtgtctatggggatgaaatacctggaggagtccaactttgtccatcgtgacctggctgcacgcaacgtgctgctggttactcagcattacgcaaaaatttctgatttcgggctgagtaaagccctgcgcgctgatgaaaattactataaagcccagactcatggcaagtggcccgtaaagtggtatgctcccgaatgcatcaactactataaattcagctccaaatctgacgtctggagttttggcgtcttgatgtgggaagctttctcatacgggcaaaagccttataggggaatgaaggggtcagaagttacagccatgctggagaagggggagcggatgggctgcccagctgggtgtccacgtgagatgtacgatttgatgaatctgtgttggacttacgacgttgaaaatcggcctggtttcgctgctgtcgaattgcgattgagaaattattattacgacgtggttaactag

SEQ ID NO: 242309 - DNA, 1839 bp, Artificial Sequence
  Description of Artificial Sequence: Synthetic coding sequence
atggcctcctctgggatggccgatagtgcaaatcatctaccatttttcttcggcaatattacgcgcgaggaggctgaggattatttggtccaaggcggaatgtccgacgggctctacctgctgaggcagagccgaaactatctgggcggatttgctctcagtgtggcacatggcagaaaagcacatcactatacaatagaacgagagttgaatggcacctacgcaatcgctggagggaggactcacgccagccccgctgatctgtgtcactatcatagtcaggaatcagatggcctggtgtgccttctaaaaaagcctttcaaccggcctcagggcgttcagcccaagactggcccttttgaagacctaaaggagaacctgatcagagaatatgtcaaacagacctggaacctccagggccaggcgctggagcaggccattatctctcagaagccccaattggaaaagctgatagccacaacagcccacgaaaaaatgccgtggttccacgggaagatatctcgcgaggagtcagagcagattgtactgatcgggtcaaaaacaaatgggaaattcctgatacgggctagggataacaatggctcttacgcattgtgcttgctgcatgaagggaaagtgttacattaccgcatagacaaagacaaaaccggtaagttatccattcctgagggaaagaagttcgataccttgtggcaactcgtggaacattatagctataaggcggatggactgttgcgcgtactgaccgtgccctgtcaaaagatcggaacccaagggaatgtgaatttcggtggcagaccacagcttcctggttcccatcccgctagttctcctgcccagggaaatcgccaggagtctaccgtctcgttcaatccatacgaacccgaacttgcaccctgggcagcagacaagggacctcagcgcgaagccctgcccatggacaccgaggtttatgaaagcccttatgccgatccggaagaaattaggcccaaggaagtttacctggatcggaagctgctcacactggaggacaaggagctgggcagtgggaatttcggtacagtaaagaagggttactaccagatgaaaaaagttgtgaagacggtagccgtgaaaatcctgaagaatgaggccaacgaccctgccctgaaagatgagctattggcggaagcaaatgttatgcagcaattggataacccatacatcgtgagaatgattggaatatgtgaagccgagtcatggatgctggttatggaaatggccgaactcggtcccttgaacaagtacctacagcagaaccgccatgtgaaagataagaacatcatagagttggtgcaccaagtttcgatgggaatgaagtacctcgaggagtccaatttcgtgcacagggatctggccgctagaaacgtcctcttggtgactcagcactacgccaaaatttcagattttggtctgtcaaaagccctgagagccgacgagaactactataaggctcagactcacgggaaatggccggtaaagtggtacgcacctgagtgcataaactactacaagttctccagtaagagcgacgtgtggtctttcggggtcctcatgtgggaggctttttcttacgggcagaaaccatatcgcggtatgaagggatcagaggtcaccgcaatgcttgaaaaaggagaaagaatgggctgccccgctggctgccctagggaaatgtatgacctgatgaatttatgttggacatacgatgtggagaacaggcccggattcgccgctgtggagctaagactgagaaactattattacgacgtcgtgaattag

SEQ ID NO: 242310 - DNA, 1839 bp, Artificial Sequence
  Description of Artificial Sequence: Synthetic coding sequence
atggcctcttcagggatggctgactcagccaaccatctgccctttttctttggcaatattactcgcgaagaagcagaggactatttagtgcaaggcggtatgtcggatggcctctacttgctgcgccagagccgcaactatctaggcggattcgctctgtctgtggcccacggtcggaaagcccaccattacacaatcgaacgggagctgaacgggacatacgctattgctgggggaaggactcacgcttcccccgctgatctgtgccattaccactcacaggagtccgatggactcgtgtgtctcttaaaaaaaccattcaataggccacagggtgtgcagcccaaaacgggcccttttgaagacctgaaggagaacttaatcagggagtacgtaaaacagacttggaacttacagggccaagccctcgaacaggcgattatttcccagaaacctcagctcgagaagctgatcgcaactacagcacacgaaaaaatgccctggttccatgggaagatttcgagagaggaatcagagcagattgtgcttattggatccaagaccaacggcaagtttctcatccgcgcacgagacaataacggcagttatgccttatgtctcttacacgaggggaaggtgcttcactaccgcatcgacaaagataagacaggcaaactctccattcctgagggaaaaaagttcgacactctctggcaactcgtggagcattatagctacaaggctgatggactcctcagggtactgacagtaccttgtcagaagatcggtacacaaggaaacgtcaatttcggtggacggcctcagcttcccggttcccatccggcatcttctccggctcaaggaaatcgccaagagtccaccgtgagctttaacccgtatgagccagaactcgccccttgggccgctgacaaagggcctcagagagaggccctgccaatggacaccgaggtgtacgagtcgccgtatgcagatcccgaggaaattaggcccaaagaggtgtacctggatcgcaagctcctgacactggaggataaagagctcggaagtgggaactttggaaccgtcaagaagggttattatcagatgaagaaggtggtgaagacagtggcggtcaaaatcttaaaaaacgaggcaaatgaccctgcactgaaggatgagttgcttgccgaggccaacgtgatgcagcagctcgataatccttatattgtacgcatgataggaatctgcgaggccgagtcttggatgctcgttatggaaatggctgagctgggaccacttaacaaatacctgcagcagaaccgccacgtgaaggacaaaaatatcatcgagctggtacatcaagtttcaatgggcatgaagtatctggaagagagtaacttcgtgcacagggatctagcagcacgcaacgtccttctcgtgacacaacactacgccaaaatcagcgatttcgggctatccaaggccctgagagccgatgaaaactactataaggctcaaactcatggaaagtggccagtgaagtggtatgccccagagtgtataaattactataaattcagttccaaaagcgacgtgtggagttttggcgttctgatgtgggaagcctttagctatggtcagaaaccttatagaggcatgaagggtagtgaagttacagcgatgcttgagaaaggggagcggatggggtgcccagctgggtgccctcgcgaaatgtacgacctgatgaacttatgctggacctatgacgtggagaacaggccgggatttgccgcagtagagttgcgcttgcgaaactactactatgatgtcgtcaattag

SEQ ID NO: 242311 - DNA, 1908 bp, Artificial Sequence
  Description of Artificial Sequence: Synthetic coding sequence
atggctagtagtggaatggctgactctgcaaatcacctgccctttttcttcgggaatattactcgagaagaggccgaggattatctggtccagggtggaatgagtgacggcttgtatctattgcggcaaagccgcaactatttgggtgggttcgccctctccgtggcccatggcaggaaggctcatcattatacaattgagcgagagttgaacggcacatatgccatagctggaggcaggacacacgccagtcccgctgacctttgccactatcattcacaggaatctgacggtctcgtttgcctgcttaaaaaaccttttaaccgccctcagggagttcagcctaaaacaggccctttcgaggacttaaaagagaaccttatccgcgaatatgttaagcaaacgtggaacttacaagggcaggctctagaacaagccatcatctcccagaagccacaactggagaaactgattgccaccaccgcccatgagaaaatgccctggttccacggcaaaatttctcgggaggaatcagagcaaatcgtcctgataggatcaaagacaaatggcaagtttttaatcagggctcgcgataacaatggcagttatgcattatgcttgctgcacgagggcaaggttctacattacagaatcgacaaagacaaaacggggaagctgtccattcccgagggcaaaaagtttgataccttgtggcagctggttgaacattacagctacaaagctgatggcttgctcagagttctaacagtcccctgccaaaagattgggacacaaggcaatgtcaacttcgggggtaggccccagttgcctgggtcccatccagccacctggtccgcaggaggcatcatttcgcgcattaagagctacagttttcctaaaccgggtcaccgaaagagctccccagcgcaggggaaccggcaagaatccaccgtgtcctttaacccttacgaacccgagttggctccttgggcagccgataagggacctcaacgcgaggcactccccatggacacagaagtgtacgagagcccctacgctgaccccgaggagatcagacccaaggaggtatacctcgatcggaaactgctgacactcgaggacaaggaactcgggtccggcaactttggcaccgtcaagaaggggtactatcagatgaagaaagtcgtgaagaccgtggctgtgaagattctaaaaaacgaagcgaatgatccagcactgaaggatgagctcttggcagaagccaacgttatgcagcagctcgataatccttacattgtcaggatgatcggaatctgtgaggccgagagttggatgttagttatggagatggcagagctgggtccgttgaacaagtatctgcagcagaacaggcatgttaaagataagaatattatagagctcgtgcatcaagtgtccatgggaatgaaatacctggaggagtccaattttgtccaccgggacctggccgctagaaatgtgctgctcgtcacacagcattacgccaaaatttctgacttcggcctatccaaggctctgagagccgatgaaaactactataaagcacagacacatggcaagtggccggttaaatggtacgccccagagtgcatcaactactacaaatttagtagtaagagcgatgtatggtccttcggcgtgttgatgtgggaggccttttcttacgggcaaaagccatatcgaggcatgaaaggctctgaggttacagccatgctcgaaaagggagagcgaatgggctgtccagcaggttgccctcgggagatgtacgatttaatgaacctttgctggacatatgacgtggaaaaccggccaggatttgctgccgttgaactgcgcctccgaaattactactacgacgtcgtgaattag

SEQ ID NO: 242312 - DNA, 990 bp, Artificial Sequence
  Description of Artificial Sequence: Synthetic coding sequence
atggtgtctaaatctaggtggaagttgctggctatgctggcgctggtgcttgtggtgatggtgtggtattccattagtcgcgaggacagcttctactttcctatccccgagaaaaaggagccatgtttgcagggcgaagccgaatccaaggccagcaaacttttcggaaactattctcgcgatcagccgatatttttgaggctggaggattacttttgggtcaagactccatctgcttacgagctcccttacggcaccaagggaagcgaggatctcctcctgcgcgtgctggcgataacctcgtcgtcaatcccaaaaaacattcagtcactgaggtgccggagatgcgttgtggtgggtaatgggcaccgcctgcgtaatagtagccttggggatgcgatcaacaaatacgacgtagtgatcaggcttaacaacgccccagtggccggatatgaaggcgatgtcggatctaaaacgaccatgagactgttctacccagagtccgctcacttcgatccaaaggtggaaaacaatcccgatacactgctggttctggttgcgttcaaggctatggacttccactggatcgagactatcttgagcgataagaagagagtgcggaaaggcttctggaagcagcctccccttatatgggacgtgaacccaaagcaaattcgcatactgaacccattctttatggagatagctgccgacaagttacttagtttgcctatgcagcaaccaaggaagatcaaacaaaagcctactactggactgctcgcaattactttggccctgcatctttgtgacctagttcacatagcagggtttggttatccggatgcttataacaaaaagcagacaatacattattacgagcagattaccctgaagagcatggcagggagtgggcataatgtttcccaagaggccttggcaatcaaaaggatgctggaaatgggagctatcaaaaacctgacttccttctag

SEQ ID NO: 242313 - DNA, 1917 bp, Artificial Sequence
  Description of Artificial Sequence: Synthetic coding sequence
atggccaccggtgctaatgcaactccgcttgacttccccagcaaaaagagaaagagaagtaggtggaatcaggataccatggaacagaaaactgttataccaggtatgcctacagtgatcccaccagggctgacacgtgagcaggagcgggcttatattgtacagctccagattgaagatctgacaagaaagctgagaaccggggacctcgggattccccctaatcctgaggaccggtccccgagccccgagccgatttacaatagcgagggaaagcgattaaacacaagagaattcaggacccggaagaagcttgaggaagagaggcataaccttattacagaaatggtggctttgaaccccgactttaaaccacccgcagattacaagcccccagccacacgcgttagtgacaaagtgatgattccgcaggatgaataccctgaaatcaatttcgtcggtctcctgatcgggcctcgtggaaacacactcaagaatatagagaaagagtgcaatgctaagattatgatcagaggtaagggatctgtgaaggaagggaaagtgggcaggaaagacgggcaaatgctgcctggcgaagacgaacccctgcatgcattggtcactgctaacaccatggaaaatgtcaagaaggcagtggaacagatacgcaatatcctgaagcagggaatcgaaacgcctgaggatcagaacgatctgagaaagatgcagcttagagaattagccagactgaacggtactctacgggaggacgataataggatactccggccatggcagtccagtgaaactcgtagtatcacaaacacaaccgtctgtacaaagtgtgggggtgccggtcatattgcctcggactgcaagtttcagaggcccggtgatccgcagagcgctcaggacaaggctaggatggacaaggagtatctgtctctgatggctgagctgggagaggcacccgttccagcgagcgtcggctccacttctggtccagcgactaccccattggcgtctgcccctcgccctgctgcgcctgcaaacaatcctcctcctcccagcctcatgtccacaacacagtctaggcctccttggatgaattccgggccttccgaatcgagaccctaccacggcatgcacggaggcggaccagggggacccggaggtggcccacacagcttcccacatcccctaccctctctgacagggggtcatggaggccatcctatgcagcataatcctaacgggccaccgccaccatggatgcagcctcctccccctccaatgaaccagggtccacaccctcctggccaccatgggccaccacccatggatcaatacctgggctcaaccccggttgggagcggtgtttacaggctacatcaggggaaggggatgatgcccccacctcctatgggcatgatgccacctccaccccctccaccctccgggcagcctccaccgccaccctccgggcctctgccaccttggcaacagcaacagcagcaacctcctccgccacccccaccctcatctagcatggcgtcttctacaccactaccttggcagcagaatacaaccaccacaaccacgtccgctggcactggctcaatccccccatggcaacagcagcaggccgctgcagcagcctcccctggagccccacagatgcaaggcaaccctaccatggtcccccttccccctggcgtgcagccccctctgccccctggagcgccaccccctccaccacccccaccccctggaagcgcgggaatgatgatcccccctcgaggcggagatggaccatcgcacgagtcagaagactttcccaggcctctggtcaccctccccggaagacagccccagcagcgaccctggtggacaggatggtttggaaaagctgcttag

SEQ ID NO: 242314 - DNA, 1920 bp, Artificial Sequence
  Description of Artificial Sequence: Synthetic coding sequence
atggccactggcgctaacgccactccgcttgactttccctccaaaaagcggaagagatctcggtggaaccaggatactatggaacagaaaaccgttattccaggtatgcccactgtgattccaccagggctgaccagggaacaggagagagcatatattgtgcaacttcagatcgaggatctcactagaaaactgcgtactggcgacttaggcatacccccaaaccccgaagatcgttcccccagtcccgagcctatttacaactccgaggggaagcgacttaacacccgtgagtttagaacaagaaagaagctggaagaagagaggcataatcttattaccgaaatggtcgccttaaatccggatttcaagcctccagctgactacaagccccctgccactagagtaagcgacaaagtgatgatcccacaagatgaataccccgaaatcaatttcgtgggcttgctcattgggcctcgcggtaatacgctcaagaatatcgaaaaagaatgtaacgctaaaatcatgataagaggcaaagggagcgttaaagaaggtaaggtaggtcgcaaagatgggcagatgctccctggtgaagacgagcccctacacgccctggtgacagctaatacaatggagaacgtgaaaaaggcagtggaacaaatccgcaacattttaaagcaaggtattgaaactcccgaggatcagaacgacttgcggaagatgcagctccgtgagctcgccaggctgaatggcacccttcgggaggatgacaataggatcctgagaccatggcagagtagtgaaactcgctcaattaccaacactaccgtgtgtacaaagtgcgggggagcaggccacatagctagtgactgtaagtttcagagacctggagacccacagtctgctcaggataaagccaggatggacaaagagtatctgtcactgatggcggagttgggcgaggccccagtgcctgcctcagtcgggagtacctccggtccggcaactacgccattggcatctgcccctcgacctgcagctcctgctaataatccccctccccctagtttgatgtcaacaacccagagtcggccaccctggatgaacagtggtccttctgaatctcggccttatcatgggatgcacgggggagggccaggcggacccggtggtggccctcacagtttcccccaccctctgccttcactgacgggaggccacggtggacaccctatgcaacacaaccctaacggcccaccaccaccttggatgcagccgccaccgccacctatgaatcagggtcctcatcctccaggtcatcatggcccacccccaatggaccagtacctcggaagcactccagtgggctcaggcgtttaccgcctgcatcaggggaaaggtatgatgccaccacctcccatgggtatgatgccacctccgccacctcccccaagcgggcagccccctccaccacctagtggaccgctgccgccttggcagcagcagcaacaacaacccccaccccctcccccaccatcttcaagcatggctagctctacaccacttccatggcagcagaacactacaaccactactacctcagcaggaaccgggagcatcccaccatggcagcagcagcaggccgctgccgcagcgtcccctggagccccacagatgcagggcaacccaaccatggttccacttcctccgggagtacagcctccgttgccacctggagccccaccccctccccctcccccacccccaggtagcgccggtatgatgtacgctcccccaccccctcctcctcctcctatggaccccagcaacttcgtgacaatgatggggatgggggtggccggtatgcctccattcggcatgcctccagcgcctcccccacctcccccacaaaattag

SEQ ID NO: 242315 - DNA, 1716 bp, Artificial Sequence
  Description of Artificial Sequence: Synthetic coding sequence
atggctactggcgctaacgcgactcctctagacttcccgtctaagaaacgaaagcggtcacgttggaaccaggatacgatggagcagaagacggtcatcccagggatgccgaccgtcattcccccaggactgacacgagagcaggagagagcgtatatcgtgcagttgcagattgaagacctcactcggaaacttcgcaccggtgaccttggcatcccccctaaccccgaggaccgctccccgtccccagagcccatatataactccgaggggaaacgcctcaacacaagggagtttcggacacgaaagaaacttgaagaggaacgccacaacttgattaccgagatggtggccctcaatcctgattttaaacccccagccgactacaagcctccggctacaagggtgtctgataaagtgatgatcccacaggatgaataccctgaaattaactttgttgggttgttaattgggccaagaggcaacactctgaagaatattgagaaggaatgcaacgcaaagattatgatccggggaaaaggcagcgtcaaggaaggcaaggttgggaggaaagatggacagatgttacccggagaagacgagccgctgcacgccctggtcacggccaacactatggaaaatgtgaagaaggctgtagaacaaattagaaacatactgaagcagggcatagagacgccagaagaccagaacgacctgcggaagatgcaactgagggaactcgcgcgactgaatggaaccctcagagaagacgacaatcggatcttgcggccatggcagtccagcgaaacaagatccatcacgaacactactgtctgtactaagtgcggaggcgcaggacacattgctagtgattgcaaatttcagaggcccggtgatccccaaagtgctcaagacaaggccagaatggacaaagaatacctcagcctcatggccgaactgggcgaggcacccgtccccgcttcagtcggctccacaagtggcccagcgacgactcctcttgcctcagctccacggcctgctgctccagccaacaatccgcctccgcctagcctaatgtccaccacacaatcccgcccaccttggatgaatagcggtccatccgagtcccggccttatcacggcatgcatgggggaggcccagggggacccggaggagggcctcatagtttccctcacccacttccttctctcaccggcggacacggtggacatcccatgcagcacaatcctaatgggccacctcctccgtggatgcaaccacctcctcccccaatgaatcagggcccacaccctcccggacaccacggccctcccccaatggggaaatccgtcccagggaaatacgcctgtggtctctggggcctatctccggcaagccgcaagaggtacgacgccgcaaccacatacggacatgatgccgctgcagcggctgctagtcaatgggccgcacccaccccatccttatggagtagtagtcccatggcgacgacagccgcagccgcatctgccacaccttcagcccagcaacagtatggtttccagtaccccctagccatggcagccaagatccccccacgcggaggcgatggcccatcccatgagtctgaggattttcccaggcccctggtgactctgcccggaagacagccacagcagagaccatggtggaccgggtggtttggaaaggctgcatag

SEQ ID NO: 242316 - DNA, 1302 bp, Artificial Sequence
  Description of Artificial Sequence: Synthetic coding sequence
atggtcgccttgaatccagacttcaagccccctgctgattacaagcctccagccactagagtctcagataaggtgatgattccgcaggatgaataccctgagatcaacttcgtgggactcttgatcggaccccgagggaacacattgaaaaatatagagaaagaatgcaacgcaaagatcatgatccggggtaaagggtccgtcaaggagggcaaggtgggacgaaaggacggacagatgctcccaggggaggacgagccactccatgcactggtgacagcgaacactatggaaaatgtcaaaaaagccgtggaacaaatcagaaacattctgaaacaggggattgaaaccccagaagaccaaaacgacttgagaaagatgcagctgcgggagctggcacgcctcaatggcacacttagggaagacgataaccgcatcctgcggccttggcagtcctccgaaacacggtcaataacaaacaccacggtgtgcaccaagtgcggcggtgcgggtcacatcgcgagcgattgcaaattccagcgccctggcgatccccagagtgcccaggacaaggccaggatggacaaggaatacttgtcactcatggctgagctgggagaggctcctgtgccagcttctgtgggttccaccagcggtccagctactactcccctcgccagtgctccgagaccggcagcgccagccaataatccccctccccctagccttatgtccactacccagtcacgcccaccttggatgaactcgggcccaagcgaatctcggccttatcacggaatgcatgggggaggtcctggcggaccagggggagggcctcattcttttccccatcctctcccaagcctaactgggggtcacgggggacaccctatgcaacataatcctaacggccctccccctccttggatgcagccccctccccctccaatgaaccagggaccccacccgcctggccaccacgggccaccacccatggaccagtacctgggttctacccccgttggctccggcgtataccggcttcaccagggaaagggaatgatgcctccccctccaatgggtatgatgcctcctccaccaccccctccatctggacagcccccaccacctcccagtggaccactccccccatggcagcagcagcagcagcagccccctccacctcccccaccatcttcatccatggcgtcgagcacccctctcccctggcagcagcggtctctcccagcggctgcgatggcccgagccatgcgagtaagaactttcagagcccattggtag

SEQ ID NO: 242317 - DNA, 2022 bp, Artificial Sequence
  Description of Artificial Sequence: Synthetic coding sequence
atggccaccggtgcgaacgctaccccattggggaaactgggaccacccggactcccaccactgcctggcccaaagggcggatttgaaccagggcctccacctgcccctggccctggagccggattgctggctccgggtcccccaccccctccaccggttggaagtatgggagctctgacagccgcttttccatttgctgccctgccaccgccacctccaccaccccctcctccacctccgcagcagccacctcccccacctcctccaccatctccaggcgcatcctaccctcccccacagcctccacctcctccacccctttatcagcgcgtctcacctcctcagccacctccaccccaaccccctaggaaggaccagcagcctggccctgctggcggtgggggagactttccctccaagaaaagaaagcggtcacggtggaaccaggatacaatggaacagaagactgtcatccctggcatgcccaccgtaattccaccaggcctgactagagaacaagaacgggcatatatcgtacagctgcagatagaagacctaacccgcaagctgcgtacaggtgatcttggaattccaccaaacccagaggatagatctcctagccccgagccaatatataactccgagggtaagcggcttaacactcgggaattccggacccggaaaaaactggaggaggagcgacacaatcttatcactgagatggtcgctctgaaccccgacttcaagcctccagccgattataagccccctgcaacccgagttagcgacaaagtgatgataccccaggatgagtacccagagatcaacttcgttgggctgcttattggacctcggggtaacacattgaagaatatcgagaaggagtgcaatgccaaaatcatgatcaggggcaaaggatctgtcaaagagggcaaggtcggcaggaaagacggccagatgctccctggagaggacgagcctctgcacgctctggtaacagccaacacaatggaaaacgttaagaaggctgtggagcaaattagaaacatcctcaagcaggggattgagactcctgaagaccaaaacgatctgcgaaagatgcagctgagagagctcgccagattgaatggaaccctgcgcgaggacgacaaccggattttgcgtccgtggcaatcctctgagacacggagtatcaccaatactacagtgtgcaccaaatgtgggggagctggacacattgccagcgactgcaagtttcaacgacctggggacccccagtctgctcaggataaagcaaggatggacaaggaatatctgagtctcatggctgagctcggcgaagccccagtgccagctagtgtgggcagtacaagcggacctgccaccactcctctggcaagcgcccctcgacctgctgcccctgccaacaaccctccacctcctagcttgatgtccacaacacagtcccgtcccccatggatgaattcaggcccatccgagagtaggccatatcatgggatgcatggtggagggccaggtggcccaggaggagggccacacagctttcctcatcccctaccaagcctgaccggtggccatggcggacatcccatgcagcataacccaaacggacctcccccaccatggatgcagccgccaccacccccaatgaatcaggggccacaccctcccggtcatcatggcccaccacctatggatcagtacctaggctcaactcccgttggatcaggcgtgtaccggctccaccagggcaagggcatgatgccccctccccctatgggtatgatgcctcctccacccccacccccttctggacagccaccccctccgccatcaggccctcttcctccatggcagcagcagcagcagcaaccgcctccgcctccacctccatcttcaagtatggcgtcttccaccccacttccttggcagcagaggtcgctaccagcggcagccatggctagggccatgagagtccggacatttcgggcacactggtag

SEQ ID NO: 242318 - DNA, 1842 bp, Artificial Sequence
  Description of Artificial Sequence: Synthetic coding sequence
atggagcagaagacagtgatccctggtatgccaaccgtcattccacccggactgacaagagaacaggaacgagcctacattgtccaactgcagatagaggatttgaccaggaagttgcgcacaggcgacctgggcattccacccaaccccgaggaccggagtcccagcccagaaccaatctataattcagaggggaaacggctgaatacccgcgagttcaggaccaggaaaaagctggaggaagaaaggcataatctgatcaccgagatggtggcattgaaccctgatttcaagccccctgcagactacaagccacctgcaacccgagtgtccgataaggtgatgattcctcaggacgagtatcccgaaattaattttgtgggactgttaatcggaccacgtggaaatacactgaagaacattgaaaaggaatgcaacgcgaagattatgattagagggaaaggtagcgtgaaggaaggaaaggtcggcaggaaggatggccagatgcttcctggagaggatgaacccttgcacgctctggttactgctaacaccatggagaatgtcaagaaagccgtggagcagattcgcaatatcctgaaacagggcatagagactcctgaggaccagaatgacttaaggaaaatgcagctccgagagcttgccagacttaatggtacgttgagggaggacgataaccggattctgcgtccatggcagtccagcgagacacggagtatcacaaatacgactgtatgcacaaaatgtggcggagctggtcatatcgcatcagattgtaaattccaacgcccaggcgatccccagtccgcgcaggacaaagcccgtatggacaaggagtatctgagcctgatggctgagctcggtgaggctccggtgcctgcctccgttggaagcacatccggcccagccacaaccccattggcgagcgccccaaggccggcagcaccagccaataatccccctcccccttctttaatgagtaccactcagtcaaggcctccatggatgaactctggaccctccgagagcaggccataccatgggatgcatggtggcggtcctggaggtcctggcggtggtccacactcgtttccccacccactaccaagtctgactggaggccacggaggccaccctatgcagcataacccaaatggccctcctcctccatggatgcaaccccctcccccaccaatgaatcagggccctcatccacctgggcaccacgggcctccacctatggaccagtacctcggctccactcccgtggggtccggcgtctaccggttacatcagggaaagggaatgatgccaccacctcccatgggcatgatgcctccccctccccctcccccatccgggcagcctcccccacctcctagcggacccctccccccatggcagcagcaacaacaacagcctccccctccccctccaccctcttccagcatggcctcttccacaccccttccttggcagcaaaatacaactacaaccactacaagtgcgggtaccggctcgatcccaccttggcagcaacaacaggctgctgcagccgcatccccgggagcgcctcaaatgcagggcaaccccacaatggtcccactgccccctggggttcagccacctctgcctccgggtgcaccgcctcccccacccccacctccaccgggttcagccggaatgatgtatgcaccgccaccgccaccccctccccctatggacccgtctaactttgtgaccatgatgggcatgggagttgcaggcatgccgccatttggcatgcctcctgcccctcctccccctccccctcagaattag

SEQ ID NO: 242319 - DNA, 1527 bp, Artificial Sequence
  Description of Artificial Sequence: Synthetic coding sequence
atggctaaaagcaatggggaaaacgggccaagggccccagccgctggagagagcctgagcgggacccgggagtctcttgcgcaaggtcccgatgcggctaccacggatgagctgtccagcctaggatcggatagcgaagccaacggatttgccgagagaagaatcgacaagtttggatttatcgtcggctcacagggcgctgaaggggctctggaagaagtcccgttggaggtactgcggcagcgagaaagcaaatggctggatatgcttaacaactgggacaaatggatggcgaagaagcataaaaagatcaggttaaggtgtcagaagggcattcctccatccctgcgagggagggcgtggcagtacctatccgggggaaaagtcaagctacagcagaatcccggtaaatttgatgaactcgacatgtcccccggtgatccgaaatggctggacgtgatcgaacgggatctccaccggcagtttccatttcatgagatgtttgtatccaggggcggtcacggccagcaggatctattccgcgtcttaaaagcatacaccttatatagaccagaagaaggatattgccaggcccaagctcctatcgcagccgtgctgttgatgcatatgcccgcagagcaggccttctggtgcctggtccagatatgcgagaaatacctcccaggatattattctgagaagctggaagcaatccagctggacggcgagatcctcttcagcctgttgcagaaggttagccccgtggctcacaaacatctgagtcgccagaaaatcgatcctctgctgtacatgaccgagtggttcatgtgcgcattctcacgaacgctgccttggagtagcgtgctccgggtgtgggacatgttcttttgtgagggcgtgaagataattttcagagtgggcctggtcctcctgaaacatgcccttggctctccggagaaggtgaaggcatgtcagggccagtacgagactatcgaaaggctgcggtccctgagtcccaaaattatgcaagaagcatttttggtccaggaagtcgtggaactgcccgttacagaacgccagattgagcgtgaacatctcattcagctgcgaaggtggcaggaaacccggggagagttgcagtgcagatcaccccctcgtttgcacggcgctaaagcaatcctagatgccgagcccggtcccaggcccgcactgcagccatcaccatctatccgacttcccctggacgctccattgcctggtagcaaggccaagccaaaaccccctaagcaagcccagaaggaacagcggaaacagatgaagggtcgaggccagctggagaaacccccagcaccaaaccaggcgatggttgtggccgctgcaggagacgcatgccctccccagcatgtgccccctaaggacagtgctccgaaagactctgcgcctcaagatctggcacctcaagtgagtgcgcaccaccggtcgcaggagtctctgacttcccaagagtcggaagacacttacctgtag

SEQ ID NO: 242320 - DNA, 2187 bp, Artificial Sequence
  Description of Artificial Sequence: Synthetic coding sequence
atgcccgctggaccggtgcaagccgtgcctcctcccccacccgtgcccactgaacccaagcaaccaaccgaagaagaagccagctcaaaagaggactccgccccttctaagcctgtagtaggcattatctatcctccccctgaggtgcgaaatatagtggacaagactgcttcttttgtggccagaaacgggccagaatttgaggcacgcattcggcaaaatgaaataaataatcctaagttcaatttcttaaacccaaatgacccctaccatgcttactatagacataaggtaagcgaattcaaggagggaaaagcccagtttgtggccaggaatggcaggcaatttctgacccaattaatgcagaaagagcagcggaattaccagttcgatttcttgcgccctcagcatagcctctttaattattttactaagctagttgagcagtatactaagattctcattccacctaagggactgtttagcaaactcaaaaaggaagctgagaaccccagagaggttctggaccaggtttgctacagagtcgagtgggctaaattccaggaacgggagcgaaagaaggaggaagaagagaaggagaaggaaagagtcgcctatgcgcagatagattggcatgactttgtggtggtagagactgtggactttcaaccgaacgagcaaggcaattttcctccacctacaacccccgaagaactgggcgctaggatcctaatccaggagcgatatgagaaatttggtgaaagtgaggaagttgaaatggaggtcgagtcggacgaagaagacgataaacaagaaaaagctgaagaaccaccatcacagttagaccaggacacgcaggtgcaggatatggacgaaggctcagacgatgaggaggaaggccagaaggtcccccctcccccagaaacccccatgccaccaccgctccctcctactccggaccaggtgattgttagaaaggattacgaccccaaggcttccaagccactgccacccgctcccgcacctgatgagtatctcgtttcacctatcactggagagaaaatccccgcatcgaaaatgcaggagcatatgcgaatcgggctgcttgaccccaggtggctggagcagagagaccgctccattagagaaaaacagtcggacgacgaggtgtatgctcctggactggacatcgaaagttcgctgaagcaactagctgagagaagaactgacatcttcggggttgaggaaaccgccataggcaagaaaataggggaggaggagatccagaaacccgaagaaaaagtaacttgggatggccactctgggagcatggctagaacccagcaggctgcccaggcaaacataacactgcaggaacagatcgaggcgatccataaggccaagggtctggtcccagaggacgacaccaaggagaaaataggcccatctaagcctaacgagatcccccagcaaccacctccaccctcatccgcaacaaatataccttctagtgccccaccaatcaccagcgtaccccgtcccccaacaatgcccccacccgttagaacaaccgttgtctcggcagtgccagtaatgccacggcctccaatggcctccgtggtcagattgcctcccggatcagtgatcgccccaatgccgcctataattcatgcaccgaggataaatgtcgtgcctatgccaccttctgccccacccatcatggccccacgcccacctcctatgatcgtgcctaccgctttcgtgcctgccccacctgtcgccccagtgccagctccagcacctatgcctcctgttcaccccccaccccctatggaggacgagccaacctctaaaaaattgaagactgaggactcactgatgcccgaagaagagtttcttcgccgaaacaagggtcctgtaagcattaaagtgcaagtgcctaatatgcaggacaagacagagtggaagctgaacgggcaagtgttggtgttcaccctgcctctgaccgaccaggtatctgttatcaaggtcaaaatccatgaagctactggtatgcccgcaggaaagcagaagctccagtatgagggaatttttatcaaagactctaattcactagcttattacaatatggcaaacggagccgtgatacatctcgccctcaaggagcgaggaggccgaaaaaaatag

SEQ ID NO: 242321 - DNA, 2073 bp, Artificial Sequence
  Description of Artificial Sequence: Synthetic coding sequence
atgactctgactatgcccactacagctattcctaaagtgatgcagcaacagcagcagacaacccaacagcagctccctcagaaagtgcaggcacaagtcattcaggaaacaattgtgccaaaggaaccccctcccgagtttgagttcatcgccgaccctccttctatatctgcgttcgatcttgatgtggttaaacttaccgcacagtttgttgctagaaacggcaggcaatttttgactcagttaatgcaaaaggagcagaggaactatcagtttgactttttgcgaccacagcactcactcttcaattactttaccaagctggtggaacaatacaccaagatactaatccctcccaagggtctgttttccaagttgaaaaaggaggccgagaacccccgagaggtgctagaccaggtgtgctaccgggtggagtgggctaagttccaggagcgagagcgcaagaaagaagaagaagagaaggagaaggagagagtagcatatgcccagattgactggcacgactttgtggtcgtggaaactgtcgattttcagccaaacgaacagggaaactttccaccacctaccacgcctgaggaattgggcgctcgcattctaattcaagagcggtatgagaagtttggggaaagcgaggaagtggagatggaggtggagagcgacgaggaagacgacaagcaagagaaagcagaagaacccccttctcaattggatcaggacacacaggtgcaggacatggatgaaggttctgatgacgaggaagaaggacagaaggtacctccaccacccgagaccccaatgcctccccctttgccacctactcccgatcaggtaattgtcaggaaggattacgatcccaaggcatcgaaacccctgcctcccgctcctgccccagacgagtacctagtttcccctattacgggggagaaaatacccgcttccaagatgcaggagcacatgcgcatcggcctgttggacccgagatggctggagcaaagagacaggagcattagggagaagcagagtgatgacgaagtttacgccccagggctcgacatcgagagttcacttaagcagctggccgagaggcgcacagatatctttggggtcgaagagactgcaattgggaagaagattggagaggaggagattcagaagcctgaggagaaggtgacttgggatggacactcaggcagcatggccaggacccagcaagcagcccaggcgaatattactttgcaggagcaaatcgaggcaatccataaggccaaagggcttgtgcccgaggatgataccaaggagaagattggcccttctaagccaaatgaaattcctcagcagccacctcccccatcttccgctactaatatcccatcatctgcccctcctattacgagcgtgccacgtcctcctactatgcctccgccagtaaggacaacagtcgtgtctgcagtgcccgtgatgcccagacctccaatggcaagtgtcgtgaggctgcccccaggctccgtcatcgctccaatgcctcctatcatacacgctcctcgcatcaatgtggttcccatgcccccttctgcgccacctatcatggccccaaggccacctccaatgattgtgccaaccgcattcgtgcctgctcccccagtagcacccgtccctgccccagcacccatgcctcctgtgcatccccctccccctatggaggatgagcctacaagtaagaagttgaagacagaagactctctgatgcccgaggaagagtttttgcgtcggaacaaaggcccagttagcatcaaggtgcaagtccccaatatgcaggataagacagaatggaagctcaatggacaggtactggtgttcactctgccacttactgaccaggtctcagtgataaaagtgaagatacacgaggccactggaatgcccgcagggaaacagaagctccagtatgaagggatttttattaaggattctaatagcctcgcctactataacatggctaacggggctgtgatacaccttgcgctcaaggagcgcggaggccgtaaaaagtag

SEQ ID NO: 242322 - DNA, 900 bp, Artificial Sequence
  Description of Artificial Sequence: Synthetic coding sequence
atggacctctcagagctggaacgtgataacaccggccgttgtaggctgtcctcaccagtgcccgcagtgtgccgtaaagagccttgtgtcctgggagttgatgaagctggccgagggcctgtgctcgggcctatggtctacgctatctgctactgcccactgcctagactggctgacttagaagcccttaaggtggcagattctaaaaccttgctcgaaagtgagcgcgagagattgttcgcgaaaatggaagacacagattttgtaggatgggcccttgatgttctgtctcccaatttaatctccacttcaatgctgggacgggtcaaatacaaccttaactctctctctcatgacactgccactggccttatccagtatgccctagatcagggggtgaacgtcacacaggtgtttgtcgatacggtgggcatgcccgagacgtatcaggcacgtctccagcaatcttttcccggaatcgaggtgacagtgaaggctaaagccgacgctctctatccagtggttagcgcggcaagcatttgcgctaaggtggctcgggatcaagccgtgaagaagtggcaatttgttgagaagttgcaggatttggatactgattacgggtcaggctaccccaacgaccccaaaacgaaggcctggctgaaagaacatgtggaacctgtctttgggtttccccagtttgtgaggttctcctggaggactgctcagactatcctggagaaggaagccgaagatgtcatctgggaggattctgcttcagagaaccaggagggcctccgtaagattacgtcttatttcctgaacgaggggagccaagccaggccacgttcctcccacagatacttcctggagagaggactagaaagcgctactagtctctag

SEQ ID NO: 242323 - DNA, 3915 bp, Artificial Sequence
  Description of Artificial Sequence: Synthetic coding sequence
atggcaaagatcgctaagacccacgaggatatcgaggcacagattcgagagattcaggggaagaaggccgctcttgacgaagctcagggcgtgggtctggacagtaccggttactacgatcaggagatatacgggggttcggattccaggttcgccggttatgtgacaagcattgccgctaccgagctcgaggatgatgatgatgattactcctcgagcacctcattactcgggcagaagaaacccggttatcacgcgcctgttgctctcctgaatgatattccccagtcaacagagcaatacgatcctttcgcagaacatcggcctcccaaaatcgctgacagggaggatgaatataaaaagcaccgtagaaccatgataatcagccctgaacggctggatcctttcgccgatggtggcaagacccccgatcctaagatgaatgctagaacgtatatggatgtgatgcgggagcagcacctaacgaaggaggaaagggaaatacggcaacagttagcggaaaaagctaaagctggtgaactgaaagtggtgaatggggctgcagcctcccagcccccaagtaaacggaagcgcaggtgggaccagacggccgatcaaacaccaggcgctactcccaagaaactgtcctcatgggaccaggccgagacaccaggccacaccccttccctgcggtgggacgaaacacctggtcgagcaaaagggtcagagacacccggagcaacaccgggtagcaagatctgggatccaaccccatcccacactcccgcaggggctgcgaccccaggtcgaggtgacacacctggacatgccacccccggacacggtggggctacctccagtgctcgcaagaacaggtgggacgagaccccgaaaacggagagagacactcctggacatggatctgggtgggcagagaccccgaggaccgatagagggggagactcaatcggcgagaccccaactccaggcgcatccaagcggaagtctagatgggatgagaccccagcatcccagatgggcggttctaccccagtattgactccaggaaagacacctataggtaccccagccatgaacatggccacccctacccccggtcatattatgagcatgacacccgagcaactccaagcatggcggtgggagcgggaaatcgacgagcgtaaccgcccattatccgacgaagaattagacgccatgttcccagaaggttacaaggtcttgcctccgccagctggatatgtgcctataagaacaccggctcgcaaacttaccgcaaccccaacccctctcggtggaatgacaggattccacatgcagacggaggacagaaccatgaagtccgtgaacgaccagccatcagggaatctccctttcctgaagcccgacgacatccaatattttgataaattactggtcgatgtggacgaatcaacactctccccggaggagcagaaggagagaaaaatcatgaagctgctgctgaagatcaagaacgggactccccctatgagaaaagctgcactgcgccaaatcaccgacaaagcgagagagtttggggctggacccctcttcaatcagatcttgccattgctgatgtctcctactctcgaggatcaggagcgacatctcctggtaaaggtgattgacagaatcctgtataagctggatgatctggtacgcccatatgtgcacaagatcctcgtcgtgattgagcctttgctgatcgacgaggattattacgcccgtgtggaaggacgggagattataagcaatctggccaaagctgctgggttggccaccatgattagtaccatgcggcctgatattgacaacatggatgagtacgtcagaaacactactgctcgagcgttcgcagtggtggcttccgcactcggcattccaagcttgctgccatttcttaaagctgtctgtaagagcaagaagtcatggcaggcccgacacacaggtatcaagatcgtgcagcagattgctatcctgatgggatgcgcaatccttcctcatttacgcagcctcgtggaaattatagagcacggactcgtagacgaacagcagaaagtgcggacaatatccgccctggcaatcgcagcactggctgaagcggcaaccccatatgggatcgagagttttgattctgttctgaagcctttgtggaaagggatcaggcagcacaggggcaaagggcttgcagcattccttaaagccatcggttatctgatccctttgatggacgccgaatacgcaaactattacactagagaggtcatgctgatacttattagagagtttcagagccctgacgaagagatgaaaaagatcgtgctcaaagtagtaaaacagtgctgcggaacagacggggtggaggccaactatatcaagacagagatacttccaccattcttcaagcacttctggcagcatagaatggcactagatcgtcgcaattatcgtcaactcgtcgacactactgtggaactggccaataaggttggtgctgcagagataattagccggattgtggacgatcttaaggacgaggccgagcaatatagaaagatggtcatggagacaattgagaaaatcatgggaaatttaggcgcagccgatatagaccacaaattggaagagcaacttattgacgggatcttatacgcatttcaagaacagacaacagaggatagtgtcatgcttaatggatttgggactgtggtgaatgccctgggcaagagagtgaagccatacctgcctcagatctgcgggacggtactatggcgcttgaataacaagtccgctaaagtcaggcagcaggctgccgacctgattagccggaccgcggttgtcatgaaaacatgtcaagaggagaagctgatggggcacctgggcgtcgtattgtacgaatatctgggtgaggagtatccagaggttctgggctcaatcctgggcgctctgaaggctattgtcaacgtgatagggatgcacaaaatgacaccccctattaaagaccttctgccacggctgacccctattcttaaaaatagacatgaaaaggtgcaggagaattgtattgatctcgttgggagaatcgctgatcgtggcgctgaatacgttagcgcccgagaatggatgcggatctgttttgagctcttggagttactaaaggctcacaaaaaagccataagaagagctacagtgaacacttttggctacatcgccaaagcaatcggacctcatgatgtgctggccaccctgttgaataatctgaaagtgcaggagcgccaaaaccgcgtctgcaccacagtggccattgccattgtcgccgagacctgcagcccttttactgtgctgccagcgctgatgaacgagtatcgtgtgcctgagctgaatgtacagaacggggtactgaaatcccttagctttctctttgaatatatcggcgaaatgggcaaggattatatttacgcagtgacgccacttttggaagacgccctcatggatcgggacttggtgcaccgacagaccgcgtccgccgtggtgcagcacatgagtctcggggtgtacggctttggctgcgaggattctctgaaccatctcctaaactatgtctggcccaacgtcttcgaaactagcccccacgtaatccaggcagtcatgggcgcactggagggtctgagagtggctatcggtccgtgcaggatgctccaatattgtttgcaaggacttttccacccagccagaaaagtaagggatgtgtattggaagatctataactctatatatatcggaagccaagacgctctgatcgctcactatcctcggatatataacgatgataaaaatacctacatccggtacgagctagattatattctgtag

SEQ ID NO: 242324 - DNA, 435 bp, Artificial Sequence
  Description of Artificial Sequence: Synthetic coding sequence
atggcgaaaattgcaaagacccacgaggatatagaagcccagattcgcgagattcaaggaaaaaaagctgctctggatgaagcacagggggtgggtctggattcaacaggatactacgatcaagagatatatgggggttcagacagccgctttgcaggttatgtcacatccattgctgcaacagagttggaggacgacgacgatgattacagcagcagtacaagtctgctcggccagaagaaacccggttaccatgccccagtcgctctgcttaacgacatcccccagagcactgagcagtatgacccttttgcggagcacagaccgcctaaaatagctgaccgagaagacgaatacaaaaagcatagaagaaccatgataattagtccagagcggttggacccgtttgccgatgggttctacagtgccgcttag

SEQ ID NO: 242325 - DNA, 435 bp, Artificial Sequence
  Description of Artificial Sequence: Synthetic coding sequence
atggccaagattgcaaagacgcacgaagatattgaggcccagatcagggaaattcaggggaagaaggccgctttagatgaagctcaaggcgtagggctggatagcacagggtactatgaccaggagatttacgggggttccgactccagattcgccggatatgtgaccagcattgctgccaccgagttggaagatgacgacgatgattactcttcctcaacttcgctgctgggccaaaaaaagcccggttaccacgcccctgtggccctgctgaacgatataccccaatcaacggaacagtatgacccctttgctgagcataggccacccaaaatcgctgaccgtgaagacgagtacaaaaaacaccgtcgaactatgatcatttcccccgagcggcttgacccgttcgccgacggcttttatagcgccgcatag

SEQ ID NO: 242326 - DNA, 2688 bp, Artificial Sequence
  Description of Artificial Sequence: Synthetic coding sequence
atggccacagagcatcccgagcctccaaaagcagagctccagctgccccctccccctcctcccggacactatggggcatgggccgcacaggaattgcaggcaaagctggctgagattggggcacctatacagggaaacagggaagagctggttgagaggctccagtcttacacccgccagaccggaatagttctcaataggccggtgctgaggggggaggacggcgataaggcagcgcctcctcccatgagcgctcagctgcctgggattcccatgccccctcctccgctgggactgcccccattgcagcccccaccgcctccccctccaccccctcccggtcttggtctaggtttcccaatggcacatcctccaaatttgggaccccctcccccactgcgcgttggcgaacctgttgccctgagtgaggaggaaagactcaagctagcacagcagcaagccgctctgctcatgcagcaggaagaaagagccaaacagcagggtgaccatagcctcaaggagcacgagctgcttgaacaacagaaacgcgctgctgtgctcctcgaacaagagcgccagcaggaaatcgccaaaatgggcacaccagtgcccagacccccacaggacatgggccagattggggtgcggactccactgggcccaagggtcgcagctccagtggggcctgtgggaccaacacccacagtgctgccgatgggggcacctgtacccagaccaagaggtccgcctcccccacctggagacgagaacagagaaatggatgatccctcggttgggcctaagatcccccaggcactagaaaagatacttcagcttaaggagtctaggcaggaagagatgaactcacaacaggaagaggaggagatggagaccgatgcgaggtcaagtcttggacagagcgcatctgagacagaagaggacaccgttagcgtaagtaagaaagagaagaataggaagagaaggaaccgaaagaagaaaaagaagccacagcgagtgcgaggggtatcttcggagagttctggagatagggagaaagattcaaccagaagcaggggatccgactcccctgccgcagacgtcgagatcgagtatgtcacagaagaacccgaaatctacgaacctaatttcatattctttaaacgcattttcgaggccttcaaactcactgatgatgtgaagaaagagaaggagaaggagcccgagaagctggataaactggagaactctgccgctcctaagaagaaagggtttgaggaggaacacaaagattcagatgacgatagctccgacgacgaacaggagaagaaacctgaggctcccaaactttcgaaaaaaaagttacgcaggatgaatcgctttactgttgccgaattgaagcaactcgttgcgcgaccagatgtggtggagatgcatgacgtcactgcacaggaccccaagttactggtgcatctaaaagccacccgcaactctgtgcctgttcctcgccactggtgtttcaagcggaagtacctacagggcaagcgaggcattgagaagcctccattcgaactgcccgacttcatcaagagaacggggatccaggagatgcgcgaagcgctgcaagaaaaggaagagcagaaaacaatgaagagtaagatgcgcgagaaggttcgcccaaagatggggaaaattgacatcgactaccagaaacttcacgatgcttttttcaagtggcagaccaaacccaaactgacgattcacggtgacctgtattacgaggggaaagagtttgagacacgacttaaagagaaaaagcccggagatctgagcgatgagttacggatcagtctggggatgccagtgggacctaacgcccataaagtgcccccaccttggctcatcgccatgcagcggtatggcccaccaccaagctaccccaacctaaaaattcctggcctgaactctcccatccccgagtcctgctcattcggctaccatgccggaggctggggcaaacctcccgtggatgaaactggcaagcccttgtacggggatgtatttggtaccaatgccgcagagtttcaaacaaagacggaggaagaggagatagatagaaccccttggggggagctagagccgagtgacgaagagagctccgaagaagaagaggaggaggagtccgacgaagacaagcctgacgagactggattcatcacacccgcagactctggcctgatcactccagggggtttttcgtccgtcccggcaggtatggaaactcctgagctgatagagctaaggaagaagaagatcgaggaggcgatggacggatcagagacaccacagctcttcaccgttctcccagagaagaggaccgccactgtgggtggtgctatgatggggagtacacacatatacgatatgagcacggttatgtcacgcaaaggtcccgcaccagaactacaaggagttgaagtagcactagcccctgaagaacttgaattggatccaatggcaatgactcaaaaatacgaagagcacgtacgcgagcagcaagcccaagttgaaaaagaggatttttcggacatggtagcggagcacgccgctaagcaaaaacagaagaaacggaaagcgcagcctcaggattcaagaggcggttcaaagaagtacaaggaattcaaattttag

SEQ ID NO: 242327 - DNA, 2400 bp, Artificial Sequence
  Description of Artificial Sequence: Synthetic coding sequence
gcgaagatggccactgaacatcccgaacctccaaaagctgagttacagttacccccaccgcctcccccaggccactatggcgcatgggctgcccaagagctccaagccaaattggccgaaataggtgcccctattcaaggtaacagagaagagctcgtggaaagactgcaatcatacacaagacagaccgggattgtgcttaatagacccgttcttcggggagaagatggagacaaggcagctccacctccaatgagcgctcagcttccgggaattcccatgccgcctcctcctctggggctgcccccattgcagcctcctccaccccctccaccccctccccctggcttgggcttaggattcccaatggctcaccctcctaacttaggaccgcctcccccacttcgcgtgggtgagcctgtagccctcagtgaagaggaaagattgaagttggcacagcagcaggcagcgttgctgatgcagcaggaggaaagggccaagcaaggagatcacagtctgaaagaacacgaattactggaacaacagaagcgcgcagcggttctgttggaacaagagcgccagcaagaggaagaagagatggaaacagacgcaaggtccagcctcgggcagtccgcctcagaaacagaggaggataccgtcagcgtaagcaagaaagaaaaaaaccggaagcgcagaaaccggaaaaaaaaaaaaaaaccccagcgcgttcgaggtgttagctccgagtcctctggggatcgcgagaaggacagtacacggtccaggggctctgattcccccgcagcggatgtcgaaatagagtatgtaacagaagaacctgagatctatgaacctaatttcattttttttaagaggatctttgaggcgttcaagctgaccgatgatgtgaaaaaagagaaagaaaaggagcccgagaagctggacaaactggagaattccgccgcacccaaaaagaaagggttcgaggaagagcacaaagacagcgatgatgacagttccgacgatgagcaggaaaagaagccggaagcccctaagctgtcaaagaagaagctgcgacgcatgaaccgattcaccgtggcagaactgaaacagctggtcgcacgaccagatgtagtggagatgcatgacgttactgcccaggaccctaaactcttggttcatctgaaagccacaagaaactctgtgcccgtgcccagacattggtgtttcaagcgcaaatacttgcagggcaaaaggggaatcgaaaaacccccatttgagcttcccgattttattaagcggactggcatccaggaaatgcgcgaagccctgcaagagaaagaagagcagaagacgatgaaatctaagatgcgcgaaaaggtacggcctaaaatgggcaagattgacatagattaccagaagctgcacgatgcttttttcaaatggcagacgaaacctaaacttactatacatggcgacctgtattacgaaggaaaggagtttgagacgaggctgaaggaaaaaaagccaggcgatctttccgacgagttgaggatttcgttgggaatgcccgtcggcccaaacgctcacaaggtgcccccaccctggttaattgcgatgcagcgctatggacctccaccgagctacccaaacttgaagatacctggtctgaacagcccaatcccagagagctgttcctttggataccatgcaggcggttggggcaagcccccagtcgatgaaacggggaaacccttgtacggagatgtgtttggcacgaatgctgctgaatttcaaactaagaccgaagaggaggagattgacaggaccccttggggcgagctggaaccatccgacgaagaaagctccgaggaggaggaggaggaagaatcagacgaagataagccggacgaaaccggattcatcacccctgcagattctggactgatcaccccgggagggttcagctctgtaccagcaggcatggaaacccccgagttgatagagctccgcaaaaaaaaaatcgaagaagcgatggatggaagcgagaccccgcagctcttcactgtgttacccgaaaagaggacggccaccgttggaggagctatgatggggtctactcatatttatgacatgtccactgtcatgtcccgcaaaggcccagcaccagagctccagggtgttgaggtagcgctggcaccagaagagcttgaattagacccgatggccatgacacagaaatatgaagaacatgtgagagagcaacaggctcaggtcgaaaaggaggatttcagcgacatggtggctgagcacgcagccaaacagaaacagaaaaaaaggaaggcccaacctcaagatagccgcggaggtagtaaaaaatataaagagttcaagttttag

SEQ ID NO: 242328 - DNA, 3654 bp, Artificial Sequence
  Description of Artificial Sequence: Synthetic coding sequence
atgttcctatacaatctaactctgcagagagcaactggaatctcctttgcaattcacggcaatttcagtgggactaagcagcaggagatcgtggtctcacgtgggaaaatcctggagttactgcggcctgaccccaacaccggtaaggttcataccctgctaactgtggaagttttcggggtgattaggagcctcatggcattcaggttaaccgggggtactaaagactacatcgtggtgggttctgactctgggaggatcgtaatcctggagtatcagccctccaagaatatgttcgagaaaatacaccaggagacattcgggaaaagcggatgtcgacgaatcgtgcctgggcagttcctagctgtggaccccaaaggtcgggctgtaatgatctcagctatagaaaaacagaagctggtctatattcttaatagagacgccgctgctagactgaccatcagctctccattagaagctcacaaggccaacactctggtttaccacgtggtgggagtcgacgtgggattcgagaatccaatgttcgcctgtctggaaatggactacgaggaggccgacaacgaccccacaggcgaagccgcagcgaacacacagcagacgttaaccttctatgaactggatttggggcttaaccacgtagtgcgaaaatattcggaacccttggaggaacacgggaacttcctcatcacagtgcctggcggaagcgacgggccatctggagtcctcatatgctccgagaactatataacgtacaaaaattttggagaccagccagatatcaggtgtcccatccctaggagacggaatgatctggatgatcccgagagaggcatgatattcgtgtgcagtgccactcacaagacaaagtctatgttttttttcctggcacagacagagcagggagacatcttcaagatcactctggaaacagacgaggatatggtgaccgagattcggctgaagtacttcgacacagtgcctgtggcggcagccatgtgtgtgctaaaaactggcttcctattcgtggcctcagaatttggaaaccattatctgtatcaaatagctcacttaggagatgacgacgaggaaccagagttttccagcgccatgcccctcgaggagggggacacattctttttccagcctaggccattgaaaaacctagtactggttgatgaactggatagcctgtcaccaattcttttttgccagatcgcagatctggccaacgaggatacccctcagctgtacgttgcgtgtgggaggggcccaaggagtagtttaagagtactgagacacggtctcgaggtttccgagatggcagtgagtgaattacctgggaatccaaacgccgtgtggaccgtacggcgacacatagaagacgaatttgacgcgtatattatcgtgagctttgtcaacgctacattagttctctccatcggggagaccgtggaggaagtcacagactccggatttctggggacaactcctaccttatcctgcagtttactgggtgacgacgcgctggttcaggtctacccggacggaattcgccatatccgggcagacaagagggtaaacgaatggaagacccctggaaaaaagaccatcgtgaagtgcgctgttaatcagcggcaggtggtgatagccttaactggcggagaactggtctactttgagatggacccaagtggccagttgaatgagtataccgagaggaaggaaatgtctgccgacgtagtttgcatgtctttggctaacgtcccaccaggggagcagagatcacgatttttagccgtgggactggtagacaacactgtgagaatcatctcactggaccctagtgactgtctccaacccctatcaatgcaggcattgccagcacagcccgagagcctttgcatagtggaaatgggcggtacagagaagcaggacgaattgggcgagcggggttcgattggctttctgtatctcaacatcggactacaaaacggtgttcttcttagaacagtcctcgatcctgtcaccggcgatctcagcgatacacgcacgcgatatctgggctctagaccagtgaagcttttcagggtgagaatgcagggacaggaggctgtcctggcgatgagttctaggtcttggctcagttatagctatcagtccagattccacttgacaccgctgtcgtacgaaacgctggagtttgcgagtggtttcgcatctgagcagtgccccgaagggatcgtggccatttcaaccaataccctccgaattttagctctggagaagctgggggctgtcttcaatcaggtggcttttcctctgcaatacactcctcgcaagtttgtgatccaccccgagtcaaacaaccttatcatcatagaaaccgatcataacgcttatactgaggccacaaaagcccagagaaagcagcagatggctgaggagatggtggaagccgctggtgaggacgaaagagaactggccgctgagatggctgctgcgttcctgaacgagaatctccctgagagcatctttggagcaccaaaggccggaaacggccaatgggcctccgtgattagggtgatgaaccccatccagggcaatacattggatctcgtacagcttgagcagaatgaggccgcatttagtgtcgccgtgtgtaggttctccaatactggcgaggattggtacgttctggtcggcgtggcaaaagaccttattctcaatccccgatcagtggcaggtggctttgtatatacatataagcttgttaataatggtgaaaagctggagttcctccacaaaaccccagttgaggaggtgccagcagccatcgcccctttccaaggcagggttttaatcggagtgggcaagctactgagagtgtacgatttgggtaaaaagaaactcctgcggaagtgcgaaaataagcacatcgcaaattatattagtggcattcagactatcggacaccgagtgatcgtgagtgatgtccaggaatcattcatttgggtcagatacaaacgtaatgaaaatcaactcataatcttcgcagacgatacgtacccacggtgggttactactgcctccttgttggactatgacacagtcgccggagccgacaaattcgggaatatttgcgtagtccggctaccgccaaacacaaatgatgaagttgacgaagatcctacaggcaacaaagctctatgggatagaggtctgctgaacggggctagccagaaagcagaagtgataatgaattatcatgttggtgaaaccgtgctgtcacttcagaaaaccacgcttatcccaggaggaagcgagagcttagtatacaccactctgagcggcggtatcggcatactcgtcccatttacgagtcacgaggaccacgacttctttcagcacgtggaaatgcatctgagatccgaacaccccccactttgcggaagagaccatctgagctttagatcgtactattttcctgtgaagaacgtaatcgacggcgacctctgcgagcagttcaactctatggagccaaacaaacagaaaaacgtctcagaggagctggataggactccacctgaagtatctaaaaaactcgaagatatccgcactagatatgcattctag

SEQ ID NO: 242329 - DNA, 828 bp, Artificial Sequence
  Description of Artificial Sequence: Synthetic coding sequence
atgttcctgtataacctcacactccagagggcaacaggcatcagttttgccatccatggaaatttttcaggcacaaagcaacaggaaattgtggtaagcagagggaagatcctggagctgctgcgtcctgatccaaacacagggaaggtgcacactcttttaacggtcgaggtgtttggagtaatacgaagcctcatggctttccgactcacagggggaactaaggattacatcgtcgtggggagcgatagtggtcggatcgtaatactcgagtaccagcccagcaaaaacatgtttgagaagatccaccaagagactttcggaaagtcaggttgccgcaggatcgtccctggtcagttcctcgccgtggaccccaaagggagagctgttatgatcagtgcaatcgagaagcagaagcttgtgtacattctgaaccgagacgccgcagccaggctcacaatttcttctcctctcgaggctcataaagcaaatacactagtgtaccatgttgtgggggtggatgtgggatttgagaacccaatgttcgcgtgcctagagatggattacgaagaggcggacaatgatcccacaggtgaagctgccgcaaatacccaacagaccctaaccttctacgagttggatctcggcctgaatcatgtggtaaggaagtacagcgaacccttggaagaacatgggaactttctgattaccgttcctgggggaagcgacgggccatctggtgtactcaacctgtctccccctttcccgaaagccatccccgctcttatttgtctggactcacctgtgtatttctgtacacacccttag

SEQ ID NO: 242330 - DNA, 1275 bp, Artificial Sequence
  Description of Artificial Sequence: Synthetic coding sequence
atggccgctgggccaatcagcgaacgaaaccaagatgctacagtttatgtcggtggtctcgacgagaaagtgagcgaacctctgctttgggagctcttcctacaagctgggcctgtggttaatacgcacatgcccaaagatcgggtgacaggacagcaccaaggctatggttttgtggaatttctgtccgaggaggatgctgactacgcaatcaagattatgaatatgatcaagctctatggcaagcctatccgagtgaataaagcaagcgcacacaataaaaacctcgatgttggggcaaacatattcatagggaatctggatcccgagattgatgaaaaattgctgtatgacacattctccgcattcggtgtgatattacagactccaaaaataatgcgggatcctgacacaggaaatagtaaggggtatgccttcattaattttgcatccttcgatgccagcgatgcggcaatcgaggcgatgaatggccagtacttatgcaacagaccgatcacagtgagctatgcttttaagaaggatagcaagggtgaacggcatggcagtgctgcggagcggcttctggcagcccaaaaccctctgagtcaggccgaccgccctcaccaactgttcgctgacgctccccctcctccctcagcccctaatccggttgtttcttcacttggctccgggctgccaccccctggcatgccaccccctggctctttcccaccgccagtccctccgccaggggcactcccgccagggataccccctgctatgcccccaccacctatgccaccaggagctgccggtcacgggcctccatctgccggaactcctggtgccggacacccaggtcacggacactcccatcctcacccttttccccctgggggtatgccacacccaggcatgtctcagatgcagctggcccaccacggtccacacggcctaggtcatccacatgccggtccccctgggtcaggaggccagccgccacccagacctcctcctggtatgccacacccagggccacccccaatggggatgcccccacgcggaccgcctttcgggagccccatggggcacccagggccaatgcccccacatggaatgcgcggtccaccccctctcatgccaccccacggttatacgggtccgccacggccacccccttatggataccagagaggccctctgcctccacctaggcccacgcccaggccccctgtgccaccacggggacccctccgaggccctctcccccagtag

SEQ ID NO: 242331 - DNA, 573 bp, Artificial Sequence
  Description of Artificial Sequence: Synthetic coding sequence
atgcctaaggatagggtaactggccagcatcagggttacggattcgtggaatttcttagcgaggaggacgccgattacgccataaagatcatgaacatgattaagctgtacggcaagcccattcgcgttaataaggccagtgctcacaataaaaatctcgatgtcggcgctaatatctttatcggcaaccttgacccagaaatagacgaaaaactgttgtacgacacctttagtgccttcggggtgatcctgcagactccgaaaattatgagggatcccgataccggcaactccaaggggtacgccttcatcaacttcgccagctttgacgccagtgacgctgcaatagaagcaatgaatggacagtatctgtgtaacaggccgattacggtgtcttacgcctttaaaaaagattctaaaggggaaagacatgggagcgctgctgagagactgctcgccgcacaaaaccctctgagccaagctgatagaccccatcagctgttcgccgacgctccgcctcctcccagcgctcctaatcccgtggtctcctccctggggagtgggctcccttag

SEQ ID NO: 242332 - DNA, 2124 bp, Artificial Sequence
  Description of Artificial Sequence: Synthetic coding sequence
atgtcaagagaccgctttcgcagcaggggcggtggaggcggagggtttcaccgcagaggaggcggaggaggtcgagggggtctgcacgatttccgctcacctccacccggaatgggtctgaaccagaaccgaggcccaatgggtcctggtcccggacaatctggacccaagcccccaatacctccgcctcctccacaccagcagcaacagcagccccctccccagcaacctcctcctcagcagccccctccgcatcagcctcccccacatccacaaccccatcagcagcagcaacctcctcccccacctcaggacagcagcaaacccgtcgtagcccagggaccagggcctgctcccggtgtggggtctgctccacccgcaagctcttccgcgcctccagccaccccgcctacaagcggcgctcctcctgggagtggacctggacccacgcccacgcctccgcctgccgtcacctccgcacctccaggcgcaccaccccctactccaccatcctctggcgtccctacaacccccccacaggctggcggtccacccccaccacctgcggctgttcccggacctgggcctggccctaagcaggggcctggcccagggggacccaaaggtggcaaaatgcccggaggccctaaaccaggcggtgggccaggcctttcaacccctgggggacatcccaaaccgccacaccgcggagggggtgaaccacgagggggaagacagcatcacccaccctaccatcagcagcatcaccagggtccgccaccaggtggccctggcggaagatctgaagagaaaatctccgattctgaaggatttaaagccaatctctccctgttgagacggccaggcgaaaagacctacacgcaaaggtgccgcttgttcgtcggaaatcttcccgcagatatcacagaggatgagtttaaaagactgttcgccaaatatggtgagccgggagaggtgttcattaataaaggtaagggcttcggatttataaagctcgaatcgcgcgctctcgcagagatagccaaggccgaactcgatgataccccgatgcgcggaagacagctgagagtccgtttcgctacccacgctgctgcgctgagcgtccgcaacttgagcccttacgtcagcaatgagctgctggaggaagccttctctcaattcgggccaattgagcgggcagtcgttatcgtcgacgacagaggcaggtctacagggaagggtattgtggagtttgcttctaagccagccgcaagaaaggcgtttgagagatgttcagagggcgtgtttctgctgactaccacacctagaccagtgatcgtggaacccttggaacaactcgacgacgaggacgggctgcctgagaaactagctcagaagaatcccatgtaccagaaagaacgggagactcctcctagattcgcccagcacgggacattcgaatacgaatactcacaaaggtggaaaagcctggacgaaatggaaaagcagcaacgagagcaggtcgaaaaaaatatgaaggacgctaaggacaagctcgagtcagaaatggaagatgcttatcatgaacaccaggctaatctcctccgccaggacctgatgcgcagacaagaggaacttagaagaatggaggaactgcataaccaggaaatgcagaaaagaaaagaaatgcagctgaggcaggaggaggagagaaggcgacgggaggaagagatgatgattcggcagagggaaatggaggagcagatgcggagacagagggaggaaagctattcacgcatgggatatatggacccgagagaaagggacatgagaatgggcggagggggagccatgaacatgggggacccctacggcagcggcggacagaaattccctcctctggggggaggtggcggaatcggctatgaggctaaccctggggttccaccggctactatgtccggcagcatgatgggaagcgatatgaggactgagagatttggacagggtggagccggacccgtggggggacagggccctaggggtatgggacctgggacccctgcagggtatggacggggaagggaggagtatgagggaccaaataaaaagccaagattttag

SEQ ID NO: 242333 - DNA, 1875 bp, Artificial Sequence
  Description of Artificial Sequence: Synthetic coding sequence
atgaacagcggcggagggttcgggctcggtctggggttcggcctgacacctactagtgtcattcaagtcaccaatctgtcctcagctgttacgtcggagcagatgcgcactctgttttctttcttgggggagatagaggagctccgtctctatccaccagacaacgcccctttagcgtttagcagcaaggtgtgttatgtcaaattccgcgacccatcaagcgtcggtgtggcccagcaccttacaaacaccgtgttcatagaccgggctctgatagtggtgccctgcgctgagggcaaaattcccgaggaatctaaggcgctgtccttgctagcccctgcccctaccatgacctccctcatgccaggtgcgggtctgctgcctattccaacacctaatcccttgaccacactcggtgtgtctctctccagcttgggggcaattcctgcagctgctctggatccgaacatcgcaacactgggggaaataccgcagcctcccctcatgggaaatgtcgacccctcaaaaatcgacgagattcgcaggaccgtctacgtcggaaacctgaatagtcagaccaccactgcagaccagctgctagaattctttaaacaggtaggggaagtcaaattcgtgaggatggccggagatgaaacccaaccaacccggttcgctttcgtggaatttgccgaccaaaatagtgtgccacgagccttggcctttaatggtgtgatgttcggcgataggcccctgaaaataaaccacagtaataatgccattgtcaaaccccctgagatgacaccccaggctgctgctaaagagctggaggaagtgatgaagcgagtaagggaggctcagtcgtttatcagtgccgctatcgaacctgaatctggcaaatctaacgagaggaaggggggaaggagtaggagccatacgcgcagcaaatcacgctcctcatcaaagagccatagtcggcgaaagagatcacaaagtaagcataggagcaggtcccacaacaggagtagaagcagacaaaaggatagaagaaggtcaaaatcacctcataagaagagatctaagtctcgcgagagacgcaagtctcggagtagaagccacagcagggataagcgtaaggacacaagagagaagataaaagaaaaagagagagtgaaggagaaggaccgagagaaagagagggagagagagaaggaaagagaaaaagagaaggaacgcggtaaaaataaggaccgtgacaaggagcgcgaaaaagacagagaaaaggataaagagaaagaccgagagagggaacgtgagaaggagcacgaaaaggatcgtgataaagagaaggaaaaggagcaggacaaagagaaggagagggaaaaggatcggtctaaggagattgatgaaaaacgaaaaaaagacaagaagtcaaggaccccacccaggagttataacgcgtcccgcagaagccgttcctccagcagggaaaggaggaggaggagaagccgtagttcatctcggtcaccccgaacttccaagaccatcaagcgcaagtcctcacgctcaccgagcccacgtagccgcaataagaaggacaagaaacgcgaaaaagagagagaccatattagcgaaaggagggagcgggaaaggagcacctccatgcgaaagagcagtaacgatagggatgggaaggagaaactagagaagaactctactagtcttaaagagaaggaacataataaagagcccgattccagtgtgtccaaggaagtagatgataaggacgccccacggactgaagaaaataaaatccagcataacggaaactgtcagctgaacgaagagaatttgtcaaccaaaaccgaggctgtatag

SEQ ID NO: 242334 - DNA, 1527 bp, Artificial Sequence
  Description of Artificial Sequence: Synthetic coding sequence
atgacgtcattaatgcctggggcaggtcttctaccgattccgacccctaaccctcttaccactctcggcgtctctctgtcgtctcttggtgctatacccgcagcagccctagatcccaacatcgctacactgggcgaaatcccgcagcctccactgatgggtaacgtagatccctccaaaattgatgaaatccggaggaccgtgtacgtcgggaacctgaattcccagacaacaactgcagaccagttactggagtttttcaagcaggtgggcgaggttaaattcgtcagaatggctggtgacgagacccaacctactagattcgccttcgtggagttcgctgaccagaactccgtaccccgtgcactagcatttaacggggtgatgtttggggatcgcccacttaagattaatcactctaacaacgcaatcgtgaagcctcccgagatgacaccccaggcggcagcgaaggaactggaggaggttatgaagagggtaagagaggctcagagctttatttctgcagcaatagagccggaatccgggaagtcaaacgagagaaaaggtggcagatcgcgcagccatactcgctccaagagccgttcaagctcgaaaagccactcccgaaggaaaaggtcccagagtaaacatcgatcaagatctcacaaccggagccggtccaggcagaaggacaggagaagatctaaatctcctcacaagaaacgctctaagagcagagaacgacgaaagagcaggtcccgctcacacagccgcgacaagcggaaggacacccgggagaaaatcaaggagaaagaaagggtgaaagaaaaagaccgcgagaaggagcgggagcgggaaaaagagagggagaaagaaaaagagagaggcaaaaacaaggatcgcgataaagagagggagaaggatcgcgaaaaggataaggagaaggatcgcgagagagaacgcgagaaggagcatgaaaaagacagagacaaagaaaaagagaaggagcaggacaaggagaaggagcgggagaaggatcggagtaaggagatcgatgagaagcgcaaaaaggacaaaaagagtcgaacccctccaaggagctacaacgcatccagaagatcacgctcatcatcgcgggaacgccgaagaagaagaagtagatctagctcaaggagtcctaggacaagcaagactataaaaaggaagtcatcccggagtcctagtcctcggagcagaaacaagaaggacaaaaagagggagaaggagcgtgaccatatctcagaacgtagggaaagagaacggtccacaagtatgcgaaaatccagtaatgaccgggatggaaaagaaaaactggaaaaaaattcaacttccctgaaagagaaggaacacaacaaggagccagatagctcagtctccaaggaggtcgacgacaaagatgcgccaaggactgaggagaacaaaattcaacataacggaaactgtcagttgaatgaggagaaccttagcacaaagaccgaggcagtatag

SEQ ID NO: 242335 - DNA, 231 bp, Artificial Sequence
  Description of Artificial Sequence: Synthetic coding sequence
atgacaagcttgatgcctggagcagggcttctccctatacctactcctaatcccctgaccactctaggagtcagcctgtcttctctgggcgcaattccggctgcagctcttgaccccaacatagctacattgggagagataccacagccccctctgatgggcaacgtggaccccagtaaaatagatgaaatacgtaggaccgtttatgtgggaaacctgaacagtcagtag

SEQ ID NO: 242336 - DNA, 1545 bp, Artificial Sequence
  Description of Artificial Sequence: Synthetic coding sequence
atgaattcaggcggtggctttgggctggggttgggatttggactcacgcccacctctgtaattcaggtgacaaatttatcttcggctgtgacttctgagcagatgcggaccctgttctcatttttgggtgagatagaggagctcaggctgtatcctcccgacaatgccccactggccttctctagcaaagtctgctacgtcaagttcagagacccttcttccgtgggcgtggcacagcaccttactaataccgtcttcatagatagggctctgatcgttgtgccatgtgcagaaggtaagattcctgaagagtcaaaggccctgagcttactggctccagccccaactatgacaagcctcatgcctggagccggtcttcttcccatacccactcctaatccattgacgacccttggcgtgtcgctatcctcccttggagccatccccgctgccgctcttgacccaaatatcgcgacactcggggaaatcccacagccccctcttatgggcaacgtggatccgtctaaaatagatgagatccgcaggacggtctatgtgggcaatctaaactctcagaccaccactgccgaccagctgcttgaattctttaaacaggttggcgaagttaaatttgtgcggatggctggtgacgagacgcagcctactaggttcgccttcgtggaatttgccgaccagaacagcgtcccaagggctctggcgttcaatggcgtgatgttcggcgataggcccctcaagattaaccactccaacaacgctatcgtaaagccgccagaaatgacaccgcaagcggctgctaaagaactggaagaggtcatgaaacgagttagggaggctcagtcttttataagtgctgcaattgagccagagagcggcaagagcaacgagcggaaaggaggccgatccaggtcccataccaggtcaaagtcccgaagcagctcaaaatcacatagcaggaggaagaggtcgcaaagtaagcaccgtagccgaagtcacaaccgctcccggtccagacagaaggataggagaagaagcaagtctccacacaagaaaagatctaaaagtagggagcggaggaaatcaagatccagaagccactcccgcgataagcggaaggacactcgggaaaagattaaagagaaggagagagtgaaagagaaagatagggagaaggaaagagagagagagaaggagcgtgagaaggaaaaggaacgcggaaagaataaagacagggacaaggaacgagagaaggacagagaaaaggataaagagaaggaccgtgaacgagaacgcgagaaagagcacgagaaggacagggataaggagaaagaaaaggaacaagataaggagaaagagagagaaaaagataggagtaaggagattgatgagaagagaaaaaaagacaagaaccccgagcaccaccctggagtgaccatgcatagagaagatctggtggttcctgccggaaaaggagttggtggaggcgcaggagtacttcccgatcggcaggagcaccagaagccttag

SEQ ID NO: 242337 - DNA, 213 bp, Artificial Sequence
  Description of Artificial Sequence: Synthetic coding sequence
atgtcggaaaagaagcagcccgtggatttgggtctgcttgaggaagatgacgagtttgaggagtttccagcggaagattgggctggattagatgaagacgaggacgcccatgtttgggaagataattgggacgacgataatgtcgaagacgatttcagtaatcaattgagagcagagttggagaaacacggctacaaaatggaaacatcatag

SEQ ID NO: 242338 - DNA, 1077 bp, Artificial Sequence
  Description of Artificial Sequence: Synthetic coding sequence
atggccttcgcccctatgggccctgaggcttctttttttgatgtactggataggcacagggagagccttctggccgctttgagacgtggcggtagggaacctccaacaggcggatcgcgcctggcttcacggttcgaagacagtgtgggtctgcagatggtttctcactgtaccaccagaaaaattaaatctgactcgcctaagtccgcccagaagttttctcttatcctgaagattttatccatgatctataaattagtgcagtcaaacacatacgcaaccaagcgcgacatctattacacagattcccagctatttggtaaccagacagtcgtggacaatataatcaacgatatctcatgtatgctgaaggtgtcgcgtcgcagcctccacattctcagcacatcaaaggggctgatcgctgggaatcttaggtacatcgaggaagacggaacgaaggtgaactgcacgtgtggggctactgctgtggctgtgccaagcaatatccagggtatcaggaatctggttaccgacgccaaatttgtgcttatcgtggaaaaggacgccacatttcagcggctgctggacgacaacttctgcaacaagcttagtccctgtataatgatcaccgggaagggcgtgcccgaccttaatacacgcttactggtcaagaaactgtgggatacctttcacgtgccggtattcaccctggtagatgctgatccccatggcattgagattatgtgtatctacaaatacggctccatgagcatgtcctttgaagcacatcacttgacagttccagcaatcaggtggcttggtctgctgccttccgacttaaaacggttgaacgtccccaaggattctctgataccattgacgaagcgagaccaaatgaagctcgacagcatcttgagaaggccttacgtgacctgccagccattttggcgcaaagagatggaaatcatggccgactcaaaaatgaaagcagagatccaggccctgactttcctgtctagcgactacctctcaagggtctacctgccgaacaaactcaaatttgggggatggatatag

SEQ ID NO: 242339 - DNA, 1065 bp, Artificial Sequence
  Description of Artificial Sequence: Synthetic coding sequence
atggccttcgccccaatggggccagaggcctcgtttttcgatgtattagaccggcacagagagagtcttctcgcggctttgcggaggggtgggagggagccacctaccggcggaagtcgccttgcttcacgatttgaagattccgtgggtttacagatggtgtcacactgtaccacccggaagattaaatctgatagccccaaatctgctcagaagttctcattgatcctcaagatcttgtcaatgatctacaaattagtgcagtccaatacctacgcgaccaaacgggatatttactatactgacagccagctgttcggaaaccaaacagtggtcgataacataatcaacgatatcagctgcatgctgaaggtgtctaggagatcactgcacatcctcagcacttcaaagggactgatcgctggaaacttgcgttacatcgaggaggacggaactaaggtcaattgtacgtgtggggctactgcagtagccgtgccatctaacattcaagggattaggaacgctaaatttgtgttaatcgtcgagaaggatgccacctttcagcgcttgttggacgataacttctgtaataagttatcaccctgtatcatgatcaccggtaaaggagtgccagacttaaatactcgcttactggttaaaaaactgtgggacaccttccacgttcctgtgtttacactggtcgatgcagatccccatgggatcgagattatgtgtatttacaagtatggctccatgtccatgtcctttgaagcacatcacctgaccgtccccgcaataagatggcttggactcctacctagcgacctcaaacggttgaacgtacctaaagatagcctgattcccctgaccaaacgggatcagatgaagcttgacagtattttgagaaggccatacgtgacatgccagcccttctggaggaaggagatggagatcatggccgatagcaagatgaaagccgaaatacaggcgctgactttcctttcctcagactacctctcaagggtttacctgccaaacaaactgaagtttgggggttggatttag

SEQ ID NO: 242340 - DNA, 1191 bp, Artificial Sequence
  Description of Artificial Sequence: Synthetic coding sequence
atggcctttgctcccatgggtccagaggccagcttctttgacgtccttgaccgacatcgcgaatctctgttggctgccctgagaagaggaggaagagagccgcctacgggcggtagtcggctggcgagctcatcagaggtacttgctagtatagaaaatattatccaggatatcatcaccagcctggctcgaaatgaggccccagccttcaccattgacaatcggagttcttgggaaaacattaaatttgaagactctgttggattacagatggtgagccattgcacaactcgaaaaattaagagcgactcacctaagtccgctcagaagttctctctgattttgaagatcctctcgatgatttataagctcgtgcaaagtaacacatatgcaacaaagagggatatatattatacagatagccagctctttggaaatcagacagtggtagataatattatcaatgatattagctgtatgttgaaggtgagccgacgaagcctgcatattcttagtacttcaaagggtctgatcgcaggcaatctgaggtacatagaagaagatggcacaaaggtgaactgcacttgcggagccaccgcagttgccgttccctcgaacatacaagggattaggaacttagtgaccgacgctaaatttgtgctgatcgtcgagaaggacgccacattccagcggctgctggacgataacttttgcaacaagctgtctccctgcatcatgataaccggcaaaggcgtccccgatctcaacacgcgcctcctggtcaagaagctttgggatacctttcacgtgcccgttttcacgcttgtcgacgccgaccctcacgggatcgaaatcatgtgcatctacaagtacggcagcatgtccatgtctttcgaggcacaccatctcactgttcctgctattcggtggctggggctgttgccaagtgatctgaagcgactaaatgtgccaaaggattccctgattcctctaacgaagcgagaccaaatgaagctggacagcatccttagacggccttatgttacatgccagcctttttggaggaaggagatggagattatggccgattccaaaatgaaggctgagattcaggccctcacatttcttagttctgattaccttagtagggtgtacctgccgaataagctgaagttcggagggtggatctag

SEQ ID NO: 242341 - DNA, 813 bp, Artificial Sequence
  Description of Artificial Sequence: Synthetic coding sequence
ctgctcgctgcacttcggagaggcggacgcgaacccccaactggaggttcccgccttgcctcatcctctgaggtgctagcaagtatagagaacatcatccaggacataattacctcgcttgcccgaaacgaggcacccgcatttactatcgacaaccgatcctcttgggagaacataaagtttgaggactcagtgggactgcagatggtgtctcactgtaccactcggaaaatcaaatcggactcaccaaaatccgcccaaaagttttctctgatcttgaaaatcctgagtatgatttataaattggtgcaaagcaacacttacgccaccaagcgcgacatctattacactgatagccaactgtttggaaatcagacagtggtagataatataattaatgatatttcctgcatgttgaaggtgtcgcgcagaagcttacacattctctcgactagcaaaggattgatcgccggtaacttacgctacatagaggaggatggaacgaaagttaattgtacatgcggggctacagcagtggcagtgccaagtaacattcaggggattcgtatcaccgatgccaagttcgtgctgatcgtggagaaagacgccactttccaacggctgttagacgacaacttttgcaacaagctgtcaccctgcatcatgatcacaggtaagggtgtccctgatctgaataccagactgttagtgaagaagctgtgggataccttccatgtgccagtgtttactttagtagatgccgacccacatggaatcgagatcatgtgcatatacaagtacggttccatgtag

SEQ ID NO: 242342 - DNA, 996 bp, Artificial Sequence
  Description of Artificial Sequence: Synthetic coding sequence
atggagaatccatcaccagctgctgctctgggaaaagccctgtgtgccttactcctggccacactgggggctgccggacagcctcttggcggagagtccatttgctctgcccgagccttagccaagtattcaatcacatttaccggaaaatggtcgcaaactgctttcccaaagcagtatcctctcttccgacctccagcacaatggagttccctgctgggcgcagcgcactccagcgactatagcatgtggcggaagaaccagtacgtttccaatggactgagagactttgccgaaaggggagaggcctgggccctgatgaaggaaattgaagctgcaggcgaggcgctgcagtccgtgcacgccgtcttttcagcccctgccgtgccttcgggaacaggacagacgagcgcagaactggaggttcaacggcgtcacagccttgtcagcttcgtggtgagaatcgttccctcgccagattggtttgttggtgtcgactccctggatttgtgtgatggagataggtggagggaacaggccgcattggacctgtacccctatgatgctggcacagattcaggctttaccttctcctcgccaaacttcgccacgattccccaagacacagtgacagagatcacaagctcttctccttctcatccagcaaattctttctattatcctcgcttaaaagcactaccacctatcgcaagagtcacactcgtgagacttaggcaaagtccccgagctttcattcccccagctcccgtcctgccatcccgagataatgagatcgtggatagcgcaagcgtccctgaaactcctttagattgcgaggtctccttgtggtcttcgtgggggctttgcggaggacactgtggccgtctgggcaccaagtcccggacccgctacgtccgagtccaaccggctaacaacggatctccatgtcccgaactagaagaggaggctgaatgtgtgcctgataactgtgtctag

SEQ ID NO: 242343 - DNA, 996 bp, Artificial Sequence
  Description of Artificial Sequence: Synthetic coding sequence
atggaaaatccatctcccgcagctgccctggggaaggcactgtgcgctcttctgcttgccacgctgggcgcagcaggccagcctctcggtggggagtcaatatgctcagctcgagctctggccaaatacagcatcaccttcaccgggaagtggagtcagaccgcctttcctaaacagtatcctctctttcgccctccagcccaatggtcatcactgttaggcgcagcccacagcagcgattactccatgtggagaaaaaatcagtacgtgtccaatggtctgcgggactttgctgagagaggtgaggcgtgggctctaatgaaagaaatagaggccgcaggagaggccctgcagagtgtgcatgctgtattctccgcacccgctgtgccatctggtaccggccagacgtccgccgaacttgaggtccagcgcaggcacagcttggtgagctttgtcgtcagaattgtgccaagtccagattggttcgtgggcgtcgattctctggacttatgcgatggggacaggtggcgggaacaagccgctctggatctgtatccctatgatgccggaacagatagcgggtttaccttctccagccctaatttcgccactatcccccaagacaccgtgactgaaatcacttcgtctagtccaagtcatccagcgaacagcttctattatcccagactgaaagccctacccccaattgcaagggttacattagtccgtctgcggcaatcacccagggccttcatccctcctgcgcctgtgctgccatctcgcgacaatgaaatcgtggacagcgcctccgttcccgagacccccttagactgtgaagtctcactctggagttcttggggactttgcgggggtcactgtggtcgtctaggcaccaaaagccggacccggtacgtccgggtgcagcctgccaacaacggatctccatgccccgagctcgaagaagaggccgagtgcgtcccagataactgcgtctag

SEQ ID NO: 242344 - DNA, 186 bp, Artificial Sequence
  Description of Artificial Sequence: Synthetic coding sequence
atggaaaaccccagtccagcagccgctctggggaaggctctctgtgccctgctgctggcaactcttggtgccgcaggccagcctctcggaggagagtcaatctgctccgcgagagccctggccaagtactcaatcacctttaccggcaaatggtcacagactgcatttcctaagcagtatccctag

SEQ ID NO: 242345 - DNA, 327 bp, Artificial Sequence
  Description of Artificial Sequence: Synthetic coding sequence
atggagaacccgagtccagccgcagcactgggcaaagccctctgtgcccttctgttggcaactctaggagcagcgggtcaaccattgggcggagagagcatttgttccgcacgggcactggcaaagtactcaatcacattcacaggaaagtggtctcagacagcatttcccaaacagtatcccttgtttcggcctccggcacagtggagcagcctcttgggggcagctcactcttctgactactcaatgtggagaaagaatcaatacgtgagcaatggcttgagggactttgctgagcgcggtgaggcctgggctctgatgaaatag

SEQ ID NO: 242346 - DNA, 54 bp, Artificial Sequence
  Description of Artificial Sequence: Synthetic coding sequence
atggagaatcccagtccggcagcagcgctcggaaaagcattgtgcgccttgtag

SEQ ID NO: 242347 - DNA, 27 bp, Artificial Sequence
  Description of Artificial Sequence: Synthetic coding sequence
atggaaaaccccagccctgcagcttag

SEQ ID NO: 242348 - DNA, 51 bp, Artificial Sequence
  Description of Artificial Sequence: Synthetic coding sequence
atggagaatcccagccctgccgcagctctgggaaaggccttgtgcgcgtag

SEQ ID NO: 242349 - DNA, 75 bp, Artificial Sequence
  Description of Artificial Sequence: Synthetic coding sequence
atggaaaacccctccccggcagcagccctcggtaaagccctgtgtgcgctcctgttggcaactttaggcgcttag

SEQ ID NO: 242350 - DNA, 195 bp, Artificial Sequence
  Description of Artificial Sequence: Synthetic coding sequence
atggagaacccgagtccagctgcggctctcggcaaagccctttgcgccctgctacttgctacactcggggcagccggtcagcctctgggaggagagtctatttgttcagccagagctctcgcaaagtatagcatcacgttcaccggcaaatggtcgcagactgcattccccaaacagtatccgctgttccggtag

SEQ ID NO: 242351 - DNA, 960 bp, Artificial Sequence
  Description of Artificial Sequence: Synthetic coding sequence
atggacccgcagaatcagcacgggtcggggtcctccctggtcgtgatccaacagccctcactagatagtcgccagcgacttgactacgaaagggagatccagcccaccgccatactgagcctggatcagataaaggccatcaggggtagcaatgaatataccgaggggccttccgttgttaaaagaccagctccccgaacggccccacggcaagagaaacatgagcgcacacacgagattatccccataaacgttaacaacaactacgagcaccggcatacctcccacctgggtcatgcggttctgccctcaaacgctcggggtccaatactcagccgatccacttctacaggaagcgcagcctcttcagggtcaaactcttcggccagcagtgagcagggtctgctcgggcgttcaccaccaacccgaccagttcccggacacagaagtgagcgtgcaatccgcacacagcccaaacaactaatagtggatgacctcaaagggtctctgaaggaggacttaacgcagcacaagtttatatgcgaacaatgtggtaagtgtaagtgcggagaatgcactgctcccaggaccttaccctcatgcctcgcctgcaaccgacagtgcctgtgttctgccgagtccatggttgaatatggcacctgtatgtgtctggtaaagggaatcttctatcactgttccaatgacgacgagggagacagctattctgacaatccctgcagttgttcccaaagtcattgttgtagcagatacctgtgcatgggagccatgtccctgttcttgccttgcttactatgctacccccctgctaagggatgtctgaaactctgcaggagatgctacgactggatccaccgtcccggatgtcgatgtaagaacagcaacacagtgtattgtaagctcgaatcttgtccctctagaggccagggcaagccatcatag

SEQ ID NO: 242352 - DNA, 960 bp, Artificial Sequence
  Description of Artificial Sequence: Synthetic coding sequence
atggacccacaaaatcagcacggtagcggttccagtctggtcgtgatccagcaaccatccctggattcccgccaaaggctggactatgagagagagatccagcccactgcgatattgagcctcgaccagatcaaagcaatccgtggcagtaatgagtacacagaaggcccaagcgtggtaaaaaggcccgctcccagaacagcccctaggcaggagaagcatgagagaactcacgagataatcccaatcaacgtgaataacaactatgaacacaggcacaccagccacctaggacatgcagtgctgccatcaaatgccagggggccaatccttagcaggagcacttctaccggatccgcggctagttcaggttccaatagctccgcttcaagtgaacagggacttcttggcaggagtcctcccacgcgtcccgtgccaggacataggtcagagcgagcaattcgaactcagcctaaacagctgattgttgacgacttgaagggcagcctgaaggaggatctgacccaacacaaattcatatgcgagcaatgcggaaagtgtaagtgcggagagtgtactgctcccagaaccctcccctcttgcctggcttgtaatagacagtgcttatgttccgccgagtcaatggtcgaatacgggacatgcatgtgcttggtgaaaggaatcttctatcactgttctaacgatgacgaaggggacagctactctgacaatccttgctcttgtagccagagccactgttgttctaggtacttgtgtatgggggctatgtctctgttcttaccgtgtctcttgtgctacccccctgccaagggctgccttaaactgtgtcgccgttgctatgactggatccatagacctgggtgccggtgtaagaacagcaatacagtgtactgtaagctagaatcatgcccatcccggggacagggcaagccgtcctag

SEQ ID NO: 242353 - DNA, 204 bp, Artificial Sequence
  Description of Artificial Sequence: Synthetic coding sequence
atggacccacagaaccagcacggcagcggcagtagtctggttgtgatacagcagccaagtttagatagtagacagcgattagattacgaacgcgaaatccagcctacagcgattctgagcctggaccaaattaaggctatacggggtagcaatgaatacacggagggaccgtccgtggtcaagcggccagcgccacgtacatag

SEQ ID NO: 242354 - DNA, 630 bp, Artificial Sequence
  Description of Artificial Sequence: Synthetic coding sequence
atggatcctcagaaccaacacgggagcggcagcagcttggtggtgatccagcagccctcattggacagcaggcagcggctggattacgaaagggaaattcagccaactgccatcctttcactggatcagatcaaggccattcgcggaagcaacgagtacacagagggcccttctgtagttaagagacctgcacctcggaccgctcctcgtcaggagaagcatgagcggacacatgaaattatacccatcaacgtgaataataattacgagcaccgacacacctcgcacctaggacacgctgttctgcctagcaacgcccgaggccctatcctgagcaggtcgacatcaacggggtccgctgcctcttctggaagtaatagctcggcaagctcagagcagggcctgctggggcgatccccacccacacgcccagtgcctgggcatcgatccgagagggccatacgcactcagccaaaacagctcatagttgatgacttgaagggaagtctcaaagaagatttgactcagcacaagtttatttgtgaacaatgtgggaagtgtaagtgcggtgaatgcacagcacctcggacactgccttcatgccttgcctgtaacaggcagtgtctctag

SEQ ID NO: 242355 - DNA, 108 bp, Artificial Sequence
  Description of Artificial Sequence: Synthetic coding sequence
atggatccacagaaccagcacggttcaggaagttcactggtcgttattcagcagccctctctggactctcgacagagattagactacgagcgagaaatacagccctag

SEQ ID NO: 242356 - DNA, 948 bp, Artificial Sequence
  Description of Artificial Sequence: Synthetic coding sequence
atggaagcccgtgcccagagtggtaacggtagtcaaccactgctccaaaccccacgagacggcggacgacaaaggggtgaaccagaccctcgggatgccctgacccaacaggtccacgttctgtctttggaccagattagggcaatccggaacaccaacgagtacaccgagggtcccaccgttgtgccaaggcccggacttaaaccagcccctaggcctagtacccagcataaacacgagagactgcatggcctgcctgagcacagacagcccccacgcctgcaacattcccaggtacattcctctgcgagggccccactaagtaggagcattagtactgtcagcagcggaagccgctctagtactaggaccagcacttcctcttcttcttccgaacaaagactcttgggctcctcttttagtagtggaccagtggccgacggaatcatccgcgtgcaaccaaagagtgagttgaaacctggtgagctaaagcctctttcaaaagaggacctcggcctgcatgcttatagatgcgaagattgcggcaagtgtaaatgcaaggagtgcacctatcctagaccacttccgtcagattggatctgcgataagcagtgcctctgttccgcccagaacgtaatcgattatggaacctgcgtgtgttgtgtgaagggcttattttatcactgctctaacgatgatgaggataactgcgcggataacccctgctcctgttcccagtctcactgctgtacgaggtggtccgcaatgggcgtcatgagtttgttccttccttgtctctggtgctacttgcctgcaaaaggctgtctgaagttgtgtcaaggttgttacgatagagtcaatcggcctggatgccgctgcaaaaattccaatacagtgtgttgtaaggttcccaccgtgcccccaaggaactttgagaaaccaacatag

SEQ ID NO: 242357 - DNA, 948 bp, Artificial Sequence
  Description of Artificial Sequence: Synthetic coding sequence
atggaggccagagctcaatcgggaaatggttcacagcctttgctgcagacccccagagatggcggaaggcagaggggggagccagacccgagagacgccctgacacagcaggttcatgtcctgtcactggatcagatcagagcaattagaaacactaatgagtacaccgagggaccgaccgtggtccctcgtcctgggctgaagccggctcctcgcccatctacacagcataagcacgagcgcctgcacggcttacctgagcatcgccaaccacccaggttgcagcattcgcaggtccactccagtgctagggccccactcagtcgatccatttctacagtgagctccggcagtaggagttccaccagaacctccacgagctcaagctctagtgaacaaaggcttctcgggagtagtttttcctctgggcctgtcgctgacggaatcatcagagtgcagcccaaaagtgaattaaagccgggtgaacttaagccattatcaaaggaagacctcggactgcatgcttaccggtgtgaggattgcggaaaatgcaagtgtaaggagtgcacctatcccagaccactgccctccgattggatctgcgataaacagtgtctatgctccgcccagaatgtgattgattacggtacttgtgtgtgttgcgtcaaggggctgttttatcactgcagtaacgacgacgaagataactgtgctgacaatccatgctcctgttcccagtcacattgttgtacgcgctggtcagcaatgggagtaatgagccttttcctgccctgtttatggtgttacctcccggcaaaaggatgtctaaagctgtgccaagggtgttacgaccgggtcaatcgaccaggctgcaggtgtaagaattcaaacactgtgtgctgcaaggtccccactgtgcctcctcgaaacttcgaaaagcccacttag

SEQ ID NO: 242358 - DNA, 948 bp, Artificial Sequence
  Description of Artificial Sequence: Synthetic coding sequence
atggaagccagggcacagtccggtaatggttcacaacctctcctgcagacaccaagggacgggggtcggcaaagaggcgaacccgacccccgagacgcattaacacagcaggttcacgtgttaagtctcgatcagattcgcgctatcaggaacacaaacgagtacaccgagggccctaccgtggtgccacggcctgggctcaaacccgctcccagaccctccacgcagcataaacacgaacgcctccatggcctgcctgagcaccgccagcccccaaggctccagcacagtcaggtccattcatctgcgcgagcgccactctctagaagcatatcaactgtgtcgtccggaagtagaagtagcacccggaccagcacatccagcagcagctccgaacagaggctgctgggcagcagcttttcatccggcccagtggccgacggcatcatcagggtgcagcctaaaagcgaactgaagccgggtgagctgaagccactgtctaaagaggacctgggcctgcacgcgtaccgctgcgaagattgcggaaagtgcaaatgtaaggagtgtacttacccaaggcctcttccaagtgactggatatgcgataagcaatgcctgtgtagtgcccagaatgtgatcgactacggtacctgcgtctgctgcgtgaagggactattttaccattgttcgaatgatgatgaagacaactgcgctgataatccatgcagctgctctcagtcccactgctgtacacgctggtcggcaatgggagtgatgtcactgttcctgccatgcctatggtgctacctcccggctaaaggctgcctaaaactgtgccagggatgttacgatcgggtcaacagacccggatgccgctgcaagaacagcaacacagtatgttgcaaagtgccaaccgtgcctccacgaaactttgaaaagccaacgtag

SEQ ID NO: 242359 - DNA, 1062 bp, Artificial Sequence
  Description of Artificial Sequence: Synthetic coding sequence
atggaagcaagagcccagtcaggcaatgggtcccagcctctgctgcaaaccccaagggacggagggcgtcagagaggggagcctgatccccgagacgctctcacacagcaggtccacgttttgagtctcgaccagataagggccataagaaacactaacgaatataccgaaggcccaacagtcgttccaaggcccggtctgaaacccgcaccccgtccgagcacccaacacaaacacgagcgcctccacggcctgcccgaacacaggcagccacctcggctgcagcactcccaggtacacagtagtgctagagcccctctgtctagatcaataagtaccgtgagctcaggaagtcgctcttctactcgaacaagtacatcttctagcagttctgagcagagactgctggggtcttcgttcagtagtggtcccgtggctgacggaatcattcgcgtgcaacccaaatcagagctgaaacctggagaattaaaacccctgagcaaagaggacctaggcctgcacgcatatcgatgcgaggactgcggtaagtgcaagtgtaaggaatgtacctatccccgacccctgccttccgactggatctgtgacaagcagtgtctatgttcggcgcaaaacgtgattgactacggcacttgcgtctgttgcgtgaagggcctgttctatcactgcagtaatgatgacgaagacaattgcgccgacaacccttgtagttgttctcagtctcactgttgtacgcgatggtccgctatgggagtgatgtccctgtttctgccgtgtctgtggtgctacctccctgccaaggggtgtcttaaattatgccaagggtgttacgaccgagtgaatcgcccaggctgtaggtgtaagaactccaacacagtgtgttgcaaggtgcccactgtccctcccagaactttaaagaaccaacatagcattatcaatcaggagtattatagcaacgaagattttttcttcctttttctgatacatatctgcaaccagctgaatagctataaccttggcactgtcaatcgtaaggttggctag

SEQ ID NO: 242360 - DNA, 867 bp, Artificial Sequence
  Description of Artificial Sequence: Synthetic coding sequence
atggacgcggctgttacagatgatttccaacaaattctgccgatcgagcaactgcgttcgactcacgccagcaatgactatgtggagagaccccctgccccatgcaagcaggccctgtcctccccatcattgatagttcagacacacaaatctgactggtctctggcaaccatgcccacatccctgcccagatcgctttcacagtgccaccagctacagcctctgccccagcatctttcccagagttctatcgcatccagtatgtcacactcgactactgctagcgatcagagacttctcgcctccataaccccgtccccctctggacagagcatcattagaacgcaaccaggggcaggtgtccatcccaaagcagacggtgccctgaagggagaagcagaacaatcagcaggccacccttctgaacacctcttcatatgtgaagaatgtggtcggtgtaagtgcgttccctgtactgcggctagacccttaccttcttgttggctctgcaaccaaaggtgtctctgctcggctgaatccctactggattatggaacgtgcttgtgctgtgtcaaagggcttttttatcactgttctaccgacgatgaagataattgcgccgatgagccctgctcatgtgggccatcaagctgcttcgttcggtgggctgctatgagtctgatttctctttttcttccttgcctctgctgctatttgcctaccaggggctgtctgcacctgtgtcagcaggggtacgattctttgaggcgcccaggctgccgatgcaaacgacacactaatacagtgtgccgcaagatctcttctggaagcgccccttttcccaaagcccaggaaaagtccgtgtag

SEQ ID NO: 242361 - DNA, 378 bp, Artificial Sequence
  Description of Artificial Sequence: Synthetic coding sequence
atggacgctgcagtgactgacgatttccagcagatccttcccatcgagcaactccggtcaacccacgcaagtaacgattacgttgaaagaccaccggctccatgtaagcaagctttgagctcccctagtctgattgtgcagacccacaagtccgactggtctctcgccacaatgccaaccagtttgcctaggagcttaagccagtgtcatcaactccaacccctaccacagcacttaagccagagcagcattgctagtagcatgagccatagcacgaccgcctcaagcactacagccccactgatgatgaagacaacagtgctgatgtcccctgcattggtgggattggttcttgcgttgtccgctggtcagccttag

SEQ ID NO: 242362 - DNA, 969 bp, Artificial Sequence
  Description of Artificial Sequence: Synthetic coding sequence
atgttgtcccccttaccaaccgggccacttgaggcctgcttctccgttcagagtcggacttcttctcctatggagccgcctatcccgcagagtgcacctctgaccccaaattcagtaatggtgcagcctcttctcgatagccgcatgtcacatagcagactccagcaccccctcacaattcttccgatcgaccaggtgaagactagtcatgtggaaaatgattatatcgacaacccatccctcgccctgactacaggcccaaaacgaacgcgtggcggagcacctgaattagcccctacccctgccaggtgtgaccaagatgtgacgcatcattggatctccttcagtggaagaccatcaagcgtttcctcttcgtctagcaccagctctgatcagagactgcttgatcacatggccccacccccagtggcagaccaggccagtcctagggcagtgcgaatccagcctaaagtggttcactgtcagccccttgatctgaagggaccagccgtgccacctgaactcgataaacattttctcctatgtgaggcctgtggaaaatgcaagtgcaaagaatgtgcttcacctcgcactctaccgtcgtgctgggtttgtaatcaggagtgcttgtgcagtgctcaaactcttgttaactacggtacctgcatgtgtcttgttcaggggatcttctaccactgcacaaacgaagatgatgaggggagctgcgccgatcatccttgctcttgctcacgaagcaattgttgtgcgaggtggtcatttatgggagccctgtcagtggtgcttccgtgcctgctgtgctacttaccagcaactggctgcgtgaaattggcacagcggggttacgaccgtctgagaagacctggctgccggtgcaaacatactaactctgtcatatgcaaggccgctagcggggacgccaagacatctcgcccagacaagccattctag

SEQ ID NO: 242363 - DNA, 321 bp, Artificial Sequence
  Description of Artificial Sequence: Synthetic coding sequence
atggaacctccaattccacaatcagcccctttaactcctaacagcgtaatggtgcagcccctgctagacagtcggatgagtcactccagactccaacatcccctgacaattctgccaatagaccaggtgaaaacttcgcatgtcgagaacgactacattgacaatccctcattggctctgacgaccggccctaagcggacacgtggaggagctccagagctagcacctaccccggcaaggtgcgatcaggacgtcacacatcactggattagcttttctggtcggccttgtagtgctacctgcctgccacccgctgcctag

SEQ ID NO: 242364 - DNA, 900 bp, Artificial Sequence
  Description of Artificial Sequence: Synthetic coding sequence
atggagcctcctattcctcagagtgccccattaacacccaattctgtgatggtgcaacccctgctcgattcacgaatgtcacactcaagacttcaacatcctcttactatactgccaatcgaccaggtcaagacttctcatgtggagaacgattacattgataatccatccctcgctttaactactggccctaaacggacacggggaggagcccctgagttagccccaactcccgcaaggtgcgatcaggacgtcacacaccactggatctctttctccggaagaccatccagtgtgtcttcctcatcatctacaagctccgatcagagactgctggaccacatggcgcctccaccagtcgctgatcaagcgagccctagggcagtccgtatccagcccaaggtcgttcattgtcaaccactagacctgaaaggacccgctgtgccccctgaactcgataaacacttcctgctgtgcgaggcgtgcgggaagtgcaaatgtaaagagtgtgccagccccagaacactccctagctgctgggtgtgcaatcaagaatgcctttgctccgcccagacactcgtaaattacggtacctgcatgtgtctggtgcagggcatcttttaccactgcactaacgaggatgacgagggatcctgtgccgaccacccatgttcatgtagccggtctaactgctgcgctcggtggtctttcatgggcgctctgtcagtggtacttccgtgcctcctgtgttatctgccggcaacagggtgcgtcaagctagcacagagagggtacgatcgtctgcgaaggccagggtgccgttgtaaacatacgaatagcgtgatttgcaaggccgcatccggggatgctaagacatcccgccctgataaacccttctag

SEQ ID NO: 242365 - DNA, 153 bp, Artificial Sequence
  Description of Artificial Sequence: Synthetic coding sequence
atggaaccccctatcccacagagcgctcccttaacccctaattccgtgatggttcaacctctcctggactcccggatgtcccactccagactgcagcatccactcactattctgcccatagaccaagtcaagacatcccacgttgagaactag

SEQ ID NO: 242366 - DNA, 1335 bp, Artificial Sequence
  Description of Artificial Sequence: Synthetic coding sequence
atgtccgaggaaactgcgacatcagacaatgacaactcctacgcgagagtgagagccgtcgtcatgactcgagacgattcgagtggcggttggctcccactcggcggatcagggctgtctagcgtaaccgtatttaaggtgccgcaccaggaagaaaacggctgtgcagatttcttcataaggggcgaacgcctgagagataagatggtggtgctcgagtgcatgttaaagaaggatctaatttacaacaaagtgacacccacattccatcactggaaaatagatgataaaaaattcggactgactttccagtctccagccgacgccagggcctttgaccgaggcatcaggcgggctatcgaggacatatctcagggatgtccggaatccaagaacgaggccgagggtgcagatgatctgcaggcgaacgaggaggactcgtccagctcccttgttaaggaccacctgtttcaacaagagactgtggttacgagtgaaccatataggtcatccaacatacggccaagcccattcgaggatctgaatgcccgacgcgtgtatatgcagagtcaggctaatcagatcacattcggacagccaggcttagacatccagagcagaagtatggagtacgttcaacgacaaatttctaaggagtgtggtagcctgaaatctcagaaccgcgtgcctctgaaaagtattcggcacgtgtcatttcaagacgaggacgagattgtccgcataaacccacgcgatattctaatcaggagatatgcggactatagacatccagacatgtggaagaatgacctcgagcgcgacgacgctgactccagtatacagttttctaaaccggactctaagaaatccgattatctgtactcttgcggtgatgagactaagctgtcatctcctaaagatagcgtcgtctttaaaacccagcctagctcactaaagatcaagaaatcaaaacgaagaaaggaagatggtgagcggtctcgttgcgtctattgtcaggaacgatttaaccatgaggaaaatgtccggggtaagtgtcaagatgcacctgacccaattaaacggtgtatatatcaggtttcgtgcatgctttgcgccgagtccatgctttaccactgcatgagtgatagcgaaggtgatttctctgatccatgctcctgcgacaccagtgatgataagttctgtctgaggtggttggccctcgtggcgctgtccttcatcgtgccttgtatgtgttgctacgttccattgcgaatgtgtcacaggtgtggagaagcgtgcgggtgttgcgggggtaagcacaaggccgcaggctag

SEQ ID NO: 242367 - DNA, 1257 bp, Artificial Sequence
  Description of Artificial Sequence: Synthetic coding sequence
atgaccgaggagacccatccagacgacgatagctacatagttagagttaaagccgtcgtaatgacccgcgacgacagcagcggcggatggttcccacaggagggtgggggaatctcacgagtgggggtctgcaaggtgatgcatcctgaggggaatggcagatctgggtttttaatccacggtgagcgacagaaagataaacttgtcgttttggagtgctacgtgcgcaaggacctcgtttatacaaaggcaaatccaacgttccaccactggaaggtggataaccggaaatttggccttacatttcagtctccagccgacgctagagcctttgaccgaggagtgagaaaagccatcgaggatcttattgagggatccaccacaagcagtagtaccatccacaatgaggcagagctgggagacgatgacgtttttaccaccgcgaccgacagcagctctaattcttctcagaaacgcgagcaacccactagaacaatttcaagccctacaagctgcgagcatagaagaatttataccctggggcacctccacgactcgtacccaacagatcactatcacctggaccaaccaatgcctcgcccttataggcaggtctcgtttcccgatgacgacgaagaaattgtaagaatcaaccctagggagaagatctggatgactgggtatgaggattaccggcatgctccggtgcgcggaaagtaccctgatccatctgaggacgcggatagcagctatgtcaggttcgccaaaggcgaagtccccaagcacgattataactacccttacgttgattcctctgactttggtttgggcgaggacccaaagggtagggggggatctgtgattaaaactcagccatcgagaggcaagtcacgccgacgcaaagaggacggagagcgcagccggtgcgtgtactgtcgtgacatgtttaatcatgaggaaaataggaggggacactgtcaggacgctcccgactctgtgagaacttgtattaggagagtgagctgcatgtggtgtgctgacagtatgctgtaccattgcatgagtgaccccgaaggggactacaccgatccatgtagctgcgacacgtccgatgagaagttctgccttcgttggatggcccttatagctttaagcttcttggccccatgcatgtgttgctatctgcctttgcgcgcttgctatcattgtggggtaatgtgcagatgctgcgggggaaaacacaaggcggcagcatag

SEQ ID NO: 242368 - DNA, 351 bp, Artificial Sequence
  Description of Artificial Sequence: Synthetic coding sequence
atgactgaagaaacccatccggatgatgactcgtatatcgtcagagtgaaagccgttgtgatgacacgcgatgacagcagcggcggttggttcccacaggagggaggcggtatctcacgtgtcggggtttgcaaagtgatgcaccccgaagggaatggcaggtcagggttcctgatccacggggaacggcagaaagacaaactggtcgtgctggagtgctatgtgcggaaagaccttgtgtacacaaaggcaaaccctacctttcatcattggaaggtagacaatagaaaattcgggctcacctttcagtctcctgccgatgctcgtgccttcgaccggggtgttcgttag

SEQ ID NO: 242369 - DNA, 1248 bp, Artificial Sequence
  Description of Artificial Sequence: Synthetic coding sequence
atggcaagccccggaagcgattcctacatcgtccgcgtcaaagctgtagtgatgaccagagacgacagctcgggtggatggtttccccaggagggcggtggtatatcaagagtcggggtgtgtaaggtgatgcaccctgaagggaacggacgttccggtttcctgatacacggcgagcgtcagaaagataaactggtggtgttagagtgttacgtccggaaagacctggtgtacacaaaggccaaccccacttttcatcattggaaggtggataataggaagttcggtttgacatttcaatccccggctgacgccagagcctttgatcgcggagttagaaaagccatagaggacctgattgagggcagcaccacctcatcatctactatccataacgaagcagagctgggtgacgatgacgtctttactaccgccacggactcctccagcaactcctcccagaagcgcgaacagcccacacggacaatctctagccctacatcttgcgagcacaggaggatttatacattagggcacttacacgactcatatcctacagatcattaccatctcgaccagcctatgccacgcccatatcgccaagtgtcctttcccgacgatgacgaagagattgttcggatcaacccaagagagaagatatggatgacgggttatgaggattacagacacgctcctgtgcgcggaaaatacccagacccttcggaagacgcagatagttcgtacgtaagattcgcgaagggcgaagttcccaaacatgactacaattatccatacgttgactctagcgattttgggctaggtgaggatcccaagggtcgaggaggatcggttatcaagacgcagcccagcagggggaaatcccgccgacgtaaggaagatggagaacggtcacgatgcgtgtactgtagagacatgtttaaccacgaggaaaatagacgcggtcattgccaagatgcaccggactccgtgagaacttgcattcgtcgggtcagttgcatgtggtgcgccgactctatgctctaccactgtatgagcgatcctgaaggcgattataccgacccctgcagttgcgacacttccgacgagaagttttgcctccgatggatggctttgatagcccttagctttttggccccttgcatgtgttgctatctacccctgagagcttgttatcattgcggcgtgatgtgccgttgttgtggtgggaaacataaggccgctgcatag

SEQ ID NO: 242370 - DNA, 1233 bp, Artificial Sequence
  Description of Artificial Sequence: Synthetic coding sequence
atggtgcgggtaagagccgtcgtcatggctcgggatgattcctctggtggttggctgccagtagggggaggcggtctcagtcaagtgagtgtttgccgggtgaggggtgctaggcccgaaggaggagcgaggcaaggacactacgtaatacatggcgagaggctgcgggatcagaaaacaacactggaatgcaccctgaaaccgggtctggtgtacaataaggtcaaccctatattccaccattggagtttgggagactgcaaattcgggctgaccttccagtctcctgctgaagccgacgagttccaaaaaagcctgttagccgctctagctgctctcgggcgtgggagtctgactcctagcagttcttcaagcagcagtagcccttctcaggataccgccgagaccccgtgtcccctcacgagtcatgtggattccgactcctccagcagccattctcgccaggagacaccgccaagtgcggctgccgcacccatcataactatggaaagtgccagtgggtttgggcctaccacacccccacaacgcaggcggtcctctgcacagtcttaccccccactgctcccctttacaggcattccagagccttctgaacctcttgcgggagccggaggactgggatggggtggaagggggtatgaagactacaggcgatccggtcctccagcccctctggcgctgtcaacttgcgtagttcgatttgcgaaaaccggcgcactcaggggcgcagccttgggaccacccgcagcccttcccgctcccttaaccgaggcagcccctcctgctcccccagctcgcccaccccctgggcctggcccatcaagcgcccctgctaaggcgagccccgaagcagaagaagcagccaggtgtgttcactgcagggctctgttcagacgcagggcggacgggaggggcggaaggtgtgcagaggcccctgaccccggtcgacttctcgtcaggcgtctctcctgtctttggtgcgccgaaagcctgctgtaccattgcctttctgacgctgagggtgatttcagcgacccatgtgcctgtgaacccggacacccccgacccgcagccagatgggccgctctggcagccctgagtctggccgtgccctgcctgtgctgttacgcccctctgcgcgcttgccactgggtggcagcgcgttgtgggtgcgccggttgtggcggtcggcatgaggaggctgcccgatag

SEQ ID NO: 242371 - DNA, 459 bp, Artificial Sequence
  Description of Artificial Sequence: Synthetic coding sequence
atggttagagtgcgcgcagtggttatggccagagatgacagtagcgggggttggctgcccgtcggaggcggagggctgagtcaggtctctgtttgccgcgttcgcggtgcaaggcccgagggtggggctcggcagggccattatgtcattcatggcgaacggctgcgcgaccaaaaaaccacactagaatgtaccctgaagcctggcctggtgtacaataaggtgaacccaattttccaccactggtcattaggggactgtaagtttggtttgacatttcagagcccggcagaagcagacgaatttcagaaaagcctcctggccgcactagccgcattaggacggggatccctaactccttcctcaagctcatcctcatcaagtccttctcaggataccgccgagacaccgtgtccgttgacactctcacagtactttagacatatgctctgtccctag

SEQ ID NO: 242372 - DNA, 1725 bp, Artificial Sequence
  Description of Artificial Sequence: Synthetic coding sequence
atgtggacatttctcggaatcgcaacatttacctatttctacaagaagtttggtgacttcatcacattggccaaccgcgaggtgctgctttgtgtgctggtgttcctcagcctgggactggtgttgtcatacagatgccggcacagaaacggtggtttgctgggcaggcagcagtcagggtcacaattcgccttatttagcgatattctgagtggactgcccttcatcggctttttttgggccaaaagccctcctgaatctgagaacaaggaacaactggaagcacgccgtcggagaaaaggcactaacatcagtgaaacatcattaattggtactgctgcttgcacaagcacaagtagccagaacgaccccgaggttatcattgtgggcgcaggcgtgttggggtcagctttagctgctgtactctcgagggatggcaggaaggtgacagttatcgagcgggacctgaaggagccggatagaatagttggtgaattcttgcaaccagggggttaccatgtgctgaaagatctcgggttaggggacacagttgagggcctggacgctcaggtcgtaaacggctacatgatacacgatcaggagagcaaatccgaagtgcagataccgtatcctctgtcagaaaacaaccaggtgcaatccggcagagcctttcaccacgggagatttatcatgagcctccgaaaggccgcaatggcggagcctaatgccaaattcatcgagggcgtcgtgctacaactgctggaggaagacgacgtggtgatgggcgtacagtataaggataaggagaccggcgacatcaaagagctccacgcccctttgacagtagtcgccgacgggctgttcagcaaatttcgcaagtcattagtttcaaataaggtgagcgtgtcttcgcacttcgtcggttttctcatgaaaaacgctccacagttcaaggcgaaccacgccgaactgatcctggcaaatcctagccccgtgctaatttatcagatcagcagcagtgagactcgagtgctcgtcgatataaggggagagatgccaaggaacctgagggagtatatggtggaaaaaatctacccacaaatacctgaccatctgaaggagccatttttggaggctaccgataattcccatctaagaagcatgcccgcttctttcctaccacctagctctgtaaagaagaggggcgtgctgctacttggggacgcttacaacatgcgacaccctcttacaggtggaggaatgactgtggcctttaaagatatcaagctgtggcgcaaattgcttaagggcatccctgatctttatgacgacgccgctatcttcgaggccaagaaatctttctactgggctcgcaagacttcccacagctttgtcgtcaatattctggcccaggccctgtacgaactattttccgcaactgacgactcgctccaccagctccggaaggcgtgttttttgtactttaagctcggtggggaatgtgtcgcgggtccagtcggcctgctttccgtactctcaccgaatcctctggtgctcattggtcatttctttgcagtggcgatttacgcagtgtacttctgcttcaagtctgaaccttggatcaccaagccacgggctctgctgtcctccggcgctgtgctttacaaagcctgctcagtgattttcccactcatctactcggagatgaaatatatggtccactag

SEQ ID NO: 242373 - DNA, 1440 bp, Artificial Sequence
  Description of Artificial Sequence: Synthetic coding sequence
atgctgaggaggaagggcacaaacatttccgagacctcactgatcggtactgcggcttgtacttccactagctcccagaacgacccagaagttatcattgtaggtgcaggggtgttgggcagcgccctggcagcggtgctgagccgcgacgggaggaaagtcaccgtgatagagcgtgatttaaaagagcctgataggatcgtcggagagtttctgcagccgggaggctatcacgtgctgaaagacttgggcctcggggatactgtggaggggttggatgcccaagttgtgaacggttacatgatccacgatcaggagagtaaatccgaagtccaaatcccctatcccttgagtgagaataatcaggtccagtctggtagggcctttcatcatgggagattcataatgtccttaagaaaggcagccatggccgaacctaacgcaaagttcatagagggagttgtgctgcagctgcttgaagaagatgacgtggtgatgggcgtccagtacaaagacaaagaaacgggggacataaaagaactgcacgcacccctgacggtcgtagccgacggcctgttctctaagtttcgaaagtcactcgtgtcaaacaaagtttccgttagtagccattttgtggggtttcttatgaaaaatgcacctcaatttaaagctaaccacgcagagcttattcttgctaacccaagtcccgttctgatctatcaaatatcaagcagcgaaactagagtcctggtcgacatccgaggcgagatgccacgtaatctacgcgagtacatggtggagaagatatatcctcaaattcctgaccacctgaaagagcctttcctcgaggcaacagacaactcccatctgcggtctatgccagcatctttcctccctccttcatcggtcaagaagcggggagtgctgcttctgggtgacgcatataacatgaggcacccccttacaggaggcggtatgacagtcgcattcaaagacattaagttgtggcgtaaactcctcaaaggtatcccagatctgtacgatgatgcagccatattcgaagcaaaaaagtcattctattgggcacgcaaaacctcccactcttttgttgtcaatatacttgcacaggccttgtacgaactgttctcagccactgacgactcactgcaccagttaaggaaggcctgctttttatactttaagcttggtggcgaatgcgtagcgggtccagtcggcctgctatctgttttatcccccaaccctctcgtcctgatcggccacttctttgccgttgcgatttatgctgtctacttttgtttcaaaagcgagccttggatcacaaagcctcgcgcactcctctccagcggtgctgtgctgtacaaagcttgctcggtgattttccctctcatatactccgagatgaagtacatggtccattag

SEQ ID NO: 242374 - DNA, 1140 bp, Artificial Sequence
  Description of Artificial Sequence: Synthetic coding sequence
atgatccacgaccaagaatccaaatctgaggtgcaaataccttaccctctcagcgagaacaaccaagtgcaatcgggtagggcattccatcacggccgtttcatcatgtccctacgcaaagcagccatggccgagcccaatgcgaaattcattgaaggggtggtgctgcagctgttagaagaggacgatgtagtgatgggcgtgcaatacaaggacaaagagacaggggacattaaagaactgcacgctccactgacggtggtggcagacggccttttcagcaaattccggaagtctctggtctcgaataaggtcagcgtgtcatctcactttgtcggcttcttgatgaagaatgccccacaatttaaggcgaaccatgccgaattgatcctggctaatccatcacctgtcctaatatatcagatcagttcttccgagacacgcgtccttgtagacatacgcggagaaatgccgaggaatcttagagagtatatggtggaaaaaatctacccgcagatccccgaccatctcaaagagccatttctggaagccaccgataattcccatctgcgcagcatgccagcgagttttctcccaccgagcagcgtgaagaaaaggggtgtacttttgctcggagacgcctacaatatgcgccacccccttactggcggaggcatgaccgtagcctttaaagacattaaactgtggaggaaactgctgaagggcatcccagacctctacgacgacgcagccatttttgaagccaaaaagagtttctattgggcacgtaagacatcccatagttttgtggtcaatatccttgcgcaggccctgtatgagttattcagcgcgactgatgattccctgcaccagttacgtaaagcctgcttcttgtacttcaaactaggcggagaatgcgtcgctggtccggtgggacttttgagtgtcctgtcaccaaatcccctggtgttgatagggcacttcttcgccgtcgcaatatatgccgtttacttctgcttcaagagtgaaccgtggattacaaaacccagggccctgctgagctcaggagccgtactttataaggcctgtagtgtgatatttcctctgatttactctgagatgaagtacatggttcactag

SEQ ID NO: 242375 - DNA, 822 bp, Artificial Sequence
  Description of Artificial Sequence: Synthetic coding sequence
atgaaaaaaacccaaacgtggattttgacttgtatctatttgcagttgttactgttcaatccacttgtcaaaactgagggtatctgtcgcaaccgggtgaccaataatgtgaaggacgtgactaaattagtcgcaaatctacccaaagattatatgatcactctgaagtatgttccaggaatggatgtgctgcctagtcattgttggatctcagaaatggtggtccagctcagtgatagtctaacagacctcctagacaaattctctaatatcagtgaagggctgtctaattactctatcatcgataaacttgtcaatatcgtggatgacttggtggagtgcgtgaaggaaaattcgagtaaagacctgaaaaagagtttcaagagtcctgagccgcgactgtttacccccgaagaatttttcagaatttttaacaggtcgatcgacgctttcaaagactttgtcgtcgcctcagaaacctccgactgtgtcgtgtcatcaactctgagccccgagaaggatagtcgagtctctgtaaccaagccgttcatgctgccacctgtcgcagcatcaagtctcaggaacgattcatcgtcatccaatcggaaggctaaaaatccgccaggagactcttccctacactgggcagctatggcactgccagctcttttcagcctgatcattggttttgcgtttggtgctctctactggaagaagagacagccctcattgacccgggcagtggagaatatccaaatcaacgaggaagataacgaaatctctatgctacaggaaaaggaacgggaattccaggaagtgtag

SEQ ID NO: 242376 - DNA, 2100 bp, Artificial Sequence
  Description of Artificial Sequence: Synthetic coding sequence
atgagactgaggcgcttagggcaggggggtaggtgttatcgcggactgtggccactgaggcatactcgcccatggagtagcccgggtgaatacgagtgggagtatgacgaagaggaggagaaaaaccaactggagatcgagcgcctggaggaacaattgtccatcaatgtctacgactacaattgtcacgttgatctaattcgcctgttacgtctggaaggagagctgaccaaggtgcggatggcaagacagaaaatgagcgagatttttcccctgacggaggaattatggctggaatggttgcacgatgagatctcgatggctcaggacggacttgatagagaacacgtgtacgatctgtttgaaaaagcagtaaaagactacatatgcccaaacatctggttagagtatgggcagtactccgtggggggaataggccagaagggcggtctggagaaagttcggtcagtattcgaacgagcactgtccagtgtggggctgcatatgaccaaaggactcgcgctgtgggaggcctatcgcgagtttgagtccgccatagttgaggctgccagattggagaaagtgcactcattgttcaggcgccaactggcaatccctctgtatgatatggaggccacctttgctgagtacgaggagtggtctgaggacccgatcccagaatctgtgatccagaactacaataaggcattacagcaactggaaaagtacaaaccctacgaggaggctctactgcaggcagaggcgccacggctggcggaataccaggcatatatcgactttgagatgaaaatcggcgacccagcacggatccagctgatctttgaaagggccctggtggagaactgtctcgtgcctgatctgtggattcgctacagtcagtatttagatcggcagctgaaggttaaagacctggtcctatccgtgcacaatagagcgatcaggaattgcccctggacggtcgctctatggtcacgctatctgctagccatggaacggcatggggtggaccaccaggtgatttccgtgacttttgaaaaagccctcaatgcagggtttatacaggcaactgattacgtggagatttggcaggcctacttggactacctcaggcggagagtggactttaagcaggactcctcaaaagagctggaggagctgcgcgctgcattcactcgcgctttagagtatctcaagcaggaagtggaggaacggtttaacgagtctggggatccatcgtgtgtgattatgcagaattgggctagaatagaggccagattatgcaataacatgcagaaggccagagaattgtgggacagcattatgacccgcggaaacgctaaatatgccaacatgtggcttgagtactacaacctggaacgcgcacacggagacacccagcattgcaggaaggccctccatcgcgcagtccagtgcacgtccgactacccagaacatgtgtgtgaagtgttattgactatggagcggactgaaggctctttggaagactgggatattgctgtgcagaaaacagagacccgtctggcacgagtgaacgagcaacgtatgaaggcagccgaaaaggaagcagctctggtacagcaggaggaagaaaaggcagagcagcgcaaaagagccagggcagaaaaaaaggctctgaagaagaaaaagaagattagaggaccagagaagcgcggagcagacgaagacgatgaaaaagagtggggcgacgatgaagaagcctttcaaacacagaagggtcgcgaacaacacccatgtagctggcgtaataccaagtgcaggagctcctctagagcgcgatgggagatgtgctgcaggcgctgtggcgctccgtttgaagcagagggagagggctcgcttcctgaggagggccacgctcagggagccgctaggcagcagcaaggtcaacaccacaggctgtgccagcagccggcactgcagcatgctggcgctggccacgaggcccaggccacactgcggggtctttggggcggaggccctgacccaacccacctgcaacagccatggggattccctcgtttattgctgcgaggggtctag

SEQ ID NO: 242377 - DNA, 2784 bp, Artificial Sequence
  Description of Artificial Sequence: Synthetic coding sequence
atggcaaccgccgctgagacctcagcttccgagcccgaggccgaaagcaaggccggtcccaaagctgacggagaagaggatgaggtgaaagcggctcgcacccgacgcaaggtcttgtccagggccgtggccgctgcaacttacaaaactatgggaccagcctgggaccagcaggaggagggagtgagtgagtccgacggtgacgagtacgctatggcgtcaagtgctgagtcctcaccaggagagtatgagtgggaatacgatgaggaggaagagaaaaaccagttagagatagaacgcttggaggaacagttgagtatcaatgtgtatgactataactgtcacgtggacctcatcaggttactgcgccttgaaggcgagctgactaaagtgcgtatggccagacagaaaatgagcgagattttcccgctcaccgaggaactttggctggaatggctacatgatgaaatttctatggctcaagatggcctggacagagaacacgtatacgacctatttgagaaggccgttaaggactacatttgccccaacatttggctggaatacgggcaatacagcgtcggagggatcggccagaaagggggactagagaaggtgcgcagcgttttcgagcgcgctctctcctcagtggggctccacatgaccaagggcttggccctctgggaggcataccgtgagtttgaatcggccatcgtagaggctgcccgactcgaaaaggtgcactctctgtttcggagacagctggctattcctctgtacgacatggaggctacctttgctgaatacgaggagtggagcgaggaccctatcccagagagcgtgatccaaaattacaataaggccttacagcagctcgagaagtacaaaccatatgaagaggcattactgcaggcagaagcgcctcggttagcagagtaccaggcttatatcgatttcgagatgaagattggagaccccgcaagaattcaactaattttcgaaagagccttggtagagaattgcctcgtccctgatctctggatacggtattcacagtacctagatagacagctgaaagtcaaagatctggtgctgtcggttcataacagggcaatccggaactgtccttggacggttgcactgtggtctcggtacctcttagcaatggagcgccatggggtcgatcaccaagtgatcagcgactctagcaaggagcttgaggaactgcgggctgccttcacaagggcactcgagtatttaaagcaagaggtcgaagagcgattcaatgaaagtggggacccatcatgtgtcattatgcaaaattgggcccgaatcgaggcccgactgtgcaacaatatgcagaaggccagagaactgtgggatagtatcatgacacgtggcaacgctaagtacgcaaatatgtggctggagtattacaacctggaacgagcccatggtgatacacaacactgcagaaaagcattgcaccgtgctgtacaatgtacttctgactatccagaacacgtatgcgaagtcctgctgaccatggaaagaactgagggctcactggaggattgggatattgccgtgcaaaaaactgagaccagattagcgcgtgttaatgagcagcgcatgaaggccgctgagaaggaagccgctttagttcagcaagaggaggagaaagccgagcagcggaaacgagcaagggcagagaaaaaggccctgaagaagaagaagaagatccgcggacctgaaaagcggggagccgacgaggacgacgagaaagagtggggcgacgacgaggaagagcagcctagtaaaaggaggagagtcgagaactctattcccgctgccggagaaactcaaaacgtggaagtcgccgctggcccagctgggaaatgtgctgcggtggacgtcgagcccccttctaagcagaaggaaaaagctgctagcctcaagcgggacatgcccaaggttcttcatgattcgagtaaagacagcattacggtgttcgtctctaacctaccatattctatgcaggagcccgacacgaagctacggcctctgttcgaggcatgcggagaagttgtccagatcagaccaatcttttctaatcgcggagatttccggggatactgctatgtggaattcaaagaagagaaatccgctttacaggcgctggaaatggatcgcaaatcagtggaaggacggccaatgtttgtgtctccatgcgtagacaaatccaaaaatcccgactttaaagtattccggtattccacaagcctggagaagcataagctgttcatctcaggactgccattttcgtgtaccaaggaggagctggaggagatctgtaaggcccatggtacggtgaaggatctgcggttggtgactaaccgggctggcaagccgaagggtttagcatacgttgagtacgaaaacgagagccaggcttcacaggctgtcatgaagatggatgggatgactataaaggagaatatcattaaggtggcgatctctaacccgcctcagaggaaagtccccgaaaaacctgagactcggaaagctccaggtggaccaatgttgctgccacagacatacggggctcgcggaaaaggccgaactcagttgagccttctgcccagggcactgcaacgaccctccgcggctgcaccccaggctgagaacgggccagcggcagctcctgccgtggctgccccagcggcaactgaggccccaaagatgagtaacgctgacttcgctaagctttttctccgaaagtag

SEQ ID NO: 242378 - DNA, 1587 bp, Artificial Sequence
  Description of Artificial Sequence: Synthetic coding sequence
atggaacgacacggcgtggaccatcaggtgatcagcgattcgtccaaagagctggaagaattgcgggctgcatttacacgagctttagagtatcttaagcaggaggtggaagagaggttcaatgaatcaggcgatccgtcttgtgttataatgcagaactgggcaagaatcgaggctaggctttgcaacaatatgcaaaaggcccgagaattgtgggacagcattatgacgagggggaacgcaaagtatgccaatatgtggctggaatactacaatttggagagagcccatggcgatacccagcattgcagaaaggctctgcacagagcggttcagtgtaccagcgactatccagagcatgtatgtgaggtgcttcttaccatggaaaggacagaagggagccttgaggattgggatatagccgtgcagaagaccgaaacgcgactggcacgggttaatgagcagcggatgaaggctgcggagaaagaagccgctcttgttcagcaagaggaggaaaaggccgaacaaagaaaacgcgctagagcagagaaaaaggcactgaagaaaaaaaagaagatacgaggacctgaaaagcgaggagccgacgaggatgacgagaaagagtggggcgacgacgaagaggaacagccgtccaaacgacgtagggtggagaattccatccccgcagcgggtgaaacccagaatgtcgaggtggctgccggacccgcaggaaaatgtgctgccgttgacgtcgagcccccaagtaagcagaaggaaaaggctgccagcctcaaacgcgacatgcctaaggttctgcacgatagcagtaaggactcaatgcaggaacctgatacaaagctgagacctctcttcgaggcatgtggcgaggtggttcagattaggcctattttcagtaatagaggtgatttccgcggatactgctacgtggagtttaaggaggaaaagtctgctctgcaagccctggagatggatagaaagagtgtggagggccgaccaatgttcgtgagcccttgtgtggataagagcaagaacccagatttcaaggtgtttcgctactctactagcctcgagaagcataaactgttcatctccggcctgcccttcagttgcaccaaggaagagttagaggagatttgcaaggcccacggcactgttaaggatttacggctcgtcactaatcgtgccggaaaaccaaaggggctcgcctacgtggaatacgagaatgaaagccaggcgtctcaggccgtgatgaagatggacggtatgacaatcaaggagaacatcatcaaagtggcaatttccaatccaccacagcgtaaggtgccagaaaagcccgaaacccgaaaggccccaggtggccctatgctcctgcctcaaacttatggtgctcggggtaaaggcagaacccagctctcactactcccacgcgctctacagaggccttctgctgccgcacctcaggccgagaatggccctgctgcggctcccgctgtggctgcaccggctgctactgaggctcctaaaatgtccaacgctgacttcgccaagctttttcttcgtaagtag

SEQ ID NO: 242379 - DNA, 390 bp, Artificial Sequence
  Description of Artificial Sequence: Synthetic coding sequence
atggcaactgccgcagaaactagcgcctccgagccggaggcggagtctaaggccggaccaaaagcagatggggaggaagatgaggtaaaggcagcacgcaccaggcggaaagtgctctcacgagccgtagccgcagcgacctacaagaccatggggccagcttgggaccaacaggaggagggtgtctccgagtcagacggggatgagtatgccatggcttcctctgcagagagctccccaggtgaatacgagtgggagtatgacgaggaagaagaaaagaatcaactcgaaatcgaaagattggaagagcaggtcggccctggtgttggaagcgggcatctgcccgtctttcaggtgctggggagcccttgccctgggccacctccatag

SEQ ID NO: 242380 - DNA, 330 bp, Artificial Sequence
  Description of Artificial Sequence: Synthetic coding sequence
atggccgcatcggccgcacgcggtgcggctgccttgagacgctccattaatcaacccgtcgccttcgttcgacgtattccttggaccgctgcatcaagccagctgaaggagcacttcgctcagttcgggcacgttaggcggtgcatcctgccattcgacaaggagaccggattccaccggggactagggtgggttcagttctcatccgaggagggcctgaggaatgccctgcaacaggagaatcatatcatcgatggcgtcaaggtgcaggtccataccaggagaccaaaattgccacaaacttcggatgacgagaaaaaggacttctag

SEQ ID NO: 242381 - DNA, 894 bp, Artificial Sequence
  Description of Artificial Sequence: Synthetic coding sequence
atggcgaaatggctgaataagtattttagtttaggcaactccaagaccaagtcgcccccacagcccccaaggcccgactatagagaacaacgaagacgaggtgagcgtccctcccagccccctcaggcagtgccacaggcttcgtcagccgctagtgcttcatgtggacccgcaaccgccagttgcttttcagcctccagtggatctcttcctgacgatagcgggtctacctcagatttaattcgagcctacagggctcaaaaggaacgtgattttgaagatccctataatgggcctggctcatcccttcgcaaactgagggcaatgtgtcgccttgattattgtggcggttccggggagccagggggagtccaacgagcctttagcgcaagctctgcttcaggggcagccggttgttgttgcgcctccagcggggcaggcgctgctgccagtagtagctcctcatccggctccccccacctctatagatcaagtagtgagcgtcgacccgcaaccccagccgaagtgaggtatatttcacctaaacatagactcataaaagtagaatcagccgcaggcggtggagccggtgatcctttaggaggcgcttgcgcaggaggccgtacttggtctccaaccgcatgcggtggcaagaagttactcaacaagtgcgccgcatccgcggctgaagaaagtggagcagggaaaaaagataaggtgaccattgccgatgattatagcgatccctttgatgctaaaaatgaccttaagtccaaggccggtaaaggggagtccgccggatatatggagccttacgaggctcaacgcattatgaccggcctgcaagaagcatggagacactctcccagcggctgcttccccgtcggcccttag

SEQ ID NO: 242382 - DNA, 1530 bp, Artificial Sequence
  Description of Artificial Sequence: Synthetic coding sequence
atggccaagtggcttaacaaatatttcagcctgggaaattcaaagactaaatcgcctccacagccaccacgaccagattacagagaacagagaagacgcggagaacgtccttcacagccccctcaggcggttcctcaagctagttctgcagcctctgcaagctgtggccctgctacagccagctgtttctcagcatccagcggcagtctcccagacgactccgggtcgacgagtgatttaattagggcctacagagcacagaaggagcgggacttcgaagacccttacaatggccctggttcgtcacttagaaaacttcgcgctatgtgccggcttgactactgtggcggaagtggtgaacccggaggcgtccagcgcgctttctcggcttcttccgcaagtggggctgccggttgttgctgtgcatcttcaggagcgggtgcagccgctagctcatctagctccagtggtagtccgcacctgtatcgaagctcatctgaaagaagaccagctacacctgccgaggtccgatatataagtcctaagcacagactgattaaggtcgagagtgccgctggtgggggagcaggggaccccctaggcggagcctgtgctggcggaaggacatggagccctacagcttgcggtggtaagaagctgcttaacaagtgcgccgcaagtgcggcagaagagtccggggctggaaaaaaagacaaagtgactattgcagatgattactcagatcccttcgacgctaagaatgacctcaaaagcaaggcaggaaagggggagtccgctggttacatggagccctacgaggcccaaaggatcatgaccgagttccagcgacaggagtcggtccgtagccagcacaaaggtatccagttgtatgacacaccatatgaacctgaggggcagagtgtcgactctgactctgaaagcacggtaagcccccgtttaagggaatcgaaattaccccaggatgatgaccggcctgccgacgagtacgatcagccgtgggagtggaatagagttaccatccctgccctggccgctcaattcaatgggaacgagaagaggcaatcgtccccatccccctcgcgtgaccgcaggcggcagttgcgcgcacccggaggcggatttaagcctatcaaacacggctcgcccgaattttgcggtatccttggagagagagtggatcctgcagtgcccttggaaaagcagatttggtaccacggagcaatatctcggggagacgcggagaacttactgcgcctctgcaaagagtgtagttatctagttcgcaatagccaaacgtcaaaacatgactatagcctgtccctaaggtctaaccagggattcatgcacatgaaactggcgaagaccaaagagaaatatgtccttggccagaatagcccaccattcgactctgtccccgaggtcatccactactatacgaccaggaaattaccgatcaagggtgctgagcatctgtcgttactttacccggtagctgttcggacactttag

SEQ ID NO: 242383 - DNA, 1080 bp, Artificial Sequence
  Description of Artificial Sequence: Synthetic coding sequence
atgcaggcagctgctctacctgaagaaattcggtggctcctggaagatgccgaagagttcctcgctgagggtctgcgtaatgaaaacctgagtgcagtagcacgtgatcaccgcgaccacattctccgaggctttcaacagatcaaagctcgctactactgggatttccagccccagggcggagatattgggcaagacagtagcgatgacaatcacagtggtacattaggcctcagtttgactagtgatgcccctttccttagtgattatcaggacgaaggcatggaggatattgtcaagggagctcaggaattggataacgtgattaaacagggctacctagagaagaagagcaaggaccattctttttttgggtcagagtggcagaaacgctggtgtgtcgttagcagaggcttgttctattattatgcgaatgaaaagtccaaacagcccaagggcactttcctgattaagggctatggcgtgcgaatggcaccacacctccggagagactcaaagaaggagtcctgtttcgaacttacttctcaagatcggcgtagctacgagttcacggcaacaagccccgctgaggctcgggactgggtggatcaaatttcattcctgctaaaagatctgagctcactgaccattccctacgaggaagatgaggaggaggaagagaaggaggagacgtatgacgatattgacggcttcgatagtccctcttgcggctctcaatgtaggcctacaatcctgcccggatcagtgggcatcaaggagcctacagaggagaaggaggaagaggacatttacgaggtgctgccagacgaggagcacgatctggaggaagacgagtccgggacccgaagaaagggggtggactacgctagctattatcaaggcctatgggactgccatggcgaccagcctgacgaactttcctttcagagaggtgacttgatccggatactatctaaggagtacaacatgtatgggtggtgggtaggtgagctgaactccctggttggcatcgttcctaaagagtaccttactactgcctttgaggtcgaagaacgatag

SEQ ID NO: 242384 - DNA, 831 bp, Artificial Sequence
  Description of Artificial Sequence: Synthetic coding sequence
atgggcaattctatgaaatccactcccgctcccgctgaacgtcccctcccaaatcctgaaggattggacagcgactttctcgccgtgctgagtgattacccttcccctgatattagcccccctatcttccgcaggggagagaaactgagggtgatcagcgacgaggggggatggtggaaagcaatttccttgtccacgggacgggaaagctacatcccaggtatctgcgtggctcgagtataccatggttggttgttcgaagggctcgggagggacaaggcagaagagcttcttcagcttcccgatacgaaagtgggatccttcatgattcgtgagagtgagacaaagaagggcttctacagcttgtccgtcagacaccgtcaggtaaaacattaccgaattttccggttgcctaataactggtattatatatcccctcggctgactttccagtgcttggaggatttagtcaaccattacagtgaggtcgctgacggactgtgttgcgtactgacaaccccgtgcctaacgcagtcaaccgccgctcccgcagttcgcgcttccagcagccccgtgaccctgagacagaagacagtggattggagacgggtgtcacgtctgcaggaggatccagagggtactgagaaccctctgggcgtggatgaatctcttttcagctatgggctccgcgagtccatcgcatcatacctctctctgaccagcgaggataatacctccttcgatcgcaaaaaaaagtctatttctctcatgtatggaggtagtaagagaaagagctcatttttcagcagccccccatatttcgaggactag

SEQ ID NO: 242385 - DNA, 882 bp, Artificial Sequence
  Description of Artificial Sequence: Synthetic coding sequence
atgctgcatcggctttgggcgtcccccgctgcgcctggcaaaaaaaaagaaatgggcaattcaatgaaatccacccccgctcccgctgagcgtcctctgcctaaccctgagggactggactctgacttcctggcagtcctgtccgactatccaagtcctgacatttcccccccaatttttagacgcggtgaaaaactgagggtgatcagtgatgaaggaggctggtggaaggccattagtctatccaccggcagggaatcctacatcccgggaatctgtgtggccagggtgtaccacggatggctctttgaagggttggggagggacaaggcggaggaactgcttcagctgccagacacaaaagttggcagtttcatgatccgtgaatctgaaaccaagaagggcttctatagcctaagcgtccgtcacagacaagtaaaacactaccggatattcagattgcctaacaactggtactatatttccccacggctcacatttcagtgcctggaagacctggttaatcactacagcgaggtcgctgacgggttatgctgcgtactgaccactccgtgcctgacccagtcaaccgcagcacccgcagttcgggcatcctccagcccagtgacgctacgccagaagacagtggattggcgacgggtgagcagactgcaggaggaccccgagggcactgagaaccccctgggcgtggatgagagcctcttttcatatggacttcgggagtcaattgcttcgtatctttctctgacatcggaagataatacctctttcgacagaaaaaaaaaatctatatccctcatgtatgggggttccaagcgcaagtcaagttttttctccagtcctccctattttgaagactag

SEQ ID NO: 242386 - DNA, 951 bp, Artificial Sequence
  Description of Artificial Sequence: Synthetic coding sequence
atgctgagtaaattagggcacagtcctctaggcggtctcagagctcggctgacattcccggtgtgcctgctgtaccaccgcctatgggcctcccctgcagccccaggcaaaaaaaaagagatggggaatagtatgaagtctacacctgctcctgctgaaagacccctgccgaacccagagggtcttgattcagattttctcgcagtcctgagcgattaccctagcccagatatttcaccgcctatttttcgacgtggagagaaacttcgggtcatcagtgacgagggaggatggtggaaagccataagcctgtctaccggacgtgaaagctatatccctggtatctgcgtcgcaagggtgtaccacgggtggctcttcgaaggcctgggccgtgataaggctgaagagctcctgcagctccccgacactaaagttggatcattcatgataagagaaagcgagactaagaaaggattttacagcctgtccgtcaggcaccgacaggtgaagcactataggatctttcggcttcccaataactggtactatatctcccctaggctgaccttccagtgtctggaggacctagtaaaccactattctgaggtcgctgatggcttgtgttgtgtgttgacaactccgtgcctcacacagtccactgccgcacctgccgtgcgggcttcctcaagcccagtgaccctgcgccaaaaaacggttgactggaggagggtgtctcgactgcaggaggatcccgagggcaccgagaatccactaggagttgacgagagcttgttttcgtacgggctgagagaatctatcgcctcctaccttagcctgacatccgaggacaatacatcttttgaccgtaagaaaaagtcaatctctttgatgtacgggggttctaagcggaagtcgtcgttctttagttccccaccttacttcgaggactag

SEQ ID NO: 242387 - DNA, 276 bp, Artificial Sequence
  Description of Artificial Sequence: Synthetic coding sequence
atgggtaattctatgaagtccacccctgcaccggcagagcgacccctgcctaacccggaggggctggactctgacttcctcgctgttctgtctgactacccttcaccagacatcagcccgccaattttcaggagaggcgaaaagttgcgcgtgatctcagatgaggggggatggtggaaagcaataagtctctccaccggcagagagtcttatattccaggtatctgtgtcgcacgggtgtaccatggatggctgttcgaaggactggggcgttag

SEQ ID NO: 242388 - DNA, 45 bp, Artificial Sequence
  Description of Artificial Sequence: Synthetic coding sequence
atgggcaacagtatgaaatccacgcccgcacccgctgaaagatag

SEQ ID NO: 242389 - DNA, 150 bp, Artificial Sequence
  Description of Artificial Sequence: Synthetic coding sequence
atggggaattcaatgaaaagtactcctgcccctgcagaaagaccccttcccaatccagagggactggattccgacttccttgcggtcttgtccgactaccccagccctgacatatcccccccaatcttccgcaggggcgaaaagctgtag

SEQ ID NO: 242390 - DNA, 477 bp, Artificial Sequence
  Description of Artificial Sequence: Synthetic coding sequence
atgggaaattccatgaagagcactccagcccctgccgagcggcctttgccaaaccccgaaggcttggactcagatttcctggctgtgctgagtgattacccttctcctgatattagcccgccaatcttcaggcgaggagagaaactcagagtcattagcgacgaaggaggttggtggaaggcgattagtctgtctacagggagagaatcatacatcccagggatatgtgtggccagagtctatcacgggtggttattcgaaggcctggggagggataaggctgaagagctattgcagttaccagacactaaagtgggatcattcatgattcgcgagtctgagaccaaaaaagggttctattcgttgagtgtgcggcacagacaggtgaaacactatcgtatatttaggctccctaacaattggtattatatctcacctagactcactttccaatgtctcgaggacttggtgaactag

SEQ ID NO: 242391 - DNA, 123 bp, Artificial Sequence
  Description of Artificial Sequence: Synthetic coding sequence
atggggaattcaatgaagagcaccccggcacctgcagaacggcctcttcccaatcctgaaggcctggattctgactttctggcagtcctgtctgattatccttcccccgatattagtccgtag

SEQ ID NO: 242392 - DNA, 786 bp, Artificial Sequence
  Description of Artificial Sequence: Synthetic coding sequence
atgggaagtctgccttcaaggaggaagagcctgccttccccaagccttagctccagtgtgcaaggacagggacccgtcaccatggaggcagaacggtcaaaggccacggccgtcgccctcggatccttccccgcaggcggtccagccgaactcagtcttaggctcggggaaccgctcaccatcgtctctgaggacggtgattggtggaccgtgctgtctgaggtgagtggcagagagtataacattccatccgttcatgtcgctaaggtcagtcatgggtggttatacgaggggctcagcagggaaaaggcagaggaacttctgctgctccccggtaaccccggtggcgcattcctgatcagggagtcacagactcgtcggggtagttacagcttatctgtgcgtttgtctcgccctgcctcatgggatcggataaggcattaccgtattcactgtctggacaacgggtggttgtatatcagtcccaggctcactttccccagtctccaagcgctagtcgatcattattctgaattggccgacgatatctgttgtttgctcaaggagccatgtgttctgcagagggctgggcctttgccaggaaaagacataccgctccccgttaccgtgcaaagaaccccactaaattggaaggagctcgattcatcccttctcttctcagaagcggcaacaggcgaagaatcattgctgagcgaagggctacgcgagtctctctctttttatataagcctgaacgatgaggctgtgtctttagacgacgcttag

SEQ ID NO: 242393 - DNA, 633 bp, Artificial Sequence
  Description of Artificial Sequence: Synthetic coding sequence
atgggaagtctacccagtcgcaggaaaagtctcccctccccaagtctgtccagctccgtccaggggcagggtcctgtaacaatggaagccgaaaggtcaaaggcgactgcggtggctctcgggagctttcccgctgggggaccagccgagctctctctgcgccttggtgagccgctgaccattgtgagcgaagacggggattggtggacagtcctttctgaggtctctgggagagaatataatattccctctgtgcatgtcgcaaaggtaagccacggatggctgtatgaaggattgagtagggagaaagctgaggagctactcttgctccctgggaatcccggaggcgcattcctgatacgggagtctcagactcggagaggaagctacagcctatccgtgcggctttcccgcccagcctcatgggatcgtatccggcactaccgcatccattgtctcgataacgggtggctgtacatttcacctcgcttgacatttcctagccttcaagccctggtcgaccactattctgagggttggccagccccttggcagggttatacccctacctgtgattgtgcagaggatactacacagttggaaagagcagggcagctgcctcccgtcttctag

SEQ ID NO: 242394 - DNA, 3840 bp, Artificial Sequence
  Description of Artificial Sequence: Synthetic coding sequence
atgacattgaccgagagactgagagaaaagatcagccgggcattctataaccacggcctgctctgcgcaagctaccccatccccattattctcttcactggattttgtatcctggcctgctgttaccctttactgaagctgccattacctggaaccgggccagtcgaatttaccacacccgtcaaggattattcaccaccccctgtggactcggaccggaaacagggcgagcccactgagcaacctgagtggtatgtcggggcaccagtagcatatgtgcaacagatattcgtcaaaagctcggtgttcccatggcataagaacctgctggctgttgacgtgtttagatcaccactttctcgcgcattccagttggtggaggaaattcgcaaccacgtactgcgcgactctagtggaattcggagcctggaggaattatgcctccaggtgaccgatctcctgccgggtttgcgaaaattgcgcaacctgcttccggagcacggctgtctgctgcttagcccaggtaacttttggcagaacgactgggagaggtttcacgctgatcccgacatcattggaaccatccatcaacatgaacccaagaccttgcagactagtgccactctcaaggacttattatttggggttccaggcaagtactcaggagtaagcttgtatacccgaaaacgcatggtgtcctatacaattacactggtattccagcattatcacgcaaagtttctggggtctttaagggccagactgatgcttctccatccaagtcctaactgctccttgcgcgcagagtccctggtccatgtccacttcaaagaagagatcggcgttgccgagcttattccactcgtcactacttacattatcctgttcgcatacatctacttcagcactcgcaagattgatatggtaaaatccaagtgggggctggccctggctgccgtcgtgacagtgctgagcagcctcctcatgtcagtgggcctctgcactctatttggcctgactcctacactcaacgggggtgagatttttccgtatctagtcgtcgtcattggcctggaaaatgtcctggtgctgactaaatccgtcgttagcactccagtggatctggaagtcaaactacggatcgctcaaggtctgtcctccgagagctggtccattatgaaaaacatggctaccgagctggggatcatcctgattggatacttcactctcgtgccagccatccaagaattctgcctgttcgcggtggtaggtctcgtgtctgacttcttccttcaaatgctgttctttacgaccgtccttagtattgacatccgacgcatggagctagctgacctgaataaacgccttcctccagaggcctgcttgcccagcgccaaacccgtgggtcagccaacaagatacgagcgccaactggcagtgcgtccttcaacccctcacaccataacattgcaaccgtcttcgtttcgcaacctgcgactgcccaaacggctacgcgtggtgtacttcctggccaggactcggttggcccagcggttgattatggcaggcacagtggtctggatcggtatccttgtttacacggatcccgctggcctccggaattatttggctgcccaggttaccgaacagtcaccgcttggggaaggagcacttgcaccaatgccagtccctagcggcatgcttcctccctcccatcccgaccccgcattcagtatatttcctccagatgctcctaagctacccgagaaccagactagtccgggtgaaagccccgagagaggaggccctgcagaggtcgttcatgatagtcccgtccctgaggtgacatggggacccgaggacgaggaactgtggaggaaattgagtttcaggcactggccaaccctcttctcttactataatataacattagcaaaacgttacatttctttgctgcccgttatcccggtaactttgcggctgaacccccgtgaggcccttgagggacgtcatccacaggatgggcgaagcgcgtggcctccacctggaccaattcccgcaggccattgggaggccggtccgaaagggccaggaggagtccaggcccatggagatgtcacgttatacaaagtcgccgctctcggactggcgaccgggattgtcctggtgctgctgttgctgtgtctgtatcgggtgctgtgtccacgtaattacgggcaattgggtggcggaccaggcagacgcaggcgaggagagcttccgtgcgacgactacggctacgcccctccagaaacagagatcgtccctctggtgctacgcggtcatctcatggacatagagtgcttggccagcgatgggatgctcttagtaagctgttgtctagcaggacatgtgtgtgtatgggacgcacagaccggggactgcctaactcggatcccacgtcccggacgtcaacgacgggattctggagtgggcagcgggctcgaagcacaggagtcgtgggaacgcctgagcgatggaggcaaggctggacccgaagagcccggtgactctccacctctcaggcacagaccccgaggacccccaccaccttctctgtttggtgatcagccagaccttacttgtttaattgatactaactttagcgcccagcctcgatccagccagccgacccagcccgagcctcggcatagggccgtctgtggcagatcaagggactctccagggtacgattttagctgcctggtccaaagagtgtatcaggaagagggattggctgccgtgtgcacgcccgcattaaggccaccttcacccggacctgtcctgtcacaagcccctgaggatgagggaggctcccccgaaaaaggaagcccaagcctcgcgtgggcgccttctgccgagggatctatctggagcctggagttacagggtaaccttattgtggtgggccgatctagcgggaggctcgaagtttgggatgccatcgaaggagttctttgttgctcgtcggaggaggtgtcatctggcataaccgccctggtcttcctcgataaacggattgttgccgctcgcctgaatggcagcctggatttcttctcactcgagacccacaccgctttatctccactccaatttagggggacacccggtcggggttcaagtcccgcatccccggtctattcttcaagcgacacggtggcctgtcacctcacgcacaccgtgccctgtgcacaccaaaagcccattaccgccctgaaagccgcagcgggacggttggtgactggaagccaagaccataccttgcgcgtgttcagacttgaagactcttgctgtctcttcactctccaggggcacagcggcgcaattaccaccgtctacatcgaccagactatggtgctggcctcgggcggacaggatggagcaatctgtctgtgggacgtgctcacaggatcccgagtgagccacgtgtttgcccatcgaggcgatgtgacatctctcacctgtacaacctcatgtgttattagcagtggcctggacgatcttatctccatctgggatcgctcgaccggaattaaattctatagtatccaacaggacctaggctgtggagctagccttggagtgatctcagataatttactcgttactggcggacaaggctgtgtgagcttctgggatctgaactatggagaccttcttcagactgtgtatctgggcaagaacagtgaagcacagcccgcaaggcagatcctggtcctggataacgcagctatcgtgtgcaactttggctcagagctcagcttggtgtacgttccttcagtgttagaaaagctggactag

SEQ ID NO: 242395 - DNA, 2316 bp, Artificial Sequence
  Description of Artificial Sequence: Synthetic coding sequence
atgacgttgaccgaaagactccgagagaaaatctccagagccttttacaatcacggactgctgtgcgcctcttaccccatcccaatcattctctttaccgggttctgtatcctggcttgctgctaccccttactgaaactcccattacccggaaccggcccagtggagtttaccacgccagttaaggactactctcccccaccagtggattcggacaggaagcagggagagccaactgagcaacccgagtggtatgtaggcgcacccgtggcttacgtgcagcagatatttgtgaaaagctctgtgtttccttggcacaagaacttgctagctgtagatgtcttccgcagtccactgtccagggctttccagttagtcgaggaaataaggaaccatgtgttgagagactcctcaggtatccgttccctggaagagctttgtcttcaggtgacagatttgctgcctggcttgagaaaactgcgaaaccttctgcccgaacatggctgcctcctgctgtcgcctggaaatttttggcagaatgattgggagcgctttcacgcagaccccgacatcattgggacgatccaccagcacgagcccaaaacgctacaaacttctgccacactcaaagacctgctattcggcgtccccggaaaatactccggagtcagtctctatacacgcaaaaggatggtgtcctatacgatcaccttggtgttccagcattatcatgcaaaatttctcggctctctgcgtgcacggctgatgctgttgcaccctagccccaattgttcattgcgtgcagagagtctggtgcacgtgcatttcaaagaggaaatcggggtggctgagttgatcccgctggtcacaacctatattatcctgttcgcatacatttatttctcaacccgcaaaattgacatggtgaaatcaaaatggggactggcactggccgctgttgttacggtgctgagctctttactgatgagtgtggggctatgtacgctctttggtctcaccccaacattgaatggcggagagatctttccctatttggttgtcgtgatcggcttggaaaacgtgcttgtgttaactaaaagcgtggtttctacacccgtagatctggaagttaagttgcgaatcgcccagggtctatccagtgagagctggtccatcatgaagaatatggctactgagctgggcattatattgatcggctacttcacgctggtccccgctatccaggagttctgtctcttcgccgtggttggtcttgtctccgacttctttcttcagatgctgttctttaccaccgtgttaagtattgatattcgacgtatggagctggctgacctgaacaaaaggctccctcctgaggcttgcttgccctcagccaagcctgtaggtcagccaactcggtacgaaagatcttccggcaggctcgaggtgtgggatgctatcgagggcgtgctgtgctgcagcagtgaggaggtgagtagcggaatcacagcccttgtttttctggacaagcggattgtggcagccagactgaatggaagtttggattttttctccctggagacacatactgccctgagtcctttgcagtttcgcggaacgcccggtcgcggttcatctcccgcttcccctgtgtactcatctagcgacacagttgcttgccatctcacgcacacagtaccatgcgcccaccaaaaacccatcaccgctttgaaagcggctgcaggtaggctagttacaggatcacaggatcatacgcttagggtcttcaggctggaggactcttgttgccttttcacattgcaggggcattctggggcaatcactacagtctacattgaccagacaatggttctggcgtccggcggacaggatggcgcaatttgcctctgggacgttctcacaggctctcgcgtctcccacgttttcgcccaccgtggggatgtgacatcattgacgtgcaccacttcctgtgtaatcagcagcggtttggatgacttgatcagtatatgggacaggtcaaccggcatcaagttttactcaattcagcaggacctgggctgtggggcatcccttggtgtgatcagcgataacctcttagtaaccggcggacaggggtgcgtgtcattctgggacctgaattatggagatctgttgcagaccgtttacctggggaagaacagcgaagcacagccagcccgacaaattctggtcctggataatgccgctattgtgtgcaacttcggctcggagctctcactagtttacgttccttctgtgctggagaagttggattag

SEQ ID NO: 242396 - DNA, 2718 bp, Artificial Sequence
  Description of Artificial Sequence: Synthetic coding sequence
atgacactcaccgagagattgagggagaagatatccagagcattttacaaccatggtctcttgtgtgcctcttaccccattcctataattttgatcggttacttcactttggttcccgctatccaggagttctgcctatttgctgtggtgggcctggtaagtgatttttttttgcagatgctcttttttaccaccgttctgtcgatagacattagacggatggagttggccgacctcaacaagagattacccccagaggcgtgtctcccttctgcaaaacctgtgggccagcccacgagatacgagcgccagctcgccgtgaggccctctacaccgcacacaatcaccctgcagcccagctcgtttcgtaatctgcgcctgcctaagcgtttacgcgtcgtgtacttccttgctagaacccggctggcgcaacgactgattatggccggaaccgtggtgtggataggaattctggtctataccgacccggcaggtcttcgcaactacttggctgcccaggtgactgaacagtctcctctcggcgaaggagctctcgcacccatgccggtcccaagtgggatgttaccaccatcacatccagaccctgcattcagcattttcccacctgatgcacctaagctcccagagaaccagaccagtccaggtgaaagtccagaaaggggagggccagcagaagtggtccatgactcccccgtgccggaagtgacctgggggccagaggacgaagagctgtggcggaaattatcctttaggcattggcccacacttttttcatactacaatatcaccttggcaaagcgttacatttctctgctcccagtcatacctgtaacgttgcgtttgaatcctcgagaagccctggaaggacgccacccccaggatggtcgatctgcatggccccctccaggacccatcccagctgggcattgggaagcgggacccaagggacctgggggtgtgcaggcgcatggtgatgtgactctgtacaaagtcgccgcactggggttggccaccggtatagtgttggtcctcttgttgctgtgtctctacagggtgctgtgtccacgcaattacggtcaacttggaggtggcccaggcagacgccgtcgaggtgaactgccgtgcgacgactacggctatgcgcctcctgagacggagatcgtgcctttggtgctgaggggccatctcatggatattgagtgtctggcgagcgacggcatgttgctggtgagctgctgtctggccggacatgtttgtgtctgggatgcgcaaaccggggactgcctaaccaggattcccagacccggacagcgcagagattccggcgtcgggagtggtcttgaggcgcaggagtcttgggaaagactctccgatggcggaaaggctggcccagaggagccaggcgactcgccacctctgagacatagacctaggggcccacctcctccaagcctgttcggagaccaacccgacctcacgtgtctgattgacactaatttttcggcacagccaagatcatcacagcctacccagcctgaacctcgtcaccgcgctgtttgcggacggagccgcgactcaccaggatatgacttttcctgcctggtccagcgagtgtatcaggaagaaggcctggcagcggtgtgtacacccgcattgcggccacctagtcctggtccagttctttcacaggcgccagaagatgagggagggagcccggaaaagggcagtcctagccttgcttgggcccctagcgcagaaggaagtatctggtccctggagcttcagggcaatttgatcgtggtgggtagatcatctgggaggctcgaagtgtgggacgctattgaaggcgtcctatgttgtagttcagaagaggtcagctcagggatcactgcgttggtattcctggacaaaagaatcgtcgccgctcgcttgaatgggtccctggatttttttagcctagagacccacacggcactttccccactccagttcaggggcaccccgggtcgtggaagttccccagcctcgcccgtttactccagcagcgataccgtggcctgccatctgacccatacagttccatgcgcccaccagaagcctatcactgcgcttaaagcagctgccggacgcctcgtgaccgggtcccaggaccacacgctgcgcgtatttaggctggaggacagctgctgcttgttcaccctgcagggtcacagtggcgctatcacaacggtctacatcgaccaaacaatggttttagcatcaggaggacaggatggagcgatttgtctgtgggatgtgttgacagggtcccgcgtctctcatgtctttgcgcaccgcggagatgtgactagtctcacctgcacaacctcatgcgttatcagcagcgggctggacgacttgatctctatttgggatcggagcactgggataaaattttactccattcaacaagacctgggctgtggggcttcactgggagtcattagtgataatctgctagttaccgggggacaaggttgcgtatctttctgggatctgaattatggggacctgctacaaacagtgtacctgggtaagaattccgaagcccagccggctagacagatccttgtattggacaacgcggcaatcgtgtgtaattttggttcagaactgtctctcgtttatgtgccctctgtgttagagaaattagactag

SEQ ID NO: 242397 - DNA, 1059 bp, Artificial Sequence
  Description of Artificial Sequence: Synthetic coding sequence
atggtcaaatctaagtggggccttgctttggccgcagtcgtgaccgtgctttcgagcttgctgatgagtgtagggctctgcacattgtttggccttacccctaccctgaacgggggagagattttcccgtacctcgtggtggtgattggccttgagaatgttctggttttaacaaaaagcgtggtgagtacccctgtggatctggaggtgaaactgcggatcgctcagggcctgtcttccgagtcctggagtattatgaagaacatggcgactgagcttggaattattctgattggctattttaccctggttcccgctatacaggagttttgtcttttcgccgtggtcggactggtgagtgacttcttcctgcagatgctattcttcaccacggtcttgtctatcgacatccggagaatggagttagccgaccttaataagcggctgcctcccgaggcgtgcttgccctctgcaaaacctgtcgggcagcctacaagatatgaacgccagttggccgtgcggccatcgactccacacacgatcacattgcaacctagtagctttaggaaccttcgccttcccaagcggcttcgggtcgtgtattttctagcccctacaggagcgcacacctgttgggccttgggatccagaacgcaaggcccaagatggggagccggaccttggcggcgacatgccgtgcaggggggtggggctggacccggacacaggcaccggcttggggctgccgcagcactgccattaccaagagctatgcctgctcagcttagggccgcagggtggtgggccagggctgcggaagccaggggggctgcgttaaggcgtctgagattgtgcgctactcgcgacggtgaccgcgcagcctgtgccgctcgtccgcctcacggtcaccgagtcccgggacagagaaggcacgctgccggtgaactccttcctggtagacctagacttagagttggcagagctgacaggggtctgccaaatgcccactcagccccaaggcaagcggcaccagggcagtggaggggacaacgtgcatag

SEQ ID NO: 242398 - DNA, 411 bp, Artificial Sequence
  Description of Artificial Sequence: Synthetic coding sequence
atgactctgactgaacggctgagagagaagataagccgagccttctacaaccacggtctactttgcgcatcttacccgatcccgatcatcctgttcaccggattctgtatcctggcatgctgctatccgcttttgaagctaccactgccgggaaccggacccgtggagttcactactcctgtcaaagactactctccccctcccgttgatagcgatcgtaagcaaggagaacccacagagcaaccagaatggtatgttggggctcctgtcgcctatgtgcagcagatcttcgtcaaatccagtgtgttcccttggcataagaatctccttgcggtggacgttttcagaagccctctcagccgcgctttccagctcgtagaagaaattcggaatcatgtcttgcgggactag

SEQ ID NO: 242399 - DNA, 3072 bp, Artificial Sequence
  Description of Artificial Sequence: Synthetic coding sequence
atgctgctgcacccctcccccaattgcagtctgagagccgagtcgctggtgcacgtccactttaaggaggaaattggcgtagccgagctcatccccttggttactacttacattattctgttcgcttatatctacttctctaccagaaaaatcgatatggtaaagtccaaatggggcctggcgttggcagccgtggtgacagtgttatctagccttctgatgtccgtaggtctgtgcaccctattcggactcacacccaccttgaatgggggtgaaatcttcccatacctagtagttgtcatcgggttggagaacgtgcttgtcctcacaaaaagcgtggttagcactccagtagatctggaggtcaaattacgcattgcccagggcttaagcagcgagtcgtggtcaatcatgaagaatatggccacagaattagggataatactgatcggttatttcactctggttccggctatccaggagttttgcctgtttgccgttgtcggtctggtctccgatttctttttgcaaatgcttttttttaccacggttctgtctattgacattaggagaatggaacttgccgacctcaacaagcggctgcctccagaagcatgccttccttccgcaaaaccagtggggcaacctactcgttacgaaagacaattagctgtgcgcccaagcacgccccatacaatcaccctgcaacccagcagcttccggaacctgcgtttaccaaagcgattacgagtggtgtatttcctggcacggacaagactggcccagcgcttgattatggccggtaccgtcgtgtggatcggtatcctcgtctacaccgatccagccggactgcggaattaccttgcagcccaggtcacggagcagagtccacttggcgagggcgcactggctcccatgccagtgcctagtggaatgctgcccccttcccatccagaccccgctttttcaattttccctcctgacgcacctaagctgcctgagaaccagactagccctggggagagtccagagcggggaggacccgcagaggtggttcacgacagcccagttcccgaggtgacgtgggggcctgaagacgaggaactttggagaaaacttagctttaggcactggccaacactgttctcctactataatatcaccctggccaagcgctacatctccctgttacccgtaataccagtcacgcttcgtttgaaccctcgcgaggcactggaggggaggcacccacaggatggtcgcagcgcctggcctcctcccggaccaatacctgccggtcactgggaagccggtcctaaaggaccagggggagtgcaggcgcacggtgatgttacactgtataaagtcgcagctctcggcctggctactgggattgtgctagttctgctcctcttgtgcctatatcgagtcctttgtcctcgtaactacgggcaattaggaggcggacctggcagacgccgacgaggggagttgccttgtgacgactacggttacgctccaccagaaactgaaattgtgccactcgtgttgcgtggccacttaatggatatcgaatgcttagcttccgacggaatgctgctcgtctcgtgctgtctagccggtcacgtctgcgtctgggatgcacaaactggggactgtctcaccagaattccacggccaggccagcgcagagacagcggggtgggatctgggctcgaggctcaggagagctgggaacggctctcagatggcggaaaggcaggtccagaagaacccggagacagtcctccactgcgacaccggccacggggacccccacctccctctctcttcggtgatcaacccgatctcacttgtctgattgatacaaatttcagtgcacagccccgatcctctcagccgacccaacctgaaccccgtcatagagctgtctgcggaagatcgcgtgactcccctggttatgatttttcttgcctcgtacaaagagtgtatcaggaagagggtttggctgccgtttgcacgcccgcactccgacctccctccccaggaccagtgctctcgcaggccccagaggatgaaggtggttcacccgaaaagggcagcccttcactcgcctgggctcccagtgctgagggaagtatttggtccctggaactgcagggaaatctgatagtggtgggtcgctctagcggccgtctggaagtgtgggacgcaattgagggagtactgtgctgtagcagcgaggaggtgtccagcgggattacagcactggtgtttttagataaacggatcgtagctgcaaggctgaacggatcgcttgatttcttcagcttggagacccacacagccctctctccgcttcaattcagaggcactcctggtcgcggttcttctcccgcatccccagtgtacagtagcagcgatacggttgcatgtcaccttactcacacagtgccatgtgcccatcagaaaccgattacagcccttaaggctgcagcagggaggctggttaccggttcccaggaccataccctgcgtgttttccgactagaagatagctgttgtctcttcaccctgcagggccactccggagccattactaccgtctacattgatcagaccatggttttggcctctggcggacaggatggagcaatatgtctatgggacgttcttacaggttcacgggtgtcacatgttttcgcccaccgtggggacgtgacttctcttacttgtactacgtcatgtgtaatatcaagtggtctagacgatttgattagtatttgggaccgaagcacaggaataaagttttattcaatccaacaggatctcggctgcggagctagccttggagtgatctccgataatctgctggtgacaggcggacaaggctgcgtcagcttctgggatttgaactatggggatctgctgcagacagtgtatttgggtaagaattccgaggcccagcctgccaggcagattttggtgctcgataatgcagctattgtttgcaactttggatcagaactctcgctcgtatacgtcccttcagttctcgagaagctcgactag

SEQ ID NO: 242400 - DNA, 267 bp, Artificial Sequence
  Description of Artificial Sequence: Synthetic coding sequence
atgaccctgactgaaagactgcgggagaagataagcagggccttctataaccatggccttctgtgcgcgtcttaccctattcccatcatacttttcactggtttttgcatccttgcatgttgttaccccctgttgaaactgccactcccgggtaccggtcctgtggaatttaccaccccagtcaaggactactccccgccaccagtagactctgatcggaaacagggagagccaaccgagcaacccgaatgggtgggcactcgctag

SEQ ID NO: 242401 - DNA, 399 bp, Artificial Sequence
  Description of Artificial Sequence: Synthetic coding sequence
atgaccctgactgagcgcctcagagaaaagatctctcgtgccttttacaaccatggcctgctttgtgctagttaccccatccccataatactgtttactggcttttgcatactggcttgctgctacccactgttgaaattaccattgcccggaacaggaccagtggagttcaccacccctgtcaaagactactcacctcccccagtggacagtgaccgaaaacagggtgagccgaccgagcagcccgagtggtacgtgggtgctcccgtagcttacgtccagcagattttcgttaaatcgagcgtgtttccatggcataaaaacctgctcgctgtcgacgtcttcagaagccctctgtcccgagcctttcaattggtagaggaaattcgcaatcactag

SEQ ID NO: 242402 - DNA, 2661 bp, Artificial Sequence
  Description of Artificial Sequence: Synthetic coding sequence
atgaagaacatggccactgagctgggtatcatcctaatcggatacttcactctcgtccccgctatacaggaattttgcttgtttgcagtggtgggacttgtaagtgatttttttctccagatgctattttttactacagtgctgtccattgacatccggaggatggaattggcggatttaaacaagcgtcttccgcctgaggcgtgcctgccgtctgccaagcctgtagggcagcccacccgatatgagaggcagctggcagtccgcccaagcactccccacactataacactacaaccttcctcttttagaaatctcaggctgccgaagagactccgtgtggtctacttcctggccaggaccaggctggcacagaggctgataatggcaggcacagtggtctggattggtattttagtctataccgaccctgctgggttaagaaattatctggccgctcaggtgacggagcagagtcctctgggcgaaggtgccctagcccctatgcccgttccctctgggatgctgccgccatcccatcctgatccagcattctccatctttccaccagatgcacctaaactgccagaaaaccaaacaagtcccggagaatcacctgagaggggaggccctgctgaggtggtgcacgatagccccgtgcctgaggtcacgtggggacccgaagacgaagagctgtggcgaaagctcagtttcagacactggcccaccctctttagctactacaacatcactttagcgaaacgatacatatctctgctgcctgttatcccagtgaccttgcggctcaatccaagggaggccttggaaggcaggcacccccaggacggtagatccgcttggcctccaccaggcccaattcctgctggccattgggaagccggacctaaaggccctgggggtgttcaggcccacggagatgtaacactgtacaaggttgccgcactcggactcgccacaggaattgtgctggtgctcctgctgttatgcttgtaccgcgtgctgtgccctcgcaactacggccagctcgggggaggccctggtcgacgtcggcgtggagagcttccatgcgatgactacggatacgcccctcccgagactgagattgtgccattggtgctccgaggccatttgatggatattgagtgccttgccagcgacggtatgctcctcgtcagctgctgtcttgctgggcacgtatgcgtgtgggatgcgcaaactggggactgtctgactcgaatcccaagacccggacaaaggagggacagcggcgtggggtctggacttgaggcgcaggaaagttgggaacgactcagtgacggcggtaaggcaggccctgaggagcccggagacagccctcccctgcggcataggcccaggggtcctccacccccatcattgttcggggaccaaccagacttgacctgcctgattgatactaacttcagtgctcagcccagatctagccagcctactcaacctgagccccgacatcgcgcagtgtgtggtcggagtcgcgacagccctggctacgatttttcatgcctggttcagcgtgtctaccaggaggaaggcctggccgctgtatgcactcccgcactaagacctcccagccccggtcccgtgctgtctcaggcgcctgaggacgagggcggtagccccgaaaaaggatcccccagcctggcgtgggccccttcagccgaagggtctatctggtcgttagagctgcagggcaatctaattgtggtaggaaggtcaagcgggaggttggaagtgtgggacgccattgagggtgtgctgtgctgttcatcggaggaggtatcctccggcattactgccctggtgttccttgacaaacgcattgtggctgcaagactgaatgggtcccttgacttcttctcactggagacacatacggccttaagtcctctgcagtttaggggcactccaggtagaggctcctctccggcaagtccagtttacagcagttctgatactgtcgcctgtcacctgacacacaccgtgccctgcgcccatcagaaacctatcaccgcccttaaagcagccgcagggaggttggtgaccggctctcaggatcataccctcagggtgttccggctggaggacagttgctgtctgttcacactgcaaggccactccggcgctattaccactgtctatatagatcaaactatggttctcgcaagcggtgggcaagacggcgcaatttgtctgtgggacgtgctgacaggctcccgggtgagtcacgtattcgcacatcggggagatgtcacaagcttaacctgcacaacttcatgcgtgatctcgtcaggactggacgacctcattagtatttgggataggagtactggtatcaaattctactccatccagcaagatttggggtgtggggcttcgcttggcgtgatcagcgataacctgctcgtgacgggaggacagggttgcgtgagtttctgggatctgaattacggggatctccttcaaacagtgtatctcggtaaaaactctgaagcccagccagcccgacagattctggtgctggataacgcggcaatcgtttgtaactttggaagcgaactgagcttggtctatgtgccctcggtcctggaaaaactggactag

SEQ ID NO: 242403 - DNA, 792 bp, Artificial Sequence
  Description of Artificial Sequence: Synthetic coding sequence
atgctgttagcctgggtgcaggctttcctggtgtctaacatgcttttggccgaggcttacggtagcggtggatgtttctgggataatggacacctctaccgcgaggaccagacttccccagcccctggcctgaggtgtttaaactggctggacgcccagtccggacttgcgtcagctcccgtgagcggcgcaggcaaccattcctactgccgtaaccctgacgaggaccctcgcggtccttggtgctatgtgagtggggaggccggagtccccgaaaaacgaccctgtgaagacttacgatgtccggagaccaccagtcaggcgctgccggcttttaccaccgagattcaagaggccagcgagggtccaggagcagacgaagttcaagtttttgctcctgctaacgccctgcctgccaggtctgaggctgccgcagtgcagccggtgatcggaatctctcagagagtcaggatgaactccaaggagaagaaggaccttggaactttgggatacgtgctgggcattaccatgatggtcataatcattgctattggcgctgggatcattcttgggtattcttacaagaggggcaaggacttaaaggaacagcacgatcagaaagtctgcgagcgggagatgcagagaattacattgccattgagcgcttttactaatccgacctgcgagatcgtagacgaaaagactgttgtcgtacacacaagtcaaacacccgtggacccgcaggagggaacaactcccctgatgggtcaggcaggcacccctggagcatag

SEQ ID NO: 242404 - DNA, 1176 bp, Artificial Sequence
  Description of Artificial Sequence: Synthetic coding sequence
atgtactctatgatgatggagaccgacctgcactctcccggaggggctcaggctcctaccaacctgtcaggaccggcaggagctggcggaggcggtggcggagggggaggaggcggaggcggaggaggcgcaaaagccaaccaggatcgcgttaaaaggcccatgaatgccttcatggtctggagtaggggccagaggcgcaaaatggctcaggagaatcctaagatgcataacagcgagatttctaagaggctgggggcagagtggaaggtgatgtccgaggccgagaagaggccgttcatcgatgaggccaagcggctccgggctctgcacatgaaggagcatccagactacaaatatcgcccacggaggaagaccaagaccttgctaaaaaaggataagtattcactggcgggtggtctccttgcggcaggggcaggaggcggtggggcagccgtagctatgggagtcggtgttggagttggtgctgctgctgtgggccagcgcctggaaagcccgggtggagcagctggagggggatacgctcacgtgaacggctgggcaaacggcgcttatcctggatctgttgccgcagccgcagctgccgcagccatgatgcaagaagctcagctcgcttatggccagcaccctggcgcagggggagctcatccacatgcccacccagcacatccacatccgcaccacccacatgcccacccgcataacccgcagcctatgcaccgctacgacatgggcgctctgcagtactctcctatttccaactcccagggatatatgtccgcttccccgtcaggctacggcggtctgccatacggggctgccgctgccgcagctgctgcagctggcggagcgcatcaaaactctgccgtagctgcagccgcagctgccgcagccgcttcctccggtgccctgggtgcacttggttctctggttaaatccgagccatccggatcgccacccgcaccggcacactccagggcgccttgccccggtgatttacgggagatgattagtatgtatctgccagcaggcgagggaggtgatcctgcagctgcggctgcagccgctgcacaatctcgtctgcactctctgccacaacattaccagggcgctggggcaggagttaatggcacagtcccccttacccatatatag

SEQ ID NO: 242405 - DNA, 1326 bp, Artificial Sequence
  Description of Artificial Sequence: Synthetic coding sequence
atggtgcaacaagcagagtcactggaggccgaatctaatctgcccagagaagccttagacactgaagagggtgaatttatggcctgctcacccgtcgctctcgacgagtctgatccagattggtgtaagacagcctccggacatataaagaggcccatgaacgcttttatggtgtggtccaagatcgaacggagaaaaataatggagcaaagtcccgacatgcacaatgctgagatttctaaaaggctggggaaacggtggaaaatgcttaaggattcagaaaagatacccttcatacgcgaggccgagagactgagactcaagcacatggcagactatccagactataagtacagacctaggaaaaagcctaaaatggacccatctgccaagccatctgcctcccagtctccagagaagtctgcagcagggggagggggtggctccgccggaggcggagccggaggcgctaagaccagtaaaggtagctcaaaaaaatgcggaaaactcaaggctccggcagcagcaggagccaaggcgggagctggaaaagccgcacagtctggtgattatggaggggctggagacgactacgtgttgggctctcttcgcgtgtccggctctgggggaggcggtgctggtaagacggttaagtgtgtctttttggatgaggacgacgacgacgatgacgatgacgatgagctgcagcttcagattaagcaggagccggacgaggaagatgaagaacccccacaccaacagctcctccaaccccctgggcagcagccatctcagctcctcaggcgctataacgtggctaaggtgcccgcaagccctacgctcagctccagcgctgaatcgcctgagggcgcttccttgtatgacgaagtacgagccggagccacatccggagcgggtggaggtagccgcttgtactattcgtttaaaaacatcactaaacagcatccaccaccactggcacaaccagcactgagcccagcatcctctaggtcagttagcacatcttcgagcagcagctctggttcaagcagcgggagcagcggtgaggacgcagacgatctcatgttcgatctctcgctcaatttctcacaaagtgcccacagcgccagtgagcagcagttaggcggaggggctgcagctggtaacctcagtctgagcctcgtggataaagatctggactctttcagtgagggctcgctcggaagccacttcgaatttcctgactattgcacgcctgagctgtccgaaatgattgcaggtgactggctggaggccaatttcagcgacttggtctttacctattag

SEQ ID NO: 242406 - DNA, 948 bp, Artificial Sequence
  Description of Artificial Sequence: Synthetic coding sequence
atggttcagcagcgaggagccagagccaagcgagatgggggtcccccacctccaggacccggacctgcagaggaaggagccagggaacctggctggtgcaaaactccttctgggcatattaaacgcccaatgaacgcatttatggtatggagccaacacgaacgccgtaagattatggatcaatggcctgacatgcacaacgccgagatcagcaaacgactgggcagacgctggcagctgcttcaggattccgagaagattcccttcgtccgggaggctgagcggctgcggctgaaacacatggcggactatcctgactataagtataggccacgcaagaagagcaaaggcgctcccgcaaaagcgagaccccgtcctccaggagggtctggtggcggaagtcggcttaagccaggtcctcagctgcctggacgtggaggcaggagggcagcgggaggccctcttggtggaggggcagctgctcccgaggatgacgatgaggacgatgatgaggagctgctggaggtcaggcttgttgagacacccggacgcgaactttggaggatggtccctgcagggcgagcagccaggggccaggccgaacgggctcagggtccttccggggagggcgctgctgccgctgcagcagcgtcacccacaccgtctgaggacgaagaaccagaggaggaggaagaggaggcggcagcagcggaagagggtgaggaagaaactgtggcatcaggcgaagagtctcttggatttctatcaaggcttccacctggtcccgctgggctcgactgtagtgcactggatcgcgacccagatctgcagcctccgagcggcacttcacactttgaatttccagattactgcacgcctgaagtcacagaaatgattgcaggtgactggagaccctcctctatcgccgatctggttttcacgtactag

SEQ ID NO: 242407 - DNA, 948 bp, Artificial Sequence
  Description of Artificial Sequence: Synthetic coding sequence
atggtccagcagcggggagccagggcaaaacgagacgggggaccccctccccctggacctggacctgctgaggagggcgctcgggagcctggatggtgtaaaacccctagcggccacataaaacgcccaatgaatgcattcatggtgtggagccagcacgagaggcgaaaaataatggatcagtggcccgacatgcacaatgccgaaataagtaagcgtcttgggaggcggtggcaactccttcaggactccgagaagattcccttcgtcagagaggctgagcgcctccgcctcaaacacatggcagactatcctgattataaatacaggcctaggaaaaaaagcaaaggagcgccagccaaggcgcgaccccgtccaccaggcggaagtggtgggggatctagactgaagcctggccctcaactgcctggtagagggggtagaagagccgcaggtggcccactggggggtggcgctgccgctccagaggatgatgacgaagacgacgacgaagagctcctggaagtgcgccttgtggagactcctggccgagaactatggcgcatggtccctgccggtcgggcagcgagagggcaggccgagagggcccagggacccagcggcgaaggagctgccgcagctgcggcagccagtcctacccctagtgaggacgaggaacccgaggaggaggaagaggaagcagccgcagctgaggagggcgaagaagaaaccgtcgctagtggcgaggaatccctcgggttcctgtctcggctgcctccgggacctgccggtctggattgctcggctctggatagagatcccgatttacagcccccatcagggacatcgcatttcgaattcccagattattgtacacctgaggtcacggagatgatcgcgggagattggcgtccatcttctattgccgacctggttttcacctattag

SEQ ID NO: 242408 - DNA, 1869 bp, Artificial Sequence
  Description of Artificial Sequence: Synthetic coding sequence
atgtcaatgcgaagccctatctcagcacagctagcattagacggagtgggcaccatggtcaattgcaccataaagtcagaggaaaaaaaggagccttgtcacgaggcaccccagggtagtgcaactgccgctgagccacagcccggagatcccgcacgggcttcccaggattcagctgaccctcaggccccagcgcagggtaacttccgagggtcatgggattgcagtagccctgagggcaacggctcccccgaacctaaacggcctggggtgtccgaagcagcctctggatcccaggagaaacttgatttcaacagaaacctcaaggaggtcgttcccgctattgaaaaactattgagctcggactggaaggagcggtttctgggcagaaacagcatggaagccaaggacgtcaagggaacacaagaatccctggccgaaaaagaacttcaactcctggtgatgatacatcagctcagcacattgcgcgaccagctcttaactgctcactctgagcagaaaaacatggctgcaatgctgtttgagaagcagcaacagcagatggagctcgccaggcagcagcaagagcaaattgctaagcagcagcagcaactgattcaacagcagcacaagattaacctgctccaacagcagatacagcaggtcaatatgccttatgtgatgattcccgctttcccccctagccaccagccgctgccggtgacccccgacagccagcttgctcttccaattcaacccattccttgcaagccggtcgagtatccacttcaactgttgcattccccccctgctccagtggtaaaacggccaggtgccatggccacccaccaccctctgcaggagccttcccagcccctgaatctcacagctaaacctaaagcacccgagctgcccaatacttcaagttctcctagcttaaagatgagtagctgcgtgcctaggcctccttcacatggagggccaactagggacctgcagagctctccgcctagccttcctctcgggttcctcggagaaggcgatgcagtcacaaaagcgatacaggatgcgcgtcagctgctgcactcccacagcggggcacttgacggttcccctaacacccctttccgcaaggaccttatctctcttgatagttccccagccaaagagcgcctcgaggacggttgcgtccatccactcgaagaggccatgcttagctgcgatatggatggaagtcgtcacttcccagaatcaagaaactcttcccacatcaaaagacccatgaatgcgttcatggtgtgggcaaaggacgaaagacgaaaaatcttgcaagcattcccggacatgcacaactcctcaatcagtaagattctgggctccaggtggaaatccatgacgaaccaagaaaagcagccttattatgaggagcaagctaggcttagtcggcagcacctcgaaaagtaccctgactacaagtacaaaccaagacccaagcgtacctgcattgtggaagggaagcgcctgcgagttggcgagtataaggctctgatgcggaccagaagacaggatgccaggcagagctacgtgatacccccacaggcagggcaggtgcagatgtcttcttctgacgtgctgtatcctagagccgctggcatgcctctggcccagcctcttgtggagcactacgtgccccgaagccttgaccccaacatgcctgtgatcgtgaacacctgcagtctccgcgaagaaggggagggtacagacgatcggcactcagtggctgatggggaaatgtatagatattcggaggacgaggattccgagggagaagaaaaaagcgatggtgagctggtggtcctcacagattag

SEQ ID NO: 242409 - DNA, 174 bp, Artificial Sequence
  Description of Artificial Sequence: Synthetic coding sequence
atgagcatgcggagccccatatcggctcagctggcccttgacggcgtgggaacaatggtgaactgtacaatcaagagcgaggaaaaaaaggagccctgtcatgaggccccacagggtagcgctaccgccgctgaaccccagccaggcgaccccgcacgtgcctcgcaggattag

SEQ ID NO: 242410 - DNA, 543 bp, Artificial Sequence
  Description of Artificial Sequence: Synthetic coding sequence
atgtcaatgaggtccccaatttcagcccagttagctttggacggtgtggggaccatggtgaactgtaccatcaaaagcgaggaaaaaaaggagccgtgccatgaggcaccacaggggtcagcaacggcagcggaaccccaaccaggggacccggcacgggcatcccaagacagcgctgacccccaagccccagcacaagggaattttcgcggttcatgggactgtagctcacctgagggaaatggcagcccggaaccaaagcgcccaggagtgagtgaggctgcctcaggatcccaggaaaagcttgatttcaatagaaatttaaaggaagtggtcccagcaattgagaaactgctatcttcggattggaaagagcgttttctgggcaggaatagcatggaggccaaagatgtgaaggggacccaagaatcactcgccgaaaaggagcttcagcttcttgttatgatccaccagctgtcgactttgagagaccaattacttaccgcgcactcagagcagaagaacatggcagctatgctgtag

SEQ ID NO: 242411 - DNA, 723 bp, Artificial Sequence
  Description of Artificial Sequence: Synthetic coding sequence
atgagcaagcctagcgatcacataaagcggccaatgaatgcatttatggtatggtcccgcggtcaacgaagaaagatggcccaggagaaccctaagatgcacaattctgaaatcagtaagaggcttggggctgaatggaagctgcttagcgaggcagagaagcggccatacattgacgaggcaaagaggctccgagctcagcacatgaaggaacacccagattataagtaccgccctcgcaggaagccaaagaacctgctgaaaaaggaccgctacgtgtttcccctgccttacctcggcgataccgatccactgaaggctgctgggctgcccgtgggcgcaagtgatggtctcctgagtgcaccagagaaggctcgtgccttcctgcccccagctagcgctccatactccctcctggatcctgctcagtttagctcctccgccatacagaaaatgggcgaagtgccccacacactcgccaccggcgctctgccttatgcatctaccctggggtaccagaatggagcatttggttccctgtcctgcccatctcagcacacccatacacacccatcacctacaaacccgggttacgtggtcccatgtaactgcactgcttggtctgcgagtacactgcagccccctgtcgcgtatatcctgttccctggaatgacgaagaccggaatcgacccttatagctctgcccacgccaccgccatgtag

SEQ ID NO: 242412 - DNA, 702 bp, Artificial Sequence
  Description of Artificial Sequence: Synthetic coding sequence
atggcccttccaggcagcagccaggatcaggcttggtccttagagccgccagctgcgacagctgccgcatcttcatcctctggccctcaagaaagggagggagccggatcccccgctgcccctggaaccctccctttggaaaaagtgaagagaccaatgaatgccttcatggtctggagtagcgcacagcgcaggcagatggctcaacagaaccctaagatgcacaacagcgaaatcagcaagaggctgggcgcacagtggaagctgcttgacgaggatgaaaaacggcctttcgtagaggaggcaaaacgactccgcgcacggcacctacgcgattatcccgattataaataccgccctcgcaggaaagctaagagcagtggcgcaggtccatcaaggtgcgggcagggaaggggcaacctggcttccggaggcccactctggggccctggctacgccaccacacaaccatcccgtggttttgggtatcgtcctccatcctatagtaccgcatatctacctggtagttacgggagcagccactgtaagctggaggctccaagcccatgcagcctcccgcaaagcgatccacggcttcaaggggagctgctccctacctacacgcattacttaccccctgggtcaccaaccccgtataatcctcctctcgccggagccccaatgccgctgactcacctttag

SEQ ID NO: 242413 - DNA, 702 bp, Artificial Sequence
  Description of Artificial Sequence: Synthetic coding sequence
atggcgctgcctggatcaagccaggaccaggcttggagtctggagccccctgcggctacagctgccgctagttcatcctccgggccacaagagcgggagggcgctggaagccctgccgctcccggaactcttcctctcgagaaggtaaagcgcccaatgaacgcttttatggtctggtcttccgcgcaaaggcgacagatggcccagcagaaccccaagatgcacaattcagaaatttccaagcgactgggcgcacagtggaaactactcgacgaggacgaaaagcggcctttcgttgaggaagcgaagcgtcttcgggcacggcacctccgcgactaccccgactacaagtataggccacgcaggaaagccaagtcgagcggcgcaggcccatcacggtgcggccagggtcggggtaacctggcttctggtggaccactatgggggccagggtatgccacaacccagccctcccggggttttggctataggcctcccagttactctaccgcctacctgccgggatcctacgggtccagccattgcaaactcgaggctccaagcccttgctctctccctcagtccgatcctagattacagggcgagctacttcccacatacacacactatctgccaccgggaagccccacgccgtacaacccaccactcgcaggggcacctatgcccctgacccatttatag

SEQ ID NO: 242414 - DNA, 1245 bp, Artificial Sequence
  Description of Artificial Sequence: Synthetic coding sequence
atgtcttctcccgatgcaggctacgctagcgatgatcagtcacagactcaatcagccctccctgcggttatggctggacttggaccctgtccttgggcagagtccctgtcaccaatcggtgatatgaaggtcaaaggcgaggcacccgcaaatagcggtgcaccagccggtgctgccggaagagctaagggagaatccaggataagacgccctatgaacgcctttatggtgtgggccaaggacgaacggaagagactcgctcagcagaaccctgacctgcataatgcggaattgagcaagatgttgggaaaatcctggaaagccctcacactcgcagagaagaggccatttgttgaggaagcagagagactgagggtgcagcatatgcaggaccaccctaactataagtatcgcccaagaagaaggaagcaggtgaaacgtctgaaaagagttgaaggaggctttctccacggtcttgctgagccccaggcagctgccctggggccagagggcggaagagtggcgatggacggcctcggccttcagttcccagagcaaggcttcccggcagggcctccactcttgccaccgcacatgggtgggcactacagggattgccagagcttgggcgcaccccctttggacggctaccctttgcccactcccgacacaagcccgctcgatggagttgacccggacccggctttctttgccgctcccatgccaggtgattgccccgcagcgggaacctacagttatgcccaggtgtcagattatgcgggacctcctgagccaccggcaggtccaatgcatccacgtctcggacctgagccggctggaccatccatccccggtctactagcccctccctcagccctgcacgtgtactacggagccatgggctcacctggggctgggggtggtcgcggttttcagatgcagccccagcatcagcaccagcaccaacaccagcatcatccaccaggtccaggccagcctagtcctccccctgaggcactgccttgtagggatggcactgatccaagccagcctgcagagttgctgggagaggttgacaggactgaatttgagcagtatctccattttgtgtgcaaaccggagatgggactgccataccaaggtcacgattctggggtgaaccttcccgatagccacggcgctataagtagcgtagtgagcgatgcatcctctgcggtgtattactgtaattacccagatgtgtag

SEQ ID NO: 242415 - DNA, 1155 bp, Artificial Sequence
  Description of Artificial Sequence: Synthetic coding sequence
atgcagcggtctcctcctggctatggagctcaggatgatcctccagctcgtcgcgactgcgcatgggcccctggacacggagcggctgcagacacacgcggtctggccgctggcccagcggcattggctgcaccagcagctcccgcatctccgccaagccctcagagatccccccctcgctcccccgagccgggtcggtatgggctgtcccctgctggccgaggcgaacgtcaggccgctgacgaatcaaggattcgccgtccaatgaacgccttcatggtgtgggctaaggacgagcgcaaacggctggcacaacagaatccagacctccacaacgcagtcttatctaagatgcttgggaaagcttggaaagagctgaatgctgctgaaaaaaggcccttcgtggaagaggcggaaagactgcgggtgcagcacctccgagatcacccgaattataagtaccgacccagaaggaaaaagcaggctaggaaggctcgaagattggaaccaggtctcttattgccagggctcgccccaccccagccaccccctgagcctttcccagctgccagcggatccgctagagcttttcgggagttgccgccactcggtgcagagtttgatgggcttggcctgcccacccccgagcgcagccccctcgacggcctcgaacccggagaggctgcattttttccaccccctgctgctcctgaagattgcgccctacgaccatttagagcaccctatgcccctacagagctgtccagagaccccggaggctgctatggcgcacctctggcagaagccttgcgcaccgcgccaccggctgctccgttagccggactgtactacggtaccctggggaccccaggaccatatccaggccctctgtcgcccccacctgaggctccccctctggagtcagccgagcctctgggaccagcagccgacctctgggcggacgtggacctaaccgaatttgaccagtacctgaattgttctcgaactaggccggatgcacccggtctcccttatcacgtggctctcgccaagctcgggccacgtgctatgtcatgtccggaagaatcatctctgatctcagctctgtccgatgctagttctgccgtctactactcagcatgcatcagcggttag

SEQ ID NO: 242416 - DNA, 831 bp, Artificial Sequence
  Description of Artificial Sequence: Synthetic coding sequence
atgtctaaaccagtcgatcacgtcaaacggccaatgaacgcattcatggtctggtcgagagcacagagaaggaagatggcacaggaaaatcccaagatgcacaacagcgagatatcaaaaaggctcggcgctgagtggaagttgctcacagagtctgaaaagagacctttcatcgacgaagcaaagcgcctccgggcaatgcacatgaaagaacaccctgactataagtatcgccctcgtcgcaaaccaaagaccctcctaaaaaaagacaaatttgccttcccggtgccctatggcctaggcggagtagcagatgcggagcatccagccctcaaggccggagctggcctgcacgcgggagcaggcggaggcctggtgccagagtccttgctcgctaatcccgaaaaagccgctgccgctgcagccgctgcagccgctcgggtctttttcccacagagtgccgcagctgccgctgcagcggctgcagctgccgcagctggctccccttatagtcttctggatctcggctctaagatggccgaaatctcttccagtagctcaggtcttccttacgcctcttcgctcggataccccaccgcgggtgcgggtgcttttcatggcgcagcagccgctgccgctgccgcagccgctgccgcagggggacacacacactcacacccatcgcccggaaatccgggatacatgattccctgcaactgtagtgcctggccttctcccggacttcaacccccacttgcctatatcctgctgccaggtatggggaaaccacagctggatccttatccagctgcctacgctgcagcactttag

SEQ ID NO: 242417 - DNA, 1341 bp, Artificial Sequence
  Description of Artificial Sequence: Synthetic coding sequence
atgagacccgttcgcgagaactcatcgggggctcggagtccacgggttcctgcagacctggcgaggagcatcctaatttcccttccattcccgccagactctctggctcacaggccaccatcttcagcgcctactgaatcgcagggcctgtttacagtagcagcccctgcaccaggggctcccagtcctcccgctaccctcgcccacctgctgcccgcacccgcaatgtactccttgctagagacagaacttaagaaccccgtcgggactccaacccaagcagcgggtacaggcggaccagccgcacccggaggcgctgggaaatccagtgctaatgcagcgggaggcgctaactccgggggaggttcctctggaggggcttcaggtggtgggggtggtacggatcaggaccgcgtcaaacgaccgatgaacgcttttatggtctggtcaagagggcaaagaaggaaaatggctcttgagaatcccaagatgcacaattcggagattagcaaacgtctgggggcagattggaagttgttgaccgacgctgaaaaacggccattcatcgacgaagccaaacgccttagggcagtgcatatgaaggagtacccggattataaatacaggccaaggaggaagacaaaaactctcttaaagaaagacaaatacagcttgccctccggcctcctgcctcccggagccgcagcagctgccgctgcggctgccgctgccgctgcagccgctagcagtccagtcggggttggacagagactcgatacttacacgcacgtgaatggctgggccaatggtgcctatagtttagtgcaagaacagctgggttacgctcagccaccctcgatgtctagccctccaccgccacccgctcttccacccatgcaccggtatgatatggctggcctacaatatagccctatgatgcccccaggggcacagagttacatgaacgtcgcagccgcagccgcagctgcttctggatatggtggcatggcaccatcagcaactgccgctgctgcagccgcttacggacaacagcccgctactgccgctgctgccgctgctgccgctgctgcgatgagtctgggaccaatgggaagtgttgtgaagtccgaaccatcaagccccccaccggcaatcgcaagtcactcccagcgggcttgtcttggagacctacgagacatgatatctatgtaccttccacccggaggagacgcagcagatgccgctagccctctgccaggagggagactgcacggggttcatcaacattaccagggggctggtactgcagtcaatggaacggtcccccttacccacatttag

SEQ ID NO: 242418 - DNA, 2253 bp, Artificial Sequence
  Description of Artificial Sequence: Synthetic coding sequence
atgtccagcaagaggcccgcttctccctatggcgaggcagacggcgaggtggccatggtaacctcgagacagaaggtggaggaagaggagtccgatggactgccagcatttcacctgcctttacacgtgtcctttcccaacaaaccacattcagaggaattccagcctgttagtctactgacacaggaaacttgcggccatcgcacacctacttcccagcataatactatggaggtcgacggaaacaaggtcatgagtagctttgcccctcacaattccagtacttcacctcagaaagcagaagagggtggacgccaaagcggcgagagtctgtcatctacagctttgggtaccccagaacgcagaaaaggcagtctggctgacgtcgtggataccctcaagcagcggaagatggaggagctcattaagaatgaaccagaagaaacgccatccattgaaaaactgctgtcaaaggactggaaggacaagcttctcgccatgggatcaggcaatttcggtgagataaagggaacaccagagtccctggctgagaaagagcgccagcttatggggatgatcaatcagctgaccagtctgagggaacagttattagcagcgcacgacgaacaaaaaaagctggccgcaagccaaatcgagaagcaaagacagcagatggagctggcgaagcaacagcaggaacagattgccagacagcagcaacaactccttcagcagcagcacaaaatcaatctgctgcagcagcagatccaggtgcaagggcagctcccccctttaatgatccccgtgttccctccagatcagcgcacactggcagctgcggctcagcagggcttcctgttgccgcctggctttagctataaagcaggctgttctgacccttatcccgtgcagctcattcccaccactatggccgctgctgcagctgcgacacctggcctcggacccttgcaactacagcagctgtacgctgcccagctcgcagctatgcaagtttcacccggaggcaagctcccgggtataccacagggcaatcttggagctgctgttagcccaacgtccatacatactgataagtcaaccaacagtcccccacccaagagcaaggacgaagtggctcagccactgaatctgtccgccaagccaaagactagcgatggtaaatctccaacctccccgacatccccccacatgcccgcactgaggattaactctggcgcaggacccctgaaagcatccgtgccagccgcactcgccagcccttccgcaagggtctctactatcggttaccttaatgaccatgatgccgtgaccaaagccatccaagaggcaagacagatgaaagagcagctgcggagagagcagcaggttctagacggaaaagtggctgtagtcaacagtctgggactgaacaactgccgcactgaaaaggaaaagacaacattggagtcattaactcaacagctcgccgtcaagcaaaatgaggagggcaagttcagccacgcgatgatggatttcaatctttctggcgacagtgatggtagtgccggagtaagtgaaagccgaatatatagggagagtagaggaaggggctcaaatgagccccatattaagaggcccatgaacgcctttatggtgtgggcaaaggatgagcgaagaaagattctgcaggcttttcctgacatgcataacagtaacataagtaagattctgggatcacgttggaaggccatgactaacctggagaaacagccctattatgaagagcaagccagactatccaaacagcacctagaaaagtacccagactataaatataagccacggcctaagcggacgtgtttagtagacgggaaaaagctgagaattggagaatacaaggcaatcatgaggaatcgacgacaggaaatgcgccaatactttaatgtgggccagcaagcccaaatccctatcgcgaccgccggtgtggtttaccctggcgctatcgcgatggccggaatgcccagcccccatttgccgtctgagcactcgtctgtgtcaagttcccctgagcccggaatgccagtcatacagagcacctatggtgtgaagggagaggagccacatatcaaagaagagattcaggcggaggacattaacggggagatctacgacgaatacgatgaggaagaagatgaccccgatgtggactacggttcagacagcgagaatcacattgcgggacaggcgaactag

SEQ ID NO: 242419 - DNA, 1929 bp, Artificial Sequence
  Description of Artificial Sequence: Synthetic coding sequence
atgagtagcaagagaccagcgtccccgtatggtgaggcagatggtgaggtggccatggtaacctctcggcagaaggttgaagaagaggagtctgacggcctcccagcgtttcacctgccgctgcatgtctccttccccaataagccccactctgaagaatttcagcccgtaagtctgcttacgcaggagacgtgtggacaccgaacaccaacatctcagcataacaccatggaggtagacggtaataaggtgatgagctcttttgcgccacacaattcatccacttctccccaaaaagcagaagagggcggacggcaatctggtgagtctctgtcttccactgctctcggcacccctgaacggaggaaagggtccctggccgacgtagtggatactctgaagcagaggaaaatggaggagcttatcaagaatgagcccgaagaaacgccttccatcgagaagctgttgagcaaggactggaaggataagttgctggccatgggctccgggaattttggggagatcaaagggacaccagagagtctcgctgagaaagaacggcaactgatgggtatgattaaccagctgacttccctccgggagcaattgctggcagcccacgatgaacagaagaaattagccgctagtcagatagaaaagcaacgtcagcagatggaactggctaagcagcaacaggagcaaattgctaggcaacagcaacaactgcttcagcagcagcacaagatcaacttgctgcagcagcagatccaggtgcagggtcagcttcccccactgatgatccctgtcttccccccagaccagagaaccttggcagccgctgcgcagcagggcttcctcctaccgccagggttctcttacaaggctggctgtagcgacccctaccccgtgcagctcattcccaccactatggcagccgctgctgccgctacccccggacttggcccactccagcttcaacagctctatgccgctcagctagccgctatgcaggtcagtcctggtgggaaactgcctggcatcccccagggcaacctgggggctgccgtctctccaacatcaattcacaccgacaaaagcacgaattctccgccacctaaaagtaaggagaaaacaacactggagagcctgactcagcaattggccgtgaagcagaatgaggaggggaagttcagccatgctatgatggatttcaacctgagcggcgatagcgatggctcagctggtgtgtccgaaagcaggatttaccgcgaatcccggggaagaggtagtaatgaaccgcacattaaaagaccgatgaacgctttcatggtatgggctaaagacgagaggagaaagattctgcaggcgtttccagacatgcataattccaatatctcaaaaatcctcgggagtcggtggaaggctatgacaaacctcgagaaacagccttactatgaagagcaggcccgattgtccaaacagcacttggagaaatatcccgattataaatacaaacctcgccctaaacggacctgcctggtggacggaaagaaactgcgcattggagaatacaaagccatcatgcgaaaccggcgacaagaaatgcgtcaatactttaatgtcgggcagcaagcgcagattcccatagccacagcaggcgtggtctatccaggcgcaattgcaatggcagggatgccatccccacatctgccatctgagcacagctctgtgagttcctcgccggagccaggaatgcccgtcattcagtcaacctatggcgtgaagggagaggagccacacattaaggaggagatacaggccgaagacataaatggcgagatctatgacgagtacgatgaagaggaggacgaccccgatgtggactacggctccgactcagagaaccacatcgccggacaggccaattag

SEQ ID NO: 242420 - DNA, 1134 bp, Artificial Sequence
  Description of Artificial Sequence: Synthetic coding sequence
atgcatgatgaggtcgcccaaccactcaacttgagcgccaagcctaaaacgagcgatggcaaaagcccaacatctcctacgagccctcacatgccagcactccggataaactccggagctgggccactgaaagctagcgtccccgctgcattggcttctccatccgcgcgagtttcaaccatcggctacctgaatgatcacgacgccgttacaaaagccatccaggaggcacggcagatgaaggagcagctgcggcgagaacagcaggtgctcgatgggaaggtggcggtggtaaatagcctaggacttaataactgccggacagagaaggagaagactactctggagtcactcactcagcagctggccgttaaacagaacgaggagggcaaattcagtcacgccatgatggactttaacctgtccggagactccgatggctcggctggggttagcgagagccggatttacagagagagtagagggagggggtccaacgagccacatattaaacggcctatgaacgcttttatggtttgggctaaggatgagaggagaaagattctgcaagcatttcctgatatgcacaactcgaacataagcaaaatacttggctcccgatggaaggctatgacaaacttagagaaacagccctattatgaagaacaggcccgactgtccaaacagcatctcgagaaatacccggattataagtacaagccacgccctaagaggacctgtctggtggatgggaaaaaacttagaatcggcgagtacaaagccattatgcggaacaggagacaggagatgcggcagtattttaatgtggggcagcaggcgcagattccaattgctactgcaggcgttgtctaccctggcgcaatagccatggccggaatgccaagtcctcacctgccttctgagcattccagcgtatcaagctctccagagcccggaatgcccgtaatccaatctacatacggagtgaagggagaagagccacatatcaaggaagaaatccaggcagaagacattaacggcgagatttatgatgagtacgatgaggaagaggacgatccagatgtcgactacgggtctgacagtgagaaccatattgcaggtcaggctaattag

SEQ ID NO: 242421 - DNA, 1764 bp, Artificial Sequence
  Description of Artificial Sequence: Synthetic coding sequence
atgtcaagtaaacgcccagcatcaccttatggggaggccgatggagaagtcgccatggtaacctcaaggcaaaaggtcgaagaagaagaaagcgatggattgccagcattccatctccctctgcatgaagttgacggcaacaaagtgatgtcctcctttgcgcctcacaactcatcaactagcccccagaaggccgaggagggtggcagacagtccggcgagagtctaagctccaccgccctgggaactccggaaaggcggaagggaagtcttgcagatgtcgtggacactctcaaacagagaaagatggaagagcttatcaagaacgagccggaggagacaccctcgatagagaagctgttatccaaagattggaaggacaagctactcgctatgggtagcgggaactttggggaaataaaggggacgccagagtcgctagcagaaaaagagaggcagttgatgggaatgataaaccagctgacaagtttaagagagcaactgctggcagcccatgatgagcagaaaaaactggcggctagccagatcgagaagcagagacaacaaatggaactggccaaacagcagcaagagcaaatcgccagacagcaacaacagcttctgcagcagcaacacaagatcaatcttttgcagcaacagatccaggtacagggccagttgcctcccctcatgatcccagtgtttccaccggatcagagaactctcgctgctgctgcccagcaggggttcctcttgccgccagggttcagctataaggccggatgcagtgatccatatcctgtgcagctgataccaacgacaatggccgcagctgctgctgccactccaggcctcggtccgctgcagcttcagcaactgtatgcagcacagctggccgctatgcaggtttcaccgggtgggaagctccccggaattccacaggggaatctaggggctgctgttagtccaacctcaatccacacagataaaagcaccaacagccccccaccaaaatccaaggatgaggtggcccaaccattgaacctgtctgctaaaccgaagacctcagacggaaagtccccaacatcccctactagcccacacatgccagcactgagaatcaacagcggagcgggacccctaaaggcatcagtcccggcagcccttgcctctcccagcgctagggtcagcaccatagggtaccttaatgaccatgacgccgtgacgaaggccatccaggaggctagacaaatgaaggagcagctcaggagagaacagcaggtgttggacggaaaagtcgccgtcgtgaatagcctgggcctcaacaattgccggactgaaaaggagaaaactaccctagaaagcctgacccagcagctcgccgtaaagcagaatgaggagggtaagttctcccacgccatgatggattttaacctgtcgggcgacagcgacggcagtgccggagtctccgaatctcgtatctatcgcgaatctcggggtcgaggctccaacgaacctcacattaaaaggccaatgaatgcttttatggtttgggccaaagacgaaagaagaaagatattgcaggcctttccagacttgggattcctgtgcgtatgtatgtatgtaataatggtgcttattataggaatcaccctcgatcactgtgagctcaatccccatctcgggatgaaatctcacatcttaccatctgactggagccggaacaacctggacctggattttgcgctgcagatgacaacttag

SEQ ID NO: 242422 - DNA, 2292 bp, Artificial Sequence
  Description of Artificial Sequence: Synthetic coding sequence
atgctgacggaccctgatctgccccaggaatttgaaaggatgtccagcaagagacccgctagcccctacggcgaagccgatggcgaagtggccatggttacaagcaggcagaaagtagaagaggaagagagtgatgggctcccagcctttcatctgccattgcacgtgtcctttcccaataaaccgcattctgaggaattccagcctgttagtctgctgacccaggagacatgtggccatagaacccctacgtcgcagcacaataccatggaagtggacggtaacaaggtgatgtcatctttcgcaccccacaattcgtctacttcaccccagaaggcagaagaagggggaagacagtctggcgaaagtctatcctcaaccgcattgggcacccccgaacggagaaagggctcacttgcggacgtcgttgacactctcaaacagcgaaagatggaggaactcatcaagaacgagcctgaggagaccccttccatcgaaaaattactctctaaagattggaaggacaaactcctggccatgggcagcgggaacttcggggagataaaagggacacctgagtctctggccgagaaggagcgacaactgatggggatgattaatcagctgactagcctgagagagcagttgttggccgcacatgacgaacagaagaagctcgcggcaagtcaaatcgaaaaacagcgacaacagatggagctggcgaagcagcagcaggaacagatcgccagacagcaacagcagctgctgcagcagcagcacaagataaacttactgcaacaacagatccaggtgcaaggccaactgcctcctctgatgattccagtcttcccgccagatcagcgcaccctagccgctgccgctcagcaaggttttttgcttcccccaggcttctcttacaaggccggttgctctgacccttaccctgtgcagctgatcccaacgacaatggctgccgctgctgctgccacgcctggactgggccctctgcagttacagcagttgtacgccgctcagcttgccgctatgcaggtgagtccaggaggaaaactacccggaatcccacagggcaacctgggagcggctgtgtctccaacgtccatccacacggataaaagcaccaattcaccacctcccaaatcaaaggacgaagtagctcagccgcttaatctcagtgcgaagccaaagacttctgacgggaaaagcccaacttccccaacctcaccccatatgccagccctgagaatcaattccggcgctggacccctgaaggcttcagtacctgctgcactcgcatcacctagtgcccgtgtgagcacaatcgggtacctcaacgaccatgatgcggtgacaaaggccatacaggaagccaggcagatgaaggaacagttgcgacgcgagcagcaggtactggacgggaaggtagctgtcgtaaattcgctggggctcaataactgccgcactgaaaaagagaagactaccttagaatcacttacccagcaactggccgtgaagcagaatgaggagggcaaattttctcacgcaatgatggatttcaatctgtcaggagactccgatggaagcgctggagtcagtgaaagtcgaatctatagggagagcagggggagaggtagcaacgagccgcacatcaaacggccaatgaacgctttcatggtttgggctaaagatgagagacgcaagatcctgcaggcatttccggatatgcataattcaaatatcagtaagatacttggctccagatggaaggctatgacaaacctggagaaacagccctactacgaggagcaggccagactcagtaaacagcacctcgagaagtatcctgactacaaatataagcctcgcccaaagcgcacgtgtctggtggatggaaaaaaactgcgcatcggagaatacaaggcgatcatgaggaaccggcgtcaggagatgcgacagtacttcaatgttggccagcaggcacagatccctatcgccacagctggggtggtttacccaggcgctattgcgatggctggaatgccaagtccacacttgccctccgaacattcctcggtttccagctccccagaacctggtatgccagtaatacagtcgacctacggtgtgaaaggggaagaaccacacattaaagaggagatccaggccgaggacataaatggagaaatctatgatgaatacgacgaggaggaagacgaccctgacgtcgattacgggagtgactcagagaaccacatagccggacaggctaactag

SEQ ID NO: 242423 - DNA, 1929 bp, Artificial Sequence
  Description of Artificial Sequence: Synthetic coding sequence
atgtcctccaaacggccagcgagtccctatggtgaggcagatggtgaagtcgctatggtgacatcccgtcagaaagtggaggaagaggagtccgacggcctgccagcatttcacctgcctctgcacgtttcctttcccaacaaaccacatagcgaggaatttcagcccgtgagcctacttactcaggaaacatgcgggcaccggaccccaacaagtcagcacaataccatggaagtggatggcaataaggtcatgagctcctttgctcctcataacagttccaccagcccccagaaggccgaagaggggggtcgacagtccggcgaaagtctaagcagcacagccctcggaacccctgaaagaaggaaaggaagcctcgccgacgttgtggacactctgaagcagaggaaaatggaagaactaataaagaatgagccagaagagactcctagcattgagaagctcttaagtaaggactggaaagataagctcctcgcaatggggtcaggcaactttggcgaaattaaagggacgcccgaaagtctggcagaaaaagaaagacagctgatggggatgatcaatcagctgacttcacttagagaacaactgcttgcagcacacgacgaacagaaaaagctcgcggcttcccagattgagaaacaacggcaacaaatggagctggccaaacagcaacaggaacagatcgcacggcagcagcagcaactgctgcaacagcagcataagatcaatttattacaacagcagatccaggtgcagggtcagcttccacccttaatgatacccgtcttccctcccgaccagcgaaccctggcagccgctgcacagcagggctttttgcttcccccagggttctcctataaagctgggtgtagtgacccatacccagtgcaactgattccaaccaccatggccgcagccgctgcggctacccctggcttgggccctttgcaactgcaacagctctacgcggcacagctggccgctatgcaggtgtctcccggaggaaagcttccaggaatcccacagggcaacctgggtgcagcagtgtcacctacctctatccatacagataagtccactaactctcctcccccaaagtctaaggagaaaaccactttggagtcccttacccagcagcttgccgtcaaacagaacgaagagggtaagttttcccacgccatgatggacttcaacctgagcggtgatagtgacgggagtgctggtgtgtcagagagccgaatctaccgtgagagtcgaggacggggaagtaacgagccccatattaagaggccgatgaatgccttcatggtgtgggccaaggacgaacgacgaaaaattctgcaggcgttccccgatatgcataacagcaatatctccaagattctgggtagcagatggaaggccatgactaatctcgagaagcaaccctactatgaagaacaggcccgtctgtccaaacaacatctggagaaataccccgattacaaatacaagccacgcccaaagcggacgtgcttagtggacggaaagaagctgagaatcggtgagtacaaggccatcatgcggaacaggcgccaggagatgcggcaatatttcaacgtgggccagcaggctcagattcctatagcgactgcaggggttgtgtatcctggtgccattgctatggctggcatgccaagcccccatctgcccagcgagcacagctccgtctcgagcagccctgagcccggaatgcctgttattcagtcaacctacggggtcaaaggggaagagccccacattaaagaagagatccaggccgaggacattaatggagagatctatgacgagtatgacgaggaagaggacgatccagatgtggactacggatccgactccgagaatcacattgctggacaggctaattag

SEQ ID NO: 242424 - DNA, 2253 bp, Artificial Sequence
  Description of Artificial Sequence: Synthetic coding sequence
atgtccagtaagcggcctgcctcaccatacggagaagccgacggtgaggtggcaatggttacaagtcgccagaaagtcgaggaagaagagagtgacggacttccagcctttcatttgcccttgcacgtgtcatttcctaataaaccccacagcgaagaattccagcccgtgtctttgcttactcaggaaacctgcgggcaccggacacccacctcacagcacaacactatggaagtagatggaaataaagtcatgtcaagtttcgccccacataactccagcacatcgcctcaaaaggcagaagaggggggaagacaaagcggcgaatccctcagcagcacagctctgggaacccccgagcgtagaaagggatccttggcagacgtggtcgacacccttaaacagagaaagatggaggagttgataaagaacgagcctgaggaaaccccaagcatcgagaagctgctgtcgaaggactggaaagataagctgctggccatgggcagtgggaacttcggcgagattaagggaaccccagagtctctggcagagaaggaaagacaacttatgggtatgataaaccagctcacaagcctccgcgagcaactgttggccgctcatgatgagcagaaaaagctcgccgcatcgcaaatcgaaaaacagcgtcagcagatggagctggcaaagcagcagcaggagcagatcgcccgtcaacagcagcaactgctgcagcagcagcataagatcaatcttctgcagcaacagatccaggttcaggggcagctgccgccactaatgattcccgtattccccccagaccagcggaccctcgccgcagcggctcagcaggggtttctgttgccgcctggtttcagttataaggcgggatgttcagatccataccccgtgcagcttatccccacgaccatggccgctgcagccgcagctactcctggattgggacccctacaattgcagcaactttacgcggcacaacttgccgctatgcaagttagtccgggaggcaagttacccggaatccctcaggggaacttaggtgcggctgtgagccctacatctatccacaccgacaagtcaacaaacagtcctccccctaagtccaaggatgaagtggcacaaccacttaacctgagcgccaagccaaagactagtgatggcaaatcacctacttctcctacaagtccccacatgcctgcactgagaataaacagcggagctggtccactgaaggcatctgtgccagcggctcttgcaagcccatccgcaagagtgtctaccattggatacctgaatgatcatgacgccgtcactaaggcgatccaagaagccagacaaatgaaagagcaattacggagagagcagcaggtgttggacggcaaggtagctgtggtcaacagtttggggctaaataattgccgcacagagaaagaaaagacgactttggagagcctgactcaacagctcgcagtgaagcagaacgaggagggtaagttttcccacgccatgatggactttaatctctcgggggattccgacggatcagcgggagtctccgaatcaagaatttaccgggaaagtaggggcagaggatctaacgaaccccatatcaagcgacctatgaacgctttcatggtatgggcgaaggacgagcgtcgaaaaatcctgcaggcttttcctgatatgcataacagcaacatatccaaaatacttggctccagatggaaagcaatgactaacctcgaaaagcagccatactacgaggagcaggcccgtctgtcaaagcaacatctggaaaagtacccagactacaaatataaacccaggccaaaacggacttgcctggttgatggcaaaaagctgaggataggtgagtacaaggctattatgagaaaccggcgacaggaaatgcggcagtacttcaatgttgggcagcaggcccaaattccaatcgccactgcaggagtcgtgtatcctggcgcaatagccatggcgggtatgcctagcccccatctgccaagtgagcattcgtcagtgtcaagcagtccggaaccaggcatgcctgttattcagtcaacttacggtgtgaaaggggaagaaccacacatcaaggaagagatacaagccgaagacatcaacggtgagatctatgacgaatacgatgaggaagaggacgatcccgacgttgattatggctcagacagcgaaaaccacattgctggacaggcgaattag

SEQ ID NO: 242425 - DNA, 2427 bp, Artificial Sequence
  Description of Artificial Sequence: Synthetic coding sequence
atgagtagcaagcaggcaaccagtccttttgcatgcgctgccgatggcgaggatgcaatgactcaggatctaacttcccgggagaaagaggagggctcagatcagcacgttgcttctcatcttcccctccaccccataatgcacaataaacctcactctgaagaattgcctactttggtgtccaccatacagcaagatgctgattgggattccgtcctgagcagccagcagaggatggagagcgaaaacaataagttgtgctccctctatagcttccggaacacaagtacaagtcctcacaaaccagatgagggaagtagagaccgcgagattatgaccagcgtcacatttggcacacctgagaggcgaaagggatccctggctgacgtggtggatacactgaaacagaagaagctcgaggaaatgacccgcaccgagcaggaagacagtagttgtatggagaaactgctctcgaaggattggaaggagaaaatggagaggttgaacactagcgaattgctcggtgagatcaaaggaacccccgagtcattggctgaaaaagaaaggcaactctccaccatgattacacagttgatctcactcagagaacaattactggccgctcacgatgagcagaagaagttagccgcttcacagattgagaagcaaaggcagcagatggaccttgctcgacaacagcaagagcaaattgctcggcagcagcaacagctgcttcagcagcagcataaaattaatctgctgcaacagcagatacaggtccaaggccatatgccccctctgatgattccgatctttcctcacgatcagaggacattggctgcggcagctgccgctcagcagggatttctctttccccctggcataacctacaagcccggagacaattatccagtccaatttattccatctaccatggccgcagctgctgcatccggcctctcacctctccaactccagaagggccacgtttcccacccacagatcaaccaaaggttgaagggcttgagcgaccggttcgggaggaatctggacacctttgaacacggaggcggtcactcctataatcataagcagatagagcagctgtacgcagcccaactggccagcatgcaagtatcccctggagcaaagatgccctctacgcctcagccacccaataccgcgggtacagtatcccccaccgggatcaaaaatgagaagagggggacctcccctgtaactcaagtcaaggacgaagccgcagcccaacccctgaacctgtcctctcgtcctaagactgctgagcccgtgaagtcacccacttcaccgacccagaatctttttcctgcgagcaagacatcccccgtaaatttgccaaataaatcctccatcccgtcccccatagggggttccctgggacggggttcctctctggatatactatcttctctcaacagccccgctctcttcggggatcaagacaccgtgatgaaggccatccaggaggctaggaagatgcgcgagcagatccagcgggagcagcagcaacagcaacctcacggcgtggacggaaaactgtctagcatcaacaatatgggtctgaattcgtgtcggaacgagaaggagcgaacccgcttcgagaatctggggccacaactgacaggtaagagcaatgaagatggtaaactgggtccaggtgtcattgacctgacacggcctgaagacgccgagggaggagcaactgtggccgaggcgcgtgtgtatcgtgatgcacggggaagggcgtccagcgaaccccacataaagcggcctatgaatgcttttatggtatgggcgaaagacgagaggagaaagatcctccaagctttccctgatatgcacaatagcaatatctccaaaatactgggcagccggtggaagagcatgagtaaccaggaaaaacagccgtattacgaggaacaggcgagactgagcaaaatccacctggaaaaatacccgaactacaaatacaagcctcggcctaagcgaacgtgtatagttgatggcaaaaaacttaggatcggcgagtacaaacaactgatgcggagcagaagacaggagatgcgacagttctttacagtggggcagcaaccacagatccctatcaccacaggcaccggggtggtgtaccctggggctattacgatggcgactaccaccccaagcccgcaaatgacctccgactgcagtagcacctccgcctcgccagagccctctttgcctgttatacaatcaacctatggcatgaagaccgacggcggatctctggccggaaatgaaatgatcaacggcgaggatgagatggaaatgtatgacgattacgaggacgatcctaagtccgattattcatccgagaacgaagcgccagaagccgtgtccgctaactag

SEQ ID NO: 242426 - DNA, 2487 bp, Artificial Sequence
  Description of Artificial Sequence: Synthetic coding sequence
atgtcttctaagcaagcaacctccccgtttgcatgcgccgctgatggggaagatgccatgacgcaggaccttacctcgagagagaaggaagaaggcagtgatcagcatgtggctagccacttgccactgcaccctatcatgcacaacaagccccactccgaagaactgcccactctggttagcacgatccagcaggacgcggattgggactccgtcctaagctcacagcagaggatggagtcagagaataataagctctgctccttgtattcattcaggaacaccagcacatcgccacataaaccggacgagggcagccgcgaccgcgaaataatgacgtccgttaccttcggcacccccgagaggcgtaaggggagcctggcagacgtggtggatactctgaagcagaagaagctcgaagagatgacacgaactgagcaggaggatagttcctgcatggagaagctgctatcgaaggactggaaggaaaaaatggagcgactcaatacgtcggaactgttaggagaaattaagggaacccctgagagccttgctgaaaaggagagacaattaagtacaatgattacccagttgatttccctgcgggagcagcttctcgctgcacacgacgagcagaaaaaacttgctgcgagccagattgaaaaacaacgtcagcagatggatctagcaagacagcagcaagagcagattgccaggcagcagcagcagctgctgcaacagcaacataagataaatttgctccagcagcagatccaggttcagggtcatatgcccccattgatgattcccatctttccacatgaccagaggaccctcgctgctgccgcagccgcacagcaagggtttctgtttcccccagggatcacatacaagcctggagataattatcctgtgcaattcatcccgtcgacaatggcagcggcagcagcatctggtctcagcccactccagctgcagaaagggcacgtcagccacccccagatcaaccaacgactcaagggcctcagcgaccgattcgggagaaacttggacacatttgagcacggtggaggtcactcttataaccataaacagatcgagcaactctatgctgcccagttagcctccatgcaggtgagccctggcgcaaaaatgccttctacgccacaacccccaaatactgcagggacagtcagtcccacgggaattaagaatgagaaaagaggaacctcaccggtcacacaagtgaaagatgaggccgctgcccagcccttgaacctttcctctcggcctaagactgcggagcccgtgaagtcccctactagccccacccagaacttattccccgcaagtaaaacatcccctgtcaacctgccaaataaatcgtctatcccatcacccatagggggtagtctgggtagaggatcaagtctcgatattctatcatccctgaattccccagctttgtttggcgaccaggacacagtgatgaaggcgattcaagaggctcggaagatgcgagaacagatccagcgggaacagcagcagcagcagccacacggagtggatggcaagctgtcatctatcaacaacatgggcttgaatagctgtaggaatgagaaagaacgaacgaggtttgagaacttgggcccacagcttaccgggaagtccaacgaggatggcaagctgggcccaggagtgattgacttgactaggcctgaagatgccgagggtagcaaagccatgaatggcagcgctgccaagctgcagcagtattactgctggcccactggaggggctacagtggccgaagcccgagtgtaccgggacgccaggggcagggccagttccgagccacacatcaagaggcccatgaacgcattcatggtctgggcgaaagacgagaggcggaagattttacaggctttcccggacatgcacaacagtaatatctcaaagatcctcggtagccggtggaagtcaatgtccaaccaggagaagcagccctactatgaagagcaagccaggctgagcaaaatccatctggagaagtacccaaattacaagtataagccaagacctaaaaggacctgtatcgtcgatgggaagaagctgagaataggcgaatacaaacagctcatgcggtcacggcgacaagagatgcgtcagttttttactgtggggcagcagcctcaaatacccatcacaactggaacaggggtggtctacccaggtgcaataactatggcaactaccacccccagtccccagatgacgagcgattgcagctccacgtcagcgtctcctgagccttcactacctgtgatccaatcaacatatgggatgaagaccgatggcggtagcctggctggaaatgaaatgataaatggagaggatgagatggaaatgtacgatgactatgaggacgaccccaagtcagactacagcagtgagaatgaggcacccgaggccgtctctgccaactag

SEQ ID NO: 242427 - DNA, 2427 bp, Artificial Sequence
  Description of Artificial Sequence: Synthetic coding sequence
atgtcctctaaacaagcaacctccccctttgcatgtgccgcagacggagaggatgctatgacccaggacctcacatcccgcgagaaagaagagggctctgaccagcacgttgcctcccatctcccactgcacccgattatgcacaacaaaccccactctgaagagctgcctaccctggtctcaaccatacagcaagatgctgactgggacagcgtgctgtcatcgcagcagcgtatggaatctgaaaataacaagctgtgctcgctctacagttttcgtaacactagtaccagcccccacaaacctgatgaaggtagtcgggacagagagatcatgacatcggtcacctttggcacgcctgaaaggagaaaagggtcacttgccgacgtggttgatacattgaaacagaaaaagctcgaggaaatgacccgaaccgagcaggaggactcatcctgtatggagaaactgctgagcaaggattggaaggaaaaaatggagcgactgaatacttcggaactgttgggagaaattaaaggcacaccggaatcactagctgagaaggagcgtcagctgtccactatgattactcagctgattagtcttagggagcaattgctcgccgcacacgatgagcagaaaaagcttgcggcaagtcaaatcgagaaacagagacagcagatggacctggcgagacagcaacaggaacagatcgccagacagcagcagcagttgcttcaacaacagcataagattaatcttctgcagcagcagattcaggtgcaaggccacatgccacccctaatgattccgatctttccgcacgatcagaggaccctggcagctgccgctgcggcacaacaggggtttctgtttccgcctggaatcacttataaacccggtgacaattatccagtgcaatttatccctagcacgatggccgcagcagccgcatccggcctatctccattgcagttgcaaaagggccatgtcagtcaccctcagatcaatcagcgtctgaaaggcttaagcgataggttcggacggaatttagatacattcgagcatggcggtggccatagctataaccacaagcaaatcgagcagttatatgctgcccagctcgctagcatgcaagtttcaccaggggctaaaatgccatctacacctcagccgccaaatactgcaggtaccgtctcccccaccggtattaaaaacgagaagaggggtacctcaccagttacacaggttaaagatgaggccgcagctcagccactcaatctctcttccagacccaagacagctgaacctgtcaagagccccacgagccccactcagaacctattccccgcttctaagacttcacctgtgaaccttccaaataagtctagcatcccatctcccattgggggatcgttgggcaggggatctagcctggacatcctgagttcgctgaacagccccgcactgtttggagaccaggatactgtgatgaaagcaattcaggaagccaggaagatgcgggaacagatacagagagagcagcagcaacaacagccccacggggtggatggaaagctttctagcattaacaatatgggcctcaacagttgccgcaatgagaaagagcggacccgttttgagaatttgggaccccagcttacaggcaagtctaacgaagacggcaaactgggacccggagtgattgacctcactcgtcctgaggatgccgaagggggagccactgtggctgaggctcgagtgtacagagatgcacgtggacgggcttcctccgagcctcacataaagagacccatgaatgctttcatggtgtgggctaaagacgaaagaaggaagattctgcaggcattccccgatatgcataattctaatatctctaagattttgggcagtagatggaagtctatgagcaatcaggagaaacagccttactacgaggagcaggctaggctcagtaaaattcacctggaaaagtacccaaattataagtacaagcctcgccctaaaagaacctgcattgtcgacgggaagaaattgcggatcggtgaatacaagcaattgatgaggagcaggcgccaagagatgcgccagtttttcacagttggccagcagcctcagatccctatcacgacaggtaccggtgtcgtctatccaggagccatcacaatggccacaaccaccccatcacctcaaatgacaagtgactgtagcagcacctccgcctcccctgaaccaagtttgccagtcattcaaagcacttatggcatgaagaccgatggcggaagcttagccggtaatgaaatgattaacggagaggatgaaatggagatgtatgacgattacgaggacgacccaaaaagcgactattcttctgaaaacgaggccccagaggccgtttccgcaaattag

SEQ ID NO: 242428 - DNA, 420 bp, Artificial Sequence
  Description of Artificial Sequence: Synthetic coding sequence
atgagttcaaagcaagccacttcccctttcgcctgcgcggctgatggtgaggacgccatgacccaggaccttacctcccgcgagaaggaagagggaagcgaccaacacgtcgcttcacatttgccccttcatcccattatgcataataagccacacagtgaagaactgccgaccctggtgtcaaccattcagcaggacgcggattgggattcagtcctgtctagccagcaaaggatggagtccgagaataacaaattgtgcagcctgtacagcttccggaatacatccacatcacctcacaagccagatgagggttccagagaccgcgagatcatgaccagcgtgacctttgggactcctgaaagacgaaaagggtcgctagcggacgtggtggacacattaaaacagaaaaaattatag

SEQ ID NO: 242429 - DNA, 2406 bp, Artificial Sequence
  Description of Artificial Sequence: Synthetic coding sequence
atgagcagcaagcaagcaacatctcccttcgcctgcgccgcagatggcgaagacgccatgacccaggatttgacaagccgtgagaaagaagagggatccgatcagcacgtagcatcacatctgccactccatcccattatgcacaacaagccccattccgaagagctgccgacattagtgtctaccattcagcaggatgcagactgggacagcgtcctgtccagccagcagcggatggaaagtgagaacaacaagctgtgcagtttatactctttccgaaataccagcacctccccgcacaagccagatgaaggtagccgcgatcgagagattatgacttctgtgaccttcggaactcctgagaggaggaagggttccctggctgatgtggttgatacattgaagcaaaagaaactggaggaaatgacacggacagaacaggaggactcctcctgtatggagaagttgttaagcaaagattggaaagaaaagatggagcggttgaatactagtgagctgctgggcgagatcaagggtacacctgagagcctggcagagaaggaaaggcagctgtcaacgatgataacccagttgatctcacttcgagaacagctccttgccgcacacgatgaacagaaaaaactcgcagcctcccagatcgagaaacagcgccagcagatggacctggcgaggcagcaacaggagcagatagctcggcagcagcagcagctgctgcagcagcaacataaaattaacctcctacagcagcaaatacaggtgcagggccacatgccgccactgatgatacctatctttcctcacgatcaacggacacttgccgcagccgcagcagcccagcagggattcttatttcctcctgggattacctacaagcccggagacaattacccggtgcagtttattcctagtactatggcagcagcggctgcttcaggattgagtcccttacagctgcagcagctttatgccgcacagctggcctcaatgcaggtgtccccgggtgccaagatgccctcaactccccagccacctaacacagcagggacggtgagtccaacgggaataaaaaatgaaaagcgcggtacatctcctgttacacaggttaaggacgaagccgcagctcaacccctaaacctctcctctagacccaaaacggccgaacctgtgaagtccccaacctcacccacgcagaatctgttcccagctagtaagaccagccctgttaatctacctaacaagagctccattccatctcccattgggggttcactggggagagggtcaagtctggggaagtggaagtcacaacaccaggaggaaacgtacgaactggatatcctttcatctctgaattcgcccgcactgttcggagatcaggacaccgtgatgaaagccattcaggaggcacggaaaatgagggaacagatccaacgcgaacagcagcagcagcagccgcacggcgtcgacggaaagctgtccagtattaacaatatgggcctgaactcttgcaggaatgagaaggaaaggacaaggttcgaaaacctcggcccacagcttacaggcaagagcaacgaggacggaaagcttgggccaggggtcattgatcttacaaggcctgaagacgccgaggggagcaaggccatgaatgggtccgcggctaagctacagcagtattattgttggccgaccggcggtgcaacagtcgctgaagcgagagtttatcgggacgcgcgtgggcgagcctcttctgagccccatattaaacgcccaatgaacgcttttatggtgtgggcaaaggatgaacggagaaaaatcctgcaggcatttccagatatgcataattcaaatatttcgaagatcctgggtagccggtggaagagtatgagcaaccaggaaaaacaaccatattacgaggagcaggctcggttgtcaaagatccacctggagaaatatccaaactacaaatataagcccaggccaaaacgaacttgtatcgtggacggtaaaaagcttcgaatcggcgagtataagcagttaatgcggtcgcgtcgtcaagaaatgcgtcaattcttcaccgtggggcagcaaccccagatccccatcaccactggcactggtgtggtgtatccgggagcgattaccatggcaaccaccaccccatcaccgcagatgaccagcgactgctcttcaacttctgcctcgccagaaccatcattacctgtgatccagtctacgtacgggatgaaaacagatggcggatccttggctggcaatgaaatgattaatggtgaggatgagatggagatgtacgacgactacgaggacgaccccaagtcagattacagctctgaaaacgaagctcccgaggctgtgtccgccaattag

SEQ ID NO: 242430 - DNA, 2487 bp, Artificial Sequence
  Description of Artificial Sequence: Synthetic coding sequence
atgtcaagcaaacaagctacctctccattcgcctgtgcggctgatggggaagatgcaatgactcaggatctgacttctcgcgaaaaggaggaggggagcgaccagcatgtagcttctcatctccctctccacccaattatgcataataaaccccattccgaggagctcccaaccttggtgagcaccatccaacaagacgcagactgggacagcgtgctgagttcacagcagcgtatggagagcgaaaataacaagctgtgttccctgtatagctttcgaaatacttcaacctctccccacaagccagatgagggctcaagggatcgcgagattatgacatccgtcacttttggaactcctgagcgacgtaaaggtagtttagctgacgtagtggataccctcaagcagaaaaagttggaggagatgacccggaccgagcaagaggactccagttgtatggagaaactcttatccaaagactggaaagaaaagatggagcgcctcaatacatctgagctcctgggagaaatcaagggcactccggagagcctagctgaaaaggaacgccagctcagcaccatgattacccagctcataagcctgcgggagcaactgctcgcagctcatgatgagcagaaaaaactagcggcttctcaaattgaaaaacagcgccagcagatggatcttgcccgtcaacagcaagaacagatagccagacagcagcagcaattactgcaacagcagcacaaaatcaacctgctccagcagcaaatccaggtgcagggccacatgccacccctgatgatcccaattttcccacacgaccagcgtaccctggcagctgccgcagccgcacagcaaggctttctgtttcctccagggatcacttacaagcccggtgacaactaccctgtccagttcattccgtcaacaatggccgctgctgccgcatccgggctctcccctctacaactccagaaaggtcacgttagtcatcctcaaattaaccagcggcttaagggactttccgatcgcttcggcagaaatttggacactttcgagcacggcggaggccattcatacaaccacaaacagattgaacagctgtacgccgctcagctagccagcatgcaggtgagccctggagccaagatgccttctactcctcaaccccctaacactgccggaactgtctcccctaccggtattaagaatgaaaaacgaggaactagcccggtcacccaggtgaaagacgaagcggctgctcagcctctaaatctctcaagccgcccaaagacggctgagccagtgaagagtcctaccagcccgacgcagaaccttttccccgcatcaaaaaccagcccagttaaccttccaaataaaagctcaataccatctccaattgggggttcactgggccgaggaagttccttggacattctttcaagtctgaatagccccgctttattcggcgaccaggacaccgtgatgaaggccatacaggaagctaggaaaatgagggaacagatccagcgcgaacagcagcagcagcagccacacggagtcgatggaaaactctcttctataaacaacatgggcctgaactcatgccgaaacgaaaaagaaagaactcgcttcgagaacttagggcctcagctgacaggaaagagcaacgaggatgggaaactgggtccaggggttatagacctgacacgtcctgaggatgctgaggggtctaaagcaatgaatggctccgctgctaaactgcagcagtactactgctggccgaccggaggggctacagtcgctgaagcgagagtctacagagatgcacgcggacgggctagtagtgagccgcacattaagagaccaatgaatgcattcatggtgtgggcaaaagacgagcggcgaaaaattttgcaggcatttcccgacatgcacaatagcaacatttctaaaatcttggggagccggtggaagtcgatgagtaaccaggaaaagcagccatattacgaagagcaggctcgattgagcaagatccatttggagaagtaccccaattacaaatacaaacccagacccaagaggacctgcattgtcgatggcaaaaagctcagaatcggagagtacaagcaattgatgagaagtcggagacaagagatgagacagttctttaccgtgggtcagcagccccagattcccataaccaccggcaccggggtagtttatcccggtgccatcacaatggcaactacaacaccctcaccacagatgaccagcgattgtagttcgacctccgcctcacccgaaccatcactccccgttattcagagtacctacggcatgaaaaccgatggtggctctttggccggtaatgagatgatcaatggcgaggacgagatggagatgtacgatgactacgaagacgatcctaaatccgactactcgagcgaaaacgaagccccagaggctgtatctgccaattag

SEQ ID NO: 242431 - DNA, 240 bp, Artificial Sequence
  Description of Artificial Sequence: Synthetic coding sequence
atgagttcgaaacaggccacctcccccttcgcgtgtgccgcagacggggaagatgctatgactcaggatctaacttctcgcgagaaagaggaggggtccgatcagcatgtggcctcccacctcccgcttcatcctatcatgcataataaacctcactccgaagagcttcctaccctcgtgagcactatacagcaggacgccgattgggatagcgtcctcagcagccaacaaaggatgtag

SEQ ID NO: 242432 - DNA, 480 bp, Artificial Sequence
  Description of Artificial Sequence: Synthetic coding sequence
atgtcttccaaacaagccactagccccttcgcatgcgccgctgacggggaggacgccatgacgcaggatctcacatcacgggaaaaggaggaaggttccgaccagcatgtggcaagtcatttgcctttacatcccatcatgcataacaaacctcactctgaagaactgccaaccttggtttcaactatccagcaggatgctgactgggactcggtgctgtcctcacagcagagaatggaatcagagaataacaagctctgttcactgtacagctttcggaatacttccactagcccgcacaagcccgacgagggttcccgtgatagggagatcatgacgtcagtcactttcggcacgccagaacggaggaaaggctctttggcagatgtggtggatacactaaagcagaagaagctcgaagagatgacacgcaccgagcaggaggacagcagttgcatggagaaactcctgtccaagtag

SEQ ID NO: 242433 - DNA, 2415 bp, Artificial Sequence
  Description of Artificial Sequence: Synthetic coding sequence
atgggaagaatgtcttctaagcaagctacttcccccttcgcttgtgctgctgatggagaggatgcaatgacgcaagacctcactagcagagaaaaggaggagggcagtgaccaacatgtagcctcccacctccccctacatcctattatgcataataaaccgcattccgaggagctccccacactggtatccactattcagcaggatgcagactgggactctgtactaagttcacaacaacgcatggaaagcgagaataacaagttatgttccctctacagcttccgaaacacaagcaccagtccacacaagcctgatgagggtagccgggaccgggaaattatgacttccgtcacttttggtactcctgaaagacgtaaaggctcgcttgccgacgtggtggacaccctcaagcagaagaaactggaagagatgaccaggaccgaacaggaagattctagctgcatggagaagctgctgtcaaaagactggaaggaaaagatggagaggttgaacaccagcgaactgctcggcgagatcaagggaaccccggagtccttggctgaaaaggaacggcagctttccactatgatcactcagctcatttcactgcgggagcagctcttggcagctcatgacgaacaaaagaagctcgcagcttcccaaatcgaaaaacagcgccaacagatggatctggctcgtcagcagcaggaacaaatcgccaggcagcagcagcagctactgcaacaacagcacaaaatcaatctgcttcagcagcagattcaggtgcaggggcatatgccaccactcatgattccaatattccctcatgaccaaaggacactggctgcagcagcggctgcccagcagggattcctatttcctccgggaattacctacaaacctggggacaattaccctgtgcaatttattcccagcactatggcggctgcagctgcctccggcctgagtccgctgcagctgcagcagttgtatgctgcacagcttgcctcaatgcaggtgtcccccggtgccaagatgccttcgacacctcaaccacccaatacagccggaactgtttctccaactgggatcaagaacgaaaagagagggacctctccggtgacccaagtgaaagacgaagctgcagctcagccactcaatctttctagcagacccaagactgctgagcctgtgaaatcgcctacaagtcccacccagaatctcttccccgcatctaaaacaagcccggtcaaccttcccaacaagtcctccatccccagccccatcggcggatctctgggtagagggtcaagtttgggcaaatggaagtcacagcatcaggaagagacttatgagctggacatcctcagctccttgaattcccctgctcttttcggcgaccaggataccgtcatgaaggcgatccaggaggccagaaagatgagggagcaaattcagcgtgaacaacagcaacagcaaccccacggggtggacggtaaactgagcagtatcaacaacatggggctaaacagctgtcggaacgagaaggagaggacccggttcgaaaatctcggacctcagctcactggtaagtccaatgaggacggcaagttaggacctggggtcatcgatctcacaaggcctgaggacgcagaaggctcaaaggccatgaacggttctgccgcaaagctgcagcagtactattgctggccaacaggaggtgcgaccgtcgccgaagctcgggtttatcgcgacgccagaggaagggcttcaagtgagccacatatcaaacgtcccatgaacgcgttcatggtttgggccaaagacgaaagaagaaaaatcctgcaggcttttccagacatgcacaactcaaatatttcaaagattttgggctcgagatggaagtccatgtcaaatcaggaaaaacagccttattatgaggagcaggcccgtctgtctaagatccatctggagaagtatccaaactacaagtacaaaccaaggcccaagcgtacctgcattgtggacggaaaaaagctgagaattggcgagtataaacagctcatgcgtagccgccgacaggagatgaggcagttcttcacggtggggcagcagccccagatccctattaccactggcacaggagtcgtgtatcctggcgctataacaatggctactacaacgccaagccctcagatgacctcagactgttcatcaacatccgcgagcccagagccaagcttgcccgtcattcagtcaacatatggtatgaaaaccgacgggggaagcctggcgggtaacgagatgataaatggggaagatgagatggaaatgtatgacgactatgaagatgatcctaaaagtgattattcctctgaaaatgaggcccctgaagccgtcagcgccaactag

SEQ ID NO: 242434 - DNA, 1167 bp, Artificial Sequence
  Description of Artificial Sequence: Synthetic coding sequence
atggcttccctgctgggcgcttatccttggcctgaaggcctggaatgtcccgcactcgatgcagaactgagcgacgggcaatcccccccagccgtgcccagacccccaggcgataaaggctctgagagtaggatccggagacctatgaacgctttcatggtgtgggccaaggacgagcgcaaacgtttagctgtgcagaaccccgacctccataacgcagaactcagcaagatgctcggcaagtcttggaaagcactgacgctatctcagaaaagaccttatgtggatgaggcggaaaggctcaggcttcaacatatgcaggactacccaaactataaataccgtcccaggcgtaaaaaacaggcaaagcgcctatgcaaacgggtcgatccaggatttcttctgtcatccctgagtagagaccagaacgctttgcccgaaaagcggtccgggtccaggggcgctctcggagaaaaagaggaccgcggagaatatagtccagggaccgctttaccttctttgcggggatgctatcacgaagggcctgccggagggggtggtggcggaaccccatcttcagtggatacctatccctatggtctccccacaccccctgagatgtcccctttggacgtgctcgagcccgagcagacatttttctcgtctccttgtcaggaggaacatgggcatccccgtaggatcccacatttaccaggacatccttattcccctgagtatgcaccctccccactgcactgttcccacccgcttggttctctcgctctgggtcagtcacctggagtgtctatgatgtcccccgtccccggatgtcccccatctcctgcctactactccccagcaacttaccaccccctacattctaacttgcaagctcatttgggccagttgagcccaccgccagagcacccaggatttgatgcgttggaccagctgagccaagtggagttgctcggagacatggaccgcaacgagttcgaccagtatctgaatacccctgggcatccagacagtgcgacaggtgcgatggcactgtctggacatgtccccgttagtcaggtgactccaactggaccgactgaaacaagtttgatatccgtcttggctgacgcgacggccacatactataattcttatagcgtgagctag

SEQ ID NO: 242435 - DNA, 1323 bp, Artificial Sequence
  Description of Artificial Sequence: Synthetic coding sequence
atgagcatgctagcagaacggcgtcgcaagcagaaatgggcggttgaccctcagaacactgcgtggagtaatgatgactctaaatttggacaacggatgctggaaaaaatggggtggtccaagggcaagggactgggcgctcaggagcagggggcaaccgaccatataaaagtacaggtgaagaacaatcacctgggactgggagctacgataaacaatgaggataattggatcgcccaccaggatgattttaatcaattgttagccgagctcaatacatgtcacgggcaagaaaccacggatagtagtgacaagaaagaaaagaagagtttttctctcgaggagaaaagcaagatctctaaaaacagagttcattacatgaaattcacaaagggcaagagctggaaggccttaacattgagtcagaaaagaccatatgttgatgaagcggagcggctccggctgcaacatatgcaggactatccaaattataagtatcgacccagacggaaaaagcaagctaagcgtctgtgcaagcgcgtggatcccggatttctgcttagcagcctttctagggatcagaatgcattgcccgaaaaaaggtcaggctcacgtggggctcttggggagaaggaggatcgcggagaatactccccaggcaccgcattaccctccttgcggggatgttaccatgagggccctgcgggtggtggcggtggaggtaccccatcctccgttgacacatacccctatggactgccaacacccccagagatgtctcccctggacgtgctggagcctgaacagactttttttagcagcccctgccaggaggaacacggacaccccagaagaattcctcacttacccggtcatccatactctcccgagtacgcaccgtcacctttgcattgttcacatccactgggaagcctggctctaggacaaagccctggcgtctccatgatgtctcccgtcccaggatgtccgccaagccccgcttattactcacccgctacgtatcaccctctccacagcaacctgcaggcccacctcggccagctctctccacctcctgagcaccctggctttgacgcccttgatcagctgtctcaagttgagctgctgggcgacatggataggaacgagtttgatcaatacttaaacacaccaggccacccggactccgctactggcgctatggccctctccgggcacgtgcccgtgagccaggtaacacctactggtcctacggaaactagcctaatcagcgtgctagctgatgctaccgcaacgtattataactcctacagcgtgtcatag

SEQ ID NO: 242436 - DNA, 1341 bp, Artificial Sequence
  Description of Artificial Sequence: Synthetic coding sequence
atgctcgacatgtcagaggccaggtctcagcccccatgcagcccatcaggcaccgccagcagcatgtcgcatgtggaggattccgacagcgatgcacctccaagtcccgcaggaagtgaggggttgggtcgcgcaggggtggcggtggggggtgctagaggcgaccctgccgaggccgcagatgagcggtttcccgcatgtattcgcgacgctgtgtctcaggtactcaaaggttatgattggtcactagtccctatgccagttcgtggcggaggaggcggtgccctaaaggctaagccacacgttaaacggcctatgaatgccttcatggtgtgggctcaggcagcgcgaaggaagctcgcggaccagtatccacacttgcacaatgccgaactcagcaaaactctgggaaaactttggcggctgttgtccgaaagcgaaaaacgtcccttcgtggaagaagcagaacggctcagggttcagcacaaaaaagatcacccagactacaagtaccaacctcgaaggcgcaagtccgcgaaagctggccatagcgacagcgatagcggtgctgagctgggcccacatccaggaggcggagcagtgtacaaagctgaggccggactgggggacggccatcatcatggggaccacactggccagactcacggacccccaaccccccctaccactcccaaaactgagctgcagcaagcaggagcgaaacccgagctgaagttggaagggagacgccctgtggattccggaagacagaacatagatttcagcaacgttgatatctccgaactaagctctgaggtgatgggaaccatggacgcttttgatgtacacgaattcgaccagtaccttccactcggtggccctgctccaccagagccaggccaggcatatggcggagcatactttcatgctggtgcatccccagtgtgggctcataaatccgcgccttccgcttccgcttctccgaccgagacaggacctcccaggccacatatcaaaacagagcagccctctccgggacactatggagatcagcctagaggcagtcctgactacgggagctgttctggtcagagttcggccactcctgcagcgcctgcaggtcctttcgcagggagccagggggactacggagacctacaggcttcgtcctactacggggcttaccctggttacgcccctgggctgtaccagtacccctgtttccatagtcccaggaggccctatgccagccccctccttaatggacttgctctgccccctgcacatagtcctacctcccactgggaccagcccgtctacactacactgacgaggccctag

SEQ ID NO: 242437 - DNA, 1530 bp, Artificial Sequence
  Description of Artificial Sequence: Synthetic coding sequence
atgaatctactcgaccctttcatgaaaatgacagatgagcaggaaaaaggactttccggcgctcctagtcccaccatgagcgaagatagtgccggatcgccatgtccgtccgggtctggaagcgataccgaaaacacccgccctcaggagaacacgttcccgaagggggagccggatctcaagaaggaaagcgaggaagacaaatttccagtatgtattagggaggccgtgtcgcaggttctgaaaggttacgattggaccctcgtaccaatgccggttagggtgaatggatcgtctaaaaataaaccccacgtcaaaaggcctatgaatgcgtttatggtgtgggcacaagctgctcggcgtaaactggcagatcagtatccgcacttgcataacgccgaactgagcaagaccctcgggaagctgtggagactgctgaacgaatccgaaaagaggccatttgtggaggaggctgagcgtctgagagtacaacacaagaaagatcaccccgattacaagtatcagccaaggcgtcgcaaaagtgtcaagaacggacaggctgaagctgaggaagccacagagcaaacccacatttcacccaatgccatctttaaagctcttcaggccgattctcctcatagtagttccggcatgtccgaggttcattctccgggtgagcacagcggccaatcccaaggtccgcctaccccaccaactacaccaaagaccgatgtccagcccggaaaggctgacctgaagcgggagggcagaccattgcctgaaggcggtcgccagcccccaattgattttcgtgacgttgatatcggcgagctctctagtgatgtaatcagcaatatcgaaacctttgatgtgaacgaattcgatcaatacctgccacccaatggtcaccctggcgttccagctacccacggacaggttacctacacagggtcttacggcatcagctctaccgctgcaacaccagcaagtgcaggacatgtctggatgtccaaacaacaagcccctccccctcccccacagcagcccccacaagcaccgcctgcccctcaagcgcctccacagccacaggccgcaccaccacagcagcccgcagcaccacctcagcagccgcaggcgcacacgctgactacgctgtcttccgagccaggccagagccagcgtacacatatcaagaccgaacagctaagcccttcacactatagtgagcagcagcagcattcccctcagcagatcgcgtattcaccattcaatttacctcattatagccccagctaccccccaatcacacgctctcagtacgactatactgaccaccagaatagctcctcctactattctcatgccgctggccagggcacagggctctactccacattcacctacatgaacccagcacagagacctatgtacaccccaattgctgacacgtcaggcgtgcctagcatccctcagacccattctccccagcattgggagcagcccgtatatacacagttaacccggccttag

SEQ ID NO: 242438 - DNA, 1338 bp, Artificial Sequence
  Description of Artificial Sequence: Synthetic coding sequence
atgaatctgcttgacccatttatgaagatgactgatgagcaggaaaaggggctgagtggggcaccctctcccaccatgtccgaggactccgctggctccccttgtccttcaggatccggctcggataccgaaaacacccggccacaagagaataccttcccgaagggagaacctgatctgaagaaggagagtgaggaggacaagtttcccgtgtgtatccgagaagccgtttctcaggtcttaaagggctacgattggactctcgtgcccatgcctgtgcgcgttaatggatccagcaagaacaagcctcatgttaagcgtccaatgaacgctttcatggtgtgggcacaggcagcacggaggaagctggccgaccagtatcctcatttacacaacgccgaactgtctaaaactctgggcaagctatggcgtctgctgaatgagtccgaaaagcggccttttgtggaggaagctgagagactgagggtgcagcacaagaaggaccacccagattacaaatatcaacccagacgtagaaagtcggtcaaaaacggccaagccgaggctgaggaagcaacagaacagacccacattagccctaacgccatctttaaggccctgcaggcagattccccccacagtagttcggggatgtccgaggtgcacagtcccggagagcacagtgggcagagtcaaggtccacccactcctcccaccactcctaagaccgatgtccaacccggtaaggccgatcttaaacgggaagggaggcctctgccagaaggaggtcggcaacctcccatagactttcgtgacgttgacattggagagttgtcaagtgacgtaattagcaatatcgaaacatttgacgtgaacgagtttgatcagtacttgccacccaacggccacccaggagtgccagctacccacggtcaagtgacctatacaggctcatacgggatcagctcaacagccgctacccccgcatcagcagggcatgtgtggatgagcaaacagcaggcccctccacctccaccccagcagcattctccacagcagattgcatactctccattcaacctcccccattactccccctcctaccctcctataactcgttctcagtatgattataccgaccatcagaactctagttcttattactcccatgcggctggtcagggcacaggcctctattctactttcacctacatgaaccccgcacagcgcccaatgtatacccctatcgcagacaccagcggcgtgcccagtatccctcaaacccacagcccgcagcactgggagcagcctgtgtacacccagttgaccaggccatag

SEQ ID NO: 242439 - DNA, 273 bp, Artificial Sequence
  Description of Artificial Sequence: Synthetic coding sequence
atgcgcggatatctcgtcgctatttttctttcagcagtatttctgtactacgtgctgcattgcatcctgtgggggactaacgtctattgggtggcacctgttgaaatgaaaagacgcaacaagatccaaccatgtctctctaaacccgcatttgctagccttctctcccagtcatcggcttacatcttgagaaaaggtatagaggagctgaatcaaacgtctatccttttcactcaggtgtcttcagtcagcccgttcagcgtctgcgggtag

SEQ ID NO: 242440 - DNA, 273 bp, Artificial Sequence
  Description of Artificial Sequence: Synthetic coding sequence
atgcggggttatctcgtcgcaatcttcctctccgcagtcttcttatattatgttctgcattgcattctgtggggaacaaatgtttattgggtagcccctgtcgagatgaagagaagaaacaaaatccagccatgcttaagtaagccagccttcgctagcctgctcagtcaatctagcgcttatatccttcggaagggaatagaggaattaaatcaaacatctatcctgttcacccaagtctcctcggtgtctcccttttcagtctgtggctag

SEQ ID NO: 242441 - DNA, 1335 bp, Artificial Sequence
  Description of Artificial Sequence: Synthetic coding sequence
atgggattgctggtgtttgtgagaaacttactcttggcgctctgtttgtttcttgtgctgggctttctttactacagtgcctggaaactacatctgctccagtgggaggaagatagtagcaagtactcccattccagtagtccccaagagaaacccgtggctgattcagtggtattgtctttcgactcagcgggacagaccttaggcagtgagtatgataggctcgggtttctgctgaatctggatagcaagttgagtcctcggaccctgtgtactgtcgtgtttggattagattgtatcctggagagcccgggtgagccgaaaaagttactcatgcctgccagccacccgctggagatattgaaatcactttcagaggacactgctttcgctttgggctttctgaaactgccaaggccagcagaactggctaccaagtacgccaacttctcagagggagcatgtaagcccggttacgcatcggccctgatgaccgctatatttccaagattttctaagcctgccccaatgtttctggatgatagcttcagaaagtgggctagaatcagggaattcgtccccccattcggcattaagggccaagacaatctaattaaagctatcctctcagtgacgaaggagtacagactgactcccgcactcgattctctgcgatgcaggcgctgcataatagtggggaatggtggagtcctcgccaacaagtctctgggcagccggattgacgattatgatattgtagtgaggctgaacagtgctccggtgaaaggattcgagaaagatgtgggatcaaagactactcttaggattacctaccccgaaggcgctatgcagcgcccagagcagtatgagcgggattctctgtttgtgctagctggctttaaatggcaggacttcaagtggctgaagtatatagtatataaagagagagtgagtgcgtctgacggtttttggaagtccgtagcaacacgtgtgcccaaggaaccaccagagatcagaatcctgaacccttatttcatacaagaggctgcctttactcttattggcctgccctttaataacggcctaatgggacgtggcaacattcctacactcggttccgttgccgtcaccatggcactgcatggatgcgacgaggtcgcagtggctggttttggttatgatatgagcactcccaacgccccactgcattactatgagacggtgcgcatggcagcaattaaagagtcatggacgcacaacatacagcgtgaaaaagagttccttcgcaaattggttaaagctagggtgatcactgatctctcatccggcatttag

SEQ ID NO: 242442 - DNA, 468 bp, Artificial Sequence
  Description of Artificial Sequence: Synthetic coding sequence
atgggactcctggtcttcgttagaaatctgttgttggccctgtgcctgtttctggtgcttggctttctgtactatagtgcatggaagctgcaccttctgcagtgggaggaagactcaaactcggtggttctaagtttcgactccgcaggtcagacactgggctctgagtacgataggctgggatttcttctaaatctggactctaagctcccagctgaattagctaccaagtacgctaacttctcagaaggggcttgcaaaccaggatatgcttccgccctgatgacagccatttttccgaggttcagcaagccagccccaatgttcctcgatgatagcttcagaaaatgggcccgaatccgggaattcgtgccgccatttggtatcaaaggccaggtattagatgcccagtatccagctcgagaaagagtgtccgccgaagccggagagtcaagccgtcatcattag

SEQ ID NO: 242443 - DNA, 1035 bp, Artificial Sequence
  Description of Artificial Sequence: Synthetic coding sequence
atgggcctgttggttttcgttcgaaatcttctcctcgcactttgcctctttctggttctgggatttctctactattccgcttggaaactgcacctgctgcagtgggaggaggatagtaactccgtcgttctgtcatttgattccgccggtcagaccctcggatccgagtatgacaggcttggcttcttgctaaacctggacagtaaactgttctcgaagcccgctcccatgttcctcgatgatagttttcgtaaatgggcccgaatacgcgagtttgtacctccgtttgggataaaaggtcaggacaatttgattaaggccattctgagtgtcacaaaggagtacaggctgaccccagccttggactccctcaggtgccggagatgtatcattgtgggaaacggcggtgtgctggcaaacaaatctctagggtccagaatagacgactacgacatcgtcgttcgcctgaatagcgcacctgtaaaaggtttcgaaaaagacgtagggagcaaaaccacattaagaatcacatatcctgagggggctatgcagagaccagagcagtacgagagagacagtctgttcgttctggcagggttcaagtggcaggattttaagtggctgaaatacattgtgtataaggaacgggtgagcgcctcagacggattttggaaatcagttgccactagagtgccaaaggaaccgccagaaattagaattctcaacccgtatttcatacaagaagctgcctttactcttatcggcctccccttcaacaacgggctgatgggacgcggtaacattcctaccctcggctccgttgccgttaccatggccctgcatggctgcgacgaggtggctgtggctgggtttggctacgacatgagcaccccaaacgctcccctacattattacgaaaccgtccgcatggctgccatcaaagagtcatggacacataatattcagcgggagaaggagtttctgaggaagctggtgaaggccagggttataactgatctgagttctggcatttag

SEQ ID NO: 242444 - DNA, 687 bp, Artificial Sequence
  Description of Artificial Sequence: Synthetic coding sequence
atgggacttctcgtcttcgtgcgcaacctcctgttggccctatgtcttttcctggtgctgggcttcctatactacagtgcttggaagcttcacctactccagtgggaagaggactccaagtacgatcgcctcggcttcctgctcaatttggactccaagttgcccgcagaacttgcaacaaaatacgcaaactttagcgagggagcctgcaagccaggctacgcatccgcgctgatgactgccattttccctcggttctcgaagcctgccccaatgttcctcgacgacagcttccggaaatgggcacggatccgggaatttgttcccccttttggcatcaaagggcaggacaatttgattaaggccatcctcagtgtcaccaaagaatacagattaacgcctgctctggatagtttacgctgccggcgatgcatcattgtcggcaatggcggagtattagctaataaatcactgggctctaggatagacgattacgacatcgtggtgagggttcatagaatggcaagcgggaacctttggcctctcgagtgtccccgttctcccctgaggtttgagtcttctacccacatctcttccagaaggccgcctagcccatctcttgcatgtccctccaccatggcctcatgggctggtggtacttcgttgcccctggccgtttggcaatag

SEQ ID NO: 242445 - DNA, 1173 bp, Artificial Sequence
  Description of Artificial Sequence: Synthetic coding sequence
atgggcctcctggtgtttgtgcggaacttgctccttgctctctgtctattcttagtgctgggattcttatattattcagcgtggaagttacatctcttgcaatgggaagaagattcatcaaaatacagtcacagtagttcaccacaggaaaaacctgtagccgactctgtcgtgcttagttttgactccgcaggtcagacccttggcagtgaatatgaccgcctgggctttttactgaacttggattccaaactccctgctgagctggccaccaagtacgctaacttcagcgagggtgcctgcaagcctggttacgctagtgctctgatgacagctatctttcccagattttccaagccagcaccgatgttcttggacgactcattccggaagtgggcgcgtattcgggaattcgttccaccgttcggcattaaaggccaggacaacttaatcaaagccatcttatctgtgaccaaggaatatcgcctgacccctgccctggatagtctcaggtgcaggcgctgtattatagtggggaacggcggtgtgttagctaacaaatccctcggctccagaattgatgactatgatatcgtcgtgcgactaaatagtgctccagttaagggatttgaaaaggacgtggggtcaaagacaacactccgcataacctatcctgaaggcgctatgcagagaccggagcagtacgagcgggactccctttttgtgctggctgggttcaaatggcaggacttcaagtggctcaagtacatcgtttacaaggagagagtttcagcttcagatggcttttggaaaagcgtagcaaccagagtgccaaaggaaccgccagagatccgcatactgaatccgtactttattcaggaagcagcgtttacactgattgggctaccattcaacaacggtcttatgggtagggggaatatcccgactctcggctccgtggccgtgacgatggcattgcatggctgtgatgaggtggctgtagcaggattcgggtatgatatgtccacccccaacgctcccttgcactattatgaaactgttcggatggcagcaataaaggagtcctggactcataatattcaacgcgaaaaagagtttttgcgaaaactcgttaaagcccgagtgattacagatttgtctagcgggatatag

SEQ ID NO: 242446 - DNA, 1242 bp, Artificial Sequence
  Description of Artificial Sequence: Synthetic coding sequence
atgggattgctggtgttcgtcagaaatcttctcctggccttatgtctgttcttagtcctggggttcctctactactctgcttggaagctccatctgctgcagtgggaagaagactctaaatatgaccgtctggggtttcttctcaacctcgatagcaagctgtccccacgtactctgtgtaccgtggtgtttggcctggattgcattctggaatctcccggtgaacccaagaaactgctgatgcctgcatcccacccactcgagatcctaaaaagtctcagcgaagataccgctttcgccctgggcttcctcaagctacctcgcccagccgaattggctacaaaatacgctaactttagcgagggtgcctgcaagcccggatacgcaagcgccctgatgactgcgatctttccgcgtttttctaagcccgcaccaatgtttctggacgacagcttccgcaaatgggctcggatccgtgagttcgtgcccccttttggaataaaaggccaggacaacctgatcaaagcgattcttagtgttaccaaagagtaccggttgaccccggctctggactctcttcggtgccggagatgcataatcgtggggaacggcggagttttagccaataaaagtctcggctctaggatagatgactacgacatcgttgttagactgaatagcgcaccagtcaaaggcttcgagaaggacgtgggcagtaaaactacactacggattacctacccggaaggcgcaatgcagcgccctgagcagtacgagcgtgactcactttttgtgttagccggatttaaatggcaggacttcaagtggctcaagtatatcgtctacaaagaaagggtctctgctagtgatggattctggaaatccgtggccaccagagtaccaaaggagcccccagaaatccgaattctgaacccctatttcatacaggaggcagcctttacccttattgggctgcccttcaataacgggctgatgggcagaggaaacatccccaccctgggctcagtggccgttaccatggcactgcacggatgcgacgaagttgccgttgcgggattcggctacgacatgagcacacctaatgcccctcttcactactatgagaccgttagaatggcagctataaaagaatcatggacacataatattcagcgcgagaaggaattcctgaggaaactggtaaaggccagggttatcaccgacctcagcagtggaatctag

SEQ ID NO: 242447 - DNA, 834 bp, Artificial Sequence
  Description of Artificial Sequence: Synthetic coding sequence
atgggccttcttgtgtttgtgcgcaaccttttgctggctctttgtttgtttcttgtgctcggatttctgtactactccgcttggaaactgcatcttctgcagtgggaggaagatagcaacagtgtcgtgttatccttcgactcagctgggcagactctgggctcagaatacgatcgccttggctttctcctgaacttggatagtaaattacctgcagagctggctacgaagtatgccaacttcagcgagggggcatgtaagccgggttacgccagcgccctgatgacggcaatctttccacgattctctaagcctgcacccatgttcttagacgactccttccgcaaatgggcacggattagggagtttgtgccaccctttggtatcaagggccaagacaacctcattaaggctattctgtcagtgactaaggagtacagattaactccagcgctcgatagtctccgttgccggaggtgcatcatcgtgggcaacggcggagtcctggcaaataagagccttggcagcaggattgatgactacgatatcgtggtgagattaaactctgcgcctgtcaagggcttcgaaaaagatgttggcagcaagactacactgcgcattacttatcctgagggggctatgcagaggcctgagcagtatgagagagatagtctgttcgtcttggccggatttaagtggcaagattttaaatggctaaaatatattgtctacaaggagcgcgtgtcgtggactcacaacattcaaagagagaaggagttcctgaggaagctggttaaagcacgggtgattactgacctctcatctggaatctag

SEQ ID NO: 242448 - DNA, 1128 bp, Artificial Sequence
  Description of Artificial Sequence: Synthetic coding sequence
atgggcttgctggtgtttgtaaggaacctattactggccctgtgcctttttctggtcctgggctttctctactactctgcctggaagctgcaccttctgcagtgggaggaggattctaatagtgttgtgttgtcctttgattccgccggacagacgctgggctccgagtatgaccggctcggcttcctgctgaatctggacagtaagttgcccgcagagctggccacaaaatatgctaactttagcgagggcgcatgcaagcccggttacgcttctgccctaatgaccgcaatcttcccgcgttttagcaagcctgcgcctatgtttctcgacgactcgttccgcaagtgggctcggattcgcgaattcgttcctccctttggaatcaaggggcaggataacctgattaaggcaattctgtccgttactaaggagtatagactcacccctgcactcgacagccttagatgccggcgatgcattatcgtgggcaacggaggagtcctggcgaataaaagtctggggagccggatagatgactacgacattgtggtgcgtctgaattcagcccctgttaagggtttcgagaaagacgtgggctccaaaaccacactgaggattacataccccgagggagccatgcagcgcccagaacagtacgaacgcgatagcttattcgtgctagctgggttcaaatggcaggatttcaaatggttaaagtacatcgtgtacaaagaacgcgtgagcgccagcgatggattttggaaatctgtggccacccgggtgccaaaggagccaccagagattcgcatcctgaacccctactttattcaagaggctgccttcaccctgattgggctgccatttaataacggcttgatggggagaggaaatattcctacactgggctcagtggcagtaacaatggctctgcacggatgcgatgaagttgccgttgccggattcgggtacgacatgtcaacacccaatgccccacttcactactatgagactgtccggatggctgctatcaaagagagctggacacataatattcagagggagaaagaattcctgcgtaagttggttaaggccagagtcataactgatttgtcatctggaatctag

SEQ ID NO: 242449 - DNA, 1080 bp, Artificial Sequence
  Description of Artificial Sequence: Synthetic coding sequence
atgggcttgctcgtgtttgtgcgaaacttactgcttgccctttgtctttttctggtgttggggttcctgtattacagtgcctggaagctacacctgctgcagtgggaagaggactctaagtacgatcggttgggctttctgctgaatctcgacagtaaactgccagccgagctggcaacgaagtacgccaattttagcgagggggcttgtaaaccagggtatgccagcgcgctgatgaccgctatatttcctaggttttccaagcctgcgccaatgttcctggacgacagcttccgtaaatgggccaggatacgtgagtttgtgcctccattcgggatcaagggtcaagataacctgatcaaggctattctctctgttacaaaagagtacagactcacccctgccctcgattcactgcgatgccgccgatgcattatcgtgggtaacggaggggtgctggccaataaatcccttggctcgcgtatagatgactacgacatcgtcgtgaggcttaactctgccccagtcaaggggtttgaaaaggacgtcggcagcaaaactaccctgagaattacatatccagagggtgcgatgcagcgaccagaacaatacgagcgtgacagcctctttgtcctggcaggcttcaagtggcaggatttcaagtggctcaagtacatcgtttacaaagaacgagtgtccgcctccgacggcttctggaaatcagttgctacccgggtgcctaaagagcccccagaaataaggattctaaacccatactttatccaggaagctgccttcactctcattggcctgcctttcaacaatggacttatgggccgaggcaacattccaacgctggggagcgtggcagttactatggccctccatgggtgcgatgaggtcgccgtcgcaggcttcggctatgatatgagcactccgaacgctccactgcactattatgagacagtccgtatggccgctattaaggaaagctggacacacaatattcagcgggagaaggaattcctgcgtaagctggttaaggcaagggtgataaccgatctcagttccggcatctag

SEQ ID NO: 242450 - DNA, 1335 bp, Artificial Sequence
  Description of Artificial Sequence: Synthetic coding sequence
atggggctgctggtgttcgtgagaaaccttttactggcactgtgcttatttctggtgctgggtttcttatattactcagcttggaagctgcatcttttgcagtgggaggaggactcctcaaaatatagtcacagctcaagtcctcaagagaagcctgttgccgatagcgttgttcttagctttgattctgccggacagaccctcgggtcagaatacgataggctgggttttcttctgaatctggatagtaaactttcccctcgcacactgtgtaccgttgtcttcggcctggactgtatcctggagagtccaggcgaaccgaaaaaactgctaatgcctgcttcccaccctctggaaatcctcaaaagtttaagtgaagacacagcctttgccctggggtttcttaagttaccacgccctgccgagttggctactaagtatgcaaatttttcggagggcgcatgtaagcccggttacgcctccgcactgatgaccgccatcttcccccgattcagtaagcccgctcctatgttcctcgatgactccttcagaaaatgggcaagaataagagagtttgtgcctcccttcggcattaagggacaagacaatttgatcaaagccattctttctgtgactaaggagtacagactcacgcccgctctcgactcgctgcggtgccgccgatgcatcatcgtgggaaatggtggagttctagccaacaaaagcctgggatcccgcatcgatgactacgatattgtggtaagactcaactctgcccctgttaagggatttgagaaagacgtggggtcaaagacgactcttcggataacgtaccccgaaggggcaatgcagagacctgaacagtatgagcgcgatagcctctttgtgctggccggttttaagtggcaggacttcaagtggttaaaatacatagtttataaggagagagtttcagcgagcgatggcttctggaagtctgtggctacaagagtcccgaaagagcctccggaaatcagaattctaaacccctatttcattcaagaggccgcatttacccttataggcctgcctttcaacaacggcctgatgggtagaggaaacatccctacccttggatccgtggcagttactatggctctgcatggatgtgatgaggtggcagtcgcgggttttggctacgatatgtcaacaccaaatgctcctttgcattactacgagactgttagaatggcggctattaaggaatcatggacccacaacatacagagggaaaaggagttcctacgcaaattagtgaaggcgcgagttattacagatctctcatctgggatttag

SEQ ID NO: 242451 - DNA, 513 bp, Artificial Sequence
  Description of Artificial Sequence: Synthetic coding sequence
atgggcctcctggtgttcgtacggaacctcttgttagcgctatgtttatttctggttctcgggtttctgtattactccgcttggaagttacatctgttgcagtgggaagaggattcctccaaatacagtcattcttcgtccccccaggagaagccggtcgccgatagtgtcgtgctgagctttgattcagcagggcagacactgggctctgaatatgatcggctgggattcctcttgaacctggactccaagctgccagccgaattggcaactaaatatgccaacttctctgagggtgcctgcaagcctggatatgcatccgccctcatgacagcaatatttcctcggttctctaagcccgctcccatgttcctggacgatagcttccggaaatgggcaaggatccgtgaatttgtaccaccattcggcattaaaggacaggtgctggacgctcagtacccggcaagggagcgtgtgtccgctgaagctggagaaagttcaagacaccactag

SEQ ID NO: 242452 - DNA, 468 bp, Artificial Sequence
  Description of Artificial Sequence: Synthetic coding sequence
atgggtctgctcgtgttcgtccgtaatctcctcctggcattgtgtctgtttcttgttctaggttttctctactactcggcttggaaattacatctgctgcaatgggaagaggactccaatagcgtggtgttgagttttgatagcgccggacagaccctcggcagcgagtacgacagattgggcttcctgttgaacctggactctaagcttcccgcagaactcgccaccaaatacgccaacttttcggagggggcatgcaagccgggttatgcttctgcccttatgacagccatattcccaagattttccaaaccggctccaatgtttctagatgactcttttagaaaatgggccaggatcagggagttcgtgcctcccttcgggattaaaggacaggtgctggatgcgcagtatccggctagggagagagttagtgccgaagcaggtgagagcagccgccatcactag

SEQ ID NO: 242453 - DNA, 561 bp, Artificial Sequence
  Description of Artificial Sequence: Synthetic coding sequence
atgggacttctggtgtttgtgcgcaacctcttgctggctctgtgtctttttctggtgctgggatttttgtattactccgcatggaagcttcatcttctccagtgggaggaagacagcaactctgtagtcctgtcattcgatagtgccggacagaccctcgggagtgagtatgaccgattagggtttttgctgaatctggatagcaagctgcctgcagaactcgcgacgaaatacgctaatttctcagagggtgcttgtaaaccagggtacgctagcgctctgatgaccgctattttcccaagatttagtaagcctgctccaatgttcctggatgatagctttcggaaatgggccagaataagagaattcgtgcccccatttggtattaaaggccaggacaacctaataaaggcaattctttcggttaccaaagagtatcggctaactcctgctctggattccctcaggtgcaggcgttgtatcattgttggtaacggaggggtgctagccaataagtctctcgggagccgtatcgacgattacgacatagtggtgcggtag

SEQ ID NO: 242454 - DNA, 558 bp, Artificial Sequence
  Description of Artificial Sequence: Synthetic coding sequence
atgggtcttctcgtgtttgtgcggaacctgctgcttgcgctttgtttgtttcttgtcctggggttcctgtattacagcgcttggaaattacacctgcttcagtgggaggaagatagctctaagtacagtcactcctcatctccacaggaaaaacctgtggcagaatacgatcgcctggggttcctgctgaatctagattctaaattgccagctgagctcgccaccaagtatgcaaacttcagtgagggagcttgtaaacctgggtacgcctccgctttgatgactgctattttccccagattttcaaaacccgctccgatgtttctggacgactcttttcgtaaatgggctcggattagggaatttgtgccgccttttggaatcaagggacaggataacttaatcaaggccattctgagtgtgactaaagaatatcgactcacgccagccctggattcacttcgctgtaggcggtgtatcattgtcggaaatggtggcgtgctcgcaaataagtcactcggctcccgcatcgatgactacgatattgttgtgcgttag

SEQ ID NO: 242455 - DNA, 606 bp, Artificial Sequence
  Description of Artificial Sequence: Synthetic coding sequence
atgggactcctcgtgtttgtcagaaacctgctgttggcactgtgcctctttttggtgttagggtttttatactacagcgcttggaagcttcatctgttgcaatgggaagaggacagcagcaagtattctcattccagttcgcctcaagaaaaaccagttgctgagtatgataggctggggtttctgctgaacctggattcaaagctccctgctgagctggccacgaaatacgctaatttctccgagggcgcttgcaagcctggttacgccagcgctctcatgaccgcaatcttcccccgtttttctaagccggctccaatgttcctcgacgattcttttagaaaatgggccaggatcagagaattcgtccccccttttggtatcaaagggcaagacaatctaatcaaggctatccttagcgtcactaaagaatacagactcacccctgcgctggattctctgaggtgccgccgatgtatcatagtggggaacgggggagtgctggccaataaatctctgggatctcgcatcgacgactatgatattgtggtgagccctggccgaacaatatcaagcgagcgcaaatcgttttgtggaagctggtag

SEQ ID NO: 242456 - DNA, 1290 bp, Artificial Sequence
  Description of Artificial Sequence: Synthetic coding sequence
atgggactccttgtcttcgtgcggaacctgctgctcgccctatgtctgtttttggtgctaggcttcctgtactatagtgcttggaaacttcacctccttcagtgggaagaagattctaacagtgtggtgctcagctttgattctgccggtcagaccctcggaagcgaatatgaccgcttgggcttcctgttaaatctggactccaaactcagcccaagaaccctgtgcaccgtggtctttggcctcgactgtattttggaaagtccaggagagcctaagaaactccttatgcccgcttctcatccactagagatcctcaaaagtctttccgaagacacggcattcgcgctgggctttcttaagctccccagacccgctgagctggccacaaaatatgccaactttagcgaaggtgcttgcaagcccggttatgcctctgcactgatgacagctatatttcccagattttcaaagccagctcctatgtttttggatgattccttcaggaaatgggcaagaataagagaattcgtgccacctttcgggatcaagggacaagacaatcttattaaagcaatcctatctgtcactaaggagtatcgattgaccccagctctggactcacttcggtgtaggcgttgtatcatcgtcggcaacggcggagtgctggccaacaaaagtcttggtagcaggatcgatgattacgacatcgtcgtgaggctaaactccgcccctgtgaaagggttcgagaaggacgtcggcagcaaaacgacgctgcgcatcacatacccggagggggctatgcagcggcctgaacagtacgaaagagactctctgtttgtgctggcaggcttcaagtggcaggacttcaagtggcttaaatatattgtgtacaaggaaagggtgtcggcaagcgatggcttttggaaaagtgtggccactagggtcccaaaagagccacccgagattagaattctgaacccgtacttcattcaggaagcagctttcacactgatcggtttgccctttaataacggcttgatgggacggggaaatatccccacactgggcagcgtggccgttacgatggccctgcacggttgtgacgaggtcgccgttgccggattcggttatgatatgtccacccctaacgctcccctgcattattatgaaaccgttaggatggctgctatcaaggagtcttggactcacaatattcagcgcgagaaagagtttcttagaaaactggttaaagccagagttatcacagacctctcatccgggatctag

SEQ ID NO: 242457 - DNA, 1038 bp, Artificial Sequence
  Description of Artificial Sequence: Synthetic coding sequence
atgggcctgctggttttcgtgaggaatctgctcctcgcactctgcctctttttggtgttaggcttcctgtattattcagcctggaaactgcatctcttacagtgggaagaggacagcaatagcgtcgtcctatcatttgactctgctgggcagactctgggcagtgagtatgaccgtctaggttttctgcttaatctggacagcaaacttccagcagagcttgcaacgaaatacgccaatttctctgagggcgcatgtaaacccggttatgcttccgccctgatgacagcaattttcccacgattctcaaagccagccccaatgttcctcgatgatagcttccgtaaatgggcgcgaatacgggagtttgtgcctccatttggaatcaaggggcaggataacctgatcaaggctattctcagcgtgacgaaagaataccggttgacacctgccctggactcattgagatgtcgtcggtgcattatagtgggtaatggaggcgtcttagcaaataagtcgctgggcagccggatcgatgactatgatatagttgtgcggctcaattccgcacctgtcaagggattcgagaaggacgtcggctctaagaccacactgcgaattacctaccctgagggtgccatgcaaagaccagaacagtatgagagggattcacttttcgtgttggcaggttttaagtggcaggactttaaatggttgaagtatattgtctacaaggaaagagtcgaagcggcattcacactgatcggcttaccattcaacaatgggctcatgggtcgcggaaacatacctaccttaggctctgtggcagttacaatggcgctacatggctgcgacgaggtggcagtagccggattcgggtatgacatgagcaccccaaatgcaccgctgcattactacgagaccgtgaggatggccgcaataaaagagagttggacacacaacatccagagggaaaaggaatttctacggaaactggtgaaggcacgcgtgatcacagacctcagcagcggaatttag

SEQ ID NO: 242458 - DNA, 1242 bp, Artificial Sequence
  Description of Artificial Sequence: Synthetic coding sequence
atgggactgctggtcttcgtaaggaatctcttgctggcgctgtgcctcttcctggtgcttggtttcttgtattacagtgcatggaaattgcatttactgcagtgggaagaagactctaaatacgaccggctaggctttctgctgaacctggactccaagctctcccctaggacattgtgcacagtcgtgttcggcttagactgtatcctggagtctcccggagaaccaaaaaagcttcttatgcccgcatcacatcctctggagatactgaagtctctgtccgaggataccgcttttgccctggggtttctgaagctgccccgaccagccgaactcgccacaaagtatgccaacttcagcgagggggcttgcaagccgggttatgctagtgccttgatgacggccattttccccagattttctaagcctgccccaatgtttctagacgatagtttccggaaatgggcacgcatcagagaatttgtcccaccattcggaataaaagggcaggacaacctgatcaaggccatactcagcgtcaccaaagagtaccggttgacccctgccctcgattcattacggtgccgaaggtgtattattgtggggaacggtggcgtattagccaataagagtttgggctctaggatagatgactacgacatcgtggttcgcctaaactccgcccctgtgaagggtttcgagaaggacgtgggttccaagacgaccctgagaattacttatcctgagggggcaatgcaacgtccagagcagtatgaacgtgactctctgttcgtgctcgccggttttaagtggcaggattttaagtggctgaaatacatcgtttacaaggaacgcgttagcgccagcgatggattttggaagtctgtagccacccgagtgcctaaggaaccaccagagatccgtatactgaacccttatttcattcaggaagccgctttcaccctgattggtctgcctttcaataatgggctaatgggcaggggtaatattcccacgctcggttcagtggcggtcaccatggctttgcatggttgcgacgaagtggctgtcgccggttttggctacgatatgtcgacgcccaacgctccactccactattatgagacggtcaggatggctgccattaaggaaagttggacgcacaatatccagagagaaaaagagtttctcaggaagttggtgaaggccagagttatcacggacttgtcttccggaatttag

SEQ ID NO: 242459 - DNA, 1035 bp, Artificial Sequence
  Description of Artificial Sequence: Synthetic coding sequence
atgggcctgctagttttcgttagaaaccttctgctagctctgtgccttttcctcgttttgggtttcctctactacagcgcttggaaattacatttactgcagtgggaggaggatagcaacagcgtggtccttagttttgacagtgcagggcagacactcgggtccgaatatgatcggttgggttttttgctaaaccttgactccaagctctttagtaaacctgctccaatgtttctcgacgatagtttcaggaaatgggccagaatccgggagttcgtacctccattcgggattaaaggccaggataacctgatcaaagccatccttagcgtcacgaaagagtatcggctgacgcccgcattagactccctaaggtgccgccgatgcattatcgtgggtaacggcggagtactggccaataaaagtctggggtcaaggattgatgattacgacatcgtcgtccgacttaattcagccccagttaaggggttcgagaaggatgtagggagcaagaccactctcagaataacctacccggaaggggcaatgcagcgtccagaacaatacgaaagggattcactattcgtcctagctgggtttaagtggcaagattttaaatggctcaagtatatagtgtataaggagcgcgtcagcgcctccgatggattctggaagtctgtggcaacacgagtccctaaggagccacccgaaatcagaatattaaacccatatttcatacaggaagctgctttcaccctgattggcttgcccttcaacaacggactgatgggcaggggaaatatccccactctgggcagcgtggctgttaccatggcccttcatggatgcgacgaggtagccgtcgctggtttcggatatgacatgagcacccccaacgcccctctgcattattatgaaactgttcgtatggccgctataaaggaatcctggacacataatatccagcgtgagaaagagttcctgaggaagctggtgaaggccagagtcatcacggatctctccagtggcatttag

SEQ ID NO: 242460 - DNA, 1290 bp, Artificial Sequence
  Description of Artificial Sequence: Synthetic coding sequence
atgggtctcctggtcttcgtacggaacctactgcttgccctgtgtctcttcctggttttgggattcctgtattattccgcctggaagctacaccttctgcagtgggaagaggattccaactcagttgtgctgtcctttgactctgctggacagacacttggctccgaatatgataggctgggcttcttactcaacctggactctaagctgtcgcctcggacactgtgcacggttgttttcgggctggactgtatattggagagtcccggtgaaccaaaaaaactgttgatgccagcttcccatcccttggagatccttaaaagtctgagcgaggacactgcttttgctcttggattcctgaaattgccacgtcctgccgagctcgcgaccaaatacgccaattttagcgagggtgcctgtaaacccggatatgcctccgcgctcatgacagcaattttccccaggttctcgaagcccgcacccatgttcctggatgatagcttccgcaagtgggcacggattcgggagtttgtgccccctttcgggatcaaagggcaagataacttgattaaggccatattatctgtgacaaaagaatacaggctgactccggcactggatagtttgcgatgccggagatgtattattgtcggaaatgggggtgtactagccaacaaatccttgggctcccgcatagacgactatgacattgtggtcaggttgaactccgcccctgtgaaaggtttcgaaaaagacgtgggatctaagacgacgttgcgcatcacctatccagagggggctatgcaacgcccagaacagtacgaacgcgactctctgtttgtgctggcagggttcaagtggcaggacttcaaatggctgaagtacatcgtgtataaggagagagtcagcgcgtctgacggcttctggaaaagtgtggccacacgagtgcccaaagaaccacccgaaatccggatactgaacccgtactttatccaagaagccgcattcaccctcattggtcttccttttaataacggcctgatggggcgaggtaatataccgactctgggctcagtcgcagtcacaatggcccttcatgggtgcgacgaggtagctgttgccggttttgggtatgatatgtccactccaaacgcaccattacattattacgagactgtaaggatggccgcaataaaagagtcatggacccataacatccagcgggagaaagagtttctgaggaaactagttaaggccagagtcattacagaccttagctctggcatatag

SEQ ID NO: 242461 - DNA, 456 bp, Artificial Sequence
  Description of Artificial Sequence: Synthetic coding sequence
atgggtttactggtgttcgtgagaaatctgctgctcgcactgtgccttttcttagtcctcgggttcctttattactccgcttggaaattgcatctcctccagtgggaggaagatagcaattcagtggtgttgtccttcgattcagctggccagacccttggttcagagtatgaccggctgggtttcctgctgaatctcgatagcaagctccctgctgagctcgccactaaatacgctaatttctcagagggcgcatgtaaaccaggttacgctagtgccctcatgacagcaattttcccacgcttttccaagccagcccctatgtttctggatgacagctttcggaagtgggccaggataagggagtttgtaccaccattcggaatcaagggccaggagtgtataggatggctgctggagatctgcggtcactctagcgctcagggagcaccctag

SEQ ID NO: 242462 - DNA, 561 bp, Artificial Sequence
  Description of Artificial Sequence: Synthetic coding sequence
atgggactgctagttttcgtccggaatctactgctggcgctctgtctttttctcgtgctaggattcctgtattattctgcctggaaacttcacctgctacagtgggaagaagattcgaagtatgaccgcctgggctttctattgaatctggacagtaaattgcccgcagaactggccacaaaatacgccaacttctccgaaggagcctgcaaacctggctatgccagcgcactgatgaccgccattttccctcggttcagcaaacccgctcccatgttcttggacgatagtttcagaaaatgggctaggattagagaatttgttccaccatttggcattaagggccaagacaatctaataaaagccatcctttctgtcaccaaagagtatcgcctcactcctgcccttgattccctgcggtgcagaaggtgtatcatcgtgggcaacggcggtgtgctggcgaacaaaagcttaggaagtagaattgacgactacgacatagtcgtatctcccggaaggaccattagctctgaaaggaagagcttctgtggtagctggtag

SEQ ID NO: 242463 - DNA, 420 bp, Artificial Sequence
  Description of Artificial Sequence: Synthetic coding sequence
atgggactgcttgttttcgtgcgcaacctgctgctggctctatgcttgttcttggtgctcggatttctgtattacagcgcttggaagcttcatctgttgcaatgggaagaggactccaaatatgatcgtcttggcttccttctgaacctggactctaagttgccggctgagcttgccaccaaatatgctaatttttctgagggggcatgcaaacccggatatgcaagcgcactgatgacagcaatattcccaagattctcgaagcccgctcccatgtttctagatgactcctttcgcaagtgggccaggatcagagagttcgtaccaccctttgggatcaaaggccaggtgctggacgcgcaatatccagccagagaacgggtctccgccgaagccggagagtcttcccgtcatcactag

SEQ ID NO: 242464 - DNA, 306 bp, Artificial Sequence
  Description of Artificial Sequence: Synthetic coding sequence
atgggtctgctggtcttcgtgagaaatcttctccttgcactgtgcctctttctggtgctgggcttcctgtactattctgcgtggaaactacacctgcttcagtgggaggaagacagcaaatatgataggcttgggttcttactgaatctggactcaaagcttcctgctgaacttgccactaagtacgctaactttagcgaaggtgcctgcaaacctgggtacgccagtgccttgatgactgccatttttcccaggcctggcaggaccatatcatccgaacggaagtcattttgcggttcctggtag

SEQ ID NO: 242465 - DNA, 786 bp, Artificial Sequence
  Description of Artificial Sequence: Synthetic coding sequence
atggggcttttggtgtttgtgcggaacctgttgttagccctctgtctgttcctggtccttgggttcctttactactctgcctggaagctgcacctgctgcagtgggaagaagattcaaaatacgatcggctgggctttttactcaatttggattcaaaactgcccgcagagctcgctactaagtacgctaatttctccgagggtgcctgtaagcccggttacgcgtctgcactgatgaccgccatttttccaaggttcagtaagcccgcacccatgttcttggacgattccttcaggaaatgggctcgcatacgtgagtttgtgccaccatttggaataaaggggcaagacaatttgatcaaggccatcttgagcgtaactaaggagtataggcttacccctgctctggacagcctgcggtgtagacggtgcataattgtcgggaatggaggggtgctggctaataaatctttgggcagcaggatcgatgattacgacatcgtggtcaggcttaactcggccccagttaagggattcgaaaaggacgtcggctccaaaactactctccggattacgtatcccgagggggctatgcagcggccagagcagtatgaaagggattctctcttcgtcttggctggcttcaaatggcaagacttcaagtggctcaagtacatcgtgtacaaagaacgggtatcctggactcataatatccagagggagaaagagttcttacgaaagcttgtgaaagcacgtgtcattacagacttgagctcgggtatatag

SEQ ID NO: 242466 - DNA, 834 bp, Artificial Sequence
  Description of Artificial Sequence: Synthetic coding sequence
atgggcctgttggtcttcgtcaggaacctgttgctagccttatgtctgttcctggttctgggcttcctgtactactccgcctggaagctgcacttgctacagtgggaggaggactcaaactccgttgtactgtcctttgatagtgctggccagaccctggggtcagagtacgatagactcggattcctcttaaacctggattccaaactccctgccgaactggccacgaaatacgccaacttttcagagggcgcttgtaagcccggatatgccagcgcgttgatgaccgctatttttccgaggttttcgaagcccgctcctatgtttcttgatgattcttttcggaaatgggcgagaattcgagaattcgtccctccctttggcattaaaggacaggacaacttaattaaggcaatactcagcgtgacgaaggaatacagacttacgcccgctctcgactcactgaggtgcaggcggtgcataattgtgggcaacggaggtgtattagctaataagtcactagggtcacggattgacgactatgatattgtggtgaggctgaacagtgcacctgtgaagggcttcgagaaggacgtcggcagtaagaccaccctccgaattacttatcccgagggggcaatgcagcggcctgagcagtatgagcgggacagtctgttcgtgctggcaggcttcaagtggcaagactttaagtggctgaaatacatagtgtacaaggaaagagtgtcatggacccataacatccagagggaaaaggaattcctgcgcaaacttgtaaaagccagggttattacagacctttcatcagggatttag

SEQ ID NO: 242467 - DNA, 513 bp, Artificial Sequence
  Description of Artificial Sequence: Synthetic coding sequence
atgggactcctcgtgtttgttagaaaccttctgttggccctgtgtctgtttctcgtgctgggatttctttactacagcgcatggaaactgcatttacttcagtgggaagaagattcaagcaagtattcacattctagctctccgcaggaaaagcccgtcgcagatagtgtggtgttatcatttgactctgccggtcagaccctgggcagtgagtacgaccgcctaggatttctgcttaatcttgacagtaagttgcctgcagaactggctactaaatacgcaaatttcagtgagggcgcttgcaagccgggttatgcttctgccctcatgacagccatcttcccacggtttagtaagccagccccaatgttccttgacgattcgttcagaaagtgggccagaataagggagttcgtcccacctttcggcattaaggggcaagtcctagacgcacaatatcctgctagggagagggtgagcgccgaagccggagaaagctctcggcatcattag

SEQ ID NO: 242468 - DNA, 642 bp, Artificial Sequence
  Description of Artificial Sequence: Synthetic coding sequence
atgcggactagcgcggagtattttagacttgctttgtcaaaactccagtcttgtgacctctttgatgaattcgacaaaatgaacaacggacctgtattaggacatgaggaggaggtcggccgaagaactacattccgcctgttctatcctgagagcgttttttctgatcccatccacaatgatccgaacaccactgttatactgacagcctttaaaccacatgacctgaggtggttgttagaactgctcatgggagataagatcaataccaatggcttttggaagaaaccagccctgaatctgatatacaagccttaccagatacgaattctggacccttttatcattaggacagctgcctacgagctgctccactttcctaaagtgtttccgaaaaatcaaaaacccaagcaccctaccaccgggatcattgcaatcactcttgctttttacatatgccacgaggtgcaccttgcaggtttcaaatacaatttctccgacttaaaatcaccactgcactactatggaaacgcgacaatgtcattgatgaacaagaacgcttatcacaacgtgaccgctgagcagttgttcctgaaagatatcatagagaagaacctggtcattaacttaacccaggattag

SEQ ID NO: 242469 - DNA, 996 bp, Artificial Sequence
  Description of Artificial Sequence: Synthetic coding sequence
atgagaggatacctggtggccatctttctgtccgctgtctttctgtattacgtcttgcattgtattttgtggggcacaaacgtttattgggtggctcctgtggaaatgaaaagacgcaacaaaatccagccctgcctcagcaagcccgctttcgcctctctgcttagattccaccagttccatccgttcctgtgcgctgcagatttccgcaaaatcgcgagcctttatggaagcgataaattcgaccttccctatggcatgaggacttcagccgaatacttccggttggccttgtccaaattgcagagctgcgacctcttcgacgagtttgataatatcccttgcaaaaaatgtgttgtggtcggcaacggtggagtgcttaaaaacaagaccttgggtgaaaagattgacagctacgacgtcatcatccgtatgaacaacggccctgtcctcggccacgaggaagaggttggccgaagaacaacatttcggttgttctaccccgagtctgtattttccgaccccatacacaatgatcccaatactaccgtgatactcactgccttcaagcctcacgacctacgttggctgctcgagttgctcatgggggacaaaattaacaccaatggcttctggaagaagcccgcactgaatttaatatataaaccatatcagatcaggatccttgaccctttcatcattcggaccgccgcatacgagctcctccacttccccaaagtatttcccaagaaccagaaaccgaaacacccaaccaccggcattattgccatcacacttgccttctacatctgtcacgaggtgcatttggcgggtttcaagtataacttcagcgatctgaagagcccactgcattactacggcaatgctacaatgtcattgatgaacaagaatgcctaccacaacgttacagcagagcagctttttttaaaagacataatcgagaagaacctggtcatcaatctgacacaggactag

SEQ ID NO: 242470 - DNA, 996 bp, Artificial Sequence
  Description of Artificial Sequence: Synthetic coding sequence
atgcgagggtatctggtggctatcttcctcagtgccgtgtttctctactacgtattgcactgtattctatggggtaccaacgtgtattgggtcgccccagtagaaatgaaaaggcggaataaaattcagccttgtcttagcaaaccagcctttgcctctttgctgcgctttcaccagttccatccttttttgtgcgcagcagatttcaggaaaatcgcctccctgtacggatcggacaaattcgacctgccgtatggaatgagaacatccgccgagtatttcaggcttgcactttccaagctgcagagctgtgatctgtttgacgagttcgacaatataccttgcaaaaagtgcgtagtggtcgggaacggaggagtgctcaagaacaagacactgggcgagaagatcgatagctatgacgtcataatccggatgaataatggccctgtgctgggccacgaagaggaggtgggtaggagaaccactttcagattattctaccccgaatcagttttctctgatcctatccacaacgatccgaacacaactgtcatcctgaccgccttcaaaccccacgacctgcgatggctgcttgagctcttgatgggagataaaatcaacaccaatgggttttggaaaaagcctgccctcaatctgatctacaagccgtatcagattcgaatacttgacccttttataatacggactgccgcttacgagcttttgcactttcctaaggtgtttcccaagaaccaaaaacccaagcatcctactactggcatcatcgcaatcacgctcgccttttacatatgtcacgaagttcaccttgcgggtttcaagtataattttagcgatctgaagtccccactgcactactatgggaacgctaccatgtctctgatgaataagaatgcataccacaatgtaaccgccgagcaactatttctgaaggacatcatcgagaaaaatcttgtcatcaacctgactcaagactag

SEQ ID NO: 242471 - DNA, 696 bp, Artificial Sequence
  Description of Artificial Sequence: Synthetic coding sequence
atgaggggatacttagtggccatcttcctgtcggctgtgtttctttattacgtgcttcactgcatcttgtggggcactaacgtctattgggtcgcacccgtggagatgaagcgacggaacaagatacaaccgtgcctatcaaaacctgcattcgccagccttctgaggtttcaccagttccatcccttcttatgtgctgctgatttcagaaaaatcgcgtctctttatggttcagacaagtttgacttgccatatggaatgagaacctctgccgaatattttaggctggccttgtccaaattacagagctgcgatttattcgacgagtttgataatatcccgtgcaaaaagtgcgttgttgtcggaaatggcggtgtgctcaaaaacaaaaccttgggggagaaaattgactcctacgacgtgatcatacgcatgaacaatggtccagttctggggcacgaggaggaagtgggcaggcgcaccacattcagactattttacccagagtcagtttttagcgaccccatccacaacgacccaaatacgacagtgattcttactgcctttaagccacacgacctccggtggctgctcgagctccttatgggagataaaataaacaccaatgggttttggaagaagccagctctgaacctgatttataagccctatcaaatccgaattttagatccttag

SEQ ID NO: 242472 - DNA, 741 bp, Artificial Sequence
  Description of Artificial Sequence: Synthetic coding sequence
atgcactgtcgggattgcgccctagtgacttctagtgggcacctccttcacagccgccagggatcacagatcgatcaaacagaatgtgtgattcgcatgaacgatgctcccacgcggggttacggacgcgatgtgggcaaccggacctctctgagagtcatcgcccatagctcaattcagagaatcctgagaaacagacacgatctgctgaacgtttcgcaaggtaccgtctttatcttttgggggccaagtagctacatgcggcgagacggaaagggtcaggtgtataacaatctgcatctgctgtctcaggtgctgccgaggctgaaggcattcatgattacgagacacaagatgctccagtttgatgagctctttaaacaggaaaccgggaaagaccgcaagatttctaacacgtggctgagcaccggctggttcaccatgacgatagcattggagctttgcgacaggattaacgtgtacgggatggtcccgccagatttctgtagagacccaaaccacccaagcgtgccctaccactactatgaacctttcggtccggacgaatgtactatgtacctgagtcacgagagaggccgaaaaggcagccatcatagattcattacagagaagcgggtgttcaaaaactgggctcggacattcaatatacacttctttcagccggactggaagccagagagtttggcaatcaatcatccagaaaacaagccggtgttttag

SEQ ID NO: 242473 - DNA, 1011 bp, Artificial Sequence
  Description of Artificial Sequence: Synthetic coding sequence
atgaaaacactgatgagacatggcctagcagtgtgcctcgcattgacaactatgtgtacctcactcctgctggtatattcttcgctgggtggccagaaggaaagaccgcctcagcaacagcagcagcaacagcagcagcagcagcaagccagcgctactggaagcagtcagcccgctgccgagtcgagtacacagcaaagaccaggcgtccccgctgggccaagaccactggatggatacttgggagtggcagatcataaacctctgaaaatgcactgccgggattgcgccttggtgacttcctctggacatctgctgcatagtcgccagggaagccagattgatcagacagaatgcgtcattcggatgaacgacgccccaacacgcggatacggcagggacgtgggcaacagaacttcactgcgcgtgatcgcccattcatctattcagcggatactccggaatcgccatgatctgctaaatgtctcccaaggaacagtttttattttctggggaccaagcagctacatgaggcgcgatggcaagggtcaggtttataataatctgcatctgttatcacaggtactgcccaggctcaaagcttttatgatcaccagacacaagatgttgcagttcgacgaattgttcaagcaagagactgggaaagatagaaaaatttctaacacttggctgtcaactggatggttcaccatgacaatcgccctggagttgtgcgatcgcatcaatgtctacggaatggttccgcctgatttttgcagagatccgaaccacccaagcgtcccataccactactacgagcccttcggtcccgacgaatgtactatgtatctctcccacgagagaggcagaaaggggtcccatcatcggtttatcacagagaagcgggtgttcaaaaattgggcccgaacattcaacatccacttttttcagcccgattggaagcccgagtctctggcgatcaatcatccggagaataaaccagtgttttag

SEQ ID NO: 242474 - DNA, 1275 bp, Artificial Sequence
  Description of Artificial Sequence: Synthetic coding sequence
atgagcgaccatggcgatgtgagcctcccgcctgaagatagagtccgcgctctgagtcagctgggatcagcagtcgaggttaacgaagatatcccccctaggaggtacttccgcagtggcgtcgaaattatccggatggcttcaatctactcggaggaaggtaatattgaacacgcctttattttgtacaacaagtacatcaccctcttcatagagaagcttcccaaacatcgtgactataaaagcgctgtgattccagaaaagaaggacacagttaaaaaattgaaggaaatcgcgtttccaaaggctgaggaactaaaggcagagttactgaagcgatatactaaggagtataccgagtataatgaggagaagaaaaaggaagccgaagagctcgcccgtaacatggcgatacaacaggagctggagaaggagaaacagagggtggcccagcagaagcaacagcagctggagcaagagcagtttcatgcattcgaggagatgatacgaaatcaagagcttgaaaaggagagattgaagatcgttcaggagttcggtaaagtcgaccccggactggggggaccattagtaccagaccttgagaagccgtcattggacgtatttccaactctcacggtcagctcaattcagcccagcgattgtcacaccacagtgaggcctgcaaagcctcctgtggtggaccgatcactgaaacccggagctctttccaacagtgagagcatccccacgatcgatggacttagacacgtggtggtgccaggacgcctgtgcccacagttccttcagctggctagcgccaacacggcacgcggagtggagacttgcgggatcctgtgcgggaaacttatgaggaacgagttcactattacccacgtgctgatcccaaagcagtccgcagggtctgattattgcaatacagagaacgaagaggagctgtttcttatccaggatcagcagggcctaatcacactgggttggattcatacacaccctacccagactgcctttctatctagcgtggacctgcacacccactgttcctaccagatgatgctgcccgagtcagttgcaattgtctgcagtccaaaattccaggagacgggcttctttaaattgaccgatcacggattagaggagatttcgtcgtgcagacagaagggcttccatccccattccaaggaccctcctctgttctgcagctgctcacatgtaaccgtggtggatcgcgcagttacaatcacagatctccggtag

SEQ ID NO: 242475 - DNA, 1275 bp, Artificial Sequence
  Description of Artificial Sequence: Synthetic coding sequence
atgagcgaccatggagacgtgtccctgccacccgaagatagagtgagggccctctcacagcttgggtccgcagtggaggtgaacgaggacatcccccctaggcgatacttccgctctggagtggaaataattcgtatggcgagtatttactccgaggagggtaacattgagcacgcattcattctatataacaagtacatcacactctttatcgagaaactgcccaagcatcgggactataagtcagctgtgatcccagagaaaaaggacaccgtaaaaaagcttaaggaaattgcatttccaaaagctgaagaactcaaagccgaactgctcaagagatacacaaaggaatataccgaatacaatgaagagaagaaaaaagaggccgaagagctggccaggaatatggctatacaacaggaactggaaaaggagaaacagagagtggcacagcagaagcagcagcaactggagcaggagcagttccatgcctttgaggaaatgataagaaatcaggagttggaaaaagagcgcctcaaaattgtccaggagtttgggaaagtcgaccccggtcttggcggacctttggttccggacctcgaaaaaccatccctcgacgtgtttccaactctgacagtgagtagtattcagcccagtgactgtcataccactgtcagaccagccaaaccccctgtggttgataggtccctgaagcccggagctctaagtaacagtgaatccatcccaacgatcgacgggctgcgccacgtagtggtgcctgggaggctgtgcccccagttcctgcaactagcttccgcaaataccgcgagaggtgtggagacgtgcgggatcctctgcggcaagttaatgcgcaatgaatttactattacacacgtgttgatccctaaacagtccgcagggagcgattattgtaacactgagaacgaagaagaattgttcttaattcaagaccaacaagggctaatcacgctagggtggatccatacgcacccgacacagacagcttttcttagtagcgttgacctgcatacacactgctcctaccagatgatgctgccagaatccgtggcgattgtgtgtagtccaaaatttcaggaaactggatttttcaagcttaccgatcatggattagaggaaatctcctcttgccgccagaaggggtttcacccccactctaaagatccaccgctgttttgctcttgctcacacgtgacggtcgtagatagagccgtgaccataacggacctgagatag

SEQ ID NO: 242476 - DNA, 1275 bp, Artificial Sequence
  Description of Artificial Sequence: Synthetic coding sequence
atgagtgaccacggcgacgtttccctaccccctgaagaccgagtaagggcactgagccagctgggctccgctgtggaagtgaatgaggacatcccccctcgtagatactttaggagcggcgtggaaatcataaggatggcctccatttattcggaggaagggaatatcgagcatgccttcatcctgtacaataagtatatcaccttgttcattgaaaagctgccgaaacaccgcgactacaaatctgcggttatccctgagaagaaagacaccgtgaaaaagctcaaagaaatagcattccctaaagcagaagagctgaaggcagaattattgaagagatatactaaagagtacacagaatataatgaagagaagaagaaggaggccgaggaattggccagaaacatggccatccaacaggaactggagaaggagaagcaacgagtggctcagcagaagcagcaacagctggaacaggagcaattccacgctttcgaggagatgatcagaaatcaggaactggagaaggagcgactcaagattgtgcaggagttcggcaaagtcgaccctggtcttggcggtcccttggtaccagacctcgagaagcccagcctcgacgtgttccccaccctcaccgtctcatccatccagcctagcgattgtcacactactgtccggccagccaagcctcccgtggtggacaggagtctaaaaccaggggctctgagtaatagtgaatcaattccaacaattgacgggctgcgccacgtcgtggtgcccggaagactgtgtcctcagttccttcaactagcaagcgccaacaccgctcggggagtcgaaacctgcggcatcctctgcggtaagctcatgcggaatgaattcactattacccacgttctaatccctaagcagagtgccggttcagactactgcaacactgaaaatgaggaggaattattcctgatacaggatcaacaaggcctaattacgctgggatggattcacacacatcccactcagacggcttttctttcttctgtggatctgcatacacattgctcgtaccagatgatgcttccggagtccgtggctatcgtatgctcccctaagtttcaggagaccggctttttcaagctgacagaccatggattagaagagatcagttcctgtagacaaaaggggtttcaccctcactccaaagacccgcctcttttctgctcctgctcccatgtgaccgtcgtcgatcgtgcggtgacaatcaccgacttgagatag

SEQ ID NO: 242477 - DNA, 1275 bp, Artificial Sequence
  Description of Artificial Sequence: Synthetic coding sequence
atgtctgatcacggcgatgtaagcctcccccctgaggaccgcgtgcgggctctgtcccagctcggttccgctgttgaggtcaacgaggatatccctcctcgacgatacttccgctcaggcgtggagattattcgcatggcaagtatctatagcgaggaaggtaatattgagcacgccttcatcctgtataacaagtatattacactctttattgaaaagctacctaaacaccgcgactataagagcgcggtgattccagaaaaaaaggacacagtcaagaagctgaaagagatagcgttccccaaagccgaggaacttaaggccgagctgctcaagagatacaccaaggagtacaccgagtacaatgaggaaaagaaaaaagaggcagaagaactggcaaggaacatggcaatacaacaggaactcgagaaggagaagcaacgcgtggcccagcagaagcagcagcagctggagcaagagcaatttcatgcattcgaggagatgatacggaaccaggaactagagaaagaaaggcttaagatcgtgcaagagttcggcaaggttgacccgggactgggaggacctcttgttccggacctggagaaaccatccttagatgtttttcctaccttaactgtgtccagcattcagccgagcgactgtcacacaactgtccgtcctgccaaaccacccgttgtcgacaggagcctcaagccaggcgcattatctaactccgaaagcatccctaccattgacggcttgcgacacgtggtagtgccaggtagattgtgcccacagtttctccagctggcgtctgcgaacacagccaggggcgtcgagacctgtggaatcctgtgtggaaaactgatgagaaacgaatttactataacacatgtactgatcccaaagcaatcagcgggttccgattactgcaacactgagaatgaagaagagctatttctcatacaggatcagcagggcctcataacacttggttggatccatacccacccgacgcagaccgctttcttgagcagtgtggatctacacactcattgctcctatcagatgatgcttccggaatcagtcgccattgtgtgtagtcctaaattccaagaaaccggcttcttcaagctgacagatcacggactggaggaaatttccagctgcagacaaaaggggtttcacccacattcaaaggacccccctttgttttgctcctgctctcacgtcaccgtggtagatagggccgtgacaataaccgatctcagatag

SEQ ID NO: 242478 - DNA, 492 bp, Artificial Sequence
  Description of Artificial Sequence: Synthetic coding sequence
atgtcagatcacggcgacgtgtctctgccccctgaggatcgcgtccgagctctatctcagctgggcagtgcggtggaagtcaatgaggacattcctcccaggaggtatttcaggagtggagtggagatcattaggatggcatccatttactccgaagaggggaatatagagcacgcctttatactgtataacaagtatattacgctgtttatcgagaaattgcctaagcacagggactacaagagcgccgtaattcccgagaaaaaagacactgtgaagaagttgaaggaaatcgctttccccaaagcagaagaattgaaggccgagctgttaaaaaggtacaccaaagaatataccgaatataacgaagagaaaaaaaaggaggccgaagaactggccaggaatatggccatacagcaggagctggagaaagagaagcaacgggtggcacaacaaaaacagcaacaattggagcaggaacagtttcactag

SEQ ID NO: 242479 - DNA, 957 bp, Artificial Sequence
  Description of Artificial Sequence: Synthetic coding sequence
atgtccgatcacggggacgtgagtctgcctcctgaggatcgggttagagccctttcacaactgggaagcgcagtggaggtcaacgaggacataccgcctagaagatatttcagatccggagtggagattattaggatggcttcaatttatagcgaggagggaaacatcgagcacgcctttatcctgtataacaagtatattaccctattcatcgaaaagctccctaagcaccgggattacaaatcagctgtaattccagagaaaaaagacaccgtgaagaaacttaaagaaattgcattcccaaaggctgaagaactcaaagctgaattattgaagcggtacaccaaagaatacactgaatacaacgaggaaaaaaaaaaggaggcagaagaactcgcccgtaacatggccattcagcaggagcttgaaaaggaaaagcagagggttgcacagcagaaacagcagcagcttgagcaggaacaatttcatgccttcgaagagatgattcggaaccaggaactggagaaagaaaggctaaaaatcgttcaggaatttggcaaggtggacccagggctggggggtcccctggtcccagatctggagaaaccatcattggatgtatttcccactcttaccgttagcagcatccagccatctgattgccacactacggtcaggcccgcaaaaccacccgtggtagaccggagcctcaagcccggagccctgtcaaattccgagagcattcccaccatcgatggtcttcggcatgtagtggtcccgggacgtctgtgtccgcaatttctgcagctggccagcgccaacaccgctaggggagtggaaacctgtgggatcctgtgcgggaagttgatgcgaaacgagttcaccattacccatgtgctcatccctaagcagtctgcgggatctgattactgtaatactgagaatgaagaggagtag

SEQ ID NO: 242480 - DNA, 414 bp, Artificial Sequence
  Description of Artificial Sequence: Synthetic coding sequence
atgagtgaccacggagatgtatcccttcccccagaggatcgggtcagggccctatctcaactgggttcagcagtcgaggtcaatgaggatattcctcccagacgctattttcggagtggcgtcgaaattataagaatggcctccatatatagtgaggagggcaatatcgagcatgccttcatactgtataataagtacattacactctttatagaaaaactacctaaacacagagattacaagtcggctgtgatcccagagaaaaaagacaccgtcaagaaactcaaagagatcgccttcccgaaggcagaggagctgaaagcggagctactgaagcggtatacaaaagagtacacggagtataacgaggaaaagaagaaggaagccgaagagctggcacgaaacatggcatag

SEQ ID NO: 242481 - DNA, 1047 bp, Artificial Sequence
  Description of Artificial Sequence: Synthetic coding sequence
atgagcgaccacggagatgtgtcgcttccaccagaggatcgagtgagagccctatctcaactgggctccgccgtggaggtcaacgaagatatccctcctcggagatacttccgaagtggcgtggagataatccgtatggcgtcaatctacagcgaggaaggcaacattgagcatgcctttattttatacaataaatatatcacactctttattgaaaagctcccaaaacatagggactacaagagtgctgtaattcccgagaaaaaggacactgtgaagaagctgaaggaaatcgccttcccaaaggccgaggagctcaaagccgagctgcttaaacggtataccaaagagtacactgaatacaatgaggaaaagaagaaggaggcggaagagcttgctaggaatatggctattcagcaagagttagaaaaggaaaagcagcgggttgctcagcagaagcagcagcagctggagcaggagcagttccacgccttcgaggagatgatacgaaaccaagaactggagaaggagcgtttaaaaattgtgcaagagttcggcaaggtcgaccccggtctggggggaccactcgtcccagacctggaaaagccatcactcgatgtctttccaacactgaccgtaagctccattcagccatccgactgccatactaccgttcgacctgcaaagcctccagttgtggaccgcagcttaaagccaggcgcactttctaactcagagtcaatacctacaattgatggattgagacatgtcgtggtgccagggagactgtgtccccaattcctgcagctcgctagtgccaatacggcccgaggggtggaaacatgcggtattctttgcggtaagctgatgcgtaatgagtttactattacacacgtgctgattccaaaacagagcgccggatctgactattgtaatacggagaatgaagaggagctttttctgattcaggatcaacaaggccttatcactctaggttggattcatgtcgagacgttatggtctctgaaatctctacacgcaccttag

SEQ ID NO: 242482 - DNA, 813 bp, Artificial Sequence
  Description of Artificial Sequence: Synthetic coding sequence
atgcggcagcagcaactggagtccgagcagtttttattctttgaagatcaacttaagaaacaagaattggcacgcggtcagatgcggagccagcagacctcgggcttgtctgagcagatcgatggaagcgcgctctcctgcttctccacccatcagaataacagcttgctgaacgtgtttgcagatcagcctaacaaatcggatgcgacgaactacgcctctcacagccccccagttaatcgggctctgacccctgctgccaccctcagtgccgtgcaaaatttggtagtggaaggccttcggtgtgtggtgctgcccgaagatttgtgccacaagtttctacaactggctgaatctaatacagtccgaggcatcgaaacatgcggaattttatgtgggaaacttacccacaacgagtttaccatcactcacgtgatcgttcctaaacagagcgctggcccagattattgcgatatggaaaacgtggaagagttgttcaacgtccaggatcaacatgacctcctcacgctaggctggatccacacacatcccactcagactgccttcttgtcctcggttgatcttcatacccattgctcctatcagttgatgttgcctgaagctattgccatcgtgtgctcacctaagcataaggacacaggcatatttcgccttacaaatgctggaatgctagaggtttctgcttgtaaaaaaaaaggttttcatccccacactaaagaaccaagattgttttccatctgcaagcacgtcctcgtcaaagacattaaaataatcgtgctggacctgagatag

SEQ ID NO: 242483 - DNA, 1311 bp, Artificial Sequence
  Description of Artificial Sequence: Synthetic coding sequence
atggatcagccctttaccgttaactcgctcaagaaactggctgccatgcctgaccatactgacgtaagcctgagccctgaggaacgcgtccgggctctaagcaaacttggctgcaacattactatatccgaagatataacgccgaggaggtatttcaggagtggcgtggaaatggagcggatggcctctgtttacctggaagaaggcaatctggagaacgcctttgtcctctacaacaaattcattacactgtttgtggagaagctgccaaaccacagggattaccagcagtgcgctgtgccagagaagcaggatatcatgaaaaaactgaaagagatcgctttccctaggaccgacgagttgaagaacgatctcctcaagaagtacaacgtcgagtatcaggagtatcttcagagtaagaataagtacaaggctgaaatcctgaaaaagctggagcaccagcgtctaatcgaggccgaacgcaagagaatagcccagatgcgccagcagcagctggagtccgagcagtttcttttcttcgaggatcagctgaagaaacaagagctggcacgcggacagatgcgcagccaacaaacatccggattatccgagcagatcgacggctctgccttgtcctgttttagtacccaccagaataatagtttgctcaatgtgttcgcagatcagcccaataaatcagatgcaaccaattatgctagtcactcacccccagtgaaccgcgctttgactccagcagccactctcagcgcagtccagaatctcgtcgtggaggggttgagatgtgtggtgctccccgaagatctgtgtcataagttcttgcagctggccgagagcaacaccgtccgtgggatcgaaacttgcggaatactttgtggcaaactgactcacaatgagttcaccattactcacgtgatcgtgcctaaacagtctgctggaccagactattgcgatatggagaacgtagaggagctctttaatgtccaggaccagcacgatttgctgaccctgggatggatccacactcaccctacccagacggcatttctgagtagcgtcgatctgcatactcattgttcgtatcaactcatgctacctgaggcaattgctatcgtctgctcaccgaaacataaggataccgggattttccgactcacaaacgcgggaatgctggaggtttccgcctgcaaaaagaagggtttccatccccatactaaggaacctcgcctattctcaatctgtaaacacgttctcgtgaaggacatcaaaattatcgttctggatttgcggtag

SEQ ID NO: 242484 - DNA, 1311 bp, Artificial Sequence
  Description of Artificial Sequence: Synthetic coding sequence
atggaccagccgttcaccgtaaattcactcaagaaattggccgctatgcctgaccataccgatgtgtccctcagtccagaggagcgggtgcgggctctgagcaaattaggctgcaacataacaatctcagaggatatcactcccagacgatactttagaagcggagtggagatggagcgaatggctagcgtgtacctggaagaagggaatttagagaacgctttcgtcttgtacaacaagtttatcacccttttcgtagagaagctgccaaaccaccgtgattaccagcaatgcgctgttcccgaaaagcaggacattatgaagaaactcaaagagatagccttccctaggacggatgagctgaaaaacgatcttctcaagaaatataacgtggagtaccaggagtacctccaatccaagaataaatataaggctgaaattctgaaaaagctggaacaccagaggctgatcgaagctgagaggaaaaggatcgcacagatgcggcaacaacagctcgagagtgaacagtttttatttttcgaggatcaactgaagaaacaagagctcgccagaggccagatgcggtctcagcaaacctccggcctgtcagaacagatagacggctcagcgctatcttgttttagtacccaccaaaacaactcccttctgaacgtttttgctgatcaaccgaataaatcggacgctaccaattacgctagccactccccccctgtgaatcgagcattaacccctgctgctacacttagcgccgtgcagaacctcgttgtcgaagggctgcggtgcgtcgtgctccccgaagacctgtgccacaagtttctgcaactggctgaatccaataccgtccgcggaatcgagacatgcgggattctctgcggaaaacttacccacaatgaatttaccatcacacacgtcattgtccctaagcagtcagcgggacctgattactgcgatatggaaaatgttgaagagttattcaatgtacaggaccaacacgatctgctgaccctgggctggatccacacacaccccactcagaccgcctttttatccagcgtcgacctacacacacactgctcctatcaactgatgcttccagaagcgatcgctatcgtgtgtagccccaaacacaaggacaccgggatttttagattgaccaacgctggcatgctggaagtgagcgcttgtaaaaaaaaaggctttcacccccatacgaaagaacctcgcctgttcagtatatgcaagcatgtcctggtgaaggatataaaaatcattgtgctcgacctgcggtag

SEQ ID NO: 242485 - DNA, 1386 bp, Artificial Sequence
  Description of Artificial Sequence: Synthetic coding sequence
atggaccagcccttcaccgtcaactcgttgaaaaaactggcagcaatgcctgaccataccgacgtgtctctctctcccgaggagcgtgtgcgcgcattgtcaaaactcggatgcaacatcactatatccgaggatatcaccccacggcgttatttccgatctggggtggaaatggagcggatggcctctgtgtacctggaggaagggaatctggagaacgccttcgtcctgtacaataaattcattacattgttcgttgaaaagctgccaaaccatagggactatcagcagtgtgcggttccggaaaaacaggatatcatgaagaagctcaaggaaatcgcttttcctagaaccgatgaacttaaaaatgacctgttgaaaaagtacaatgtagagtaccaggaatatcttcagagtaaaaacaagtataaggccgagatcctgaaaaaacttgagcatcaacgtctgatcgaggccgagaggaagagaattgcccaaatgcgccagcagcagcttgagagcgaacagtttctttttttcgaggaccagctgaaaaaacaggagctcgcccgaggtcaaatgaggtcgcaacagacttctggcctgagcgaacagattgacggctctgcgctctcttgtttcagtacgcatcaaaacaattcattactgaacgtgttcgccgaccagcccaacaaaagcgacgccactaattacgcctcacattcacccccagtgaatagggctctgacaccagcggcaacactcagtgccgtgcagaatctcgtcgtcgaaggcttgcgctgcgtggtcttacccgaggacctgtgccataagtttctgcagctggcagagtctaacactgtcagggggatcgaaacctgcggcattctatgtgggaagcttacccacaacgagttcacgatcactcatgtgatagtgccaaaacagagtgctgggccagattactgtgacatggagaacgtggaggagctgtttaacgtccaggaccagcatgatcttctaacactgggctggatccatacccacccaacgcagacggctttcctaagctcagtagacttacatacgcactgcagctaccagctcatgctgcctgaggctattgctattgtttgctcacctaaacataaagataccggtatttttaggcttaccaacgctggcatgcttgaggtgagtgcctgcaagaagaaagggttccacccacacaccaaagaacctcgactcttctccatccagaagttcctgagtggcatcatttccgggacagcactggaaatggagcctctgaagatagggtatgggccaaacgggtttcccctgctcggcatcagccggtcaagcagtcctagtgagcagctatag

SEQ ID NO: 242486 - DNA, 267 bp, Artificial Sequence
  Description of Artificial Sequence: Synthetic coding sequence
atgagcatcatggatcacagccccaccacgggggtcgtgacagtcatcgttatcctgatcgccatcgcagctctgggcgctctcatacttggatgctggtgctacttacggttgcagagaataagtcagagtgaggacgaggaatcgatagttggtgacggcgaaacaaaggaaccattcctcctcgtgcagtactccgctaaaggtccctgtgtggagagaaaagctaagctgatgacacccaacggcccagaagttcatggttag

SEQ ID NO: 242487 - DNA, 744 bp, Artificial Sequence
  Description of Artificial Sequence: Synthetic coding sequence
atgttacagaattccgccgttcttctggtgctagtcatatcagctagtgcaacacatgaggccgagcagaatgatagcgtgagtcctcggaaaagtagagttgccgctcagaattctgctgaggtggttaggtgcctcaactccgccctgcaggtggggtgtggtgctttcgcatgtcttgaaaattcgacttgtgacaccgatgggatgtacgacatttgcaaatcttttctctactctgccgctaagttcgacacacagggtaaggcgttcgtcaaggagagcctgaaatgtattgccaacggcgttacatccaaggtcttcttagccattagacggtgctctacatttcagcggatgatcgctgaagttcaggaagaatgctacagcaaacttaatgtttgctctatcgctaaaaggaatccagaggccatcactgaggtcgtgcagctgcccaatcactttagcaacaggtactacaataggttggtacgctcactgctggagtgtgacgaagatacggtctccaccatccgcgactccttaatggagaaaatcggccctaacatggcttcactcttccacatcctgcagacagatcactgcgcccagacccaccccagagcggactttaatcgcagacgcacaaatgagccgcagaagctgaaagtcctcttgcgcaacttgaggggggaggaagacagcccatctcatataaagcgaacaagtcacgaatctgcttag

SEQ ID NO: 242488 - DNA, 537 bp, Artificial Sequence
  Description of Artificial Sequence: Synthetic coding sequence
atgtatgacatctgtaagtcgtttctatattctgctgcaaaatttgacacccagggtaaggctttcgtcaaggaatcgctgaagtgtatcgccaacggcgtgacgtccaaagtgttcctggcgattaggagatgttccacgtttcaaagaatgattgccgaggtgcaagaagagtgctactcaaagctcaacgtgtgtagtattgctaagaggaaccccgaagccatcactgaggtcgtacagctgcccaatcacttcagcaacaggtattataatcggcttgtacgcagtttgcttgaatgcgatgaggacacggtgagcactatccgcgactcactcatggagaagataggccctaatatggcctcgttgttccacattctgcagaccgaccactgcgcccagacacatccacgggctgactttaatcgacgaaggaccaatgagcctcagaaactgaaagtgctcttgcggaacctgaggggagaggaagactcacctagtcacatcaaacgcacatcccacgaatccgcttag

SEQ ID NO: 242489 - DNA, 537 bp, Artificial Sequence
  Description of Artificial Sequence: Synthetic coding sequence
atgtatgacatctgtaaatcattcttgtactcagctgctaaattcgacactcaaggaaaggccttcgtcaaggaaagcctgaagtgtattgccaatggtgtgacctctaaggtgttcctggccattcgcagatgttcaactttccagaggatgatcgctgaggtgcaggaggagtgttacagcaagcttaacgtgtgttccatcgcaaaaaggaacccggaagctatcacagaagtggtgcagctgccaaaccacttctctaaccgttactacaataggctggtgagaagcttgctggaatgcgatgaggatactgtttcgaccatacgcgactcactgatggagaagattggtcctaatatggcttcgctttttcacatactgcaaaccgaccattgtgcacagacacacccgagagctgatttcaacaggaggcgcacaaatgaaccacagaaactgaaagtgttattgcggaatttacgcggagaggaggacagcccttcccatatcaaacggacctcacatgagagcgcctag

SEQ ID NO: 242490 - DNA, 2733 bp, Artificial Sequence
  Description of Artificial Sequence: Synthetic coding sequence
atggcaagttcggcgcagtccggtggatcctcgggtggacctgcggtcccaaccgttcaacggggtattattaaaatggtcctgtcaggatgcgccatcattgtgaggggtcagccacggggaggcccaccaccagaaagacagatcaatctatcaaacatcagggccggaaacctcgcacggcgagcagccgctacgcagccagacgctaaggacaccccagacgagccatgggccttccccgctagagagttcctcaggaagaaacttatcgggaaagaggtgtgcttcactattgagaacaagaccccccagggcagagagtacggaatgatctacttaggcaaggatacaaacggtgaaaacatcgcagagtcactcgtagccgagggcctcgcaacacggcgagaaggaatgcgggctaataatcctgagcaaaaccgcctctctgagtgtgaagagcaggcgaaagccgctaaaaagggcatgtggagcgagggcaatgggtcacatactatacgggatctcaagtacacgattgagaatccacgacactttgtggattcgcatcaccagaagccggtgaatgccatcatcgaacacgtccgcgacggatccgtggtgcgcgctctgctgctgcccgactactacctcgtcaccgtcatgttatctggaattaaatgccctacattccggcgagaggctgatggctctgaaactccagagccatttgccgcagaggccaaattttttaccgagagtagactgctgcaaagagacgtgcagatcatcctcgaatcgtgccataatcagaacatcttggggactatacttcatcctaacggaaacattaccgagcttttgctgaaggagggttttgccagatgtgtggactggagcattgccgtgtacacccgcggagctgagaagctccgagcggcagaaagatttgccaaggagagaagactgcgcatctggcgggattacgtcgcaccgactgctaacctcgaccagaaagataagcagtttgtcgccaaggtgatgcaggttcttaatgcagatgcaattgtggtgaaactgaactccggcgattacaaaacgatccatctgagctccatccgacctcccagattagaaggcgagaacacacaggacaagaacaaaaagcttcggcctctgtacgacataccatacatgttcgaagctagagagttcctcaggaagaagctgattggtaagaaggtcaacgtaacagttgattatattaggccggcatctccagcgacagaaacggttccagccttctctgagcgaacttgcgccacggtcactatcgggggaatcaatatcgcggaagcgcttgtgagtaagggccttgctactgtcatccggtaccgccaggatgatgatcagaggagtagccattacgatgagctgctggcagccgaggccagggctattaaaaatggaaaagggctccattccaagaaggaagttcctatccaccgcgtcgcagatatttccggagacacgcagaaggcaaaacagtttctgccctttttacaaagggcgggacggtccgaggcagtggtggagtacgtgttctcaggctctagacttaagctgtacctccctaaagagacctgcctgatcacttttctcctagctggcatagaatgtcccagaggtgcccgaaatctgccgggacttgttcaggaaggcgagcctttctcagaagaagccacactgttcactaaggagttagtgctgcaaagggaggtggaagtggaggtggagtcaatggataaagccggtaacttcattgggtggctgcatatagatggggcaaatctcagcgtcctcttagtcgagcatgccctatctaaagtccacttcacagcagagaggtcttcatactataaaagtcttttgagtgcggaggaggcagccaagcagaaaaaagagaaagtttgggctcactatgaggagcagcctgtggaggaggtgatgccagttctagaagagaaggagagatcagcatcttataaaccagtgttcgtaacggagatcactgatgatctccatttttacgttcaggatgtagagaccgggactcagctagagaaactaatggagaacatgaggaacgatatagctagccaccccccagtggaaggctcatacgctcctcgtagaggcgaattctgcattgcaaaattcgtggacggcgagtggtacagagccagggtggagaaggtggagtcgccagctaaaatccacgtgttttacatcgattatggtaaccgagaggttcttccgtcaacaaggctcggaaccctttcacctgccttctcgactcgggtcctgccagctcaggcaacagaatatgcctttgccttcatccaggttccacaggatgacgacgctagaaccgacgccgtcgattcagtagttagggatattcaaaatactcagtgcctcttgaatgtggagcatctgtccgccggatgtccccatgtgaccctgcagtttgccgattctaaaggggacgtgggactgggcttggttaaggaagggctcgtgatggtcgaagtgcggaaagaaaaacagttccagaaagtgataactgagtacctaaatgctcaggagagcgcgaagtcagccagactgaatttgtggagatacggagactttagagccgatgatgctgatgaattcggatattcccggtag

SEQ ID NO: 242491 - DNA, 2703 bp, Artificial Sequence
  Description of Artificial Sequence: Synthetic coding sequence
atggcatcatctgctgttcccaccgtgcagcgcggaattatcaagatggtcctaagcggttgtgccattatcgtccgcggacagccaagaggtggaccaccacctgagaggcagattaacctgtccaatatccgtgctggcaacctcgccaggcgagccgcagccacccagcccgatgcaaaggatactccagatgagccatgggcctttccagctagggagtttctgcgcaagaaactgattggcaaagaagtatgttttacaattgaaaacaagaccccccagggcagggaatacggcatgatctacttaggcaaggacacgaatggcgagaacatcgccgaatctctggtggccgaagggctcgcgacacggagggaaggaatgcgagctaacaacccggagcagaataggctgagtgagtgtgaggaacaggcaaaagccgctaagaagggaatgtggagcgaggggaacggctcacataccataagagacctaaagtataccattgagaatccaaggcactttgtggactcacaccaccagaagcctgtcaacgcaatcatcgaacacgtacgtgatggttctgtggtgcgggcactcctactgcctgactactacctcgtgaccgtgatgttgtctggcataaaatgcccaacatttagacgagaagctgacgggtcagaaaccccggaaccatttgctgccgaggcaaaattcttcaccgaaagtcgccttctccagcgggacgtccagatcatactggaatcttgtcacaaccagaatatcctgggcacgatcctgcatccaaatgggaatatcaccgagcttctgttaaaggaagggtttgctaggtgtgtggactggtccatagccgtgtacactagaggagccgagaaactccgagctgcagaacgattcgccaaggagagaaggctgcgcatctggcgcgattacgtggcacctaccgctaacctggaccagaaagataagcaattcgtggccaaggttatgcaggtgttgaacgcagacgctattgtagtgaaattaaattcaggcgattataaaaccatccacctctcatcaattcggcctcccaggttagagggcgaaaatacgcaagataaaaataagaagttacgtcccttatatgatatcccctatatgtttgaagcccgtgaattcttacgcaagaagctgattgggaagaaagtcaacgttacagtggattatattcggcctgctagtcctgccacggagaccgtgcctgcattctccgaaagaacttgcgctaccgttactattgggggaataaatattgcggaagccttggtaagcaagggcctcgctaccgttatccgataccgccaggatgatgatcaacgatcttcacactatgatgagctgctggccgctgaagccagagctatcaaaaatggtaaggggctccactcaaagaaggaagtgccgatccacagggttgcagatatctccggcgacacgcagaaagccaaacagtttctcccctttctacagagagcgggacgctccgaagccgtcgttgagtacgtgttctcaggaagcaggctgaaactgtacctgcccaaagagacatgcttgattaccttcttattggctgggatagaatgtcccagaggtgctcgcaatctgcccggacttgtgcaggaaggagagccttttagcgaggaagcaaccctctttacaaaagaattggttttgcagagggaggtggaggtcgaggtggagtcaatggataaggccggaaattttatcggctggctgcacatagacggggctaaccttagtgtgttgcttgttgaacacgccttgtctaaagtgcactttactgctgagagatcatcgtattacaagagtctcctaagcgccgaagaggccgctaagcagaaaaaagaaaaagtctgggctcattacgaggaacagccagtagaagaggtgatgcccgtcctcgaggagaaagagagaagtgctagttataagccagtgtttgtgactgagattactgatgatctgcacttttatgtacaggacgtcgaaacaggcacgcagctcgaaaaactcatggagaacatgagaaatgatatcgcctctcacccgcctgtcgaaggctcttatgccccaagacgcggtgagttctgcatcgccaagtttgtagatggggaatggtatagggccagagtagagaaggtagagtcccctgccaagatccatgtgttctatattgactacgggaatagggaggtactgccttccactagactcgggaccctttcccccgcttttagcaccagggttctgcccgctcaagcaaccgagtacgcctttgccttcatacaggtcccgcaggatgacgatgcacgaaccgacgccgttgatagcgtggttagagatattcagaacacgcagtgcctgttgaatgtagagcacttatctgctggttgccctcacgttactctgcagttcgcggactccaaaggcgatgtcggccttggactggtgaaagagggtctcgtcatggttgaggtaaggaaggaaaagcaatttcagaaagttattaccgagtatctgaatgcccaagagagcgccaaaagtgcaaggctgaacctgtggcggtacggagatttccgagcagacgatgcagacgaatttgggtacagtcgctag

SEQ ID NO: 242492 - DNA, 705 bp, Artificial Sequence
  Description of Artificial Sequence: Synthetic coding sequence
atgaatcatctgcccgaagacatggaaaacgccctgaccggctcacagagcagtcatgcctcgcttcgcaacattcattcgatcaatcccacgcagctcatggcgaggatcgagtcttacgaagggcgtgaaaaaaaaggaatttcggacgtgcgaaggacgttttgcttgtttgtgacatttgatctgctatttgtaacattattatggattatcgagttgaacgttaacggtggaattgagaacactctggagaaagaagtcatgcaatacgattattatagcagctatttcgatatttttctgttggccgtatttaggttcaaggttcttattctggcctatgcagtgtgccgcctgcgacactggtgggctattgcgcttacgactgcggtgacaagtgcattcctcctggcgaaagtgattttgagcaaactgttctctcagggggcatttggatatgtgctccccattatatcattcatcttagcctggatcgaaacttggtttctggactttaaagtgctaccacaagaggcagaggaagaaaatcgtttactgatcgtgcaggatgcctctgagcgggctgctctcatcccaggcggactatctgatggccagttctactcaccgcctgagtcagaagcaggatcagaagaggcagaagagaaacaggactccgaaaaaccgctgctggaactgtag

SEQ ID NO: 242493 - DNA, 705 bp, Artificial Sequence
  Description of Artificial Sequence: Synthetic coding sequence
atgaaccacctgcctgaggatatggagaatgcgttaaccggatcccagtcctcacacgcctccctgaggaatattcacagcattaaccccacacagttgatggcacggattgagtcctacgaaggaagagagaagaaaggaatcagtgatgtcagaaggaccttctgcttgttcgtgacgttcgatctgctttttgtaacactcctctggattatcgagctcaacgttaacggaggcatcgaaaacactttggagaaggaagtcatgcagtacgattattattcgtcatattttgatattttcctcctggcagtgtttcgcttcaaagttctcatcttagcctacgctgtgtgcaggttgcggcattggtgggccatcgcactgaccacggccgtgacgagcgcctttcttttggcaaaagtgatactgagcaagctgttttcccaaggggcatttggatatgtcctgcccatcatctccttcatcctggcttggatagagacctggttcctcgactttaaagtcctcccgcaagaagcagaggaggaaaaccggctgcttatcgtgcaggatgcttccgaacgggcagcgctgatccccggaggactgtctgatggacagttctatagcccaccagagagcgaggcaggaagtgaagaggcagaggagaagcaggacagcgagaagccgctccttgaactgtag

SEQ ID NO: 242494 - DNA, 621 bp, Artificial Sequence
  Description of Artificial Sequence: Synthetic coding sequence
atgaatcatctgcccgaggacatggagaacgctctaacggggtcacagtctagtcatgcctctctccgtaacatccacagcataaatccgacgcagctgatggccagaatcgagtcttacgagggccgtgaaaaaaaaggaattagcgatgtccggaggacattctgtctgttcgtgacatttgatcttcttttcgtaaccctgctgtggataatcgagctcaacgttaacggagggattgagaacaccctcgagaaagaagttatgcagtatgactactattcctcctatttcgatattttcctgttggcggtgtttcggtttaaagtcttgatcctcgcctatgcagtgtgccgattgagacattggtgggccatcgcattaaccacagctgttacctccgcctttctactggcaaaggtcattcttagcaaactgttctcacagggtgccttcgggtacgtccttccaatcatcagtttcatcctcgcatggattgaaacctggttcttggatttcaaagtgctacctcaagaggctgaggaagagaaccggctacttattgtccaggatgcatcagagagggcggcattgatcccgggtggtctcagcgatgggtag

SEQ ID NO: 242495 - DNA, 555 bp, Artificial Sequence
  Description of Artificial Sequence: Synthetic coding sequence
atgaaccacctccccgaggatatggagaacgccctgacagggagtcagtctagtcacgctagtctgagaaacattcacagcatcaatcctacacagttgatggctagaatcgagtcctatgagggaagggaaaaaaaaggtatctccgatgtgcgcagaactttctgtctcttcgtcacatttgacctgctgttcgtgaccctgttgtggatcatcgagctcaacgttaacggcggaatagaaaacacactggaaaaagaagtgatgcagtacgactattacagctcctattttgacatcttcttgctggcagtgttcagattcaaggtgttgatcttagcatacgccgtctgccggctgaggcactggtgggccatcgcactaacgacagcagttacgtcggcctttctgttagcgaaagtcattctgtctaaactgtttagccagggcgcttttgggtacgtcctacccatcatcagtttcatcctagcttggatcgagacctggtttctggacttcaaagtgttgcctcaggaggcggaggaagagaactag

SEQ ID NO: 242496 - DNA, 519 bp, Artificial Sequence
  Description of Artificial Sequence: Synthetic coding sequence
atgaatcacttacctgaggatatggaaaatgccctcaccggttcccagagttcccatgccagcctgaggaacattcactcaattaatccgacacagcttatggcaagaatcgaatcatatgaaggaagggaaaagaagggaattagcgatgtaagacggaccttctgtctgttcgtcacattcgatttactatttgtgacactgctgtggataattgagctcaatgtaaacgggggaatcgagaacacactggagaaggaggttatgcagtatgattactattcctcttacttcgatatctttctgttggccgttttccgctttaaggtgctaattcttgcctacgctgtgtgtcggctgagacattggtgggcaatcgccctcactacggcggtgacatcggctttcctcctggccaaagtcattctatcaaaattatttagtcagggcgcatttggctatgttttgcccatcatcagcttcatcctagcctggatcgaaacatggttcctcgattag

SEQ ID NO: 242497 - DNA, 684 bp, Artificial Sequence
  Description of Artificial Sequence: Synthetic coding sequence
atggagaacgccctcactggctctcagagcagtcacgcctctctcaggaacatacatagcatcaatccaacacagctcatggcacggatagaaagttatgagggcagagagaagaaaggtattagcgatgtgcggaggaccttctgcctgttcgttacattcgacctcctgttcgttaccctcctgtggattattgagttaaatgttaatggaggaatagagaataccctagagaaggaagttatgcagtatgattattattcaagctacttcgacattttccttctggccgttttcagattcaaagtgctcatcctggcctacgcagtgtgccgcctgcgtcattggtgggctatcgctctgaccacagccgtgacgagcgccttcctgttagccaaagtaattctgtccaaacttttttctcagggggcatttggatatgtgctgccgatcatctctttcattttggcttggattgaaacgtggtttctagacttcaaagtgctgccccaggaggccgaggaagaaaatcgtctgttgatcgtgcaggatgcttccgaacgggcagcactgatacctgggggactgtctgatgggcaattttattcaccacccgaatctgaagccggaagcgaggaggcggaagagaaacaggacagcgaaaagccgctgctcgagctatag

SEQ ID NO: 242498 - DNA, 1338 bp, Artificial Sequence
  Description of Artificial Sequence: Synthetic coding sequence
atgagcaagctgcctagggagctaaccagggatctcgagaggtccttgccagcagtggcctctctgggttcgagcctcagtcactcccaaagcctgtccagtcacctcctgccacctcctgagaagcggagggctatatcagacgtaagacggaccttctgcttgttcgtgacatttgacctactgttcatttccttgttatggattattgagctgaacaccaacactggtattaggaagaacctggaacaggaaatcatccagtataatttcaaaacgtccttctttgacatcttcgtgcttgccttcttcaggttttccgggctcctgttgggttacgccgtcctgcgcctccggcattggtgggtcatcgccgtgactaccttagtgtcttccgcttttcttatcgtcaaagtgatcctttctgaactcctgtccaagggggcattcgggtatcttttgccaatcgtgagctttgtgctggcttggctcgagacatggttcctcgactttaaagtgctcccccaggaggctgaagaggaacgctggtatctggcggcacaggtggcagtggcccgtggacccttattgttcagcggggctttgtctgagggccaattttattctccccctgaatcttttgccggttcagacaacgagagcgatgaggaagtcgcaggtaaaaaatcctttagcgcacaggagcgagagtatatcagacaggggaaagaagcaactgctgtcgtcgaccagatcctcgcacaggaagagaactggaaattcgagaaaaacaatgaatacggggacaccgtgtacaccattgaggtaccgttccatggaaaaactttcatactcaaaactttcctgccctgccccgctgagcttgtctaccaagaggttatactccagccagaacggatggtcctatggaacaagaccgttactgcatgtcaaatcttgcagcgggtggaagataacacccttatatcctacgatgttagcgctggtgcggctgggggagtggtgagccccagagattttgtgaatgttcgccgtatcgaaaggcgcagagacaggtacctatccagcggcattgcgacttcccacagcgcaaaaccacctactcacaagtatgtcagaggcgagaatggacctggcggtttcattgtgttgaagtccgccagcaaccctagagtgtgtacgtttgtgtggattctgaacacggatctgaaagggagactccccaggtatctaatacaccaaagtctcgctgctactatgtttgagtttgccttccatctgcgccagaggataagcgagctcggtgccagggcatag

SEQ ID NO: 242499 - DNA, 1284 bp, Artificial Sequence
  Description of Artificial Sequence: Synthetic coding sequence
atgtcgaaacttccaagagagttgacaagggacctggaaaggagcctgcctgctgtcgccagcctaggtagttctctcagccacagccaaagcctgagttcacacttacttcctccgccagaaaagcgcagagcgatttccgatgtgcgcaggacattttgcttatttgtgacgtttgacctgctgttcatttctcttctttggattatcgagctgaatacaaacacaggcatccggaagaacctagaacaagaaattatccaatataattttaagacttcattcttcgacatttttgtactagccttctttcgcttttctggtctattgctgggctatgctgttttgcgactgcggcattggtgggtaattgccctcctgagcaagggtgcgtttggctatctgctgcctattgtgtccttcgtgcttgcctggttggagacttggttcctggacttcaaggtgttgccacaggaagctgaggaggagcgatggtatttggccgcacaagtggctgttgccagagggccacttctctttagtggagccctgagcgagggtcagttctacagcccccctgaatcgtttgccggatcggacaacgagagcgatgaagaggtggcgggaaaaaagtcatttagtgcccaggaacgtgaatacatcaggcagggaaaagaggctacggcggtcgtggaccagattttggcccaggaggaaaattggaagtttgagaagaataacgagtatggggacaccgtctacactattgaagtgcccttccatggaaagaccttcattctgaaaacatttctgccatgtccggctgaactggtataccaggaagtcatactccagccggaacgaatggtgttatggaacaaaacagttacagcctgccagattttacagcgggtggaggataacaccctcatctcttacgacgtgagtgctggtgccgcaggaggcgtggttagtcctagggactttgtcaacgtgagaagaattgagcgcaggagggacagatacttgagttccggaatcgctacctcacacagtgctaaaccccctactcataaatatgtgaggggcgagaatggtccaggcggttttattgtgctgaaatcagctagtaacccacgagtgtgcactttcgtctggattctgaataccgatctcaaggggcgtctgcctaggtacctgatccatcagagtcttgccgctactatgtttgagttcgccttccatttgcgacaaagaattagcgagcttggcgctagggcttag

SEQ ID NO: 242500 - DNA, 591 bp, Artificial Sequence
  Description of Artificial Sequence: Synthetic coding sequence
atgagcaaactcccgagagaactgactagagatttagagagatcactccccgctgtagcttccctggggtcctccctctcccatagccagagcttatcctcacatcttttaccccctcccgagaagcgacgcgctatttccgacgtccgcagaaccttctgcctgtttgtgacatttgaccttttgttcattagccttctgtggataatcgaactgaacacaaacacaggtattagaaagaatctggagcaagaaattatacagtacaacttcaagaccagcttcttcgacatttttgttctggcattcttccgcttctcagggcttctcttgggctatgcagttttaaggttgagacactggtgggtgatagccgtgactaccctcgtaagctcagcctttctgatcgtcaaggtcattttgagtgagctgctttctaagggcgctttcggctatctgctccccattgtgtcattcgtccttgcttggttggagacttggtttctcgactttaaggttctaccccaggaagcagaagaggagagatggtacctcgccgcacaggtggcagtagcacggggtcctctttag

SEQ ID NO: 242501 - DNA, 1338 bp, Artificial Sequence
  Description of Artificial Sequence: Synthetic coding sequence
atgtctaaactgcccagggagctcacaagagatctcgagcggagtctgcctgccgtcgcctctcttggctcatcgctgtcccactcccagtcactaagttctcatctcctcccaccccctgagaagcgaagagcgatttcagacgtacgtcggactttctgcctgttcgttactttcgatctgctgtttatttcactgctctggattattgagttaaataccaacacaggtatccggaaaaatctggagcaggagatcattcagtacaatttcaaaaccagcttcttcgatattttcgtgctcgcgttttttcggttctccgggttgctgcttggatatgcagtcctgagactgcggcactggtcccgcaggtggtgccccgtgcattctagcttgagcaggtcctcatccttatcttgcagtgcaaaagggcacctggctacctgtagccccagctcccttctctcctcgccgggatggcgcccaggctcgctaacctcgaaatcctatccacggaagctcaaaaggtcagactcagctcctccagggtacttagccgctcaggtcgccgtggctaggggtcctttgctgttcagcggggcactgtcagaaggacagttttactctccccctgagtcattcgctgggagcgacaacgagtcagatgaagaagtggcaggcaaaaagtctttcagtgcacaagagcgtgagtacatccgacagggtaaggaggctactgctgtggttgaccagattctggcccaggaagaaaattggaaattcgaaaaaaacaatgaatacggcgacacagtatacacaattgaagtgcccttccatggtaaaaccttcatactgaagacattcctgccctgcccagccgagttagtctatcaagaagtgatcctgcagccagagcgtatggtgttatggaataagaccgtaacggcctgccagatcctccagcgcgtggaagacaataccttgatctcttacgatgtaagtgcaggggctgccggtggcgtggtgtcaccaagagatttcgttaatgtgcgcagaatcgagcgacgacgagatagatacctttctagtggaatcgctacgtctcactccgcaaaaccacctacacacaaatacgtcagaggggaaaacgggccaggaggctttattgtcctaaagtccgcttccaacccccgagtatgtactttcgtatggatcctgaacacagatttaaaagggaggctccctcgctatctgatacatcagtcacttgcggctacgatgtttgagttcgcctttcatcttcgacagagaatctctgagctgggagcacgagcttag

SEQ ID NO: 242502 - DNA, 618 bp, Artificial Sequence
  Description of Artificial Sequence: Synthetic coding sequence
atggaaggtctgagcgatgtcgcctccttcgccacgaagctgaagaacacgcttattcagtaccacagcattgaggaagacaagtggagagtagccaaaaagacgaaggacgtgacggtctggcggaaaccgtcggaggaatttaacggctacctgtataaagcacagggcgtcattgatgatttggtatatagcattatcgatcacatccgcccagggccatgtagactcgattgggactctcttatgacctccctggacatcctagagaactttgaagagaactgttgtgtcatgagatatacgactgctgggcagctgtggaacatcatcagtccacgggagttcgtggactttagctataccgttggctataaggaggggctgctgtcctgtggtatttcccttgattgggacgaaaagagacccgaatttgtccgtggctataaccacccatgcgggtggttttgtgtgccactcaaagacaatccaaatcaatcattgctgactggatacatccagactgatcttagaggaatgatcccacagagtgcagtcgacaccgctatggccagtactttaactaacttctacggagacctgcgcaaggcactgtag

SEQ ID NO: 242503 - DNA, 576 bp, Artificial Sequence
  Description of Artificial Sequence: Synthetic coding sequence
atggaggggctctcagacgtcgcttcttttgccacaaagcttaagaatacactgatccagtaccattctatcgaggaggacaaatggagagttgcaaagaaaacgaaggatgtgaccgtatggcgaaagccctcagaggaatttaatgggtacctttataaagcccagggcgtgattgatgatctggtctatagcatcattgatcacatcagacccggaccatgcaggctcgattgggattccctgatgacttctctagacattctggaaaactttgaggagaactgctgcgtcatgcgatatacaacggccggacagctgtggaacatcataagcccccgagaattcgtggactttagctatacagtgggatacaaggagggactgctatcttgcggcatttcccttgattgggatgagaagaggccagagtttgtgcgtggatataatcatccttgcggatggttttgcgtgccactcaaggacaatcccaaccagtctcttctcacagggtacatccagacagatctgcgaggaatgattcctcaaagcgcagtcgataccgcaatggcctag

SEQ ID NO: 242504 - DNA, 642 bp, Artificial Sequence
  Description of Artificial Sequence: Synthetic coding sequence
atggaccctgcacttgccgctcagatgtccgaagccgtcgccgagaagatgctgcaataccgtcgggatactgccggatggaaaatctgcagagaagggaatggggtgagtgtctcctggcggccttccgtggaattcccaggaaatctctaccgaggcgaaggcatagtatacggaaccctggaagaagtgtgggactgcgttaagcctgctgtggggggtctgagagtgaagtgggacgagaatgtgactggcttcgagatcattcagtccatcacagacacgctgtgcgtgtcccgaacctccacaccatccgcagcaatgaagctgatctcaccacgggatttcgtggatctagtgttagtcaaaagatacgaggatggcactatatccagcaatgccacacacgtcgaacacccactctgcccccctaagcctggtttcgtccgaggtttcaatcatccttgtggttgtttctgcgagccgctgcccggtgagcccacgaagacaaatcttgtcaccttctttcatacagatctgtccggctacctcccccaaaatgtggtggacagcttttttccacggagcatgactcgcttttatgccaatctacagaaagcagttaaacagttccacgaatag

SEQ ID NO: 242505 - DNA, 663 bp, Artificial Sequence
  Description of Artificial Sequence: Synthetic coding sequence
atggactttaaagctatcgcacagcaaaccgctcaggaggttctgggttacaatcgcgacacctccgggtggaaggtagtgaagacttctaagaaaatcaccgtttcttcgaaggcctccagaaaattccatggaaacttataccgcgtcgaagggatcattccagagtctcctgctaagctcagcgattttctgtaccagacgggagatcgcattacctgggacaaaagcctgcaggtgtacaacatggtgcacagaattgacagtgatacattcatctgtcatacaatcactcagagcttcgcagtgggctcaataagccctagagattttatcgacttagtgtatataaaaagatatgagggtaatatgaacataattagctccaaatcagtggatttccctgagtaccccccatcgagcaactacatccggggttataaccatccctgcggcttcgtgtgttcaccgatggaggaaaacccggcttattccaaactggtgatgttcgtacaaaccgaaatgcgcggtaagctgtctccaagcatcattgaaaagactatgccatccaacttagtgaatttcattctgaatgccaaagatggaatcaaagcccaccgcaccccatctaggaggggcttccatcacaacagccacagttag

SEQ ID NO: 242506 - DNA, 3072 bp, Artificial Sequence
  Description of Artificial Sequence: Synthetic coding sequence
atgaccctgaacaattgtgcctctatgaagctcgaggtgcattttcagtccaaacagaacgaggattccgaggaggaggagcaatgcacaattagctcacattgggcctttcagcaggagtcaaagtgctggagtcctatggggagctccgacctgctagcgccacccagcccaggactccccgcaacctcaagctgtgagtccgtgctcaccgagctgtccgccacaagcctacctgtgatcaccgtctcactacccccagaaccagctgatctgccattgccgggaagagctccttcatcatcggatcggcctctattatctcccacccagggacaggagggcccacaagacaaggctaaaaagagacatagaaaccggagcttcctgaagcaccttgaatcactgaggagaaaagaaaagagtggatcccaacaggcagaacccaaacactcacctgctacaagtgagaaggtatcaaaagctagcagtttccgaagttgccggggattcctctccgccggtttctatcgtgccaagaactgggccgctacctccgccggagggtctggggcaaatacacggaaagcatgggaagcatggccagttgcctcattccgtcaccctcagtggacgcaccggggtgattgtctagtgcacgtgcctggagaccataaaccaggcacctttcccagaagcctgtccatcgaatccctgtgccctgaagacgggcaccggctcgccgattggcagccaggaaggagatggggatgtgaaggcagacggggaagctgtgggagtactggttctcacgcctctacctacgacaatcttccagagctgtaccccgcagagccagtgatggtgggcgctgaggctgaggacgaagatgatgaggaatcaggcggatcttatgctcacctcgacgatatcctgcagcatgtgtggggtctccagcaaagggtagaactgtggagcagggccatgtatcccgaccttgggcctggagatgaagaggaggaagaagccactagtagcgtggagatagctactgttgaggtgaagtgccaggcagaggctttatcacagatggaagtgcccgcacatggcgagtctccagcctgggcccaagccgaagtacaaccagctgtgttggcacccgcacaggcccctgctgaagctgagccggtcgcgcaggaagaagcggaggccccagccccagcccctgcacccgctccagctcaggacagcgagcaggaagcccacagtgggggtgagcccacctttgcttctagtctgtctgtggaggaagggcactcaattagtgacaccgttgcttccagcagcgagctggactcatccggcaattctatgaacgaagcagaggccgctggtccattagctggactgcaggcatccatgcctcgggagcgaagagattcaggcgttggggctagcctaactcggccatgtcgtaagctgcggtggcattcatttcaaaacagccataggccatctttgaactccgaatcactggagattaatcgtcagtttgcgggacaaatcaacctgttgcacaaaggatcgctgctccgtctgaccgcctttatggaaaagtatacggtgccccacaagcagggatgggtgtggagcatgcccaaattcatgcggcgtaataaaacccccgactacagaggccagcatgtgttcggtgtcccccctctcatccatgttcagcggactggacagcctctacctcagtccattcagcaggccatgagataccttcggtctcagtgtctggatcaggtaggtattttccgcaagtctggagtgaagagccgcattcagaatctcagacaaatgaatgaaacatctccagataacgtgtgttacgagggacaaagtgcatacgacgtggccgatctgctgaagcagtatttcagagatctgcccgaacccatctttacctccaaactgacgaccacctttctgcagatctatcaattgttacctaaagatcaatggttggcagctgcccaggccgctactctcctgctgccggacgaaaacagggaagtgctgcaaacactgctgtatttcctttccgacatagcatccgcggaggagaaccagatgacagccggtaatctcgcagtctgtctggccccttctatattccatcttaatgtgtccaagaaggatagcccctctccccgaattaagtccaagagatccttgattgggaggccgggtccacgcgatttgagtgacaacatggctgctacccaaggcttgtcgcatatgatatctgattgtaagaagctatttcaggtgcctcaagatatggtgcttcagctctgctcttcctattccgctgctgaattaagtccaccaggtcctgccctggcggagctgcgtcaagctcaggccgctggagtgtctctgtcactatacatggaggagaacatccaggacctattgcgggatgctgccgagcgtttcaaaggttggatgtctgtgccgggaccacaacacacagaactcgcatgtcgaaaggccccagacggccatcctctcaggctttggaaggcttcaaccgaggtggccgcaccccctgcagtggtgctgcatcgggtgttaagagaacgggctctgtgggatgaagatctgttgcgagcccaggtgttggaggccctgatgccaggcgtggagctgtatcattatgtgacagacagtatggcaccgcacccttgcagagattttgtcgtgctccgcatgtggaggtcagatttaccccgtggcggttgtctcctcgtcagtcagagtttggacccagaacagccagtgcctgaaagtggggtgcgggcactaatgctgaccagccaatacctgatggagccttgcggattgggcagaagtagactcacacacatttgtcgggctgacctgaggggccgttcccctgattggtataacaaggttttcggtcacttatgtgctatggaagtggccaagatccgagactcattccctacactacaggctgccggtccagaaacaaaattatag

SEQ ID NO: 242507 - DNA, 3072 bp, Artificial Sequence
  Description of Artificial Sequence: Synthetic coding sequence
atgacattaaataactgtgcttccatgaagctagaggtgcattttcaatcgaagcagaacgaagactcagaagaagaggaacaatgtactatctcctcacactgggcttttcaacaagagagtaaatgttggtcgcccatggggtcttctgatttgctggccccacctagcccaggtctgcccgctaccagcagctgtgaatctgtacttacagagttgtccgcgacatctctacctgtcattacagtgagcctgccacctgaaccagcagatctgcctctgcccggaagggctccttctagcagcgatcgacctctactttcaccgacacagggacaagagggtccccaggataaggctaagaagcgccaccggaataggagcttccttaagcatctagaaagtttgaggaggaaggagaagtctggttctcaacaggccgagcccaagcacagccctgctacaagcgagaaggtgagcaaagccagtagctttagaagctgtcggggattcctgtcggccggtttctatcgcgcaaaaaattgggcagccacctcagccggtgggtccggtgccaatacaagaaaggcctgggaggcttggcccgtagcctctttccgccacccccagtggactcaccggggagactgcctcgtgcacgtaccgggagatcataagcctggtacattccccagatccttaagcatcgagtccttgtgtcccgaggatgggcataggctcgccgactggcagcccggacggaggtgggggtgcgaggggaggagagggagctgtggttccacgggctcacatgcaagcacgtacgacaacctgccggagctgtacccagcggaacctgtgatggtcggcgctgaggccgaggatgaggacgatgaagaatccgggggaagctacgcccatcttgacgacatcttgcagcacgtctggggccttcagcagagagtagagctgtggtctcgagccatgtatccagatttgggccctggggacgaagaagaagaggaagctacttcctccgtagagatagcaacagtggaagtaaaatgccaagctgaggccctgagccagatggaggttcctgcccacggtgagtctccagcctgggcacaggcggaggtgcagcctgctgtgctcgcccctgcgcaggccccagcagaggcagagccagtcgcacaggaggaggccgaggctcccgcaccagcccctgctcccgcacccgctcaggattcagaacaggaggcgcatagtgggggagagccaactttcgcctcttctctaagcgtggaagaaggccacagcatctcagacacagttgcatcctcctccgagctggacagtagcggaaactctatgaacgaggcggaggctgccggaccacttgccggactgcaggcctccatgcctagggagagacgggattcgggagttggggcttccttaaccaggccatgtagaaaactgcgctggcacagctttcagaacagtcaccgcccatctctgaacagtgagagcctcgaaattaacaggcagttcgccggacagatcaacttacttcataaagggtctcttcttagactcacggcctttatggagaagtacactgtgccacataagcaggggtgggtgtggtccatgcccaagttcatgaggaggaataaaaccccagattaccgcggacagcatgtgtttggcgtgcctcccctcatccacgtgcagcggaccggccagccactgcctcaatcgatacaacaggcaatgcgatacctgcggagtcagtgtttggatcaggtgggcatttttcgaaaatccggggtgaaaagccggatccaaaacctccgacaaatgaacgagaccagccccgataacgtatgttacgagggacagtctgcctatgatgtggcggacctcctgaagcagtatttcagggacctgccagaaccaattttcaccagcaagctgaccacgactttcctccagatttaccagttacttccaaaagatcagtggttggcagcagcacaggctgccactcttctgctgcccgatgagaacagggaggtcttacaaacacttctttactttttgagtgatatcgcgtcagctgaggaaaatcagatgacagccggtaacctggctgtgtgtctcgccccttccatttttcatcttaacgtttccaaaaaggactcaccaagcccacggattaaaagtaagagaagcctcattggcagacctggacctcgcgatctgtccgataatatggctgcaacgcaggggctctctcacatgatctcagactgtaagaagttatttcaggtgccccaggatatggtccttcagctgtgctcctcctatagcgctgccgagttgagtccacccggacctgccctcgcggaactacgccaggcgcaggcagcaggggtctccttatcattatatatggaggagaatattcaggatcttttacgcgatgcagctgagcgcttcaaaggctggatgtctgtgcctggacctcagcataccgaactggcatgcaggaaagcgcctgatggacatcccctaaggctgtggaaagcctcaaccgaagtcgcagcccctcctgctgtcgttctccatcgcgtgcttcgggaacgagccttgtgggacgaggatcttctgcgcgcacaggtcctcgaggccctaatgccaggagttgaactgtatcactatgtgacagattcgatggcccctcatccatgtcgggactttgtggtgctccggatgtggagatccgacctgcccagaggcggttgtctcctagtatctcaatccctggacccggagcaacccgtgccagaaagtggagtgcgcgcactgatgttgacatcacagtacctcatggaaccttgcggtctgggtcgctctcggctcacccacatctgtcgggcagatttgcggggtaggagcccggactggtacaataaagtatttggccacttgtgcgctatggaggtggccaagatcagagacagctttcctacccttcaggccgctggtcctgagactaaactctag

SEQ ID NO: 242508 - DNA, 3312 bp, Artificial Sequence
  Description of Artificial Sequence: Synthetic coding sequence
atgccattgctggacgtgttctggagctgttttagaaaggtgaaatgttttccgctgctccaggtgaaaaagaatgccgaagcagaggcaaagagagcttgtgagtggctgcaggctacaggcttccctcaatatgtgcagcttttcgaagagggaagtttccctttggacatcggcagcgtcaagaagaaccacgggttcctcgatgaggatagcctgggggctctgtgccggaggttaatgaccttgaataactgcgccagtatgaagctggaggttcacttccagagcaaacaaaacgaggacagcgaagaggaggaacagtgtactatatcatcccattgggccttccaacaggagagcaagtgttggtcgcccatgggttcctccgatttattggctccaccttcgccgggacttcctgctacctcaagctgcgagagcgtactgaccgagctgagcgcgaccagtctgcccgtcattaccgtttcgcttcccccagagcccgctgatctccccctcccaggccgtgccccatcttcttccgatcgccctctgctttcccctactcaggggcaagaaggaccacaggataaagccaagaaaagacatagaaatcggagtttcctcaagcatcttgaatccttgcggaggaaggagaaatcgggctctcagcaggccgaacccaagcactctcctgccacaagcgaaaaggtttccaaagcatctagttttagatcatgccggggatttctctccgccggattttatcgcgctaaaaattgggccgcaaccagtgccggtggctccggggctaacactagaaaggcgtgggaggcatggcctgtggcctctttccgacacccacaatggactcataggggcgactgtctcgtgcacgtccctggagaccacaaacctggcacattccccaggagtctgagcattgagagcttatgcccagaagatggtcaccggctcgctgactggcagcccggtagaaggtggggctgcgaagggagacgcggaagttgcggcagtaccggatcacatgccagtacttacgacaacctgcccgagctctatcctgcagagccagtgatggtcggtgccgaggcagaggacgaagacgatgaagagagcggcggaagctacgcccatctcgacgacatcctgcagcacgtgtggggcttgcaacaaagagtggagttgtggagccgagctatgtaccctgacctaggaccgggtgatgaggaagaagaggaggccacatccagcgtagaaatagccacagtagaagtgaagtgtcaggccgaagccttgtcgcagatggaggtgcctgcgcatggggaatcccctgcatgggctcaggccgaagtgcagccagccgtcctggctcccgcacaggcccctgccgaggccgaacccgtagcacaagaagaggcggaagcgccagccccagcccctgcgcctgcaccagcgcaggactccgaacaagaggctcattcagggggagaacccacctttgcttcttccctgagcgtcgaggaggggcacagtatatccgatactgtagcttctagctcagaactcgactcttccggtaacagtatgaatgaagcggaagcagccggtcccctggctgggctgcaagcgtctatgcctagagagcgcagggatagtggcgtaggtgcgagtctgacacgcccttgccgaaagctgcgttggcatagctttcagaattctcaccggccatcgctgaactcggaatctctagaaattaaccgccagttcgctggccagattaatttgctgcataagggttcactcttaaggcttacagcttttatggaaaagtacaccgtgccccataagcagggctgggtgtggagcatgcccaaatttatgaggagaaataaaacacctgattatcggggacaacatgtctttggagtccccccacttattcatgtgcagcgcaccgggcagcctctcccccaaagcatccagcaggctatgaggtacttaagatctcaatgtttagaccaggtgggaatctttaggaagagcggggtaaagtcccgaatccagaatctgagacagatgaatgaaacttcccctgataatgtgtgctatgagggccagtccgcctacgatgttgccgatcttctcaagcagtactttagggacttaccagagcccatcttcacctccaaactcacaaccacgtttcttcaaatctaccagctgttgcctaaggaccagtggttggcagcagcccaggcagcaaccctactgctccccgatgaaaatcgggaagtgctccagacccttctctattttctgtcagatattgccagtgcagaggagaaccagatgactgccggtaacttagctgtgtgtctggcaccttccatcttccacctgaatgtttccaaaaaggactctccctcccctcgtattaaatctaaacgatcactgattggcagacctggcccacgagaccttagcgacaatatggccgcaacacagggtctctcccatatgatctccgattgcaagaaactgttccaggtgccacaggacatggtgctccaactgtgtagctcttattcagcggctgaactttccccccctggacccgcacttgccgaactcaggcaggcccaggctgctggggtgagtctcagcctctacatggaggaaaacatccaagacctactgcgcgacgctgcagagcggtttaaagggtggatgtctgtgcccggtccccagcatactgagctagcttgcagaaaggctcctgatggtcaccccttgagattatggaaagccagcaccgaagtcgccgctccccctgccgtagtactccatagagtcctgcgcgaaagagctttgtgggatgaagacttgctacgtgctcaagtgctggaggccctgatgcctggagtggagctgtaccactacgtaaccgacagcatggcacctcatccatgccgtgacttcgtggttctaagaatgtggcggtctgacctgccgaggggagggtgtctgttggtctcccagtctttggaccccgagcagcctgtaccggagagcggcgtccgcgctctcatgctgacctcccagtacctcatggagccttgtggtctgggacggtctcgcttaacgcatatttgccgggctgacctgcggggtcggtcacctgattggtataataaagtgtttggccatttgtgcgccatggaggttgccaagatacgagactctttcccaactttgcaggccgctggccctgaaaccaaactctag

SEQ ID NO: 242509 - DNA, 159 bp, Artificial Sequence
  Description of Artificial Sequence: Synthetic coding sequence
atgcccttacttgacgtgttctggagctgctttaggaaggtaaagtgctttcccctcttgcaggtgaaaaagaatgccgaggctgaggccaagcgggcatgtgagtggctccaggcgactggctttcctcaatatgtccagctgtttgaaggagggtag

SEQ ID NO: 242510 - DNA, 189 bp, Artificial Sequence
  Description of Artificial Sequence: Synthetic coding sequence
atgaagttcctggtgtttgcttttatcctggccctgatggttagcatgataggggctgattcttcggaggagaagttcttgcgccgaatcggacggttcggatacggatatggcccttatcagccagtgccagaacagccactgtatccgcagccttaccaaccacagtaccagcaatataccttttag

SEQ ID NO: 242511 - DNA, 159 bp, Artificial Sequence
  Description of Artificial Sequence: Synthetic coding sequence
atgaagtttctcgtgttcgcctttattctcgcgcttatggtcagcatgatcggcgcagatagctccgaggaatacggatacgggccttaccagcccgttccggagcaaccattgtacccgcaaccctaccagccccagtaccaacagtataccttttag

SEQ ID NO: 242512 - DNA, 843 bp, Artificial Sequence
  Description of Artificial Sequence: Synthetic coding sequence
atgcgatggtttctgccctggactctggctgcagtcactgctgctgctgcctccacagtcctagcgacagcactgtctcccgctccaacaaccatggactttaccccagcccctctcgaggataccagctcacgccctcagttctgcaagtggccctgtgaatgtcccccttcacctccgcgatgtcctctcggcgtttctcttatcactgacgggtgcgagtgctgtaagatgtgcgcccaacaactgggcgacaattgtacagaagccgctatttgtgatccccatcggggactgtactgtgattactcaggagacagacccagatatgccattggcgtttgtgcccatgcagttggcgaggtcgaagcatggcacagaaactgcatagcatacacttctccctggtctccatgctcgaccagttgcggacttggggtttctacaagaatctccaacgtgaatgctcagtgctggcccgagcaggagtctcgcctgtgtaatctgcgaccctgcgatgtagatattcatacattaataaaggcagggaaaaagtgcctggctgtatatcagccagaggcttctatgaactttacactggcgggttgtatctcaactaggtcctaccagccaaagtactgtggcgtctgcatggacaatcggtgctgtattccctacaagagtaaaaccattgacgtaagcttccagtgtccagacggcctgggcttctcccgacaagttctttggattaatgcatgcttttgtaacctgtcatgtagaaaccccaatgacattttcgctgatctggagagttaccccgatttttccgagatagcgaactag

SEQ ID NO: 242513 - DNA, 507 bp, Artificial Sequence
  Description of Artificial Sequence: Synthetic coding sequence
atggctaaaactgccatggcctacaaagaaaagatgaaagaactgagcatgctctccctgatttgtagttgcttttacccggagccgaggaatataaatatttatacctatgatgatatggaggtgaagcagataaacaagagggcctctggccaggccttcgagctcatcttgaagccaccctctcccaagaagaaggacttaagccttgaagagatccagaaaaaactggaagcggctgaggaaagaaggaagtcccaggaagcacaagtcttaaaacagctagccgagaaacgggaacatgaacgcgaggtgttacagaaggccctcgaggagaataacaatttcagcaagatggccgaggagaaacttatacttaagatggagcaaattaaggagaaccgggaagctaatctggcggctatcatcgaacgcctccaggagaaggagcggcacgcggctgaagttcgcagaaataaggagttgcaggtggagttaagcggctag

SEQ ID NO: 242514 - DNA, 564 bp, Artificial Sequence
  Description of Artificial Sequence: Synthetic coding sequence
atggcgaagaccgccatggcctacaaagagaaaatgaaagaactgagcatgttatccctgatctgttcatgtttttatcccgaacctaggaacattaatatttacacttacgacgacatggaggtaaagcaaattaataagagggcaagcggccaagcctttgaactgatcctgaagcccccttcccctatttctgaggctccgaggacacttgccagccctaaaaaaaaagatttatctctcgaggaaatccagaagaaattagaagccgctgaagagagacggaagagccaagaggcacaagttctcaagcagctggctgagaagagggaacacgaacgcgaggtccttcagaaggctcttgaggaaaataataacttcagcaagatggcagaggaaaagttgattcttaagatggagcagataaaggaaaatagggaagccaatctggctgccatcatagagcgtctccaagagaaattggttaaatttatttctagtgagctgaaagagagcatcgagagccagtttttggagcttcagcgagaaggggagaagcagtag

SEQ ID NO: 242515 - DNA, 543 bp, Artificial Sequence
  Description of Artificial Sequence: Synthetic coding sequence
atggcgtcaacgattagcgcttataaagagaagatgaaggagctctccgtcctctcactgatttgcagctgcttttacacacaaccacatcccaacacagtctaccagtatggggacatggaggtaaagcagcttgacaagagggcttccggtcagagctttgaagttatcctgaaaagccctagtgacctgtcacccgagtcaccaatgctatcaagccctccaaagaaaaaggacacaagcttggaggaacttcagaagcgacttgaggctgctgaagaacgaagaaagacacaggaggcccaagtcctgaagcagctcgccgagaggagggaacacgagcgtgaggtgctacacaaagccctggaggagaataacaatttctcacgacaggctgaagaaaagctgaactacaagatggagctaagcaaggagatccgcgaagctcatctggctgccctcagagaacggctgagagagaaggaattgcatgcggcagaggtcaggcgcaacaaggaacaacgggaagagatgagcgggtag

SEQ ID NO: 242516 - DNA, 510 bp, Artificial Sequence
  Description of Artificial Sequence: Synthetic coding sequence
atgaaagaactctccgtcctgtctttaatatgttcctgtttctatacccagccacaccctaacactgtttaccagtacggggatatggaggttaagcaactagataagcgagcctccggccaatccttcgaagtaattctaaaaagtccgagtgacctgagcccagagtcgcctatgttgagttctccaccaaaaaagaaagatacttctctggaggaactccagaaaagactggaggctgccgaagaacgccgaaagactcaggaggctcaggtccttaaacagttagccgagcgcagggaacatgagagagaggtgctccacaaggccctcgaagagaataacaacttcagccgccaggccgaagagaagctcaattataagatggagctttctaaggagatcagagaagcccacctcgccgcactacgcgagcggctcagagagaaggagctgcatgcggctgaggtccggcgaaacaaggagcagagagaggaaatgtctggttag

SEQ ID NO: 242517 - DNA, 1422 bp, Artificial Sequence
  Description of Artificial Sequence: Synthetic coding sequence
atgttctcagtacagctgtctctgggggagcagacatgggagtctgaggggtcatcaatcaagaaagcccagcaggcagtggcaaataaggccctaactgagtccactctacccaagcctgttcaaaaaccaccgaagtccaatgttaataacaaccccggttctatcacgccaacagtggagttaaacggactcgcaatgaagaggggggagcccgcaatctaccgccctctggatccgaaaccctttccaaattatcgggcaaactacaacttccggggaatgtataatcaacgctaccactgtccagtgccaaagattttttacgttcagttaaccgtgggcaataacgaattcttcggcgaaggcaaaactcggcaagccgcacgccataatgcagcaatgaaggccttacaagccttacagaatgagcctatccctgagaggtccccccagaatggcgagagtgggaaggacgtagacgatgacaaggatgcaaacaaaagcgagatttcactggtttttgagattgccctgaaacgaaacatgccagtgagcttcgaagtgataaaggagtctggacccccacacatgaagtcctttgttacacgggtgtccgtcggagagttctccgccgagggagaaggtaatagcaagaagctgagcaagaagcgagcggctacaactgtgctccaggagctcaaaaagcttcccccacttccagtcgtagagaagcctaaattgttttttaaaaaacgccctaaaaccatcgtgaaagctgggccagaatatgggcaaggaatgaaccccatttctaggctcgcccagatccagcaggcgaagaaagagaaggagcccgactacgttttactgagtgagaggggaatgccacgcagaagggagttcgttatgcaggtgaaagtgggaaatgaagtggccaccggaacgggccctaacaagaaaattgccaaaaagaacgccgctgaagctatgctgctccagctgggatataaagcaagtaccaatcttcaagaccaactggaaaagaccggcgagaacaaaggttggagcgggcctaagcctggatttccggaacctaccaataacacccccaaaggcatactgcacctgtcacccgatgtgtatcaggaaatggaagcctcacgccacaaggtcatcagcggaaccacactagggtatctgagtcccaaagacatgaatcaaccatccagtagcttcttttccattagcccaacatccaatagttccgctaccattgccagagaactgctgatgaacggaaccagcagcactgcagaagcaattggtctcaagggttcgtcccccacaccaccttgtagccctgtgcaaccttctaagcaactggagtatttggccagaattcaaggctttcaagtgtag

SEQ ID NO: 242518 - DNA, 1515 bp, Artificial Sequence
  Description of Artificial Sequence: Synthetic coding sequence
atgaaaagaggagagccagctatttatcggccactggaccccaagccatttccaaattatagagccaattataacttcaggggtatgtacaatcagagataccattgccctgtaccgaaaattttttacgtccagttaacggtgggtaacaatgagttttttggtgaaggtaaaacacggcaggcggcaagacataatgccgctatgaaagcgctccaggcgttgcaaaatgagccaatccctgagcggtctccccaaaatggggagagtggaaaggacgtagacgacgataaagatgccaataagtccgaaatcagcctagtatttgagatcgccctgaagaggaatatgcctgtctcctttgaagtgatcaaagagagcggaccaccacatatgaaaagctttgtgacaagggtctccgtaggggaattcagcgccgaaggggagggcaacagcaagaaactcagcaagaagcgcgctgctactaccgtgttacaggagctcaaaaagctgccgcctttacccgtagtcgaaaagccgaaactttttttcaaaaagagacctaaaacaatcgtgaaggcaggccctgaatacggacaagggatgaatcccatcagccgattggcccagatccagcaggccaagaaggaaaaggaaccggactacgtgctgctctccgagcgcggtatgcctcggaggagggagtttgtgatgcaggtcaaggttgggaatgaagtggccaccggcaccggacccaataagaagatagcaaaaaagaacgcagctgaggcaatgctcctgcagttgggatacaaagcaagcaccaatcttcaggaccagctggaaaagactggtgaaaacaaaggctggagcgggccaaagcctggatttccagagccgacaaacaacactcccaaagggattcttcatcttagccctgacgtttatcaggagatggaagccagtagacacaaggtcatctccggtactactctgggttacctctctccgaaggatatgaaccaaccatcatcaagcttttttagtatctcgccaacttctaactccagcgccacaattgcacgggagctcttgatgaacgggacatcctccacggcggaggctattggtctgaaagggtccagtccgaccccaccttgttctcccgtgcagccttcaaagcagttggagtatctggcccgtatccaggggttccaggtgcactattgcgacaggcaaagtggtaaagagtgcgtgacctgcctgacattggctccagtccaaatgacattccatgctatcgggtcaagtatcgaagcttcccacgaccaagccgcactatcagcactgaagcagttcagcgagcagggactggatccgatagatggagcgatgaacatcgaaaaaggctcactggagaaacaggcgaaacacctgcgcgagaaggctgataataaccaagcccctccaggaagcattgcacaggactgcaagaagagcaactccgccgtatag

SEQ ID NO: 242519 - DNA, 1197 bp, Artificial Sequence
  Description of Artificial Sequence: Synthetic coding sequence
atgaaggctcttcaagctctccagaacgaacccatcccggagaggagcccacaaaacggagagtcaggaaaggatgtcgacgatgataaagacgctaataaaagcgagatctccctagtgttcgaaatcgccctgaagagaaacatgcctgtgtcctttgaggttatcaaagagagtggtccccctcacatgaagagtttcgtgacacgcgttagcgtgggcgaattttccgccgagggggaaggtaactccaaaaaactgtctaagaaacgcgctgctacaaccgtgctccaggaactgaaaaaactgccgccattgcccgttgtggagaaacctaagctgtttttcaagaaaaggccaaaaacgatcgtgaaagccggacctgaatacggtcagggcatgaatcctatcagcagactcgctcagattcagcaggcaaaaaaagagaaagaacctgactatgtgctgctctctgaaaggggaatgccacggagacgcgagttcgtgatgcaagtgaaagttggcaacgaggtagccaccggcaccgggcctaataagaaaattgccaaaaagaacgcagccgaggctatgctccttcagctgggatataaagcatctactaacctccaagatcagctggaaaagactggcgagaataaggggtggtctgggcctaagcccggatttccagagccaaccaataacacgccaaaggggattctccacctatccccagatgtatatcaggagatggaggcttccaggcacaaggtgatatctggaactacactcggatacctgtctcctaaagacatgaaccagcctagtagctctttcttctcaatctcacccacgagcaactccagcgcaaccattgcgcgagagcttctcatgaacggtacatcttccacagccgaggccattggcctgaaagggagtagccctaccccaccctgctctcccgttcagccttcaaagcaattggagtacctggctcggatccagggttttcaggccgctcttagcgccctgaagcagttctcagagcaaggcttagacccaatcgatggcgctatgaacatagaaaagggtagtctggagaagcaagccaaacatctgcgggagaaggccgacaacaatcaggcccctccgggaagtatagcgcaggattgtaagaagagtaactctgcagtttag

SEQ ID NO: 242520 - DNA, 1440 bp, Artificial Sequence
  Description of Artificial Sequence: Synthetic coding sequence
atgctccagatcaaccagatgttcagcgtacagctgtctcttggggaacagacatgggagtctgaggggtctagcatcaagaaggctcagcaggccgtggctaacaaggctcttactgagagtactctgcccaaaccggttcaaaaacccccaaagtcaaacgtcaacaataacccagggtcaatcaccccgaccgtagagctcaatgggctcgcaatgaaacgaggggagcctgcaatttacaggcccttagaccctaagccctttccgaattacagagctaattacaacttccgaggaatgtataaccagcgctatcattgtcctgttcccaaaattttttacgtgcagttaaccgtgggtaacaacgaatttttcggcgaggggaagactcgccaggccgcacggcacaatgccgctatgaaagctctgcaggccctgcagaatgagcccatcccagagcgtagcccgcaaaatggggagtccggaaaggatgtggatgacgataaggacgccaacaagtccgaaatcagcctggtgttcgagatcgctttaaaaaggaatatgccagtcagcttcgaagtgatcaaggagagcgggccaccccacatgaagagttttgtaacccgcgtttctgtgggtgagttctcagccgagggagaaggaaatagcaaaaagctgagcaaaaaacgggcagccactaccgtgttgcaggaacttaagaagttgccccctctccctgtggtagagaaaccgaaattattctttaaaaagcggccaaaaacgattgtgaaagcaggcccagagtatgggcagggaatgaaccccattagccgcctggcacagatccagcaggcgaaaaaagaaaaagagcccgactatgtcctattgtctgaacgtggcatgcctcggagaagagaatttgttatgcaagtaaaagtgggtaacgaggtggcgaccggtacaggcccaaataagaaaatcgccaagaaaaacgcagctgaggccatgttattgcagctcggctataaagcctcaaccaatttgcaggatcagttggagaagaccggcgagaacaaggggtggagtggccctaaaccaggattccccgaaccaactaataatacaccaaaggggatactgcacctatcacccgacgtttaccaagaaatggaagcctcgcgccacaaggtgattagcggcaccaccctgggctacctaagtccaaaagacatgaaccagccaagttccagttttttctccatttccccaactagcaattctagcgctacgatcgccagggaactgttgatgaacggcacctcaagtacagcggaagctattgggttgaaaggtagttctccaacacccccttgttcacccgtccagccctccaagcagttagagtacttggccaggattcaagggtttcaggtgtag

SEQ ID NO: 242521 - DNA, 615 bp, Artificial Sequence
  Description of Artificial Sequence: Synthetic coding sequence
atgttacagattaatcagatgtttagcgttcaactgagcctgggcgagcagacttgggaatctgaggggtcctcaatcaaaaaagcccagcaagcagtggccaacaaggcgcttacagagtctacactccctaaacctgtgcaaaagcctccaaagagcaatgtgaacaataatcctggctccataacccctaccgtggagctgaacggtctcgctatgaagcgtggggagcccgctatttacagaccactagatccaaagccattccctaattaccgcgcaaattacaattttcgaggtatgtataatcaacgctaccactgcccggtgcccaaaatcttttacgtccaactgaccgtggggaataatgagttcttcggggaaggaaagacgcgtcaggctgcacgtcacaacgctgccatgaaagccctgcaggctttacaaaacgaacccattccagagcgctctccacagaatggagaatctggaaaagatgtggatgatgataaggacgcaaataaatccgagatctcactggtgtttgagatcgctctgaagcgtaatatgccagtctcttttgaagtgattaaggaatccggtcctccacatatgtag

SEQ ID NO: 242522 - DNA, 195 bp, Artificial Sequence
  Description of Artificial Sequence: Synthetic coding sequence
atgttgcagattaatcagatgttctcagttcagctgtcacttggagaacagacctgggagtcagaaggcagcagtatcaaaaaggctcagcaggccgtggccaacaaggctctcactgagtccactctacccaagcccgtgcagaaaccccctaaatcgaatgtgaataacaacccagggtctattacaccctag

SEQ ID NO: 242523 - DNA, 1440 bp, Artificial Sequence
  Description of Artificial Sequence: Synthetic coding sequence
atgttgcaaattaaccagatgttctccgtccagttgtcccttggagagcagacatgggaaagtgagggctcctccatcaaaaaggcccagcaagcggtggcaaacaaagcacttacagagtccacactacctaagcccgtccagaagccacctaagtcgaacgtgaacaataaccccggatccattacccctaccgtcgaactgaacggattagccatgaagcggggagaacccgcaatataccgaccactcgatcccaaaccattccctaactacagagcaaactataatttccgcggtatgtacaaccagcgataccactgccctgttcccaaaattttttatgttcaactgacagtcgggaataacgagttttttggcgagggaaaaacgcgacaggcagccaggcacaatgctgccatgaaggcacttcaggccctgcagaatgagcctatcccagagcgctcgcctcagaatggagaatccggcaaagacgtggacgacgataaggatgccaataagtctgagatcagtctcgtgttcgagatcgcgctgaagaggaatatgcctgtcagctttgaggtgatcaaagagtccgggccaccacatatgaagtccttcgttacaagagtcagcgtaggcgagtttagcgctgagggagaagggaattccaagaagctgagcaaaaagcgtgccgctaccactgtgctccaggaactcaaaaaactgcctccactgccagtggttgaaaagccgaagctgtttttcaaaaaaagaccaaagactatcgtgaaggctggtccagaatacggacagggcatgaaccccatcagccgactagctcaaatccaacaagctaagaaagagaaggagccagactacgtgttactttcggagaggggcatgccacgtagacgggagtttgtgatgcaagtgaaagtcggaaacgaggtggccaccggtaccggtccaaataaaaaaattgctaaaaaaaatgcagcagaggccatgctcctccaattaggatataaagcatccaccaatctgcaggaccaactcgagaaaactggcgagaataaaggctggtccgggccaaagccaggatttcccgagcccacaaacaacactccaaaaggaatccttcaccttagtcctgacgtatatcaagagatggaagcttccaggcataaagttatttctggcacaactttgggttatctgagtcccaaagacatgaatcagccttcctcgagtttcttttctattagtccaacttccaattcaagtgcgacaatcgccagagaattgctcatgaacggtaccagcagcactgctgaggctattggcttaaaaggcagttctccaacccctccgtgcagccccgtgcagccgagcaaacagttggaatacctagctcggattcagggatttcaggtatag

SEQ ID NO: 242524 - DNA, 1617 bp, Artificial Sequence
  Description of Artificial Sequence: Synthetic coding sequence
atgctgcagatcaaccaaatgttttcagtgcagctgtcactcggagagcagacttgggagagtgaagggtcatctatcaaaaaggcccagcaagccgtggcaaataaggccctcacagagagcacattgcctaagccagtgcagaagccccctaaaagcaatgtgaacaataaccccggaagcatcacacccacggtcgagcttaatgggctcgccatgaaaaggggcgagcccgcaatctaccgacccctggaccccaagccctttcctaactatagagccaattacaacttccgcggaatgtacaatcagcgctaccattgtcctgttccgaaaatcttttacgttcagttgactgtcgggaataacgagttcttcggagagggtaaaacacgtcaggcagctcgtcacaatgcggcaatgaaagccttacaggcccttcagaatgagccaattccagaacgctctccacaaaacggagagagtggcaaagatgtcgacgacgataaggatgcaaataaatcggaaatctctctagtgtttgaaatcgccttgaagcggaatatgcctgtttcattcgaagtgattaaggagagtgggccaccccacatgaaatcatttgttaccagggtgagtgttggggaatttagtgccgagggagagggaaattccaagaagctctctaagaagagagccgctaccacggtgctgcaggaacttaaaaagctgccccctcttccagttgtggaaaagcctaaacttttcttcaagaaaagaccaaagacgattgtaaaagcaggccctgagtacggccagggtatgaaccccatatctaggctggcccagatccagcaggctaagaaagaaaaggaacccgactatgtcctgttatccgagcggggtatgccccgaaggagagagttcgtcatgcaagttaaggtgggcaatgaagtcgcgaccggaaccggccctaacaaaaagatagccaagaagaacgccgctgaggcgatgctgttgcagctcgggtacaaagccagcactaatctgcaggatcagctggagaaaaccggcgagaacaaaggctggagcggtcccaagcctggatttcccgaacccactaacaacaccccgaagggtatcctgcacctctcacctgacgtttatcaagagatggaagcctcccgtcacaaagtaatttctggaactaccttaggttatctgagcccaaaagatatgaaccagccatcgtcctcctttttcagcatctccccgacctccaacagcagtgccaccattgccagagagctcctgatgaacggtacaagcagcacagccgaagccatcggactaaagggctcatcacccactcctccgtgttcccccgttcaaccttctaaacagttggagtatctcgcacgaatccagggcttccaagccgctctcagcgccctgaaacagttctcagagcagggacttgaccctatagacggggcaatgaacattgagaagggaagccttgagaaacaggccaagcatctgcgcgaaaaagctgacaacaatcaggccccacctggctctatcgcccaggattgtaagaaaagtaattccgctgtgtag

SEQ ID NO: 242525 - DNA, 318 bp, Artificial Sequence
  Description of Artificial Sequence: Synthetic coding sequence
atgcttcaaataaatcagatgtttagtgtccagctttcactcggcgaacagacctgggagagtgagggatctagcattaagaaggcccaacaggccgtcgctaataaggctctgactgaaagcacattgcccaagcccgttcaaaagcctccaaaaagcaacgtgaataacaatccaggaagcatcacccctaccgtggaactgaacggactggccatgaagagaggggagcctgcaatttaccgcccactagatcccaagccctttcccaattaccgggctaactacaatttccggggaatgtacaaccagagatag

SEQ ID NO: 242526 - DNA, 1713 bp, Artificial Sequence
  Description of Artificial Sequence: Synthetic coding sequence
atggccaatcccaaggagaagacagccatgtgcctggtcaatgagctagcacggttcaacagagtgcagcctcagtacaaattgctgaacgagcgcggtcccgcacacagcaaaatgttctctgtgcaacttagccttggcgaacagacttgggagtctgaggggtcctcaattaagaaagctcaacaggccgttgcaaacaaagcactgacggaaagcacacttcccaaacccgtgcaaaaaccgcctaagtctaacgtcaataataatcctggctctattactcctaccgtcgagctgaacggattggccatgaagcgcggtgaacctgccatctacagaccgttggaccccaaaccctttcccaactaccgggcaaattacaattttagaggtatgtacaaccaacgctatcactgccccgtaccaaagattttttatgtgcagctcacagtcggaaacaacgaatttttcggtgaaggtaagacaaggcaggcagctagacataacgcagctatgaaggcgctccaggcactgcagaacgaacctattcctgaaaggagcccacagaatggcgagagcgggaaagacgtcgatgatgataaggacgcaaacaagtcggaaatcagtctggtgttcgaaatcgccctcaagaggaatatgccagtctcattcgaggtaattaaggagtctggccctcctcacatgaagagctttgtcactcgtgttagtgtcggagagttctctgcagagggggaaggcaactccaagaagttgtccaagaaacgtgctgctacgaccgtgctgcaggagctgaagaagttgcctcctctacccgtggtggagaagcccaagctgtttttcaagaagcggcctaaaactatcgtgaaggccggacccgagtacggccagggtatgaatcccattagccggctggctcagatacagcaggctaagaaggaaaaagaacctgattacgttctgctgagtgagagagggatgccccgacggagagaattcgtaatgcaggtaaaagtcggcaatgaggttgccacagggacaggtccaaacaagaagatcgccaagaaaaacgccgctgaggccatgctgctgcagcttggatataaggcgtccaccaacctgcaagatcagcttgagaagacaggagagaacaaggggtggagcggcccaaaacctggcttccctgaaccaaccaataataccccaaagggaatcctacatctgtcacccgatgtttatcaggagatggaagcttcgcggcacaaagtgatttccggtacaaccctgggctacttgtctcccaaagacatgaaccagcccagctcctcattcttctctatctcacctactagtaattccagcgctaccatagcaagagaactcttaatgaacggaacaagcagtacggcagaagccattggtcttaaaggttctagtccgacgccaccatgcagccctgtccaacctagcaaacagctggagtacttggccaggatccagggcttccaggccgctctctcggccctgaaacaattcagcgaacagggacttgaccctatcgatggcgcaatgaatattgaaaagggaagtctggagaaacaggctaagcatttacgagaaaaggcggataataatcaggcccctcctggaagtatagcacaggactgcaagaagagtaactcagcggtttag

SEQ ID NO: 242527 - DNA, 1044 bp, Artificial Sequence
  Description of Artificial Sequence: Synthetic coding sequence
agcctcctgaccaatgacgcttcttctgaatctatcgcctccttctcaaagcaagaggtcatgtcgtccttccttcctgagggaggttgttacgaactcctgaccgtgattggcaagggcttcgaggacctcatgaccgtaaatctggcacggtataaacccactggagaatatgttactgtccgcagaatcaacctggaggcttgttctaacgaaatggtgactttcttgcagggcgagctccacgtctccaagctcttcaatcatcccaacattgtgccctatagagctacgttcatcgctgataatgagttatgggttgtgacctccttcatggcctacggaagcgccaaggacctgatctgcacacattttatggacgggatgaacgaactcgctatcgcatatatccttcagggcgtgttaaaggcactggattatattcatcatatgggctatgtgcatcggtctgtgaaagcttcacacatcctgatcagcgtggatgggaaagtgtacttatctggcttgcgctcaaacctctccatgattagccacggacaacgccagcgtgtggtccatgatttcccgaaatacagcgtcaaggtgctgccctggctcagccctgaagtgctgcagcagaacctccagggttatgacgcaaaatccgatatttactctgtcggtatcacggcctgtgaactggcaaatggtcacgtcccgtttaaggacatgcctgctacacaaatgctgctggaaaagctgaatggcaccgtcccctgcctgctcgacacgtctactattccagccgaggagttgactatgagcccttcccgctccgtagcgaacagtggcctaagcgacagtctgacaactagtaccccaagaccttctaatggagactctccgagccatccctaccataggaccttcagtcctcacttccatcatttcgtggaacagtgcttgcagcggaatcccgatgctcgctatccttgctggcccggtcctggtctgagggaatcacgtggctgtagtggaggttag

SEQ ID NO: 242528 - DNA, 1296 bp, Artificial Sequence
  Description of Artificial Sequence: Synthetic coding sequence
atgtcattcctcgtgtcgaagcctgaacgcatccggaggtgggtgtcggagaaattcatcgtggagggcttgagggatcttgaactgtttggggagcaaccaccgggagacacacgcaggaaaaccaatgacgcgtcatccgagtctatcgctagtttctctaaacaggaggtcatgagcagctttcttcctgaaggaggatgctacgaactgctgaccgtgattggtaaagggttcgaggatttgatgacagtcaacctggctaggtataaacccaccggggagtacgtgacagttcgtcgcatcaacctggaggcttgtagtaacgaaatggttaccttcctgcaaggagagctacacgtcagcaaattgtttaaccatcccaatattgtaccctaccgggcaacattcattgcggacaacgaattgtgggttgtcaccagttttatggcatacggttctgccaaggaccttatctgtacacatttcatggacgggatgaatgaactcgcgattgcctatattctgcagggtgtgcttaaggccctagattatatccaccacatgggatatgtgcacaggagtgtcaaggcatcccacatcttgatctccgttgacggcaaagtttatctgtccgggctcaggagcaatctctccatgatctcccatggccagcgccagcgagtggttcacgactttccaaaatatagcgtgaaagtactcccatggctgtcccccgaggtcttacagcagaacttgcagggctatgacgctaagagtgatatctacagtgttggaataactgcttgcgaactggctaatggtcatgtgccatttaaagatatgcctgccacacagatgctcctcgagaagttgaatggaaccgtcccatgtctgctggatacttcaactatccccgcagaggaattaaccatgagtccctcccgatctgtcgcgaattctggcctttccgactccctgactacgtccactccaaggccgagcaacggtgattcccctagccacccttaccacagaacgttttcaccacacttccatcatttcgtggagcagtgcctgcagcggaatcccgatgcgcgtccaagcgctagcactcttttaaaccacagcttctttaagcaaataaagcggagagccagtgaggctttgcctgaactgctgcggccagtcactccaataacaaacttcgaagggagccagagtcaggaccactctggtatcttcggcctcgtgacaaacctcgaagaacttgaagtggacgactgggagttctag

SEQ ID NO: 242529 - DNA, 1122 bp, Artificial Sequence
  Description of Artificial Sequence: Synthetic coding sequence
atgagcagctttctgccagaggggggatgttacgagctccttaccgtgatcgggaaaggttttgaggatctaatgactgtgaatcttgcaaggtacaaacctacgggcgagtacgtgacagtccggaggataaacctcgaagcttgctcaaacgagatggtgacgtttctgcagggcgagctgcacgtttccaaattgtttaaccaccctaacattgttccttaccgggcaaccttcattgccgacaacgaactttgggtagtgacctcatttatggcatacggctccgctaaagaccttatctgcacccacttcatggatggaatgaatgaactggcgatcgcctacatcctgcagggcgtgctcaaggccctagattacatacatcatatgggatacgttcatcgttctgtgaaagctagccacattcttatctccgttgatggcaaggtgtacttgtcgggtctccgatccaatctaagtatgatctctcatggacagcggcagagagtagtacatgacttccctaaatattcagtgaaagtactgccttggctcagccccgaggttctgcagcagaatctgcagggctatgatgccaagtccgatatttattctgtgggcattactgcctgcgagctcgccaacggtcacgtgccatttaaagatatgccggcaacccaaatgttgctcgagaagttgaacgggaccgtaccgtgcctcctggatacttcgacaatacccgctgaggaattgacaatgtccccaagcaggtcggttgctaattccggactgtccgactcattaacgacgtctacccccagaccaagcaacggagatagtccctcccacccgtatcatagaactttcagtccacacttccaccatttcgtcgagcaatgcctccagcgtaaccctgacgccaggcctagtgcatctactctgctgaatcactcattctttaagcagattaagaggcgggcatccgaggcactgcccgagctcctgaggcctgtcacgcctatcactaacttcgaggggtcccagagccaggaccacagcgggatttttggcctggtgaccaacctcgaggaactcgaagtggacgactgggagttttag

SEQ ID NO: 242530 - DNA, 1047 bp, Artificial Sequence
  Description of Artificial Sequence: Synthetic coding sequence
atgagcttcctaacaaacgacgcctcgtctgagagcatagcatccttcagcaagcaggaagttatgtcatcttttctcccggagggcggatgctacgagctgctgacagtgatcggaaaggggttcgaggatctgatgactgtgaatttagcgagatataaaccaaccggggaatatgtgactgtgcgtcgcataaatttagaggcgtgctccaatgaaatggtgacctttcttcagggggagctgcacgtctcaaagctgttcaatcatccaaatattgtgccctatcgcgctaccttcatcgctgacaacgaactctgggttgttaccagctttatggcctatggaagcgccaaagacctaatttgtactcacttcatggacggaatgaacgagctcgctatagcctacatcctccagggtgtactgaaggctttagattatatacaccatatggggtatgtccatcgctccgtaaaagcctcccacattctcatttccgtggacggaaaggtgtacctctcaggcctgcgttctaatctctccatgatctctcatgggcaacgacagcgggtcgtgcacgattttccaaaatattctgtcaaggtgttaccttggttgtctccagaggtgttacagcaaaatctgcaagggtacgatgcaaagtctgatatttactcagtaggaattactgcatgtgagctcgccaacggacacgttccattcaaggatatgcctgctacacagatgctgctggagaagctgaatgggaccgttccatgtctgctcgacactagcactatccctgccgaggaactgaccatgtctccctcccgctcagtggccaacagcggcctgtccgactctttaaccacctccaccccgcgaccaagcaatggggattccccaagtcatccataccaccggacattcagccctcatttccatcacttcgtggagcagtgcttgcagcgcaaccctgacgcacgctatccatgctggccaggccctgggctccgcgagtcccgcggatgttcaggtggctag

SEQ ID NO: 242531 - DNA, 900 bp, Artificial Sequence
  Description of Artificial Sequence: Synthetic coding sequence
atgagcttcctggtgtccaaaccagaaaggataaggcggtgggtctccgaaaaattcatcgttgaggggctgcgcgacctcgagcttttcggaggaaagggcttcgaggacctgatgacagtcaacctggctcgctacaagccaacaggagaatacgttacagttagaagaatcaacctcgaagcctgttctaatgagatggttacctttctgcaaggagaactgcatgtctcaaaactgtttaaccaccctaacatcgtgccatatagagcaacctttattgccgacaatgagttgtgggtggtgacttccttcatggcttacggatctgcaaaagatctgatatgtacacactttatggatggtatgaatgagctcgcaatcgcctacatcctccagggagtgttaaaggccctcgattatatccaccacatgggctacgtgcaccgttcggtaaaagcctcacacatactgatcagcgtggatgggaaggtgtatctgagcggcttgcggtcaaacctctctatgatcagtcacggacagcgtcagagagttgtgcatgacttcccaaaatattccgtgaaggtactgccctggctctcacctgaagttctgcaacagaatctccagggatacgacgcaaaatctgacatctattcagtcggtatcacagcctgtgagctcgccaacggtcacgtgccattcaaagacatgccggcaacccaaatgctgctagaaaagctcaatggcaccgtaccatgcctgttggatacttctactattcctgccgaagaactgacgatgagtcctagtagaagtgtcgctaactcaggactgagcgactcactaactacttctacacccaggccaagcaacggacctgttccggcacccagctag

SEQ ID NO: 242532 - DNA, 1257 bp, Artificial Sequence
  Description of Artificial Sequence: Synthetic coding sequence
atgagtctgcttgattgtttttgcacttcccgcacgcaggtggagtcattgagaccggaaaaacagtctgagactagtatccatcagtatttggttgacgaacctactttgtcatggtcgcgcccaagcaccagagcctctgaggtgctgtgtagcactaacgtttcacattatgagcttcaggtggaaatcgggaggggcttcgataacctcacaagtgtgcacttggccagacacacccctactggcaccctggtgacaatcaaaatcaccaacctggaaaactgcaatgaagagagattgaaggcacttcaaaaggctgttattctcagccacttcttccggcatccaaatatcaccacgtactggaccgttttcacagtgggctcctggctttgggttataagcccgttcatggcttatggctcagcgtcccagcttttaaggacctactttccagagggaatgagcgaaactctgatccggaatatccttttcggcgctgtgcgaggactaaattatcttcaccagaatggatgcattcacagatcaatcaaagccagccatattttgatctctggggatggacttgtcacattatccggcctcagccacctgcacagtttagttaagcacggccagcgccaccgggctgtatacgacttcccccagtttagcacgtctgtgcaaccatggctgtcacccgagcttttgcgtcaggaccttcacgggtataatgtcaagtcagatatttacagcgttggcattaccgcgtgtgagctggcctccggccaagttccattccaggacatgcatcggacacagatgctcctgcagaagctgaaagggccaccctatagcccattggacatttctatcttccctcagtccgagtctaggatgaagaatagccagagcggagtggactccgggatcggggaaagtgttctggtgtcctcgggaacccacacggtgaatagcgataggctccatactccttctagcaagacattctcgcccgctttcttctctttagtacagctctgcctgcagcaggaccccgagaagagaccatccgcttccagcctgcttagccatgtgttctttaaacaaatgaaagaggagtcccaagattctattctgtcgctgttgccccctgcttataataagcctagcatctcacttccccctgtgctcccatggacagaacccgagtgcgattttcctgatgagaaagatagttactgggagttttag

SEQ ID NO: 242533 - DNA, 1134 bp, Artificial Sequence
  Description of Artificial Sequence: Synthetic coding sequence
atgagtctcttggattgcttctgtacatctaggacccaagtggaatctctcagacccgaaaaacagtctgagaccagtatacaccaatatctggtcgacgagcctacgctgagctggtctcgcccttcaacacgtgcttctgaagttttgtgctctacgaacgtgtcacattatgaattacaggtggagattggcagaggcttcgacaacctgactagcgtgcatctggcaaggcatacccccacgggcacattggtcaccattaagattacaaatctggagaattgtaacgaggagagacttaaagcactccagaaggccgtgattttgtcccattttttcaggcaccctaacataactacgtattggaccgtttttaccgtcgggagctggttgtgggtcatctctccctttatggcttacgggtcggcttctcagctcctccggacatacttccccgaaggaatgagcgagacgctcattcgtaatatcttgtttggagccgtccggggactcaactacctgcaccagaacgggtgtatccatcgctctatcaaagccagtcacatccttataagcggggacggactggtgactctttcaggtctttctcacctgcattctctcgtaaagcacggccagagacacagggctgtctacgactttcctcagttttcaacctccgtgcagccttggcttagtccagagctgctgagacaagacctccacgggtacaacgtgaagtcagatatttacagcgtgggaatcactgcatgcgagctggcctcaggccaggttccttttcaagatatgcaccgaacccagatgttactgcagaagcttaaaggccctccttactcgcccctcgacatctcgatattcccacaatctgagagtcggatgaaaaactcgcagagtggcgtagatagcggcattggtgaatcagtgctggtgagttcgggaactcacactgttaattccgaccgcttgcacacgcctagcagcaagacattctcccctgcattctttagcctggtgcagctatgcctgcagcaggatccagaaaaacgcccatcagcgtcctcactgctgtcccatgtgtttttcaaacaaccatatttcgagtttctctag

SEQ ID NO: 242534 - DNA, 843 bp, Artificial Sequence
  Description of Artificial Sequence: Synthetic coding sequence
ctcggatattgttccgcatcccaactcctccgcacctatttccctgaagggatgtctgaaacactgattcggaacatcttgttcggcgcagtcagggggcttaattacctccatcagaatggttgtattcaccgctccataaaggccagccatattttaataagcggagacgggttagtcactctttctggcctctctcaccttcatagcctggtaaagcacggccaacgtcacagagccgtctacgacttcccgcagttctctacatccgtccagccctggctgtctcctgagctccttaggcaggacctccacgggtacaatgtaaaaagcgacatctacagcgtaggaatcaccgcttgtgaattagcatcaggccaggtgccattccaggacatgcataggacccagatgcttctgcagaaactcaaaggccctccgtactctccgttggacatatcaattttccctcagtccgaaagtaggatgaagaactcccagagtggggtggatagcggaatcggggagtctgtattggtgagctccgggacacacaccgtcaactcagaccggctgcacacaccatcatctaaaacgtttagccctgcctttttttcactggtacagctttgtctgcaacaagatcccgaaaaacggccttccgcttctagcttgctgagccacgtgttcttcaagcagatgaaagaagaatcccaagattctatattgagtctattgcctcccgcttacaataaaccatctatctcgctgccccctgtactgccgtggaccgaacccgaatgcgacttccccgacgagaaggacagctactgggaattttag

SEQ ID NO: 242535 - DNA, 1257 bp, Artificial Sequence
  Description of Artificial Sequence: Synthetic coding sequence
atgagcctgctggattgcttttgcaccagccgtacccaagtggaaagcctccggcctgagaaacagagtgaaaccagtatccatcagtatctcgttgatgagccaaccttgagctggagtcggccaagtacgcgtgcatccgaggtcctgtgttctacaaacgtgtctcattatgagctgcaggttgagatcggaagaggttttgacaatctgacaagcgtccacctcgccaggcacactcccacaggcactctcgtgactatcaagatcaccaatctcgagaattgtaatgaggaacggctcaaagcactccagaaggccgtcatcttgtctcatttctttagacacccaaatatcaccacatattggaccgtgttcaccgtggggagctggctgtgggtgatcagtccttttatggcctatggttcggcaagtcagcttcttagaacgtacttccccgaaggcatgtcagaaacactaattaggaatattttattcggggcagtgagggggctcaattacctgcaccaaaacgggtgtattcatcggtctatcaaggcaagccatatcttaatatctggcgacggattagtgacactctccggcttaagccatttgcacagtctggtaaagcatggccaaagacaccgcgctgtttatgactttcctcagtttagtactagtgtgcagccttggttatccccagagctgctgcgccaggatctccacggctataacgtaaagagtgacatatatagcgttggaattacggcctgtgagctggcgtccgggcaagtgccgttccaggatatgcatcggacccagatgctgctccagaagttaaaaggcccaccatacagccctctcgacatcagcatattcccacaaagcgagtcaaggatgaaaaatagccagtccggcgtggacagtggcatcggagagtcagtgctggtgagctcaggaactcacactgtcaacagcgacaggctgcatacgcccagtagtaaaaccttcagccctgcattcttctccttggtgcaactctgcttgcaacaagaccctgagaaaagaccttctgctagttctctgctctctcacgtgttcttcaagcaaatgaaggaagaatctcaggactccattcttagcctccttccccctgcctataacaagcctagcatctctctccctccggtgctgccatggacagagcctgagtgtgactttcctgacgagaaagacagctactgggaattttag

SEQ ID NO: 242536 - DNA, 1260 bp, Artificial Sequence
  Description of Artificial Sequence: Synthetic coding sequence
atggaatcgatatctatgatggggtccccgaaaagtctgagtgaaacatttttgcccaatggtattaacggaatcaaggacgctcgcaaagtcactgtcggagtgatcggctccggagacttcgccaagtctctcacaatacggctgattaggtgcgggtaccatgtcgtgatcggaagccgcaatcccaagttcgcgtccgagttctttccacacgtagttgacgttacccaccatgaggatgcacttacaaagactaacatcatctttgtggccatacacagggaacactatacctcactgtgggatctccgccatctacttgtgggcaagattctaatcgatgtgtcgaataatatgcggattaaccagtatcctgagagcaacgcagaatacctggcctccctgtttcccgacagtcttatagtgaaaggcttcaacgtggtgagcgcatgggcactccagctcggacctaaggacgcctctcgacaggtgtatatctgttcgaataacatccaggccaggcagcaggtaattgaactggcacgccagcttaattttattccaatagatttgggctccctgagtagtgccagagaaatcgaaaatctgccactgagattattcaccctttggaggggccctgtggtggtcgcgatcagtctggccactttctttttcttatacagtttcgtgagggatgtcatacacccatacgctaggaaccagcagtccgacttctacaagatccctatagagattgtcaacaaaacccttcctattgtggccattacccttctctctcttgtatatctggctggccttttggccgcagcttaccagttatactacggaaccaaatacagaaggttccctccctggcttgaaacctggttgcaatgtcggaagcagctcggtctactgtcatttttctttgccatggtccatgtggcctactctctgtgcctgccgatgcgtcggtctgagaggtaccttttcttgaacatggcctaccagcaggtgcacgccaatattgagaactcctggaacgaggaagaagtatggagaatcgaaatgtatatttccttcggcattatgagtcttggcctgctgagtctgctcgctgtgaccagtatccccagcgtttctaacgcgctaaactggcgcgagttttcatttatccaaattttttgttcatttgctgatacccagacagagctggagctggagtttgtctttcttttaacactgctcctctag

SEQ ID NO: 242537 - DNA, 1473 bp, Artificial Sequence
  Description of Artificial Sequence: Synthetic coding sequence
atggaaagcatcagcatgatgggatcccctaagtccctttccgaaactttcctgccaaatggaatcaatgggatcaaggatgccagaaaggtgaccgtcggagtcatcggatctggagatttcgcaaaaagcctcactatcagattgatccgctgtggataccatgtcgtcataggcagtcggaaccctaagttcgcctccgagttttttccccacgttgtggatgtgactcaccatgaggacgcacttacaaaaacaaatattatcttcgtggctatccacagagaacattacacttccttgtgggacctgcggcacctgctcgtgggtaaaattctcatcgatgtgtcaaataatatgcgcatcaaccagtacccagaatccaatgcggaatacttagcctctctttttcctgactccctgattgttaaggggtttaacgtggtttcagcctgggcactgcaactgggaccgaaggacgcgtcacgacaagtgtatatctgcagtaacaatatccaggccaggcagcaggtgattgagctggcaagacagctaaatttcattccaatcgatctaggaagccttagctccgccagagagattgaaaatctccctcttagactgtttaccctttggcgaggcccagtcgtcgtggccatctcgcttgcgacgttcttttttctctactcgttcgtgagggacgtaattcatccatacgctagaaaccagcagagcgacttttataagatcccaatcgagatcgtgaataaaaccttgcccattgtagctatcacgctcctgtcgcttgtctatctggccggactgttagcggcagcttatcagctttactatgggacgaaatataggcgttttccaccatggttggagacatggctgcagtgccggaagcaattgggcttgctgtcgtttttttttgcaatggtacacgtagcctactctctctgtttacctatgcgcaggagtgagcgctacctgttcctgaatatggcttaccaacaagtgcacgccaatattgagaactcctggaatgaggaagaggtatggaggatcgagatgtatatctcgtttgggatcatgtctcttgggctgctgagcttgctggctgttacaagtatccccagcgtcagcaatgctctgaattggcgggagttctcattcatccagagcacactcggttatgtggcactcctgatatcgacatttcatgtgcttatctacggctggaagagagcgttcgaggaggagtactaccggttctatacacctcccaatttcgtgctagcattggtgctgcccagcattgtcatcctcggtaagatcattctctttctgccttgcatcagccggaagctcaagcgcattaaaaagggctgggagaagtcacagttcctggaagagggcatgggcggtactatcccacatgtcagtccagaacgggtgacagttatgtag

SEQ ID NO: 242538 - DNA, 1473 bp, Artificial Sequence
  Description of Artificial Sequence: Synthetic coding sequence
atggaaagtatttccatgatgggctcacccaaatccctatctgagacatttctgcctaacggcattaatgggattaaagatgcccgaaaggttaccgtaggagtcattgggagtggtgacttcgccaaatctctgacgatccggttgatccggtgtgggtaccacgttgttattggttccagaaatccaaagttcgctagcgagttttttcctcatgtggtcgatgtcacacaccatgaggacgctctgacaaaaaccaacatcattttcgtcgccatccaccgcgagcattacacctccctgtgggacttgcgacacctcttggtcggtaaaatccttattgacgtgtcgaataacatgcgcattaatcagtatcccgagagcaatgccgagtacctggcctccctgttccctgacagcctgatcgtcaagggcttcaatgttgtgagtgcttgggcactacagctgggcccaaaagacgcctccaggcaggtttacatctgttcaaataatatccaggcgaggcagcaggtcattgaactggccagacaactgaacttcatccccattgatctggggagcctctccagcgctcgcgagatcgagaatctgcccctgcgattattcactctgtggcgaggtcccgtcgtggtggccatttcactcgccacgttcttcttcctctattccttcgtgagggacgttattcacccatatgccaggaatcagcagtcagacttctacaaaatcccaatcgaaatcgttaataagaccctacccatagttgcgatcactttgctgtcactagtctacctggcagggcttctggctgcagcttatcagttgtattatgggaccaaataccgccgttttccaccatggctggaaacctggttgcagtgtagaaagcagctaggtttgctgagcttcttttttgcgatggtccacgtcgcctacagcctctgtctccctatgcggagaagtgagcgttatctgttcctcaacatggcataccagcaagtccacgccaacattgaaaacagctggaatgaggaagaagtgtggaggattgaaatgtacataagcttcggaatcatgtctctgggacttcttagcctgttggccgtgacttcaattccctccgtgtccaatgctctgaattggcgcgagttcagctttatccagagcacccttgggtacgtcgctcttcttatttctacttttcacgttctgatctatgggtggaaacgcgcatttgaggaggagtattaccgcttctatacccccccaaattttgttctcgccctggtgctaccctccatcgttatcctgggtaaaatcattctttttctgccgtgtatctccaggaaactgaagcgcataaagaagggatgggaaaaatcacagtttctggaagaggggatgggaggcactattcctcacgtgtcgcccgaaagagtcaccgtgatgtag

SEQ ID NO: 242539 - DNA, 1473 bp, Artificial Sequence
  Description of Artificial Sequence: Synthetic coding sequence
atggagtccattagcatgatgggtagccctaaaagcctctctgaaaccttcctaccaaatggaatcaatggcattaaggatgcgagaaaagttacggtgggcgtaattgggtccggagacttcgccaaaagcctgaccatacggctcattcggtgcggctaccacgttgtcattggctcgcgcaaccccaagtttgcctccgagttctttccacatgtggtggacgttacacaccacgaagacgcccttaccaagacgaatatcatcttcgtggcaatccacagagaacactacacctccctgtgggacctccgacaccttttggtcggtaaaattctcattgatgtgtcgaataacatgaggattaatcaatacccagaatctaacgcggaataccttgccagcctgtttccggacagtctgattgtgaaaggctttaatgtggtctccgcatgggctctgcagctagggccaaaagacgcatcaagacaggtttacatttgctcaaataacatccaggcaaggcagcaagtgatcgagttagcacgacagcttaacttcatccctatagacctaggctcccttagcagcgccagggagatcgagaatctgccattgcggctgtttacgctctggcggggtccagtggtggtagccatctctctggcgacctttttctttttgtactcattcgtacgggacgtgatccacccctatgctcgcaatcagcagtctgacttttacaaaatcccaatcgaaatcgtcaataaaactcttccaatcgttgctataacactcctgtcactggtgtaccttgccggactgctggctgccgcatatcaactgtattatgggaccaagtataggcgctttccaccctggctggagacttggctccagtgtcgcaagcagttggggctgctcagcttttttttcgccatggtgcacgtagcttatagcctgtgtcttccaatgagacggtcagagagataccttttcctaaacatggcctaccagcaagtgcatgctaacattgagaactcttggaacgaagaagaggtctggagaatcgaaatgtacatttcattcggaatcatgtctctggggttactatccctacttgccgtgacttctattccatccgtttccaatgccttgaactggcgtgagttttcgttcattcagagtactctcggctatgtcgctctgttaatctccacctttcatgtcctcatatatggttggaaaagagcatttgaagaggaatactaccgcttctacacaccgcctaatttcgtgttagccctggtgctaccctccattgtgatcttgggaaaaataattttattcctcccctgcattagccggaaactgaagaggatcaagaagggctgggagaagagtcagtttctggaagagggcatggggggtacaattccacatgtttccccggaacgagttacggtcatgtag

SEQ ID NO: 242540 - DNA, 1365 bp, Artificial Sequence
  Description of Artificial Sequence: Synthetic coding sequence
atggagtctatttctatgatggggtccccaaagtcactgtccgagacgttccttcccaacgggatcaatggaattaaagacgcccgtaaggttaccgtcggtgtgattggaagtggagatttcgctaagagcttgacgatccgcctgatccggtgcgggtaccatgtggtcatcggtagtcggaacccaaagttcgcatccgagtttttcccccacgtggttgatgttacgcaccatgaggatgctctgaccaagaccaatatcatcttcgtagctatccaccgggaacactatacatccttatgggacctgagacacctgctggtcggcaaaattttgatcgacgttagcaacaatatgcgaatcaaccaatatccagaaagtaatgctgaatacctggcctccttgtttcctgacagcctgatcgtgaaaggcttcaatgtcgtaagtgcctgggcgttgcaactcggacccaaggacgcctctcgtcaggtgtatatttgtagcaataacattcaggccagacagcaggtgatcgaactggcacgccagttgaacttcatccctattgacttgggatctctgagctcagccagggagatcgaaaacctgcccctcagactttttacactgtggaggggccctgttgttgtggcgatttctcttgccaccttcttttttctgtactccttcgtccgcgatgtgatccacccgtatgccaggaaccagcagtccgatttctataaaatcccaatcgagatcgtcaacaagacactccctattgtggccattacattgctttccctcgtgtacctggccggtctgctagccgctgcatatcagctgtattatggaacaaaatatcgtcgctttcccccatggctggagacctggttgcagtgcagaaaacagctgggactcctctccttctttttcgccatggttcacgtcgcttactcactgtgtctccccatgagaaggtccgagcgctacctgtttctgaatatggcctatcaacaagtccacgctaatatcgagaactcctggaatgaagaagaagtttggcgtatcgaaatgtacatctcgtttggtatcatgagcctgggtctgttatctctgctagctgtaacttcaattccttctgttagcaacgcccttaactggagagaatttagtttcatccagtccactctcggatatgtcgcactgctgatctcaacatttcatgtattgatatacggatggaagcgcgcatttgaagaggaatattataggttctatacaccccctaactttgtgctagccttggtgctgccatccattgtgatactggacctcctgcagttgtgcaggtacccagattag

SEQ ID NO: 242541 - DNA, 1365 bp, Artificial Sequence
  Description of Artificial Sequence: Synthetic coding sequence
atggagtctatttctatgatgggcagtcccaagagcctctccgagacatttctcccaaatggtatcaatggtataaaggacgctagaaaggtgaccgttggggttattggaagtggggactttgccaagtctttaacaatacggcttatccgctgcggatatcatgtggtgattggcagtaggaacccaaaatttgcatcggaattctttccacatgtggtggacgtcactcatcatgaagatgctctgaccaaaaccaatataattttcgttgcaattcacagagaacactatacgtccctctgggaccttcgacaccttttagtcggaaaaattctgatcgatgtgagcaacaacatgagaatcaatcagtaccccgagagcaacgcagaataccttgcatccctgttccccgacagcctgatcgtcaagggtttcaatgttgtttccgcctgggcgctccagctgggacctaaagacgcatcccggcaggtgtacatctgcagtaataacatccaagccaggcagcaggtgattgaactggcgaggcaactgaattttatccctattgacttagggagcctctccagtgctagagaaatcgaaaatctccccctgcgcctgttcacactgtggaggggacctgtcgttgttgcgatctcactggccactttcttcttcctgtactcatttgtgagggacgtaatccatccttatgcgagaaaccagcagagcgacttctataagatccccattgaaatagtgaacaaaaccctgcccatcgtggctatcacattgctgtcgctggtgtatctggcgggattgttggcagccgcttaccaactatactacgggactaaatacaggcggtttccaccatggctggagacttggctccagtgccgaaagcagttaggtcttctcagcttcttctttgcaatggtgcacgttgcctatagcctgtgtttgccaatgagacgtagcgagagatacctgttcctcaacatggcctatcagcaggtgcacgcaaatattgagaattcttggaatgaggaggaggtttggcgcatcgaaatgtacatttctttcgggatcatgagcctgggtctgctgtccctactggccgtgacctcaatcccctctgtgagcaacgcactaaactggcgcgagttctcatttattcagagcaccctgggttacgttgcacttctcatatcaacctttcacgtgctcatatatgggtggaaaagagcatttgaagaggagtactatagattctacactccccctaattttgtactggcccttgtgctcccaagtatcgtcatccttgatctcttgcagttgtgcaggtatcctgactag

SEQ ID NO: 242542 - DNA, 1365 bp, Artificial Sequence
  Description of Artificial Sequence: Synthetic coding sequence
atggagtccataagcatgatgggatcccccaagtccttgtcagagaccttcctgccaaacggcataaacgggataaaggatgcaagaaaggtgactgtcggtgtgataggaagtggggacttcgcaaagagcttgactattcgacttattagatgcggataccacgttgttattggctcgagaaaccctaaattcgcctctgaattttttccccatgtggtcgacgtaactcaccacgaggatgccttgacaaagaccaatataatattcgtcgccatccaccgggagcattacacgtccctctgggacctgcgccatctgctcgttggcaaaatcctgatcgacgtttctaataacatgcggatcaatcagtatcccgaatccaacgctgagtatttggcctcactatttcctgactctctgatcgtgaagggtttcaatgtcgtatcggcatgggcactgcagctaggaccaaaagatgcctcacgccaggtctacatctgcagcaataacattcaggcacgacagcaagtgatcgagctggcaaggcaactgaacttcattccaatcgacctgggatctttgagtagcgctcgggagattgaaaacctgccactgcgcctgttcaccttgtggcgaggtccagtcgtagtagcgatctcactcgccaccttcttcttcctatactcatttgtgagagacgtaattcatccatacgccaggaatcagcagtccgatttttacaagatcccgatcgagatcgtcaacaaaacactccctatagtggcgattaccttgttgagcctggtgtatctcgctgggctgctagcagccgcttaccagctgtactacgggacaaagtaccggagattccctccttggctcgagacttggctccaatgcaggaaacagctcggcctgctttccttcttctttgcaatggtacacgtagcgtactcattgtgcctgcccatgagaaggagcgagaggtacctcttccttaatatggcatatcagcaggtccacgccaacatcgagaattcatggaacgaagaagaagtttggaggatcgaaatgtatatctcttttggcatcatgagtctcggcctcctcagtctgctggcagtcactagcattccttccgtgagcaacgcacttaactggagagagttcagtttcatccaatcaaccctgggctatgtcgccttacttatcagtacattccatgtcctcatctacggatggaaaagagcgttcgaggaagaatactatcgattttatacgccgcctaacttcgtgcttgccttggtgttgccatctatcgttatcctggacctgctgcagctgtgtcggtaccccgattag

SEQ ID NO: 242543 - DNA, 267 bp, Artificial Sequence
  Description of Artificial Sequence: Synthetic coding sequence
atggaatctatttctatgatgggctcccccaaaagtttatctgaaaccttcctcccaaacgggatcaatgggatcaaagacgctaggaaggtgaccgtgggcgttatcgggtccggggacttcgccaaatctcttaccatacgtctgataaggtgtggttaccacgtcgtgataggctccaggaaccccaagttcgcctcagaatttttccctcatgtcgtggacgtcacgcaccacgaggatgcactcaccaaaacgaacatctag

SEQ ID NO: 242544 - DNA, 549 bp, Artificial Sequence
  Description of Artificial Sequence: Synthetic coding sequence
atggagtccatttctatgatgggaagccctaaatccctttctgagacgttcttacctaacggaatcaacggcataaaggacgcccgaaaggttaccgtgggagtgatcgggagcggagacttcgccaagtccctgacgatcagattaatacgctgtggttatcacgtcgtgatcggctcacggaatcccaaattcgcatctgaattcttcccacatgtggtagacgtgacccatcacgaagatgccctgacgaaaaccaacattatttttgtggcaatccatagagagcactatacctctctctgggatctgcggcatctcctggtggggaaaatactcatcgatgtaagcaacaatatgcgaatcaaccagtaccccgaaagcaacgccgagtacctggcctcactgttcccagattcgctgatcgtgaagggctttaacgtggtgagtgcctgggccctgcaactgggtccaaaggacgcgtccagacaggtgtacatctgcagtaataacatccaggcaagacaacaggtgatagaactggcctag

SEQ ID NO: 242545 - DNA, 1467 bp, Artificial Sequence
  Description of Artificial Sequence: Synthetic coding sequence
atgccagaggagatggacaagcctctcatatcactccacctcgtggacagtgactcatccctggctaaagtacctgacgaggcaccaaaggttggcatccttggttctggggacttcgctcgatctcttgctacacgcttagttggcagcgggttcaaggtggtggtcggtagcaggaacccgaaacgcactgccaggctgtttccctctgccgctcaggtgacttttcaggaagaggccgtgtcttctcccgaagtcatttttgttgctgtgtttcgcgaacactacagttccctgtgttctctctctgatcagctagcaggtaaaattctggtggatgtctcaaatccaaccgagcaggaacacctccaacaccgtgagagcaacgcagaatatctggcaagcctgtttcccacctgtacagtggtcaaggccttcaacgtgatttcagcctggacgcttcaagccggaccccgtgacggcaataggcaggtccctatttgcggggaccaacccgaggcgaagcgagccgtatccgaaatggccctcgccatgggcttcatgccagtagatatgggatctttggctagcgcttgggaagtagaggcaatgcctctgcggctgctgccagcctggaaagtgcctactctgttggctctgggcctttttgtgtgtttctatgcatacaattttgtgcgagacgtactgcagccctacgttcaagagtcccaaaacaagttttttaaactgcccgtgtcagtcgtcaacaccacattgccctgcgtggcatatgtgttgctgagcttagtgtacctcccaggcgttctagcagcagcgctgcagttacgtcggggaaccaagtaccagcgttttcccgattggttggaccactggttgcagcatcgtaagcagataggcttattgtccttcttctgtgctgcactgcacgctctttatagtttttgtctccctttaaggcgcgctcatagatatgatcttgtgaacctcgccgtgaagcaggtattagctaacaaatcacacctgtgggtcgaggaagaagtctggaggatggaaatttatctgagcctgggcgtgctggctctggggaccctgagccttctcgctgtaacctctctgccatcgatcgccaatagcctcaactggcgggaattttctttcgtccagagctctttgggtttcgttgccttggtgctgtcaactttacatacactcacctatgggtggactcgggctttcgaggagtcaaggtacaagttctacctgcccccaaccttcacacttacactgctcgtgccctgtgtggtgatattggctaaggcactgttcttgctcccttgcatttcccgtcggttagcccgaatcaggagaggttgggagagagagtccacaattaaatttacactgcctacagaccacgcgttggccgaaaaaacctcacacgtgtag

SEQ ID NO: 242546 - DNA, 1467 bp, Artificial Sequence
  Description of Artificial Sequence: Synthetic coding sequence
atgcctgaagagatggataaaccacttattagcctgcatcttgtcgacagcgattcctccttagccaaggtgcccgacgaggctccaaaggttggaattcttggcagtggcgatttcgcccgaagtctggctactcgcctggttggcagtggatttaaggttgttgttggttccagaaaccctaaacggactgctcggctcttcccaagcgccgctcaggtgactttccaggaggaggctgtctcgagcccagaagtgatttttgtcgctgtcttcagagaacactacagcagcctctgctcgctgagtgaccagttggccggtaagattttggtcgatgtgtccaatccaaccgaacaggagcacctccagcaccgggaatccaatgccgagtatttggcgtcgctttttccaacttgtaccgttgtgaaggcctttaacgttattagcgcttggactctgcaggccggtcccagagacggaaaccgacaggtgccgatttgcggcgaccagcccgaagctaaaagagctgtctccgaaatggcgttggctatgggctttatgcccgtcgatatgggctctctggcaagcgcctgggaagtggaggctatgccactgcgcttacttcctgcttggaaggtgcccacactcttggccctcggtcttttcgtgtgtttctacgcgtacaactttgtgcgggacgtgttacagccctacgttcaggaatcccaaaataagttcttcaagcttccagttagcgttgtgaatactaccctaccctgtgttgcttacgttctcttgagcctagtatatctgcccggagtcctggcagctgccctgcagctgcgtcggggaacaaagtaccagaggtttcccgactggctcgaccactggttacagcaccgcaaacagatcggactcctctcattcttttgtgccgcactgcatgcactctacagtttctgcctgcctctgaggcgggctcacaggtacgatctcgttaaccttgcagtgaaacaggtgctcgccaataaatctcacctatgggtggaagaggaggtgtggaggatggagatttacctgtcactcggcgtactcgccctgggtacactttcactcctggccgttaccagcctgcccagcatcgcaaattctctaaattggcgcgagttctccttcgtacagtcctccttaggttttgtagccttggttctgtctactctccacaccctgacctatgggtggacgcgggcattcgaagagagtcggtataagttctacctgcccccaacgttcaccctgaccctcctggtaccatgcgtcgtaattcttgccaaggctctgttcctcctcccatgtatctcacgtcggcttgccagaatccgcagaggctgggaacgcgagagcaccattaagttcacactgcccacggaccatgctctcgcagaaaagacaagccatgtgtag

SEQ ID NO: 242547 - DNA, 1467 bp, Artificial Sequence
  Description of Artificial Sequence: Synthetic coding sequence
atgcctgaggaaatggataaacctctaatttcgctgcatttagtggactcagactcctccctggccaaggtccctgatgaagcccctaaggtggggattttgggttcgggagattttgcgcgatcactcgccacacggctggtgggctcgggatttaaagtagtggttggcagccggaatcctaagagaacagccagactgtttcccagcgctgcccaagtaaccttccaggaggaggcagtgtcatctccagaggtgattttcgttgctgtgttccgggagcattatagctctctgtgctcactatccgaccagctggcagggaaaatccttgtagatgtgtccaaccctacagagcaggaacacctgcagcacagggaatcaaacgctgagtatctggcctcacttttccccacttgcaccgtggttaaggcatttaatgtgatctcagcctggacactacaggccggacccagggatggcaaccggcaggtcccgatctgtggcgatcagccagaggctaagagagccgtctccgagatggccctggcaatgggtttcatgccagtagacatggggtctctggcttctgcctgggaggtcgaagcaatgcccttgcgcctgctcccggcatggaaggttccgacgctgttggccctgggactgtttgtgtgtttctacgcatataatttcgtcagagatgtcctgcagccatatgtccaagagtcccagaataaattctttaagctacctgtttctgtcgtgaacacaaccctcccctgcgttgcctacgtgctcttgtcgctggtctatttgcccggagtgctcgcagccgctctgcagcttaggaggggcaccaagtatcaaaggttccccgactggctagaccactggctgcagcacagaaagcaaattgggcttttatcattcttctgcgcagccttgcacgcgctctattccttctgtttaccactgcgcagagcacacaggtacgacctggtgaatctcgctgttaagcaggtccttgccaataaatcacacctgtgggtcgaagaagaggtatggaggatggaaatttacctcagcttgggagtgctcgcactcggaaccctgtctctgcttgcagtgacctcactcccttctatcgccaatagtctgaattggagagagttctcttttgtgcaatcttccctgggatttgtcgcgttagttctgagcaccttgcacaccctgacttacggttggacaagggcctttgaggagtcgcgttataaattttacctcccccctacattcaccctaacactgctcgtcccatgcgtagttatcttggcaaaggcactcttcttactgccttgcatcagtagaaggctggcgaggattcggcgtggttgggaacgagagtccaccattaaatttacattgccgactgatcacgcgttggctgaaaagacgtcgcatgtctag

SEQ ID NO: 242548 - DNA, 1467 bp, Artificial Sequence
  Description of Artificial Sequence: Synthetic coding sequence
atgcctgaggaaatggacaagccgctgatctcactgcatctggttgactcggatagctccttggccaaagtgccagatgaagcacctaaagtagggatcctcggatctggtgactttgcgaggagtttggccacccgtctcgtaggcagtggatttaaagtggtagtgggctcaaggaaccctaagaggaccgccaggctcttcccctcagccgctcaggtcacatttcaggaggaggccgtgagcagtccggaggttatctttgttgctgtcttcagggagcactactcatcgctgtgcagtcttagtgatcagctggcgggaaagatcctcgttgacgtttcaaaccccacagaacaagaacatcttcagcatcgggagtcaaacgccgagtatttagcaagtttattccccacctgtaccgtggtcaaggcttttaacgtcatcagtgcctggacactccaggctggccctcgtgacggcaatcggcaggtaccaatttgcggcgaccagcctgaggcgaaaagagcagtctcggagatggccctggcgatgggcttcatgccagtcgatatgggctcgctggcaagcgcatgggaggttgaagccatgcctctcagattgctccctgcctggaaagtgccaaccttgctcgccctcgggctatttgtgtgtttctatgcctataatttcgtacgcgacgttctgcagccatacgtgcaagaaagtcagaataaattcttcaaactcccagtgtcggtagttaacactaccttaccatgcgtagcttacgtcctgctgagtctggtgtaccttcctggcgtgctcgccgcagctttacagctcagaagaggtacaaagtaccagaggttcccagactggctggaccactggctacagcatagaaaacagataggactcctctcattcttctgtgccgctcttcacgcgctgtatagtttctgccttcctctgcgcagagcccatagatacgacctcgtgaatctcgccgtaaaacaggttcttgctaacaaatcccacctctgggtcgaggaggaagtgtggcgcatggaaatctatttgagtctgggtgtactcgctctgggcacgctgtccctccttgccgtgacatcactcccctcaatagccaacagtctgaattggagggagttctcctttgtgcagtcctctcttggttttgtagcgcttgtgctatccactctgcacaccctgacttatggatggacgcgtgcgttcgaagaatccaggtacaagttttatctgcctccaacattcacccttaccctgctggtcccctgtgtcgtgattttagccaaggccctttttctactcccatgtatttcacgtagactggccagaataaggagaggctgggagagagagtccacgatcaagttcacgctgcccaccgaccacgcactggctgagaaaacctcacacgtatag

SEQ ID NO: 242549 - DNA, 1497 bp, Artificial Sequence
  Description of Artificial Sequence: Synthetic coding sequence
atgtcccaccaacccgcagtcgccaccaagatgcctgaggagatggataagcctctcatcagccttcatctggtggacagcgattcaagtctcgccaaggtgcccgacgaagcgcctaaggttggcatcttgggcagcggcgattttgcacgtagcttggccacacggttagtggggagcggctttaaggtggttgtcgggtctagaaacccaaagagaaccgctcgcctctttccctccgctgcacaggtgacgtttcaagaggaggcggtaagctccccggaggtgatattcgtggcagtgttcagggagcattattcatcgttgtgcagcctctcagaccaactggccggaaaaatactggttgatgtatctaatccaaccgaacaggagcatcttcagcacagggagtcaaacgccgaatacttagctagtctgtttccaacttgtactgtggtgaaggccttcaatgtgatcagcgcatggacgttgcaggctggaccaagggacggcaatcgccaggtgccaatttgcggagaccaaccggaagccaagcgggctgtgagcgagatggctctcgcgatggggtttatgcctgtggacatgggcagccttgcatccgcctgggaagtagaggcaatgcccctgcggctgctaccggcttggaaagtgcccaccctcctcgccctgggtctctttgtatgtttctatgcctataattttgtacgtgatgtgttgcaaccgtatgtacaggagtcccaaaacaaattttttaagctccccgtgtcagtcgttaataccacactgccttgcgtggcgtatgtcctcttaagccttgtgtacctccccggtgtactagccgcagccctgcagctacgtcggggtacgaagtaccagcgtttccctgactggctggaccattggctccagcacaggaaacagatcggcctcctgtccttcttctgcgcggcactgcatgccctatactccttttgccttccactcagacgcgctcatcgctacgacttggtgaacttggccgtcaaacaggtgctcgccaataagtcccacctgtgggtggaggaggaggtgtggagaatggaaatttacctgagcctcggggtgctggcactcggaacactctctttgctggcggtgacctccctcccctcaatcgccaatagtctgaattggagagagttttcatttgtacagtcttctctgggctttgtggccctcgtgctttcaaccctccacaccttgacgtatggctggaccagagcttttgaagagagccgctacaagttttacttgcccccaacctttaccctgaccctcttggtgccatgtgtggtcatccttgcaaaggccctgtttcttctgccctgcatctctcggagactggccaggattcgacgaggctgggaaagagagtcaactataaagtttaccttgcccacggatcatgctttagctgagaaaacttctcatgtgtag

SEQ ID NO: 242550 - DNA, 1374 bp, Artificial Sequence
  Description of Artificial Sequence: Synthetic coding sequence
atgcctgaggaaatggacaagcccttaattagcctccacctggtggactcagactcctcattggccaaggttccagacgaggccccaaaggtcggcatcctgggctccggagacttcgcacggagcttagctacgcgcttggttgggagcggcttcaaagtggttgttggttcccggaacccgaagaggacagcgaggctgtttccatcagcagcccaggtcacatttcaggaggaggccgtgtccagccccgaggtaatttttgtagctgtctttagagagcattacagttccctttgttccctgtccgaccagctggctggtaagatactggttgacgtttcgaatcctaccgagcaggagcacctccagcatcgggaaagcaatgctgagtacctggcctccttgttccccacctgcacagtggtaaaggcattcaacgtcattagtgcgtggacactccaggccggtcccagagacggcaatcgtcaggtccctatctgcggggatcagcccgaggcaaagagagctgtctcggagatggcacttgcaatgggttttatgccggtggatatgggtagtcttgcatctgcatgggaggttgaggccatgccgttacggctgttgccagcctggaaagtgccaaccctgctggccctgggtctgttcgtctgcttctacgcatacaatttcgtcagagatgtactgcagccctacgtacaggagtcccagaacaagttcttcaagctccctgtctcggtggtcaacacgacccttccgtgcgtggcctatgtgctgcttagcctggtgtatctcccaggcgtccttgctgctgcattgcagctaaggcgaggaaccaagtaccagcggttcccagactggctcgaccattggctccaacatcgcaaacaaatcggtctgttatcattcttctgtgccgcactccatgctctatacagtttctgcttgccgctgcggagagcccacagatatgatctggtcaaccttgctgtaaaacaggtgctggccaacaagagccatctctgggtcgaggaagaagtctggcgcatggaaatttacctcagcctcggagtgctggcgctgggaaccctgtcactgctcgctgtcacgagcctcccatccattgccaattcactgaattggagggagttctcattcgtccaatgtgtggccacaagctccgcaggcaacacaggctccggaaccagaaggcccgagtcacaatcccaagacccacaccttccggcaccacatcaccagacgtccttccttggccctcgttccttttgttgcagcctggtgcctgtgagcactccttacgggcatcaggaggatctctcctggacacgctag

SEQ ID NO: 242551 - DNA, 1467 bp, Artificial Sequence
  Description of Artificial Sequence: Synthetic coding sequence
atgccagaggaaatggataagccactgatatcccttcacctggtggattcagactccagtttagccaaggtgccagatgaagcgcctaaggttggcattctagggagcggagactttgccaggtccctggcaacaagactggtaggctcagggtttaaggtcgtagttgggagccgcaaccccaaacggacagctagattatttccctcggcggctcaggtcacttttcaggaggaagccgtgtcaagcccggaggtgattttcgtggccgtgtttagagaacattatagctcgctgtgtagcctttctgatcagcttgccggaaagatccttgtcgacgtgtccaatccgacagagcaggagcacctccagcacagggaatcaaacgcagaatatttagcctccctgtttcccacctgcaccgttgtcaaggcttttaatgtgatatctgcctggacgttacaagcgggaccgagggacggtaaccgtcaggtcccaatctgcggtgatcagcccgaggccaaaagagctgtgtcagaaatggcactcgctatgggctttatgcccgtagatatgggcagtctggcatctgcctgggaagtcgaggccatgcccttgcggctgctgccagcatggaaagtacctacgctactggccttggggctctttgtgtgcttttatgcctacaactttgtgcgggatgtcttgcaaccttacgtgcaggaatctcagaataagttcttcaagcttcctgtctccgtggtcaatacaacgttaccctgtgtagcgtacgtcctgctgtctctagtgtatctcccaggggttcttgcagcagccctccaacttagacgtggtacgaagtaccagcgattccctgattggctggatcattggctgcagcacaggaagcagatcggcctgctgtccttcttttgcgctgccctgcacgccctatactctttttgcctgcctttgcgtagagcccatagatacgatcttgtgaatctggcagtcaaacaggtgcttgctaacaagtcacatctctgggtcgaagaagaggtgtggaggatggagatctatctaagtctgggtgtcctggccctcgggacactcagcctccttgccgtgacctccctgccatctatagcaaattccctgaattggcgggaattcagttttgtccagtcttcgctcgggtttgtggccctggtgctctcgactctacatacgttaacatacggatggactcgcgcttttgaggagagcaggtataaattctaccttccaccaacattcacccttacgctgttggtcccatgcgtggttatcctggccaaggctctatttctgctgccatgcattagcagaaggctggctaggattcgacggggatgggagcgggaaagtaccataaagtttactcttcctaccgaccatgcccttgcagaaaagacttcccacgtatag

SEQ ID NO: 242552 - DNA, 1374 bp, Artificial Sequence
  Description of Artificial Sequence: Synthetic coding sequence
atgccagaggaaatggataagccactgatcagcctccatctggtggattccgattcctctctggcaaaagtgcctgatgaggctcctaaggttggaatcttggggagtggagactttgcacgcagcctcgctacccgcctcgtgggaagtggttttaaagttgtcgtcggatcacggaaccctaagcgcactgccaggttatttccctcggcggcacaggtgacttttcaggaggaggccgtctcctccccagaagtgattttcgtcgcagtgtttcgcgaacattacagttcgttgtgttcactgtccgaccagctggcaggaaaaatactggtggacgtaagcaatccaactgagcaggagcatctacagcacagggaaagcaacgccgagtaccttgcctcactatttcccacctgtacagtggtgaaggcctttaacgtcatttcagcttggaccctgcaagccggtccacgggacgggaaccggcaggtgcctatctgtggggatcaaccagaggctaaacgtgccgtttctgaaatggctctggccatgggcttcatgcctgtggacatggggtcactggcatcagcttgggaagtggaagccatgcccctgcgcttgctgcctgcatggaaagtgccaaccctattggcccttggtttgtttgtttgtttctacgcgtacaatttcgtgagagacgtcttacagccttatgtacaggagtcacagaacaaattcttcaagctgccagtcagcgtggtgaacactacactgccgtgcgtggcctacgtgttgctcagccttgtctatctgcccggtgtgctggctgccgcactccaactccgaagaggaacaaagtaccagcggtttccagattggctggaccattggctgcagcaccgcaaacagatcggcctgctctcgtttttttgtgcagctcttcacgccctgtactctttctgcctgcctcttaggcgcgcacaccgctacgacttagtgaacctagccgtgaagcaggttctggcaaataaatcccacttgtgggtggaagaagaagtgtggaggatggagatctacctgagcttaggtgtactggcgctggggacactgtctctgctggccgtaacctcactacctagcatcgctaactccctgaattggagggaattctccttcgtgcagtgcgtggctacatcttcagcagggaatacagggtccggaacacgcaggccagaatcacaaagtcaggaccctcacctccccgcaccacaccaccaaacaagcttcctcggccctcgcagtttctgctgttctttggtgcctgtgagtaccccctacggccatcaggaagatttatcgtggactaggtag

SEQ ID NO: 242553 - DNA, 432 bp, Artificial Sequence
  Description of Artificial Sequence: Synthetic coding sequence
atggaaatttacctgtccttgggagtcctcgctcttggcacgctttcactgctcgcagtcacttctctcccctccattgctaactcgctgaattggagagaatttagtttcgttcaatcctccctcgggttcgtggctttggtcttatccaccctgcataccttgacgtatggctggacccgggcttttgaggaatctcgctacaagttctacctgccgccaacatttactctcactcttcttgtcccctgtgtagtcatccttgctaaggctctgttcttgctcccatgcatctcaagaagacttgccagaatacgtagagggtgggagagggagtctactatcaaattcactcttcctactgaccatgccctgagcccactagggtttctgttccttgttgtgcaatcaggaattaccgtgtgcaagtag

SEQ ID NO: 242554 - DNA, 852 bp, Artificial Sequence
  Description of Artificial Sequence: Synthetic coding sequence
atggaaaagacctgcatagacgctctcccactcactatgaatagctccgagaaacaggagacggtctgcatctttggtactggagacttcggccgttccctcggtctgaaaatgctgcaatgcggctattctgtggtctttgggtcaaggaacccacagaaaacgacactgcttccatctggcgctgaagtcctgtcctactctgaggctgcaaaaaagtcaggaattatcatcattgccattcaccgtgagcactatgacttcttgaccgaactgactgaagtgctgaacggcaagatacttgtggatattagcaataacctaaaaatcaaccagtatccagagagcaacgcggagtacctagcccacttggtgccgggagcccatgtggttaaggctttcaacactattagcgcatgggcacttcaatccggagccttggacgcttcacgccaagcaatcctgaagaaagagaacccattctcaacctcatcagcctggctgagcgacagttatgtggccctggggattctcggattttttctgtttgtgttgctgggaatcacttcgcttccaagtgttagtaacgcagttaactggagggagtttagatttgtgcagtccaagctcggctacctgactctcatactctgtactgctcacactctagtctatgggggaaaacggtttctctccccttcgaacttaagatggtatctgcccgctgcatatgtcctgggcctcattataccctgcacagttctcgtgattaaattcgttcttattatgccttgtgtcgacaacacactgacccgtatcaggcagggatgggagaggaattctaaacattag

SEQ ID NO: 242555 - DNA, 1380 bp, Artificial Sequence
  Description of Artificial Sequence: Synthetic coding sequence
atggaaaaaacttgtatcgacgcacttcccctgaccatgaacagttcagaaaagcaggaaaccgtctgcatctttgggaccggagactttggccgaagcttgggtcttaagatgctgcagtgtgggtatagtgtggtgtttgggagccggaatcctcaaaagaccactctgctgccgtcaggcgcagaggtactttcctatagcgaagcagccaaaaaatcaggtatcattattatagccatccacagagagcattacgattttctgacagaattaacggaggtgctgaacgggaagatcctggtcgacatttctaataatctgaaaattaatcaatatcctgagtccaatgccgagtaccttgcccacctcgttccgggtgcccacgtggtgaaggcttttaacacgatatcagcgtgggcattgcaatcaggtgcactggacgccagccgccaggtgttcgtgtgcgggaatgatagcaaggctaaacagcgggtaatggatatcgtaaggaatcttggcctgacacctatggatcagggtagtcttatggctgcgaaagagatcgaaaagtacccactgcaattatttcctatgtggaggttcccattttatctgtcggctgtcctgtgtgtatttctgtttttctactgtgtgatccgggatgtgatatacccatacgtctacgaaaagaaagacaacacttttaggatggcaataagtattccgaacagaatcttccccatcaccgcgttgactctactggccctggtttatctccctggtgtgatcgccgcaatactgcagctctatcgcggaactaagtataggaggtttcccgactggctggatcactggatgctgtgccgcaaacagttgggcttggtcgcgttagggtttgctttcctgcatgtgctctatacactggttattcctatacgctactacgtccgctggcgcctgggcaatctaacggttactcaggcgatactgaagaaggagaatccatttagcacatctagcgcatggcttagcgatagctacgtggcattagggatcctcggctttttcctgttcgtacttctgggcattacatctctcccaagcgtttccaacgccgtgaattggagggaatttaggttcgtgcagtccaaactaggatatttgactctgattctgtgtacggctcacaccctggtatacgggggtaaaaggtttctgtccccttcaaacctgaggtggtacctccctgctgcgtatgttctgggccttatcattccttgtaccgtgctcgtaattaaattcgtcctcatcatgccttgcgtcgataatactctgaccagaataaggcagggctgggagaggaattcaaagcactag

SEQ ID NO: 242556 - DNA, 1080 bp, Artificial Sequence
  Description of Artificial Sequence: Synthetic coding sequence
atgcccgctcatctgctgcaagacgatatctcctcgtcctacacaacaacgaccaccatcacggcgcctcccagccgcgtgctacagaacggcggtgacaaattagaaacaatgccactctatctcgaagacgacattcgccctgatattaaagatgacatttatgatcccacctataaagacaaggagggaccttccccaaaggtggaatatgtctggcgaaacataatactgatgtcccttttacatctgggagccttgtacggaattacgctcatacctacttgtaaattctacacatggctctggggcgtcttttactatttcgtgagtgctctgggaataactgctggtgcccaccggctgtggtcccaccgttcctataaggctagactgccccttcggctcttcctcattatagcaaatactatggcattccagaacgacgtatacgagtgggccagagatcacagagcccaccacaagttttccgagacacacgccgacccacataactctcgcagaggttttttcttctcccacgtgggctggctcttagtgcgaaaacacccggctgtgaaagaaaaaggatcaactttagatctctctgacctggaggctgaaaagcttgtgatgttccagaggaggtattacaagccaggcttactcatgatgtgtttcattctccccaccctggtcccttggtacttttggggagagacctttcagaactccgtgttcgtcgcaacattcctgaggtacgccgttgtgttaaatgctacttggcttgtgaactccgccgctcacctgttcggatatagaccttatgataaaaacatttcccctagagaaaatatcctcgtatctctcggggctgtgggagagggtttccacaactatcaccactcctttccatatgactattcggccagtgaatacaggtggcacatcaacttcaccacgtttttcatagattgcatggccgctctcgggctcgcttatgatcgtaaaaaggtgtctaaagctgcaattctggccaggataaagcgcactggcgatgggaactacaaatccggatag

SEQ ID NO: 242557 - DNA, 729 bp, Artificial Sequence
  Description of Artificial Sequence: Synthetic coding sequence
atgccagcacacctgctccaagatgacatttctagctcctatacgaccacaactaccattactgctcctccgtccagggtactgcagaatgggggtgacaagcttgaaactatgcccttgtacctagaggatgatattcggcctgatattaaagacgatatctacgatccaacttacaaggacaaggagggaccaagtcccaaagtagaatatgtctggagaaatatcattctgatgtccctcctacatctcggtgctctctacggaataaccctcatacctacatgcaagttctacacatggctgtggggtgtcttctattactttgtgtctgctctggggatcaccgccggtgctcaccgactctggagccatcggtcctacaaggctcgcttgccactgcgtctgtttcttatcattgctaatacaatggctttccagaatgacgtgtatgaatgggccagggatcaccgcgctcaccataagttctcagaaactcacgccgacccgcataactcccggaggggattcttcttttcccatgtcggttggctgttggtgcgaaagcatccagcggttaaggagaaaggatcaaccttggacctctccgacctggaggctgagaaattggtgatgtttcagagacgctactacaaaccagggttgctaatgatgtgtttcatccttcccactctcgtgccttggtatttctggggggaaacattttag

SEQ ID NO: 242558 - DNA, 813 bp, Artificial Sequence
  Description of Artificial Sequence: Synthetic coding sequence
atggcgtgcagaccacgttccccccctcgacatcagtctcgctgtgacggagatgcttcacccccatcacccgctagatggtcgcttggccgtaaacgccgagcagacggcagacggtggcgtcccgaagatgccgaggaagcagagcataggggagctgagcggagacctgagagctttacaacacctgagggcccaaaacctagaagccgatgcagtgattgggcctccgcggtggaagaggacgagatgagaacacgggttaataaggaaatggccagatacaagaggaagctccttattaacgattttggtcgagaaagaaagagttcatctggcagctcagacagcaaggagtctatgagtacagtccctgctgattttgagacagacgaaagtgtgttgatgaggaggcagaagcagatcaattatgggaaaaacacaattgcttacgaccgttatatcaaagaagttccgcgacatttgcggcagcctggaattcaccccaagactcccaacaagttcaagaagtactctagacggagctgggatcaacagatcaaactctggaaggtcgcccttcatttctgggacccacccgctgaggaaggctgtgacctacaagagatccatcccgtggacctggagtccgctgagagctccagcgaacctcagactagctcacaggatgactttgatgtttactcggggacaccaactaaggtcaggcacatggattcccaggtggaagacgaattcgaccttgaagcttgtctgacagagcctttgcgagacttttctgcaatgtcctag

SEQ ID NO: 242559 - DNA, 5327 bp, Artificial Sequence
  Description of Artificial Sequence: Synthetic coding sequence
atggcgctgagcctctggcctctactgctcctgctcctgctgctcctcctgctgtccttcgccgtaaccctagcaccaacagggcctcactccctggacccaggactgtcgttcctcaagtccttactgtccacgttggaccaggctccgcaagggagcctctccagaagccgttttttcactttcctggcgaatatctcctcttcctttgaaccaggaaggatgggcgagggacccgtcggagagccgcctcccttacaaccaccggcactcagactgcatgacttcctcgtgaccttgcggggtagccccgactgggaacctatgctgggcctgctgggtgatatgctggccctgctgggtcaggaacaaaccccacgagactttctcgtgcaccaagccggagtgctcgggggactggttgaagtgctcctgggcgctttggttccgggtggacctccaactcctacccggccaccatgtaccagagacggaccatctgactgtgtcctggctgctgattggcttccttccctccttctattattggaaggtaccagatggcaggccctcgtgcaggtgcaaccttccgtggatcccaccaacgcaacggggttggacggaagggaagcggcacctcactttctgcagggactcctgggcttactcacgccaacgggcgagcttgggagcaaggaagccctgtggggagggctcctgcgcaccgtgggagcccctctttatgccgcatttcaagaaggtctgcttcgtgtgacccatagcctccaagacgaagttttttccatcctgggacaacctgaaccagatacaaacggccagtgtcagggtggcaatcttcagcagctgttactgtggggtgttcggcacaatctgtcatgggacgttcaggccctgggctttctgagcggcagcccacctcctccacccgctttgctgcactgcttgagcaccggtgtgccactcccccgtgccagccaaccctccgcgcacatctcgcctaggcaaaggcgtgctattacggttgaagccctgtgcgagaatcacctggggcctgcacctccctattcaatatccaatttctcgatccatctgttatgccagcacacaaagcccgctacgcctcagcctcacccctcaacaacagccatctgtcagactgctgtttggtatgctgttagctgggccccaggtgcacaggggtggttgcaagcttgtcatgaccaatttcctgatgaatttctggatgctatctgttctaatttgagctttagtgcactctcaggcagcaacagaaggctagtcaagagattgtgcgcaggccttctccctccacccacttcctgcccggaggggctgccccctgtacctctgacacccgatatcttctgggggtgctttcttgagaacgaaacactgtgggctgagagattgtgtggggaggcgtcacttcaggctgtgccccctagtaaccaggcctgggtacaacatgtgtgccaaggcccaacccccgacgtgactgcgtctcctccctgtcacatcggaccatgtggtgaaagatgtccagatggtggcagtttccttgtcatggtatgcgccaatgacaccatgtatgaggtccttgtgccgttttggccttggttggcaggacaatgtaggatatcccgtggcggaaatgacacttgctttctggaaggactgctggggccattgctcccctccctgcccccactcggtccgtcccccctgtgcctgacccccggaccattcttgctcggcatgttgtcccaactgcccaggtgtcaatcgtccgtgccagctttggctcaccctacccggttgcactacctgctgcgactgttgaccttccttcttggaccaggggctggcggagctgaggcccagggcatgctgggaagagcactgcttctgtcctcactgccggacaactgctccttctgggatgctttcagacccgagggtcgaaggagcgtactaaggactattggcgagtacctggagcaggacgaggagcagccaacaccgtcggggttcgaacccaccgtgaacccatcttctggaatatcgaagatggaactgctggcatgttttagccccgtactgtgggaccttctgcagagggagaagagtgtttgggctctgcagattctcgtgcaggcctatctgcacatgcctcccgaaaacctccagcagttagtgctctctgccgaaagggaggcagctcagggatttctaactctgatgctccagggcaagctgcagggcaaactccaggtgccaccttctgaagagcaggcactgggcaggctgacggccttgctactgcaaagatacccacgtctcacatcacaactgtttattgatttgagccccctgattcccttcctggctgtatctgatctcatgcgctttccaccttcattacttgctaatgacagcgtgctcgcagcaatacgggactactcacccggaatgcggcctgaacaaaaagaggcgctggctaagagactgttagcacccgaactctttggagaggtgcctgcatggccacaagaattgttgtgggccgtcctcccgctactaccacatctcccactggagaattttctgcagctaagtccccatcagatacaggcactggaggatagctggccagctgccggtctgggacccggtcacgctagacatgttttacgatctctggtgaatcagtccgttcaggacggcgaggagcaggtaaggcggcttgggcctctagcctgctttctcagcccagaggaactgcagagtctggttcccctatctgaccccacgggcccagtggaacgcggtctgttagagtgcgccgcaaacggtacactgagtcctgaggggagagtagcgtatgagttattaggagtactccgctcaagtgggggtgctgtgctgtcccccagggagctccgcgtctgggcacctctattttctcagctcgggctgaggttcctgcaggagctatctgaacctcaacttcgggctatgctcccagtgctccagggcactagtgtgacccccgctcaggccgtgcttctgctcggacggctgctgccgcgacatgacctcagcctcgaagagctctgctctctgcatcttctgctgcccggactcagcccccaaaccctacaagccataccacgtcgcgttctagtgggcgcatgttcttgcctcgcccctgagctctcccggctttccgcttgccagactgctgcgctcttgcagacattccgagttaaagatggcgtaaagaacatggggaccacaggcgcagggcctgccgtgtgtatccctggccagccaattcctacaacgtggccagattgcttattaccactcctgcctctcaagctactgcagctagactctttagccctgctggccaatagaaggcgctattgggaactcccctggtccgagcagcaggcccagttcctgtggaaaaaaatgcaggtacctaccaacttgactctgcggaatctgcaggcactaggtacactggccggaggaatgagctgcgaattccttcagcaaattaactcaatggtcgattttctggaggtggtacacatgatataccagttgccaacccgtgtgcgaggcagtttacgcgcttgtatttgggccgagttacagagacgtatggccatgcccgagcccgaatggacaactgtaggcccagagttgaacggcctggattccaaactgctcctagatctgcctatccagctgatggatcgactcagcaacgaatctattatgctagtggtggaactcgtgcagcgggcacccgagcagctgttagccctgacgcccctgcaccaggcggcactcgcggagcgtgccctccagaacttggcccctaaggagacacccgttagcggagaggttttggagaccctcggtccgctcgtagggttcctcggtacggagtcgaccagacagattcccctgcaaatcctgttgtctcatctcagccagttgcagggcttctgtctgggcgaaacttttgctacagaactgggatggctgctactgcaggagagcgtgctcggaaagcctgaattgtggtctcaagatgaggtggaacaggctggaaggctggtgtttactctgtccacggaggctatcagcctgattccacgcgaggctctcggtcctgagaccctcgaaagactcttggaaaaacagcagtcttgggagcagtcaagagttggccaactgtgcagggagccccaactagctgcgaagaaggcagccctggtggccggagtggtaaggccggcagcagaggacctgccagagccagtaccaaattgcgctgatgtccgtggaacctttcccgcagcatggtctgctacgcagattgcagagatggagctctctgattttgaggattgccttacactcttcgccggagatccgggattagggcctgaggagctgcgcgcagctatgggaaaagctaaacaactctggggaccccctagggggtttagacccgaacagatcctccagctcgggaggctgctcataggacttggcgatagagaactccaggaacttatcctggttgactggggcgtgctatccacccttgggcagatcgacggctggtcaacaactcagctgcgcattgtggtctcatcctttcttcgccagtctggcaggcacgtgtcccaccttgatttcgtccacttaacagcgctgggatacaccctttgtggccttaggcccgaggaacttcagcacatctcttcctgggaattctctcaagccgctctctttttaggcacactgcacctacaatgttctgaagagcagctcgaggttttggcacacctcctcgtactgcctggcggattcgggccaatctccaattggggtccagaaatattcactgaaattggaacaatcgcagccggtatcccagacctggcattgagtgcacttcttagaggccagatccagggggttactcctctcgcaatttccgtgattccaccaccaaagttcgcggtggtcttttctccaatccagctgtcatccctgacttctgcacaggcggttgccgtcacacccgaacagatggccttcctttcaccagaacagcggagggccgtggcttgggcccagcatgaaggaaaagaatccccagagcagcaggggagatccaccgcctggggtctgcaggattggtcaaggcctagctggtcactggtgttgactattagtttcctgggacatctgttgta

SEQ ID NO: 242560 - DNA, 1056 bp, Artificial Sequence
  Description of Artificial Sequence: Synthetic coding sequence
atggccttgtccctgtggccgttgctgttgctgcttctccttctcctcttgctgagcttcgccgtgacccttgctccaacaggccctcactctctggaccctgggctgtctttccttaagagcttgcttagcactctcgatcaggctccacagggaagcctgagtaggtcaagattctttaccttccttgctaacatcagctctagcttcgagcccggaagaatgggagaggggcctgtgggcgaacctccaccccttcagccgcctgccctgagacttcacgattttttggttaccctgcgcggatctcccgactgggagcctatgctcggcctcttaggtgatatgttagcactacttggacaggagcaaacgcccagagatttccttgtccaccaggccggagttctgggtggcttagtggaggtgttactgggtgctctggttccaggtggtccaccaaccccaacacaaccaccctgcactagagatggcccaagcgattgcgtgctagccgctgactggctgcctagtttgctgctgttgcttgagggtacacgttggcaggcacttgtgcaggtgcaacccagtgttgaccccacaaacgcaaccggcctggacgggagagaagcagctccgcactttctgcaggggttactggggttgctaactccaacaggcgaactgggaagtaaggaggccctgtggggtgggctactacgaactgtgggcgcacctctgtacgctgcattccaggaagggctgctgcgagtaactcatagtctccaggatgaggtgttctcgatccttgggcaaccggaaccggatactaacggtcagtgccaaggcggaaatctccagcagctgctgctgtggggggttagacataacctctcttgggatgtgcaggccctggggttccttagtggatcccccccaccccctccagccctgcttcactgtctgagtaccggcgtgccgcttccacgcgcttcacagccatctgcccatattagtcctagacaacggagggccattaccgtcgaagcgctgtag

SEQ ID NO: 242561 - DNA, 5327 bp, Artificial Sequence
  Description of Artificial Sequence: Synthetic coding sequence
atggccctgagcctgtggcctctccttctactgctcctgctgctgcttctgctgagttttgccgtcacgctcgcacctacaggaccgcacagcctagaccccggtctttcttttctgaagtccctgctctctaccctggaccaggcccctcaagggagcctctcacgaagccggttttttaccttcctggccaatatctcttcctcttttgagcctggcagaatgggagagggaccggtcggtgagccccctcccctgcagcctccggctctccggttgcacgactttttagttactctgcggggaagcccagactgggaacccatgcttggtcttctgggcgatatgctcgcactgctcgggcaggagcagaccccccgagacttcctcgtacatcaagcgggtgttctaggcggactggttgaagtcttactgggggcactcgtgccgggtggtcctcctaccccaacgcgcccaccatgcacacgggatggtccctctgattgtgtcctggccgcagactggctgccctcactgctactgctgttagaaggaactagatggcaggccctggtgcaggtccagccaagcgtggatcctaccaatgccaccggccttgatgggcgtgaggcggctccccattttctgcagggactactgggattgcttacgcccactggggaactgggcagcaaggaagccctgtggggcggtttactacggacagttggtgctcctttgtacgctgctttccaggaggggttgctgcgggtcacccacagcctgcaggacgaagtgttttcgattttgggccaaccggagccggacactaacggccagtgccagggcggtaacctccagcagctgttgctttggggcgtccggcacaatctgagctgggacgtgcaagccctgggattcctttctggctcaccccctcctccacccgctctcctccattgtttatccactggggtccctctacctagggccagccagccttcggcacacatctcccctcgacagagaagagcgatcacagtagaagccctatgtgagaaccacttaggtccagctccaccctactccatctctaatttctccattcacctgctgtgccagcacacaaaacctgctacacctcagccacacccaagcaccacagcaatctgtcagaccgccgtgtggtatgccgtgagttgggctcctggcgctcagggatggctccaggcttgtcatgatcagtttccggacgagttcctggacgcaatatgttccaacctgtccttctccgccttgtctggatccaacaggcgcctggtcaaacgtctttgtgcaggtctcttacccccacctacatcttgtcctgaggggctgccacctgtacctctaacccccgatattttctggggatgctttttagaaaacgaaaccctttgggctgagaggctctgcggcgaagcctctctacaggctgttcctccatctaaccaggcgtgggtccaacacgtgtgccagggccctacccctgacgtgaccgcttccccaccctgccacattggcccttgcggagagaggtgtccagacggtgggtctttcttggtcatggtctgtgcaaacgacactatgtatgaagtcctggtgcctttctggccttggttggctgggcagtgtagaatcagccgtggcggaaatgacacatgtttcctcgagggcttgttggggcctctgctaccctcgctgcccccacttggaccttcccccctttgtctcacacccggtccgtttctcttggggatgttatcccagcttccaaggtgccagagtagcgtcccggctctggcccacccaacgcggcttcactatttgctgcgtctgctgaccttccttctgggcccaggggcaggaggcgcagaagcccaggggatgttggggagagcgctgttgctttcatccctccctgacaactgtagcttctgggatgcctttaggcccgagggcaggagatccgtgctgagaacgataggcgagtacctcgaacaggatgaagagcagcctaccccaagtgggttcgagcctacggttaacccaagttcaggaatcagcaaaatggagcttctcgcctgtttctcacccgtcctgtgggaccttcttcaacgggagaaatctgtgtgggcattgcagatcctggttcaggcgtatttacacatgccccctgaaaatctccagcagctcgtcctctcagctgagagggaagccgcacaaggctttttgaccctgatgctgcagggcaagctacagggcaaattgcaggttcctccatctgaggagcaggccttgggcaggcttactgcactcttattacagaggtatccaaggctaaccagtcagttattcatcgatctgagtcccttaattccatttctggccgtgagcgatctgatgaggtttccacccagcttgttggcgaatgatagcgtactggccgctattcgcgactatagccccggaatgagacctgagcagaaggaggcactggctaaacgtctcctcgcccctgagctgttcggcgaggtgcctgcatggccacaggaactgttgtgggccgtcttgccactgctgcctcacctcccccttgagaactttctccaactgtctcctcatcagatccaggccctcgaggactcctggcccgcagctggcctcggaccgggtcacgctaggcatgtgctacggtcgcttgtgaaccagtcagtgcaggacggtgaggagcaagttaggagattggggccacttgcatgttttctgtcccccgaagaacttcagtccttggtgcccctcagcgacccaaccggccctgtcgagagagggcttctcgaatgcgccgcaaacggcaccctgtcgccagaaggcagggtggcctacgagctgctcggcgtgcttcggtcatcggggggtgccgtgctgtcccctcgggaactgcgtgtgtgggctcccctcttcagtcagttgggactgcggttcctccaggaattaagtgaaccccaattacgagcaatgctgccagtcctacagggcaccagcgttacgcccgcacaggccgtgctgctcctgggcaggttgcttcccaggcacgacttgtctttggaggaattatgcagcctccatctcctactgcccggtctgagcccccagacgctgcaggctatcccgagaagagtcctcgtcggggcttgctcttgcttggctcctgaactatctcgactgtctgcttgccagaccgctgcactactccagaccttcagagtcaaggacggcgtcaagaatatgggcaccacaggcgctgggcctgccgtgtgcatcccaggtcagccgattcccaccacatggcctgattgtttgctccctttactgccactcaagctccttcaactggactccctggctctgctggccaatagaaggaggtattgggaactgccctggtctgagcagcaggcccaattcctgtggaaaaaaatgcaggtgcctaccaacttaaccttgcgcaatctgcaagcattaggaactttagctggaggcatgtcatgcgagtttttacagcagattaactccatggttgactttcttgaagtcgtccatatgatctaccagcttccaactcgagttcgcggttccctgcgggcatgtatttgggccgaactgcagagaagaatggccatgccggagcccgagtggaccactgtcggtccagagctgaacggccttgacagtaaactcctgctggatttacctatccagttaatggacaggctctccaatgaatcaatcatgttggtggtcgaactcgtgcagcgagccccagaacaactccttgcgttgacacctctccatcaggctgctctggcagagagagccttacagaacctggctcctaaagaaacacccgtgagcggagaagtgctggagactctcgggccactggtgggtttcttgggcaccgagtccactaggcaaattcccttgcagatacttctgtcacatctgtcccagctccagggcttctgtcttggggaaacattcgctaccgaactcgggtggcttctgctccaagagtctgtgctgggcaagcctgagctgtggtcccaggacgaggtcgagcaagccggtcggctggtgtttaccctatccacagaagcaattagcctgataccaagggaggcactgggcccagagacactcgaacgattgttggagaagcagcaatcgtgggagcagtctcgggtcggccagttgtgtagggaacctcagctggctgccaagaaggccgctctggttgccggtgtggtgcgacccgctgctgaagacctgcccgagccagtcccgaactgtgcagacgtcaggggcacttttcctgctgcctggtccgccacgcaaatcgccgagatggagctctcagattttgaggattgtctgactctcttcgcaggcgatcccggattgggcccagaggagctgagagccgctatggggaaagccaagcagctttggggccctcctcgcggatttaggcctgagcagatccttcaactaggccgtctgctgatcgggctcggcgatagggagctccaagagctgattctggtggattggggtgtgctctctactctggggcagatcgacgggtggagtaccacccaactgcgcatcgttgtctccagctttctgaggcagtccggccgacatgtctcccatctagatttcgtacacctgactgccctgggctatacactgtgcggactgaggccagaagaactgcagcatattagctcgtgggaattttcacaggctgcacttttcctgggaacactccatctgcagtgctctgaggagcaactggaagtgttagcccatctactagtgctccctggtggcttcggtcccatttctaactggggccctgagatcttcacagaaatcgggactatcgctgccggtatacctgacctagctttgagcgctctccttcgcggacagattcagggcgtgacgcctctagctatcagcgtgatcccaccacccaagttcgccgtcgtgttttcccctattcagttgtcatccctgacctctgcacaggctgttgcggtgaccccggagcagatggcattcctgagtccagagcagcgcagggctgtagcttgggcccagcacgaggggaaggagagccccgagcagcagggtcgctccacagcctgggggctgcaggattggagtaggccctcttggtctttagtgctaacaatttccttcctcgggcatctgctgta

SEQ ID NO: 242562 - DNA, 1056 bp, Artificial Sequence
  Description of Artificial Sequence: Synthetic coding sequence
atggcactgtctctgtggccgttactgctgctcctgctgctgctcctactgctgtctttcgccgtgaccctcgccccaaccgggccacactcattggatccaggcctaagcttcttgaagtcacttcttagcactctagatcaagcccctcagggatccctgtcgcgcagccggttttttacttttctggcaaatatttcctcctcttttgagccagggcgaatgggcgagggaccggttggcgagccacccccactgcagccacccgctttgaggctgcacgactttctcgtaacccttcgagggtcaccagactgggagcccatgctgggtctgttaggagatatgctggccttgcttggacaagaacagacccccagagactttctcgtgcaccaggctggcgtactcggtggcttagtggaagttctactgggtgccctggtaccaggtgggccacctactccaaccaggcccccttgcactagggatggacctagcgactgcgttctggccgctgactggcttccttcattgctgctgttgctagaaggaacacgctggcaggccttagtgcaggttcagccttccgtggatccaacaaatgcaacagggctcgacggcagagaagccgctcctcacttcttacaggggctgttaggtctgcttaccccaacgggcgaactaggtagtaaggaggccctgtggggcggactactgagaacagtgggagcccctctctacgcagctttccaggagggcctgctgcgagttacccattcactgcaggacgaggtcttttctattctgggccaaccagaacccgacacaaatggacagtgccagggcggtaacctgcagcagctgctcttatggggggtgaggcataacttgagttgggatgtccaggctttggggttcttatccggatcacccccaccaccacctgctcttttgcattgcctgtccacaggtgtgccactgcccagggccagtcaacccagtgcgcatatcagcccgcgacagagaagagccataaccgtggaagctctgtag

SEQ ID NO: 242563 - DNA, 2100 bp, Artificial Sequence
  Description of Artificial Sequence: Synthetic coding sequence
atggcccttagtctgtggcctctgctgcttctccttcttctgttgctgctgctgtcattcgctgtgacattggcccctactggtcctcacagcttggaccctggattgtcctttctgaaatctcttctgagtacattagaccaggcacctcagggctccttgtctaggtcacggtttttcacctttctggccaacatcagctccagttttgaaccgggacggatgggggaagggcctgttggagaaccacctcctctgcagcctccagctctcagactgcatgacttcctcgtcacattaaggggctctcccgattgggagcccatgctaggtcttctgggcgatatgctggctttactggggcaggaacagacccctagagactttctggtgcatcaggctggagtccttggtgggctggtggaagtgttgctgggtgccctagtgcccggtggaccccctacacccacccagccaccctgtacccgagacggtccgagcgactgtgtcttggccgctgactggctgccttccttgttgctgctgctcgaggggactaggtggcaggctctggtacaggtccagccatccgtcgatcccacaaacgcaaccggcctggatggtcgggaggcagcaccccactttctgcaggggttgctcggcctgctcacaccaactggtgaactgggcagtaaagaagcactgtggggcggactgcttagaacggtgggcgctcctctctacgctgcattccaggaggggctgttgagagtcacccatagcctgcaagatgaagtcttttccatcctcggccagcctgaaccagacacaaacggtcagtgtcagggaggaaatctgcagcagttacttctctggggagtgaggcacaatcttagttgggatgtccaagcacttggcttcctgagtggtagccccccaccgccacctgcactcttgcattgcctgtcgaccggcgtgcctctgccgagggcatcacagccttcggcccatatcagcccaaggcaacgtagagccatcaccgtggaagcattgtgtgagaaccaccttgggcctgccccaccttacagcataagcaatttttctatccacctcttatgccagcacacaaagcccgctaccccccaacctcatccatcgacgacagccatttgtcagaccgcagtctggtatgctgtgtcatgggctccaggcgcacagggatggcttcaagcgtgccatgaccagttcccggacgagttcctcgacgccatctgttcaaacctcagtttcagcgccttgagcggctcaaatcgcagactcgtgaagcgactgtgtgctgggctgctgccccctccgacttcttgcccagaaggattgcctcccgtgcccctgacacccgacattttctggggatgctttcttgaaaatgagaccctgtgggctgaacgcctgtgtggtgaggcctcactgcaggccgtcccacccagtaatcaagcctgggtccagcacgtctgccaggggccaacgccagatgttacagcatccccaccctgccacattggcccatgcggtgaacggtgccctgatggcggttcttttctggtcatggtgtgtgctaacgataccatgtatgaagtgctggtccccttctggccatggctcgccggacagtgccgcatcagccgaggcggaaatgacacatgtttcctcgaggggcttctggggcctctcctcccttcattgcctcctctcggcccttcccccttgtgtctcactccagggccatttctactggggatgctctcgcaacttcctagatgtcagagcagtgtgcctgccctcgctcatcctactcgattgcattaccttctgaggttgttaaccttccttcttgggcctggagctgggggtgctgaggcccagggaatgctgggacgggcactccttctgagttcactccctgacaactgttctttttgggacgcattccgacctgaggggcgaaggtccgtcctgagaacgattggcgagtacaacaaaatgagatcctcacagcctcaccaagcactcaatccactgtcaaccccggctctggtctag

SEQ ID NO: 242564 - DNA, 3009 bp, Artificial Sequence
  Description of Artificial Sequence: Synthetic coding sequence
atggagctactggcttgcttttctccagttctttgggacctgctccagagggaaaagtccgtttgggcactgcaaatactcgttcaggcttacctgcacatgcctccagagaacttgcagcagctggtcctgtcagccgaaagagaagcggcacagggcttcctgaccctgatgctacaggggaaattgcagggaaaactacaggttccacctagcgaggagcaagctctggggaggttaactgctctcctgcttcagcgctatccccgactcacctctcagctgtttatagatttaagccctctgatcccatttttggcagtgtctgatctgatgagatttcctccttctctcctcgcaaatgactctgtacagcagggctatagaggcagcgaggagaactctctggaggaggataagggtctgaggccaatgacccctaggagccttgctgcaatcagagattactcccccggtatgcggccagagcaaaaagaggccctggctaagcgtctgctggctcctgagcttttcggagaggtaccagcctggccacaagagttactctgggctgtgttgccacttctgccccacctgccccttgaaaatttcctccagctgtctccacaccagattcaggctttggaggacagttggcccgcagccggactggggccagggcacgcccgacatgtcctgcggagccttgtgaatcagtcagtccaggacggagaggagcaggtgagaagactggggccattagcctgttttctgtcccccgaagaactgcagtcactcgtgcccctgtcagaccccaccggacccgtggaacgtggcctgctggagtgtgcggcaaacggcacactgagcccggaaggcagagttgcttacgaacttctgggggtgctgaggtcaagcggcggtgcagtgctgagccctcgagagctgcgcgtgtgggccccactctttagtcagttaggtttaagattcttacaggaattgagcgaacctcagctaagagctatgttgcccgtgctccagggcacgtctgtgacccctgcccaagcggtgcttcttctggggcgactgttaccaaggcatgatctgctgcaactagacagcctggccctgctggccaacagacggcgttactgggaacttccatggagtgaacagcaagcacagtttctgtggaagaagatgcaggtgccaacaaatctgactctcaggaacctgcaggccctggggacgttggctggcggtatgtcatgtgagttcctgcagcagattaattcaatggtggacttcctggaagtggtgcatatgatctatcaactcccaactagagttaggggaagcttgcgggcttgcatatgggccgagcttcagcgtcgtatggcaatgcccgagccggaatggacaaccgtgggtcccgagctgaatggcctcgatagcaagcttctcttggacctgccaatccaactgatggacagattatctaatgagagcataatgctggtggtggaactggtgcagcgggcacctgagcagctcttagcccttacccctctccaccaggccgctctcgccgaaagggctctccagaacctggccccaaaagaaacccccgtgagcggcgaggtgctggagacactcggcccattggttggatttctcggcactgagtccacccgccaaatcccactccaaatcttgctgagtcatctgagccagttacaaggtttttgtctcggggagacattcgccacagaactgggatggctgctcttgcaggagagcgtgttaggcaaacctgaattgtggagccaggatgaagtggagcaggccggtaggctcgtgtttactctgagcactgaggccattagcctcatcccacgcgaggctttaggaccggaaactctggaaaggctattagagaaacagcagagctgggagcagagtagggtgggccagctctgtcgtgagccacagctggccgctaagaaagccgcactggtggcaggtgtggttcggccagccgctgaggacctgcccgagcccgttcctaattgcgccgatgtgcggggaactttccctgcggcttggtcggctacgcagatcgctgaaatggagctgtctgatttcgaggactgtctcacgctgtttgctggcgatcctggtttagggcctgaggaactgagagccgctatgggcaaggcgaagcagctatggggaccgcctagagggttccggccagagcagattttacagctcggcaggctgttgattggccttggagatagagagttgcaagagctcattctcgttgattggggagtattaagtacgttaggccagatcgacggatggtccactacacagctgcgcattgttgtcagcagcttcctgaggcaaagcggccgtcatgtaagccacttagacttcgtacatctaacggcgctgggctacacactctgtggcttaaggcccgaggaactccagcacatttcaagctgggagttctcacaggctgcccttttcctggggactctgcatctgcaatgcagcgaagagcaattggaagtgctcgctcacctattagtcctgcctggaggatttggccctatatccaactgggggccagaaatcttcactgaaattggaacaatcgcagcaggcatacccgacctggccctgagcgcattgctgagagggcaaattcagggagtgactccacttgctatttctgtcatcccaccgcctaagtttgccgtggtgttttcgccaatccagctatcctcattgacatcagcccaggccgtggccgtcaccccagagcagatggcctttctgagccctgagcagagacgcgcagtcgcttgggcacagcacgagggaaaagaatctcccgaacagcagggtagatccaccgcctggggacttcaagactggtcaagaccatcctggagcttagtgctaacaatctcatttctagggcatctgctgtag

SEQ ID NO: 242565 - DNA, 1890 bp, Artificial Sequence
  Description of Artificial Sequence: Synthetic coding sequence
atgtttcgggaccaggtgggtgtcctcgccggatggttcaagggttggaatgagtgcgagcagacagtggccctcctatccctcctgaaacgcgtctcccagactcaggcacgattcctccagctctgcctcgaacactctctggctgactgcgccgagctccatgtgctcgagagagaggcaaatagtccgggaatcatcaatcagtggcaacaggaaagcaaggataaggttatctcactgctactgacacacctgccattactgaagccaggcaacctcgatgcaaaagtggagtacatgaaactgctgccaaaaatccttgcgcatagcatcgagcacaatcagcatattgaagagtcacgccagttgctgagctatgctctaatacacccagccacctctctggaagataggtccgcattagctatgtggctcaaccacctggaagatagaacttctacaagcttcgggggacagaataggggaagatccgattccgtggattacggtcagacccattattatcaccaacggcagaactcagatgacaagctgaatggctggcagaactctcgagactctgggatttgcatcaatgcatccaattggcaggacaagagcatggggtgcgaaaatggccacgtgcccttatactcttcgtcatctgtgcccactacaatcaacacaatcggcacaagcacctcaacaaacgttcccgcttggctgaaatctctcaggctgcacaaatacgctgcccttttttcccagatgacatacgaggagatgatggcactgacggagtgtcagctggaggctcagaatgtgacaaagggagcgcgtcataagatcgtgataagtattcaaaagctgaaggaacgccagaatcttctgaagtctctggagcgggacattatagagggcggtagtctgcgcatccctctacaggagcttcaccaaatgatcctgactcccatcaaggcatactcatccccgagcacaacgcccgaagcacgcagacgtgagccccaggcaccgaggcaaccttctttgatgggtcccgagtctcaatcgcccgactgtaaagacggcgctgccgcaacaggcgctaccgccaccccttcggcgggagccagcggaggcttgcaacctcaccagctgagttcctgcgacggagaattagccgtcgctcctctccccgagggagatttgccgggacagtttactagagtgatgggaaaggtatgtacccagcttctggtgagcagaccagacgaagagaacatatcaagttatctccagctgattgacaagtgtctgatccacgaagccttcaccgaaacccagaagaagaggctgctctcctggaaacagcaagttcagaaactgttcagaagtttcccacggaaaacactgctcgacatttccggttaccggcagcagcgcaaccgagggtttggccagtctaacagcctgcctaccgctggctcggtgggaggtgggatggggcgtcgaaaccccaggcaatatcagatacccagcaggaacgtcccttctgcacggttgggcctcctgggcacgagcggtttcgtaagttccaaccagagaaatacgacagcaactcctactataatgaagcagggcagacaaaatctgtggtttgcgaatcccggtggcagtaatagtatgcctagtcggactcactcatccgtgcagcgtacccgcagcctgcctgtccatacttcaccacaaaatatgctaatgtttcagcagcccgaattccaactccctgtcaccgaaccagacataaacaataggctggagagcctgtgcctgagtatgaccgagcatgccctcggtgatggcgtggacaggacgagtacaatctag

SEQ ID NO: 242566 - DNA, 1893 bp, Artificial Sequence
  Description of Artificial Sequence: Synthetic coding sequence
atgatgtttagagaccaggtgggcgtgctggccggatggtttaaggggtggaacgagtgcgaacagactgtcgctctgctttcattgttgaagagagttagtcagacccaggctcggttcctgcagttgtgcctcgagcacagcctggccgattgtgcagaactgcatgtgttggagcgcgaggcaaactctcccggtatcattaaccagtggcagcaggaaagtaaggataaagttattagcctcctcctgactcacctccctttgcttaagccgggaaatctcgatgccaaagtagagtacatgaagctcctcccaaagattctagcgcacagtatcgaacacaaccagcacatagaggagtcaagacagctattgtcatatgcgctgatacatcccgctacctcgctcgaagatagatctgccctggcgatgtggcttaaccacctggaggacagaacctctacgtcgttcggcggacagaaccggggtcgaagcgactcagtcgactatggccagacccactattatcatcagcggcagaacagcgatgataagcttaatggatggcagaattcccgagactccgggatctgtataaatgcatccaattggcaggacaaatctatgggttgcgaaaatgggcatgttcccctgtacagctcttcgtccgtcccaaccaccatcaacaccattggcacttcaacaagcacaaacgtgcctgcttggctgaagtcactgaggcttcataaatatgccgctttgttctctcaaatgacatatgaggagatgatggctctcaccgaatgtcagctcgaggcccagaatgtaaccaaaggggctagacacaagattgtgatttctatccagaaactcaaagaaagacaaaacctgctgaagtccttagaacgagatattattgaaggcggatctcttcggataccattacaggaactgcaccagatgattctgacccccattaaggcttattcatctccctccactacacccgaggctaggagaagagaaccccaagctccaagacagcctagtcttatgggtcccgagtctcaatcgcccgattgtaaagatggcgctgcagccaccggcgctaccgccaccccatccgctggtgcgtctggaggattgcagccccaccaattatccagctgtgacggtgagctggcagtagcgcctctgcccgagggcgacctgcccggtcaatttacccgtgtgatgggaaaggtttgtactcaactcctcgtttcacgcccagacgaggaaaacatatcgtcatacctacagctcatcgacaaatgcttgattcatgaggcttttaccgagacacagaaaaaaagactcctctcttggaaacagcaggtccagaagttgtttcggagtttcccccgaaagacattgctcgatattagcggataccggcagcaaagaaatcgtggatttgggcagagtaatagcctgccaaccgctggctcagtcgggggagggatggggcgtcggaaccccagacagtaccaaatacccagtcgtaatgtgccttcggcacgcctcggtttgctggggaccagcggattcgtgtcaagcaaccagaggaacaccacggcgacccccacgattatgaaacagggacggcagaatctgtggttcgcgaatccagggggaagtaactccatgcctagcaggacacacagcagcgtccagagaacacgctcactgcctgtacatacctccccacaaaacatgctgatgtttcagcagccggagttccaattacctgtcaccgagccagacatcaacaaccggttggagtccctctgcctgtctatgaccgagcatgccctaggtgacggtgtggatcgcacaagtacgatttag

SEQ ID NO: 242567 - DNA, 2154 bp, Artificial Sequence
  Description of Artificial Sequence: Synthetic coding sequence
atgtttcgtgatcaagtgggcgtcctcgccggttggttcaaaggatggaacgaatgtgaacaaaccgtggcactcttgtcactgttaaaacgcgtatcacagactcaggccaggtttctgcaactgtgcttggagcactctctggcggactgtgcagaactccacgtgctcgaacgagaagccaatagtccaggaattattaatcagtggcagcaggagagcaaggataaggtgatttccctgttgttgacccacctgcccctgctcaaaccaggcaacctcgatgcaaaagttgagtatatgaagttgctgcccaaaatcctagcacattcgatcgagcacaatcagcacattgaagagtctagacagctgttatcttatgccctgatccaccctgctaccagcctggaagacagatctgctctggctatgtggctgaatcaccttgaggatagaactagcaccagttttgggggacagaatcggggtcggagcgatagcgttgactatggacagactcattattaccaccagcgtcaaaactccgatgataagcttaatgggtggcagaattcacgggattccggcatctgcatcaacgctagcaactggcaggacaagagcatgggatgcgagaacggccacgttcccctgtatagttcttcatcagtgcctactacgatcaatactattggtacgagtacctctactatcctgtctggccaagcccaccacagtcccctaaagaggtcagtgagccttacgccacccatgaacgtccctaaccagcctctgggacacggctggatgtctcacgaggatctgcgcgcaagggggcctcaatgcctcccatccgatcatgcacctttgtcgccccaatcctctgtggcatcaagcgggtcgggcggtagcgaacacctggaagatcagacaacagccaggaatacattccaggaagaagggtcggggatgaaagatgtaccagcctggctcaagtcgctccgtctacacaagtatgctgcgctgttctcacagatgacatatgaggagatgatggctttaaccgagtgtcaactcgaggcccagaacgtgactaagggcgctcggcacaagatagttatctcaatacagaaacttaaagagcgccagaatctgcttaagtccctggagcgagatataatcgagggtggatcactaagaatcccactccaggagttacaccaaatgattctcactcctatcaaagcctattccagcccatctacaactccggaggccaggcggcgtgagcctcaggcccctagacagccctctcttatgggccctgaaagtcagagcccagattgtaaagatggagctgctgctacaggcgctactgccacccccagcgccggtgcctctggcggtcttcagccccaccagctgagcagttgtgatggggagctagctgtggctcctctccccgagggcgacctccccggacaatttacaagagtgatggggaaggtgtgtactcagctcctggtttccagaccagacgaggagaacatctcaagctaccttcagttgatagacaagtgcttaatccacgaagcttttacagaaactcaaaaaaagaggctgctcagctggaaacagcaggtgcagaagctgtttcggtcttttcccagaaagaccctccttgacatctcaggataccgccaacagcgcaacagaggctttggacagtccaattccctgcctacggctgggtcagttggcggaggcatggggagaagaaatcccagacagtatcagataccatcacgaaacgttccatccgccagactcggacttctaggcacctctggcttcgtatcctctaatcagcggaatacaactgcaacccccaccataatgaaacaagggaggcagaatctatggtttgcaaatccgggtggcagcaattctatgcctagccgaacccacagcagcgtgcaacgcacacgcagtctgccagtgcatacaagcccgcagaacatgcttatgtttcagcagcccgagtttcagctcccagtgacagagccagacatcaataacaggttggaaagtctgtgtctctctatgactgaacacgccctgggggacggcgtggaccgcacctcaaccatttag

SEQ ID NO: 242568 - DNA, 2157 bp, Artificial Sequence
  Description of Artificial Sequence: Synthetic coding sequence
atgatgttcagggaccaggttggcgtgcttgctggatggttcaaaggttggaacgagtgtgagcagacagtcgctctcctgtccttgctgaaacgggtcagccaaacccaggctcgcttcctgcaactctgcctggagcactcattggccgactgtgcggaacttcatgtcctggagagagaagctaactcacccggaatcattaatcagtggcagcaagagagcaaggataaggtgatctcccttctgttaacccacctgcccctcctcaagccaggcaacctggatgctaaggtagaatacatgaagctcctacctaaaatactcgctcactctatcgaacacaaccagcacattgaagaatcccggcagctgctttcctatgccctgattcacccggcaacaagtttggaggaccggagcgcgctggccatgtggcttaatcatctggaggacaggacttccacatcttttgggggtcagaatcgaggacgaagtgacagcgtggattacgggcaaacccactactaccatcagcgccaaaacagcgatgacaagttgaacggctggcagaacagcagagattcgggcatctgtatcaatgcatccaattggcaagacaagtctatgggttgcgaaaacgggcacgttccactgtatagcagctcttctgtccccaccaccatcaacaccatcggcacttccacaagtactatcctgtccgggcaggcacaccatagtccactgaaaaggtcggttagtcttacacctccaatgaacgtgcccaaccagccactgggacatgggtggatgagccacgaagatctccgggctaggggaccacaatgtcttccctctgaccatgcaccattgagcccccaaagcagtgtcgctagttccgggtctggcggaagtgaacatttggaggaccagacaaccgctaggaacacttttcaggaggagggatccgggatgaaagacgtgcctgcctggctcaaatctctgcggctccacaagtatgccgcactttttagccagatgacatatgaagaaatgatggccctaaccgaatgtcagctggaggcacaaaacgtcactaagggggcacggcataaaattgtaatttcaatccagaagcttaaagaacgacagaatctgctcaagtctctggagcgcgacatcattgaaggaggcagcctaaggatacccttacaggagttgcatcagatgatactcacccctattaaggcatactcctcccctagtaccacacccgaggctcgtagacgcgaaccccaggcacctcgccaaccctcattgatggggccagaatcccagagtccagattgcaaggacggagccgcagcaacaggagctacagccaccccaagcgccggagcatctggcggactacagccccatcagctgagcagctgtgatggggagctggctgtggccccattgcctgagggagatctgcctggtcagttcactcgagtaatgggcaaggtatgcacgcagctgctagtgtctagacccgacgaggaaaacatctccagctatcttcagctcatagacaaatgcttgatccatgaagcttttaccgagacacaaaagaaacgcctcctctcatggaagcagcaggtgcagaaactgttcaggagttttccacggaaaacactcctggatatctctggctatcgacagcagcggaataggggattcggacagagcaattccctcccgacagctgggtcagtgggcggagggatggggagaaggaacccaaggcagtaccagattccatctcgcaatgtaccgtcagctcgcctggggttgctcggaacatcaggttttgtgtcttctaaccaaagaaacacaaccgccacacctaccatcatgaagcagggaagacagaacctctggttcgctaaccccggtggctctaacagcatgccttccagaacacacagcagtgtgcagagaacccgtagtctacctgtgcatacatcgccacagaacatgctgatgtttcaacagcccgagttccagctgcctgtcaccgagcctgatatcaacaacagactggaaagtctgtgtctgtcgatgacagagcacgcacttggagacggggtggaccggacaagcacaatttag

SEQ ID NO: 242569 - DNA, 2157 bp, Artificial Sequence
  Description of Artificial Sequence: Synthetic coding sequence
atgatgttcagggaccaggtcggggtgctggccggatggtttaaaggatggaacgagtgtgaacagaccgtggccctgctgagtctactgaagagagtgtcccaaacccaggccaggtttctacagttgtgcctggaacatagcctagccgactgtgcggagctccacgtcctggaacgtgaagcaaattcaccaggaatcattaaccagtggcagcaggagtcgaaagacaaagttatcagtctgcttttgactcatctccctcttcttaaacccggaaatctcgacgctaaagtggaatatatgaagctgctgcccaaaattctcgcccactctatcgagcacaaccagcatatcgaagaatccagacagctgctgagttacgctctcatccaccccgctacctcacttgaagataggtccgcactcgctatgtggctgaatcacctggaagacagaacctcgacaagcttcggaggacaaaaccggggacgatcggatagcgtggactatggtcagacacactattaccatcagaggcagaactccgacgataaactgaacgggtggcaaaattcacgcgattccgggatctgtatcaacgcctctaactggcaagacaagtcaatgggctgcgagaatgggcatgtgccactttactcttcatcctccgtcccaacgacaattaacacaatcgggacgtccacatccactattctttcaggccaggcccaccactctcctctgaaacgctccgtgagtttaacaccaccaatgaacgtgcccaaccagccattgggccacggctggatgagccacgaggacctgagagccagggggccacagtgtctgccctccgatcacgcccctttgtctccacagagctccgtggctagcagcggtagtggcggaagcgaacacctcgaagaccagacaacagcacggaacaccttccaagaagagggaagcggtatgaaggacgtcccggcttggcttaaaagtcttaggcttcacaagtatgcagccctgttctcccagatgacctatgaggaaatgatggctctcaccgagtgtcagctcgaggcccagaacgtgactaaaggagctcgtcataagatcgtgatatcaattcagaaactgaaggaacgccagaaccttctcaaatcccttgaaagggacatcatagagggagggtccctcagaattcccttacaggaattgcatcaaatgatcctgactccgatcaaggcctattcctctccaagtacaactccagaagcccgacgaagagagcctcaggcccctagacagcctagtttaatgggccctgaatctcagagccccgactgcaaagatggggcagccgctactggcgctaccgccactcctagcgctggcgcaagtggcggattacagccacatcagcttagctcttgcgatggagagctggctgtcgctcccctccctgaaggcgaccttcccggtcagttcacgcgagtgatgggcaaggtctgcacacagttactggtaagccggcctgatgaagaaaacatctcatcctatttgcagctgattgacaagtgtttgatccacgaagcgttcaccgagacccagaagaagcgtctcctctcgtggaaacaacaggtccagaagttgttccgctcgtttccccgaaagacactgcttgatattagcggctatcggcagcagcggaaccgagggtttggacagtccaacagcttaccgactgcgggaagcgtagggggagggatgggcagacgcaatcctcgacagtatcaaatcccgtctcgtaacgtacccagtgccagactgggcttactcggaacttccggtttcgtgtcttccaaccagaggaacacaacagcgacgcctacgatcatgaaacagggaaggcagaacctctggttcgctaaccccggagggtctaatagtatgccgagccgaactcattctagcgtgcagaggactagatccctgccggtgcacacttctccccagaatatgcttatgttccagcaacctgagtttcagctcccggttacagagccagatattaataacagactagagtccctgtgtctctccatgacagagcatgctctgggggacggagtggacaggacctccacaatatag

SEQ ID NO: 242570 - DNA, 1038 bp, Artificial Sequence
  Description of Artificial Sequence: Synthetic coding sequence
atgatcttgacccctatcaaggcctattcaagccccagcacaacacctgaggccagacgtcgtgagcctcaggccccacggcaaccgagcttaatggggccagaatcccagtcccctgactgcaaagacggcgctgcagccacaggagcaactgcaactccttcagccggtgcatctggaggactgcagccgcaccagctaagctcttgtgatggcgagttggccgttgcccctttgccggagggggacctccccggacaatttacacgcgtgatgggaaaagtgtgtacccagctcctggtgagccgcccagacgaggagaatatcagctcctatctgcagctgatcgacaaatgtctgatccatgaggcctttacagagacacagaagaaaagactcctgagttggaagcagcaggttcaaaagctttttagaagttttcctaggaagaccctgctggatatctccggttatcgccagcaacgcaaccggggattcggccaatctaatagcttgccaacagccggtagcgtcggtggtgggatgggacgcagaaacccccgtcagtatcagattccttcccgtaatgtaccttccgcccgactaggactcctggggacctctggctttgtgagttcaaatcaaagaaacactactgcaactccgactattatgaaacaagggcgtcagaacctgtggttcgcaaaccctggagggtctaatagtatgccttctcgcacacactcctccgtgcagaggaccaggtccctgcctgtgcacactagcccccaaaatatgttaatgttccagcaaccaggcagtcaggtgcattccggcttgtgcttgaccgatctgaggggttggctcagcttgtctggagcaccttcgatgccggctctgacagttcctaaatccagtcagggagaatttcaactccctgtaactgagcccgacattaacaatcgcctcgaaagtttgtgcttaagcatgactgaacacgcactaggggatggcgtggatcgaactagtaccatttag

SEQ ID NO: 242571 - DNA, 981 bp, Artificial Sequence
  Description of Artificial Sequence: Synthetic coding sequence
atggcaggacccaaccagctatgtatccgaaggtggaccactaagcacgtcgccgtctggctcaaggatgaagggttttttgagtatgtggatattctctgtaacaaacatagactcgacggcatcaccctcctgacattgaccgagtacgacctccggagcccacccctggaaatcaaggtcttaggcgatattaagcgcctgatgctcagtgtccgcaagctgcagaaaattcacattgatgtgcttgaagagatgggctataattctgatagccccatgggctcaatgacccccttcatcagcgcgctacagagtaccgactggctctgtaatggggagctttcccacgattgcgacgggccaatcacagatttaaattcggaccaatatcagtacatgaacggcaagaacaagcacagcgtgagacgacttgatcctgaatactggaagacaattctctcctgtatctacgtcttcatcgtgtttgggtttacaagtttcatcatggtgatcgtacacgaacgcgtgcccgatatgcaaacttatccacctcttccggacatatttcttgactccgtgcctcgcatcccatgggcattcgccatgacagaggtgtgtgggatgattttatgctatatctggttacttgtgctccttcttcacaaacaccgatccatcctcctcaggagactctgttcacttatgggcactgtcttcctcctcaggtgttttacgatgttcgtgacctctctgagtgttcccggacagcatctgcagtgtactgggaaaatctacggctccgtgtgggagaagctgcatcgcgcatttgctatttggtccgggttcggaatgacactgacaggagtccatacatgcggcgactatatgttcagcggacacacagtggtgttgacaatgctgaattttttcgtgaccgagtgcaagtacctgttctcggcatccatgagaattaggtag

SEQ ID NO: 242572 - DNA, 1437 bp, Artificial Sequence
  Description of Artificial Sequence: Synthetic coding sequence
atgcccgcaagaagtagacataggccccgtctacacagtggcagcccgcctagggccccaccaccaccacttgaagcacttcactccggggaagccggacgggcacccgacagcgatggcggatcggatgcggacagcgaagtcggcccaggctcaccaacccggacagctgaggctgctgaggaggagatggcaggacccaaccagctgtgcattagaaggtggacaaccaagcacgtggctgtctggctgaaagacgaagggttttttgagtatgtcgacatactatgcaataagcatcgtctggatgggatcaccttgttaaccttaacagaatacgatcttcgtagcccccctttagagatcaaggtcctgggcgatatcaagcggttaatgctgtccgtcaggaagctacaaaaaatccacatagacgtgctggaggagatgggctacaactcagatagcccgatgggtagcatgactcctttcatttctgctctgcagagcaccgattggttatgcaatggggaactttcacatgattgtgatgggccaatcaccgacctgaacagcgaccagtatcagtacatgaacggaaaaaataagcattccgtcaggaggctggacccagagtattggaagacaatcctttcttgtatatatgtcttcattgtgtttgggtttacctctttcatcatggtgatcgtccacgaacgcgtgccagacatgcagacatatcctccactgccagacatctttcttgactcagtccctcgaatcccgtgggcatttgctatgacagaggtatgcggaatgattctgtgctacatctggctgcttgtactgctgcttcacaaacataggtccattttgctgcgccgtctgtgttctttaatgggcacggtgttcctcttgaggtgctttaccatgttcgttacatccctcagtgtaccaggacagcacctgcagtgcaccggcaaaatatacggctccgtatgggagaaacttcatcgggctttcgctatctggtctggtttcgggatgaccttaactggcgtacacacatgcggagattatatgttcagcggccatactgttgtgctcacaatgttaaacttctttgtcactgaatacaccccacggtcttggaacttcctgcacacactgagctgggtgctgaacttattcggtattttctttatccttgctgcccatgaacattacagcattgatgtgtttatcgccttctacattaccacccggctgttcctctattaccacacacttgctaatacacgcgcttaccagcaatcaagaagggctcggatctggttccctatgttttccttttttgagtgcaacgtgaacggcacagtgcccaatgagtactgctggccattcagtaagccagctattatgaaacgcctgatcggttag

SEQ ID NO: 242573 - DNA, 765 bp, Artificial Sequence
  Description of Artificial Sequence: Synthetic coding sequence
atggcagggccaaaccaattatgtatccgacgatggaccacaaaacacgtggcggtgtggctgaaggatgaggggttcttcgaatatgtggatatactgtgtaataagcataggctggacggcattactctacttaccctaacagaatacgacctgcgcagccctccactagagattaaggttctgggagatattaaaaggctcatgttatctgtgcgcaaactgcagaagatccatatcgacgtcctggaggaaatgggttacaatagtgactcccctatgggatccatgacccctttcatcagtgcccttcagtctaccgattggttgtgcaatggagagctctcacatgactgcgacggcccaataaccgatctcaattcagaccagtatcaatacatgaatggaaagaataagcactccgtccgtcgtcttgacccagagtattggaagactatcctgagttgcatatatgtctttatcgtctttggcttcacgagctttatcatggtcattgtccacgagcgtgtacctgatatgcagacttatccacccctgcctgacatctttttggatagcgtcccaaggattccctgggcctttgctatgacagaagtgtgcgggatgattctgtgctacatttggctgctggtgttgctgcttcataagcaccggagcatactgctcagacgattgtgttcccttatgggaactgtgttcttgctgaggtgctttaccatgtttgtgacatccttaagtgtctag

SEQ ID NO: 242574 - DNA, 1248 bp, Artificial Sequence
  Description of Artificial Sequence: Synthetic coding sequence
atggctgggccaaatcagctgtgcatcagacgatggaccacaaagcacgtggccgtgtggctcaaggacgagggctttttcgagtatgttgacattctatgtaacaagcatcggttagatgggatcacactgctgactctgactgaatatgacctgaggagcccacccttagagataaaagtactgggcgacatcaagaggctgatgttgtcggtgaggaagctgcagaagatccatatcgacgtactggaggagatgggttacaacagcgactcacctatgggaagcatgaccccctttatatccgccctgcagagcacagactggttatgtaatggcgagctgagccacgactgtgatggcccaatcactgaccttaatagtgaccagtatcaatatatgaacggcaaaaataaacatagcgtgcggcgattggaccccgaatattggaagacaatcttgagttgtatttatgtttttatcgttttcggtttcacctctttcataatggtcatcgtccacgagcgtgtgccagacatgcagacctatccaccattgcccgacatctttctcgactcagtgcccaggattccttgggcgttcgcgatgaccgaggtatgtggcatgatactgtgttacatttggctgttggttctgctgctgcataaacatagaagtatcttactgcgacgcttgtgctccttaatgggcacagtgttcctgttacggtgctttactatgttcgtcacatctctaagtgtccctggacagcatctacaatgtacagggaagatctatgggtctgtgtgggaaaagttgcaccgggcattcgccatctggagtggatttggcatgacactgacaggagtgcacacatgtggcgattacatgtttagtggacacaccgtagtgcttaccatgctgaatttttttgtcacggagtacacgcccagaagttggaacttcctgcacacactgagctgggtactgaatctcttcgggatcttttttatcctcgcggctcacgagcattatagcatcgatgtgtttatcgcattctacattaccacaagactctttctctactatcacacgctggccaatacccgggcatatcaacaatccaggcgggctaggatctggtttcccatgttctccttttttgagtgcaacgttaacggaacagtacccaacgagtattgctggcctttctcgaagccagctatcatgaaacggcttattggctag

SEQ ID NO: 242575 - DNA, 4770 bp, Artificial Sequence
  Description of Artificial Sequence: Synthetic coding sequence
atggctaagcagttgaatttaccggagaacactgacgactggaccaaggaagacgtgaatcagtggttggaaagccacaagatagatcagaagcacagggagatcctcacagaacaggacgtcaatggagccgtgcttaagtggctgaaaaaagagcacctggttgatatgggtatcacccacgggcctgccatccagattgaggaactgttcaaagagcttcgcaaaacagccattgaggattccatccagactagtaagatgggcaagccctccaaaaatgctccaaaggatcagacagtgtctcagaaggagaggagggaaaccagcaaacagaaacagaaaggtaaagagaatcctgatatggcgaatccctccgccatgtctactaccgcaaaaggaagcaagagtctaaaggtcgaactaatagaggataaaattgactatactaaggaacggcagccctcaattgatctcacttgcgtgtcctaccctttcgacgaattttcaaacccgtatcggtacaaattagattttagtctccagcccgagaccggacctgggaatcttattgaccccattcatgaattcaaggcatttacaaacaccgctactgccaccgaagaagatgttaagatgaaatttagtaacgaggtgttcagatttgccagcgcctgtatgaacagcaggaccaatggaactattcacttcggcgtgaaggataagccgcatggcaaaattgtaggcatcaaagtgacaaatgacactaaagaagccctgatcaatcatttcaacttgatgatcaacaaatactttgaggaccatcaggtccagcaggcgaagaagtgtattcgggaacctagattcgtcgaggttttgctgcctaactccaccttgagtgaccgctttgtcatcgaagtagacatcattccacagtttagcgaatgtcagtatgattacttccagatcaagatgcagaattataacaataaaatttgggagcagagcaaaaaatttagcctgtttgtccgcgatggaacctccagcaaggatataacaaagaacaaggttgatttccgggcttttaaggcagatttcaaaactcttgcggagagcagaaaggctgcagaagagaaatttcgtgctaaaacaaacaaaaaagagcgtgaaggccctaaactagttaaactgctcaccggaaaccaggatttgcttgataacagctattatgaacagtacatccttgtgacaaacaagtgtcacccagatcagaccaaacacctggattttcttaaagagataaagtggtttgccgtgctcgagtttgaccctgaatcgaatatcaacggagtggttaaggcctacaaagaatccagagtcgccaacctgcactttcctagtgtttacgtggagcaaaagactaccccaaacgagacaatctccaccctgaatctttatcaccagccctcatggattttttgcaatggacggctggatttagacagtgaaaagtacaagccttttgatccatcttcgtggcagagagagagagcttccgatgtgaggaaacttattagcttcctgacacatgaagatattatgcccagaggcaaattcctggtggtcttcctgctcctaagtagcgtggatgaccctagagatcccctgatcgagactttctgtgctttttaccaggatctaaaggggatggagaacatcctgtgtatatgtgtgcacccacacatcttccaggggtggaaagatctgctcgaggctagactgataaaacaccaggacgaaatctcctcacagtgcatttcagcactcagcctggaggagataaatggcaccatcttgaagcttaaatcggttactcaaagtagcaagcgtctcctcccatccatcgggctgtcgacagtgctgttaaaaaaagaagaggacatcatgaccgcgctggagattatctgcgaaaacgaatgcgaaggtactctactggagaaggataagaacaagttcctggagttcaaagcgtcaaaggaggaggacttctacagaggaggcaaagtgagctggtggaatttctacttcagttccgagagttattcttctcctttcgtgaaacgcgataaatatgagcgcttggaggctatgatccagaattgtgctgactccagcaagccaacgtctacgaagataattcacctctatcaccatccgggatgcgggggaacaaccctagccatgcacattctctgggagctgagaaaaaagtttaggtgtgcagttctgaaaaataaaaccgttgacttttctgaaatcggagaacaagtcacaagtctcataacatatggcgctatgaatcgccaagagtatgtacctgtcctgctgttagttgacgattttgaagagcaggataacgtgtacctgctgcagtattccatacaaacggctatcgcaaaaaagtatattcgctacgagaaaccgctggtaataatcttaaactgcatgaggtctcagaatcccgaaaagagtgcgaggatacccgattctattgcagtaattcagcagctgtctccaaaggaacagcgcgctttcgaactgaaactcaaggagataaaagaacagcacaaaaacttcgaagatttctacagtttcatgataatgaagacgaactttaacaaggaatacatcgaaaatgtggtccgcaatatccttaagggtcaaaacatatttacaaaagaagccaaacttttctcgttcctggcactcttaaactcgtacgtccctgatactactattagtctgtctcaatgcgaaaaatttctaggaatagggaataagaaggcattttggggtacagagaaatttgaggacaagatgggtacctattccaccattttaattaagacagaggtaatcgagtgtggtaattactgcggcgtgcgaatcatacattccttgatagcggaatttagtctcgaggagttgaagaaatcctatcacttgaacaagtcccagattatgctcgatatgctgactgagaatctgttttttgacaccggaatgggcaagtcaaaatttctgcaggatatgcacaccttactgctgaccagacacagggacgagcatgaaggggagactggaaactggttctctccgtttatcgaagcactgcacaaggacgagggcaacgaagctgtcgaagcagttctgttggagtcgattcacagattcaaccccaacgcgttcatttgtcaggccctcgcgaggcacttttacattaaaaagaaggatttcggtaatgccctgaattgggctaagcaagctaagatcatcgagcctgataattcatacatcagcgacacactgggacaggtctataagtctaagatcaggtggtggattgaagagaacggagggaacgggaacatcagtgtggacgacctgatcgcgctgctcgatcttgcggagcacgctagctctgcttttaaagagtctcagcagcagtccgaggaccgggagtacgaggtgaaagagagactgtaccccaagagtaagcggagatacgacacctacaatattgcgggatatcaaggagaaatcgaggttggtctgtacaccattcagatcttacagttaatccctttttttgataacaaaaacgagctgtctaagcgttacatggttaacttcgtgtcaggtagcagtgacataccaggcgatcctaacaacgaatataagttggcactgaagaactatatcccttacttaacaaagctgaagttctcactgaagaagagctttgatttcttcgacgagtatttcgtgcttttgaagcccagaaataatatcaagcagaacgaagaagccaagacccgcaggaaagtggccggatatttcaaaaaatacgttgacatcttctgtttactggaagagagccaaaacaacaccgggctgggttccaagttttcagaaccactacaggtggaaaggtgtaggaggaacttggtggccctcaaggcagacaaattctccggtctgttagagtatttaattaagtctcaggaggatgctatcagcacaatgaagtgcattgtgaacgaatatacatttctcctggagcaatgcaccgtgaaaatccagagcaaagagaaactcaacttcatacttgccaacatcatacttagctgcattcagcctacctcaagactggttaaacctgtcgagaagttaaaagaccagcttagggaggtgctacagccaataggcctaacgtaccaattctctgagccctactttcttgcaagtctgctgttctggccggaaaaccaacagctcgatcagcattccgaacagatgaaagagtatgcacaggcactaaagaacagctttaaggggcaatataagcatatgcaccgcacaaagcaacccatcgcttactttttcctggggaaggggaagagactcgaaaggttggtgcataaaggaaaaatcgatcagtgtttcaagaagaccccggacataaattccctgtggcagtcaggcgatgtttggaaggaagagaaagtgcaggaattattgctgcgcttgcagggtcgcgctgaaaacaattgtttgtatatcgagtacggcattaacgagaagattaccatccccattacacctgcgtttcttggacagctccgttccgggaggtcaatagagaaggtgagcttctatctgggattcagcatcggaggccctctggcatacgacatcgaaatcgtgtag

SEQ ID NO: 242576 - DNA, 3852 bp, Artificial Sequence
  Description of Artificial Sequence: Synthetic coding sequence
atggccaaacaactgaatttaccagagaatactgatgactggacaaaagaggacgtcaaccagtggttagaatcacataaaatcgatcagaaacatcgggagattctgaccgaacaggatgtcaatggcgctgtgcttaaatggttaaaaaaagaacatctggtagatatggggattacgcacggaccggcaattcagatcgaggagctttttaaggaactgcgcaagactgccattgaagactccatacagacgtccaagatgggcaagcctagcaagaacgcaccaaaggatcagaccgtatcgcaaaaagagcggagagagactagcaaacagaagcagaaaggtaaggagaacccggacatggcaaacccttcagccatgtctacgaccgccaagggctcaaagtccttaaaggtggagctcatagaagataagatcgactatacgaaagaacgccagccatccattgacctcacatgcgtcagctaccctttcgatgaattttccaatccttaccggtataagctagacttcagcctgcaaccagagaccggaccaggaaacctgatagatccaattcatgagtttaaggcctttacgaacactgccaccgcaactgaagaggatgttaaaatgaagttcagcaatgaggtctttcgctttgcttcagcatgtatgaatagtcggaccaatggcaccatccactttggggtaaaagacaaaccacatgggaagatcgtgggcattaaggtgactaacgataccaaagaggctctgataaatcacttcaacttgatgatcaacaaatatttcgaggaccaccaggtgcaacaggctaagaaatgtatccgggaaccccgattcgtggaggtgctcctccctaactctacgctgtcagatcgatttgtcatcgaggtggacatcatcccccagttctccgaatgccagtacgactactttcaaatcaaaatgcagaactataataataagatctgggaacagtccaaaaaattcagcttgttcgtgcgcgacggaaccagttcaaaggatatcactaagaacaaagtggactttcgtgcctttaaggccgactttaagacattagccgagtctagaaaggctgcagaagagaagttccgggctaaaacaaacaaaaaggagcgggaagggcctaaactcgttaagctgctgactgggaaccaggatctgcttgataacagctattacgagcagtatatactcgtgaccaataaatgccaccctgaccagacaaaacacctggactttctcaaagagatcaaatggtttgcggtgttggaattcgaccctgaaagtaatatcaatggcgtagtgaaggcatataaagagagcagagtagcaaatctgcactttcccagcgtttatgtggaacagaagactactccaaacgaaacaataagcactctcaatctctatcatcagccatcctggatcttttgtaacggtagattggacttagattcagagaagtacaaaccctttgatccttcaagctggcaaagagaacgggcttccgatgtcaggaaactgataagtttccttacgcacgaagatattatgcctagggggaagttcctggtggtttttttactcctaagctcagttgatgaccctagagaccctttaatcgagacattctgcgccttttaccaggatctgaaggggatggagaatatactgtgcatctgtgtgcatccacatattttccagggatggaaagacttgctggaggcccgtctgatcaaacaccaggatgagatatcgtcacagtgtatcagtgccctgagcttggaagaaattaatggcacaatactgaaacttaaatctgtgacacaaagttccaaaagactcctccccagtatcggcctcagcaccgtgctgctgaaaaaggaagaagatattatgaccgctctggagataatttgcgaaaatgagtgtgaggggactctgctggaaaaagataagaataagttcctggaattcaaagcctctaaagaggaggatttctatagaggcggaaaggtttcgtggtggaacttctacttttcttccgaatcctacagctcaccatttgtcaagcgcgacaaatacgagaggctggaggctatgatccaaaattgcgcagacagttcaaagcccacctcaaccaagatcattcacctgtatcatcaccccggttgtggaggtactaccctggcaatgcacatcctgtgggaacttaggaaaaaatttcggtgcgcggttctcaagaacaagaccgtggatttctcggagatcggagagcaagtcacatccctaattacttacggcgctatgaatagacaggagtatgtcccagtactgcttctagtggatgactttgaggagcaagataatgtgtacttgcttcaatattctattcagacagccatagctaagaagtatatccgatacgagaaacctctggtgattattctcaactgtatgcgctcccaaaaccctgagaaaagcgcccgaattcctgacagtatcgctgtgattcagcagttatcacccaaagagcaacgggcttttgaactgaaactgaaagagatcaaagagcagcacaagaattttgaagacttttattccttcatgatcatgaagacaaactttaacaaagaatatattgagaatgtcgtgaggaatatcctaaagggccaaaatattttcacaaaggaagcaaagttgttcagctttctagcccttctaaattcatatgtgcctgacactaccattagcctctcccagtgcgagaaatttctgggaatcggtaacaagaaggcattctgggggacagagaaattcgaggacaaaatgggaacatactctactatcttgataaagacagaggtgatcgagtgtggtaattactgtggagtcagaataatacattccctgatcgccgaattcagcctggaggaacttaaaaaatcttaccatctgaacaaatcccagattatgcttgatatgctcacggaaaaccttttcttcgacacaggtatgggaaagtctaagtttctgcaggatatgcataccctgctacttacgagacacagagatgaacacgaaggggaaacaggaaactggttttctccttttatcgaggccttacataaggacgaaggtaatgaggcagtcgaggctgtgttactggagagcatccaccgctttaatcccaacgccttcatttgccaggctctcgctcgtcacttctatataaagaagaaagactttggcaatgcacttaactgggccaagcaggccaagatcatcgaacctgataatagttacatatcagatacgctgggacaagtctacaagagcaaaatcaggtggtggatagaggaaaacgggggaaacgggaacatatctgtcgatgatctaatcgctttactggacctggccgagcatgcctcatcggccttcaaggagagccagcaacagagcgaggacagggagtacgaagttaaagaaagattgtacccaaagagcaaacgcaggtatgacacatataatatcgccggataccaaggagaaattgaggtgggcctgtacaccattcaaattctgcagctgatccccttcttcgacaataaaaacgagctgtctaaacgctacatggtgaacttcgtctccggttcctcagatatccccggagatccaaacaacgaatacaagctggcacttaaaaattacatcccctacctgactaagctcaagtttagcctgaagaagagtttcgatttcttcgacgaatatttcgtactcttgaagcccaggaacaattag

SEQ ID NO: 242577 - DNA, 4755 bp, Artificial Sequence
  Description of Artificial Sequence: Synthetic coding sequence
atgagtaagcaggtttctctgcctgaaatgatcaaagattggaccaaggagcatgtcaagaaatgggtgaacgaggaccttaagattaatgagcagtacggtcaaatcctcctgtcggaggaagtgaccggcctggtgctgcaggagctgaccgaaaaggacttggttgagatgggcctgccttgggggcctgcgctgctcataaagcgcagctataacaagttgaactccaagtcacctgagtccgacaaccacgaccccggtcagctggataatagcaagccctctaagacagaacatcagaagaatcccaagcacaccaaaaaagaggaggagaactccatgagcagcaacattgactatgaccctcgggaaattcgtgatattaagcaagaggagtctattttgatgaaagagaacgtgctcgatgaggtcgcaaacgctaagcacaaaaaaaagggcaaactgaaaccagagcagctaacctgtatgccttatccttttgatcagtttcacgatagccaccgttacattgagcactacacactacagcccgagaccggagcgctgaatttaattgaccctatccacgaattcaaggcactcactaacaccgagaccgcgaccgaggtggatataaaaatgaagttttcgaacgaggtctttaggttcgcctccgcctgcatgaactctcgtacaaatgggacaatacatttcggcgtcaaagacaagccccacggggagattgtcggcgtgaagatcacttccaaggctgcattcatagatcattttaacgtcatgatcaaaaaatatttcgaggaaagtgagattaatgaagcgaagaagtgtataagggagcctcgcttcgtagaggtgctgctacaaaacaacacccctagcgatagatttgtgatcgaagtagatactatcccgaaacatagcatttgtaacgataaatatttctacatccaaatgcaaatatgcaaggacaaaatctggaagcaaaatcagaatctgtcactgttcgttcgcgaaggagcatcatcgagagatattttggccaactccaaacagcgagatgtcgattttaaggcctttctgcaaaatctgaagtcgctcgtcgccagtcgcaaagaggccgaagaggagtacggcatgaaagccatgaagaaggaaagtgagggtctgaaattagtaaagctgctcatcggaaatcgtgattccttggacaacagttactacgactggtacatccttgtgacaaacaagtgtcacccgaaccagatcaagcacctggatttcctaaaagagatcaaatggtttgccgtgctggaattcgaccctgagtcgatgattaacggggtggtgaaggcttacaaagagagtagagtggctaacctgcattttcccaatcagtacgaagacaagaccacgaacatgtgggagaagatctccactctaaatctgtatcagcagccctcgtggatattctgtaacggcaggagcgaccttaagagtgagacctataagccactcgagcctcacctgtggcagagagagcgcgcaagcgaagtgcggaagctgatattgtttctgactgatgaaaatataatgacaagggggaagttcttggtcgtcttcctgttgctgagttctgttgaaagccccggtgaccctctcattgagactttctgggctttctaccaggctctgaagggtatggagaatatgctttgtatctctgtcaatagccacatatatcagaggtggaaagatctcttgcagactcgcatgaaaatggaagatgaactgacaaatcacagcatttccactctgaacatcgaactggtgaacagcacaatcctcaagctgaagtctgtcacgcggagtagtaggcggtttctacccgctcgcggttcatccagtgtcatcctcgaaaaaaagaaggaggatgtacttaccgccctggaaattttgtgcgagaatgagtgtacagagaccgacattgaaaaggataagtctaagttcctcgaattcaagaagtcaaaggaagaacatttctatcgtggtgggaaagtgtcctggtggaatttctatttctccagcgaaaactattcatctgattttgtgaaaagggattcatacgagaagctgaaggacctgatacactgttgggcagaaagcccaaaacccattttcgcaaaaattatcaatctctaccaccaccctggctgtggcggaacgaccctggccatgcatgttctctgggacctgaagaagaattttcgctgtgcggtcctcaaaaataagaccacagattttgctgagatcgccgaacaagtgattaatctggttacataccgggctaagtctcatcaggattacatccctgttttattgctggtggacgattttgaagaacaagaaaacgtgtactttctgcagaacgcgatccattccgttcttgccgagaaggatctcagatacgagaagacgctggtgatcatcctgaattgtatgagatcacgcaacccagacgaatcagctaaactagcagattccattgccctcaattatcaactgagctctaaggaacagcgggctttcggcgcaaaactcaaagagatcgagaagcagcataagaattgtgagaatttttatagtttcatgataatgaagagcaacttcgatgagacctacatcgaaaatgttgtgagaaacatcctgaaaggccaggatgtggattctaaggaggcacagttgatatccttcctggcattattatcgagttacgttaccgactccaccatatctgttagccagtgtgaaatttttctgggtattatttacacttctactccctgggagcctgagagcctcgaagataaaatggggacctatagcaccctgctgattaagaccgaggtggcagaatacggacgttacacaggagtcagaatcattcaccccctcattgctctgtactgtctgaaggaacttgagaggagctatcatcttgataagtgtcagattgccctcaatatcttggaggaaaacttgttctatgattccggtataggaagagataagtttcaacatgacgtgcagacgctcctgttaaccagacaaagaaaggtctacggtgacgagacagatacgctgttctcccctctcatggaggctctccagaacaaagatattgagaaggtattgtctgcgggatccagaagatttccacagaacgcctttatctgccaggccctggcgaggcacttctacattaaagagaaggactttaacaccgctcttgactgggccagacaggcaaaaatgaaggcccctaagaacagttacatcagcgatacacttggccaagtctacaaaagcgaaattaaatggtggttagacggaaataaaaattgtcgctccatcactgtgaacgacttgacacacctacttgaagccgcagaaaaggcttcacgagcctttaaggagagccagcggcagactgatagtaagaactacgagactgagaattggagccctcaaaaatcccagcgccgttatgacatgtacaatacggcgtgctttcttggcgagatcgaggtgggattatatacgatccaaattctccagctgaccccattttttcacaaggagaacgagttgagcaaaaagcacatggtacagttcctttccggaaagtggactatcccacccgaccccagaaacgagtgttatcttgcccttagtaagttcacctctcacctgaagaatctccagtctgatcttaagcgatgctttgactttttcatcgattatatggtgctgctgaaaatgcgctacacccagaaggagatagctgagatcatgcttagtaaaaaggtttctcgatgttttcggaagtacaccgaattattttgccacctggacccatgcctcctgcagtcgaaggagagtcagctgcttcaagaagaaaattgtcgcaaaaagctagaggcacttagagccgatagattcgccggattgctcgaatacctgaaccccaattataaagacgcgaccactatggaatctattgtcaacgagtacgctttcctgctgcagcagaactctaaaaaacccatgacaaatgaaaaacaaaatagtattctggccaatattatcctgtcatgtttaaagcccaacagtaagctcatccagcctctcactaccctgaaaaagcagctgagagaagtgcttcagtttgtgggcctatcacaccagtacccgggtccatacttcttggcatgcctgttgttttggccagagaatcaggagttggaccaagattctaaattaattgagaaatatgtcagctctctgaaccgcagctttaggggtcagtacaagcgaatgtgtcggagcaaacaagcgtcgaccctgttctatctgggaaagcgcaagggtctgaacagtatagtgcacaaagctaaaattgaacagtactttgataaggcgcagaacacaaattccctctggcattccggcgatgtctggaagaaaaatgaagtaaaagatttgctgcggagactgaccggccaggccgagggaaagctaatcagtgttgaatacggaactgaagagaaaatcaaaatccccgtgattagcgtgtacagcgggccactgaggtctggcagaaacattgaaagagtttctttctatttaggcttcagcattgaaggccctctggcatatgacattgaggtgatctag

SEQ ID NO: 242578 - DNA, 1221 bp, Artificial Sequence
  Description of Artificial Sequence: Synthetic coding sequence
atgtcaaaacaggtgtccctgccagaaatgataaaggattggaccaaggagcatgttaaaaagtgggtgaacgaagatttgaaaataaatgaacagtacggacaaattcttctgtctgaagaagtgaccggcctcgtgctgcaggaactcacagaaaaggacctcgtggaaatggggctcccatggggtcctgctctgctgatcaaacggagctacaataagctgaactcaaaatcgccagagtccgacaaccacgatccagggcagctcgacaactctaaaccctccaagacagagcaccagaaaaaccctaagcataccaagaaagaggaagagaattctatgtcttcaaatatcgattacgacccacgggaaatccgagacattaaacaggaggaatcaatccttatgaaggaaaacgttttggacgaagtagccaacgccaagcacaagaagaagctggaggccctgagggccgatcgcttcgccggtttactcgaatacctcaatccaaactataaggacgccactacaatggagtcaattgtcaacgagtacgccttcctgcttcagcagaactccaaaaagccaatgacaaatgaaaagcagaattccattctagcaaacatcatcctgtcatgtctcaagcccaattcaaagttaattcagcctcttactaccctgaaaaaacagctgcgtgaggtcctccagtttgtcggattgagccaccaatacccaggaccatactttttagcttgtttgctgttttggccagagaaccaggaactggaccaggacagtaagctgattgagaagtacgtatcgtcactgaatagatcattcagggggcagtataaacgcatgtgcaggagtaagcaggcgagcactctcttttatcttggcaagcgaaagggtctgaatagtatcgtgcataaagcaaagattgagcaatattttgacaaagcgcaaaacaccaactctctgtggcacagcggggacgtgtggaagaaaaatgaagttaaggacctccttagacggcttactgggcaggcagaggggaagctcatatccgtggaatacgggacagaggaaaaaattaagataccggtgatttctgtctacagcggccctctccgaagcgggcgtaatatagaaagggtctcattctacctgggattttcaatcgagggcccactggcctatgacatcgaggtcatatag

SEQ ID NO: 242579 - DNA, 4755 bp, Artificial Sequence
  Description of Artificial Sequence: Synthetic coding sequence
atgagtaagcaggtttcattgccagagatgatcaaagattggactaaggaacacgttaagaagtgggtaaacgaagatcttaagattaatgagcagtatggccagattttattgagcgaggaggttacaggcctggtcctacaggagttaacggaaaaagaccttgtggagatgggacttccatgggggccagctctgctcattaagcggtcctacaataaactgaattctaagtcgcccgagagtgataaccatgatccgggacagctggacaacagcaaaccatctaaaaccgaacatcagaaaaaccctaagcacaccaagaaagaagaggagaacagtatgtcttctaacatcgattacgaccctcgagagatcagagatatcaaacaggaggagagcatcttgatgaaagagaatgttcttgacgaggtggcgaacgcaaaacacaagaaaaaggggaagcttaaacctgagcaattgacatgcatgccttaccccttcgatcagttccacgactcacatcggtatattgagcattatactttgcaacccgagactggggctctgaaccttatagacccaatccatgagttcaaggcgctgaccaacaccgagactgccaccgaagtggacattaaaatgaaattcagcaacgaagtcttccggttcgcctctgcctgtatgaatagcagaaccaatggaacgatacacttcggcgtcaaggataagccccatggcgaaatcgtaggcgtgaagatcacctccaaagcagcctttattgaccattttaatgtaatgatcaaaaagtactttgaggaaagcgaaatcaatgaggctaagaaatgcatccgcgaacctcgcttcgtcgaagtcctgttacagaataacacaccctccgaccggtttgtcattgaagtagacacaattcctaaacattccatatgcaacgacaaatacttctatatacagatgcagatctgcaaagacaagatttggaagcaaaaccaaaacttgtcactgttcgtgcgggaaggcgcatcaagtcgcgacatcttagcgaactcaaagcaacgcgatgtcgacttcaaagcttttcttcagaacctcaagtctctggtagcttctagaaaggaggccgaagaggagtatgggatgaaagcaatgaagaaggaatccgagggcctaaagctcgtcaagttactgataggaaatcgggactccctggataatagttattatgattggtacatcctggtcaccaacaaatgccatcccaaccagatcaagcacctggactttctgaaagaaataaagtggtttgccgtgctggaattcgatcctgagagtatgattaacggcgtggtcaaagcatacaaggagtcccgcgttgcaaacttacacttccctaaccagtacgaagataagactactaacatgtgggaaaagatctccacgttgaatctgtatcaacagccgtcatggatattctgcaatggtagaagcgatttgaaaagcgagacctacaaaccattggagcctcacttgtggcaacgcgagagggcctccgaagtcaggaagctgatactgttcctgaccgacgagaacatcatgacccggggaaaatttctcgtggtttttttgttactgagttccgtggagtccccgggtgatcctctgatcgaaacattttgggcgttctatcaagcccttaaggggatggagaatatgttatgcatcagcgtcaactctcacatctatcagcgctggaaggacctgctacagacacgtatgaagatggaagatgaactgacaaatcacagcatctcaactttgaatatcgaactcgtcaactcaaccatcctcaaactcaaaagtgtcaccaggagttctcgaagatttctgcccgcaagaggctcctcctctgtgatactggagaagaagaaggaggatgtattgaccgcgctagagatcctttgcgagaacgaatgtacagagacagacatcgaaaaggataagtccaagtttctcgaatttaaaaagtctaaagaagagcacttttatcgcggtggcaaagtgagctggtggaacttctacttttcgtcagagaactactccagcgatttcgtgaaacgggactcctatgagaaactcaaggatctgatccattgttgggctgaaagtccaaagccaatttttgcaaagataataaacctgtaccaccaccccggttgcggtggtaccaccttagcaatgcacgtgttgtgggatctcaagaagaattttaggtgcgccgtgctgaagaacaaaactacagattttgccgaaatcgcagagcaggtcataaacctggtaacttacagagctaagtcacaccaggattacattccagtgctgcttctggtcgacgattttgaggaacaggagaacgtgtacttcttgcagaacgcaatacactcagttttggccgagaaggacctgaggtatgagaagaccttggtcatcatactgaattgtatgaggagccggaatccggatgagagcgctaaacttgccgactccatagcgctgaactatcaactcagcagtaaagagcagagagcattcggcgctaagctgaaggagatcgagaaacaacataagaattgcgagaatttctattctttcatgataatgaaatctaactttgatgaaacatatattgagaatgtggtccgaaatattctgaagggacaggacgtggacagcaaggaagcacagctgatctcctttctggccctgctgtcttcatatgtgacggactctaccatctcggtttcccaatgcgagattttcctggggattatctatactagcacaccctgggagcctgaatccctcgaggataaaatggggacctacagtactttgctgattaagaccgaagtggccgagtacggcaggtacactggcgtcaggatcatccacccactcattgcgctgtactgcttgaaagaactggaacggtcctatcacctggacaagtgccagattgctcttaacattctggaagagaacctcttctacgactcaggaatcggcagggataagttccagcacgacgtgcagaccttgttgctaacccgccaacgcaaagtatacggggacgaaaccgacaccttgttcagccccctgatggaagctctgcagaacaaagatatcgaaaaggttctgtccgccggtagtaggaggtttcctcagaacgcctttatttgccaagcccttgctagacacttttacataaaagaaaaagactttaatacagccctggactgggcgagacaggctaagatgaaagccccaaaaaactcttacatcagcgatactctgggacaagtctacaaatccgagataaaatggtggcttgacgggaataagaactgccggtccataacggtcaatgacctgactcacctgctagaggctgctgaaaaggctagccgggcttttaaggaaagtcagcgacagacagacagcaaaaactatgaaaccgagaattggtcaccacagaaatcgcagcggcgatatgatatgtacaacacagcatgcttccttggagagattgaggtggggctctataccatccaaatcctgcagttgacaccttttttccacaaagagaatgaacttagcaagaagcacatggtacagttcttatctggcaaatggacaattcccccagaccctcggaacgaatgttatctcgccctctctaagttcacctctcacctcaagaacctacagagcgatcttaaaaggtgttttgacttcttcatcgactacatggtacttctaaaaatgaggtatacgcagaaagagatcgctgagatcatgctctctaagaaagtgtctagatgttttaggaaatacacggaactattttgccatctggatccttgcctgcttcagagcaaagaatctcagctcctccaagaagagaattgccgcaagaaactggaggccttgcgcgctgatagattcgccggactcctggagtacttgaaccctaactataaggacgccaccacgatggaatccattgtgaatgaatatgccttccttttgcagcaaaattcaaaaaagccgatgaccaacgagaagcagaactcgatccttgctaatattattctttcctgtctgaagccaaactcaaaactgattcagcctctgacaactctgaaaaagcagctaagagaggttctccagtttgttggactgtcacaccagtaccctggtccttactttctagcctgccttttattctggccggagaaccaagagctggaccaagactccaaactgatcgagaagtacgtgagttcgctaaatcgctcatttcggggacaatataagaggatgtgcaggagcaagcaggcatcaaccctcttttatcttgggaagcgcaaaggtttgaactctattgtgcacaaggcaaagattgagcaatacttcgataaggcacagaacaccaactcactgtggcactcaggagacgtgtggaagaaaaacgaagtgaaggacctacttaggagattgacaggtcaggctgagggtaagttgatttcagtggagtatggcaccgaggagaagatcaagattcctgtgatatccgtctattccggaccactgcgatccggtagaaacatcgagcgcgtgtccttctacctgggtttttcgattgaagggcctctggcatacgacatagaggtgatatag

SEQ ID NO: 242580 - DNA, 213 bp, Artificial Sequence
  Description of Artificial Sequence: Synthetic coding sequence
atgtctaagcaggtctccctcccggagatgatcaaggattggaccaaggagcacgtgaagaagtgggttaatgaggacctgaaaatcaacgaacagtacggacagatactcctgtccgaagaggtgaccggactggtcctgcaggaactaacagagaaagacctggtcgaaatgggactgccatgggggcctgcactcctgatcaagcggtag

SEQ ID NO: 242581 - DNA, 4755 bp, Artificial Sequence
  Description of Artificial Sequence: Synthetic coding sequence
atgtccaagcaagtctccttaccagaaatgataaaggattggaccaaggaacacgtcaagaaatgggtgaatgaggatctgaagataaatgagcagtacggacaaatccttctgtccgaggaagtgacaggcctcgtcctccaggagctgactgagaaggatctagtagagatgggcttgccctggggacccgcactgctgataaagaggtcttataataagctgaattctaaatctccagagagcgacaatcatgaccctggacaattggataattccaagccttctaagaccgaacatcaaaaaaatcctaaacacacaaagaaggaagaggaaaactcaatgtcaagtaacattgactatgaccccagggaaattcgggacataaagcaggaagagtccatccttatgaaggagaacgttctcgatgaagtggccaatgccaaacataagaagaagggtaaattgaagcccgagcagctcacctgcatgccatatcccttcgaccaattccacgactcccaccgctacatcgagcattatacactgcagccggagacgggcgctctgaacctcatcgacccaattcacgaattcaaagccctaaccaatacagagacggccacagaagttgatatcaaaatgaagttttcaaacgaagtgtttagatttgccagcgcctgcatgaattcacggaccaacggtacgattcattttggcgtgaaggataaaccccacggcgaaatagttggggtgaagattacatccaaggctgccttcatcgaccattttaacgttatgatcaagaaatacttcgaagagagcgagataaatgaggccaagaaatgcattcgggagccaagatttgttgaggtccttctccaaaataacacgccttccgatcgcttcgtgattgaggttgacaccataccgaagcacagcatatgcaacgataaatacttctatattcagatgcagatttgcaaggataagatttggaagcaaaaccagaacttgtccctctttgtccgggaaggagcctccagtagggacattcttgccaatagcaagcagagagatgttgattttaaggcctttctccagaacttaaaatctctggttgcctcccgcaaagaggcagaggaagagtacggcatgaaggctatgaagaaggagagtgagggtcttaagctcgtgaagctattaattggcaatcgcgattccctcgataattcttactatgactggtatatcctcgtaacaaataaatgccaccctaatcaaattaagcatctcgatttccttaaggaaattaagtggttcgctgtcctggaattcgatcccgagagtatgatcaatggcgtggtgaaagcctataaagagtcaagagtcgccaatctgcactttcccaatcagtatgaagataaaaccacaaacatgtgggagaaaatatctacactaaatctgtatcaacagccaagctggattttctgcaacggacggagtgatcttaaatcagagacttataaaccccttgaaccacacctgtggcagcgggaacgcgcatccgaggtcaggaagttgatattatttcttacagatgaaaacattatgacacgcggtaagtttctggttgttttcttgctgctttcatctgtcgagtcccccggagacccattaatcgagaccttttgggctttttatcaagccctgaaaggtatggaaaatatgttgtgcatatcggtgaatagccacatctatcaacggtggaaagatctgttgcaaacaagaatgaaaatggaggatgagctgactaatcattccatcagcaccctgaacatcgagctggtgaatagtacaattctaaaactcaagagcgtaaccagatcgtcccgacgcttcttgcccgctagaggatcctcatctgtcattcttgaaaagaagaaagaggatgtccttaccgccctcgaaatcctctgcgaaaacgagtgtacagagacagatatcgaaaaggacaagtccaaattcctggagtttaaaaagagtaaggaggagcacttttacaggggtggaaaggtatcatggtggaacttctacttttcaagtgaaaactatagcagcgatttcgtgaagagagactcttacgaaaagctaaaggatctgatccactgttgggcagagagtcctaagcccatcttcgccaaaatcattaatctctatcatcaccccggttgcggcggtacgaccctggctatgcatgtgctgtgggacctaaaaaagaattttaggtgtgccgtactcaaaaacaagactacagacttcgcagagatcgccgagcaggtgattaacttagtgacttaccgggcaaagtcacaccaggattatatccccgtcctgttgctggtcgatgattttgaggagcaggagaacgtctacttccttcagaacgctattcatagcgtgcttgccgagaaagacctgcggtacgagaagactctggttatcattctgaactgcatgcgctctcgtaatccggatgagagtgcgaaattggccgacagcattgccctgaactatcaactgtcaagtaaagagcagcgagctttcggcgctaagctgaaggagattgaaaaacagcacaagaactgcgaaaatttctacagcttcatgatcatgaaaagcaacttcgacgaaacatacatagagaatgtagtgagaaacatccttaagggccaggacgtggactccaaagaggcccaacttatttcttttctcgctctgttatcctcttatgtgaccgactcaaccatctcggtgtcccaatgcgaaattttcctggggataatatatacttctacaccctgggaaccagaaagtctcgaggacaagatgggcacctatagtacgctgttgatcaagaccgaggttgccgagtacggcaggtacacaggcgtgcgaattatacaccccctcatcgctctgtattgtcttaaggagctggagcgcagctatcacttggataagtgccagattgccttgaacatcctcgaggagaaccttttttatgattccggtatcggacgcgacaaattccagcatgatgtacagaccttgcttttaaccagacaaaggaaggtgtacggtgatgagaccgataccttattcagcccacttatggaggccctgcagaacaaagatattgagaaagtgctctccgcgggttcgaggcgcttccctcaaaacgcctttatctgccaggcattggcacggcacttttatatcaaagagaaggactttaacaccgctctagattgggccaggcaggctaaaatgaaggccccaaaaaatagctacatctccgataccctcgggcaggtctataagtccgaaatcaaatggtggctagatggcaacaaaaattgtcgctctattacagtcaacgatctgactcatctgttggaagccgcagaaaaggcttctagagcgtttaaagagtcccaaagacaaacggactctaaaaattacgaaaccgaaaattggagtccacaaaagtcccagaggcgctatgacatgtacaatacagcctgtttcctgggagaaattgaagtcggcctgtatactattcagattctgcagttaactccgtttttccacaaggagaatgagctcagcaagaagcatatggtccagtttttaagtggtaagtggacaattccacctgacccccgaaacgagtgctatctggccctgagcaaattcactagtcatctaaaaaacctgcaatccgacctgaagaggtgtttcgatttctttattgattatatggtgctgctcaagatgcggtatacccagaaggaaatcgccgaaatcatgctgtccaaaaaggtgagtcgatgtttccggaagtacactgaactgttctgtcacctggacccctgcctgctgcagagtaaggagagccagctgttgcaggaagagaactgcagaaagaagctggaggccctcagggccgaccgcttcgctggactcctggaatatttgaacccaaactacaaggacgcgacgacgatggagtccattgtaaacgagtacgcctttctcctccagcagaacagtaaaaagcccatgactaacgaaaagcaaaacagcatcctggccaacatcatactgagctgcctcaaacccaattccaagcttatccagccacttactactttaaagaagcagctcagagaagtgctgcagttcgtgggcctttcccaccagtacccgggaccatacttcctggcatgtctcctgttctggccagagaaccaagagctcgaccaggattctaaactaatcgaaaaatacgtatcctccctgaatcgctccttccggggtcagtacaagcgtatgtgccgcagcaaacaggcaagcacgcttttctatctggggaaaaggaagggacttaactccattgtccataaagctaaaattgagcagtattttgataaggcccagaacacaaacagcttatggcacagcggcgatgtctggaaaaaaaatgaagttaaggatctgcttcggcgactcactgggcaggccgaaggtaaattgatcagcgtggagtacggtacggaagaaaagattaagattcctgtgatctcagtatatagtggaccactccggtcaggccgtaatattgaacgggtctccttttatctcggcttcagcattgaaggaccactcgcgtacgatatcgaggttatttag

SEQ ID NO: 242582 - DNA, 213 bp, Artificial Sequence
  Description of Artificial Sequence: Synthetic coding sequence
atgtccaaacaggtgagccttccggaaatgataaaggactggacaaaagagcacgtgaagaagtgggtaaacgaggacctgaagatcaacgagcagtacgggcagatcctactttctgaggaggtgacaggcttggtgctgcaggagttgacggaaaaggacctggtcgagatggggttgccatggggtcccgctctcctgattaaacgctag

SEQ ID NO: 242583 - DNA, 213 bp, Artificial Sequence
  Description of Artificial Sequence: Synthetic coding sequence
atgagcaaacaggtgtcactcccggaaatgataaaggactggactaaggaacacgtgaagaaatgggtgaacgaggacctgaagattaacgagcaatacggtcaaatccttctgtcggaggaagttactgggctggtgctgcaagaactgacagagaaagacttagtggagatggggctgccctggggcccagcccttctaataaaaaggtag

SEQ ID NO: 242584 - DNA, 213 bp, Artificial Sequence
  Description of Artificial Sequence: Synthetic coding sequence
atgagcaagcaggtatcactgcctgaaatgattaaggactggacgaaagaacatgtaaagaaatgggtgaacgaggacctgaagatcaatgaacagtatggccagatcctcctgtcagaggaagtgacaggactcgtgcttcaggaattgactgagaaagatctggtcgagatgggtctgccatgggggccagcattattaatcaagcggtag

SEQ ID NO: 242585 - DNA, 957 bp, Artificial Sequence
  Description of Artificial Sequence: Synthetic coding sequence
atggcaccatgggcggaggcagagcacagcgcacttaaccccctgagggcggtgtggctgactttaaccgccgcattcctgttaacccttttactgcagctcctgccccctggcctcctccctggctgcgctatcttccaggaccttatcagatatggcaaaaccaagtgcggcgaacctagccgaccggcagcctgtcgcgcatttgatgtaccaaaaagatacttttctcacttctacataatatctgtgttgtggaatggatttctcctctggtgtctgacccaatccctcttcctcggggcaccctttccaagctggctacacgggctgcttcggatccttggggctgcccagtttcagggtggagaactggcactatcagccttccttgtcctggtgtttttgtggttacactccctccggcgtctgttcgaatgcctgtatgtgtccgtgttctctaacgttatgattcatgttgttcaatattgtttcggacttgtatactacgttctggtcggattgaccgtgcttagtcaggtcccaatggacggtaggaacgcttatattaccgggaagaaccttctgatgcaggcccgatggtttcacatactggggatgatgatgtttatctggtctagtgcccaccagtataagtgtcacgtaattctgggaaacctgcgaaaaaacaaggccggagtggtgattcactgtaaccatcgtattcccttcggtgactggttcgagtacgtaagtagcccgaactatttggccgaactaatgatctacgtttctatggccgtgactttcggcttccataatctgacatggtggctggtggttaccaatgtgttttttaatcaggctttgagtgcatttctgagtcaccagttttacaaatctaagtttgtatcttacccaaagcaccgcaaggcttttcttccttttctgttttag

SEQ ID NO: 242586 - DNA, 711 bp, Artificial Sequence
  Description of Artificial Sequence: Synthetic coding sequence
atgacacgatgccctgcagggcaggcagaggtggaaatggccgagttgtacgttaagcccggaaacaaggagcggggatggaatgatcctcctcagttcagttacggtctgcaaactcaggcagggggtccaaggcggagcctgctcacaaagcgggtcgcggctcctcaggacggcagcccacgtgtgccagcatccgaaaccagcccgggacccccacctatgggcccacccccaccctcgtccaaggcccctcgctcgcctcctgtcggctccggcccagcaagtggcgtggagcccacctcctttccagtggaatccgaagccgttatggaagatgttttacgcccattagagcaggcgcttgaggactgtaggggccatacacgaaaacaagtttgtgacgatatctccaggcgactggcccttttgcaagaacagtgggccggtggcaagctgagcatccccgtgaagaagagaatggcccttttagtccaagaactctcctcgcatcgatgggacgcggctgatgatatccaccggtcgctcatggttgaccacgtcacagaggtctctcaatggatggtgggcgttaaaaggttgatcgcagaaaagagatccctgttctctgaagaggccgctaatgaggaaaaaagtgctgctacggctgagaaaaatcatactatccccggatttcaacaggccagctag

SEQ ID NO: 242587 - DNA, 681 bp, Artificial Sequence
  Description of Artificial Sequence: Synthetic coding sequence
atggaaggctgtgtttcgaatctcatggtttgcaacctcgcttattccgggaaactggaagagcttaaagaaagcatcctggccgataaatcactggcaacccgaacagatcaagacagtcgcacagctctgcactgggcttgttctgcaggccacaccgagatcgtcgagttccttcttcaattgggggtgcctgtaaacgataaggatgatgctgggtggagcccactccacattgccgcttcagccggaagggatgagatcgtcaaggcccttcttggcaagggtgctcaggtgaatgctgtgaaccagaatggttgcactccgctccattacgcggcttctaaaaatcgccatgagattgccgtaatgctgcttgagggcggagcaaatccagacgccaaagatcactacgaggccactgccatgcacagagcagctgcaaagggaaatttgaaaatgatccatatactgctttactataaggccagcacaaatatccaggacacggagggcaatactccattacaccttgcttgcgacgaggaaagagtcgaagaggccaagttgctcgtaagccagggcgcttcaatttacatagagaacaaggaggagaaaactcctcttcaggtggccaaaggcggactcggcctgatcttgaagcgaatggtagaaggatag

SEQ ID NO: 242588 - DNA, 780 bp, Artificial Sequence
  Description of Artificial Sequence: Synthetic coding sequence
atggccacggccactggagtggcagaggaacggctgcttgccgcactagcgtacctacaatgtgccgtcggctgtgctgtattcgcccgtaatcgccagacaaactcggtgtacggaaggcacgccctgccttcccatcggcttagagtccccgctagagccgcttgggtggtacaggaattaccctcactggcccttccgctttaccagtacgcatccgaatctgccccacgccttagatcagctccgaactgtattttgcttgctatgtttctcgtgcattacggtcatcgttgcctgatatatccttttttgatgcggggaggtaagccaatgcctcttctcgcttgtaccatggcaattatgttctgtacatgtaacggctacctgcagtcgcgctacctgagccattgtgccgtctatgccgacgattgggtgaccgacccacggtttttgatcgggttcggtctgtggcttaccggtatgctgattaatatacactccgatcacatcctgagaaacctgagaaaaccaggcgacactgggtacaagattcctaggggaggcctttttgagtacgtgacagcagcgaactactttggcgagattatggagtggtgtggctatgctctggcctcttggtcggttcagggggctgcatttgccttttttactttctgctttttaagcggaagggctaaggagcaccacgaatggtacctgcgaaagttcgaggagtatcccaagtttagaaaaatcattatcccgttcctcttctag

SEQ ID NO: 242589 - DNA, 585 bp, Artificial Sequence
  Description of Artificial Sequence: Synthetic coding sequence
atggaacatgctgcacagccttggagatggcaaaggagacgtggctggagaagatcagcctgctggccccgaagccctacatgttcggccccttgggctgccagatcgtctagagcaatcgtgcgcagaacacagtgtaccgccgctacaaggtgcccggctacggggagcgaatgccgacgagggcctccgggatggtgtcgcagctgtcctagatggccctgtaggtcaacctctactcccgcatctccacctagagtgagcgccgcaaggccgactgcttctagctggccctgctcctctagcacaacagggatcgggaacgtcggtatgcaagcattagccgtttgcctgcacccaaaatgccagcctatggtccccatcgtctgccctgatcttaatcacgatagtaagactcagagagagatcgccggaatcagatgctcctacagtctgttgggaaacacagccgcttccaggcggatccctacatctttaatgacccaacacttaaatgctcacctcctcgccaatacatgcttcgctgtgaatcagtatgaagtgtttcttggggttctggcatag

SEQ ID NO: 242590 - DNA, 639 bp, Artificial Sequence
  Description of Artificial Sequence: Synthetic coding sequence
atggaacacgccgcacagccatggagatggcaaaggaggagggggtggagacgctctgcctgctggcccagatccccaacctgtagcgcgccatgggctgccagatccagtagagctatcgttagacggactcaatgcaccgccgctacacggtgtccagccactggctctgagtgtaggagggggccaccaggttggtgtagatcatgccctcgatggccatgtagaagcacttcaacaccagcgtccccacctagggtcagcgccgcaagacccactgctagctcctggccctgcagctcctcaacaacaggaattggcttcggcctgtggctgactggcatgttaatcaacatccatagcgaccacattctgaggaacctccggaaacctggagataccggttataagatacctcggggaggcctgttcgaatacgtgaccgcagccaactatttcggggaaatcatggaatggtgcggatacgctctggcaagttggagtgtccaaggtgccgcatttgcgttcttcactttctgctttctatcgggcagggccaaagaacaccacgaatggtatctgaggaagttcgaggaatatcctaagtttagaaaaatcataattcccttccttttctag

SEQ ID NO: 242591 - DNA, 858 bp, Artificial Sequence
  Description of Artificial Sequence: Synthetic coding sequence
atgttgctcgcaacattcaagctctgcgccggatcatcttatagacatatgcgtaatatgaaaggcctacgccaacaggccgtgatggccatctcccaggagctgaacagacgagcgctcggcggtcccacaccgtctacctggatcaatcaggttcgtaggaggtcgagcctacttggttcgcgtcttgaggaaacactgtactcagatcaggagctggcttacttacaacaaggagaagaagcaatgcagaaagccctcggcattctaagtaaccaggaggggtggaaaaaggaatcgcagcaggacaatggggacaaggtgatgtctaaagtcgtacctgatgtcgggaaggtgtttcgcttggaagtggtcgtcgatcaacccatggagcgcttgtatgaggagctggtggagaggatggaagcaatgggggaatggaacccgaacgtgaaggagattaaagtgctgcaaaagattggcaaagacacatttattacccatgagctggccgctgaagccgctggcaacctggtgggtcctagagattttgtctcagtaaggtgcgccaaacggcgaggttcaacttgcgtgctggcagggatggcaacggattttggcaacatgcccgaacagaaaggtgttatccgggctgagcatggtcccacctgtatggtgctgcacccgcttgccggaagcccttctaagacaaaactcacctggcttctttcgattgatctgaaaggttggttaccaaaatcaatcattaaccaggtgctgagccagacacaggtggatttcgccaatcatctgcgtaaaaggctggagtcacatccggctagtgaagctagatgctag

SEQ ID NO: 242592 - DNA, 744 bp, Artificial Sequence
  Description of Artificial Sequence: Synthetic coding sequence
atgttgctggcaacctttaaactatgtgcgggtagctcctatcgccatatgaggaacatgaaaggcagccggctggaggaaaccctgtacagcgatcaggaactggcttatttgcagcagggggaggaggccatgcagaaagctctcggcattctgagcaatcaggagggttggaaaaaggagtcacagcaagataatggtgataaggttatgtcgaaggtggtccctgatgtcgggaaagtgtttaggctcgaggtagtggtggaccagcctatggagcggctgtacgaagagcttgttgagcgcatggaggccatgggggaatggaaccctaacgtgaaagagataaaggtgctgcagaaaattggaaaggatacctttattactcatgagttggctgctgaggccgctgggaatctggtcggtcctagagatttcgtcagcgtcaggtgtgctaaaagaagaggatcaacctgcgtgcttgccggtatggctactgactttgggaacatgcctgagcaaaagggagtgatcagagccgagcatggacctacctgtatggtcctccatccacttgcaggtagccctagcaaaactaaactcacttggctcctctccatcgaccttaagggatggttacccaaaagcatcataaaccaggtgttgtcacagacccaggtggattttgccaaccatctacggaagcggctcgaaagtcaccctgctagcgaagcacggtgttag

SEQ ID NO: 242593 - DNA, 969 bp, Artificial Sequence
  Description of Artificial Sequence: Synthetic coding sequence
atgtcatcttccccttgggagcccgcaaccctccgccgagtatttgtcgtgggagtcggcatgacaaagtttgtgaaacccggagctgagaactcaagagactatcccgaccttgcggaagaagccggaaagaaggcccttgcagatgcccagatcccgtactctgcggtggaccaggcctgcgtggggtatgtcttcggtgtagccgaatgtgtcctggcgctaggcttcgagaagatgagtaaaggatcattagggatcaaatttagcgacagaaccatacctactgacaagcacgtcgatttgctgattaataagtatggtctgagtgcacatccggtcgccccacaaatgtttggttatgcaggaaaagaacacatggagaagtatgggaccaagattgaacactttgcaaaaattggttggaagaatcacaagcatagtgtcaataacccttactcacagtttcaggatgaatacagtctggatgaagtgatggccagcaaagaggtatttgactttttgaccattctccagtgctgtcctaccagcgacggcgcagccgcagcgatactcgctagcgaagcattcgtacaaaagtacggactgcagagcaaggcagttgagatccttgcacaagagatgatgacggacctgccctccagctttgaggaaaagagcattatcaaaatggtcggattcgatatgtcaaaggaggccgcacggaagtgctacgaaaagtccggactcacacctaacgacatcgacgtcatcgaattgcacgattgcttttcaacaaatgagttactgacatacgaggccctgggcctgtgtcccgagggacaaggagctacactcgttgatcggggagacaatacatacggaggaaagtgggtcattaatccaagtggcggactaatttctaagggccaccctctgggggcaaccggcggtcactcatgttcatag

SEQ ID NO: 242594 - DNA, 1644 bp, Artificial Sequence
  Description of Artificial Sequence: Synthetic coding sequence
atgagttcatcgccctgggaacctgccacgttaaggagggtgttcgttgtcggagtgggaatgacaaagtttgtgaagcctggggctgaaaattcccgggactatcccgatctggccgaggaggctggtaagaaggccctggctgatgcgcagatcccctactccgctgtagatcaggcctgcgtgggctacgttttcggggactctacttgtggccagagagccatttatcattcccttggaatgacaggcataccgatcatcaacgtgaataacaactgcgctacagggtctaccgccctattcatggctagacagttgatacaagggggagtcgccgaatgcgtgctggcactggggttcgagaaaatgtctaaaggctcgctggggattaagttttctgaccgaaccattcctaccgacaagcatgtggacctactgatcaataaatacgggttaagtgcccacccagtggctccccagatgtttggctacgctgggaaggaacatatggaaaaatacggtaccaaaattgaacactttgccaagattgggtggaagaaccacaagcactccgttaacaatccgtattcccagtttcaggatgagtacagcctggacgaggtaatggcctcgaaagaggtctttgacttcctaaccattctccagtgttgcccaacctcagacggcgcagcagccgctatcctcgctagtgaagcatttgtgcaaaaatatgggctgcagtctaaagccgtcgaaatcttggctcaagagatgatgactgacctccctagtagcttcgaggagaaaagcatcattaagatggtcggatttgatatgagcaaagaagcagcacgtaagtgttatgaaaagtcgggactcaccccgaacgacattgacgtgatcgagctgcacgattgtttttccacaaatgaattgctcacttacgaggctttggggctatgccctgagggtcagggtgctactcttgtcgatcgaggtgataatacatacggaggcaagtgggtcataaacccgtctggcggactcatcagcaagggccacccgctaggcgcaaccggactggctcagtgcgcagagctgtgttggcagctcaggggcgaagcaggtaaacgtcaggtccccggtgcaaaagtagcccttcaacataatctgggcattggcggagcagtcgtagtaacgctctacaaaatggggttccccgaagccgctagttcttttcggacccatcagatcgaggccgttccaacctcaagcgcgagcgacggatttaaagccaatctggtgtttaaagagatcgagaagaagctggaagaagagggcgagcagttcgtcaagaaaattgggggaatatttgcttttaaggttaaggatgggcctggaggcaaagaggcgacttgggttgtggatgtcaagaacggaaagggctccgtgctaccaaatagcgacaaaaaagccgactgtacaatcactatggcagattctgactttttagctcttatgaccgggaagatgaatcctcagtcagccttttttcaaggtaaactgaagataacaggcaatatgggtctggctatgaaacttcagaacctccagctacagccaggaaacgcaaaactgtag

SEQ ID NO: 242595 - DNA, 1572 bp, Artificial Sequence
  Description of Artificial Sequence: Synthetic coding sequence
atgtcatcatccccgtgggaaccagcaactctccgtagagttttcgttgtgggcgtggggatgaccaagtttgtgaagcccggagccgagaacagtagggattacccggatctggctgaggaggctggggactctacctgcgggcagcgagctatttatcactcactcgggatgacagggatccctatcattaatgttaataataattgcgcaactggctctaccgctctgttcatggcaagacagcttattcaagggggagtggcagagtgtgtgctagccctgggttttgagaagatgtctaaaggaagccttggtatcaagttttccgaccgcacaatccccacagacaagcatgtcgatctgcttatcaataaatatgggttaagtgcacatcctgtggcgccacagatgttcggatacgcgggaaaggagcatatggaaaagtatgggacaaaaattgagcattttgccaagattggatggaagaatcataagcactctgtaaacaatccttacagtcagtttcaggatgagtattctctcgatgaggtgatggcctccaaggaagtgtttgacttccttacgatattacaatgctgtcctacaagcgatggggctgctgctgccattttggcatctgaagcctttgttcagaaatatggactgcagtccaaggctgtggaaatcttagcacaggaaatgatgaccgatctcccctcttcctttgaagagaaatccatcattaagatggtcggcttcgatatgtccaaggaggcggctcggaagtgttacgagaaatccgggctgaccccaaacgacatagacgtgatcgagctgcacgattgtttctctaccaacgagctgctgacttacgaagcactgggtttatgtccagaaggacagggtgccacactggttgatcgcggagataacacttacggcggaaagtgggtgatcaacccatccgggggattgatttctaaaggacatccgttaggcgctaccggcctggcacaatgtgctgaattgtgctggcagctgcgcggtgaggcgggtaaacggcaggtgcccggagccaaagttgccctccaacacaacctcgggataggcggagccgtagtagtgacactatataagatggggttcccagaggcagctagcagctttagaactcaccagatagaggctgtgcccacaagcagcgccagcgatggctttaaggctaatctggtgtttaaggaaatcgagaaaaagctcgaagaggagggagagcagttcgttaaaaagatcggcggtatcttcgcgttcaaggttaaagacggacccggaggcaaggaagcaacatgggtggtggacgttaagaatggaaagggcagtgtattgcccaattctgataaaaaggctgattgcacaatcacaatggctgatagtgatttcctcgccctgatgacaggcaaaatgaatccgcagtccgcattcttccagggaaagctgaagatcactgggaacatgggcctcgctatgaagctgcagaacctgcagctgcagcctggaaacgcaaaactatag

SEQ ID NO: 242596 - DNA, 180 bp, Artificial Sequence
  Description of Artificial Sequence: Synthetic coding sequence
atgggctttccggaggccgcttcgtcttttcgcacacaccagattgaggctgtcccaacctcttcagcatctgacggttttaaagccaacctggtattcaaggagatcgaaaagaagcttgaggagataaggcggttgaccgctcagagtcagtggttgacacagaccagctggttatag

SEQ ID NO: 242597 - DNA, 423 bp, Artificial Sequence
  Description of Artificial Sequence: Synthetic coding sequence
atgggatttcccgaggccgcaagaactcaccagatcgaggccgtgcctactagcagcgcatccgacggctttaaagccaatctcgtgttcaaagagatcgaaaaaaaactggaagaggaaggggaacaatttgtgaaaaaaattgggggaattttcgcttttaaagttaaggacgggccagggggaaaagaagccacctgggtcgtcgatgtaaaaaatgggaagggtagcgttctacccaacagcgataaaaaagcggactgtactatcactatggctgattcagacttccttgccctgatgactggtaaaatgaaccctcagtctgcattctttcagggcaagctcaagattacgggtaacatgggcctagccatgaagctccagaatctccagctccagcccggtaatgcaaagctctag

SEQ ID NO: 242598 - DNA, 432 bp, Artificial Sequence
  Description of Artificial Sequence: Synthetic coding sequence
atgggcttcccagaagcagcaagcagcttccgcacccaccaaatagaagcggtacccacttcctcagccagcgacggatttaaagccaacctggtctttaaagaaatcgagaagaaactggaagaggaaggggaacaatttgtcaaaaagattggaggtatctttgccttcaaggtcaaggatggtccaggaggaaaagaggccacctgggtcgtcgatgtgaagaatggtaagggatctgtgctccccaattcagataagaaagctgactgtacaatcacaatggcggattctgatttcttagcgctgatgaccggaaaaatgaacccccagagcgcttttttccaggggaagcttaaaatcactgggaacatgggcctggccatgaagctccagaatctgcagctgcagcccggaaacgcaaaactgtag

SEQ ID NO: 242599 - DNA, 180 bp, Artificial Sequence
  Description of Artificial Sequence: Synthetic coding sequence
atggggttccccgaggcagcatcttccttccgaacgcatcagattgaggccgtgcccactagctcagcctctgacggttttaaggccaatctcgtctttaaggaaatagaaaagaagctagaagagataaggcgcctgaccgcccagtcacaatggttaacacagacctcctggctctag

SEQ ID NO: 242600 - DNA, 1401 bp, Artificial Sequence
  Description of Artificial Sequence: Synthetic coding sequence
atgactggcatcccaattattaacgtgaataacaattgtgcaactggcagcaccgctctattcatggctaggcagctcatccagggcggagtggcagagtgtgtactcgcgctaggctttgagaaaatgtcaaagggatcacttggcattaagttcagtgaccgcacgatccccacagataaacacgtggatctgctgatcaacaagtatgggctttcagcacatcccgtagccccacagatgtttggttacgctggcaaggaacacatggagaaatatgggaccaaaattgagcattttgccaagatcggatggaagaaccataaacattctgtcaataatccttatagccagttccaggacgaatactctcttgatgaggtaatggcgtcgaaggaagtgttcgactttctgacaattctgcagtgctgccccacttctgacggagccgctgcagctatcctggcttctgaggcattcgtacagaagtacggattgcagtctaaggccgtcgaaatcctcgcccaggaaatgatgacagacctgccatcctcgtttgaagagaagagtatcattaaaatggtgggcttcgacatgagcaaagaggccgctcgtaagtgctacgaaaagtctggactcacaccaaacgacatcgacgtgatagaactgcacgactgcttcagtacaaatgagctgcttacctacgaggccctggggctgtgccctgaagggcagggagccactttggtggatagaggagataatacatacggaggtaaatgggtgattaatccttccggcggactgatcagcaagggccaccccctgggggctaccggattggcacagtgcgccgaactgtgttggcaattacgcggtgaggccggtaagaggcaagttccaggcgcaaaagtggccttgcagcacaacttgggtatcgggggtgcagtggtggtgaccctctacaagatgggtttccctgaggcggcatcgagtttccgaacgcaccagattgaggctgtgcccaccagcagtgcttccgatgggttcaaggctaacctggtgttcaaggagatcgaaaagaaactggaagaagaaggcgagcagttcgtcaagaaaattgggggtatttttgctttcaaagtgaaggatggaccaggtggcaaggaagccacctgggttgtggatgtcaagaatggaaaaggcagcgtgctgcctaactccgataaaaaagccgactgcacaatcaccatggcagatagcgactttctagccctaatgaccggcaagatgaatcctcagtcagcattttttcagggcaagttgaaaatcaccggcaacatgggcctagccatgaagctccaaaacctacagctgcagcctggtaacgccaagctttag

SEQ ID NO: 242601 - DNA, 1512 bp, Artificial Sequence
  Description of Artificial Sequence: Synthetic coding sequence
atgtcgtcctcaccgtgggaacctgcaaccctccggagagtgtttgtcgtgggcgttgggatgacaaaatttgtgaaacctggcgcagagaactcccgggattaccctgatctagcagaagaggcagggaagaaggcactcgccgacgctcagattccatactccgcggtcgatcaggcatgcgttgggtatgtctttggagtcgctgagtgtgtcttggcactagggttcgagaaaatgagtaaaggctcactgggcatcaaattctcagataggacaattccaacagataagcatgtggatttattgatcaacaagtacggcttaagtgcccaccccgtggcacctcaaatgtttggctatgccggaaaggaacatatggagaagtatggtaccaaaatcgagcacttcgctaagattggatggaagaaccataaacacagcgtgaataatccatattcacagttccaggatgagtactctttggatgaggtgatggcttcaaaagaagtgttcgacttcctcactattcttcaatgttgtcccacatccgatggcgcagcagccgctattctcgcaagtgaggcttttgtccaaaagtacggcctccaaagtaaggccgtggaaattctggctcaggaaatgatgactgatctgccgtcctccttcgaagaaaaatccataatcaaaatggtgggattcgatatgagcaaagaggccgcacggaagtgttacgaaaagtctgggctcactccaaatgatatcgacgtgatagagctccatgattgtttctccacaaacgagttactgacttacgaagccctgggcctttgtccggaaggacaaggggctaccttggtcgatagaggcgataatacctacggtggaaagtgggtgattaatccatctggcggactgatatcaaaggggcatccactcggagctacaggcttggcgcagtgcgccgagttgtgctggcagcttcgaggggaggctggaaagcgtcaggtgccaggggctaaggtagctttacagcataatctgggaattgggggtgctgtggtggttacgttgtacaagatgggattccctgaagccgcatctagcttccgtacacaccagatcgaggcagtacctacctccagcgcatccgacgggttcaaggcaaacttggtattcaaagaaattgagaaaaagttggaagaggagggggaacagtttgtgaaaaaaatcggcggtatcttcgcttttaaggtgaaggacggtccgggagggaaggaagccacctgggttgttgatgtaaaaaatggaaaggggtctgtcctgcccaatagtgacaagaaggctgactgtacaatcacaatggccgactccgacttcctggccttgatgactggtaagatgaacccccagagcgcctttttccaagggaaacttaagattactggcaatatggggctggcaatgaaactccagaacctgcagctacagccgggtaacgcgaaactgtag

SEQ ID NO: 242602 - DNA, 1653 bp, Artificial Sequence
  Description of Artificial Sequence: Synthetic coding sequence
atggtcggcgaagagaagatgtctctgcggaaccgcttgtcgaaatccagggagaatcccgaagaggacgaagaccagcgaaaccccgcaaaagagtcactagagacaccctccaatggccgaatagatataaagcagttgatcgccaagaagattaaactaaccgccgaagcagaagaactgaagccattcttcatgaaagaggtcgggagtcattttgacgatttcgtcactaacctgatcgagaagtctgcttccctggacaatggcggttgcgcgctgacaactttcagcgtgctggaaggagagaagaacaaccatagggcgaaggacctcagagccccacctgaacaaggcaaaatctttatagctaggcgctcccttttggacgaactgctcgaagtcgaccatatccgcaccatctaccacatgttcattgctctgctcattctgttcatactcagcacattggtggtggattacatcgatgagggtagactcgtattggagttcagtctgctgtcatacgcatttggcaagttcccaactgttgtgtggacttggtggattatgttcctgagtaccttcagcgttccttactttctgttccaacattgggcaacagggtacagcaaaagcagccatcccctcattaggtccctttttcacggttttctcttcatgatctttcaaatcggcgttttgggatttggtcccacgtatgtcgtgcttgcttatactctccccccagcctcacgatttatcatcatcttcgagcagatcagatttgtgatgaaagctcactcattcgtacgcgagaatgtgccgagggtcctgaactcagcaaaggagaagtcgtctacagtccccatccccactgtcaatcagtacctgtacttcctcttcgctcccacactgatctacagagactcatacccgagaaacccgacggtccggtgggggtatgtcgccatgaaatttgcccaggtgtttgggtgttttttctacgtttactatatcttcgaaaggctgtgcgctcctctcttccgaaacattaagcaggaaccgttctctgccagagtgctggtcctctgcgtgtttaactcaatcctccctggtgtgttgatactcttcttaacctttttcgcttttctgcactgctggctgaatgccttcgctgagatgctgcggtttggcgataggatgttctacaaggattggtggaattctacttcttattccaattactacagaacttggaatgtggttgtgcatgattggttgtactactatgcttataaggattttctctggttttttagcaagcgctttaagtctgcggcaatgttggcggtgtttgccgtgagtgcagtagtgcatgagtatgcattggccgtgtgtctttccttcttctaccctgttctgtttgtgttatttatgttcttcgggatggcattcaactttatagttaacgacagtcggaaaaagcccatttggaatgtgttaatgtggacttctctgttcctagggaatggtgtcctgctgtgcttctattcacaagagtggtacgctagacagcactgtccactgaagaatcctacatttcttgattacgttcggcctcgaagttggacctgccgatatgtgttctag

SEQ ID NO: 242603 - DNA, 783 bp, Artificial Sequence
  Description of Artificial Sequence: Synthetic coding sequence
atggtgggcgaagaaaaaatgagtcttcggaacagactgtccaagagcagggaaaatccagaggaagatgaggatcagcggaatcctgccaaagaatccctggaaacccctagtaacggcagaatagatataaaacagctcattgccaagaagatcaagctgaccgccgaagctgaagagctgaaaccgtttttcatgaaagaagttggctctcatttcgatgactttgtcaccaatctgattgagaagagcgcctcccttgacaacggcggatgtgccctgaccacgttctcggttctcgaaggtgaaaagaataaccatcgggctaaagatctgagggcccctccagagcaggggaagatctttatcgccagaagatctctgcttgacgagctacttgaggttgatcacattcgcactatctaccatatgtttattgccttacttatcttgttcattctgtctacccttgtagtagattatattgacgagggacgactggttctcgagttctctcttttaagttatgcatttggcaaattccctaccgtcgtctggacatggtggatcatgtttctgtcgacgtttagtgtcccatactttctctttcagcactgggcaactggttattctaagtcctcacatccgctgatcagaagtctatttcacggatttctgttcatgattttccagatcggggtgttggggttcggacctacctatgtggttctggcctacaccctgccacctgcttctaggtttataataattttcgagcaatag

SEQ ID NO: 242604 - DNA, 861 bp, Artificial Sequence
  Description of Artificial Sequence: Synthetic coding sequence
atgaaggctcattcctttgtgcgggagaatgtcccacgagtcttgaactccgccaaagaaaaatcctcgaccgtgcccataccgacggttaatcaatatctttattttctctttgcaccgacgctgatctatagagactcttatcccaggaatcctacagtaagatggggatatgtcgctatgaaattcgctcaagtcttcggttgtttcttctatgtgtactacatctttgaacgcctgtgcgcacccctgtttagaaacataaagcaggaacccttcagtgccagggtgctggtgctgtgtgtctttaacagcattctaccaggagtgctcatcctgtttctgaccttttttgcttttttgcattgctggttaaatgctttcgccgaaatgcttcggtttggtgatcgaatgttttataaagactggtggaactcaacatcatattccaactattaccgtacctggaatgtggtggtccacgactggttgtattattatgcttataaagacttcttatggttcttctccaagaggtttaagtctgctgccatgctcgctgtgttcgcagtgagcgctgttgtccacgagtacgccctggccgtatgccttagctttttctaccccgtacttttcgtgctgtttatgttcttcggcatggccttcaactttattgtgaacgacagtcgcaagaaacctatatggaatgttcttatgtggacttcactgtttttgggcaatggcgtcctgttgtgcttctacagccaggagtggtacgcccgacaacactgcccactcaagaatccaacattccttgactatgtacgaccacgctcttggacctgtaggtacgtgttttag

SEQ ID NO: 242605 - DNA, 1458 bp, Artificial Sequence
  Description of Artificial Sequence: Synthetic coding sequence
atgaaagaagtcggcagtcactttgatgattttgtgactaacctgatcgagaaatctgcctcactggacaacgggggatgcgcccttaccaccttcagtgtgctggagggcgagaaaaataaccaccgcgcaaaagacctgagagcccctcccgagcagggcaaaatctttatcgctagaagatctcttctggatgaactcctggaagtggatcacatcagaaccatatatcacatgtttattgccctgctcatcctcttcatcctcagcacacttgtcgtggactacatcgatgagggccgattggttctggagttttccctgctgtcatatgcattcggcaagttccccactgtcgtgtggacatggtggatcatgttcttgtccactttctccgtgccttatttcctgttccagcactgggccacaggttatagtaaaagcagtcaccccctgattcggtccttattccacggcttccttttcatgatttttcagattggcgtactgggatttggtcccacgtatgttgtcttggcgtatacactgccgcctgcctcccgctttatcattatttttgaacaaattagatttgtcatgaaagcgcacagctttgttcgcgagaacgttcctcgggtgttgaattccgctaaagagaagtcatcaacggtgcccatccctactgtcaatcaatacctctactttctgtttgcgcctactctgatctatcgggatagctatccccgtaaccctacagtccgttggggctacgttgctatgaaatttgctcaggtcttcggctgtttcttctacgtctattacatcttcgaacggttatgcgccccactgtttcggaatatcaagcaggaacccttttcggcccgagtcctcgtgctgtgtgtgtttaacagcatactgccaggcgtcctcattttgttcctgactttttttgcattcctccattgctggctgaatgcgtttgctgaaatgttacgatttggcgatcgaatgttttacaaagactggtggaactctaccagctactctaactattaccgcacttggaatgtggtggttcatgactggctctactactatgcatataaggactttctgtggtttttcagcaagaggttcaaaagcgctgccatgctggcggtatttgccgtgagcgctgtcgtgcacgaatatgcccttgccgtgtgcctgtcttttttctatcctgtcctatttgtgttgtttatgtttttcgggatggctttcaactttattgttaatgactctcgcaagaaacccatttggaacgtgttgatgtggacttcgttattcttgggcaatggcgtacttctgtgtttttattctcaagaatggtacgctcggcagcactgcccactgaaaaatccaacctttttggattatgtgaggccaagatcctggacctgccgatacgtattttag

SEQ ID NO: 242606 - DNA, 1479 bp, Artificial Sequence
  Description of Artificial Sequence: Synthetic coding sequence
atggagctgaaaccgttctttatgaaagaagtgggttcccatttcgacgatttcgtgactaacttgattgagaagtccgcatcactggataatgggggttgtgcacttactactttcagtgtgctggagggggaaaaaaacaaccaccgcgctaaagatcttagggcaccaccagagcagggcaagattttcattgctcggaggtcattgctagatgaactgctggaggtggaccatatcaggaccatttaccatatgttcattgcactgttaattcttttcatcctgagtaccttagtggttgactatatcgacgagggacgcctggttctggagttctccctcctctcttatgcattcggcaagtttccgactgtcgtgtggacatggtggataatgttcctgtcgacattttccgttccttattttttgttccagcattgggctactggctactcaaaatcatcacacccgctcatccgctccctttttcatggtttcctttttatgatattccagatcggagtccttgggttcggacccacatatgttgtgctggcttacaccctgcctcctgctagtcgatttattatcatttttgaacagatccgatttgtgatgaaagcccactcttttgtgcgggagaatgtcccacgcgtcctgaattcagctaaggaaaaatccagcacagtgcctattcccacagtgaaccagtatctttatttcctctttgctccaactttaatataccgcgacagctaccccaggaaccctaccgtacggtggggttacgtcgcaatgaaatttgctcaggtgttcgggtgcttcttctacgtctattatatcttcgaacgcctctgtgcgcctttatttcgcaacattaaacaggaacccttcagcgccagggtgctcgttctatgcgtcttcaattctatactcccaggtgtcctaattctgttccttacgttcttcgccttcctccattgctggctgaatgctttcgcggagatgctgcgtttcggcgacaggatgttctacaaggactggtggaactcaacctcatactcaaattattatcgtacctggaatgtggtagtccacgactggctctattactacgcatacaaagacttcctctggttcttcagcaagaggtttaaaagcgcagcaatgctggccgtgttcgccgtgagtgccgtcgttcacgagtacgctctggcagtgtgtctctcctttttctacccagtgctgttcgtcttgttcatgttcttcgggatggcctttaactttatcgtgaacgattcaaggaagaaacccatctggaatgtactgatgtggacctcgctgttccttggcaacggcgttctcctgtgcttttatagtcaggagtggtacgcgagacagcactgccctctgaaaaatcctacatttttggactacgtgcgcccacgttcatggacttgtcgctatgtattttag

SEQ ID NO: 242607 - DNA, 1569 bp, Artificial Sequence
  Description of Artificial Sequence: Synthetic coding sequence
atggaaccgggtggggcacgtctcaggctccagaggaccgaaggcttaggaggcgaaagggaacgacaaccctgtggggatggaaacaccgaaacacaccgagctccggacctagtacagtggactagacacatggaagcggtgaaagcacagctactggaacaggcacaggggcaactaagggaactgctggaccgagcaatgagagaggccattcagagctaccccagtcaggataaaccgctcccacctccacccccagggagtctgtcacgcacacaggaaccttctctgggaaagcaaaaagtttttatcattcggaaaagcctcctcgatgaactgatggaagtacagcactttagaactatttaccacatgtttattgcaggactgtgtgtgttcattatttcaactctggccatcgacttcatcgacgaaggtagattactgctggagtttgacctgctgatctttagctttggacagctcccacttgctttggtgacctgggtgcccatgttcctcagtactctcttagcaccttaccaggccctgagattgtgggcacgcggtacatggacccaagctactggactgggatgcgctctgttggctgcacacgcagtagttctctgtgccctaccagtgcacgttgcggttgagcaccaacttcctcctgccagcaggtgtgttctagttttcgagcaagtacggttccttatgaaatcctattcttttctcagagaggctgttcctggaactctgcgggcaagacggggtgaaggcattcaggctcctagcttttctagttacctttacttccttttttgcccaacccttatataccgggagacatacccacgaacaccatacgttcgctggaattacgttgccaagaatttcgcgcaagcactgggctgtgtcctttacgcttgtttcatcttaggcaggctgtgcgtcccggtctttgctaacatgagccgagaacccttcagcactagggcactggttctctctatactccatgcgactctgccaggtatttttatgctgttgttaattttcttcgcattcctgcactgttggttgaacgcctttgccgagatgctgcgctttggagacaggatgttctaccgtgattggtggaatagcacttctttcagcaattactatcgcacctggaatgtagtggtgcacgattggttgtactcttacgtttatcaagatggcctgagacttttgggcgctcgggcacgaggcgttgctatgctaggcgtgtttctagtgtcagctgtggcccacgagtacattttctgctttgttctggggttcttctatcccgtaatgctcattttatttctggtaatcgggggtatgctgaattttatgatgcacgatcagcgcacgggccctgcttggaatgtgctgatgtggaccatgcttttcttgggtcaaggcattcaggtgtcgctctattgccaggagtggtacgcacgcagacattgcccactgcctcaggccacattttggggacttgttaccccacgttcttggtcgtgccatacttag

SEQ ID NO: 242608 - DNA, 3426 bp, Artificial Sequence
  Description of Artificial Sequence: Synthetic coding sequence
atggacgattctggggagctcggagggctcgaaactatggaaactctcacagagttaggagatgagctcaccctgggagacatcgatgaaatgttgcagttcgtatccaatcaagttggagagttccccgacctttttagtgaacagctgtgtagctcctttcccggaagcgggggaagcggctcttctagcggatcatcgggaagttcatcatcctccagcaacgggagaggatcctcctcaggagctgtagaccctagcgttcagagatctttcacacaggtgactctgccatccttttccccgagcgcagcctccccccaggctcccacgttacaggtcaaggtgagtcccacctctgttcccaccaccccccgagccactccaatactccagcccagaccccagccccagccccaaccgcagactcagctgcaacagcagactgtgatgattaccccgaccttttccactactccgcagacccgcattattcaacaaccccttatataccagaatgctgccacttccttccaagtgctacaaccccaggtacagagtcttgttacctcctcccaagttcagcctgtgaccatccagcagcaggtacagacggtgcaggcccagcgggtgttaacacagactgctaatggcaccctgcagacacttgctcccgctaccgtgcaaacagtagcggcaccacaggttcagcaggttcccgtgctcgtccagcctcaaatcatcaaaactgattcattggtccttaccacccttaagactgatgggagtcctgttatggctgcagtgcaaaaccccgctcttacggctctcactacaccgatccaaactgccgctctgcaggtgccaacactcgttggtagtagtggcacaatcctgacaacaatgcccgtcatgatgggccaggaaaaggtcccaattaaacaggtccctggtggagtgaaacagttagaacctccgaaagaaggagaacgtcggacaactcacaacattattgaaaaaaggtatagatcatcaattaatgacaaaattattgagttgaaagatttggtcatgggtacagatgctaaaatgcacaagtctggtgtgctacggaaagcaatcgactatattaagtaccttcagcaggttaatcataagctgcggcaggagaacatggtcttgaaattagccaatcagaagaataaactcttgaaggggattgatctcggatcccttgtggacaacgaggtggacctgaaaatcgaagactttaatcagaatgtcctgctgatgagccccccagcttcagactccggatctcaggcagggttctctccttatagtattgacagcgagccaggctcaccactcctcgacgatgccaaagtgaaggatgaaccggactctccacctgtggccttgggaatggtcgacagatctcggattctgctgtgtgtgttaacgtttctatgtctctcatttaatcccctaacatctctgcttcaatggggaggtgcacacgacagcgatcagcacccccattctgggagtgggaggtccgtcctctccttcgaatcaggaagcgggggatggttcgactggatgatgccaactctgctcctatggctcgtaaatggggtcattgtcttgtctgtgttcgtgaaactcttggtgcatggggaaccggttattagaccacactcacgatccagcgtgacattctggagacatcggaaacaggccgatctcgatttagcccgaggcgactttgctgctgcagccggtaacttacagacatgtcttgcagttctgggacgcgctctgccaacttcgcgtctagatctggcttgctccctgtcctggaacgtgatccggtattcactccaaaagttgcgactggtccgctggctcctcaagaaggttttccagtgcagacgtgccacacctgctaccgaggcaggattcgaagatgaggccaaaacgagcgccagggacgccgctctggcataccaccgattacatcaattgcacatcacaggcaagttgcccgctgggagtgcttgttctgacgttcacatggcactatgtgcagtgaatcttgctgaatgtgccgaagagaagataccgccatctaccctcgtggaaatccaccttaccgctgccatgggactgaaaactcgctgcggtggaaaactgggctttctcgcctcatatttcctgtcacgggcacaatcactgtgcgggccagaacacagcgcggtgccagacagcctgcgatggctgtgtcaccccttggggcagaagttcttcatggagcgaagttggtcagtgaagagtgcagcgaaagagagcctttactgtgcacagagaaacccggctgatcctatcgcccaagttcatcaagcattttgcaaaaacttgctggaaagagccatcgaaagtctggtaaaaccgcaggcaaagaagaaggctggtgatcaggaagaggagagctgcgaattcagctctgctctggaatatttgaaactcctgcatagtttcgtggattctgttggcgtcatgagccccccattgtcacgcagctccgtactgaaatcagcccttggtcccgacatcatttgccgctggtggacatctgccatcacggtggctatcagttggctccagggggacgatgctgctgtgaggtcccatttcaccaaggtggaacgaattcctaaagcccttgaggttacagagagcccactggtcaaggcaatctttcatgcttgcagggcgatgcatgccagtcttccaggaaaagctgacgggcagcagtcctctttctgccactgtgagcgtgccagcggacatttatggagttcattgaacgtgtccggagccacctccgacccagcgctcaaccatgtagtgcagctcctcacctgcgatctgctcctcagcctccggacggccttatggcagaaacaggcatctgctagccaggccgtgggagagacctatcacgccagcggcgctgagttggcgggatttcagagggacctcggaagcctgcgcagattagctcactcgttccgccctgcgtaccgcaaagttttcttgcatgaggccacagtcagattgatggccggagcttcacctactaggacacaccaactgctggaacatagtctccgacgacgcactactcagtccacgaaacatggcgaagtggatgcttggccgggtcagcgggagagggctacagcgatactgctggcgtgtcggcacctgcctctttcttttctttcctctcctgggcagagagcagttttactggccgaggccgctcgaacacttgaaaaagttggcgatcgcagatcttgcaacgactgccagcagatgatcgttaaactgggcggaggcactgcaatcgccgcttcatag

SEQ ID NO: 242609 - DNA, 2055 bp, Artificial Sequence
  Description of Artificial Sequence: Synthetic coding sequence
atggacgactccggcgagctcgggggattggaaaccatggagactctgaccgaactaggagatgaactcaccctgggggatatcgatgagatgcttcagtttgtgtcaaatcaagtgggagagtttcctgacctgttcagcgaacagctctgttcctcgttccccggtagtggcggatcaggatccagctcaggctcctcaggttcatcttcttcttccagcaatggccgaggaagctctagcggcgctgtggacccctccgttcagcggtcattcactcaggtaacactaccttccttttcgccctcggctgcctcaccgcaagcccctacactgcaagtgaaagtgtccccaacatcggtccccactacgcccagggcaactcccatccttcagcctcggcctcagccacagccacagccacagacacagctgcaacagcaaacagtcatgataacccctaccttttcaaccactccccagacccggatcatacagcagccacttatatatcaaaacgcagccacttcatttcaggtgctccaaccccaggtacagagtctggttacctcttcccaagtccaacccgtcacgatacagcagcaggtgcagacagttcaagcccagcgggtgctcactcagaccgccaacggcacgctgcaaaccttagctcccgcaaccgtacaaaccgttgctgcccctcaggtgcagcaagtgcctgtgctggtccaaccgcagatcattaaaacagacagcctggtcctaaccactttgaagactgatgggtcaccagtaatggcagcagtccagaatcctgccctgacggccctgactacacccatccaaacagctgcacttcaagtacctaccctggttggtagctctggtacaatactgactactatgccagttatgatgggccaggagaaggtgccaatcaagcaggtcccagggggagttaagcaactggagccacctaaggagggcgaaaggcgaactacacacaacatcatcgagaaaagatatcggtcttccattaatgacaagattatcgagctcaaggacctcgtgatggggaccgacgcaaaaatgcacaagtccggagttcttagaaaagccatagattatataaagtacttgcagcaggttaatcacaaactgcggcaggagaatatggtgctaaaattagccaatcagaagaacaagctgttaaaggggatcgatctgggttcgctagtggacaatgaagtggacctcaagattgaggatttcaatcaaaacgtgctgctgatgagccctcctgctagcgatagcgggtctcaggcgggtttttccccctactcaatcgacagtgaaccagggtccccattgttggatgacgcaaaagtaaaggacgagcctgatagcccgcctgtggccttaggcatggtggacaggtctcgtatcctgctatgtgtgctgacgttcctatgcctgtctttcaatccgctgacttctctgttacagtggggcggtgcacacgactccgatcaacacccccactcaggcagtgggcgaagtgtgttgagctttgagtccgggagcggaggttggtttgattggatgatgcccactctcctgttatggctggtgaacggagtgattgtgctgagcgtatttgtgaaactgctcgtacatggagagcctgttattaggccccatagccgaagtagtgtcaccttttggaggcaccggaagcaggcggatttggacttggccagaggcgtctacggtaaaaaatctggcgctacgcactctatcgaagaggaactgaatattcatatttcccggggtactaggacccggaccctcttatccagcagacgtttttgcagttgctgtcgacaaccgaccaatctgccaggcagcttcgggccaggtaccgctcatctccctccaggcccaggtctgcaaccgttgctagagagggacccgcttcagccagccgaggccacacccggtgctctcgctgcgcaggaatctctccctgtgcccgcaggacatgcatcacactag

SEQ ID NO: 242610 - DNA, 3309 bp, Artificial Sequence
  Description of Artificial Sequence: Synthetic coding sequence
atggatgattctggggagctgggaggtttagagaccatggaaaccctgaccgagctcggggacgaactgactctgggggacatcgacgagatgcttcagtttgtgtccaaccaggtaggggaattccctgatttgttttctgagcagctttgctcctcttttccgggaagcggcggatcaggcagctctagcggcagcagcggtagtagtagttcttcaagtaatggaaggggtagcagctctggggcagtggatccctcagtgcaaaggagcttcacccaggtgactttgcctagcttctccccttccgcagcatcaccacaggcccctacccttcaagtaaaggtctcaccaacatccgtgccaacaacgccacgcgcaactcctatcctgcagccacgtccccagcctcagcctcagccccagacacagttacagcagcaaacggttatgatcacccccactttcagcactacaccacagacccggattatccagcagccactgatttatcaaaacgctgccacaagctttcaggtcctgcagccccaggtacagtcccttgtcactagctcacaggtgcagcccgtgactatccagcagcaggtacagaccgtccaggcccagagggtcctgactcagactgcaaacggcaccctgcagacattggctcccgcaacagttcagacagtcgcggctccccaagtgcagcaggtgccggtgctggttcagccacagatcatcaaaactgacagtcttgttttgacaacacttaagacggacgggtctcccgtgatggctgctgtacaaaacccggcattgaccgcactgactacacctatccagaccgccgctttgcaggtccctactctggtcgggtcatcagggactatcctaacgaccatgcccgtcatgatggggcaggagaaggtgcctatcaagcaggtgcctgggggagtaaaacagctggaaccgccaaaggagggagaacgaagaacgactcataacattatcgaaaaacgataccgctcaagcattaacgacaagattatcgaactgaaggatctggtgatggggaccgacgctaagatgcataaatccggcgtcctcaggaaagctatcgactatattaagtacctccaacaggtcaatcataagctgcgccaggagaacatggtgttgaagctcgccaatcagaagaataaactgttaaaaggaatcgacctgggctctttggtcgataatgaagtggacctgaaaatcgaagatttcaatcagaacgtgctgctgatgagtcccccagcctcagattccggaagccaggcaggcttcagcccgtacagcatcgacagcgagcccggtagcccgctgttggatgacgccaaggtgaaggatgaacccgattcaccgccagtggcactgggaatggtggatcggtctcgaatcctactctgtgtcctgacgttcctctgtctctcctttaacccccttacatcactcttgcaatggggtggggctcatgatagcgaccaacacccacattccggatccggaagatctgttttgtcctttgagagcggatctgggggatggtttgactggatgatgccaaccctcctgctgtggctggtaaatggcgtcatcgtcctatcagttttcgtcaagctgctggttcacggtgagccagtgatccgaccacacagccgatcttctgtaacgttttggcgccatcgtaagcaggccgatctagatctcgccagaggagattttgctgccgcagccggtaatctccagacatgcttagccgtcctgggccgagctttacccacatcgagacttgatctcgcgtgttccctgtcctggaatgttattcgatactccctgcagaaattgagactggtgaggtggcttctcaagaaagtctttcaatgccgccgagccacccccgctactgaggcgggattcgaggatgaggccaaaacatccgcaagggacgcagcactggcataccaccgcctccaccagctgcatattacggggaagctgccggcaggcagtgcctgttcagacgtgcatatggctctttgtgctgtaaacctggctgaatgcgcggaagaaaagatcccaccgtccacactggtggaaatccatctgactgcagccatggggctgaaaacgagatgtggcggtaaacttggcttcttagcaagctacttcctgtcgcgtgcccagtcactgtgcggccctgagcatagcgcagtccccgactccctcaggtggctgtgccacccccttggccagaagttttttatggaaaggagttggtcagtaaagtctgccgcaaaggaaagcctgtattgtgcccagaggaatcccgctgatcccatcgcccaggtacatcaggccttctgcaaaaacttgctggaacgagccatcgaatccttggtgaaaccgcaggcaaagaagaaggctggcgaccaagaggaagaatcttgcgagttctcttcagcactcgaatacctcaaactcctgcattcattcgtggattctgtcggcgtaatgtctccccctctgagcaggtcttccgttctgaagtccgccttagggccagacatcatctgccgctggtggactagcgccataacggttgccatttcctggttgcagggggatgacgcagctgtccgctcacatttcaccaaagttgaaaggatccccaaggcattggaagtcactgaatcacccctggtaaaggctatctttcacgcgtgcagagctatgcacgcttcactcccgggaaaggcagatggccagcagtcctcattttgtcactgtgagagggcatcggggcacctttggagcagcctgaacgtaagcggtgccacgtcggaccccgcattgaaccacgtggtgcaattgctgacttgcgatctgttgctctcactgaggacggctctgtggcagaaacaggctagtgcctctcaagccgttggagagacgtaccatgcatcgggcgctgagctggcaggcttccaaagagatcttggttctctgaggagattggcccattccttcaggcccgcatacaggaaggtgttcctgcacgaggccacagtgaggctcatggccggtgcctctcctacaaggactcatcagctcctggagcactccctcaggaggagaactacgcagtcgacaaaacatggagaggttgatgcatggccaggtcaacgagaaagagcaaccgccatccttctcgcctgcaggcatttaccgttgagttttctgccttgtctgcagccatcgtag

SEQ ID NO: 242611 - DNA, 648 bp, Artificial Sequence
  Description of Artificial Sequence: Synthetic coding sequence
atgcatgctagcttaccgggaaaagctgacggacagcaatccagcttctgtcactgtgagagagcctcaggtcacctgtggtcgtctctgaatgtgtccggggcaaccagcgatcctgcactgaaccacgtggtgcaactgcttacctgcgatctcctcctgagtttgagaaccgccctctggcagaagcaagcaagcgcctctcaggccgtcggagagacataccatgcatcaggagcagaactcgcgggatttcaacgcgacctgggctctctgagaaggctcgcccattcctttcgtccagcttatagaaaggtatttctgcacgaagccaccgtgcgcttgatggctggagcgtctccaaccagaacacaccagctcctggagcatagcctgcgccgaaggacaacccaaagcaccaagcacggtgaggttgatgcatggccaggacaacgggaaagagctaccgccattctactcgcgtgcagacatttacccctaagctttttatcctcccccggacagcgggcagtgctgcttgctgaagccgctcggaccctggagaaagttggggataggaggtcatgcaacgactgccagcagatgatcgtcaaactggggggaggcacagccatcgcagcgagctag

SEQ ID NO: 242612 - DNA, 900 bp, Artificial Sequence
  Description of Artificial Sequence: Synthetic coding sequence
atggacctggtccttcgcgtggcagattactatttcttcaccccatacgtctaccctgcgacttggcccgaggatgacatctttcgccaggctatcagcctcctgatcgtaaccaatgtaggggcttatatcctctacttcttttgtgctacactttcatactattttgtgttcgaccatgctcttatgaaacacccccagtttctgaagaaccaggtccgcagagaaattaagttcacagtccaggcactcccatggatcagcattctgacggtggcgctttttttgttagaaatccgcggatacagcaagctgcacgatgatctcggggaatttccatacgggctttttgagttggtggtgtctatcattagcttcttgtttttcaccgacatgtttatatactggatccacaggggcttacatcataggcttgtgtacaaaagactccataagcctcaccatatttggaaaatccctacaccgttcgcctcacatgctttccaccccatcgacgggtttctccagagtctgccatatcatatctatcctttcatcttccccctccacaaagtggtatatctctcgctctacatcctggtaaacatttggacaataagtattcatgacggtgactttagggttccccagatactgcagcccttcattaacggctctgctcatcacactgatcatcacatgttctttgattacaactacggccaatacttcactctgtgggatagaatcgggggaagctttaagaacccatctagctttgaagggaaggggcctctatcctatgtgaaggagatgacagagggtaaacggtcatcacattctggcaatgggtgcaagaatgaaaagctctttaacggggaattcaccaaaaccgagtag

SEQ ID NO: 242613 - DNA, 900 bp, Artificial Sequence
  Description of Artificial Sequence: Synthetic coding sequence
atggatctggtgttaagagtcgctgattattacttctttactccatacgtttaccccgcaacttggccggaggatgacatttttcggcaggcaataagtctgttaatcgtaacgaatgtgggtgcttacatcctgtacttcttctgtgccaccctgtcatactattttgttttcgaccatgctcttatgaaacatccacagtttctgaagaaccaagttcgccgtgagataaagtttaccgtgcaggctctgccttggatcagcatcctgacggttgcactctttctgctagagattagggggtactccaagctccatgacgacctcggggagttcccatacggactgttcgagctggtagtgtctatcatctcatttcttttcttcacagacatgttcatatattggatccacagaggcctgcatcataggttggtgtacaaacgtctccacaagccgcatcacatttggaagattccgaccccgttcgcatcacatgctttccacccgatagatgggttcttacagtctctgccctaccatatataccctttcatcttccccctacacaaagtggtgtatctctccctgtacatcctggtcaatatctggaccatttccatccacgacggggatttccgcgtgccccagattctgcagcccttcatcaatggaagcgcccatcacacagatcaccacatgttctttgattacaactatggacagtactttacactgtgggatcggattggcggtagtttcaagaacccaagctcttttgagggtaagggcccactgtcatatgtgaaggagatgacagaaggaaagcgctcatcccattctggcaatggttgtaagaatgaaaaattgtttaacggcgagtttacgaaaactgagtag

SEQ ID NO: 242614 - DNA, 192 bp, Artificial Sequence
  Description of Artificial Sequence: Synthetic coding sequence
atggagggtgctggcgctggcagcggatttcggaaggagctggtgagcaggttactgcacctgcactttaaggacgataaaaccaaagaggccgctgttaggggggttaggcaggcacaggcggaagatgcactgcgggtggatgttgaccagctggagaaagtactgccccagctcctgctggacttctag

SEQ ID NO: 242615 - DNA, 246 bp, Artificial Sequence
  Description of Artificial Sequence: Synthetic coding sequence
atggagggcgctggcgctggctccggttttagaaaagagctcgtgtcccgactccttcacttgcacttcaaggacgacaagactaaagtgtccggcgacgctctgcagttaatggtcgaattacttaaggtgttcgtggtggaggccgcagtgagaggcgttcgccaggcccaggcagaggatgccttacgcgtggatgtcgatcagttagagaaggtgctgccccagttgctcctcgatttttag

SEQ ID NO: 242616 - DNA, 2121 bp, Artificial Sequence
  Description of Artificial Sequence: Synthetic coding sequence
atggggggtaagggtggtggagatacacggggaccagttctgtttccctgtcagctagcccaagcactgtcccctagacgcgcttttcctagagaactcaaagagaaaggtcagcggatgagctcccaacccgcaggaaatcagacctccccaggggctacagaggattactcctatggcagctggtatattgacgaaccccagggcggagaggagcttcagccagaaggagaggtgcccagttgtcacacgagcattccccctggcctctaccacgcctgtctggccagcctgtctatcctggtactccttttactcgccatgttggtgcgacgcagacaactctggcctgactgtgtgcggggtcgccctggcttgccttctcctgtcgatttcctggcaggagatagaccgcgtgctgtccccgcagctgtgttcatggtgctgctgagtagcctatgcttactcttgcctgacgaggatgccctgccctttctgactctcgcatccgctccatcccaagacggtaaaaccgaggcgccacggggagcctggaaaatcctgggcctgttttattacgcggctctgtactatcccctagcggcttgcgcaactgccggacacaccgccgcacatctcctgggctccaccctgtcctgggctcacctgggagtgcaggtgtggcagcgggcagagtgtccacaggtacccaaaatctacaaatactattctctcctagcctctctgccactgctgctcggcctaggttttctgagcctgtggtatccagttcagctcgtgcgctccttctctcgcaggaccggcgctgggtcaaaaggacttcagtcatcatatagtgaagagtatctccgaaatcttttgtgtcgtaagaagctgggatcttcctatcacacatctaaacatggcttcctcagttgggcccgtgtgtgcctcaggcattgcatttacacacctcagcctgggttccacctcccccttaaactggtactgagcgctacgctgactggaaccgccatctatcaagtggcgctactcctgctggtcggcgtggtccctactattcagaaggtgcgtgccggagttactaccgatgtttcctatctgctagctggtttcggaattgtgctttctgaagacaaacaggaagtggttgaactagtgaaacaccatctctgggccttggaagtctgctacataagcgcccttgtcctgtcctgtcttttgacctttctggtcttgatgcggagccttgttacccacagaaccaatctgagagctctacatcgcggagcagctctggacctgtccccgctacaccggtccccgcacccctcacgacaagccatcttttgctggatgagctttagtgcctatcaaacagcatttatttgcttgggtctgcttgtgcaacagatcatctttttcctggggacaaccgcactggcgtttctcgtcttgatgccagtgctgcacggcaggaacctcctcttgtttagaagcttagaatccagctggccattctggctaacacttgctctggctgtgatccttcagaatatggccgctcattgggtattcctggaaacccacgatggtcacccccaactaactaaccgtcgggtgttgtacgcagcgacgtttttgctgtttcctcttaatgtgttggtgggcgctatggtagcaacatggcgggtgctgttgagcgcactttataacgccatacatttaggccagatggacctctcgctgctgccacctcgtgcagcaaccctcgaccccggttactacacgtatagaaactttctgaagatcgaggtgagtcagagtcaccccgctatgaccgccttttgttccctgctgctgcaagcgcagtcgctgttgcccaggactatggctgcccctcaggactcccttagacctggcgaagaggatgagggtatgcagctcctgcaaactaaagacagcatggccaaaggtgccagacccggtgccagccgcggacgagcaaggtgggggttggcgtacactttgctgcacaatcctaccctgcaggtctttcgaaagacagccctgttgggagcgaatggcgcacagccctag

SEQ ID NO: 242617 - DNA, 2004 bp, Artificial Sequence
  Description of Artificial Sequence: Synthetic coding sequence
atgtcctcacagccagcaggcaatcagacttcgccaggcgctaccgaggactactcatacggctcctggtatatcgatgagcctcaaggtggagaggagctacagcctgaaggcgaggtaccaagctgccatacctcaatcccccctggcctgtaccacgcgtgcctggccagcctgtctattctagtccttctcctactggccatgcttgttcgacgcagacagctctggccggactgcgtccggggaaggcccggtctgcccagtcccgtggatttcttagcgggagatcggccaagagccgttccggctgctgtatttatggtgttgctgagctctctgtgtctgctgctcccagatgaagatgccctccctttcttgacccttgcctccgcccctagccaggatggtaaaacggaagcgcctagaggagcatggaagatcctggggttgttctattatgccgctctgtactacccactcgcagcttgcgctacggccggtcacactgccgcacacctgctcggctcaactctgagctgggctcatctgggagtgcaggtctggcagcgcgctgagtgcccacaggttcccaagatctacaaatattattctctgctcgcttcccttccccttctgctgggtctcggatttctcagtttatggtaccccgtgcagctggtccgcagcttctcgcgccgaacgggcgctggatcgaaagggcttcagagtagctattccgaagagtacctgcggaacctcctctgccgaaagaagctgggcagcagctatcacacaagcaaacacgggttcttgtcctgggctagagtctgcttgcggcactgtatatacacacctcaaccaggtttccatctgccactgaagctagttctctcagctaccctcactggcaccgcaatttatcaggtggcactgttgcttctggttggagtggttcccactatacaaaaagtacgcgctggcgttaccaccgacgtatcctaccttttagccggattcggaattgtcctgtccgaagataagcaggaggtggtcgaattggtgaagcaccacctatgggccttggaggtatgctacattagtgctctcgtgctgtcttgcctgctcaccttcttagttcttatgcgtagcctcgtgacccaccgaactaatctccgagccttacaccgcggtgcggctctcgatctgtctccattgcacaggtctccccacccaagtaggcaagcaatattctgctggatgagtttctctgcttaccagactgccttcatttgcctggggctcttagtccagcagattatcttcttccttggaactactgccctagcttttctggttctcatgcctgttctgcacgggcgtaaccttcttctgtttcgcagcctggagagcagctggcctttctggctcacacttgctttagcagttatcctgcaaaacatggcagcccattgggtttttttggagacgcacgacggccatcctcagctgacaaaccgcagagtcttgtatgcagccacattcctcctgttccctctgaatgtcctggttggtgctatggtcgctacctggagggttttgctgagcgccctgtataacgctatacatctgggccagatggatctatcactgttgcctcctcgggcagccacccttgatcctggttactatacataccggaactttctcaagatagaagtctctcagagtcaccccgcaatgacagctttctgctctcttctgctacaggcgcagagcttgttacccaggaccatggctgcccctcaggactccctacgcccaggagaggaggatgaagggatgcagttactgcagaccaaagattccatggctaagggggctcgcccaggagcctctagagggagggctcggtgggggcttgcttatacactcctccacaatccgactttgcaagtattcagaaagacggctcttcttggcgcaaatggcgcacagccttag

SEQ ID NO: 242618 - DNA, 2004 bp, Artificial Sequence
  Description of Artificial Sequence: Synthetic coding sequence
atgagctcacaacccgcaggcaatcagaccagtcctggggcaaccgaggactactcttatggatcttggtacatcgacgagccccagggcggagaggagttgcaacctgaaggggaagtgccctcatgccacactagtatcccccctggcctgtaccacgcttgcctggcctctctctctattctggtcctgttgctgctcgcgatgctggtgcgcaggcggcagctgtggccagattgtgtcaggggcagacccggtctcccaagccctgtggacttcctcgcgggtgatcggccaagggcagtccctgccgcagtatttatggtgcttttgtcttccctgtgcctcctactgcccgacgaggatgcactgccattcctcactttagcatccgctccttctcaggacggcaaaactgaagcgcctaggggagcctggaagatcttggggcttttctattatgcagcactgtactatcccctggcagcctgcgcaacagctggacataccgcggcacacttgctggggtccaccctgtcatgggcccaccttggcgtccaggtctggcagagggctgaatgccctcaggtacccaagatctataagtactattctctgctggctagcctgcctctgctgctggggctagggttcttatccttgtggtaccccgtccaactagttcgttccttcagtcggaggacgggcgcagggtccaaaggactccaatcgtcatattcagaagaatacctgaggaatctcttgtgcaggaaaaaacttggtagctcctatcacacatctaagcatggcttcctgtcttgggccagagtgtgcctgcgtcactgcatctatacacctcagccaggcttccaccttccactcaagcttgttctcagcgccaccctaacaggtacggcaatttaccaggtggccctgctgcttctggttggcgtggtgccaacgatacagaaggttagggcgggagtgaccacagacgtgagttacctgttagctggctttggcatcgtgctatctgaggataagcaggaggttgtcgagctggtgaaacaccacctatgggcgctcgaggtgtgttacatttctgctttggtgctcagctgtctgctgacattcctggttctgatgaggtctcttgtgactcacaggacaaatcttcgagccttgcaccgaggtgctgctctggacctgagcccactgcatcggtccccacacccaagccggcaagctattttctgctggatgagtttcagtgcataccagaccgcgtttatttgtctggggctcttagtgcaacagataattttctttctggggaccaccgcactcgcttttctcgtgcttatgcctgtgctgcacgggaggaacctgcttctgtttagatctctggaaagcagttggccattctggctgactctcgccctggctgttatactccagaatatggcagcacactgggttttcctggagactcatgatggtcatccgcagcttaccaaccgcagagttctgtatgccgcaaccttcctgctgtttcctcttaatgtactcgtgggtgccatggtcgctacttggcgcgtgctgctttccgctctgtacaacgccatccatcttggacagatggatctgtcattattgcccccaagagccgcaacactggaccctggatactatacctacaggaattttctcaaaattgaggtatcacagtcacatccagccatgaccgctttttgctcgcttctgctacaggcccaatctctcttacccaggactatggccgctcctcaggattccctccggccaggggaagaagatgaggggatgcaattactccaaactaaggacagtatggctaagggagccaggccgggagcctctcgcggtagagctcgttggggcctcgcatataccctgctccataacccaacactgcaggtgttcagaaagaccgcactgctgggcgctaacggagcccagccttag

SEQ ID NO: 242619 - DNA, 1800 bp, Artificial Sequence
  Description of Artificial Sequence: Synthetic coding sequence
atgttggttcgcagaagacagctgtggcctgattgcgtccgagggcgaccaggactccccagccctgtggacttcctggcaggcgacaggccgagagcggtccccgcagccgtatttatggtgctcctaagctctctgtgtctgctgttgccagatgaggacgccctgccatttcttacgctcgcctcagcaccgtcacaggacggcaaaaccgaagctccaagaggggcatggaagattctcggcttgttttattacgccgctctgtactaccctctggccgcttgtgctacggctggacataccgccgctcatctgttaggatctacgctgagctgggcgcatctgggcgtgcaagtgtggcagcgggctgagtgtccccaagtgcctaagatttataagtactatagcctcctggcttccctaccccttcttttgggcttgggtttcctctcgttgtggtatcccgtccagctcgtgcggtccttctccaggcgcaccggcgcaggaagtaagggcctgcaatcctcttactctgaggagtacttgaggaatctcctgtgccgtaagaagctagggtcatcgtaccatacaagcaaacatggatttctaagctgggcaagagtctgcttgagacattgtatatacaccccccagccgggattccacctccccctgaaattggtgctaagcgccacgttaaccgggaccgcgatttaccaagtggctctgcttctgttggtgggggttgtccccaccatccagaaagttagggccggagttacaacagatgtttcttatctcctagctgggttcgggatcgttctgtccgaggataagcaggaggttgtggagttggtgaagcatcacctttgggcactggaggtatgttacatcagcgctttagtcctgagctgtctgttgactttcctcgtgctgatgagaagtctggttacacatcgtaccaacctgagggcgttgcacaggggcgctgcactggacttgtcgccacttcaccgttccccacatccaagccggcaggccattttttgctggatgtctttttccgcctatcagacagctttcatatgtcttggactgctggtgcagcagatcatctttttcctcgggacgacagcactggcctttttggtcctgatgcccgttcttcatgggcgaaatttactcctgttcaggtctctcgagtcgtcctggcccttctggttgacattagcactcgctgtgatcctccagaatatggccgctcactgggttttccttgagactcacgatggtcatccccagctaacgaatagacgagttctatacgcggctaccttcctacttttcccactgaacgtcctcgtgggcgcaatggtggcaacctggcgagtcttactatctgccctgtataatgctatccacctgggtcagatggatctctctctcctgccccctcgcgcagccacactggatccaggctactacacctatcgaaacttcctcaaaatagaggtgagtcaatcccatcctgcaatgacagccttctgcagcctactgctgcaggcacagtcacttctgcccaggactatggctgcccctcaagactcattgagacctggtgaagaggatgagggaatgcagttgctgcagaccaaagacagcatggcaaagggcgctcgcccaggcgcatctcgcggacgagccaggtggggactggcttatacactgctgcacaacccaacactccaagtgttcagaaagaccgccctgttgggggcaaatggcgctcaaccctag

SEQ ID NO: 242620 - DNA, 1977 bp, Artificial Sequence
  Description of Artificial Sequence: Synthetic coding sequence
atgtctagccaacccgctggcaaccagacaagtcctggcgcaacggaggactattcatatggatcatggtacatcgatgagccacagggcggtgaagaattgcagccggaaggcgaggtgccgtcatgccatacctccatcccccctggcctttaccatgcctgtttggcttccctttctatcctggtattgcttctgcttgcgatgttggtccggaggcgccagctttggcccgactgcgttaggggcagacccggactgccccgtccacgagctgttcctgccgcagtgttcatggtcctcctcagtagtctatgcttgcttctcccagacgaagacgccctgcctttcttgacacttgctagtgccccatctcaagatggcaagacagaggctccaaggggagcttggaaaattctgggactattctattacgccgctctctactacccactggcagcttgcgcaactgcgggtcacacagccgcacatctcctgggctctaccctctcttgggcacacctgggtgttcaggtctggcaaagggcagaatgtcctcaggtccccaagatatataagtactacagtctgttggcttcactgccactgctcctggggttagggtttctttcattatggtacccagtgcagctggtccgtagtttttcccgcaggactggagcagggagcaaaggacttcagtccagctacagcgaggagtatttgagaaatctgctctgtcgcaagaagctgggctcttcctatcacacctcaaagcacggctttctgtcttgggcaagggtctgtttgaggcactgcatctatacaccccagccgggattccacctcccgctgaaactcgtgctttccgcgacactgactggaactgcaatctaccaagtggccctactcctgcttgtgggcgtggtgccaacaattcagaaagtgagggcaggagtcaccacagacgtcagctatctgctcgctggtttcggcattgtgctttccgaggataaacaagaggttgtagaactcgtgaagcatcacctgtgggctctggaggtgtgttatatttcagcactggttttgtcatgtctgttaacattccttgtcctgatgcgcagcttggtcactcacagaactaacttgcgcgctcttcatcgcggagctgctttggacctttcccctctccataggtcaccgcatccatctcggcaggctatcttctgttggatgagctttagcgcttatcagaccgcgttcatctgtttgggattactcgtgcaacagatcatcttctttctgggaactacagctctagccttcctggtgctgatgccagtcttgcacggaagaaacctgctgttatttcgtagtctggagagcagctggcccttctggctgactttggcattggctgtcatcctccagaatatggccgcacattgggtttttctcgaaactcatgacggccacccccagctgacaaacaggcgggtgttgtacgctgcaaccttcctgttgtttccgctgaacgttctggtgggggcaatggtggctacctggagagtgctgttgtcggccctgtacaacgccattcacttgggccaaatggacctatccctcctccccccaagggcagcgaccttagatcctggatactatacctatcggaattttctcaagatagaggtttctcagagtcatccagcgatgacagcgttttgctctctattactgcaggcccagagtcttctgccaaggacgatggctgcacctcaggactctctgcggccaggagaggaggatgagggcatgcagctgctgcaaactaaagattccatggcaaagggagctaggcccggtgcatcccgcggacgggcacgctggggcctggcttacactctgttgcacaatcctacccttcaggtctttcgaaagaccgcactcctgggggctaatggtgcgcagccttag

SEQ ID NO: 242621 - DNA, 480 bp, Artificial Sequence
  Description of Artificial Sequence: Synthetic coding sequence
atgtcaagccagccagcgggaaatcagacctctccgggtgccacagaagactattcttatggaagctggtatatcgacgaaccacaggggggtgaggagctccagcccgaaggcgaagtgccttcctgtcacacaagtattccacccggtctataccacgcctgcctcgccagcctctcaattctggtcctgctcctgcttgccatgttagttcgtcggcgacagctctggcccgactgcgtaagagggaggcccggtctgccatccccagtggactttctggccggagaccgtcccagagccgttcccgcagccgtattcatggtccttctgtcttcactgtgcctgttacttcctgatgaagatgcactgcctttcctaaccctcgcgagcgcaccgtcccaggacgggaaaacggaggcaccacgcggtaacctcccaaaaataacagaactgcggcttgtgcgggcatggatatag

SEQ ID NO: 242622 - DNA, 2121 bp, Artificial Sequence
  Description of Artificial Sequence: Synthetic coding sequence
atgggcggaaaaggcggtggggatactcggggtccggtgctgtttccttgtcagctggcccaggccctgtcgccacgcagagccttccccagagaactgaaagagaaaggacaacggatgtcctcccagcccgcaggaaaccagacctctcccggagctaccgaagactatagctatgggtcatggtatatcgacgagccacagggtggagaggagctccagccagagggtgaagtcccgtcgtgtcacaccagcattccacccggactgtaccatgcatgtctggccagcctttctatcctggttctgctgcttctcgcaatgcttgtgcgaaggcgccagctctggccagattgcgttcggggaaggcccggactgccgtcccccgtagatttcctcgcaggcgatagacctagggcagtcccagccgctgttttcatggtcctcctaagttctctgtgcctgctactccctgacgaggacgccctgccatttctgaccctggcgagtgcaccatcacaggatggaaagactgaagctcccaggggcgcatggaagatcttgggattgttctactacgccgctctatactatcccttggccgcatgcgccacagccggacacacagccgctcatctccttggatcgactctttcctgggcgcacttgggggtgcaagtctggcagcgagcagaatgcccccaggtgccaaagatctacaagtactactccctgctcgccagccttcctcttcttctggggctgggctttctgagcctgtggtatccggtgcagcttgtgcgttcattcagtcgacgcacgggtgctggcagcaaaggccttcaaagctcctatagcgaggagtacctcagaaacctgctgtgccgcaagaaacttggctcatcttatcatacaagcaaacacggattcctttcttgggcacgggtatgcctcaggcattgcatctatacgccacagccagggttccatctgccactgaagctcgttctgagcgctactctgaccggaactgcaatttaccaagtagcactgctgttgctggtaggcgtggtaccaaccatccagaaggtcagagcaggagtgactaccgatgtgagctatctgctggctggattcggtatcgtgctctccgaggacaagcaggaggtggttgagctggtgaagcaccatctctgggcactggaagtctgctatatttccgctttggtgttaagctgtctcctgaccttcctggtgttaatgagaagccttgtcacacaccgtaccaacctcagagccctgcaccgcggagctgcgctggacttgtctcccctgcaccggtcacctcacccttcccgacaggccatcttctgctggatgtcattttccgcgtatcagaccgccttcatctgtctgggattattggtgcaacagatcatctttttcctcggcactactgcactggcctttttggtactcatgccggtcctccacggcaggaacctgcttctgttcagaagcctcgaaagctcatggcctttctggctgacactggcactcgccgtgatccttcaaaatatggcagcacactgggtgttcttagaaacacatgacggacatcctcagcttacaaaccggagagtgctttatgccgcaaccttcctcttgttcccactaaatgtgctggttggtgctatggtggctacctggcgtgtattactctctgccctgtacaatgcaatccatctggggcagatggatttaagtctcttgcctcctagagccgctaccctcgacccaggctattacacatacaggaattttttgaagatcgaagtgtctcaatcgcatccggcaatgaccgctttttgctcattactgctccaggcccaaagccttctgccaagaacgatggccgctccacaggatagtctgaggccgggtgaggaggacgagggcatgcagctcttgcagaccaaggactcaatggctaaaggcgctagaccgggtgcatcacgaggccgagcacggtggggactggcatacactctacttcacaatcctacactgcaagtgttccggaagaccgcactgctgggtgccaacggagctcagccttag

SEQ ID NO: 242623 - DNA, 2115 bp, Artificial Sequence
  Description of Artificial Sequence: Synthetic coding sequence
atgcagatcaggttactgcgcgctgagctggtggtgcctctttggcagttcatccgccagtggccacctgggtctgacgggtgggggcagatggaggaaaagggacagaggatgagttcccagcccgcagggaaccagactagcccaggggctactgaggattacagttacgggtcttggtacatcgatgagccacaggggggtgaagaactccagcccgagggagaggtcccgagctgccacacctccatacctccaggactgtaccatgcatgtttagccagcctctcgattcttgtgcttctgctcttagctatgctggtgaggcggagacagctatggcccgactgcgtacggggacggccaggtttacccagccctgtggacttcctggccggagataggcccagagccgtgcccgcagccgtcttcatggtgcttctgtcttccctgtgtctcctgctacctgatgaggatgccctgccattccttaccttggccagtgcccctagtcaagatggcaaaacggaggcccctcggggtgcttggaagattttaggccttttttattatgccgcattgtactacccactcgccgcatgcgcgaccgcaggacacacagctgcccacctattaggctctaccctgtcttgggcccaccttggcgtacaggtgtggcagagagcagaatgcccgcaggtgcccaagatctataaatactatagcctcctagcctcgctgcctcttctcctgggactgggattcctgtctctctggtatcctgtgcagctcgtcagaagcttttctcggaggaccggagcgggatccaagggtctgcagagcagttattccgaggagtacctgagaaaccttctctgccgaaagaagctgggaagtagttaccacacaagtaaacatggtttcctgtcatgggccagagtttgcctgcggcactgtatatatacccctcaacccggatttcatctccctctgaagctggttctgtccgcaaccctcacgggcacagccatctaccaggtggccttgctattgctcgtgggggtcgtgcccacaattcagaaggttcgcgcaggcgtaaccacagatgtttcctacctccttgccggttttggcatcgtcttatcagaagacaagcaggaggtagtggagttggtcaaacaccacctgtgggcattagaggtctgttacatttccgccctcgtcttaagttgcctcctgacctttctagtcctcatgcgctcactggtgacacacagaactaacttgagggccctccaccggggtgctgccctggatcttagtcctctgcatagatcccctcacccgtctcggcaggccattttctgttggatgagcttcagcgcataccagactgccttcatttgccttgggttactggtgcagcagataattttttttttgggcaccacggctctcgccttcctagtgttgatgccagtgctgcatggcaggaacttgctcctgttcagatccctggagagcagctggcctttctggctgacattggccttggcagtgatcttacagaacatggccgctcactgggtgtttctggagacccacgatggccacccacagctgaccaatcggcgtgtgctgtacgcagctactttcttgttgttccccctcaatgtgcttgtgggagctatggtggccacatggcgcgttctgttgtcggcgttgtataacgccatccacctggggcagatggacctctcactgttgccccctagggccgctactttagaccccggatattatacgtaccgcaatttcctgaagattgaggtgtcccagagtcatcccgctatgaccgctttctgttcgctactgctccaggcacagagtctgctccccaggactatggccgctccgcaggactcactcaggcctggagaagaggatgagggcatgcagctcctccagacaaaggattctatggctaagggagcaagacccggagcttctaggggcagggcacgatgggggcttgcctacactctgttgcacaatccaacgcttcaggtgttccggaaaaccgccctcctgggagccaatggggcacagccatag

SEQ ID NO: 242624 - DNA, 1674 bp, Artificial Sequence
  Description of Artificial Sequence: Synthetic coding sequence
atggccgctggcacgtcgatgagccctgacgaggacgcactgccttttttaactctcgcctccgccccatcccaggatgggaagaccgaggctcctagaggcgcatggaagatactgggtcttttttattatgctgcactatactaccctctggccgcatgtgcaactgccggacatactgcggcacatctcttgggctccacactgtcctgggcccacctcggggtgcaggtgtggcaacgagcagagtgcccacaggtgcctaagatatacaaatactactccctgctcgcttcactccccttacttttgggcttagggttcctttccctgtggtatccggtgcagctggtccgaagcttttcccgccgaacgggcgcagggagcaaaggcctccagtcctcatattccgaggagtacctacggaacctgttgtgtaggaaaaagctaggaagctcatatcacacatccaaacatgggttcctctcctgggcaagggtgtgcctgcgccattgtatttacaccccccagccagggtttcacttacccctgaagctcgttctgtctgctaccctgaccgggacggccatatatcaggtggccctcctgctccttgtaggcgtggtcccgacaatccagaaggtcagggctggtgttactactgacgtttcttatcttctggccggattcggaattgtgctgagcgaggacaaacaggaggtggtagagctcgtgaaacatcacctgtgggccctggaggtctgttatatcagcgcccttgtgctgtcctgcctccttacctttttggtgctgatgcgctcactcgtgacccacaggacaaacctgcgtgcactccaccgaggcgcagccttggacctgagtccactgcaccggagtccacacccttctcggcaggcaatcttttgttggatgagcttctcagcttatcagaccgctttcatttgtctgggcttactcgtgcagcaaatcatctttttcctgggcaccacagctttagctttcttagtgcttatgcctgtccttcacggcagaaacttgcttttgttccggtccctggagtcctcctggcccttctggttaaccctggcgctggctgtcattctccagaacatggccgctcactgggtcttcctggaaactcacgacggccacccacagctcacgaatcgtagggtattatatgctgctacattcctgttgttccctcttaacgtcctcgtcggcgcaatggttgcgacctggagagtactgctgtccgcgctgtataatgccatccacctcggacagatggatctcagcttactcccgcctagagccgctacactggatccgggatattatacgtatcggaacttcctgaaaatcgaagttagtcagagccatcctgccatgaccgcgttctgctctctgctgctccaggcccaatctctgctgcctcgcactatggccgctccacaggacagtctgcggcctggtgaagaggatgagggcatgcagctgcttcagactaaggacagcatggccaaaggagctcggccaggtgcatcaagaggccgagctagatgggggctggcttacacgctcctccacaatcctacacttcaagtgttccggaaaaccgccctgctcggcgctaacggggctcagccgtag

SEQ ID NO: 242625 - DNA, 1431 bp, Artificial Sequence
  Description of Artificial Sequence: Synthetic coding sequence
atgggtaaactacggctgcaggagatttataagtactattcccttctggccagcctacctttactgttgggccttggtttcctcagcctttggtatccagtacagctcgttaggtcattcagccggagaacaggcgcagggtccaaggggctccagagttcgtacagtgaagagtacttgcgcaacctattgtgccgtaaaaaactcggttctagctaccacacttccaagcacggttttttaagttgggctagggtatgtcttcgacactgtatctacacaccgcagcctggctttcacttacccctgaagctggtcctctccgccactctgacaggcacggctatctatcaggttgctctgctcctcctggtgggagtggttccaacgatacaaaaggtgcgggctggcgtaaccactgacgttagctatctgcttgccggattcggcattgtcctcagcgaagataaacaagaagtggtagaacttgtcaagcatcacttatgggccctcgaggtatgttacattagcgccctggtcttatcttgtctcctgacttttttggttttgatgcggagtctggtaactcaccgtactaatctgcgggctcttcacaggggggcagccttggacctgtcccctctccaccggagtccgcacccctccagacaggctatattctgctggatgtcgttttccgcttaccagactgctttcatctgtctcggcctcctggtgcagcagatcattttctttcttggcaccactgcacttgccttcctcgttttgatgcctgtgctccacgggagaaatctgttgctgttcagatcactcgagagctcctggccattctggctcacactggccctcgctgtcatactgcagaacatggctgcacattgggtgttcctggagacacacgatggccatccacaactgaccaacaggcgggtcctctacgcagctacgtttttgctattcccgctgaacgtactggtgggagctatggtcgcaacctggcgcgtgctactctcggccctctacaatgccatccacctcggacagatggatctaagcctccttccacctagagcagcgactcttgatccaggctactacacgtaccggaactttctgaaaatagaggtgagccaaagccacccagctatgacagcattctgttccctgcttctccaagcccagtcattgctgcctcgtaccatggctgctcctcaggacagtctcaggccaggagaggaggacgagggaatgcagttgctgcaaactaaagactcaatggcaaagggtgccaggcctggtgcgagccgcggacgggctaggtggggattagcatacacgctcttgcacaatcccaccctgcaggtgttccgcaaaacagccctcctgggggctaacggggcacaaccttag

SEQ ID NO: 242626 - DNA, 993 bp, Artificial Sequence
  Description of Artificial Sequence: Synthetic coding sequence
atgggcaaaatagacgtcgataaaatcttattctttaatcaagagattagactttggcagctgatcatggccactccagaagagaacagtaacccccacgacagggccactcctcaactgccagcccagctccaggagctggagcaccgagtagccaggcggagactaagccaggcccgacatagggcaacccttgctgcattgtttaataacctgaggaaaacagtgtacagccaaagcgatttgatcgctagtaagtggcaggtattgaacaaggcgaagtctcacatccccgagctggaacagacactggataatctgctgaaactgaaagcatcgttcaacctggaggatggtcacgcttcatctcttgaggaagtaaagaaagagtacgcaagcatgtattccggaaatgactcctttccgcagaacgggtcatccccgtggtaccttaacttctacaaacaaacgatggacctgctcaccggttcgggaattataacacctcaagaggctgcactccctatcgtcagtgcagctataagtcatctgtggcaaaatctatctgaggaaaggaaggcctcactgcgccaggcgtgggcgcaaaagcaccgcggaccggctactcttgccgaggcgtgccgggagcccgcttgtgccgagggctctgtgaaagactccggtgtggatagccagggggcatcctgttctctcgtgtccacgccagaggagatcctctttgaggatgccttcgatgtcgccagctttctagacaagtctgaagttccgtccacatcatcttccagctcagtactcgcttcctgcaacccggaaaaccctgaagaaaaatttcaactgtatatgcagatcatcaacttttttaagggcctgtcctgcgccaacacccaagttaaacaggaggcaagcttccccgtggacgaagagatgataatgctgcagtgtacggaaactttcgatgacgaggacctttag

SEQ ID NO: 242627 - DNA, 882 bp, Artificial Sequence
  Description of Artificial Sequence: Synthetic coding sequence
atgggattccccgctgctgcattgctgtgcgcactctgctgtggccttttagcccctgccgctagagcaggttactccgaggagcgctgctcgtggaggggttccggattgactcaggaacctggctcagtcggacaattggctttggcatgtgcagagggagccgtggaatggctgtaccccgctggcgcattgagactaacacttggcggacccgacccgagagccagaccaggcatcgcttgcctccggccagtaagaccattcgccggtgcccaggtctttgcggagagggcgggtggagccctggagttgcttctggcagaggggcctggacctgcaggcggacgatgcgtgaggtggggccctcgtgagaggcgtgcacttttcctacaggccaccccacatcaggacatatccagacgtgtggcagcattcagattcgagctgagggaagacggtcggccagaattaccccctcaagcccacgggctcggcgtcgatggagcatgcagaccatgctccgatgctgagttgttgttggctgcatgcacgtccgatttcgtcatccatggtataatccatggagtgacccacgatgtcgaactgcaggaaagtgtgataacagtggtggcagctcgagtcttacggcagacgccgccactgtttcaggccggtcgcagtggcgaccaaggattgacttctattcgcacacccttgcgttgcggtgtgcaccccggacctggcacttttttgttcatgggctggagtcggttcggagaagctagactgggttgcgctccaagattccaagagttccgcagagcttatgaggccgctagggccgctcatctccatccatgcgaagtcgcactgcattag

SEQ ID NO: 242628 - DNA, 1197 bp, Artificial Sequence
  Description of Artificial Sequence: Synthetic coding sequence
atgttaggacggagcggctaccgggctctgccgctcggcgacttcgaccgttttcagcaaagcagctttggcttcctgggatcccagaagggctgtttatctcccgagcggggtggagttggtaccggcgcagacgtgccacagtcatggccatcctgtctctgtcatggattaattagcttcctgggattcttactgcttttggtgacctttcctatcagcggctggtttgcgctgaaaatcgtgcccacttatgagcgaatgatcgtctttcggctgggcagaatccgcacaccacagggcccagggatggtattacttctgccctttattgatagttttcagagagtcgatctgagaacccgcgcattcaacgttcctccctgcaaactagcctccaaggatggggctgtgctttcggtcggcgctgacgtgcagtttcggatttgggatcccgtcctgagcgtcatgaccgtgaaagacctgaatacagccacaagaatgacagcccagaatgctatgactaaggctttgttaaaaagacccttacgggagatccaaatggagaagctcaagatatccgaccaactgctgctggagatcaatgatgtcacacgggcatggggacttgaagtcgatagagtggaattggccgtggaggctgtcctccaacccccacaggactcaccagccggacctaacctagactctacactccagcagcttgcactccatttcctgggcggatccatgaatagtatggctggaggggcaccctccccaggtcctgccgataccgtggagatggtttctgaggtggagcccccagcacctcaggttggtgcaagatcctctccaaaacagcctttggccgaggggctgttgacagccctccaaccatttttgtcagaggcgctggttagccaggttggtgcatgctatcagttcaacgtagtactgccatctggaactcagtctgcttactttttggatctcactactgggcgaggtcgggtggggcacggcgttccagacgggattcccgatgttgtggttgaaatggctgaggctgacctgagggcactgctgtgccgcgagctcaggcccctgggcgcatatatgagtggcagactcaaagtgaagggcgacctcgctatggctatgaagctggaagcggtcctgagagctctcaagtag

SEQ ID NO: 242629 - DNA, 1047 bp, Artificial Sequence
  Description of Artificial Sequence: Synthetic coding sequence
atgctgggaagatctggctacagagctctcccgcttggtgacttcgaccggttccaacagtcaagcttcggattcctgggctcccagaaaggatgcctgtcccccgaacggggaggcgtgggcaccggcgcagatgttccccagtcttggcccagctgtctttgtcatggcttgatctcgttcctgggtttcttgctgctcctggtgacctttcctatatctgggtggtttgctttgaaacttgcctcgaaggacggtgctgtcttgagtgttggcgcagacgtgcagttcagaatttgggaccccgtgttgtccgtgatgaccgtcaaagatctgaacaccgcaacccgcatgacagcacagaatgccatgaccaaggccctgctgaagagacctctgagagagatccagatggaaaaacttaaaatttctgatcagctgctgttggaaatcaacgatgttactagagcatggggacttgaggtggaccgggtcgagctggctgtagaagctgtgttacaaccaccgcaagacagcccagccggacccaacctggacagcactctacagcagctggctttacattttctgggcggttcgatgaacagcatggccggaggcgcaccaagcccgggacccgcagacaccgtggaaatggtcagcgaagtggagcccccagctcctcaggtcggcgcacgctcttctcctaaacagcccttagccgaaggcctgctaactgccctccaaccgttcctctccgaggcccttgtgagtcaggtgggcgcttgttaccaattcaacgtggtactgccttcaggaacacagtcagcctacttcctagacctcacaacgggacgtgggagggtcggacacggagtgccagacggaattccagatgtggtagtggagatggccgaagctgatctgagagccctgctttgcagagaactgaggcctcttggagcctatatgtccggcaggttaaaggtcaagggggatctggccatggcaatgaagctagaagccgtactccgcgctttgaaatag

SEQ ID NO: 242630 - DNA, 984 bp, Artificial Sequence
  Description of Artificial Sequence: Synthetic coding sequence
atgctcggtaggagtggctatagagcgctgcccctgggggacttcgatagatttcagcagagctcctttggcttccttggcagccagaaggggtgcctgtctcctgagcgaggtggagtcgggaccggggcagacgtccctcagtcatggccatcatgtctgtgccatgggctgatttcttttctggggtttctgctcctgcttgttaccttcccaatctcgggctggtttgcattaaaaatcgtgcccacttacgagaggatgattgtattcagactagggagaatccgtacgcctcagggtcccggtatggtgctgttgctgccttttatcgactctttccagagggtcgatctgcggaccagagccttcaatgtccccccttgtaagctggccagcaaggacggagccgtgctgtccgtgggtgctgacgtgcagtttaggatctgggatcccgttttgtctgtgatgacagtcaaagatcttaatactgccacccgcatgacagcgcagaatgcaatgaccaaggccctcctgaagcggccattaagagagatccagatggagaaactcaagatttctgaccagctcctgcttgagatcaacgatgtcacccgcgcatggggcttggaggtggatcgcgttgagctcgccgttgaggccgtactgcagcctccacaggactctccagccggaccaaacttggactcgaccctgcagcagctggcattacattttctgggaggcagtatgaacagtatggccggaggtgctccgtccccagggcctggtcgaggtcgagttggccatggcgtcccagatggaataccggacgttgtggtagagatggctgaggccgatctaagagctcttctgtgcagggagcttcgacccctgggcgcttatatgtcaggcagactgaaagtgaaaggagatctcgcaatggccatgaagctggaggctgtactgcgtgctctgaagtag

SEQ ID NO: 242631 - DNA, 1068 bp, Artificial Sequence
  Description of Artificial Sequence: Synthetic coding sequence
atgcctgatgtgccacagtcttggccatcctgcctgtgtcacggcctaattagtttcctggggtttctgctgttacttgtgacgttccccatctccggttggttcgcattgaagatcgttcctacctacgagaggatgatagtctttcgactgggcaggattagaacacctcaggggccaggtatggtgcttctgctaccgttcattgactcattccagcgcgtggatttaagaaccagagctttcaacgttcctccttgcaaactggcttcaaaagatggcgctgtgctcagcgtcggcgcagatgtgcaatttaggatttgggacccagtgttgtcggtcatgacagtgaaagacctgaacaccgccactagaatgactgcacagaatgcaatgacaaaggccctgttgaagagacctctgagagagatccagatggagaagttaaaaatttcagaccagctgctgcttgagataaacgatgtgaccagagcctgggggctggaagtggaccgtgtggaactcgctgtggaagctgtcctccaaccacctcaggactccccagccggacccaacttagatagtactctgcagcagctggcccttcacttcctagggggatcaatgaatagcatggcgggtggcgctccctctcctggcccagatacggtggagatggtgtcagaagtagaaccccctgcaccccaagtgggggcacgctcgtctcccaagcaaccattagccgaaggcttgcttacagcccttcagcctttcctcagcgaagctcttgtgtctcaggtcggggcttgttatcagttcaatgtggtgctgccctccgggactcaatccgcctattttttagatttgacaaccggtcgtggtcgcgtgggccacggtgtacctgacggcatcccggacgtcgttgtcgagatggctgaagcagatttacgcgcactgctctgtcgcgagttgcggccattgggggcttacatgtcgggtcgactcaaagttaagggcgatcttgccatggctatgaagttggaggctgtgcttagggccctgaagtag

SEQ ID NO: 242632 - DNA, 933 bp, Artificial Sequence
  Description of Artificial Sequence: Synthetic coding sequence
atgatcgtattccgtcttggccgtattaggacacctcaagggccaggcatggtgttactgttgcccttcatcgacagttttcagcgggtcgatctgagaactagggcttttaatgtgcccccttgcaaactcgctagtaaggatggggctgtgctgtcagttggtgcagatgtgcagtttcgcatttgggaccccgttctgtccgttatgaccgtgaaggatcttaataccgccacacggatgaccgcccagaatgcgatgactaaggccctactgaagcgccctctacgcgagatccagatggagaaactcaagatatctgaccagctgctgctggagattaatgatgtgacacgcgcatggggcttggaagtggatcgtgtggaactcgccgtagaagccgtcctgcagccacctcaggacagccctgccggtccaaatttggatagcacactccagcagttggccttgcacttcttgggtggctcaatgaattctatggctgggggagccccatccccaggaccggacactgtggagatggtatcggaagtcgagcctcctgcccctcaggtcggagcgcgatcaagtccaaagcaaccactggccgagggcctcttgacggccctgcagccctttctatcagaggcacttgtctcccaagtcggtgcctgttaccagtttaatgttgtattacccagcggcacacagtccgcctactttctggaccttaccaccggtcggggacgcgtgggccacggcgtgccggacgggattcccgacgtggtggtggaaatggcggaagcggatcttcgcgctctattgtgccgggaactgagaccgttgggggcttatatgagcggcaggcttaaagtgaagggcgatctggctatggccatgaaactggaagcagttctccgcgctctgaagtag

SEQ ID NO: 242633 - DNA, 1044 bp, Artificial Sequence
  Description of Artificial Sequence: Synthetic coding sequence
atgcttgggaggtcgggctacagagccctgccccttggtgatttcgatagatttcagcagagtagtttcgggtttttgggctctcagaaaggctgcctgtcccctgaacgcggaggcgtcggaaccggtgcggacgtgccccaaagctggcccagctgtttatgccacggacttatctccttcctgggtttcctgctcctgctcgtgacttttccaattagtggatggttcgccctgaagctcgcttccaaagacggggctgtgctttcggtgggcgctgacgtccagtttcgcatttgggaccctgtactcagcgtgatgacggtaaaagacctgaatacagcaacccggatgaccgcacagaatgcgatgacgaaggctctgctcaagagaccattacgcgaaatccagatggagaagctcaagatctctgatcaacttcttctcgagattaacgacgtgacaagagcctgggggctagaggtagaccgtgtggaattggctgtcgaggccgtgttgcagcctccccaggatagccccgcaggaccaaatctagattctactctgcaacagcttgcactgcattttctgggcggttcaatgaattcaatggccggaggggctccatcaccaggtccagatacagtggaaatggttagcgaggtcgagccacctgctccccaagtcggcgctcgctccagtccaaaacagcccctagctgagggcctgttaactgcactgcagcccttcctatccgaggccctggtcagtcaggtgggggcatgttaccagtttaacgttgtgctaccatctggtactcaaagcgcttattttctcgatctgaccacagggaggggcagggtgggacatggtgttcctgatggaatccccgacgtagtggtggagatggccgaggctgatttgagggcacttttatgcagggagctgcggcctttgggggcatatatgtccggaaggcttaaggttaaaggagacctagctatggccatgaagctcgaagctgtcctgcgggctctgaagtag

SEQ ID NO: 242634 - DNA, 1071 bp, Artificial Sequence
  Description of Artificial Sequence: Synthetic coding sequence
atgctcgctcgagcagcccgaggaacgggggctctgctgctccgaggctctctgctggcatctggtcgagctcccagacgggcatcatccggcctgccaaggaataccgtggtcttgtttgtcccgcaacaggaggcatgggtagtggaacggatgggtagattccaccgcattctcgaacccggactgaacattctgattcctgtcctggacagaatacgctatgtacagtcactgaaggagatcgtgattaacgtgccagaacagtcagccgtgaccctggataatgtgactctgcaaatcgacggtgtcctgtatcttcgcataatggatccttataaagcctcatacggtgtggaagacccggaatacgccgtaacccaactcgcgcaaaccaccatgcgcagtgaactggggaagctgagcttggacaaagtgttccgcgagcgcgagagcctgaacgcctcaatcgttgacgcaatcaatcaggccgcagactgctggggaattcgttgtcttcgatacgagatcaaggacatccacgtcccccctcgcgtaaaagagagcatgcagatgcaggtggaggctgaacggagaaaacgggctaccgtgcttgaatcggaaggcacccgcgagtccgctatcaatgtcgccgagggcaagaaacaggctcagatcctggcttctgaagccgaaaaggccgaacagattaatcaggccgcaggcgaagcctcagcagtccttgctaaggcaaaagcaaaggctgaagctattagaatcctggccgctgcactgacccagcacaacggcgacgctgccgcatccctgacagtggccgagcagtatgtgtccgcctttagcaagcttgctaaagattctaacacaatcctgctgccaagtaaccctggtgatgttacaagcatggtggcgcaggctatgggagtttacggtgctctcaccaaggcgccagtcccgggaacaccggactcgttgtcttcgggatctagtcgcgacgtccagggcacagacgcgagtctggatgaagaattggatcgtgttaaaatgtcctag

SEQ ID NO: 242635 - DNA, 936 bp, Artificial Sequence
  Description of Artificial Sequence: Synthetic coding sequence
atgcttgctcgcgctgctagagggacaggagcactacttctgcgcggatctctccttgcatctggaagagcccctcgcagagctagttcaggactgcctcggaacacagtagtgcttttcgtgcctcagcaagaagcttgggttgtcgagaggatgggcaggtttcacaggatcctggaaccgggtctgaacattttgatacccgtactggataggatccggtacgttcagtctctgaaggagatcgtgattaacgtcccggaacagagtgcagtgacacttgataatgttacactgcagatcgacggagtcctgtacctccgcattatggacccttataaagctagttacggcgtcgaggatccagagtacgccgtaacgcaactggcgcagactactatgagatcagagctcggaaaactttcacttgataaggtctttcgagtggaggcagagaggcggaagcgcgcaaccgtgctggaatcagaaggaactagggaatctgctatcaatgtcgccgaaggcaagaagcaggcccagatacttgcaagcgaggccgaaaaagccgaacagattaaccaggccgcaggagaggctagtgcagtcctggcaaaagcaaaagccaaagctgaggctatccgcatcctggcagccgcactaacacaacacaatggcgacgcagctgcctctctgaccgtggctgagcagtacgtttcagcgttttccaagttggccaaagacagtaacaccatcttgctgccatctaacccaggtgacgtcacatccatggttgcacaagctatgggagtgtacggcgctctgaccaaggccccagtgcccggaactccagacagcctgtcttctggtagctcccgtgacgtacagggtactgacgcaagcttagatgaagagttagacagagtgaaaatgagttag

SEQ ID NO: 242636 - DNA, 876 bp, Artificial Sequence
  Description of Artificial Sequence: Synthetic coding sequence
atggattcaagggtgtcatctcctgaaaaacaggataaagagaacttcgttggcgtgaataacaagcgcctgggcgtctgcggatggattctgttcagtctgtccttcttgctcgtcatcattacgttcccaatttctatttggatgtgcctcaaaatcataaaggagtacgagagagccgtggtttttagactggggaggatccaggcagacaaggcaaaagggcctggtctgattcttgtgctcccttgtatcgatgtgttcgtcaaggtagacctccggaccgtcacctgtaatatccctcctcaggaaattctgactcgggactcagtcacgactcaggtggacggagttgtctattaccgaatctattccgcagtgtcggccgtggccaacgtcaacgacgtgcaccaagccactttcctcctggcccaaacaactttgagaaacgtcttggggacccagaccctgtcccagatcctggccggtcgggaggagattgcacactccattcagaccctcctggacgatgcgaccgaactctggggcatccgtgttgcgagagtcgaaatcaaagatgtacggattcccgttcagctgcagaggtctatggcagcagaggccgaagccacgagggaggctcgcgcaaaagtgctcgcagccgagggggagatgaacgcgtctaagtctctgaagagcgcctcaatggtgttagcggagtctcctatcgccctccagctgcgatacctccagactctgtccactgtcgcaaccgaaaagaactccaccatagtgtttccgttacccatgaacatcttggaaggaattggtggggtttcctacgacaatcataaaaagcttcccaacaaagcttag

SEQ ID NO: 242637 - DNA, 849 bp, Artificial Sequence
  Description of Artificial Sequence: Synthetic coding sequence
atgaacagccggggtgagctggtcggggtaaataacaaacgactcggggtgtgtgggtggattctgttctccctcagtttcctgcttgttatcattacatttcccattagcatatggatgtgtctgaaaattatcaaggaatacgaaagagccgtggttttccgcttgggaagaatacaggcggacaaggcaaagggccctggtctgatactggtgctcccctgcatcgatgtgtttgttaaggtggatctgcggactgtaacttgcaatattccccctcaggaaatccttacccgcgattctgtgacgacccaggtagacggagtagtgtactaccggatatattcagcagtgagtgccgtcgctaacgtgaatgacgttcaccaggctactttcttgctcgcacaaacaactctccggaatgttctgggaacacagactttgtcccaaatccttgctggcagagaagaaatcgcccacagtatccagacactcctcgacgacgccacagagttgtggggaatccgggtcgcccgtgtggagataaaggacgtacgcattccagtgcagctgcagcgttcgatggccgctgaggcagaggctacaagggaggctcgcgcaaaggttcttgccgcagagggcgaaatgaacgcttcgaaatccctgaagtccgcttccatggttctggccgaaagtccaatagcactgcaactgcgctaccttcagaccctttccacagtggcaacagagaagaactctaccattgtgtttcctttgcctatgaacattcttgaaggaattggaggagtcagctatgataatcacaagaagttaccaaataaggcctag

SEQ ID NO: 242638 - DNA, 2970 bp, Artificial Sequence
  Description of Artificial Sequence: Synthetic coding sequence
atggcgcgtcctgtgcagttagcacccggttctctggcactggtgctgtgtcgtctggaggcccagaaggccgctggagccgcagaggagcccggtgggagagccgtgttccgagcgtttaggagggctaatgcccgatgtttctggaacgcgcgactggcacgggctgccagtaggttggcattccagggctggctgcggcgtggcgtactgctcgtgagagcaccccctgcatgtcttcaggtgctgcgagacgcgtggcgccgtcgggctttgcgaccccctcgcggatttaggattcgcgcagttggggatgttttccccgtgcaaatgaacccaatcactcaatcccagttcgtgccactcggcgaagtactctgttgtgcaattagcgacatgaacactgcccagattgttgtgactcaggagtccctacttgagaggctcatgaagcactaccccggtatcgccattccttctgaagacatactgtacaccactctcggtaccttaattaaggagagaaagatttaccatactggagaaggctactttatcgtgaccccacagacctacttcatcactaatacaaccacccaagagaataaacgcatgctgccctctgatgagagtcgcctaatgcccgctagcatgacctaccttgtgtctatggagtcttgcgctgaatcagcccaggaaaatgcggctccaattagccactgtcagtcctgccagtgctttcgggacatgcacacgcaagacgtgcaagaagctccagtggccgctgaagtgaccaggaaatctcaccgtggcctgggtgagtcagttagctgggtgcagaatggcgcagtctccgtcagtgcggagcaccacatttgcgaaagtacaaaacctctgccctacacccgcgataaggaaaaaggcaaaaaatttggattctcattgctgtggagaagcctaagccgaaaggaaaagcccaagacagaacactccagctttagtgcacagtttccccctgaagaatggccagtgagggatgaggacgacctggacaatattcctcgagatgtagagcacgaaattattaaaaggatcaaccctatcctaacagtggacaacctcatcaagcatacggtgctgatgcagaagtacgaggagcaaaagaagtataactcacagggcacctcaacagacatgttaacaatcggacacaagtacccatccaaagagggagtcaagaagaggcaggggctcagcgcaaagcctcagggccagggccattccagacgtgatcgacacaaagctagaaatcagggatccgagtttcagccaggaagcataaggctggagaagcatcccaagctccctgcaacacagcccattccacggattaagagccctaacgagatggtgggccaaaagcctttaggcgagatcacaactgtgctcggcagtcatcttatatacaagaagcgaatcagcaacccattccagggcttgagccacaggggttcaacaatcagcaaaggtcataaaatccagaagacttctgaccttaaaccctcccagactgggccaaaggagaagcctttccaaaaaccaagaagcttggactcaagccggatcttcgacggcaaagcaaaagaaccatacgccgagcaacccaatgataagatggaggccgagtctatctatatcaatgaccctacagtgaaaccaattaacgatgactttaggggacatcttttctcacatccccagcaaagcatgctccagaatgacggcaaatgctgtccctttatggagtccatgctacgctacgaggtttatggaggggaaaatgaggtgatccccgaggtgctgaggaaaagccattcccactttgataagctcggtgaaaccaaacagacaccccacagcctgcctagcagaggcgcaagtttctcagaccggaccccaagcgcttgtcgcctcgtggataacaccatccaccagttccaaaatctgggcctgctcgactacccagttggggtgaatccactgagacaggctgccaggcaggataaggattccgaagaattgctgaggaaaggattcgtgcaagacgcggagacaacatcactcgagaatgaacaactgtccaatgacgaccaggccctttaccagaatgaggtggaggacgacgacggtgcctgtagctcgctgtaccttgaggaagatgatatttcagagaatgacgacttacgccagatgctgcccggacactctcagtactcttttactggcggatcacagggaaaccacctgggaaagcagaaggtgatcgaacggtctctgactgagtataattcaacaatggaacgcgtagagtctcaggtgttgaaaagaaatgagtgctacaagcctaccgggctgcacgccacgcctggtgagtctcaggaacccaacctgagtgcagagtcctgcggactgaacagcggtgcccaatttggctttaattatgaggaagaaccttcagttgctaagtgcgtacaggcttcagccccagccgatgaaagaatctttgattactacagcgccaggaaggcttcatttgaggctgaggttatccaggataccattggggacacaggcaagaaaccagcttcttggagccagtctcctcagaaccaggagatgagaaagcacttcccccagaagtttcagttgttcaacaccagtcacatgccagtgttagcacaggacgttcagtatgagcacagtcacctcgagggcacggagaaccatagcatggccggtgactctggaatagactccccgaggactcaatctcttgggtccaacaacagcgttattttagatggccttaaacggcgtcagaatttcttgcagaatgtggagggaactaagtcatctcagcccctgacttcaaactccctcctgcccttgaccccagtgatcaacgtgtag

SEQ ID NO: 242639 - DNA, 510 bp, Artificial Sequence
  Description of Artificial Sequence: Synthetic coding sequence
atggcaaggcctgttcagctggccccagggagccttgccctcgtgctgtgccgattggaagcgcagaaggccgcaggcgctgcagaggagccaggaggcagggcagttttccgggctttcagaagagctaacgcaagatgcttttggaacgcgaggcttgccagggcagcctcccgactggcttttcagggctggcttcgaagaggggtgcttctggtgagggccccacccgcatgtctccaggtgctcagagatgcctggcgccgtcgcgctctccggccaccccgtggtttccgtattcgagccgtaggcgacgtgtttcccgtgcaaatgaatcctattacccagtcccaattcgtgcccttaggcgaagtcttatgctgtgcaattagtgacatgaacacggcacagatagtagtgacgcaggagagtctcctggaaagactgatgaaacattacccagggcaccgagtctgggacctaatcatccagtccttttggatggattag

SEQ ID NO: 242640 - DNA, 684 bp, Artificial Sequence
  Description of Artificial Sequence: Synthetic coding sequence
atggcacgccctgtacaacttgccccaggctcactcgctctagtgctgtgcaggttagaggcgcagaaagccgcaggggcagctgaggagcctggtggcagagccgtgtttcgggcattccgcagggctaacgctcggtgtttctggaacgcgcgtctagccagggccgcatcacgtttggcattccagggatggctgaggcggggagtgttgctggtaagggcacctccagcatgtctccaggtgctacgcgacgcttggcggagaagagcactaaggcctccaaggggattcaggattcgcgcagtgggtgatgtgttccccgtccagatgaatccgattacgcagagccagttcgtgccgttgggagaagtcctttgttgcgcaattagtgacatgaacaccgctcagatcgtggtgactcaggagtcgctgttagagcgtctcatgaagcattaccccggaatcgcaatcccttccgaagatattctatatacgacgttgggcaccctgataaaggagaggaagatatatcataccggtgagggatacttcatagtgaccccccagacatacttcatcactaacactactacgcaggagaataaacggatgttgccatcggatgaatctcgcctaatgccagcttccatgacatacctggacactgagtccggtatttag

SEQ ID NO: 242641 - DNA, 2970 bp, Artificial Sequence
  Description of Artificial Sequence: Synthetic coding sequence
atggcacgccctgtccagctcgccccaggctcattggccttagtgctgtgtaggctggaggcccaaaaagctgcaggggctgccgaggaaccaggaggcagagcggtgttccgagccttcaggagggctaacgctcgttgtttttggaacgcccgactggctcgcgcagccagccgattagctttccaagggtggctgagacgtggcgttctgcttgtccgcgcacccccagcttgtctccaggtgctgagggatgcctggcgcaggcgagctctccggccaccgaggggctttaggatccgcgctgtaggggacgtcttccctgtgcagatgaaccccatcactcagagccagttcgtcccattgggagaagtgctctgttgtgccatatccgacatgaatactgctcagatcgtggtgacacaagagtctctgctcgagcggctaatgaagcactaccctgggatagcaataccttcagaagacatactgtacaccactctagggacactgatcaaagaacgcaagatttaccataccggagaagggtatttcatcgtgacaccccagacctatttcattaccaacacaaccacccaagaaaataagcggatgctgccctctgatgagagcaggcttatgccggcttcaatgacatatctcgtctccatggagtcatgcgccgagtccgcacaagagaatgccgcacccattagccattgccagtcttgccagtgttttagggatatgcacacgcaagacgtgcaagaggcccctgtggccgcagaggtgactcgcaagtcacacagggggctgggcgagtcagtatcctgggtccagaacggagccgtcagtgtgagcgccgaacatcatatttgcgagagtaccaagccactcccatacacaagggacaaggagaagggaaagaagttcgggttctctttgctttggaggtccttatcaaggaaagagaagccaaaaacggaacactccagcttttccgctcaattccctcctgaggaatggcctgtgcgagacgaggatgacctagataatatcccacgggatgtggagcacgagatcattaaaagaatcaatcccatcctgactgtcgacaaccttattaaacacacagtacttatgcagaaatatgaagaacagaaaaagtacaatagtcaagggacaagcactgacatgctgaccattgggcacaagtacccaagtaaggagggcgtgaaaaagaggcagggcctgtcagctaagccgcagggccaggggcactccaggagggatagacacaaggctcgtaaccaggggagtgaatttcaacccggtagtatccgcctagaaaagcacccgaagctccctgcgacccagcccatcccgcgtatcaagagccccaacgagatggtcggccaaaagccacttggtgagatcaccaccgtcctcggaagtcatctcatctacaaaaagcggataagcaacccatttcagggtctctcgcaccggggatccaccatctcaaaggggcataaaatccagaaaacatctgacctgaaaccctcccagacgggaccaaaagagaagccgttccagaaaccccgatcactcgacagctcccgcattttcgacggaaaagcaaaagagccttacgccgaacagcctaacgacaagatggaggcagagtccatctatattaacgaccccaccgtgaagcccattaacgacgactttagagggcatttgttctctcatccacagcagagcatgctgcagaacgacggaaaatgctgcccatttatggagagtatgttgcgatacgaagtctatggtggagagaatgaagtgatccccgaggtgcttcgtaagagccacagtcatttcgacaagcttggagaaaccaagcagacaccccactctctgcccagccggggtgcctcctttagcgatcggacaccttccgcctgccgccttgttgacaatacaatccaccagtttcagaaccttgggctactggattatcctgtcggcgtaaatccattgcggcaagctgctcgtcaggacaaggactccgaggaactgctccggaagggtttcgtccaagacgcagagacgacatcgctggaaaatgagcagttgtccaatgatgaccaggctctgtaccagaatgaggtcgaggacgacgatggcgcttgttcctctttatatctcgaggaggacgatatatcagagaatgacgacttgcgacagatgctccctggccactcccagtattccttcacagggggatcacagggcaaccatctgggcaagcagaaagtgattgaacggtccctgaccgaatacaactcaactatggaaagggtggaatctcaagtcctcaagcggaatgagtgctacaagcccacgggcctgcacgcgactcccggagaatcacaggagccgaatttgtcagctgagagctgcggcctgaattccggtgcacagtttggcttcaattatgaagaggaaccaagtgttgccaagtgtgttcaggcatccgcacctgctgacgaaagaatctttgactattacagtgccaggaaggctagcttcgaggcagaggttatccaggatacaattggagacacaggcaagaagcctgccagttggagtcagtcccctcaaaaccaggaaatgcgcaaacattttccacagaaattccagctcttcaatacttctcatatgccagtcctggcacaagatgtgcaatatgaacacagccatttggaggggaccgaaaatcattccatggctggagactcaggaatcgactcccccaggacacagtcactagggtccaacaacagcgtaatattggatggcctgaagagacgacagaatttccttcagaacgtagagggcaccaagtcatctcagcctcttacctccaactccctgttgcccttaacaccagttattaatgtctag

SEQ ID NO: 242642 - DNA, 2640 bp, Artificial Sequence
  Description of Artificial Sequence: Synthetic coding sequence
atgaaccccattacgcagtcccaatttgtcccgctgggcgaagtcttatgctgtgctatctctgacatgaatactgcacagattgtcgtaacccaggagtcacttctggagcggctcatgaagcactacccaggtatcgctattccaagcgaggatattctctacacaaccttgggtaccctgattaaggagcggaagatttaccacacgggggagggttacttcattgtcacgccccagacttactttatcaccaacacaactacccaggaaaacaaaagaatgctcccaagcgacgaatcccggctgatgccagctagcatgacttatctggtctccatggaaagctgcgccgagtctgcccaggaaaatgcggcacctatttctcactgccagagttgccagtgcttcagagacatgcacacccaagacgtgcaggaggcacctgtggccgctgaggtcactcggaagagtcataggggcttgggcgaatcagtgagttgggtacaaaacggcgcagtttccgtgagcgccgaacaccacatttgtgagtcaactaaaccattaccctacactcgggacaaggagaaaggaaaaaagttcggcttctctctgctctggcgcagtctgtctagaaaggaaaagcctaagactgagcactctagtttttctgctcaattccctcccgaggaatggcccgtgcgggacgaggacgacctcgacaatatccccagagatgtggagcacgagattatcaaacggattaacccaattctgactgtggataatctgataaagcatacggttctgatgcagaagtatgaggagcagaaaaagtacaattctcaagggactagcaccgacatgttaacaataggccataaataccctagcaaagagggcgtcaagaagagacaagggctgtccgccaaaccacaggggcaaggccattctagacgtgaccgtcataaagctcggaatcagggatctgaatttcaacccggaagtattcgtttggaaaagcatcctaagctaccagccacacagcctatcccaagaatcaagtctcccaacgagatggtcggtcaaaaacccctgggggaaatcaccactgtcctgggatcacatttgatctataagaagcgaatctcaaacccattccaggggctgtcccaccgaggctctaccattagtaaagggcataagatccaaaagacgtccgacctcaagccaagccagacaggacctaaggaaaaacctttccaaaagcccaggtcccttgattcaagcaggattttcgatggtaaagccaaagaaccttatgctgagcagcccaatgataagatggaggccgagagtatctacatcaatgaccccacagtgaaaccaatcaatgatgacttccggggacacttgttcagccatccacagcagtctatgttgcagaacgacggaaagtgctgcccatttatggaatccatgcttaggtacgaggtgtatgggggagagaacgaggttatcccagaagtgctgaggaagagccacagtcattttgacaaactcggcgagactaaacagactccacactcattgcctagtcgcggtgcttcgttttctgatcgcactccaagcgcctgtaggctggtcgacaacacaattcatcagttccagaatttaggactgcttgattaccccgtgggagtcaacccgttgcgtcaagccgcacggcaggataaggacagcgaagagcttcttcggaagggatttgtgcaagacgccgagactacaagcttggaaaatgaacaacttagcaacgacgaccaagccctatatcagaacgaggtggaggacgatgacggagcctgttccagtctgtatcttgaagaagatgacatttccgaaaatgatgatctgcgccagatgttgcccggtcattcccaatactcgttcactggcggttcccagggcaaccacctcggcaagcagaaggtgatcgagcggtctctgacagagtacaactccaccatggagagggtcgagtctcaagtccttaaacggaacgagtgctataaacccactggattgcatgccacaccgggagaatctcaggaacccaacctttctgccgaaagttgtgggctgaacagcggtgcacagttcggctttaactacgaagaagagccgtccgtggcaaaatgtgtgcaggcgtccgctccggctgatgagcgcatattcgactactattccgcacgaaaggcaagcttcgaagccgaggttattcaggacacaattggcgacacaggcaagaagcctgcaagttggagccagtccccgcagaaccaggagatgcggaaacactttccccagaaattccaattgttcaacacctctcacatgcccgtgttagcccaggacgtgcagtacgaacattcacacttagaaggcactgagaatcacagtatggccggtgacagtggcattgactcacccaggacccaatctttgggaagcaacaattctgtaatcctggatggactaaagagacggcagaacttcttgcagaatgttgaaggaaccaagtctagtcagcccctaacctccaattctttgctgcctctgacaccagtgattaatgtctag

SEQ ID NO: 242643 - DNA, 4178 bp, Artificial Sequence
  Description of Artificial Sequence: Synthetic coding sequence
atggtggagccgggacaggacctgctcctcgccgctctcagcgagagcgggattagtccgaatgacctatttgatattgacgggggtgatgccggactggcaacacctatgcccactccctctgtgcaacagagcgtgcccctatcagctttagagcttggcttggagactgaggctgcagttccagtaaagcaggaacccgaaaccgttccaacacctgccttgcttaatgtacggcagccgccttcaaccacaacatttgttctgaatcagattaatcatctcccccctctggggtcgacaattgtaatgaccaaaactcctccagtaacgactaacagacagacaatcactttaacgaaattcatccaaaccacagcatctacacggcctagcgtttcagcacctaccgtgcgaaacgccatgaccagtgctcctagtaaggaccaggttcagctcaaggatctccttaaaaacaattctttgaacgagctgatgaaactgaaacccccagccaacatcgcccagccggtagccaccgccgcaactgacgtgtctaatgggacggtgaaaaaagaaagcagtaataaagagggcgctcgcatgtggatcaatgatatgaaaatgcgctctttcagtcccaccatgaaggtgccagtagttaaagaggatgacgagcccgaggaggaggacgaagaagaaatgggccacgcggaaacttacgctgaatatatgccaatcaaacttaaaattgggttgagacacccggatgctgtagtggaaacctccagtctctcctcagttacaccgccagacgtttggtacaaaacatcgatcagtgaggaaaccatcgataacggatggcttagtgcccttcagttggaggccattacatacgcagcccagcagcatgagacatttcttccgaacggggacagggccggtttcctcataggagatggagctggcgtgggaaaaggacgcactatcgctggcatcatctacgaaaactatctgctttctcggaaacgcgctctctggttcagtgtttcgaacgaccttaaatacgacgcggagcgcgacttgcgagatataggcgcaaagaacattctggtccactctcttaataaatttaaatatggtaagatttcgtcaaaacacaacgggagcgtcaagaaaggggttattttcgcaacatattccagccttatcggggagtcccaatccgggggaaaatacaagacccgcctgaagcagttattgcactggtgcggggatgatttcgatggcgttattgtgttcgacgagtgccacaaggcaaagaacctctgcccagttggcagttccaagccaacaaagaccggactcgcagtcctagagctccaaaataaacttcccaaggccagagtcgtgtacgccagcgctacaggagcttctgaaccacggaatatggcgtacatgaacaggctgggaatttggggcgagggaacacccttcagggaattctcggattttatacaggccgtagaacggaggggggtgggagcgatggaaattgtggctatggacatgaaattgagagggatgtacattgccagacagctgtcctttacaggtgtcacttttaagatcgaagaggtgctactttcccagtcgtatgtgaaaatgtataataaggccgtcaagttgtgggtcatcgctcgcgagagattccagcaagcagcagatctaattgatgcagaacagcgaatgaaaaagagtatgtggggacagttttggtcagctcatcagaggttttttaagtatctgtgcattgcttctaaagtcaaacgggtggtgcagctagctagggaggaaattaagaatgggaaatgcgttgttatcggcttgcagtcaacaggtgaagctcgcacacttgaggctctcgaggaagggggaggcgaactcaacgattttgtctctaccgctaaaggggttctgcagtccctgatcgaaaaacatttccccgctccggaccgaaagaaactgtatagcctccttggaattgacttaaccgccccatcaaacaattcatccccaagagacagcccttgtaaggagaataagatcaaaaaacgcaagggggaggaaattacgcgagaggccaaaaaggccagaaaagttggaggcctcaccggctccagttccgacgacagtggtagtgagagtgatgcttcggataatgaggaatcagactacgaatcgtcgaagaatatgtcaagcggcgacgatgacgattttaatccattcctcgacgaatcgaacgaagatgacgagaacgacccctggcttatccggaaggatcacaagaagaacaaagaaaagaaaaaaaagaagtcaatcgatcccgatagcattcaaagcgctctgctggcgtcaggcctcggaagcaagagaccgtccttcagcagtactcccgtgatttcccccgctccaaactctacccctgctaattcaaacacgaatagcaactcttctctgattacctcccaggatgctgtcgaacgagcccagcagatgaagaaagacctgctcgacaagctcgagaagctagcagaggacctccccccaaacacccttgacgagctgattgatgaattggggggacctgagaacgttgctgaaatgacagggagaaagggacgtgtcgttagtaacgacgacggttcaataagctacgaatcaaggtccgagctagacgtgccggtagaaatcttaaatatcaccgaaaagcaacggtttatggatggagataaaaacatcgctataatttccgaagctgcgagctcggggattagcttgcaggcagaccgcagggcaaagaatcagcgtcggagagttcacatgacgctggagctgccatggagtgcagatagggctattcagcagtttggaagaactcataggtccaaccaggtgacggcacctgaatacgtgtttctcatcagtgagttggccggtgagcagcgtttcgcctcaattgtcgcaaagcgcttggagagcctgggggcacttacccatggcgatagaagagctaccgagtcgcgagacctcagccggttcaacttcgataacaagtatggccgaaacgccctggagatcgtaatgaaaagtatcgttaatctggacagtcctatggtctccccacctcccgactaccccggagagtttttcaaagatgtccgccagggtctcatcggagtgggcctaataaacgtcgaggacaggagcggcatcctaaccttagacaaggactataacaacatcgggaagttcctcaacagaatcctgggcatggaggttcatcagcagaacgccctgttccagtacttcgctgacacattaacagcagtggtgcagaacgccaagaaaaatggcagatatgacatgggaatcctggacctggggtcaggcgacgaaaaggtgcgcaagtcagacgtgaaaaagttcttaaccccaggctactcgaccagcggccacgtcgaactctatacaataagtgtggagcgcggtatgagctgggaggaagccacgaagatttgggccgagctgaccgggccagacgacggattttacctgagtctccagatccggaacaataaaaaaacagctattctggttaaagaagtgaacccaaagaaaaagctttttcttgtttaccgcccaaatactggcaagcaactaaagctcgaaatatacgcagacctgaagaaaaagtacaaaaaagtggtgagtgatgacgcactgatgcattggctggatcagtataatagctctgccgatacatgcacccacgcatactggaggggcaattgtaaaaaagcaagtttgggtttggtttgcgaaatcggtctgcgctgtcgcacgtactacgtgttgtgcggatctgtgctcagcgtttggaccaaagtggaaggcgtcctcgcatctgtgagcggaacaaacgtcaaaatgcaaattgtgcgcctgcgaacagaggacggtcagagaatcgtgggcttgataatccctgccaactgcgtaagcccgttggtgaatctgctgtctacttccgatcagtctcagcagctagcagtgcaacagaaacagctttggcagcaacatcatccccaaagcattaccaacttatcaaacgccta

SEQ ID NO: 242644 - DNA, 4181 bp, Artificial Sequence
  Description of Artificial Sequence: Synthetic coding sequence
atggtagagccagggcaggatcttctgttagctgctctgagcgaaagtggaatcagccctaacgatctgtttgatattgacggcggtgacgctggccttgcaactcccatgccaacccccagcgtccagcagtctgtccctctgtcagcactggaactgggcctcgagaccgaggcagccgttcctgtgaagcaggagccagagactgtgcctacgcccgctcttctgaacgtgagacagcagccgccatcaactactaccttcgttctcaaccagatcaatcacctgcctccccttggcagcacaattgtcatgaccaagactccaccagttacaaccaatagacagacaataaccttgacaaagtttatccagaccactgcaagcacccggcctagcgtctctgctcctacagttcgcaacgccatgaccagtgcccctagtaaggatcaggttcaactcaaagaccttctaaagaacaactcacttaatgaactgatgaaactcaagccccctgctaacattgcccaaccggtggcgacagccgctacagatgtttctaatggaactgttaaaaaggagtctagcaataaggagggtgcgagaatgtggattaacgatatgaaaatgcggtctttctctcccactatgaaggttcccgtggttaaagaggacgacgagccagaagaggaggacgaggaagagatgggccacgcagagacatacgcagagtacatgcctattaagctgaaaataggcctgcggcaccccgatgccgtggtggagacctcgtctctctcctctgtcacaccccctgatgtttggtataaaacatccattagcgaggagacgattgacaatggctggctgtccgccctccagctggaagctatcacatacgctgcccaacagcatgagacctttcttccaaatggagatagagccggatttctgataggggacggcgctggcgtgggaaagggacggacaattgcaggcataatttatgagaattatcttctgtccagaaaaagggcactgtggttcagcgtaagcaatgatctgaaatacgacgcagagcgagatttacgagatatcggtgccaagaacatattagtgcactcgctaaacaaattcaagtatggaaagataagtagtaagcataatgggtccgtaaagaaaggcgtgatttttgccacctattcctccctcattggtgagtcccagagtgggggaaagtataagacaagactaaaacagttactgcattggtgcggcgacgacttcgatggcgtgatagtgtttgacgagtgccacaaagcgaaaaacctttgtccagttggatctagcaaaccaactaagactggcttggccgtgctggagctgcagaataagttacctaaagcccgtgtggtctacgccagtgcaaccggagccagtgagcctcgtaacatggcatacatgaatagattggggatttggggcgagggtactccatttagggagttctctgactttatccaggcggtagaaagaagaggcgttggcgctatggaaatcgtcgccatggacatgaagctcaggggcatgtatattgcccgtcagttatcctttaccggagtgactttcaagatagaggaggtcttactgtcccagtcttatgtgaagatgtataataaagctgtcaaactgtgggtcatcgccagggaacgctttcagcaggccgctgatctgatcgacgccgagcagcggatgaaaaaatctatgtggggccagttttggtccgctcatcagaggttcttcaagtacctttgtattgccagcaaagtgaaaagggtggttcagttggctagggaagagatcaaaaacggcaagtgtgtagtgattggactccagtcgacaggtgaggcgagaaccctggaggccttagaggaaggtgggggagaactgaacgacttcgtgtccactgccaagggagtgctccagtccctgattgaaaagcacttccccgcacctgatcgaaagaagctctattccctactcggtattgacctgacagctcctagtaacaatagttcccccagagatagtccctgtaaggagaataagataaaaaagcggaaaggggaagagattacacgggaggccaagaaagctagaaaagtgggcggactcacgggctcatcatctgatgatagtggctcggagagtgatgcaagcgataacgaagagtcagattacgaatcctcgaagaatatgagctcaggcgacgacgatgatttcaacccatttctggatgagagcaatgaggacgatgaaaatgatccatggctgattcggaaggatcataagaaaaataaggagaaaaagaaaaaaaagtcaatcgacccggacagtatccagagcgctctactggcctctggcctgggaagcaagagaccttcattctcttccacacctgtgatcagtcctgccccaaactctacccctgctaacagcaacacaaacagtaactcctcactgattacctctcaagacgccgtcgaacgcgcacagcagatgaaaaaggatctcctggataagctggagaagcttgccgaggacttacctccgaacacgctagacgaacttattgacgaactcggagggcctgaaaatgtggcggagatgactggccgtaaaggcagggttgtcagcaatgatgatgggagcataagttacgagtcacgaagcgaactcgatgtccccgtggagatccttaatataaccgagaagcagcgctttatggacggcgacaaaaacatcgctattatctcagaggcggcttcaagtggaatctccctgcaggccgaccgcagggcaaaaaatcagcgtcggcgtgtgcatatgaccttagagctgccatggtctgccgacagggcgatccagcagtttgggcgtacccacagatcgaatcaagtgactgctccagaatatgtatttctgatctcagaactggccggagaacagaggttcgcttccattgtcgctaagagacttgaaagcctgggcgcactcacccacggtgacaggagagcaactgagtcccgcgatctatccaggtttaactttgacaacaagtatggtagaaacgccctcgaaattgtgatgaaatccatcgtaaatctggatagcccaatggtgagccccccaccagattacccaggcgaatttttcaaggacgtgcggcaaggattaattggtgtgggtctcataaatgtcgaagacaggagcggaattctcacgttagacaaggactacaacaatatagggaaattcctgaatagaatactgggcatggaagtgcaccaacagaatgccctttttcagtatttcgctgatacattaactgccgttgttcagaatgctaaaaaaaatgggcgatatgacatgggcatattggacttggggtcaggagacgaaaaggtgaggaaatcagacgtcaaaaaatttttaacccctgggtacagtacatccggccacgtggaactctacactatcagcgttgagaggggcatgagctgggaggaggctactaaaatttgggccgaattaaccggccctgacgatggattctaccttagcctgcagatcaggaacaataagaaaactgccatcctcgtgaaggaagtgaatcctaagaaaaagttatttctggtctacagaccgaacaccggaaagcagctgaagttggaaatttatgccgacctgaagaaaaaatataagaaggtggtctctgatgatgccttaatgcactggttggatcagtacaactcatcagccgatacctgcacccatgcttattggcgcggaaactgcaagaaggcctcgctggggctggtttgcgagatcgggctgagatgccggacttattacgtcctttgtggctccgtgctgtctgtttggaccaaagttgaaggagtactggcatccgtttccggaacaaatgtgaaaatgcagatagtcagactccggaccgaagacgggcaacggatagtgggccttatcataccagccaattgtgtgtcgccgctggtcaacctgctgtccacctcagaccaaagtcagcagcttgcagtgcagcaaaagcagttatggcagcaacatcacccccaatcaatcacaaacctcagcaatgctta

SEQ ID NO: 242645 - DNA, 2199 bp, Artificial Sequence
  Description of Artificial Sequence: Synthetic coding sequence
atggtcgagccagggcaggacctcctacttgccgcactgtctgaatcaggcatctccccaaacgacctgtttgacattgatggaggcgatgctggcctggcaacccccatgcctacgccctctgtgcagcagagtgtgcccctgagcgctctggagctgggattggaaaccgaggctgcagtgcctgtcaaacaggagcccgagacagtgcctactcctgccctcctcaacgtgcgacagccaccatccaccactacattcgtgcttaatcagattaaccacctccctcctttgggctcgacgatcgtgatgactaagacgccgcctgtgacaactaaccggcagactattacattgacaaagttcatccagacaacagcttctacccggcctagcgtctcagctccgacagtaaggaacgccatgacctctgcacccagcaaggaccaagttcagctaaaggatctgttgaagaacaatagtttgaacgagcttatgaaattaaaaccccctgccaatatagcgcaacctgtggctacggccgctacagatgtctcaaatggtaccgtgaagaaggaatccagcaacaaagaaggagcccgaatgtggatcaacgatatgaagatgaggtctttttcaccgaccatgaaagttcctgtggttaaggaggacgatgagcctgaggaagaggacgaggaagagatgggacacgcggaaacctatgcggagtatatgccaattaagctcaaaattggtttgcgccacccggacgctgtggtagagacttcctccctctctagtgtgaccccgcctgatgtttggtacaaaacctccatcagtgaggagaccattgacaacggctggctgtcagccctgcagctagaggccataacctatgctgcccaacaacacgagaccttcctgccaaacggagatagagccggattcctcatcggagacggagccggtgtgggcaaaggaagaaccattgccggaattatctatgaaaattacctcctctcgcggaaacgggcactgtggttttccgtgtccaatgacctcaaatacgatgctgagagggacttacgtgatattggtgccaagaacatcctcgtgcactcactcaacaaattcaagtacggcaaaatctcgtctaaacacaacggttctgtgaagaaaggcgttatctttgccacttactcaagcctcattggcgaatcacagagcggagggaagtacaaaacgcgcctcaaacagctgctgcattggtgcggcgatgatttcgatggagtgattgttttcgatgagtgtcataaggctaagaacttgtgcccagtcggatctagcaaacctaccaaaacgggactggctgtactggagctccaaaacaaactcccgaaagctcgcgtggtctatgccagcgccacaggggcatctgagccgaggaacatggcttacatgaaccgtcttggcatatggggagaggggacacccttccgtgagttctctgatttcatccaggctgtcgagcgcagaggagtgggcgcaatggaaatcgtggccatggacatgaagctccgcggtatgtatatcgcccgacagttatcctttactggtgtgacatttaagatcgaagaggtgcttctgtcccagtcatatgtgaagatgtacaacaaggccgtcaaactttgggtgatagctcgtgaacggttccagcaggccgcagacctcatcgatgccgagcagcgcatgaaaaagtccatgtggggccagttctggagcgcgcatcaacgctttttcaaatatttgtgcattgcctctaaggtgaaacgcgtggttcagttagcaagggaggagatcaagaacggaaaatgtgtggtgattggactgcaatcaaccggtgaggcccgtactctagaggccttggaggagggcggaggggaattaaatgatttcgtgtctactgccaagggggtgctgcagtccctcattgagaaacacttccccgctcctgaccgcaagaaattgtacagcttgcttggcatcgatttaaccgctccgagcaacaacagctccccaagagactcaccttgtaaggagaataagataaagaaacgaaagggcgaggagatcacacgcgaagccaagaaagcccgaaagatgtccctgatgcgcatgatgaaaatggtttccagctag

SEQ ID NO: 242646 - DNA, 1632 bp, Artificial Sequence
  Description of Artificial Sequence: Synthetic coding sequence
atggagcaggtgaatgagctgaaggagaagggtaataaagctctgtccgtggggaacatcgacgatgcgctccagtgctacagtgaagccattaaattggatccacacaaccatgtcttgtactctaataggagtgctgcatacgcgaagaaaggcgattatcaaaaggcttacgaggatgggtgcaaaaccgtggatctgaagcctgattggggtaagggctattctaggaaagcagccgcattggagtttctcaatcggttcgaagaggctaaacgcacatacgaggaaggccttaagcacgaggccaacaatccccaacttaaggagggactgcagaacatggaagccagattagccgaacgtaaattcatgaatccatttaacatgccaaatctttaccaaaaactagagagcgatccccgtacccgcacgttactgtcagaccctacttaccgtgagttaatagagcagctgcggaataaaccgtcagacttaggcactaagctgcaggatcctcggatcatgactacgctcagtgtacttctgggagtggacctcggatccatggacgaggaagaggagatcgctactccccctccccctcctccgcctaagaaggaaacgaaacctgaacccatggaagaagatctgcctgagaacaaaaaacaggcgctgaaagagaaagaactgggtaacgatgcctacaagaagaaggactttgacactgctctcaagcactatgataaggctaaggagctggaccccactaatatgacctacatcactaaccaagcagccgtgtatttcgagaaaggtgactacaataagtgcagggagctctgcgaaaaagcaattgaagtgggtagggagaacagggaggattatcgccagattgccaaagcctacgctcgcataggtaacagctacttcaaggaggagaagtataaggatgccatccatttctacaataaatcactggccgaacatcgaactcccgatgtcctcaaaaagtgccagcaggccgaaaaaatcctgaaggaacaggaacggctagcttacatcaaccccgacctggcacttgaggaaaaaaacaagggcaacgaatgctttcagaaaggcgactacccacaggccatgaagcactacaccgaggctatcaaaagaaatccgaaggatgccaaactttattctaatagggcagcttgttacactaagcttctggagtttcaattggccctgaaagattgcgaagaatgcatccagcttgagccaacatttatcaagggttataccaggaaggccgcagcccttgaggctatgaaggactacaccaaagccatggacgtgtaccagaaggctctcgatctcgacagctcttgtaaagaggcggcagatggataccagcgctgtatgatggcgcagtacaatcggcatgacagcccagaagatgttaaacggcgagcgatggccgatccggaagtgcagcagattatgtccgaccccgctatgagattgatcctggagcagatgcagaaagatcctcaggcactgtcagagcacctgaaaaacccggtgatcgcccagaagatccaaaagctgatggacgtcggcctaatagctattcgttag

SEQ ID NO: 242647 - DNA, 1359 bp, Artificial Sequence
  Description of Artificial Sequence: Synthetic coding sequence
atgaatcggcagctagttaacatccttacagcgctgttcgctttctttcttgaaaccaatcactttagaactgctttctgtaaggatcacgactcccggagtgggaagcagcctagtcagacccttagcccctctgattttctcgacaaactaatggggagaacctcgggctatgatgccaggatcagaccaaacttcaagggaccacccgttaacgttacatgcaatatcttcatcaacagcttcgggtcagttaccgaaacaacaatggattacagagtgaatatttttctccgacagcagtggaacgactcacgcctggcgtatagcgagtaccctgatgactccctcgacttggacccgagtatgctggacagtatttggaaacccgacctcttcttcgcaaatgagaagggggctaattttcacgacgtcacaacagataacaagctcctgcggatcagtaaaaacggtaaggtgctgtactccatccggttgacgctgaccctctcatgtcccatggatctcaaaaattttcccatggacgtccagacatgtactatgcagctcgaaagctttggatatacaatgaacgacctcatcttcgaatggttgagcgatggccctgtgcaggtggcagaaggactcacactcccccagttcatcctgaaagaggaaaaagagcttggctattgcactaagcattacaacaccggaaaattcacgtgcattgaagtgaagttccatctagaacgccagatggggtactatctgatccagatgtacattccctccctgctcatagtgattctgagctgggtgagtttctggatcaacatggatgcagcaccagcaagagtggcactgggcataacgacagtgctgactatgaccacccaaagctctggaagcagagccagtcttccaaaagtgtcctacgttaaggctatcgatatctggatggcagtgtgcctgctttttgtgtttgctgccctcctcgagtacgcagcagtgaattttgtctcgaggcagcataaggagtttctgcgactgcggagacgtcagaagcgacagaataaggaggaagacgtgaccagagagtccaggtttaacttttccggatacgggatgggtcattgcctccaagtgaaagacgggactgccgtaaaggctacccctgctaatccattgccacagcctcccaaggatggtgacgctataaaaaagaaattcgtagatagggcgaagagaatagacaccatttcgcgggcagcatttcccttagctttcctcatcttcaatatcttctattggattacatacaagatcatcagacatgaggatgtgcataagaaatag

SEQ ID NO: 242648 - DNA, 3489 bp, Artificial Sequence
  Description of Artificial Sequence: Synthetic coding sequence
atgaatgggcatcaccagcagaatggagtcgagaatatgatgctgttcgaggtagtgaaaatgggcaaatcggctatgcagtcagtggtggacgattggatagagtcttacaaacacgaccgagacatcgccctcctagacctcatcaacttcttcatccagtgtagcggctgtaagggcgttgttacagctgagatgttccgacacatgcaaaactcggaaataatcagaaaaatgaccgaggagtttgacgaggactctggagattacccactgacgatggccggaccccaatggaagaaatttaaatcctctttttgcgagttcatcggagtgcttgttcgtcaatgccagtactctatcatctacgatgaatacatgatggatactgttatcagccttctcactggactcagtgattcccaagtccgcgcttttcggcatacctcgaccctggctgctatgaaactgatgacggccttagttaatgtcgccctgaatctgtctattaatatggataacacacaaaggcagtatgaagctgaacggaacaagatgattggaaagagagcgaatgagcgtctcgagctgctgctgcagaagagaaaggagctgcaggagaaccaggacgaaatcgagaatatgatgaacgcaatcttcaagggagttttcgtccatcggtacagggatgccattgcagagattcgcgctatctgtatcgaagagataggtatttggatgaagatgtactctgacgcgttcctaaacgattcttaccttaaatatgtggggtggacaatgcacgacaaacaaggagaagtgcggcttaagtgcctcacagcgctccaaggactctactacaacaaagagctgaactccaagctggagctgtttacctctaggttcaaggatcggatcgtgtccatgactctcgacaaagaatatgacgtggccgttcaagcaattaagctcctgacactggtgctgcagtcatccgaggaggttctgaccgccgaagattgtgagaatgtataccaccttgtgtacagtgcccacagaccggtcgccgtggccgctggggaattcttatataagaaattgttctcaagaagagatccggaggaagatggaatgatgaagcgccgaggccgtcagggcccaaatgccaatctcgtgaagacgctggttttcttcttcctcgaatccgaactccacgagcatgccgcatatctggtagactctatgtgggattgcgctacagagctgctcaaggactgggaatgcatgaacagcttattgctggaagagcccctgtccggagaagaggccctcactgatcgccaagagtctgctctcattgagatcatgctgtgcactatcagacaggcggcagaatgccatccaccggtcggaagagggactggtaaacgggtgctgaccgctaaagagaaaaagacacaactggacgatcgtactaaaattacagagctctttgcagtggcactacctcaacttttagctaaatactctgtggatgccgaaaaggtgactaatctgcttcaactgccccagtacttcgacctcgagatttacactacgggtcggttagagaaacatctggacgctctgcttagacagatccgcaacatcgttgaaaaacacaccgacaccgatgtgttggaagcctgttctaagacttatcatgccctgtgtaacgaagagtttaccatcttcaatcgagtggacattagtcgatcacagctgatcgacgagctggctgataagtttaataggctgctcgaggactttctgcaggagggggaggagccggacgaggatgacgcatatcaagtcctgtcaacactgaagaggattacggctttccataatgctcacgacctgtccaaatgggatctgttcgcatgtaactacaagcttctgaaaacagggatcgagaatggtgacatgcctgagcaaatcgtgattcatgcattgcaatgcactcactacgttatcttgtggcagttagcgaaaataactgagagctcttctaccaaagaagatttattgcgattaaagaagcagatgcgagtgttctgccagatctgtcagcactacctgactaatgtgaatacgaccgtcaaggaacaagcctttaccatcctctgcgacattctaatgatctttagtcaccagatcatgtccggaggacgggatatgttagagcccttggtctatacaccggatagcagccttcagtccgagttactttcttttatcctcgatcatgtctttattgagcaggatgacgataacaattccgcagacggccaacaggaggacgaggccagtaagatcgaggcactccacaaaagaaggaatctgttggctgccttttgcaaactcattgtctatactgtggtggagatgaacacggccgctgacatctttaaacaatatatgaagtactacaacgattacggcgacattataaaggagacaatgagcaagacgcggcaaattgacaagatacagtgcgccaaaacactgattctctcattgcagcaattgttcaacgagatgatccaggagaacgggtacaactttgaccggagttcttcgactttcagtggcattaaagagctggctcggagatttgcactcacatttggactggaccagcttaaaacacgggaggctattgccatgcttcacaaggatggcatcgaatttgcatttaaggagcctaatccccagggggagtctcacccaccactaaacctggcatttctggacatcctgtctgagtttagctcaaaactcttgcgccaggataaacgcacggtatacgtatatttggagaaatttatgacatttcaaatgtctctgagacgcgaggacgtgtggctgccactcatgtcataccggaattctctgctggccggaggcgacgatgacaccatgtcagtgatttctggcatatctagcagaggatccacagtgcgctcaaaaaagagcaagccctcgaccggcaagcgcaaagtggtggaaggcatgcagctgagtttaactgaggaaagttcttcctctgattcaatgtggctgagtcgagagcagaccctgcacactcctgtcatgatgcagaccccccagctgacgtcgactatcatgcgggaaccaaagcggctgcgacccgaagactccttcatgtcagtctacccgatgcagactgagcaccaccaaaccccgctcgattacaacagacggggaacttcactgatggaggacgatgaggagcctattgtcgaagatgtgatgatgtcctcagaaggccgtattgaagacctgaacgaaggtatggattttgacactatggacattgatctacctccttccaagaacagacgagagcgaacagaacttaaacctgattttttcgaccccgctagcatcatggatgagtctgtcctgggcgttagtatgttctag

SEQ ID NO: 242649 - DNA, 3696 bp, Artificial Sequence
  Description of Artificial Sequence: Synthetic coding sequence
atgatcgccgcacccgagattcctactgacttcaatctgttacaggaatctgagacgcatttctcgtcggataccgacttcgaggacattgagggaaagaatcaaaagcaggggaagggcaaaacttgtaaaaaggggaagaagggtccagccgagaagggcaagggcggtaatggaggcggtaagcccccaagcggacctaatagaatgaatggccatcaccagcagaacggcgtggaaaatatgatgcttttcgaagtcgtcaagatgggcaagtctgccatgcagtctgtggtagacgactggatcgagtcttataaacacgatcgggacatcgcactccttgacctgatcaatttttttatccagtgtagcggctgtaagggggtggtcaccgccgagatgttccgccatatgcagaattccgagatcatcaggaagatgaccgaagagtttgacgaggacagtggggactaccccctgacaatggctgggcctcaatggaagaagtttaagagctctttttgcgaattcattggcgtactcgtgcgccagtgccaatatagtataatctacgatgaatacatgatggataccgtgatttccctactcactggattaagtgatagccaggtgcgcgcattccggcatacttcgacgcttgctgctatgaaactaatgacagctttggtaaatgtcgctctgaatctaagcataaatatggacaatactcagaggcagtacgaggccgaacggaataagatgattggcaaacgggctaatgaaagactggagctgctcctgcagaaaagaaaagagctgcaggagaatcaggatgaaatcgagaatatgatgaatgcgattttcaagggcgtgtttgtccacagatatagagacgcgattgcagaaatccgggcaatctgtatcgaagagattggaatttggatgaagatgtactctgacgccttccttaatgactcttacttaaagtacgtgggatggactatgcacgataagcaaggtgaggttcggctaaagtgtctcacggcccttcaaggactctactataacaaagagctcaactctaagcttgagctgttcactagccggtttaaagacagaatcgtaagcatgacacttgacaaggagtacgacgtggccgtgcaagccatcaagctgctcactctcgtgctccagtcctccgaagaggtgctgactgccgaggactgtgagaacgtgtatcacctggtgtacagtgcccaccggccagtggctgtggcggcaggcgagtttctatataaaaaacttttctcacgccgagacccggaagaggatggaatgatgaagagacgcggaaggcagggccctaacgccaacttggtgaaaacccttgttttctttttcctcgaatctgaactccacgaacacgcagcatatttagttgattcaatgtgggactgtgctactgagctactgaaagactgggaatgcatgaactctctgctcctggaagaacctctatctggcgaggaggctctaaccgacagacaggaatccgccctcatcgagatcatgctgtgtacaatcaggcaggccgcagagtgtcacccacccgtagggcgaggcacagggaaacgcgtgctgaccgccaaggaaaagaagacacagctggacgacaggacaaaaatcacagagctgttcgcagtggctttgccacaactgctggccaagtattctgtagacgccgagaaggtgaccaacctactccagctcccccagtatttcgatctggagatttatacaaccggaaggctggagaagcacctggatgcgctccttagacagattcgaaacatcgtggaaaaacataccgacactgatgtgctggaggcatgctcaaagacttatcacgctctctgcaatgaagagttcaccattttcaacagggtggacatcagccgtagtcaactgatcgacgaacttgccgacaagttcaatcgacttctggaagactttttacaggagggtgaggaacctgatgaggatgacgcataccaagttctgtccacccttaaacgaataacggccttccataatgcacatgatctaagcaaatgggatctgtttgcctgtaactataaacttttaaagactgggattgagaacggggacatgcccgaacaaatcgtgattcacgcgctccagtgcacgcactatgtgattctgtggcagttggccaagattacggaatcctctagcactaaggaggatttactccgactgaagaagcagatgcgagtattctgtcagatttgccagcattacttaactaacgtgaacactactgtgaaggagcaggcctttaccatcttgtgcgacatcctcatgatattcagtcaccagattatgagtgggggtcgcgacatgttagaacctcttgtctatacaccggactcgtctttgcagtctgaacttttgagcttcattctggatcacgtattcatagagcaggacgatgacaacaactcagccgatggacagcaggaagacgaagcctccaagatcgaggccctccataaacgccgaaacttattggctgcattctgcaagctcattgtctataccgtagtggagatgaataccgccgcagatatcttcaagcagtacatgaagtattacaatgactatggcgatataatcaaggagactatgtcaaagacaaggcagattgataagattcagtgtgctaaaaccctgatcttgtccttacagcagttgtttaatgagatgattcaggagaacgggtataatttcgatagaagtagctcaacattctctggcatcaaggaactcgccaggcgttttgccctgacttttgggctggatcagcttaaaacaagagaagcgattgcaatgctccataaagatggtatagagttcgcttttaaggaacctaacccacagggcgaatcccacccacctctaaacctggcgtttttggatatcctgagtgaatttagcagcaagctgcttcgccaggacaaaagaacagtgtacgtgtatctagaaaagttcatgacctttcaaatgtccctgcgaagggaggatgtctggctgccactcatgtcctacagaaactccctactggccggaggagacgatgatacgatgagcgtcatatcaggcatcagtagtcgtggctctaccgtccggagcaaaaagagcaagccttccacagggaagagaaaggtggtggaggggatgcaactgagtttgacagaggaaagctctagtagcgacagtatgtggctgtccagggagcaaactctgcacacgcccgtgatgatgcaaacacctcagctgacctctactattatgcgcgaacccaaaaggttacggcctgaggactcctttatgtctgtgtacccaatgcagaccgaacaccatcagactccactggactacaaccgcagagggactagtctcatggaggatgacgaggaacccatagtggaggacgtaatgatgtcctctgagggacgcattgaagatcttaacgaagggatggactttgacacgatggatatcgacttgcccccttcaaaaaatagacgcgaaagaaccgagttgaagccggattttttcgatccagctagcattatggacgaaagtgtgctcggcgttagcatgttttag

SEQ ID NO: 242650 - DNA, 3807 bp, Artificial Sequence
  Description of Artificial Sequence: Synthetic coding sequence
atgatcgctgcccctgaaataccaacggattttaatctgcttcaggagagcgagacccacttttcaagcgatacagattttgaggacattgaggggaagaatcagaaacaaggcaaaggaaagacctgcaagaaggggaagaagggacccgctgagaaaggaaaggggggaaatgggggaggaaagccgccaagcggcccaaataggatgaatgggcatcaccaacagaacggcgtcgaaaacatgatgcttttcgaagtagttaagatgggaaaatctgccatgcaaagcgtggtggacgattggattgagagctataaacatgatcgtgacatcgcgctgctggaccttatcaacttctttatccagtgtagtggttgtaaaggggtagtgaccgcggaaatgtttcgccacatgcagaatagcgaaatcatcagaaaaatgacagaggagtttgatgaagactctggcgattatcctctaaccatggccggtcctcaatggaaaaagttcaaatcatcattctgcgaatttattggggtgctggtgcgacaatgccaatatagcataatctatgacgagtacatgatggacaccgtgatctcactcctgactgggttaagcgactctcaggttcgggcattccgtcacacgagtaccctagcagcaatgaagctgatgacagcactggttaatgttgctctgaatcttagtatcaatatggacaacactcagagacagtatgaagccgaacgtaataaaatgatcggcaagagagccaacgagcgcctggaactgctgctccagaaacgcaaggaactccaggaaaaccaggatgagatcgaaaatatgatgaacgctattttcaagggagtgtttgtgcaccggtacagggacgctatcgccgagataagagccatctgtattgaggagattggaatttggatgaagatgtacagcgacgcttttctcaacgacagttacttgaagtacgtgggatggacaatgcacgacaaacagggcgaagttaggctcaagtgtttaacggctcttcagggcctatattataacaaagaactaaactccaaactcgagttattcacctcgcgttttaaagatagaattgtttctatgacacttgataaagaatatgatgtcgcagtgcaggccatcaagctgctcactctagtgttgcagtccagtgaggaagtccttacagctgaggattgcgaaaacgtataccacctcgtgtactctgcccacaggcctgttgctgtagcggctggagagttcttgtacaagaagcttttcagcagaagggatcctgaagaggacggaatgatgaaaaggaggggaaggcagggtcccaacgctaacctggtcaaaactcttgtatttttttttctcgaatcagaactgcacgagcatgctgcctacctggttgactccatgtgggactgcgctactgagctgctcaaggactgggagtgcatgaacagcctgctgcttgaagagcccttgagcggggaggaggcacttaccgacaggcaggaatctgctttgatcgagattatgctgtgcacaatacggcaggcagccgagtgtcaccctcccgtaggccgagggacaggtaagagggtcttaacagcgaaagaaaaaaagacacagttagacgataggacgaagattaccgagctgtttgctgtggcccttccacaactgcttgcaaaatactccgtggatgccgaaaaagtgactaatcttctccagctcccgcaatatttcgacctggaaatctacacaacgggacggctcgaaaaacacctggacgccctcttacgccagattcgaaacatcgtcgagaagcacacggacacagatgttctggaggcctgttcaaagacctaccatgccctttgcaacgaggagttcacgatatttaatcgagtggatatctccagaagccaactgatagatgagctggcagataagttcaatcgactactagaagactttctgcaagaaggggaggagcctgatgaggatgacgcctaccaggtgctgtccaccctgaagcggatcaccgcatttcacaacgcacatgatctgagcaagtgggatctgtttgcttgcaactataaactgctgaaaacaggcattgaaaatggcgatatgcccgaacagattgtcatacacgcgctgcagtgcacacactacgtcattctgtggcaacttgctaaaattaccgaaagttcctccacaaaggaagacctgctgaggctgaagaaacagatgcgagtgttttgccagatctgtcagcattatttgactaacgttaatacgacagtgaaggagcaggcatttacaattttgtgcgatatattaatgatctttagtcatcagatcatgtcggggggtcgggacatgctggaaccactggtgtacacgcccgacagttctttgcagagtgagctgctcagcttcattctggaccatgtgtttatcgagcaggatgacgacaacaattctgcggacgggcagcaggaagacgaggcttccaagattgaggcccttcataaaagaagaaacctgctggctgccttttgtaaattgatcgtgtataccgttgtggagatgaacaccgcagccgatattttcaagcagtacatgaagtactacaacgattatggggatatcatcaaggaaacaatgagtaaaacccgccagatcgacaaaattcagtgtgccaaaaccctcatactttcactgcagcagctgttcaacgaaatgatacaggagaacggctacaatttcgatcgcagctcctctactttctcgggcattaaagagctcgctcgtcggttcgctctaactttcggcttagatcagctaaaaacccgcgaagctatcgcaatgttacataaagatggaattgagttcgcattcaaggagcctaatccccaaggcgagtcccatccgcctctgaacctagcctttcttgacattctctccgagtttagctctaaactcctcagacaagacaagcgcaccgtttatgtgtatctcgaaaagtttatgacattccaaatgtcgttaaggagagaggatgtgtggttgcccctgatgtcctatagaaattcgcttcttgcaggcggtgacgatgatacaatgagcgtcatctccgggatcagcagcagggggagtacagtaaggagcaaaaagtccaaaccatccacaggaaagagaaaggtcgtggagggaatgcagctttcattgacagaagagagctcctccagcgatagcatgtggttgtcgcgggagcagacactgcacacccctgtcatgatgcagacccctcagctcacaagcactattatgagggagccaaagagactcagacctgaagatagctttatgagtgtgtatcccatgcaaacagaacaccaccagaccccgttggattacaatacccaggttacatggatgcttgcgcaacgccagcaggaggaagcccgacagcagcaggaacgtgccgcaatgagttacgttaagctgaggacaaacctccaacatgcgattcgtcggggaacaagtctcatggaggatgatgaggagcccatagttgaagacgtgatgatgagctctgaaggtcgaatcgaggatctgaatgaaggcatggattttgacaccatggacattgacctgcccccttccaagaaccggagagagcggaccgagctgaagcctgatttcttcgacccggcttctattatggatgagtccgtcttaggggtctccatgttttag

SEQ ID NO: 242651 - DNA, 3696 bp, Artificial Sequence
  Description of Artificial Sequence: Synthetic coding sequence
atgatcgcagcacccgagataccaaccgattttaatttgctgcaagagtccgaaacacactttagctcggacaccgacttcgaagatatcgaggggaagaatcagaagcagggaaaaggcaagacctgtaagaagggcaagaaaggcccagccgagaagggcaaaggagggaatgggggagggaaacctccctcaggtcctaaccggatgaatgggcaccaccagcagaacggtgtggagaacatgatgttgttcgaggtagtgaagatggggaaatctgccatgcagagcgtggtagatgattggattgaatcttacaaacacgatagggacattgcgctgcttgacttgatcaattttttcatacagtgttctgggtgcaaaggcgttgtaacagccgaaatgttccggcatatgcagaactctgaaattatcagaaagatgacggaagaatttgatgaagacagcggcgattatccactgaccatggccggtcctcagtggaagaaatttaagtcttcattctgcgaattcatcggtgtcttagtgcggcaatgccaatactcaattatttacgatgaatatatgatggacacagtcatctctctgctcactgggctctccgatagccaggtgcgcgcattccgacatactagtactctcgcggcaatgaagcttatgactgccctggttaatgtggcccttaatctgagtataaatatggataacacgcagcgccaatatgaggccgaacggaacaaaatgatcggcaagcgcgcaaatgagagactcgaactactgctgcaaaaaagaaaggagttgcaggagaaccaagatgaaatagaaaacatgatgaacgctatcttcaagggcgttttcgtccaccgctatcgagacgcaattgcagagattagagcgatctgcatcgaagaaattggaatctggatgaagatgtactcggacgcatttctgaacgacagttatctgaagtatgttggctggaccatgcatgacaaacagggagaagttaggctaaaatgtcttaccgctctacaaggactctattataacaaggagctaaatagtaagcttgagttgtttacctctcggtttaaggacagaatcgtgagtatgactctcgacaaagaatatgacgttgcagtccaggcaataaagctgctgactttagtgctccaaagctcagaggaggttctaacggcagaagattgtgaaaacgtgtaccatcttgtgtactccgcgcacagacccgtggccgttgccgctggggagttcttatataagaaactcttctcccgtagggacccagaggaggacggcatgatgaagagacggggacgacagggacccaacgcgaatctcgtgaaaactttggtgttttttttcctggagtctgaactgcatgaacatgccgcttaccttgtagactcaatgtgggattgcgctacagagctgctcaaggactgggaatgtatgaattccttactgctggaggaaccgcttagtggcgaagaagccctcacggatagacaggagagtgccctaattgagattatgttgtgtaccattcgccaggccgctgagtgtcacccgcctgttggacggggtactggcaagcgtgtcttgactgctaaagagaagaaaacgcagctggacgatcgcaccaaaataactgagctcttcgcagtcgccctgcctcagctccttgctaagtattcagtcgacgcagagaaagtgaccaatctgcttcagctcccccagtatttcgacctcgaaatttatacaactgggcgactagaaaaacacttggacgccctgcttagacagattaggaatattgtcgagaagcataccgacaccgatgtgctcgaggcatgttccaagacctaccatgctctttgcaacgaagaatttacgattttcaatcgagttgacatcagccgcagccagttaatagacgaactcgcagacaaattcaatcgactcctcgaggattttctccaggaaggtgaggagccagacgaggacgatgcctatcaagttctttctactctcaaacgaattaccgccttccacaatgctcacgatctgtccaaatgggacctgttcgcatgcaattacaaacttctgaaaacaggaatcgaaaacggggacatgccagagcagatagtgatacatgccttgcagtgtacacattatgtgatactatggcagctggcaaaaattactgaatccagcagcaccaaggaagatctcctgcgattaaaaaaacagatgagagtcttttgccaaatctgccaacattatttaacaaacgtgaacaccaccgtgaaagaacaggcctttacaatactatgtgatatcctgatgatcttcagccaccaaatcatgagcgggggtcgagatatgctggaacctctggtttacacccccgacagctcactgcagagtgagctcctctccttcatactcgaccatgtgtttatcgaacaagacgatgacaacaactccgccgacgggcagcaggaggatgaagccagcaagatcgaggccctgcacaagcgcaggaacctcctcgcagctttttgtaaactgattgtgtacacagtggtggaaatgaacacggcggctgacatcttcaagcagtacatgaagtattacaacgattacggggacattatcaaggagacgatgagtaagacacgacaaatagataaaatacagtgcgctaagaccttgatcctaagtctccagcagttatttaacgagatgatccaggagaatggctacaacttcgatcgctccagctccacctttagcggcatcaaagagctcgcgagaaggttcgctttgacttttggtttagaccagctgaaaactagagaggctatcgctatgctccataaggacggtatagaattcgctttcaaggagcctaacccccagggggaaagccatccccctctgaatctggccttcctggacattctgagtgaattttctagcaaattgctgcgacaagacaaaaggaccgtgtatgtgtacctagaaaagtttatgacctttcagatgtccctgcgcagagaagatgtctggctcccactgatgagctatagaaattctctgctggcgggaggcgacgacgataccatgtccgtcatttccgggatctcttcccgaggcagtacagtaaggagcaagaagtccaagccttctacaggcaagcgtaaagtggtggaaggcatgcagctctctctgactgaagagtcctctagctccgattcaatgtggctgtccagggaacagacactgcacactcccgtcatgatgcaaacacctcagctgaccagcacaattatgcgtgaacccaaacgtctgcggccagaggattcatttatgagtgtgtacccgatgcagactgagcaccatcagactccccttgattacaacaggagaggcacttccttgatggaagatgatgaagaaccaatagtagaggatgtcatgatgtcatctgaagggaggattgaggatctgaacgaagggatggatttcgacaccatggatattgatttaccacccagtaaaaatcggagagagcggacagagttgaagcccgatttctttgaccccgcttctattatggacgaatccgtgctgggggtgagtatgttttag

SEQ ID NO: 242652 - DNA, 3696 bp, Artificial Sequence
  Description of Artificial Sequence: Synthetic coding sequence
atgattgccgctcctgagatccccacggattttaaccttctgcaggaatcggagacgcatttctcctccgacacagacttcgaggatatcgaaggcaagaatcagaagcaaggcaagggcaagacctgtaagaaggggaaaaaggggccagccgagaagggaaaggggggaaatgggggaggtaagccgcctagtggtcccaaccgaatgaacggacatcaccaacagaatggcgtggagaatatgatgctgtttgaagtggtcaagatgggcaagtccgcaatgcagagtgtagtggacgactggatcgaaagctataaacatgacagggatattgcccttctcgatctcattaacttctttatccaatgctcaggctgtaagggcgtcgtgaccgctgaaatgttccggcatatgcaaaactctgaaattatccggaagatgaccgaggaatttgatgaggattcaggggattaccccctgacaatggctggcccacagtggaagaaattcaaatccagtttctgtgaatttatcggtgtactcgtacgccagtgtcagtattccatcatctacgatgagtacatgatggacaccgtgatttctttattgacggggctgtctgactcccaggtgcgggctttcagacacacttcaactttggccgctatgaagcttatgaccgcattagtgaatgtggcacttaacctttccatcaacatggataatacccagcgccagtacgaagcggagcggaataaaatgattggtaagagagccaacgaaagactggagctactgcttcagaaacgaaaggagctgcaagaaaatcaggacgagatcgagaacatgatgaatgccatttttaaaggagtgtttgtacataggtacagagacgccatcgcggaaatcagagcaatttgtatcgaggaaataggcatatggatgaagatgtatagcgatgcgttccttaacgactcctatctcaaatacgtagggtggactatgcacgacaaacagggggaagtgaggttaaagtgtcttactgcactgcaagggttgtattacaataaggagttgaactcaaagctagagctgtttaccagtagatttaaggatcgaatagtgtcaatgactctggataaggagtacgacgtggctgtgcaggcgattaagcttttgaccttggtcctacaatcaagcgaggaagtgctcaccgccgaggattgtgagaatgtgtatcatctggtgtacagcgcccatagacccgtggctgtagcggcaggcgagtttctctacaaaaaactgttcagcagacgcgaccccgaggaagacgggatgatgaaacggagaggtagacagggacccaacgctaatctcgttaaaacactcgtctttttcttccttgaatctgaactacatgaacatgctgcttacctggtcgacagcatgtgggactgtgccactgaactgctgaaagattgggagtgcatgaacagcctcctcctggaggagcctttaagtggtgaggaggctctgaccgatagacaggaaagcgcgcttattgaaatcatgctgtgtaccatcagacaagccgctgagtgccaccccccagtcgggaggggcacgggcaagagggtccttaccgccaaagagaaaaagactcaattggacgaccggacaaaaattaccgaactgttcgcggtggctctgccacaacttctcgcgaaatacagcgtggatgccgagaaagtgacgaatcttctccagctgccccaatattttgatctggagatctacaccaccggacggctggagaagcaccttgatgctctgctgcgtcagattcggaatatcgtcgagaaacacactgacacagatgtgctcgaagcctgctcaaagacataccatgcgctttgtaatgaagagttcactatttttaacagagtagacatttccagatcacagttaatagatgagctggcagataagtttaacaggctgttagaagattttttgcaggaaggagaagagccagatgaggatgacgcatatcaggtgctatcaaccctgaaaaggatcactgccttccataacgcccatgatttgtctaaatgggatctctttgcatgcaattataagctcctcaaaacaggaatagaaaacggtgatatgccggaacaaatcgttatccacgcccttcagtgtacccactacgtcattctgtggcagttggctaagatcactgaaagctcgagtactaaagaagacttgctgagactcaaaaaacaaatgcgagtgttctgtcagatctgccagcactatttaaccaatgtcaacacgactgtgaaagaacaggctttcactattttgtgcgatatcctgatgatcttttcgcatcagatcatgtcaggcggtcgggatatgcttgagccactagtctatacccctgactcaagcttacagtccgagctcctatccttcattctggatcacgtattcatcgaacaggacgacgacaataatagtgccgacggccagcaggaagacgaagcatccaaaatcgaggccttgcataaaaggcgaaatctactggctgcattttgtaaactgattgtctacaccgtggtcgagatgaataccgcagcagacatcttcaagcagtacatgaagtactacaacgactatggcgacatcattaaagagacaatgtccaagacgagacaaatagataagatccagtgtgcaaaaacactgattctctcgttgcaacagctttttaatgagatgatacaagaaaacggatataactttgatcgaagctcttccacatttagtggcatcaaagagctcgctcggaggttcgccctcactttcggccttgaccaactcaagactagagaggctatcgccatgctgcacaaggacggaattgaattcgcattcaaagaaccgaacccacaaggcgagtcccatccaccactgaatctagcttttctcgatatccttagcgagttctccagcaaactgttgaggcaggataaacggaccgtttatgtttaccttgagaaatttatgaccttccagatgagtcttcggagggaagacgtctggctgcctctcatgtcttaccggaattctctacttgcgggaggcgatgacgatacgatgtctgtcatcagcggtatctcttctcggggatccacagtccgttctaagaagagcaagccatctaccggaaagcggaaggtggttgaggggatgcaacttagcctaaccgaggaatcctcaagcagtgatagcatgtggctgtcccgtgagcagactctgcataccccagtgatgatgcagacacctcaattgacgtcaactatcatgcgagagccgaagcggctaaggccagaagattcctttatgagcgtgtaccctatgcagacagaacaccaccagactccattggactacaaccggagaggcacatctcttatggaggacgacgaagagcccattgtagaagatgtgatgatgtcctctgaagggagaatcgaggacttaaacgagggcatggatttcgatactatggacatcgacttgcccccttctaaaaacaggcgagaacggaccgaattaaagcctgatttcttcgaccctgcctctataatggacgagagtgtgctgggagtatctatgttttag

SEQ ID NO: 242653 - DNA, 213 bp, Artificial Sequence
  Description of Artificial Sequence: Synthetic coding sequence
atgattgccgcaccggaaattccgactgatttcaacctgctgcaagagtcagaaactcatttctcttccgataccgattttgaggatatcgagggaaaaaaccagaagcagggcaagggtaaaacatgtaagaaaggtaaaaagggtcccgctgagaaaggcaaaggtgggaatggcggtggaaaaccaccctccggccctaacagaatgtag

SEQ ID NO: 242654 - DNA, 348 bp, Artificial Sequence
  Description of Artificial Sequence: Synthetic coding sequence
atgattgctgccccagaaattccaacagatttcaacctgctgcaggagagcgagacccacttttcatctgataccgactttgaggatatcgaaggcaagaaccaaaagcaggggaaaggtaaaacgtgcaagaagggcaagaagggaccagccgaaaagggcaagggagggaacggtgggggaaaaccaccttctggtccaaacaggatgaacggtcatcaccagcagaacggggtggaaaacatgatgctgttcgaagtcgtcaagatgggaaaatcagcgatgcaaagcgtggtagacgactggatcgagagctataagcacgatagggacattgccctgctgtag

SEQ ID NO: 242655 - DNA, 510 bp, Artificial Sequence
  Description of Artificial Sequence: Synthetic coding sequence
atgatcgcagctccagaaatccctactgacttcaacctgttgcaggagtccgaaacgcacttctctagcgataccgactttgaggatatcgaaggcaagaaccaaaagcagggcaaagggaagacctgcaaaaaaggcaaaaaaggccctgcagaaaagggcaaaggcggaaacggcggagggaagcctccaagtggcccaaatcggatgaatggtcaccaccagcagaatggggtagagaacatgatgttgtttgaagtcgtaaagatgggaaaatctgctatgcagtccgtcgtcgacgattggattgagtcatacaagcatgacagggatatcgccctcttagatctgattaacttcttcattcagtgttctgggtgcaagggagtcgtaacggccgaaatgttcaggcatatgcagaatagcgaaatcatcagaaaaatgacggaggagttcgacgaggatagcggagactaccctctcacgatggcaggcccacagtggaagtag

SEQ ID NO: 242656 - DNA, 465 bp, Artificial Sequence
  Description of Artificial Sequence: Synthetic coding sequence
atgatcgccgctccagaaattcccacagattttaatctgctccaggagtcagagactcacttttcctctgacactgatttcgaggatattgagggaaaaaatcagaaacagggaaaggggaaaacctgtaagaaaggaaagaaggggccagccgagaagggtaagggagggaacggcggaggcaaaccccctagcggcccaaatcgcatgaacgggcatcatcagcaaaacggggttgaaaatatgatgctctttgaggtagtcaagatgggaaaatccgctatgcagagcgttgtggacgattggatcgagtcttacaagcacgaccgtgatatcgcgctcttggatctgatcaacttttttattcagtgcagcgggtgcaagggagtggtcacagctgagatgttccgtcatatgcaaaatagcgagattatcaggaagatgacggaagaatttgatgaatag

SEQ ID NO: 242657 - DNA, 627 bp, Artificial Sequence
  Description of Artificial Sequence: Synthetic coding sequence
atgatcgccgcacctgagataccaaccgattttaacctgctccaggagagcgaaacacacttcagctctgatacagatttcgaggacattgaaggaaaaaaccagaagcagggcaaagggaagacctgcaagaaggggaaaaagggcccagcggaaaagggaaaaggcggaaacggaggtggaaagcctccgagcggtcctaaccgaatgaatggccatcaccaacagaacggtgtcgaaaatatgatgctattcgaagttgtaaagatgggcaaatctgccatgcagagcgtggtcgacgactggatcgaatcctacaagcacgaccgtgacattgccctgctcgatctgattaatttcttcatccagtgctcaggatgcaaaggcgtcgtcaccgctgagatgtttagacatatgcagaattctgaaatcatcagaaagatgaccgaggaattcgatgaagactccggagattatcccttgactatggcaggccctcagtggaaaaagtttaagagctctttttgcgagttcattggggttctggtgaggcagtgccagtattcgattatttacgacgagtacatgatggacacagtgatctcattactgaccgggctgtcttag

SEQ ID NO: 242658 - DNA, 1647 bp, Artificial Sequence
  Description of Artificial Sequence: Synthetic coding sequence
atgatcgcagcgccagaaattccaaccgacttcaatctgttgcaggaaagcgagactcacttcagttccgatacagacttcgaggatattgagggtaagaatcagaagcagggcaagggaaagacctgcaagaagggaaagaagggacccgctgagaagggtaaggggggaaatggtgggggaaaacctccttctggtcctaatcgtatgaatggccaccatcagcagaacggagtggaaaacatgatgctcttcgaggtggtgaagatgggaaaaagcgcaatgcagagcgtcgtggacgattggatcgagtcctacaaacacgaccgcgatatcgctctgctcgatttgatcaatttcttcatccagtgctccggttgtaagggcgtcgtaaccgcagaaatgtttaggcatatgcagaactcagagattattaggaagatgaccgaggaatttgacgaggattccggcgattatcccctaacaatggccggtccccagtggaagaaattcaaatcttcgttctgtgagtttattggagttctcgtccggcagtgccagtactccattatttacgacgaatacatgatggacaccgtgataagcttgcttaccgggctatcagattcacaggtgcgcgcatttagacacacctccaccctcgccgctatgaaactcatgaccgccttggttaacgtggcgctgaatctgtcaatcaatatggataacacacagcggcaatacgaagctgagcggaataaaatgattgggaagcgcgctaacgaacggctggagctgcttttacaaaaacgcaaagaattgcaagaaaatcaggatgagattgagaacatgatgaacgccatttttaaaggcgtgtttgtgcaccgctaccgtgacgctattgccgagatccgggcaatctgcatcgaagaaataggtatttggatgaagatgtacagcgacgccttcctgaatgattcatacctgaagtacgtcggatggacgatgcacgataagcagggagaagttcggctgaaatgtctcactgccctgcaggggctctactacaacaaggaactgaacagcaagcttgagctcttcacctctcgttttaaggaccgcatcgtctctatgacacttgacaaggaatatgatgtggccgtccaagcaattaagctgttgactcttgtgcttcagtcatcagaggaagtactgaccgctgaggattgtgagaacgtgtaccacctggtttatagcgcccaccggccagtcgccgttgcagccggtgagttcctgtacaaaaaattgttttctcggagagaccctgaagaagacggaatgatgaagcggagggggaggcaagggccaaacgcaaatttggtcaaaacactagtttttttcttcctggaatcagagctccacgaacatgctgcgtacctggttgactccatgtgggactgtgccactgagcttctaaaggattgggagtgtatgaattcccttctactagaagagccgctgtcaggcgaggaggctctgactgatcgacaagagagcgcgctcattgagataatgctgtgcacgattagacaggccgctgagtgtcacccacctgtcggaagaggcaccggaaaaagagtgctctag

SEQ ID NO: 242659 - DNA, 123 bp, Artificial Sequence
  Description of Artificial Sequence: Synthetic coding sequence
atgatagccgctcccgaaatccccaccgacttcaatttacttcaggagtccgaaacccatttttctagcgacacggactttgaggacatcgagggtaaaaatcagaagcaagggaaaggatag

SEQ ID NO: 242660 - DNA, 3678 bp, Artificial Sequence
  Description of Artificial Sequence: Synthetic coding sequence
atgtccagtcccctacagagagcagtgggggatactaagcgggcactgtctgctagctcctcaagcagtgcaagcctgcctttcgatgaccgggactcgaatcacacaagtgagggaaatggcgattcactgttggcagacgaagacacagacttcgaagacagcctgaacaggaacgtgaaaaaacgagccgcaaagcgccctcccaaaacgacccctgtggcgaagcatccaaagaaaggttctcgggttgtgcaccgacactcccgaaaacagagcgaacctccggcaaacgatctgttcaatgccgtcaaagcagccaagtctgacatgcagagcctggtggacgaatggctcgattcctacaagcaggatcaggacgccggattcctcgagttggtcaactttttcattcagtcatgcgggtgcaaggggattgtgactccggagatgtttaagaagatgtccaactctgaaattatccagcacctgacggagcagttcaacgaagatagtggcgactatcctttgattgcacctggcccaagctggaaaaagttccagggttctttctgcgaattcgtgcggacccttgtttgccagtgtcaatattctctattgtacgatggcttcccaatggatgatctgattagccttctgactggactgagcgactcacaggtgcgagctttccgccacacatcaactctcgccgctatgaagctgatgacgtcgttggtgaaagttgctttacagctcagtgtccatcaggacaataaccagagacagtacgaagccgaacgcaacaaaggccctggtcagcgcgcacctgaaagactggaatctctcctggaaaagagaaaggaactgcaagagcatcaggaagaaatagagggcatgatgaacgccctcttccgcggtgtcttcgtgcacaggtaccgggacgtcttgccggagatacgggcaatttgtattgaggagattggttgttggatgcagtcatactcaacttccttcctgacagactcatacctgaagtatatcgggtggaccctgcatgacaagcacagagaggtacgcctgaagtgtgtgaaagcccttaagggtctgtatgggaatcgcgacctgacaacccgtctggaactttttaccagtcgtttcaaggacaggatggtctctatggtcatggaccgggaatatgatgtggcagttgaagcggtaagactgctgatccttattctcaaaaacatggagggggttctcacggacgcagactgtgaatcagtttacccagtggtttacgccagccaccgcggacttgcctccgccgctggtgagttcctttactggaaattgttttaccccgagtgcgagattagaatgatgggaggcagagaacagagacagtcccccggagcacaacgcaccttctttcagctgctgctgagtttcttcgtcgaaagtgaactacacgatcacgctgcttacctcgtcgacagcttgtgggactgtgccggagctaggttgaaggattgggagggactgacatcactgttgctggaaaaagaccagaatctgggcgatgtacaagagtctacgctgatcgagattctggtgtcgagcgcgaggcaggcctcagagggccacccgcctgtagggagagtaacaggtcggaaagggcttacatctaaggagcgaaagacacaggctgacgatcgggtgaaattgacagaacacctcattccgctgcttccccaattgcttgcaaaattcagtgctgacgcagaaaaagtcacaccactgttgcaactgctgagttgcttcgatctgcacatatattgtaccggcaggctcgagaaacacctagaactgtttctgcagcaattgcaggaggtggtagttaaacacgcagagcctgctgtgttagaggctggggcacatgccttgtaccttctctgcaatccagagtttactttcttttcacgggcagactttgcgagatcacagctggtggatctgctcacggatcggttccagcaggagttggaagaactgttgcaaagctcatttctagatgaggacgaagtttataacttagccgctaccctgaaacgcctgagcgctttctataatacacacgacctaacccgttgggaactgtatgagccgtgttgtcaactccttcagaaggcagtggatactggcgaagttccgcatcaggttatattgcccgcactgaccctcgtgtatttctcgatcctctggacattgacccacatctcaaagtcagatgcatcgcagaaacagctgagttccctgcgggacagaatggtggcattctgtgaactgtgccagtcttgtttgtccgatgttgatacagagattcaggaacaagcatttgtgctgctgtccgatctgcttctgatattctccccccagatgatcgtgggaggtcgcgactttttacggcctctcgtttttttcccagaggccaccctccaatctgagttggccagcttcttaatggatcacgtgttcatccagccgggtgacctaggatctggtgattctcaggaggaccatttgcaaatagagcggttgcatcagcgccgtaggctcctggctggcttttgcaaactgctattgtacggggtgctcgaaatggacgcggcttcagatgtattcaagcactacaacaagttctataatgactatggcgacattattaaagagaccttaactagagcacgccaaatagacagatcccactgcagtcgtatactactgcttagtctgaaacaactttacacagagctgctgcaggaacatgggcctcaggggctcaacgagctacctgcgtttattgagatgcgagacctggcccgacggttcgccctgagcttcggtccccaacagctccagaacagagacctcgtcgtgatgctccataaggagggaatacaattctcgctctcagagctgccgccagccggttcaagcaaccagcccccaaatttggccttcctggagcttctcagcgaattcagcccaaggttattccaccaagataagcagttgttgctgtcttacctggaaaaatgtttacagcacgtgagccaggcccctggacacccgtggggaccagtcactacctactgtcacagcctgtctcccgtggagaacaccgccgaaacttcaccgcaggttcttccctcttccaagcggaggcgagttgaagggcctgccaagccaaatcgcgaggacgtgtctagcagtcaagaagagtctctccaacttaattctatccctcctactcccaccctcacatcaaccgcagtgaagtctcgacagccactttgggggctcaaggagatggaggaagaggacggcagcgaacttgactttgcccagggccaacccgtggcaggaacagagaggagtcggtttctgggaccccagtactttcagacccctcacaatccttcagggcctggcctcggcaaccagctgatgagattaagtttgatggaagaggacgaggaggaggaacttgagatccaggacgaaagcaacgaagaaaggcaggacacggacatgcaagcctcctcctacagttcaacctctgaacggggactggaccttctcgacagtacggaactggacatcgaggacttctag

SEQ ID NO: 242661 - DNA, 2667 bp, Artificial Sequence
  Description of Artificial Sequence: Synthetic coding sequence
atgagttcgcctctgcagagagcagttggcgacaccaagcgggctttgtccgcatcatcttcgtctagcgcatcactgccctttgacgacagagatagcaaccacacttcagaaggaaatggagattcactgttggccgatgaagatacagatttcgaggactctttaaatagaaatgtcaagaagcgggcagccaaaagacctcctaaaacaacgcctgtcgcaaaacaccccaagaaggggtctcgggttgtacaccggcactccagaaagcaatccgagcctcccgctaacgatctgttcaacgcggttaaggccgcaaagagcgacatgcaatcattggtcgatgagtggcttgattcgtataaacaggaccaagacgcaggctttctcgagttggtcaatttctttatacagtcctgtgggtgcaaagggatagtcacccctgaaatgtttaagaagatgagcaattctgagatcattcagcacttgactgaacagtttaacgaaatggacgacctgatcagcctgttgacaggactgagtgatagccaagtccgggcattcaggcacacaagtaccctggccgctatgaagctgatgacttccttggtgaaagtggccctgcagctgtccgtgcatcaagataataaccagcggcagtacgaggccgaaagaaataaagggcctggacagagagccccagaacgactagaatctctgttagaaaagcgcaaagaactgcaggaacaccaggaagaaatcgaggggatgatgaacgctttgtttagaggcgtatttgtgcacagatacagagacgtgttgcctgagatccgcgctatctgcatcgaggagatcgggtgttggatgcagtcttacagcacgtccttcctgacagatagctatcttaagtacataggctggaccctccacgataaacaccgggaagtgcgattaaagtgtgttaaggcgcttaaggggctgtatggcaatcgggacctcaccactcgcctagaattgttcaccagcagatttaaagatcgtatggtgagcatggtcatggatcgggaatacgacgttgccgtggaagcagttaggcttctgattctgattctgaagaatatggaaggagtccttactgatgcagattgtgagagtgtttacccagtggtgtatgccagtcacaggggcttggcgtctgctgctggggaatttctttattggaaactattttaccccgagtgtgagatccggatgatggggggtcgtgagcagcgtcagagccctggagcccagaggactttctttcagctgttgctgtctttttttgtggagtccgagttacacgatcacgcggcttacctcgtggactccctgtgggactgtgcaggagccaggctcaaggactgggaaggtttgacaagcctcctattagagaaggaccaaaacctgggagacgttcaagaaagtaccctgatcgaaattttagtgagttcggctaggcaggcctccgagggtcatccgcctgttgggcgtgtgactggcaggaagggccttacaagtaaagaacgcaagacacaggcagatgaccgtgtgaaactaacagagcacctgattcctcttctgccccagctcctcgccaagttcagcgcagacgccgagaaggtcaccccgctgctgcagctcctttcttgctttgacctgcatatctactgcaccggccgactggaaaaacacctggaacttttcttgcagcagctgcaagaagtagtcgtgaagcacgctgagccagcagtgctggaagcgggtgctcacgccctctacctgttatgcaaccccgagttcaccttctttagccgagccgacttcgccaggtcacaattggtagatttgttgactgataggttccagcaggaactcgaggagctcctgcagtcttcatttctggacgaggatgaggtatataacctcgctgcaacgttgaagaggctgagtgctttctataacacacatgatctcacacgctgggaactctacgaaccctgctgtcagcttttgcagaaggcagttgacacaggtgaggttccgcaccaagttatcctcccggctttgaccctggtatacttcagtatcttgtggaccttaacacattccctttcccctgtggagaacacggcagaaacatcaccacaggtcctgcctagcagcaaaaggcggagagtggaggggcctgcgaagcctaacagggaagatgtctcttcctctcaggaagagtccctgcagctgaactcgattcctcccacgccaaccctgacctccaccgcggtgaaatcacgccaacccttgtgggggctgaaggagatggaagaagaggatggtagcgaactggacttcgcccagggacagccagtggctggaaccgagcgttcgcggtttctcggccctcagtacttccagacacctcataatcccagcggccctggactcggaaaccaattgatgcgactgagcctcatggaggaggatgaggaagaggaactcgagatacaggatgaatctaacgaggaaagacaggataccgacatgcaggcatccagctattcgagtacttccgagaggggactggacctcctggacagcactgagctggacatcgaagatttttag

SEQ ID NO: 242662 - DNA, 789 bp, Artificial Sequence
  Description of Artificial Sequence: Synthetic coding sequence
atgttgcacaaagagggaatacagttttccctgagtgaactgccgcctgcaggctctagcaatcaacctcccaacctcgctttcctcgagctgctgagcgagttcagtccacgacttttccaccaagacaaacagctgttactttcttacttggagaagtgtctgcaacacgtgagtcaggcacctggacatccgtggggacctgttaccacctactgccatagcctgtcccctgtggagaacactgctgagacaagcccacaggtcctcccctcttctaagcgcagaagagtggagggacccgctaaacccaatcgggaggatgtgtcctccagtcaggaagagtcccttcagctcaattcaatacccccaacgcctacgctgactagcaccgccgtgaaatcacggcagcccctgtgggggcttaaggaaatggaagaagaggacggatccgagctggatttcgcacaaggatctcagccagtggccggaaccgagcgcagtcggtttttgggccctcagtattttcaaactcctcataacccatctgggcctggcttgggaaatcagttgatgagactgagtcttatggaggaagatgaggaagaggagttggagattcaggacgaatccaacgaagaacgtcaggacacggacatgcaggcaagctcctattcttcaacaagcgagagaggactggacctgctggactcaacagaactagatatcgagattacagagagtctgccactgttaggaaaatcaccacacccatacaatagccgctag

SEQ ID NO: 242663 - DNA, 438 bp, Artificial Sequence
  Description of Artificial Sequence: Synthetic coding sequence
atgagctccccattgcagcgggctgtgggggacaccaagagggccctgtccgcttcaagctcttccagcgcctccctcccgttcgacgatcgggattcaaatcacaccagtgaaggcaatggtgactccctattggcggatgaagacacggacttcgaagacagtctgaaccgtaatgtgaagaagagagcggctaagaggccccctaagacaaccccggtcgccaagcatccgaaaaagggttcgcgcgttgtccacaggcattctcgcaaacagagcgagccccctgccaacgatctgttcaacgcggtgaaggcagcaaagtcggatatgcagtcactcgtcgatgagtggctggattcctataagcaagatcaagatgcgggatttctggaactggttaacttcttcattcagtcatgcgggtgtaagggttag

SEQ ID NO: 242664 - DNA, 339 bp, Artificial Sequence
  Description of Artificial Sequence: Synthetic coding sequence
atgtcaagccccctccagcgggcagtgggtgacacgaaaagggccctgtcagcatcctccagcagctccgccagccttccctttgacgaccgcgattcaaatcatacaagtgaaggaaacggagactctctgctggccgatgaggatacagatttcgaggactccctcaatcggaacgttaaaaaaagggccgctaagagacctcctaagacaacaccggtggcgaaacaccccaagaagggcagcagggtcgttcacagacatagtcggaagcagagtgagccgccagccaacgatcttttcaatgcagtcaaagccgcaaaatccgacatgcagtag

SEQ ID NO: 242665 - DNA, 3678 bp, Artificial Sequence
  Description of Artificial Sequence: Synthetic coding sequence
atgagttcacccttacaacgggcagtgggcgatacaaaacgcgctcttagcgcaagttcatcctcttctgctagtctgccgttcgacgaccgcgactcaaatcataccagcgagggcaacggcgactctcttctcgcagacgaggatacggacttcgaggactcgctaaatcgaaacgtgaagaagcgtgcagctaaacgaccgcctaaaaccactcccgtcgccaagcaccctaagaaaggctcgagagtggtccaccgacattcccggaagcaatcggagccacccgctaacgacttgtttaatgccgtgaaggccgctaaatcagacatgcaaagcttggtggacgagtggctagatagctataaacaggaccaggacgccggtttcttagagctggttaatttcttcatacagtcctgcgggtgtaaaggcattgtgactcctgagatgttcaagaagatgtccaacagtgaaataatacagcacctcaccgagcagttcaacgaagacagtggcgattacccactaatcgcccctggaccaagctggaagaagttccagggctcattctgtgaatttgtgaggacgttggtgtgtcagtgccaatactctctgctctacgatggctttccaatggacgacctgatctcacttttgacaggactcagtgactctcaggtgagagctttccggcacacctctactctggctgccatgaaactgatgacctccctggtgaaagtggccctgcagctgagcgtgcaccaagacaataaccagagacagtacgaggccgaaaggaataagggtccgggtcagcgggctccagaacgcctcgaaagcctgctggagaaaagaaaggaactgcaggaacaccaagaggaaattgaggggatgatgaacgcactctttagaggcgttttcgtgcacaggtatagggacgtgctccctgagattcgcgcaatctgcattgaagaaattggctgctggatgcagtcgtactctacaagtttcctcacagacagctaccttaagtatattggctggactctccacgacaagcatcgggaggttcggcttaaatgtgtgaaggccctgaaaggactgtatggaaaccgggacttgactacacgtctagagctcttcaccagtaggttcaaagatcgcatggtgagtatggttatggaccgcgaatatgatgttgcagttgaagcagtgcgattgctaattctgatcctgaagaacatggaaggggtgctgactgacgctgattgtgagtccgtctaccccgtagtatacgctagccacagaggactcgccagcgcggcaggcgagttcctctactggaaacttttctaccccgaatgtgaaattagaatgatggggggtcgggagcagaggcaaagtccaggggcacagaggactttcttccagctgctgctgagttttttcgttgagagtgagttgcacgaccatgccgcatacttagtcgatagcctctgggactgtgccggtgccaggctaaaggactgggaaggactgacatcgttgctgctcgaaaaagaccaaaacctcggcgacgtgcaggagagcactctaatcgagattcttgtgtcctctgccagacaggcttctgaggggcacccacctgtaggtagggttactggacgaaaaggcctgacgtcaaaagaacgcaagacacaggctgatgaccgcgtgaaattgacggagcatctgattccactgctcccacaactgctcgccaaatttagcgccgacgccgaaaaggtgaccccattgctgcagctgctatcctgcttcgacctgcatatctactgcacagggcgactcgaaaaacatctggagctctttctccaacagctgcaagaggttgttgtgaaacatgcagaacctgccgtgcttgaagctggtgcgcacgctctgtatctcctctgcaaccccgaattcacatttttctctagggcagacttcgctcgcagccagcttgtcgacctgctaacagaccggttccagcaagaactcgaagaactccttcagtcttcattcctggatgaggacgaggtgtacaatcttgccgctactctcaagcggttgtccgccttctacaacactcacgacctgacaagatgggaattgtacgagccatgttgccagctcctgcagaaggctgttgataccggcgaggtgccacaccaagtaatcctgcctgccttgacgctcgtgtatttttccattctctggaccttgacccacatctctaaatccgatgctagccagaagcagctgagctccctaagagaccgcatggtggcgttctgcgagctgtgtcagagttgtttgtctgacgtggacactgagattcaagagcaggcattcgtactcctgtccgatctgctgctaattttttcgccccaaatgatcgtgggagggagagactttctccgcccattggtgtttttcccagaggccacactccagagcgagctcgcgtcattcctgatggatcatgtgtttatccaacccggagaccttggcagcggtgacagtcaagaggaccacttgcagatcgaaaggcttcatcagcgaaggaggctgttagcagggttctgcaaactactgctatacggcgtgctggaaatggatgcagcatctgacgtcttcaagcactacaacaaattttataatgattacggtgacatcatcaaagagaccttaacaagggccaggcagatcgataggtcccactgctcgaggattttacttctgtcactgaaacagctttacaccgagctcctccaggagcatggaccccagggacttaacgaactaccagcgtttattgaaatgagggatttggccaggagattcgcactgtcattcggccctcagcagctgcagaacagagacctggtggtgatgttgcataaagagggaatccagttctctctatcagagctaccacctgcaggctcttctaatcaaccacccaacctggcattcctagaactgttgtccgagtttagtccacgacttttccaccaggacaagcagctgctgttgtcctacctcgagaagtgcctccaacacgtgagccaagctcccggacacccttggggccctgtgacaacctattgccattccttaagtcctgtggagaacacagccgagacaagcccacaagtgctccccagctctaagaggcgcagggtggaagggcctgcaaagccgaacagggaggatgtgtctagctcacaggaggaatctctacagcttaacagcatcccacccacccccacactcacctcgaccgcagttaaaagccgtcagcctctgtgggggcttaaagagatggaagaggaggacgggagcgaactggactttgcccagggccagcctgtagccggtaccgagaggtcacgattccttgggcctcaatacttccaaacaccacataacccctccggtccagggttgggaaaccaactgatgcgcttgagtctcatggaggaggacgaggaagaggaactggagattcaggatgaatctaatgaggagaggcaggacactgacatgcaagcctcttcatactcctcaactagtgagagggggttagatctcctggactctacagagctggacatcgaggatttttag

SEQ ID NO: 242666 - DNA, 567 bp, Artificial Sequence
  Description of Artificial Sequence: Synthetic coding sequence
atgagctcaccgctgcagagagcggtcggagacacaaagcgtgccctgagcgcatcatccagcagtagcgcgtctctcccattcgacgatcgggattctaatcacacctctgagggaaacggagactccctgctagccgatgaagacaccgacttcgaagacagtctgaatcgcaatgtgaaaaagagagctgcaaaaaggccaccaaaaaccactccagtcgccaaacaccctaaaaaaggctccagggtggtgcaccggcacagcaggaaacagagcgagcctccagcaaacgacctcttcaatgctgtgaaggccgctaagtcggatatgcaggattctggtgattaccctctaatcgcaccaggccctagctggaaaaagttccaggggtccttctgcgagtttgtgcgtactcttgtttgccaatgtcaatacagcctgctgtacgacggcttccccatggacgacctgatctcactgctcacaggactctcagacagtcaggtcagggcttttagacacacatcaactcttgcggcaatgaagttaatgacatctctgtag

SEQ ID NO: 242667 - DNA, 1047 bp, Artificial Sequence
  Description of Artificial Sequence: Synthetic coding sequence
atggtttggccatgggtggccatggccagcaggtggggccctctgattggcttagcgccatgctgcttgtggctcctaggcgcagttttgctgatggacgcatcagcccgtcccgcaaaccacagcagcacccgcgaacgtgtggctaatcgggaagaaaacgaaattcttccccctgaccacttaaatggagtcaaactcgaaatggatgggcatctgaacagggggttccatcaggaagtttttctgggcaaagacttaggcggttttgatgaggacgctgagccacgaaggtctcgccgaaagttgatggtgattttttctaaggtagatgtgaacactgaccggaagatcagcgcaaaggagatgcagcgatggattatggagaagaccgcagaacatttccaagaagcgatggaagagtctaagactcattttagggccgtggaccctgatggcgatgggcatgtttcttgggatgaatataaagtgaaattcttggcctccaagggacattccgaaaaggaagttgccgacgcaatccggctgaacgaggaactaaaggttgatgaggagactcaggaggtgctggaaaatttgaaggataggtggtatcaggccgacagcccgccagcagacctgctgctaacagaagaggaattcctgagcttcctgcaccccgagcacagcagaggaatgttgagattcatggttaaggaaattgttagggatctggatcaggatggagacaaacagctgagtgtccccgagttcatttccctgcccgtcggcaccgttgaaaaccagcagggtcaggacatagatgacaactgggtgaaggatagaaagaaagagttcgaggagctgatcgacagcaatcatgatggaatagtcacggcagaggaactggagaacgtgcctaccttaccgctgcagccaatcggcacgctaaattcccacttcgtcaggctggcagcagagttgggcggagggaaagcaacactgacatgtgcacctcttgcccgtagggcgacctggactccttag

SEQ ID NO: 242668 - DNA, 1089 bp, Artificial Sequence
  Description of Artificial Sequence: Synthetic coding sequence
atggtgtggccctgggtggcaatggctagccgttggggacctctgataggactcgcaccctgttgcctgtggctcctgggggcagtactcctgatggatgctagtgctaggcctgccaatcactccagcactcgagaacgcgtcgctaaccgggaggaaaatgagatcctgcctccagatcatctgaatggtgtcaagttggagatggatgggcatctgaatcgaggtttccaccaggaggtgttcttgggtaaagacttggggggtttcgacgaagatgccgagccacggagatctagacgcaaactgatggttatcttttcaaaagtcgatgtcaatactgaccgcaagatctcagcaaaagagatgcagagatggatcatggaaaaaacagctgagcattttcaagaagcgatggaagagagtaagactcattttagggcggttgacccagatggggatggccatgtgtcgtgggatgagtacaaggttaagttcctcgcttctaaaggccattctgaaaaagaagtcgccgatgcgattagactaaatgaggaactcaaagtcgatgaggagacgcaggaggtgctggagaatctcaaggacagatggtatcaggctgatagtccccctgcggatcttcttttaaccgaggaggagttccttagtttcctccatcctgagcatagtcgcggaatgctgaggttcatggtcaaagagatagtcagggatcttgaccaggacggagacaagcagctgtcagtgcctgagttcatcagcttgcctgtgggaactgtggagaatcaacagggtcaagacatcgatgacaattgggtgaaagacaggaagaaagagtttgaggagttgatcgacagcaaccacgatggcatcgtaaccgctgaagaacttgaatcctacatggacccaatgaacgagtacaacgcactgaatgaagccaaacagatgattgcagtggccgatgagaaccaaaatcaccacctcgagccagaagaggtcctcaagtacagcgaattttttacggggagcaaactggtggattatgcacgttctgtgcacgaagaattctag

SEQ ID NO: 242669 - DNA, 732 bp, Artificial Sequence
  Description of Artificial Sequence: Synthetic coding sequence
tgactggaaatggatggacatctgaaccgcggtttccatcaggaggtgttcctggggaaggacctgggaggatttgacgaggatgctgaaccccgtagaagcaggcggaaactgatggttatcttttcaaaggtggatgtgaatactgatcgaaaaattagcgctaaagagatgcagaggtggatcatggaaaagacggccgagcacttccaggaagccatggaagagagcaaaacccacttcagagctgttgacccagacggcgatggccatgtgtcatgggatgagtataaagtaaagtttctcgcatcgaaaggacactcggaaaaagaagtagctgacgccattagattgaacgaggagctcaaggtcgacgaggaatcatccacttccaggaactttcttgacctcagagctggcgtatgcagacccaggtacccccaggctgcccctttgagtgcccaggaagtgctggagaacctcaaagaccgttggtatcaagctgattccccaccggcagatctcttgctgactgaggaggaattcctgagcttcctgcatcccgagcattcccggggtatgctgcgctttatggtgaaagagatcgtgagggatttggatcaggatggagataaacagttgtcggtgccagagttcattagtctcccggtgggtacggtggaaaaccagcagggccaggatatagacgacaactgggtgaaggaccgttag

SEQ ID NO: 242670 - DNA, 609 bp, Artificial Sequence
  Description of Artificial Sequence: Synthetic coding sequence
atggtttggccttgggtggcaatggcgagtcggtggggccctctaattggactggcgccatgttgtctttggctcttaggagctgtactgctcatggatgcttccgctagacctgcaaaccatagctccactagggaaagggtggcaaatcgggaggagaacgagattctgcccccagaccacctgaatggagtcaagcttgaaatggatggccacttgaacaggggatttcatcaggaagtttttctgggcaaagacctagggggtttcgacgaggatgcggaacccagaaggtctcgtagaaaacttatggtgatcttctctaaagttgatgtgaacactgaccggaagatctccgcgaaagaaatgcagaggtggattatggaaaagacggcagaacactttcaagaggctatggaagagagcaagacacacttccgggctgtggacccggatggagatggacacgtttcttgggacgaatacaaggtgaagttccttgcctctaagggccacagtgagaaggaagttgccgatgcaattagactcaacgaggagctgaaagtggatgaagagaggcacgggccacctggccctcgcgctctttag

SEQ ID NO: 242671 - DNA, 636 bp, Artificial Sequence
  Description of Artificial Sequence: Synthetic coding sequence
atggccgtggtccccctgctgctgcttggaggtttgtggtccgcagtgggagcttctagtctcggcgtagtgacctgtggaagtgtggtgaaactactgaatacccgacacaacgtccggctccacagccatgacgtacggtatggctcaggcagcgggcaacagtcagtgacaggcgttacctcagttgacgattcgaacagctattggagaatacgcggaaagagcgccacggtctgtgagaggggcacacccattaaatgtgggcagccaatccgccttactcacgttaacacagggcgtaatcttcacagtcatcacttcacttctcccctttcagggaatcaggaagtgtccgcgtttggcgaagagggcgaaggggactacctcgacgactggacagttctgtgtaatggaccttactgggttcgcgacggtgaggtgagatttaagcattcctctacggaggttctccttagtgtgacaggtgagcagtatggccgtcccatctcaggccagaaggaagtgcacggcatggcccagccttcccagaataattactggaaagctatggagggaatcttcatgaagccatccgaactgcttaaggccgaggcacaccacgcggagctatag

SEQ ID NO: 242672 - DNA, 666 bp, Artificial Sequence
  Description of Artificial Sequence: Synthetic coding sequence
atgtggagtgctggtagaggtggagctgcttggcccgtgctgcttggcctgctgcttgctctgctcgtgccgggaggaggcgctgcaaaaaccggagccgaactagtcacgtgtggttcagttttgaaacttctgaatacacaccaccgagtgagacttcactcacacgacataaagtatggatcagggtccggtcagcaatcggtgacaggagtggaggcatctgacgacgccaatagctattggagaatacggggaggttcagaaggaggttgccccagaggcagcccagtccgttgtggccaggccgtgaggcttacgcacgtactgactggcaagaaccttcacacccatcattttcctagcccattgtctaacaaccaagaggtgagcgccttcggcgaggatggagagggcgatgacctcgatttgtggactgttagatgctccggtcaacactgggagcgggaagccgctgtccgtttccagcacgttggcacgtcagtgttcctgtcggtgactggagagcaatacggttcacctatccgcggacagcacgaggtgcacggaatgcctagcgctaatactcacaatacatggaaggcaatggagggtatttttatcaaacctagcgttgaaccgagcgcaggccatgacgagctttag

SEQ ID NO: 242673 - DNA, 2058 bp, Artificial Sequence
  Description of Artificial Sequence: Synthetic coding sequence
atggacgtctgcgtacggctggcattatggctcctatgggggcttttactgcaccaaggtcaaagcctgtctcacagccactcggaaaaagccaccggcacttcatcaggagccaactcagaggagtccaccgccgctgaattctgtcggatcgacaaacccctctgtcacagtgaggacgagaagttgtcttttgaagccgtgcgtaacattcacaagcttatggacgacgacgcgaacggcgatgtcgacgtggaggagtccgatgagttcctgcgtgaggatctaaattatcacgatccaactgtcaaacactctacgtttcatggggaagataaattgataagtgttgaggacctgtggaaagcctggaaatcctctgaggtgtataattggacagtcgacgaagtggtccagtggcttatcacatacgtcgagttaccccagtatgaagagacatttagaaagctgcaactcagtggtcacgctatgccacggttagcagtgacaaacaccacaatgactgggactgtgctgaaaatgaccgacaggtctcacagacagaaactccagctaaaagcattagatactgtcctattcggcccacccttattgactagacacaaccatctgaaggattttatgctggtggtgtccatcgtcattggggtgggcggttgctggttcgcctatatccagaatcggtactccaaggaacacatgaagaaaatgatgaaggacctggaagggttgcacagggctgaacaatcacttcacgacctgcaagagcgccttcataaggctcaggaagagcacaggacagtggaggtggagaaagtgcacctcgaaaaaaagctgagagacgaaattaaccttgcgaagcaggaggcacagaggttgaaagagttgcgcgaaggaactgagaatgagcggtcccgccagaagtatgcagaggaagaactggagcaggttcgagaggccctccggaaagctgagaaggagctcgaatcccattcctcgtggtacgcaccggaggcattacagaaatggttgcagctgactcacgaagtggaggtgcaatactacaacataaaaaagcagaatgccgaaaagcagcttctggtcgctaaggagggggctgagaagattaaaaagaaacgaaatacattattcgggacatttcacgtggcacactcctcaagcctggatgacgtcgaccacaagatcttgacagcgaagcaggctctgagcgaggttacagcagccctccgagagcggctccaccgctggcagcagatagagattctgtgtggattccagattgtaaataaccccggtattcatagtttggtggctgcgctcaatattgaccccagctggatggggtccacacgacctaatccagctcactttatcatgacggatgatgtggatgacatggacgaggaaatcgtgtcccctttatctatgcagagtcccagcctacagagttcagtacgccagcgactgacagaaccccaacacggcctgggttcgcagagagacctgacccatagcgatagcgaaagttcactccatatgagcgatcgtcaacgagttgcccctaagccacctcagatgtcccgggctgcggatgaggcactaaacgccatgaccagcaatggcagccaccggctgatcgaaggagtgcaccccggtagtcttgtcgagaagcttccggactcacctgcactagccaaaaaagccctcctggctctcaatcacggacttgacaaggctcacagcctcatggagttgagtcccagcgctccacccggtggatccccacatctcgattcctctagaagccactccccctcgtcacccgatcccgacacccccagccccgtgggggattcccgcgctctgcaggcctccaggaatacaagaataccacatctggccggtaaaaaggccgttgccgaagaggacaacgggtctatcggcgaagaaactgacagcagccccggacggaaaaaatttcccctgaagatatttaagaaaccccttaagaagtag

SEQ ID NO: 242674 - DNA, 2502 bp, Artificial Sequence
  Description of Artificial Sequence: Synthetic coding sequence
atgaacgcagctggaattcgggctcctgaagccgctggagcagacggaacaaggttggcacctgggggaagcccctgcttacggagacgaggaagaccagaggagtcgccagcggctgtcgtggcccctaggggagccggagaattacaggcagccggtgcacccttgcggttccaccccgcttcaccgaggaggctccaccctgcgagcacgcccggacccgcatggggatggttgctgcgcaggcgcaggtgggcagctctgctcgtcctgggccttttggttgcaggcgcagccgacggttgcgagctggtgcccagacatttgcggggtcgtcgcgctacagggagcgctgcgactgctgcgagcagtcccgcagctgccgctggagattctcccgcacttatgacggacccatgcatgtcactgtctcctccatgttttacagaggaagatcgttttagtctagaggccctgcagacaatacacaaacaaatggacgatgataaagatgggggtatagaagttgaagagtctgacgagttcatccgcgaagacatgaagtacaaggacgcgactaataagcattcgcatctgcacagggaagacaaacatattacaatcgaagacctctggaagagatggaaaacttcggaagtgcataactggaccctggaagatactctgcaatggttaattgagtttgtcgaattgccacagtacgagaagaacttcagagataataatgtcaagggaaccactcttcctcggatcgctgtccatgaaccatccttcatgattagtcagcttaaaatcagtgatagaagtcaccggcagaaattacagttgaaggccctggacgtagtactgttcggccctctcacacgccctccgcacaactggatgaaggacttcatcctgacggtgagcatagtcatcggagttggcggttgctggttcgcctacacgcagaataaaacatctaaggagcacgtcgctaagatgatgaaggacctggaatctttgcagaccgccgaacagtctttgatggatcttcaggagaggctggagaaggcacaggaggagaatagaaacgttgcagtggaaaaacagaatcttgagcgcaaaatgatggatgaaatcaattacgccaaagaggaagcatgtagactcagagaactgcgggagggggcagagtgtgagctttctcgacgccaatacgctgagcaagagctcgaacaggttcgcatggcgctaaaaaaagcagaaaaagaatttgagctgagatctagttggtccgttcctgacgccctgcaaaagtggttacaactaacccatgaggtggaggtgcagtactacaacattaaacggcagaacgccgagatgcagctggcgatcgccaaggatgaagcggagaaaatcaagaagaaaaggagtaccgtgttcgggactctgcatgtggcccacagcagtagtttagacgaggtagatcacaagatcctggaggccaaaaaagccctttccgagctgacaacttgcctccgcgagcggcttttccggtggcaacaaatcgagaagatttgcgggttccagattgcccacaacagcggcctgccctccctgacctccagcctatactctgaccacagctgggtcgtgatgccaagggtgtctattccaccttatccaatagcaggtggcgtagacgatctagatgaggacacgccccctatagtgagccaatttcccggtacaatggctaaaccccctggctcacttgcgaggtcctcttccctgtgccggtccaggcggtccatcgtgcctagctcaccacagccccaacgggcacaactggcccctcacgccccacaccccagccaccccaggcaccctcaccaccctcagcacacaccacacagcctgccgtcacctgaccccgacatcctgtctgtctcatcatgcccagccctctatcgcaatgaggaggaggaggaagcaatttactttagtgcggaaaagcagtgggaggtccccgataccgcatcagagtgtgattcgctcaatagctccatcggtagaaaacagtcacctcctctcagcctggaaatttatcagaccctctcgcccagaaagatatcgcgagatgaggtgagcttggaggacagcagccggggagactctcctgttacggtcgatgtttcatggggaagccctgattgtgtgggactcaccgagactaaatccatgattttttcgccggctagcaaggtttataacggaattctggagaaatcatgctctatgaatcagctgagttccggaattccggtgcctaaacccaggcacaccagttgctcttcagccggtaatgatagtaaacccgtacaggaagcaccgtctgtggcgagaatctcctccattccccatgatctgtgccacaatggcgagaaaagcaaaaagccgtcaaaaattaaaagtctgttcaagaagaaaagtaagtag

SEQ ID NO: 242675 - DNA, 2526 bp, Artificial Sequence
  Description of Artificial Sequence: Synthetic coding sequence
atgaacgccgcaggcatccgcgcacccgaggcagctggcgctgacggcactagactggcccctggaggttctccttgcctaaggaggagaggaagacctgaagaaagcccggcagccgtagtagcaccacggggtgccggagaactgcaggcagcaggggcacccctgagatttcacccagctagtcccagacgtttgcatcccgcttctacacctggtcctgcttggggatggcttctccgcagacgaagatgggcagctctcttggttttgggtctgcttgttgccggtgcggcagatggatgtgagctcgttcctcggcacctgcgcggtcgccgtgcaactgggtcagcggcaacggccgcttcctcgcccgcagccgcagccggtgactcaccggctctcatgacggacccatgcatgagcctgtctccaccttgcttcactgaagaagacagattcagcctggaagcgctgcagacaattcataagcagatggacgatgacaaagatgggggaatagaagtagaagaatccgatgaattcatccgggaagatatgaagtacaaggatgcgacaaacaaacattcccaccttcacagggaggataaacacattaccatcgaggatctttggaagagatggaaaaccagtgaggtgcacaattggaccctcgaggacaccctgcagtggctcatcgagtttgtagaactgccccagtacgagaaaaatttccgggataataatgttaagggtacaacactgccacgaatagctgtgcatgaaccctcctttatgatctcccagctgaagatttccgaccggtcccatcggcagaagctgcagttaaaagcactggacgtggttctgttcgggccactgaccagaccacctcataattggatgaaggactttatcttaaccgtctccatcgtaattggggtgggtgggtgctggtttgcttacacacaaaacaaaaccagcaaggagcacgtggccaaaatgatgaaggacctggagtctctgcagacagcagaacaaagtctcatggatttacaggagaggcttgaaaaagcccaggaagaaaacagaaatgtggccgtggaaaaacagaatctggaacgcaagatgatggacgaaatcaactacgctaaagaggaagcctgtaggctgagagagctgcgggaaggcgctgagtgcgagctgtcaagaaggcagtacgctgagcaggagctggagcaagtgcgtatggcacttaaaaaggccgaaaaggaattcgaactgagatcttcatggagcgtccccgacgccctgcagaaatggctccagctgacccacgaagtcgaagtccagtactacaatataaagcggcaaaacgcggagatgcaactagctatagcgaaggatgaggtggccgcttcatacctgattcaagccgagaagattaagaagaagcgtagcaccgtgttcggtacgctgcatgtcgctcactcatcgtcgcttgacgaggtggaccacaaaatcctggaggcaaaaaaagcattgtctgagctgaccacctgtctccgggagagactgtttcgttggcaacagattgagaagatttgcggatttcaaattgcccataattctggacttccaagtctaacttcttctctgtactcagaccactcatgggttgtcatgccaagggtgtccatccccccatatcccattgccggtggagtcgacgatctcgacgaggatactccaccaatcgtgtcccagttccctgggacaatggccaagcctcccggaagtctggctcgaagttccagtttgtgtcgctcaaggcgctccatcgtgccgtcttcaccacagccacagcgtgcccagttggcacctcacgccccacaccctagccacccgagacaccctcaccacccccagcatacgccacactccctgccatcccctgatcccgatatcctgagcgttagcagttgtcctgccctctaccgtaacgaggaggaagaggaggctatatactttagtgcggagaaacaatgggaagttcctgacaccgcttctgaatgcgactccctcaactcttccattggcagaaagcaatctcccccactgtcgctggagatttaccagacactgtccccccgtaaaattagtcgtgacgaagtgagcctggaggattcgagtcgcggagactctcctgtcacagtggacgtgtcctggggatcgccagattgtgtaggattgacggagacaaagagtatgattttctcacccgctagcaaagtgtataacgggattttggagaagagctgctcgatgaaccagctgtccagtggcatccccgtcccgaaaccccgtcatacatcttgctcctctgctgggaacgattctaaaccagtgcaggaggccccaagcgttgctcgaatctcatctatcccccatgacctctgccacaacggagagaaaagcaaaaagccaagcaagattaaatcactgtttaagaaaaaatctaagtag

SEQ ID NO: 242676 - DNA, 2061 bp, Artificial Sequence
  Description of Artificial Sequence: Synthetic coding sequence
atgaatgcagccggaatccgagctcctgaggcagcaggcgcagacggcacacgtctagctcctgggggatctccatgcctaaggaggcggggacgtccggaggaaagccctgctgcagtggttgctcccaggggggcaggggagttgcaagcggctggcgctccacttaggttccacccagcttcaccacgcagattacacccagcttctaccccagggccagcttggggctggttactgaggagaagacgctgggccgcattgttagtgctgggcttattagttgctggtgctgcagacggatgtgaacttgtccctcgacaccttagaggaaggcgggcaaccggaagtgctgcaaccgctgcctccagtccagcggcagccgctggagacagcccagctttgatgaccgacccctgtatgtccctgtccccaccctgttttaccgaggaggatcgcttttccttggaagcactccagactatccacaagcagatggatgacgacaaggacgggggaatagaagtcgaggaaagtgacgagtttattcgagaggatatgaaatacaaggacgcgacgaacaaacatagtcatcttcatcgtgaggacaagcacattactatcgaggatttgtggaaaaggtggaaaacttcagaggtacataattggactttagaggacacattgcagtggttgatcgagtttgtcgaactgccccagtacgaaaagaattttcgggataataatgtgaagggcacgactctccccaggatcgcagtccacgaaccctcatttatgatctcccagctgaaaatttccgatcggtcccatagacagaagttacagctcaaggctcttgacgtggttttgttcggtccattgaccagacccccacacaactggatgaaagattttatcttgacagtttccatcgtaattggggtcgggggttgctggttcgcctacactcagaataagacttccaaagaacatgttgccaaaatgatgaaggacctggagagcctccaaacagccgagcagagcctgatggatctgcaggagaggctcgagaaggcccaggaggagaacaggaatgttgccgtcgagaaacagaatctggagagaaagatgatggacgagataaactacgctaaggaagaagcctgcagattgcgggaactgagggagggcgcagagtgtgaactgagtcgacggcagtatgccgaacaagaactggagcaggttcgcatggccctgaaaaaggccgaaaaggagttcgagctgcgttcttcctggagcgtgccagatgcattacagaagtggctccagttgacacacgaagtcgaagtccagtactataacattaaacgccagaatgcggaaatgcaactggctatcgccaaagatgaagccgaaaagatcaaaaaaaagcgttccaccgttttcggtacactacacgttgcccatagctcctctcttgatgaggtcgaccacaagatacttgaggccaaaaaggccttgagcgaactgactacttgcctaagagagcggctcttccgttggcagcagatcgagaaaatctgcggatttcagattgctcacaattccggtttgcctagcctgacctcaagcctgtactcagatcactcttgggttgtgatgcccagggttagcatcccaccttacccgattgctggcggagtggatgacctagatgaagacacccctcctatcgtaagccagtttccgggaactatggccaagcccccaggttccctggcaaggagttctagcctctgtcgtagtcgacggtccattgttccttcttccccccagcctcaacgagcacaactggctccccacgcaccacacccatcacacccaagacacccacatcacccgcagcatacaccacattccttaccttcccctgaccccgacatcctgtccgtgtcaagctgtcccgctctgtatagaaacgaagaggaagaggaggcgatctacttctcggcagagaaacagtgtattcatttaggtctgggtgcgtgcaagtctgaatag

SEQ ID NO: 242677 - DNA, 2241 bp, Artificial Sequence
  Description of Artificial Sequence: Synthetic coding sequence
ctgcttgtcctcggacttctcgtggcaggcgcagcagatgggtgtgagctggttcctaggcatctgcggggacggcgagccactgggtccgcagctactgctgctagttcccccgctgccgctgcgggagattctcccgctcttatgacagacccttgcatgtctttgtctcctccttgtttcacggaagaggaccggttctcactggaagccctccagactattcacaagcagatggacgacgataaagacggtgggattgaggtcgaagagagcgatgagttcattagggaggacatgaaatacaaagatgccaccaataagcattcccacctgcacagagaggacaaacacattaccatagaagacttgtggaagaggtggaagacaagcgaggtccacaattggactttagaagacacactgcagtggttaattgaattcgtggaattgccacagtacgaaaagaattttcgggacaataacgtgaaaggcacgaccctgcctcggatcgctgtccacgaaccatccttcatgatctctcagcttaaaatttcagaccggagccatagacagaaactgcagctgaaagccctggatgtcgtgctgttcggtccgctgacccgacctccccacaactggatgaaggattttattttgaccgtctctattgtaatcggcgtcggcggttgctggtttgcctacactcaaaacaaaacaagtaaagaacacgtggccaagatgatgaaggacttggaatctcttcagactgcagagcaaagcctgatggatctgcaagaaagactggagaaagcacaagaagagaatcgcaacgttgctgtggagaagcagaatctggagcggaaaatgatggacgaaatcaactacgctaaggaggaggcttgtagactccgggagcttcgggagggggctgaatgtgagctcagcaggagacagtacgctgagcaggagctggagcaggtccgcatggcgctgaagaaagcggaaaaggaattcgagctgagatcctcctggagtgttccagacgcactgcaaaaatggttgcaacttactcatgaggtcgaggtgcagtattataatataaagaggcagaatgctgaaatgcagttggccatagctaaggacgaagccgagaaaattaagaaaaagcgaagcacagttttcgggaccctgcatgtagcacacagcagtagcttagatgaggtcgaccacaaaatcctagaggccaaaaaagctctcagcgagctgacaacctgcctaagggagcggctatttcgctggcagcagattgagaaaatatgtggattccaaatcgctcataactcgggactaccttcactcacctcctccctctacagcgatcattcatgggtggtgatgcctagagtcagcatccctccctacccaatcgccggaggggtcgacgatctggatgaggacacccccccaattgtgtcccagtttcccggtacaatggctaagcctcctggatcattggctcgcagctcctccctgtgccggagtcggagatctatcgtgcccagctctcctcaaccccagcgtgcacagcttgccccacacgctccccacccaagtcatccaaggcacccccaccacccccagcacacaccacactccttaccaagtcctgaccctgatatactgtcggtttcctcatgccccgcattatatcgcaacgaagaggaggaggaagcaatctactttagtgcagagaaacagtgggaggtaccagacacagcctctgagtgtgatagtctcaatagtagtattgggagaaaacagagccccccactcagcctcgagatctaccagaccctgtccccccgtaagatatcgcgagacgaggtgagcctggaggattccagccgtggcgattcccccgtgactgtggacgtgtcttggggatcacccgactgtgtcggccttaccgagaccaaatcaatgatattcagcccagcctcaaaggtttacaatggcatcttggagaaatcctgctcaatgaaccagctgtcttccgggatccccgtaccaaagccacggcacacatcttgttcaagcgctggcaatgactctaagcccgtacaggaagccccatctgtggcccgtatttcatctatccctcatgatctgtgccacaatggggaaaagagtaaaaaaccgagcaagatcaagtcgctgttcaagaagaaaagcaagtag

SEQ ID NO: 242678 - DNA, 2265 bp, Artificial Sequence
  Description of Artificial Sequence: Synthetic coding sequence
cttctggtactcggtcttctcgttgccggagcagccgatggatgtgagttagtcccaaggcatctaagaggacgccgagcgaccggcagtgcggcaaccgcagcttcatccccagccgcagccgcaggggattccccagccttaatgaccgacccctgcatgtcgttgtctcccccttgctttactgaagaagacaggttcagcctggaggcccttcagactatccacaagcagatggatgatgacaaggacggcggaatagaagtggaggagagcgacgagttcatcagagaagacatgaaatataaggatgcaactaataagcactcacatttacatagagaggacaagcatatcaccatcgaggacctctggaaacggtggaagacgtcagaagtccacaattggacactggaggacactctacagtggcttatcgagttcgtcgagctgccacaatatgagaagaactttcgcgataataacgtgaagggtactacccttccacgaatcgcggttcacgaaccctcctttatgatttcccagctgaagattagcgaccggagtcacaggcagaaactgcagctgaaggccctcgacgttgtcctcttcggtcctctgacaaggcctccccataattggatgaaggatttcattcttactgtgtcaatagtgatcggagtcggtggatgttggttcgcttacacacaaaacaaaacatccaaggagcacgtggcgaaaatgatgaaggacctggaatcgcttcagaccgcggaacagagcttaatggatctgcaggagagactggagaaagcacaggaggagaatcgcaacgtggccgtcgagaagcagaatctggaaaggaaaatgatggacgagatcaattatgccaaagaggaggcctgccgcctccgggagttgagggagggggctgagtgtgagctttcccgcagacagtacgctgagcaagaactggagcaagtaaggatggctctcaaaaaagccgagaaagagtttgagctccgctcttcctggagcgttcctgacgccctccagaaatggctgcagctgactcacgaggtcgaggtccagtactataacatcaagcgacagaacgcagagatgcagttagccatcgcgaaggacgaggtggctgctagttatctgatccaggccgagaagattaagaagaagcggtccactgtttttgggaccctgcatgtggctcacagctcgagccttgacgaagtggaccacaagatccttgaagccaaaaaggcactttccgaactgaccacttgcctgcgtgaacggttattccggtggcagcagattgagaaaatctgtggattccagatcgcgcacaactctgggctacccagtttgacttctagcctatactccgaccactcttgggtggtcatgccacgagttagcatcccgccatatcccattgctgggggtgtcgacgacctggatgaggatacacctcctattgtgtctcagtttcccggtacaatggccaagccacccggttccctggctcgctcatcatctctatgccgctccagacgctctatcgtgccgagctctccacaacctcaaagggctcaattggcacctcacgctccccacccttctcaccctcggcacccacaccacccccagcacactccccactctcttccgtcgcctgatcccgatatcctatctgtgagctcttgccccgctctctatagaaatgaagaggaggaggaggccatctactttagtgcggaaaagcagtgggaagtgcccgacaccgcctccgagtgcgattccttaaatagctctatagggagaaaacagtctccgcctctgtcactggagatctatcagaccttgagtcctcggaagattagccgcgacgaggtgtcactggaagacagcagtaggggggattctccagttacggttgatgttagttgggggtccccagattgcgtgggactgaccgaaactaagagcatgatattttctcctgcaagtaaggtgtacaatggaatcctggagaagtcatgctcaatgaatcagcttagttccggcattcccgttccaaagccaaggcatacttcatgctcttctgctgggaacgatagtaaaccagtgcaggaagcacccagtgtggccagaattagcagcataccacacgacctgtgtcacaacggcgagaaaagcaaaaagccctctaaaattaagtctctctttaaaaagaaatccaagtag

SEQ ID NO: 242679 - DNA, 1800 bp, Artificial Sequence
  Description of Artificial Sequence: Synthetic coding sequence
ttactagtgctaggcttactggtggcaggagcggctgatgggtgcgagctggtgcctcgccacctcaggggcagaagggccaccggcagcgctgccactgctgctagctccccagccgctgccgcaggcgactctccagcccttatgacggatccatgtatgtcattatcacctccatgctttacagaagaggaccgattctctcttgaggctctccagaccattcataagcagatggatgacgacaaggatggtgggatcgaggttgaggaatccgatgagtttatccgggaggacatgaagtacaaggatgccacaaataaacattctcacctgcatcgagaagacaagcatattaccattgaggacttgtggaagaggtggaagacttccgaggttcacaactggacacttgaggatactctgcagtggctcattgaattcgtcgaattaccccagtatgagaaaaattttagagataacaacgtcaaaggtaccacccttcctcgaattgcagtccacgaacccagcttcatgattagccagctaaagatctcagatcgtagccaccggcaaaagctgcagctgaaagccctggacgtggtactcttcggccctctgacaagacctccacataactggatgaaagattttatccttacagtttctattgtgatcggcgttggaggttgctggtttgcttacacgcagaacaaaacatctaaggagcatgtggccaaaatgatgaaagatctggaatctctccagaccgctgagcagtcactcatggatcttcaagagcgtctcgaaaaagcccaggaggaaaatcggaacgtcgccgttgaaaaacagaatcttgaaaggaagatgatggatgagatcaattatgctaaagaggaagcttgccgactgcgggaactaagagagggtgccgagtgtgagctcagcagacgccagtacgcagaacaggagctggaacaggtccgcatggcattgaagaaggcagagaaggaattcgaactgagatctagttggtcagtgcctgacgccctacagaaatggctgcagttaactcacgaagtcgaggtgcagtattataatatcaaacgtcagaatgcagagatgcagctggctattgctaaggatgaagcagaaaagattaaaaaaaagcgcagtactgtttttggcactctccacgtcgcacacagctcaagtctggatgaagttgaccataaaatcctggaggccaaaaaggcgctgtctgagctgacgacgtgcttgagggaaaggttgttccgctggcagcagatcgaaaaaatatgcggattccaaattgcccacaattctggtctccctagcctgaccagtagcttatattcagaccacagctgggtcgtgatgcccagggtttctatccctccgtaccctatcgccggaggggtcgatgacttagatgaagacaccccacccatcgttagccaatttcctggaactatggccaaaccccctgggagcctcgcgaggtcctcatcactctgtaggtcccgtagatcaattgtcccttcatcaccccaaccgcaacgcgctcagctcgcacctcatgctccccaccccagtcacccacgccacccccaccacccgcagcatacaccccactctctgccaagccctgatccagatatcctctcagtatctagttgtccagccctctatcgtaatgaggaagaagaagaagccatctatttctctgccgaaaaacagtgcattcacctgggcctaggagcttgtaaatctgagtag

SEQ ID NO: 242680 - DNA, 3654 bp, Artificial Sequence
  Description of Artificial Sequence: Synthetic coding sequence
atgtacatcaagcaagttatcattcaaggcttcaggtcatatcgggaccagacaatcgtggacccttttagctccaagcacaacgtcattgtgggaagaaatggaagcggcaagagtaactttttctacgcaattcagtttgtactgtccgacgaattcagtcaccttcgtcccgaacagaggcttgccctactgcacgaaggaacaggccctcgcgtgatctccgcttttgtggaaatcatattcgacaactctgacaataggctgcccattgacaaggaagaggtctccctgaggcgagtgatcggcgcaaagaaagatcagtatttccttgataagaaaatggttactaaaaacgacgtcatgaacctgctagagtcagccggtttctcgcgctccaacccttattacattgtcaaacagggaaaaatcaatcagatggctaccgctcccgattcacagcggctcaagttgcttagagaggtggccggaactcgtgtgtacgacgaacggaaggaagaaagcatcagcctcatgaaagaaaccgagggcaaacgtgagaagattaacgaactcctcaaatacatcgaggaacgccttcatacactagaggaggaaaaagaggagctggcgcaataccaaaaatgggataaaatgagacgcgcattggagtatacgatatataaccaggagctcaacgagaccagggccaagctggatgagctgtccgccaaacgcgaaactagtggtgaaaagtccagacagctgagggacgcccaacaggatgcgagagacaaaatggaggacatcgagaggcaagttagagagttaaaaaccaagataagcgccatgaaagaagagaaagaacagctgtcggcagagagacaggaacagattaagcagaggactaaactggagctgaaggctaaggatctccaggatgagctagctggaaattcagagcagaggaaaagactgctcaaagagaggcagaaacttctagagaaaatcgaagagaagcagaaggagcttgctgaaaccgagcctaagtttaacagtgtcaaagaaaaagaagagcggggtattgccagactcgcacaggctacccaggagcggacagatctttacgccaagcagggcagaggctcccagttcacttctaaggaagaaagagacaagtggatcaagaaagaactgaagtctcttgaccaagccattaacgacaaaaaacgtcagatagccgcaatccacaaagatttggaagataccgaagccaacaaagagaagaacctggaacaatacaacaagctggaccaggatttgaacgaggtaaaggctagggtcgaggaattggacagaaagtattatgaggtgaaaaataagaaggatgagctgcagtccgaaagaaattatttatggcgcgaggaaaacgccgagcaacaagccctagccgcaaaaagggaggacctggagaagaaacagcagctgttgagggcagctacaggcaaggcgattctgaatggaatcgactcaatcaataaggtacttgatcattttagaagaaaaggaattaaccagcacgtacaaaacggctatcacggaatagttatgaataatttcgagtgtgaacccgctttctatacatgtgtcgaagtgacagccggaaacagactgttttatcacattgtggatagtgatgaagtgtctaccaaaatcctgatggagttcaataagatgaatctgcccggagaggtgacctttctccccctgaacaagcttgacgtcagggacacggcctatcctgaaaccaacgacgctatccccatgatctccaagctcaggtacaatcctcgctttgacaaagccttcaaacatgtgttcgggaaaactttgatttgcaggagtatggaggtgtcaacccagctggcccgtgctttcacgatggactgcattacattggaaggtgaccaggtcagtcataggggggcactgacaggaggatactacgacacaagaaaatccagactggaactgcaaaaggacgtgaggaaggctgaggaggagcttggagagctggaggccaagttgaacgagaacctgcgcagaaacattgaacgcatcaacaacgagatagatcagctgatgaatcaaatgcaacagatcgaaacacaacagaggaaattcaaagcttcccgggactccattctttcggagatgaaaatgttgaaggaaaagcggcaacagtctgagaaaaccttcatgccaaagcagagaagcttacagtcactagaagcatcattgcacgccatggaaagtactcgagagtccttgaaggccgagctgggcaccgatttattgtcacagctttctctggaggatcaaaagagggtggacgccttgaatgacgaaattcgtcagcttcagcaggagaatcgtcagctgctgaacgaacggataaagttggagggtataatcactagagtcgaaacctacctgaacgagaacctccgcaagcgcctcgatcaagtggagcaggagctgaacgaactgagggaaactgagggaggcaccgtgctcaccgccacaaccagcgaactggaggcgatcaacaaacgcgtgaaagataccatggcaagaagcgaggatctagataattctatcgacaagacggaggccggaatcaaggagttacaaaagtcgatggagcggtggaagaacatggagaaggagcacatggatgctatcaatcacgatactaaggaactggaaaagatgacaaaccgccaaggtatgttactcaaaaagaaagaggagtgcatgaaaaagatcagggaactcggatccctgccgcaggaagcctttgaaaagtatcagacgctatctctgaaacagctgttccgtaagctcgagcaatgtaatactgagttgaagaagtacagccatgtgaacaagaaggcactagaccagttcgtgaactttagcgagcagaaggagaagttgataaagaggcaggaggagctcgatcgtggatataagtctatcatggaactcatgaatgtcttagagctccggaagtacgaggctattcaacttaccttcaaacaagtctcaaagaatttttccgaggtgttccagaagcttgtacctggagggaaggcgacgctagtgatgaaaaagggcgatgtggagggctcccaaagtcaggatgagggggagggctctggagagtcagaaagagggagcggctctcagagctcagtgccttccgttgaccagttcacaggtgtcggcattcgagtgtcctttacgggcaaacagggtgagatgcgggagatgcaacagctctcaggcggacaaaagtctctggtcgctctcgctctgatcttcgcaatccaaaaatgtgatcccgcacctttctacctttttgacgaaatcgaccaggccctcgacgcccaacatcgaaaagcggtgagcgatatgatcatggaactcgccgttcatgctcagtttatcaccaccacttttcggccagagctattggaaagcgcagacaaattctacggcgtgaaatttaggaacaaggttagtcacatcgatgtcatcacggctgagatggccaaggacttcgtggaagacgacaccactcatgggtag

SEQ ID NO: 242681 - DNA, 3306 bp, Artificial Sequence
  Description of Artificial Sequence: Synthetic coding sequence
atggcaactccatcaaagaaaacgagcactccatcgccacagccatcaaagcgagcgctaccgagggatccaagctcggaagtgcccagtaagaggaaaaactcagcccctcagctcccactccttcagtccagcggccctttcgtggaggggtctatagttaggattagcatggagaactttctgacctatgacatctgcgaggtaagtccaggccctcacctgaatatgatcgtgggagccaatggaacgggaaagtcatcaatcgtgtgcgcgatttgtctgggactggcaggcaagccggcatttatgggcagagccgataaggtagggttctttgttaagcgaggctgcagcagagggatggtggagatcgaactctttagagcaagcgggaatctggtcattacacgcgaaatcgatgtcgcaaagaatcagagtttttggttcatcaataagaagtcaacaacacagaaaattgttgaggagaaggttgcagcattgaacatccaagtcggtaatctgtgtcagtttcttccacaagacaaggtgggagagtttgcaaagctaagtaagatcgagttactggaagcaaccgagaagtcaatagggccaccggaaatgcacaagtatcattgcgagctcaagaacctgcgggaaaaggagaaacagctggagaccagttgcaaggagaagaccgaatatcttcagaagatggtgcagaggaatgagaggtacaagcaggatgtggaacgattctacgagcggaagcgtcaccttgacctgatcgagatgttggaggctaagcggccttgggtggagtacgagaatgtgcgacaggagtacgaagaagtcaagcttgtgcgagatagagtcaaggaggaggtgaggaaactgaaagaaggccaaattcctgttacctgcagaatcgaggagatggagaatgagaggcacaatttagaggccaggatcaaagagaaagctactgatatcaaagaggcgtcacagaagtgcaagcagaagcaggatgtaatcgagcgcaaagataaacacattgaggagctgcagcaagcgttgattgtcaagcagaatgaagagctggatagacagcgacggatcggcaacactcggaagatgatcgaggatctgcagaacgagctgaaaacaactgagaattgcgagaacctccagccgcagattgatgctatcactaatgacctacgcaggatccaggatgagaaggccttgtgcgagggggaaattatcgacaagaggagagagagagagactctggagaaagagaagaaatcagtggatgaccatatcgttcggttcgataacctgatgaaccagaaagaagacaagctgcgccagagattcagggatacctatgatgctgtcctctggctccggaacaacagggataagtttaaacagagggtttgtgagccaatcatgctgaccatcaacatgaaggacaacaaaaatgcgaaatatatcgaaaaccatatacccagcaacgacctccgagcttttgtctttgagagccaagaagatatggaggtttttcttaaggaggtgagggataacaagaaactaagggtgaatgctgtcattgccccaaagtcctcgtacgctgacaaggctccctcccgttccctcaacgagcttaagcagtatggattttttagctatcttagggaattgtttgacgcaccagacccagttatgtcgtacctctgctgtcagtatcatatccatgaagtccctgtgggcacagagaagacacgcgagagaatagaaagggtcattcaggaaacacgcctgaagcaaatttacacagctgaggaaaaatacgttgtgaagaccagcttttatagcaataaagtgatctctagcaatactagcctgaaagtagcccagtttctcacagtcactgtcgatctggaacagcgcagacacctagaagaacagctcaaagaaatccaccgaaaactccaggctgtggatagcggcctgatcgctctccgggagacaagtaagcacctagaacacaaagataatgaattgcgccagaagaaaaaggaactgctcgaaagaaaaacaaaaaagaggcagcttgaacagaagatatctagtaagttgggttctcttaagctgatggagcaggacacctgtaacctcgaggaggaggaaagaaaagcttctacaaagattaaagaaattaatgtccagaaggccaaactggtgaccgaactaacaaatttgatcaagatttgcacaagcctccacatccagaaggtagatcttatcctgcagaacacaacagtcatcagcgaaaaaaacaagttggaaagcgattacatggctgcaagctcccagttgagactgaccgagcagcattttattgaactggatgagaatagacaacgactgctgcagaaatgtaaagagctgatgaaacgagctaggcaggtgtgcaaccttggtgctgagcagactctgccacaggagtaccagacccaggtacctacaatccccaatgggcataattcctctctccctatggttttccaggacctgccaaacactttagacgaaattgacgcactgctgactgaagaacggtcgagggcctcctgctttaccgggctcaaccctaccatcgtgcaagagtatactaaaagagaggaagaaattgaacaactgactgaagagttgaagggaaaaaaggtggagctagatcaataccgcgagaacatttcgcaggttaaggaacggtggcttaatcctctcaaggagcttgtcgagaagatcaacgaaaagttctccaattttttttcttctatgcagtgcgcaggagaagtggatcttcacaccgaaaacgaggaagactacgacaagtacggcatccgcatccgggtcaagttccgctcatctacccaactgcacgaactgaccccacaccaccagtccgggggagaaagatccgtcagcacaatgctgtacctgatggcccttcaggagttgaacaggtgcccatttcgagtcgtagacgaaatcaatcaaggaatggatccaattaacgagaggcgagtgttcgagatggtggtcaatactgcctgtaaggagaacaccagtcagtacttttttataacacccaagctgctgcagaatcttccatactctgagaaaatgacagtgctgtttgtctacaacgggccacatatgcttgagccaaacacttggaatcttaaggccttccagcgcagacggaggcgcatcacattcacacaaccgtcctag

SEQ ID NO: 242682 - DNA, 3276 bp, Artificial Sequence
  Description of Artificial Sequence: Synthetic coding sequence
atggccaagcgaaaagaagagaatttttcatctccgaaaaacgcaaaacggcctaggcaggaggagctcgaggactttgacaaggacggtgatgaagacgagtgcaagggcactaccttgaccgcggcagaggtgggcatcatcgaaagcatccacctgaagaattttatgtgtcacagcatgctcgggcctttcaagtttggatctaacgtgaactttgtggtagggaacaacggtagcgggaagtcagccgtgttaactgcactgattgtgggactcggaggaagggcagttgccacaaaccggggatcctcactaaaaggtttcgttaaagacggacagaatagtgccgacatctccatcaccttgaggaatcgtggtgatgatgcctttaaagcgtccgtatacggcaactccatactgattcagcagcacatatctatagatggttcgcgttcttataaactcaaaagtgccacaggatccgtcgtgtccactcggaaggaggagctgatcgcgatcctggatcacttcaacatccaggtggacaatccggtgtctgtccttacccaggaaatgtccaagcagtttttacaaagcaaaaacgagggtgacaagtacaaattttttatgaaagcaacacagctggagcaaatgaaggaggattatagctacattatggagactaaggaacggacaaaagagcagattcaccaaggtgaggaacgactcacagaactgaaacggcagtgtgtggagaaggaagagaggttccagagcattgctggtctctcaacgatgaaaaccaatctggaatccctaaagcacgaaatggcgtgggccgtggtgaatgaaattgagaagcaacttaatgccattagagataacatcaagattggagaggacagagcagcccgactggaccggaagatggaggagcaacaggtgcgactgaatgaagcagaacagaaatataaagatattcaggacaagctggaaaaaatttccgaggagactaatgctcgggcacctgaatgtatggccttgaaggccgacgtggtagccaaaaagcgtgcctataatgaggctgaggtgctttacaacagaagcctaaatgaatacaaggccttaaaaaaggacgatgaacagctgtgtaaacggatcgaggagcttaaaaagagcacagatcagtccttagagcccgaacggctggaaaggcagaagaagatctcgtggctcaaagagcgggtgaaggcattccaaaatcaagagaattctgtcaaccaagaaatcgagcaatttcagcaggcgatcgaaaaagacaaggaagagcacgggaagatcaaacgcgaggaactagacgtcaagcatgccctgagctataaccagaggcagctgaaggagttaaaggactcaaaaaccgacagactcaagcgctttggcccaaacgtcccggcactcctggaggcaatcgacgatgcctataggcagggccactttacatataagccggttggaccactcggggcttgtatccatttaagagatccagaactggcattggccattgaaagctgtctgaagggcctcttacaggcttattgttgtcacaatcatgctgacgaaagagttctgcaggccctgatgaagaggttctatctgcccggtaccagtcgtcccccaatcatcgttagcgaatttcgaaatgaaatttacgatgtgagacatcgggcagcctatcacccagactttcctacagtcttaactgccctggagatcgacaacgctgtcgtggccaactccctgattgacatgcgtgggatcgagaccgtgctgttgattaaaaataatagcgtggccagggccgtcatgcagtctcagaaaccccctaagaattgcagagaggcctttactgctgacggagaccaggtatttgctggcagatattactctagcgaaaacacccgccctaaattcctctcccgcgatgtcgattccgagatatctgatctggagaatgaagtggagaacaaaaccgctcagatacttaatttacagcagcacctcagtgccctcgagaaagatattaaacacaacgaagagctcctgaaacggtgtcagcttcattataaggagttgaagatgaaaattcggaagaatattagtgagatacgagagctggagaatatcgaggagcaccagagcgtggatatcgcaacacttgaagatgaggctcaggagaacaagtctaaaatgaagatggtggaggagcatatggagcagcaaaaggagaacatggaacatcttaaaagcctaaagattgaggcagaaaataagtacgatgctataaaatttaagattaatcaactgagcgaactcgccgaccctttaaaggatgagcttaacttggccgattctgaggttgacaatcaaaaacggggtaagcggcactacgaggagaagcagaaagaacatctcgacacgttgaataagaagaagagagagttggatatgaaggaaaaggaactggaagaaaaaatgtcacaagcaaggcagatctgccctgaacggattgaagtggaaaaaagtgcaagcattctggacaaggaaatcaaccgactccggcagaagattcaggcagaacatgcaagccacggtgatagggaagagattatgcgacaataccaggaagcccgtgaaacctacttggatctggacagcaaagtcaggacactcaaaaagttcattaagctcctgggtgaaattatggaacatcgcttcaagacatatcaacagttcaggaggtgtcttacattgagatgtaagctgtactttgacaatctgttgtcacagcgcgcatactgtggcaagatgaacttcgaccacaagaatgagaccttgtccatttcggtccagcctggagaaggcaacaaggcagcatttaatgacatgagggcattgagcgggggagagaggagtttcagcaccgtctgttttattctgagcttgtggtcaatcgcagaatcccctttccgatgcttggacgaattcgacgtttatatggatatggtgaaccggcgaatcgctatggatctgattctgaagatggccgattctcagcgatttaggcagtttatcctgctgactcctcagtctatgagcagtctaccctcgtctaaactcataagaatactcagaatgtcagatcccgagaggggccagacaacactgcctttcagacctgttacacaggaggaagatgacgatcagaggtag

SEQ ID NO: 242683 - DNA, 3354 bp, Artificial Sequence
  Description of Artificial Sequence: Synthetic coding sequence
atggctaagaggaaagaggaaaatttctcaagccccaaaaatgccaaacgaccaagacaggaggaactcgaagacttcgacaaggacggtgacgaggacgagtgcaagggcacaaccctgacggcagcggaggtggggatcattgaatccatccacctgaagaactttatgtgccattctatgctgggccctttcaagttcggttctaacgtgaacttcgtcgtcggtaataatggctcgtggagcgcagtggttaggtccaggctcaatgcaacttcagcaagccaggtgcaggcaatccttctctttcaaccatgcggaaagtccgcagtcttgactgcactgatcgttggcctcggcggacgcgctgtggcaaccaatcgcggaagttcactcaaaggctttgttaaggacgggcagaacagtgccgacattagtattacgctcagaaaccgcggtgacgacgctttcaaggcttccgtttatgggaatagtattctcatccagcagcacatctctatcgacggctcccggtcctacaagttgaagtctgccactggctctgtcgtctcaactcggaaggaggagctgattgctatcttagaccacttcaatatacaggttgataatcccgttagtgtcctgacccaagaaatgtctaaacagtttttgcagagtaagaacgagggagataagtacaagttctttatgaaagctacgcaactcgagcagatgaaagaagattattcgtatattatggagacaaaagagcggacaaaggaacagatccaccaaggagaggagagactgacagagctgaagcgccaatgcgtagaaaaggaggagaggtttcagtccatcgctggcttaagcacaatgaagaccaaccttgaaagcctgaaacatgagatggcgtgggccgtagtcaacgagatagaaaagcagctgaacgctattagagacaatattaaaatcggcgaggaccgggctgctcgccttgataggaagatggaagagcagcaagtgaggcttaatgaagccgaacagaagtacaaggacatacaggacaaattggaaaagatctcagaagagaccaacgctcgtgcccctgagtgcatggccctgaaggcagacgtggtcgccaagaagagagcctataatgaggccgaggttctgtataacaggtcgctgaacgagtacaaggctctaaaaaaagacgacgagcagctctgtaaaagaattgaggagctcaaaaagtctaccgatcaaagtttggagccagaacgactggaacgtcagaagaagatatcctggttgaaggaacgagtaaaggcgttccaaaatcaggagaatagcgttaaccaggaaattgaacagtttcagcaggctattgaaaaagataaggaggaacatggtaaaatcaaacgagaggagttagacgtgaagcacgccttatcatacaaccagagacagctcaaagagctcaaagatagcaagacagacaggttgaaaaggttcggaccaaacgtcccagcccttttagaggccatcgatgacgcttaccgtcagggccacttcacttacaaacccgttggtcctttgggggcttgtatccaccttcgcgaccccgagctggctctggcgatcgaatcctgcctgaaggggttgctacaggcatactgttgtcataaccatgccgacgagagagtattgcaggccctcatgaaacgtttctacctccccggtacgagtagaccccctatcattgtaagtgagttcaggaacgagatttacgatgtgcggcatcgagccgcttatcatccagatttccctaccgtgctgacagctttagaaatcgacaacgctgtagtggcaaattcgctgatcgatatgagggggatagagaccgtgcttttaataaagaataattccgtggctcgagctgtaatgcaaagccagaagccacccaagaactgtagggaagcattcacagcagatggggaccaagtgtttgccggaaggtactactccagtgagaacacaagacccaaattcttaagcagagacgtagattcggaaatctcggacctggagaatgaagttgagaataagacagctcaaatccttaacctccagcaacacctttcagcactggagaaagacatcaaacacaacgaagagcttcttaagcggtgccaattgcattataaagaactgaagatgaagatcaggaaaaatatctctgaaatcagagagttggagaacattgaagaacaccagtccgttgatatcgccacactcgaagacgaagcccaagaaaataaatctaagatgaagatggtggaggaacacatggagcagcagaaggaaaacatggaacatctgaagtccctaaagatagaggcggaaaacaagtatgacgcaatcaaattcaagattaaccagctgtcagaattagcagatcctctcaaggacgaactgaacctggcagacagtgaggtggataatcaaaagcgtggcaagcgccactatgaggagaaacaaaaagagcacttggacacacttaacaaaaagaaacgcgaactagatatgaaggagaaagagctggaggagaaaatgagccaagctcgccagatatgcccggagcggatagaagtcgaaaagtctgcctccatcctggacaaggaaatcaatagacttcggcagaaaattcaggcagagcacgccagtcatggggatcgcgaagaaatcatgcggcagtaccaggaggcccgagaaacttacctcgatctggactctaaggtcaggactctgaagaaattcataaagctcctgggagaaatcatggagcatcgcttcaaaacctaccaacagttccggaggtgcctcactctaagatgcaaattgtatttcgataacctgctctcccagcgcgcatattgcggcaaaatgaacttcgatcataagaacgagacactcagcatctctgtccagcccggtgagggcaataaagccgcttttaatgacatgcgtgcactgtctggcggtgaaagatccttcagcacagtttgtttcatactgagcctgtggagcattgccgaatccccttttcggtgtctggatgaatttgacgtttacatggatatggtcaataggaggatcgctatggacctcatcctaaagatggcagactctcagcgatttcgccaattcatactgcttaccccgcagtctatgagctctcttccaagtagcaagcttattcggatccttcggatgtcggatccagagagagggcagactactctcccctttcggcctgtgacacaggaagaggatgacgaccagaggtag

SEQ ID NO: 242684 - DNA, 3276 bp, Artificial Sequence
  Description of Artificial Sequence: Synthetic coding sequence
atggctaaacgcaaagaagagaatttttccagccctaaaaatgccaagcgtccacgccaggaggaattggaggacttcgataaggacggtgatgaagatgagtgtaaagggactacgctcaccgcagcagaagtggggatcatcgagtctattcacctcaaaaactttatgtgccactctatgctcggaccctttaaattcggatcaaacgtcaacttcgtggttggaaataatggcagtgggaaatccgccgtactgaccgcccttattgtgggattagggggacgtgcagttgctaccaacagaggttcttcattgaagggttttgtgaaggacggccaaaactctgctgatatcagcatcactctcaggaatagaggcgatgatgctttcaaggcttcagtctatggaaacagcatcctgatccagcagcatatcagtattgacggatctcgttcttacaagctaaaaagcgccacaggaagcgtcgtctcaacgaggaaagaggaacttatcgcaattttagaccatttcaacatccaggtggacaaccccgtctcagtcttgactcaagagatgtccaagcagttccttcaatcaaaaaatgagggggataagtacaaattttttatgaaggcaacccagctggagcagatgaaggaggactactcctatattatggaaacaaaggaaagaactaaagaacagatccatcagggcgaggagcgcctcaccgagctgaagcggcagtgcgtagagaaggaggagcggtttcagtcaattgcaggcctgagtactatgaaaaccaacttagaatctctgaaacacgagatggcatgggcggtggtgaatgaaatagagaagcagctgaatgctatcagagacaacatcaaaattggcgaggatcgcgcagctaggctagatcgtaaaatggaggagcagcaggtacgactcaacgaggccgagcaaaagtataaggacatacaagacaagctggagaagatttcagaggagaccaatgcccgagccccagagtgcatggccctaaaggccgacgtggtggctaagaagcgagcctacaacgaagcagaggtactgtacaataggtcgctgaacgagtacaaggcactgaaaaaggacgacgagcagctctgcaagagaatagaagagttaaaaaagtctaccgatcagagcctcgagcctgagcgcttggaacggcagaaaaagatatcttggttaaaagagcgggtgaaggccttccaaaaccaggagaattccgttaatcaggaaatcgagcagttccagcaagccatcgaaaaggacaaggaggagcacgggaagatcaagagggaggagttggatgtcaagcatgcactttcatacaaccagcggcagctcaaggagctgaaggatagtaaaactgatcgactcaaacgctttggccctaatgtgcccgcactcttggaagcaattgatgatgcatacaggcagggccattttacttataagcctgtgggacccctcggcgcatgcattcatttgcgggaccctgagttggcattggctatcgaaagctgcctgaagggccttctgcaggcttattgctgtcacaatcatgccgacgagagagtcctgcaagcattgatgaagaggttctacttacctggtacctctagacctccaataatcgtttctgagtttaggaacgaaatatacgatgtccgacatcgggctgcctaccatccggactttcccacagttctgaccgcactggaaattgacaacgcagtggtggcaaacagtctgattgacatgagagggattgagacagttttgctgatcaaaaacaactcagtggccagggctgtcatgcagtcccagaaacctcctaagaattgccgggaagcatttacagccgatggtgatcaagtttttgccggacggtattactcctccgagaatacccggccaaaattcttgtcaagagatgtggattcggagataagtgatctggagaatgaggttgaaaataagacagcccagatcctgaatctccagcagcatctgtctgcccttgaaaaagatatcaagcataatgaagaattgctgaaacggtgccagctgcattataaggaactaaagatgaaaataagaaagaatatcagtgaaattcgggaattagaaaatattgaggagcaccagtcagtcgacattgcaaccctcgaggatgaagctcaggaaaataagagcaagatgaagatggtagaagaacacatggaacaacaaaaggagaacatggagcacctgaagagcttgaaaattgaagcagaaaacaagtacgatgctattaagttcaagattaatcagctgtctgaactggcagaccctttgaaagatgagttaaatctagccgactccgaggtcgataaccaaaaaagagggaagcggcactacgaggagaaacagaaagaacacctggatacactcaataagaaaaagcgcgagctggatatgaaagagaaggaactggaagaaaagatgtcccaggctcggcagatctgtccagaaaggatagaggtcgaaaagagcgctagtattttggacaaggagatcaataggctgaggcagaagatccaagctgaacacgcatcccatggcgatcgggaggaaattatgaggcagtaccaagaggccagagagacttacctcgatctggatagcaaagtgcgaactctgaaaaaattcataaagttgctgggtgagatcatggaacataggttcaagacgtatcagcagtttcgcagatgccttactttacggtgcaaactatacttcgataatctgctgtctcagagggcttattgtggcaagatgaacttcgaccacaaaaatgaaacactgagtatttcagtgcagcccggagaagggaataaggcagctttcaatgatatgcgcgcactaagtggcggagaacggtccttctcaacagtgtgcttcattctatcactgtggtccatcgccgaatctccattccggtgcctggatgagtttgacgtctacatggacatggttaatagaaggatagctatggacctgatcctgaaaatggcggactcgcagcggtttcgacaattcattctactgactccccagagtatgtctagtctcccaagcagtaagcttatcagaatacttcgcatgagtgatcctgagcgtggtcaaacgaccctgccatttagaccggtcacacaggaggaggacgacgatcagaggtag

SEQ ID NO: 242685 - DNA, 174 bp, Artificial Sequence
  Description of Artificial Sequence: Synthetic coding sequence
atggctaaacggaaggaagagaatttctcaagcccgaagaacgccaaaaggccgcgtcaggaggagttggaggatttcgataaagatggcgacgaggatgaatgcaaggggaccactctcactgctgctgaggttgggattatcgaatcaatccatctaaagaattttatgtag

SEQ ID NO: 242686 - DNA, 3276 bp, Artificial Sequence
  Description of Artificial Sequence: Synthetic coding sequence
atggccaagaggaaggaggagaatttcagctcacctaagaacgctaagcgcccacggcaggaagaactcgaggattttgataaagacggagacgaggatgaatgtaagggaacaacactcaccgctgctgaggtaggcataattgagtctatccaccttaagaatttcatgtgccactcaatgttaggtccttttaaattcggctctaatgtaaactttgtcgtgggcaataacggtagtggaaagtccgcggtactgacagcacttatcgtggggcttggcggtagggctgtcgctactaaccgtggttccagcctcaaagggtttgtgaaggacgggcagaacagcgccgacatttccattaccttacgcaatcggggtgacgatgccttcaaggccagcgtctatggaaatagcatcctcatacagcaacacataagcattgacggtagccgcagttataagctgaagtccgctacaggcagcgtggtgagtacaaggaaggaggaactgatcgctatattagaccatttcaatatccaggtggacaaccctgtgtctgtcctgacacaggagatgtctaaacaatttctccagagcaagaacgagggcgataaatacaaattctttatgaaggcaacccagctggagcaaatgaaggaggattactcatatatcatggagacaaaggagcggaccaaggaacaaattcatcagggcgaggaacggctaacggaactgaagaggcaatgtgtggagaaggaggagcggtttcaatccatcgccggactgtccactatgaaaactaatcttgagtctctgaagcatgagatggcctgggcggtggtgaacgagatcgaaaagcagctgaacgccatccgtgacaatatcaaaataggcgaggaccgcgctgctagactggacagaaagatggaggaacagcaggttagactcaatgaggcggaacagaagtacaaagatatacaggacaagctagaaaaaatttctgaagaaacaaacgcgagagctccggaatgcatggccctcaaagccgatgtggtggccaaaaagcgtgcctataacgaggctgaggtcctgtacaatcgcagcttaaacgaatacaaggctctcaagaaggatgatgaacaattgtgtaaaagaatcgaggaacttaagaaatctactgaccagagcctcgagccggaacgcctggaacgccagaaaaaaatcagttggctcaaagagagggttaaggcgttccagaaccaggagaattccgtgaaccaggagatcgagcagttccagcaggcaattgaaaaggacaaggaagaacacgggaaaattaagcgagaggaactggacgtgaaacacgccctgtcttacaaccagaggcagctgaaagagctcaaggatagcaagactgataggctcaagcgattcggacctaatgtccctgctcttctggaagccatagatgatgcctaccgtcaaggtcacttcacttacaagcccgtgggaccactcggtgcctgtattcacctgcgagatcccgagctcgcactagctattgagtcatgcctaaagggcctgctgcaggcgtactgttgccataaccatgctgatgaaagagttttgcaggccctgatgaagcgtttttatctgcccggaacatcacgtccgcctatcatcgtctctgaatttcggaacgaaatctacgacgtaagacaccgagcagcatatcaccctgacttccccaccgttctgactgccttagagatcgataacgctgtggtagcgaattccctaattgatatgcggggaatcgagaccgtcttgctaatcaagaacaatagcgtcgctagggcggtgatgcagtcacagaaaccccctaagaactgccgggaggcctttacggcggatggagaccaagtattcgccggtcgctactactcttccgaaaatacccggcctaagttcctctcgcgggacgtggattcagagatttcagacttggaaaacgaagtcgagaataagactgctcagatcctgaatcttcaacaacatttaagcgccctagaaaaggacatcaagcacaatgaggaattgcttaaaaggtgtcagctccattacaaagaactcaaaatgaaaattcgcaaaaatatatccgagatccgcgagttagaaaacatagaggaacatcaatcagttgatatcgcaactttagaggacgaagctcaagaaaacaaaagtaagatgaagatggtggaggaacatatggaacaacagaaagaaaacatggagcatctgaagagtctcaagatcgaagctgaaaataagtatgacgccataaaatttaagattaaccaactgtccgaactggctgaccctttaaaagatgagctgaacctggccgactcggaagttgacaatcagaaacggggaaagcggcactacgaggaaaagcagaaagaacatctggacacactaaataaaaagaaaagggaacttgatatgaaagagaaagaattagaagaaaaaatgtcacaggcaaggcaaatttgtcctgaaagaatcgaagtcgagaagagcgcgtccattctggacaaagaaattaaccggttgagacagaaaattcaggccgaacatgccagtcacggagaccgggaggagataatgagacaataccaggaagcccgagagacatatctggatctcgacagcaaagtgagaacattaaaaaaattcataaagctgctcggagagatcatggaacaccgatttaagacatatcaacagtttaggagatgcctcacccttagatgcaaactttatttcgataacctgctcagtcagagggcatactgtggcaaaatgaactttgaccacaagaacgaaacactctctatttcggtacaacctggcgaggggaataaggccgcattcaatgatatgcgggcattgagcggcggagagcggagtttcagtacagtctgcttcattcttagtctgtggtccattgccgaaagcccctttcggtgcctagatgagttcgacgtttacatggatatggtgaataggcgcatcgctatggatcttatcttgaagatggctgattcacagagatttcggcagtttatcctcctcactcctcagtcaatgagctctctcccctccagcaagctgatccgtatcctgaggatgtcagacccggagagaggacagactaccctgcctttccgccctgtgacacaggaggaggatgacgatcagaggtag

SEQ ID NO: 242687 - DNA, 2130 bp, Artificial Sequence
  Description of Artificial Sequence: Synthetic coding sequence
atggctgagacactggagtttaatgatgtataccaagaggtcaaagggtctatgaacgatggcagactacggttgagccgccaaggcattatcttcaagaactctaagacagggaaggtggataatattcaagccggtgaactgacagaaggcatctggcgacgtgtggccctcgggcacgggcttaagctcctaacaaagaacgggcacgtgtataaatacgatggcttcagagaatcggagtttgaaaaattgagcgacttcttcaagacacactatcggttggaacttatggaaaaagacttgtgtgtgaaggggtggaattggggaaccgtcaaattcggcggacagttactgtccttcgacatcggggaccagcccgtgttcgagatacctttatctaacgtctcacagtgtaccaccggaaaaaacgaggtgactcttgaattccatcagaacgatgacgccgaggtgtctcttatggaagtgcggttttatgtgccccctacgcaagaggatggtgttgatccggtagaggccttcgcccaaaacgtcttgtctaaggcagacgtaatccaggccaccggcgatgcaatttgtatcttccgcgagctacagtgcttgactcccaggggacgctatgacatacgaatctacccaacatttctccacttacacggtaagaccttcgactacaagataccgtacactacagtgctgcgcctgtttctcctgccacataaagaccagcgtcagatgttctttgtaatttctttagaccccccaatcaaacaggggcagacccggtaccacttcttaatcctcctcttcagcaaggacgaggacatctctctcaccttgaacatgaatgaagaagaggtcgaaaagcggtttgaagggaggctgactaagaatatgtctggctctctgtatgagatggtttcacgagtgatgaaagcattggtcaatcgtaagattaccgttcctggaaattttcagggtcactcaggcgctcaatgtatcacttgttcttacaaagcttcgtctggactgctgtaccccctggagagaggatttatatatgtgcataagccccctgtccacatccgattcgatgaaattagttttgtgaattttgcgagaggtacaaccaccactcgctctttcgactttgaaattgagacaaagcaggggacgcagtacacgttttctagtattgaacgtgaagagtacggcaaattattcgacttcgtcaatgctaaaaaactgaacatcaaaaatcgagggctaaaggaagggatgaatccatcctacgatgagtatgccgattcagacgaagaccagcacgatgcatacctcgaacgcatgaaagaggaagggaagattcgggaagagaatgctaacgatagctccgatgattccggcgaggaaactgatgagtccttcaatcccggagaagaggaggaggacgttgcagaggaattcgactcaaatgctagcgcgtcttctagtagtaatgaaggcgatagcgacagggacgagaagaaaagaaagcagctcaaaaaggctaaaatggccaaggatcgcaagagccgcaaaaagccagtcgaggtcaagaagggcaaagaccccaacgccccaaaacgccctatgtccgcttatatgttatggttaaacgcctcaagggagaagattaagtccgaccatccaggtatctccatcacagacttgtcaaaaaaagcgggagaaatttggaaaggcatgtctaaggagaagaaggaagaatgggatcgcaaagcagaagatgcacggcgagactatgagaaagctatgaaagagtacgaggggggaaggggcgagagctccaaacgcgacaagtctaagaaaaagaagaaagtgaaggtaaaaatggaaaaaaaatcaaccccaagtcgcggtagctccagcaagtcctcctcaaggcagttaagcgagagctttaagagtaaagaattcgtgtcttccgacgaaagctctagcggtgagaacaaatcaaaaaaaaaacgtagacggagcgaggattctgaggaagaagagctggcttccacccctcctagtagcgaagacagtgctagcggcagcgacgagtag

SEQ ID NO: 242688 - DNA, 240 bp, Artificial Sequence
  Description of Artificial Sequence: Synthetic coding sequence
atgaagagcctcacatggatccttggcctctgggccctggccgcatgcttcacacctggagagtcccagagaggccctaggggaccttacccacctggacctctggctccaccacagccattcggtccaggattcgtgcccccaccacctccccctccttatgggccaggcagaatccctcctcctccccctgctccgtacgggcctggcattttcccgccacctccaccccaaccttag

SEQ ID NO: 242689 - DNA, 324 bp, Artificial Sequence
  Description of Artificial Sequence: Synthetic coding sequence
atgaagtcactgacttggattttaggtctctgggctctggcagcttgcttcacacccggagaatctcagcgcggtccacggggaccttacccccctggacctctggctcccccacagccttttggcccaggctttgtccccccaccacccccacctccttacggacctggacggatccctcctcctccttactcctgcacacctaatatgaataactgcagcagatgccaccaccaccacaagcggcaccattacccatgtaactactgtttctactatccaaaatacgagtttcagcactgttttcaggagaccttcacttag

SEQ ID NO: 242690 - DNA, 240 bp, Artificial Sequence
  Description of Artificial Sequence: Synthetic coding sequence
atgaaaagtttaacctggatactcgggctgtgggcgcttgccgcatgcttcacaccgggagagtcccagcgaggcccaagagggccataccccccaggtcccctagcgccaccccagcccttcggcccagggttcgtgcccccaccaccaccacctccttatgggcctggccgaatcccaccgcctccccctgctccttacggtccgggaatctttccccctcctcctccacagccctag

SEQ ID NO: 242691 - DNA, 348 bp, Artificial Sequence
  Description of Artificial Sequence: Synthetic coding sequence
atgtcccggcatagcaggcttcagagacaagtgctaagtctctaccgggacctgctgagggccggaaggggtaagccaggggctgaggccagagtgagagcagagtttaggcaacacgctgggcttcctcggtctgatgtgctgcgcattgagtatctttatagacgcggaaggagacagctccagctgctccgatccggccacgcgaccgccatgggagccttcgtgcgccctcgggctccgactggtgaaccaggcggtgtgggttgtcaaccagatgatggcgatagcccgagaaacccccacgatagcacaggcgcacctgagactcgacctgacggacggtag

SEQ ID NO: 242692 - DNA, 501 bp, Artificial Sequence
  Description of Artificial Sequence: Synthetic coding sequence
atggcagtgtccactgtttttagcacctcaagtctgatgctcgccttgagcaggcattctctgctgagcccactgcttagcgtgacgtcttttaggaggttctacagaggcgactcacctaccgatagccagaaggatatgatcgagattccactgccaccatggcaagaacggacagacgagtctattgagacaaagcgcgctcggttgctatacgaatcacgaaagcgtggcatgctggaaaactgtatactgttgtcccttttcgctaaagagcatctccaacacatgaccgagaagcagctgaacttatatgatcggctgataaatgaaccttcaaacgattgggatatctactattgggccacagaagctaaaccggcaccagagatttttgaaaatgaagtcatggctctgttgcgtgattttgccaaaaacaagaataaggagcagagactgcgtgcccctgacctggaatatctgttcgagaagccaaggtag

SEQ ID NO: 242693 - DNA, 843 bp, Artificial Sequence
  Description of Artificial Sequence: Synthetic coding sequence
atggccgcagtagttgccctgtcactaagacggagactcccagccacgaccctggggggagcctgccttcaggcgtctaggggggctcagactgccgctgctaccgctcccaggatcaaaaagttcgccatctacagatgggacccagacaaagccggagataagccccacatgcagacctacgaggtggacttgaacaagtgtggtcccatggttctcgacgctctgatcaaaattaagaacgaagtggactcaacattgacttttcggaggtcttgccgggagggtatctgcggctcatgcgcgatgaacatcaatggaggcaacaccctggcttgtacccgtcgaatcgacacaaatctcaacaaggtatccaaaatatatcctcttccgcacatgtacgtgatcaaggatttggtcccagacctgtcaaacttttacgctcagtataagtctatcgaaccctacctgaagaaaaaggacgaatcacaagaaggcaagcagcaatatctgcagagtatcgaagagagagaaaagctcgacgggttatacgaatgcatcctctgcgcttgctgcagcacaagttgcccctcctattggtggaatggagataagtacttgggcccagcggttctaatgcaggcctatagatggatgattgactccagagatgacttcacagaagaacgactagccaaacttcaggacccattttccctgtacagatgccataccattatgaattgtactaggacctgtcctaaaggattaaatcctgggaaggcaatcgccgagattaagaagatgatggctacctataaggagaagaaggccagtgtatag

SEQ ID NO: 242694 - DNA, 453 bp, Artificial Sequence
  Description of Artificial Sequence: Synthetic coding sequence
atggccgctctgctcctacggcatgtcggtagacattgccttcgcgctcatttcagcccccagctgtgtatccggaacgccgtccccctgggcacaacagcgaaagaggagatggagcggttctggaacaagaatattggttccaaccggccactctctcctcatatcacaatatacagctggtctctccccatggctatgtccatctgccatcgaggaaccggaatcgccctcagtgccgatgtgggacctagaaagaggcctgaggacagtcctgctataccagtctggtcaggttgtcccggaagctattgcgtggtgttgtacggggctggttcccatgtgaagaaggggggatctcaacaccacctgcccacacactactatatccatccctcattttgcctctctttcttgtccccagcttgggaaaagttctcactgtttgtgtag

SEQ ID NO: 242695 - DNA, 510 bp, Artificial Sequence
  Description of Artificial Sequence: Synthetic coding sequence
atggctgctcttctgctgcgccacgtggggaggcattgcttgcgagcccactttagtccacagctttgcattcggaacgccgtccctctgggcactaccgccaaggaggagatggagagattctggaacaagaatattggctctaaccgcccactcagccctcatattacgatttactcttggtccctgcccatggcaatgagcatctgccaccggggaaccggcatcgcgctgtcagccggagtctcactgtttgggatgtctgctttgctgctgcccggaaatttcgaaagttacctggagcttgtgaaaagcctgtgtctaggacctgcactgatccataccgctaaatttgcgttagtttttcctctgatgtaccatacttggaacggcattcgccatttgatgtgggacctgggcaaggggttgaagatcccccagctgtatcaaagtggggttgtagtactggtcttaacagtactgtccagcatgggactggccgctatgtag

SEQ ID NO: 242696 - DNA, 351 bp, Artificial Sequence
  Description of Artificial Sequence: Synthetic coding sequence
atggcggctcttctgttgtcctggtcgctccctatggccatgagcatctgccacagagggactgggatagccctcagtgcgggagtgtctctatttggcatgagtgctctgctcctgccaggaaacttcgaatcttatctggagttggtcaagagcctgtgcctcgggcctgcactcattcacaccgccaagtttgctctggtgtttcccctcatgtaccatacctggaacggaatccgccacttgatgtgggatctcggtaaaggactcaaaatccctcagctgtatcagtctggcgtggtggtactggtccttactgtgttaagtagcatggggctggcagcgatgtag

SEQ ID NO: 242697 - DNA, 408 bp, Artificial Sequence
  Description of Artificial Sequence: Synthetic coding sequence
atggctgcactgctgttgaggcatgtggggcgacactgtcttagagcccatttttctcctcaactgtgtatcaggaattggtctcttccgatggccatgagtatttgccacagagggaccgggattgccctgagtgcaggtgtgagcttatttggcatgtcagccttactgctcccagggaacttcgagtcatatctggagctcgtcaaaagtttgtgtcttggtccagctctcattcataccgcaaagttcgccctagtgttccccctgatgtatcacacttggaacggcatcagacacctgatgtgggatctgggcaaaggcttaaagatcccccagctgtatcagtccggcgttgttgtcctggttctgaccgtgttgtcgagcatgggcctggctgctatgtag

SEQ ID NO: 242698 - DNA, 480 bp, Artificial Sequence
  Description of Artificial Sequence: Synthetic coding sequence
atggcagttctgtggcgcctgagcgcagtctgtggcgcactgggcggacgcgcattactgctccggacccccgtcgtgcgtcccgctcatatctccgccttccttcaggaccgtcctataccggaatggtgcggggtccagcacatccacctgtcaccatctcatcacagtgggagtaaagccgcttctttgcactggacttccgagagagtggtttctgtcttactcctgggcctcttaccagctgcttatctaaacccatgctccgccatggattacagcctggccgctgcactcactttacatggccactggggactggggcaggttgtgaccgattacgtacacggagatgctctgcaaaaggccgcaaaggccggactgttggcattgagcgcactgacttttgccggattgtgctactttaactaccacgatgtgggcatttgcaaagctgtggctatgctatggaagctatag

SEQ ID NO: 242699 - DNA, 465 bp, Artificial Sequence
  Description of Artificial Sequence: Synthetic coding sequence
atggctgccagcatgttctacggaagattggtcgccgttgccacacttcgcaaccacaggcccagaaccgctcaacgagcggctgcccaggggcctgttttgataggcagcagtcacgggggagtgaacatcgaagacgtcgccgctgaaagtcccgaggccatcattaaggagccaatagatattgaggagggcattaagaaggagcaggccctccagttggctcagaaaatgggcttccccccaaacattgtcgaatctgccgcagagaatatggtcaagttatacagcctgtttttaaagtatgacgctacaatgatagagattaaccccatggtggaggactccgacggagctgtgctctgcatggacgctaagattaattttgattctaatagtgcatacagacagaagaaaatatttgatctacaggactggacacaggaggatgaacgcgacaagtag

SEQ ID NO: 242700 - DNA, 897 bp, Artificial Sequence
  Description of Artificial Sequence: Synthetic coding sequence
agcggcaggggacacccctctgaaccccctgccagtgacggtcccgcagggtgttgctctggatcaaaagatgttgttattaaggcgcaggtcctggccggaggaaggggaaagggcacatttgaatctggattgaagggaggagtgaagatagtattctcccctgaagaagctaaggcggtgtcgtcacagatgatcggcaagaagctttttaccaagcaaactggggagaaggggcgtatctgcaaccaggttctcgtctgtgaacgaaagtatccacgcagagagtattacttcgcgataacgatggagagatcattccagggacccgtcctcatcggctcaagccacggaggcgtgaacatcgaggatgtggctgctgagtcgccagaggccataatcaaggaacccatcgatatagaggaaggcatcaaaaaagagcaagccctgcagctcgctcagaaaatgggctttccgcctaatatagtggagtccgccgctgagaacatggtaaagctttactccctctttctgaaatacgatgctaccatgatagaaatcaaccccatggtggaggacagcgacggcgcagtgctctgcatggacgccaagatcaacttcgactccaactctgcgtatcggcagaaaaagatctttgacctccaggattggacccaggaagacgaacgcgacaaagatgctgccaaggccaatctcaactacatcggcttggacggaaacattggctgcctggtcaatggagccggactggccatggccacgatggacatcatcaagttgcacggcggaacccccgctaacttcctagatgttggcggaggggctacggttcaccaggtcaccgaggcctttaagctgattacctccgacaagtag

SEQ ID NO: 242701 - DNA, 1326 bp, Artificial Sequence
  Description of Artificial Sequence: Synthetic coding sequence
atggcagccagtatgttctacgggcgattggtggctgtggcaactctccggaatcacagaccgaggacagcccagcagcagcagcgtaatctatcacttcatgagtatatgtccatggagcttctccaggaggcaggagtcagcgtcccgaaaggatatgtggcgaaaagccccgatgaggcttacgcaatagctaaaaagcttggatcaaaagatgtggtgataaaagcccaggtgctcgctggaggtaggggtaagggtactttcgaaagtggactcaaaggtggggtgaaaatcgtgttttctccagaggaggcaaaggcagtgtcaagtcagatgatcggaaaaaagctgtttactaaacagaccggcgagaaaggtagaatctgcaatcaggtcctcgtgtgtgaacgcaaataccctaggcgtgaatattacttcgctattaccatggagagatcatttcagggacctgtgcttatcggctcaagccacggaggtgtaaatattgaagacgtggcggctgagtcgcctgaagctatcattaaggagcccatcgacatcgaggaaggtatcaagaaagaacaggcccttcagctggcccaaaaaatgggttttcctcctaacatagtggaatccgccgctgagaatatggtgaaactttactccctgttcctcaagtacgacgctaccatgatcgagatcaatcccatggtggaggatagcgatggcgctgtcctctgtatggatgccaagattaattttgatagtaacagtgcctaccgtcagaaaaaaattttcgatcttcaggactggacccaagaggacgagagggataaggatgctgctaaggccaacctgaactacattggactagatggcaacatcggctgtcttgtgaacggcgctgggctggctatggccactatggatattattaagctgcacggcggaacccccgctaattttttggatgtggggggtggtgccactgtgcaccaggttactgaggccttcaagctgatcacctccgacaaaaaggttctggccatcttggtgaacatatttggaggcatcatgagatgcgatgtgatagctcaaggcatcgtgatggcagtcaaagatctggagattaaaatccccgtcgtcgtgcgactccagggcaccagagtagacgacgccaaggctctgattgccgactcaggcctcaagattctggcttgcgatgatcttgacgaagcagccagaatggtcgtgaagctttccgaaatagtgacactggccaagcaagctcatgtcgacgtgaaatttcagctccccatctag

SEQ ID NO: 242702 - DNA, 1392 bp, Artificial Sequence
  Description of Artificial Sequence: Synthetic coding sequence
atggccgcttctatgttttacggtcgattggttgcagtggccactttgagaaatcaccggcctcggaccgctcagagagctgctgcacaggtgttagggagctcgggactttttaataaccacgggctgcaggtgcagcagcaacagcagaggaatttgtcacttcacgagtatatgtccatggagctgctgcaagaggccggagtgagtgtgccgaaagggtacgtggcaaaatcaccagacgaggcttacgccattgcaaagaaactcgggtctaaagatgttgtgatcaaggctcaagttctggctggaggcagaggaaaaggaacgttcgaatccggactgaaaggcggagtgaaaattgtgttctcgccagaggaggcaaaggccgtgagctcgcagatgatcggcaagaaactgttcactaaacagaccggagagaagggacggatttgtaatcaggtcctcgtttgtgagcgtaagtatcccaggagggagtactatttcgcaatcaccatggaacggagcttccaaggtcctgtgctgattggctcctcccacgggggtgttaacatcgaggatgtggctgcagagagtcccgaagccataatcaaagaaccaattgatatcgaagagggtataaagaaggaacaggccctgcagctggcacagaagatgggtttccctcctaatatcgtggagagcgccgctgagaatatggtgaagctctactcactttttctcaagtatgacgcaactatgattgaaatcaatcctatggttgaagacagtgatggtgcagtattgtgcatggacgccaagattaacttcgattctaattccgcctaccgccagaagaaaattttcgaccttcaggactggactcaggaggacgaacgcgacaaggatgccgctaaagctaatctgaattatattggcttggatggtaacatcggctgcttagtaaatggagccggactagctatggcaacgatggatatcataaaactccacggcggtacgccagctaactttctcgacgtcggtggcggagccaccgttcaccaggtcacagaagccttcaaactgattacatcggacaagaaggtgctcgccatccttgtcaatatcttcggtggaatcatgaggtgtgatgtcattgctcaaggcatcgtgatggccgttaaagatttggaaattaagattccagtcgtggtgcgtttgcagggtacaagggtcgacgatgccaaggcgcttatcgcagattctggcctaaagattcttgcatgtgatgacctagacgaagctgctaggatggttgtaaagctgagcgagattgtgactcttgcaaagcaggcacatgtagatgttaagttccagctcccaatctag

SEQ ID NO: 242703 - DNA, 1218 bp, Artificial Sequence
  Description of Artificial Sequence: Synthetic coding sequence
atgagtatggaactgcttcaagaggccggagtctcagtgccaaaaggctatgtcgctaagtctcccgacgaagcatacgcaattgctaaaaagttgggatccaaagatgtggtgattaaggcacaggtcctcgcagggggacggggtaagggcaccttcgagagtggtctcaaaggtggagtgaagatcgtcttctcacccgaggaagcaaaagctgtaagctcccagatgattgggaagaagctctttaccaaacagactggggagaagggacgaatctgcaatcaggtgctggtctgcgagagaaagtacccccgtagggagtactactttgccattactatggagcgtagctttcaggggccagtcctcatcgggtccagtcatggtggagtaaacatcgaagatgtggcagcagagtcccctgaggccatcatcaaagagcctatcgacatagaggagggaataaagaaggaacaagctctacagcttgcccagaagatgggtttcccacccaatatcgtggaaagcgcagccgagaacatggttaaactttacagcctctttcttaagtacgatgccaccatgatcgaaatcaaccccatggtggaagacagcgacggggctgtgctttgcatggatgctaaaattaacttcgactctaactccgcatatcggcagaaaaagatcttcgacctgcaagattggacccaggaagacgaacgggataaggatgctgccaaagcgaatctgaactacatcggactggatgggaacattggctgtctggttaatggcgcagggttggcaatggccacaatggatatcatcaagcttcacggaggcacccccgctaatttcttggacgtgggcggaggggctactgtgcaccaagtgaccgaggcctttaagctcattacttccgacaagaaggtcttggcaatactcgttaatatcttcggcggaattatgcggtgcgatgtcatcgcgcagggcattgtcatggctgtcaaagacctcgaaattaagattcccgtggtagtgaggctccaggggacaagagtggacgatgctaaagcgttaatcgcagattcgggcctgaaaattctcgcatgtgatgacctcgatgaggccgcacgcatggtcgttaagctgtccgagatagtcacgctggctaaacaagcacacgtggatgtcaagtttcaactgcctatttag

SEQ ID NO: 242704 - DNA, 876 bp, Artificial Sequence
  Description of Artificial Sequence: Synthetic coding sequence
atggaacgcagcttccaagggccagtgttgattggaagctcacatggtggggtgaacatagaggacgttgccgctgaaagtccggaggcaatcataaaagagcctattgacatcgaggagggaataaagaaggagcaggcactgcaactagcccagaagatggggtttccacctaacattgtagaaagcgccgctgagaacatggtaaagctttactctctttttctaaaatatgatgccaccatgatcgaaatcaatcctatggtagaagacagtgatggagctgtcctgtgtatggatgcaaagattaactttgattcaaatagcgcataccgacaaaagaagatctttgacctacaggattggactcaggaggacgagagagacaaggacgctgctaaagccaatctgaactatatcgggctcgacggaaacatcggatgtcttgtgaacggcgcaggccttgcgatggctactatggacatcatcaagctgcacgggggaacccctgctaattttttggacgtggggggaggcgctacagtacatcaagtaacagaagcattcaaactcattacatccgacaagaaggttttagccatactcgttaatatctttggcggaattatgagatgcgatgtaatagcccaaggaatcgtcatggcagtcaaagatcttgaaattaaaatccccgtcgtggtgcgcttacaggggacccgagtagatgacgcaaaggcccttattgcggattcaggtttgaagattcttgcatgtgatgatcttgatgaagccgcacggatggtcgtgaaactgtccgagattgttactttggcaaaacaagcccatgttgatgtaaagttccaacttccaatttag

SEQ ID NO: 242705 - DNA, 1218 bp, Artificial Sequence
  Description of Artificial Sequence: Synthetic coding sequence
atgtctatggaattactgcaagaagccggagtgtctgtcccgaaggggtatgtggcgaaaagccctgatgaagcttatgcaatcgctaaaaagttgggttccaaggacgtggtcattaaggcccaggttctggcagggggaaggggtaaaggaacctttgagtccggcctcaaaggcggagtaaaaatcgtcttttcgcctgaagaagccaaagcagtgagttcacaaatgatcggtaaaaaattgtttacaaagcagacaggtgagaaaggcagaatctgtaatcaggtcctcgtgtgtgaacgtaagtacccacggcgtgagtactacttcgcaatcactatggagagaagctttcagggtccagtgctcatcggatcctcccacggcggagtcaatattgaggatgtggccgctgagtctcccgaggcaatcatcaaagagccaatcgacattgaagagggtattaagaaggaacaggcccttcagctcgcccaaaagatggggtttcccccaaatatcgtagaatccgccgctgaaaatatggtaaagctctactcactctttctgaaatacgacgcaaccatgatcgagattaacccaatggtggaagacagtgatggcgcagtgttgtgtatggatgcaaagattaattttgattccaattccgcatatcgacaaaaaaagatctttgacctccaggactggacccaggaggatgaaagagacaaggacgctgccaaggcgaacctgaattacattgggctggatggcaatattggctgcctggtgaacggggctggtctagcaatggccaccatggatatcattaaactgcatggcggaacaccagctaattttctggacgtaggcggaggagcgactgtccatcaggtcaccgaggcatttaagttgattacaagcgacaaaaaagtgttggccatcctggtaaacattttcggcggaatcatgaggtgcgatgtcatcgcacagggaatcgtgatggccgtcaaggacctcgagattaagattcctgtggtggtgcggctgcaggggacaagggtggatgatgccaaggccctgattgccgatagtggtcttaaaattctggcctgcgatgaccttgatgaagcagcccgaatggtcgtaaaactttcagaaatcgtcaccttggccaagcaagcccatgtagacgttaagttccagttgcctatctag

SEQ ID NO: 242706 - DNA, 990 bp, Artificial Sequence
  Description of Artificial Sequence: Synthetic coding sequence
atgatcggaaaaaaactcttcactaaacagacaggcgagaagggaagaatttgcaatcaggtgctcgtgtgcgagagaaaataccctaggcgggaatactacttcgctataacgatggaacgctcgttccagggtcctgtgctgatcggcagcagccacgggggagtgaatattgaagatgtcgcagccgaaagccccgaagctatcattaaggagccaattgatatcgaggagggaataaaaaaagagcaggctctgcagttggcacagaagatgggcttcccacccaacatagttgagagtgccgcagagaatatggtcaagctgtatagcctgtttctaaagtatgatgctactatgattgaaatcaatccgatggtcgaggattccgacggagcagtgttgtgtatggatgccaaaattaactttgattccaattcagcatacagacagaagaaaatcttcgaccttcaggactggactcaggaggatgagagggacaaagatgcagccaaagccaatctgaactatatcggcttggacggtaatatcggttgcctggtcaacggagccggattggccatggccaccatggacattataaaactccacggaggcacccccgcaaactttttagacgtgggtggaggggcaacagtgcaccaggttactgaagcttttaaactcatcacctcagacaaaaaggtgttggccattctggtgaacattttcgggggaatcatgagatgtgacgtgatagcacaggggatcgtgatggccgtcaaagatctcgaaattaagatcccagtcgtggtgcgtttgcagggtaccagagtagacgacgctaaggccctcattgccgacagtggcctgaagattctggcttgcgacgatttagatgaagccgctcgtatggttgtgaagctgtcagagattgtgacactcgccaaacaggcccacgttgacgtaaagttccagttaccaatctag

SEQ ID NO: 242707 - DNA, 1041 bp, Artificial Sequence
  Description of Artificial Sequence: Synthetic coding sequence
atgactgcaaccttggccgctgctgcagacattgccaccatggtgtccggcagttcaggtttagccgcagctcggttgttaagtcggagctttcttttgccccagaacggcatcagacattgcagctataccgcctccaggcagcatctgtatgtggacaagaacacaaaaatcatttgtcagggattcacaggaaagcagggtactttccacagccagcaggccctggagtacggaaccaagctggtggggggaaccacaccaggcaagggagggcagactcacctgggtctgccagtatttaacactgtcaaagaagctaaggaacagacgggagccacagcttcagtgatctacgtgccacccccatttgctgctgctgcgatcaatgaggctatcgaagccgaaatacctctagttgtttgcataacagagggcattccgcaacaggatatggtacgagtgaaacataaattattacgccaggaaaagactaggctgattggacccaactgcccaggggtgatcaacccgggagaatgcaaaatagggataatgccgggtcatatccataaaaaagggaggataggtatcgtgtcacgatcaggcacactcacgtacgaggcagttcaccagaccactcaggtcggtttgggtcagtctctgtgcgttgggatcggcggagaccctttcaatggtacggatttcatcgactgtttggaaatttttctcaacgacagcgctaccgagggaatcattcttattggtgagatcgggggaaatgccgaagagaacgcagctgagttcctgaagcagcacaacagtggcccaaattcgaaacccgtagtaagttttatcgctgggctcaccgccccaccaggacggaggatgggacatgccggagctataattgctgggggtaagggcggagcaaaagagaagatttctgctttgcagtcagcaggcgtagtggtgtccatgagcccagcccagttaggcaccaccatttacaaggaatttgaaaaaaggaagatgctgtag

SEQ ID NO: 242708 - DNA, 5483 bp, Artificial Sequence
  Description of Artificial Sequence: Synthetic coding sequence
atggctaggaaaaaattctcaggactggaaatttctcttattgttctgtttgtgatagttacaattattgcgatcgctttgattgtggttctggctacaaagacacctgctgtggatgaaatatctgactccacatcaacgcctgccaccactagagtcaccacaaacccaagcgatagtggcaagtgcccgaacgtactgaatgacccggtgaacgtacgtatcaactgtatcccagaacagttcccaacagaaggaatctgcgcgcagagaggctgttgttggcgcccttggaatgacagtttgattccttggtgtttttttgtggacaaccacggctataatgtacaagacatgacgaccacatcaatcggagtcgaagccaaactgaatagaattccgagtcctacactttttggcaatgatattaactcagtgcttttcaccactcagaaccaaacccccaacagatttcgattcaaaattaccgatccaaataaccggagatacgaggtgcctcaccagtacgtgaaggagttcacgggccctacggtgagtgacaccctgtatgacgtgaaggtggcacaaaatcctttcagcatccaggtcattcggaagagtaatggaaagactctgttcgacacgagcataggcccattagtgtattccgaccaatatctgcaaatcagcacgcggctgccctctgactatatctacggcataggtgaacaggtccacaagcgtttccgccacgatctaagttggaagacatggcccatctttacccgagaccagctgcctggcgacaataacaataacttgtatggtcatcagaccttcttcatgtgcatagaggatacctccggcaaatccttcggcgtttttctgatgaacagcaacgcaatggaaatcttcatccaacccacccccatagtgacttacagggtcaccgggggtattctggacttttatattttgctgggagacacaccagaacaggtggtccagcaataccaacagttagtcgggttgcctgctatgcctgcctattggaacctgggcttccagctgagcaggtggaattataagtctcttgacgtagtgaaggaggtggtgagacgaaaccgcgaggctgggatcccattcgatacccaagtgacggacatcgattatatggaagataagaaggattttacctacgatcaggtcgcattcaatgggctgccacagttcgtccaggatctccacgaccacggacagaagtatgtgatcatcctggacccggctatcagtatcggcagaagagccaacggcacgacgtacgcaacgtacgagcggggtaacacccaacacgtgtggatcaatgaatccgatgggagtacccccatcattggggaagtgtggcctggcctaacagtgtatccagacttcacaaatcctaattgtattgattggtgggctaacgagtgctctatttttcaccaggaggtgcagtatgatgggctttggattgatatgaatgaggtgtcttccttcatccaggggtccacaaaggggtgcaacgtgaacaaacttaattacccaccttttactcccgacatcctcgacaaattaatgtacagtaagacaatatgtatggatgcagtacagaattggggcaaacagtatgacgtacattcactgtatggctatagtatggccattgcaacagaacaggccgtccagaaagttttccctaacaaacgcagctttattctaactcgctctacttttgcaggctccggtaggcacgcagcccattggttgggagacaatacagcctcatgggagcaaatggaatggtcaatcactggcatgctcgaattctcactgtttgggatccctcttgtaggggctgatatatgtggcttcgttgccgagactaccgaggagctctgcagaaggtggatgcaactgggggctttttatccttttagtcgtaaccataatagtgatggctacgaacaccaagatcctgcttttttcggccagaacagcctgctggtgaaaagtagccgacaatacctcacgatccgttatactctcctgccattcctgtacacactattttataaggcccacgtgttcggagagacagtggccaggccggttctgcatgaattttacgaggacacgaatagctggatcgaggacaccgaattcctgtggggtccggctctcctgatcaccccagttttgaaacagggcgcagatacagttagcgcctacattcccgatgcaatttggtacgactacgagagcggggcaaaacgcccttggaggaaacagagagtggacatgtacctccctgccgataaaatcgggctgcatctgcggggagggtacatcattcccatacaggaacccgatgtgactactaccgcctcccgaaaaaaccctctaggcttaattgtggctctgggtgaaaacaacacggcaaaaggcgacttcttctgggacgatggtgaaaccaaagacaccatacaaaatggtaattatatcctttacaccttctccgtttcaaataacactttagacattgtctgcacccacagttcttaccaagagggaacaactttggccttccaaactgtcaagatcttaggattgacggacagtgtgaccgaggttcgtgttgccgagaacaaccagccaatgaatgctcacagtaacttcacttacgacgccagtaatcaggtgctgctgatcgccgaccttaagcttaacttagggaggaatttcagcgttcagtggaatcaaatcttttccgagaatgagcgatttaactgctacccagatgctgacctggctaccgagcagaaatgtacacaaagggggtgtgtgtggaggactggcagctctctctcaaaggctccagaatgctacttcccgaggcaggacaactcttattccgtgaattcggcgaggtactcatccatgggaatcaccgccgatctccagttaaatacagcgaatgcaagaattaagttaccctcagatccgatctctacgctccgggtcgaggtgaagtatcacaagaacgacatgttacagtttaagatttacgacccccagaaaaaaagatatgaggtgcccgtccctttgaacatccccacaacaccaatctctacatacgaggaccggttgtatgatgtagagattaaggagaatcctttcggtatccagatccggaggagatctagcgggagagtcatatgggattcttggttgccaggcttcgcctttaacgaccagttcattcaaattagcacaaggctcccctctgagtacatctatggcttcggagaggttgagcacaccgcgtttaaacgagacctcaactggaatacgtggggcatgtttacacgggaccaacccccagggtacaagctcaattcgtatgggttccacccctactacatggctctcgaagaagaaggcaacgcccatggcgtctttttgctcaatagcaacgcaatggatgtgactttccaacccacacctgcgctgacatatcgtaccgtcggcggaatcttagatttctatatgttcctaggccctacgccagaagtggccacaaagcagtaccacgaggttattggacatccggtgatgcccgcttattgggctcttggcttccaactctgcagatatggctacgcaaatactagtgaagttagggaactgtatgacgccatggtcgcggcaaacattccatacgatgtccagtatacggacattgactacatggaacgtcaactggactttactatcggagaggcattccaggatctgccacagttcgtcgacaagatcagaggggagggcatgcggtacatcatcattctggacccggcaatctctggcaacgagacaaagacatacccagcatttgaacgaggacagcaaaatgatgtgtttgtcaagtggccaaacacgaacgacatttgctgggccaaggtctggccagatttgccaaatataactattgacaaaactttaacagaggacgaagccgtgaatgcttcacgcgctcacgttgccttccctgacttctttcgcacaagcactgccgagtggtgggccagggaaatcgttgacttctataacgagaagatgaaatttgacggcctctggattgatatgaacgaacctagctcctttgtaaacggcacaactaccaatcaatgtcgaaatgatgaactgaattaccctccatattttcctgagctgactaagagaaccgacggactccatttccgaaccatctgcatggaagcagagcagattctctctgatgggacctcggtgctgcactacgatgtacataatttgtatgggtggtcacagatgaagcctactcacgacgcactgcaaaagactacaggcaagagggggattgtgatctcaagaagtacgtaccctacgagtgggaggtgggggggacattggctgggtgataactatgcccgatgggacaacatggataagagcatcatcggcatgatggagttttcactgtttggaatgtcgtataccggagccgatatatgtggcttttttaacaattcggagtaccatctgtgcacccgttggatgcagctcggtgcgttttatccttactccagaaaccacaatattgccaatacccgcagacaggacccagcaagttggaacgagacattcgccgagatgtcccggaacattctgaacattaggtacacgcttcttccatacttttatacacagatgcacgaaattcacgctaacgggggtacagtgattcggccacttctgcatgaattctttgatgaaaaacccacctgggacattttcaaacaattcctctggggcccagccttcatggtgacaccagtcttggagccatatgtccaaaccgtgaatgcatacgtcccaaacgcaaggtggtttgattaccatacagggaaggatatcggggttcgagggcaatttcaaacgttcaacgcgagttacgacacgatcaatctgcacgttcggggaggtcacatattaccctgtcaggagccagcccagaataccttctacagtagacaaaagcacatgaagctcatcgtggccgcagacgataaccagatggctcaggggagtttattttgggatgatggtgaatcgatcgacacatacgagcgcgacttgtatcttagcgtgcagtttaatctcaatcaaacaactctgacatctaccatcctgaagaggggatatatcaacaaatccgaaacacgactggggtccctacacgtttggggtaaaggtaccacccctgttaatgccgttacactgacttacaacggaaataaaaattctctcccatttaacgaagacacaacaaatatgatcctgcgaatcgatctgaccactcataatgtgacccttgaggagccaatcgagattaattggagtta

SEQ ID NO: 242709 - DNA, 2616 bp, Artificial Sequence
  Description of Artificial Sequence: Synthetic coding sequence
atgaagtactcttgttgtgcgctggtgctggcagtgctcggaacggaattgcttgggagcctctgctcaactgttcggtcgcccagattccgcggtcgtattcagcaggagcggaagaatatccggcctaatatcattttagtgttaacagacgatcaagatgttgaactgggaagcttacaggtgatgaacaagaccagaaagataatggagcacggaggggcaacatttataaacgcctttgtgacaacgccgatgtgttgtccaagtagaagtagtatgttgaccgggaagtacgtgcacaaccataacgtttataccaataatgagaactgcagcagtccaagctggcaggccatgcacgagcccaggacattcgcagtgtatttgaataatacaggctaccgcaccgcgttctttggcaagtatcttaacgagtacaacgggtcctatattcctccaggatggcgggagtggcttgggctgattaagaattcccggttctataactacaccgtgtgtcgaaacggaataaaagaaaagcacggttttgactacgctaaggattacttcacagacctgatcactaatgagtctattaactacttcaaaatgagcaagcggatgtaccctcaccggccagtgatgatggtcatcagtcatgctgcccctcacggccctgaggacagcgccccacagtttagtaagctgtatccaaatgcctcccagcacattacaccgtcgtataattacgcgcctaatatggacaaacactggattatgcagtataccggtccaatgctacccatccacatggagtttaccaatatcttgcagcgaaagcggttacaaactcttatgagtgtggacgactctgtggagcgtctctataacatgttagtggaaactggagagttagagaatacttacataatctacacagctgatcatgggtaccacatcggccagttcgggctggtgaagggcaagtccatgccctacgacttcgatatccgggtccccttctttatccggggacccagcgtcgaacccggtagcattgtgcctcagatcgtactcaatattgatctcgcacctactattctagatattgccggtctcgacacccccccagacgtggatgggaagtccgtgttaaagttgctggatcccgagaaaccaggaaaccgcttccggacaaataagaaggctaaaatttggcgggacacctttcttgtggaacgagggaagttccttcggaaaaaagaagagtcaagcaagaacattcagcagtctaatcacctgcctaagtacgaacgggtcaaagaattgtgccagcaggctagatatcagacggcctgtgaacagcccggacagaaatggcagtgtattgaggacacatcaggaaagttgcggatccataagtgtaaggggccatccgacctgttaaccgtccgccagtctacaaggaacctgtatgcacgcggatttcacgataaggacaaggagtgctcttgtagggagagtggttatagagctagccgcagccagaggaagtctcaaaggcaattcttgaggaaccagggaacccccaaatacaagcccaggttcgtccatacacgccaaaccagatctttgtcggttgaatttgaaggggagatttacgacatcaacctagaagaggaggaggagctccaggtgctgcagccaaggaatatcgcaaagcggcacgatgagggccataagggtcctagagacttacaggctagttcgggcggtaaccggggacggatgctcgccgattcatccaatgccgtaggaccaccgaccacagtgcgtgtgacccataaatgctttatcctaccaaacgacagtatccactgcgagcgggaactataccaatccgcacgcgcatggaaggaccacaaagcctacattgacaaagagatcgaggccctgcaagacaagattaagaaccttcgcgaggtcagaggtcatctgaaaagacggaagccggaagagtgctcttgctccaagcaatcgtactacaataaggaaaagggagtcaaaaagcaagagaagctaaaatcccacttgcacccctttaaagaagccgcacaggaggtcgacagtaaactgcagctgtttaaggagaacaacaggagaaggaagaaggagaggaaagagaagagacgccagcgcaagggggaagagtgttccctcccaggcctcacctgctttacacacgacaataaccactggcagacagctcctttctggaacctcggaagtttttgcgcctgcacttcatcgaacaacaatacatactggtgtctaagaaccgtgaatgaaactcacaacttcctattctgtgagtttgcaactgggttcttagagtacttcgacatgaacaccgatccctaccagctgacaaatacggtgcacacagtggagcggggtatcctaaaccagctccatgtacaacttatggaactgcgttcttgtcaggggtacaaacaatgcaaccctaggcctaaaaacctcgatgttggaaataaagatgggggaagctatgatttacacagggggcagctctgggatggatgggagggatag

SEQ ID NO: 242710 - DNA, 2616 bp, Artificial Sequence
  Description of Artificial Sequence: Synthetic coding sequence
atgaagtatagctgttgtgccctggtgcttgccgtgttaggtactgaacttcttgggtcactctgttccactgtacgatcaccacgcttccgtgggaggatccagcaggaaaggaaaaacatacggcctaatatcattttggtcttgactgacgaccaggacgtcgaactcgggagcctgcaagtgatgaacaagacacgcaagattatggaacatgggggagcaacctttattaacgcatttgttaccacccctatgtgttgtccctcccggtcatcaatgttgacagggaagtatgttcacaatcacaacgtctacacgaacaacgagaattgcagctccccgagctggcaagccatgcacgaacccagaaccttcgcagtatacctgaataataccggctacaggactgcattcttcgggaaatatcttaacgaatataatggctcatacattcccccagggtggagagagtggctggggttaattaagaactcccgtttctacaactataccgtctgcagaaacggcatcaaagagaaacacgggtttgattatgcgaaggattatttcaccgaccttatcacaaacgagtctattaattacttcaagatgagtaagcgcatgtatccccaccgccctgtcatgatggtaattagccacgccgcacctcacggaccagaagattcagcccctcagttctctaagctgtatccaaacgcttcgcagcacattacgccgtcctataactatgccccaaatatggataagcactggattatgcagtacacgggacccatgctgcctatccacatggagtttacaaatatcttacagcgaaaacggctacagactctgatgtctgtcgatgacagtgttgagcgcctttataacatgctggtagagaccggagagcttgaaaatacctacattatttacaccgcagatcacggttaccacatcggtcaatttggcctggtgaagggtaaatccatgccatacgatttcgatattagagtgccattcttcatcagaggcccttcggtagaacctggtagcattgtccctcagatcgtgctgaatattgacctggccccaacaatactggacatcgccggactcgacaccccgcctgacgtagatggtaaatctgtgctaaagctgttagatcctgagaagccgggaaatcgattccgaaccaacaagaaagccaaaatttggagggacacttttttggttgaaaggggcaagtttctccgcaagaaagaagagtcaagcaagaacattcaacagagtaatcacctgccaaagtatgagagagtcaaagagctgtgtcagcaagctcgataccaaactgcatgtgagcagcctgggcagaagtggcagtgtatagaggacacatccggtaagctccgaatccataagtgcaagggcccttcagatctcctgactgtacgccagtccacacgcaatctgtacgcaagaggcttccatgacaaggacaaggaatgtagctgtagggaatctggttacagggcctccagaagtcaaaggaagtcacagaggcagttccttagaaatcaaggtactccaaaatataagccacggttcgtgcacaccagacagactcgttccctttctgttgagttcgagggcgagatttatgatataaacttggaggaagaggaggaactgcaggtgttgcagcccaggaacatcgccaagcggcacgatgaaggtcataaaggaccgcgagatctgcaagcatcgtcaggcggaaatagggggagaatgctcgcggactccagcaatgctgtcggaccgcctactacggtacgcgtgacacataaatgctttatactgccaaacgactctatccattgcgagagggaactttaccagagcgcccgtgcttggaaggaccacaaggcctacattgacaaagaaattgaggctctgcaggacaagatcaaaaaccttagagaagtgcggggtcatctgaagaggcggaagccagaagaatgctcctgttctaaacagagttattacaacaaggaaaagggggtgaaaaaacaggagaagttaaaaagccatcttcaccccttcaaagaggctgcccaggaagtggatagcaaactacagttgtttaaggagaataaccgcagaagaaagaaggaaagaaaagaaaaacgtcgccagaggaaaggagaagagtgtagcttgcccggtctgacttgtttcactcatgacaacaatcactggcagacggctccattttggaatttgggcagcttttgcgcctgcacttcttccaacaacaatacgtactggtgcctcagaactgtgaacgaaactcacaatttcctgttttgtgagttcgcaacgggattcctcgagtactttgatatgaacactgacccatatcagctgactaatactgtccatacagtcgagagagggatcctaaaccagctgcacgtgcagcttatggaactcaggtcatgccagggatacaaacaatgcaatcctcgccctaaaaacctcgatgtgggcaataaggacggcggatcatacgatctgcacaggggccagctgtgggacgggtgggagggatag

SEQ ID NO: 242711 - DNA, 2616 bp, Artificial Sequence
  Description of Artificial Sequence: Synthetic coding sequence
atgaagtatagttgttgcgccctggtgctggctgtgctcgggactgaactcctcggaagcctgtgctcgactgtccggtcaccgcgattccggggacgcatacagcaggaacgaaagaacatacgtcccaatatcattctggtcctgaccgatgaccaggacgtggaactgggctccctccaagtgatgaataagacacggaagattatggaacatggtggtgcaacgttcataaacgctttcgtcacgactcccatgtgctgcccttcccggtcatccatgctgaccggaaaatatgtgcacaaccataatgtttacactaataatgaaaattgttcatcaccatcctggcaagccatgcacgaaccacgtacttttgcagtctacctgaacaacaccggttatcgcaccgccttcttcggaaagtaccttaatgaatacaatgggagctacattcctcccggatggagagaatggctgggattgatcaagaacagtcgattctataattacactgtctgcaggaacggcatcaaagaaaagcatggtttcgattacgccaaagactactttaccgatctcatcaccaacgaatcaattaattacttcaagatgtcaaaaagaatgtatcctcaccgccctgtcatgatggtgatatcccacgccgcaccacatggtcctgaagacagcgccccacaattttccaaattataccctaacgcctcccagcacatcacgccctcctataattatgcaccaaatatggacaagcactggataatgcagtacactggcccaatgctgcctatccacatggagttcaccaatattctccagagaaaacgacttcagaccctgatgtctgtggatgacagcgtggagagattatacaatatgctcgtcgaaacgggagaactggaaaatacatatatcatttacaccgccgatcacggttaccacattggccagttcggactagtcaaggggaagagtatgccatacgattttgatatccgggttccattcttcattcgcggaccttccgtcgaacctggaagcattgtcccacagattgtgctcaacatagatttagcccctacgatcctcgatatcgccggactcgatacccccccagatgtcgatgggaagtccgttctaaagctcttagatccagagaaacctggaaaccgcttccgaaccaataagaaagctaaaatctggagggacacttttctcgttgaaaggggcaagttcctgcgcaagaaggaggaatcctcaaaaaatatccagcagtccaatcatctgcccaagtatgaaagggtgaaggagctctgtcaacaggccaggtaccagaccgcctgcgaacaaccgggtcagaaatggcagtgtattgaagacaccagcgggaagctgcgtattcacaagtgtaaaggcccaagcgacctgcttacagttaggcagtctacccgcaacctgtatgcacgcggattccacgacaaggataaggaatgttcatgtcgcgagtctggttaccgggcatccaggagtcagaggaagtcccaacggcaatttctcaggaatcagggcacgccgaagtataagccacgatttgtgcatacaaggcagacccgaagtttgagtgtcgaattcgagggcgaaatctacgacatcaacctggaggaggaagaggaactgcaggtgctgcaacctagaaatatcgcaaaacggcatgatgaaggccataaggggcctcgcgatctccaggcttcaagcggcggtaatcgtggtagaatgctggcagattcaagcaatgccgtggggccacctaccactgttagggtgacccacaagtgtttcattctacctaatgactcaatccattgtgaaagggagctctatcaaagcgctcgcgcttggaaggatcataaggcctatatcgacaaagaaattgaggccctgcaggacaaaatcaagaatctccgcgaggtgcggggacacctaaagcgtaggaaacctgaggagtgcagctgtagtaagcagtcctattataacaaggaaaaaggggtgaaaaagcaggagaagctgaagagccacttgcacccatttaaagaggcggctcaagaggtcgatagcaaactacagctctttaaggaaaataaccggcgacgcaagaaagagagaaaagaaaagcgcaggcaaaggaagggcgaggaatgttccctgccaggtctgacatgcttcacacacgataacaaccactggcagacagcccctttttggaaccttggctctttctgtgcatgcacaagttccaacaacaatacatactggtgtttgcgtaccgtcaatgaaactcacaattttctgttctgcgagttcgccacaggcttcctggagtactttgatatgaacaccgacccatatcaactaacaaataccgttcataccgtagaacgtggaattctcaaccagctgcatgtgcaacttatggagctgaggtcctgccaggggtacaagcagtgcaacccccgtcccaagaatctagatgttggtaataaggacggtgggtcatacgatcttcataggggacagctctgggacgggtgggagggctag

SEQ ID NO: 242712 - DNA, 2616 bp, Artificial Sequence
  Description of Artificial Sequence: Synthetic coding sequence
atgaagtactcttgttgcgccctggtgctcgcagtcctgggtacagaattgttggggtctctgtgctctactgtccgttctcctaggtttcggggacggatccagcaggaacggaagaacatcaggccaaacataattctggtccttacggatgaccaggacgtcgaactcgggtctctacaggtgatgaataaaacccgcaagataatggaacatggaggagccacttttataaatgcattcgtgactacccccatgtgctgtccatcccgctcctccatgctgaccgggaagtatgtccacaatcacaacgtttacactaataatgagaactgttcatcaccctcatggcaggccatgcacgagccaaggacctttgctgtgtacttaaacaataccggctatcgcactgcgttttttgggaaatacttgaacgaatacaacggatcatacattcctccagggtggagagagtggttgggccttatcaagaactcacggttttacaactacaccgtgtgcaggaacggcatcaaagagaaacacggcttcgattacgctaaggactattttacggatctcattaccaatgagagcatcaactattttaaaatgtccaaacggatgtatccccacagaccggtaatgatggtgatttcccacgcagcccctcatggcccagaggatagtgcaccccagtttagcaagctgtatcctaatgccagtcagcacattacaccaagttacaattacgcgcctaacatggacaagcactggataatgcagtacaccgggcctatgctgcccattcacatggagttcaccaacatactgcagcggaaacgccttcagactctgatgagcgttgacgacagtgtggaaagactctataatatgcttgtcgagactggcgaactggagaacacatatatcatttacactgcagaccatggttaccacataggccagtttggcttggttaagggcaaaagtatgccttatgattttgacatccgggtaccatttttcattaggggtccctccgtggaacccggaagcattgtgccccaaatcgtccttaatattgatctcgcaccgacgattctggatatcgcgggtctcgatacgccccctgatgtggacggtaaatccgtgctgaaacttctcgacccagagaagcccggaaacaggtttcggacgaataagaaggcaaagatctggagggacaccttcctggtggagaggggaaagtttctgaggaaaaaagaggagtcttccaagaatatccagcagagcaaccatctgcctaaatatgagcgcgttaaggagctatgccagcaggcccgttatcagaccgcctgcgagcagccagggcaaaagtggcagtgtatagaggacacctccggcaaactcaggatccacaaatgcaaggggcctagcgacctactgaccgtcagacagtcaacacggaatctgtacgcacgtggctttcacgataaagacaaggagtgtagctgtcgcgagtcgggctaccgagcaagtcggtcccagaggaaatcccagcggcaattcctgcgcaaccaaggcacaccaaaatacaagccacgcttcgtccatacacggcagacccggtcactcagcgtggaattcgagggcgaaatctacgatattaatcttgaggaggaggaagagcttcaagtgctgcagcctaggaacatcgccaagcgacacgatgagggccacaaaggtcccagggatttgcaggcatcctcagggggaaatagggggagaatgttggctgatagcagtaatgccgttggccctcccacaacagtgcgcgttactcacaagtgttttattcttccaaatgactccatccactgcgaacgggaactttatcagagcgctcgagcctggaaggaccataaagcttacatcgacaaggaaattgaggccctgcaggacaaaattaaaaatcttcgcgaggtcagggggcatttaaagcgccgtaagcccgaagagtgcagttgttccaaacagtcctattataacaaggagaaaggagtgaaaaagcaagagaaactcaagtcccatctgcacccttttaaagaagctgcccaggaagtggattcaaaactgcagttgtttaaggagaataaccgtagacgcaagaaggaaaggaaggaaaagcgtcgacagcgaaaaggggaggaatgctcattgccgggactgacgtgcttcacccatgataacaaccactggcagacagcccctttttggaatctgggaagtttctgtgcatgtacatcgtctaacaacaatacctactggtgcttgcgcaccgtgaacgaaacccacaacttcctcttctgtgaatttgcaacaggattcctggaatattttgatatgaatacagacccttatcagttgacaaacaccgtccacaccgtggagcgcggaattctgaaccaactgcacgtccagctgatggagctcaggtcttgccagggctacaagcagtgtaaccccagacctaaaaatttggacgtcggcaacaaggacggaggttcctacgacctgcatcgtggccagctgtgggacggatgggaggggtag

SEQ ID NO: 242713 - DNA, 90 bp, Artificial Sequence
  Description of Artificial Sequence: Synthetic coding sequence
atgaagtacagctgttgtgctttggttctggccgtcctagggacagaactgttggggtcactctgcagtacagttcgttctcccagatag

SEQ ID NO: 242714 - DNA, 519 bp, Artificial Sequence
  Description of Artificial Sequence: Synthetic coding sequence
atgaagtactcttgctgtgctctggtgcttgccgtcctgggcacagagctccttgggtccctgtgctctaccgtcagatccccacgcttcagaggaaggatccagcaggaaagaaaaaatatccgcccaaatataattcttgtcttgacagacgatcaggatgtagagctgggcagcttgcaggtcatgaacaaaactaggaagataatggagcacggaggcgctaccttcatcaacgcgttcgttacaacccccatgtgctgccctagtaggtcaagtatgctaacgggcaagtacgtgcacaatcacaatgtctacacgaacaacgagaattgcagttctccttcttggcaggcaatgcacgaaccaagaacattcgctgtttacctaaacaataccgggtataggaccgcattttttggaaaatacctcaacgagtataacggatcctatattcccccaggttggcgagagtggcttggtctcatcaagaactctcgcttctacaactacacctag

SEQ ID NO: 242715 - DNA, 231 bp, Artificial Sequence
  Description of Artificial Sequence: Synthetic coding sequence
atgaagtatagctgttgtgccttagtgctggccgtgctgggaacagagcttctgggtagtctctgctcaaccgtgcgcagccccagatttagaggacggatacagcaggaacgtaagaatataagacccaatattattctcgtgttaactgacgaccaggacgtcgaactgggctcattgcaggtgatgaataagactcgaaaaatcatggagcacgggggtgccacatag

SEQ ID NO: 242716 - DNA, 258 bp, Artificial Sequence
  Description of Artificial Sequence: Synthetic coding sequence
atgaagtacagctgctgcgcattagtactggctgtcctcggaaccgaacttctgggatccctgtgcagcacagtgcgatctccaaggtttcgtgggagaatccagcaagagaggaagaatattcggcctaacataatcttggtgctgaccgacgaccaggacgtggaattgggtagcttgcaagtgatgaacaaaacccgcaagattatggagcatggaggagcaacatttataaacgcctttgtcaccactccatag

SEQ ID NO: 242717 - DNA, 171 bp, Artificial Sequence
  Description of Artificial Sequence: Synthetic coding sequence
atgaagtactcttgctgcgccttggtcctcgctgtcttggggacagagctgctgggcagcctctgcagtacggtcagatcacccaggttccgtgggagaatccagcaggagcgcaaaaacatccgaccgaatatcatcctggttctgaccgatgaccaggacgtggaatag

SEQ ID NO: 242718 - DNA, 2613 bp, Artificial Sequence
  Description of Artificial Sequence: Synthetic coding sequence
atgggcccaccatcactggtgctatgtctgctgtcagctaccgtgtttagcctcctcggagggagtagcgccttcctctcccaccatcggctgaaagggagattccaaagagacaggcgtaatattcgacccaatatcattctggttctcactgatgatcaggatgtggagcttgggtcaatgcaggtcatgaataaaacacgtcggatcatggaacagggtggcgcacacttcatcaacgcattcgtgacaacacctatgtgctgtcctagtcgcagctccatcttgactgggaagtacgtccacaatcataacacctatactaataatgagaactgttcctctccctcttggcaggcccagcacgagtccagaactttcgccgtgtatctgaactccaccgggtaccgcacagccttcttcgggaaataccttaacgaatacaacgggagttatgtgcctccaggatggaaagagtgggtcgggctgctgaagaatagtaggttttacaactataccttatgcaggaacggggtcaaggagaaacacggaagcgattactctaaagactacctcacagatttgatcacgaacgattccgtgagcttcttcagaacatctaaaaagatgtacccacatcgacctgtgctgatggtgatcagccatgcagcccctcacgggcctgaagatagcgcccctcagtacagtcgcctgtttcccaacgcttcacaacatataaccccttcttacaattacgcgcctaatccggataagcactggatcatgagatacactgggccaatgaaacccattcacatggagtttacgaacatgctgcagcgtaaaagactgcagacactcatgagcgttgacgattcaatggagacaatatacaacatgttggtcgaaactggtgaactcgacaacacatatatagtatatactgcagatcatgggtaccacatcggccagtttgggctggttaagggaaagagcatgccttatgagttcgatattcgtgtgccattttacgtgcggggacctaacgtcgaagccggatgtcttaacccccacatcgtgctgaatatcgatctggcccctacaatactcgacatcgccggtttggacatccccgcagacatggatgggaagagcattttgaagcttctggacaccgaacgcccagtcaaccggttccacctgaaaaagaagatgagggtatggagagattccttcctcgtcgagagggggaaattactgcataaaagagacaacgataaggtggacgcccaggaggagaactttctcccgaagtaccagcgggtgaaggatctgtgccaacgcgctgagtatcagacagcttgcgaacagctggggcaaaagtggcagtgcgtggaggacgcaactggcaaactcaaactccacaaatgcaaaggcccaatgaggttgggcggtagtcgcgctctcagtaacctggttcctaaatattatggccagggatctgaagcttgtacatgtgacagcggtgactataaactgagtctcgcagggagaagaaagaaattatttaagaaaaagtacaaagccagctacgtccgcagccgcagtatcaggagcgtggccatcgaggttgacgggcgagtgtaccatgttgggctgggtgatgccgcacagccacgtaatttaaccaagcggcactggccgggtgctcccgaggatcaagacgataaagatggcggagacttctccggcaccggagggctgcctgactactcagccgctaaccctatcaaagttacacaccgctgttacattctggagaacgacacagtgcagtgtgatttggatttgtataagagtctccaggcatggaaagaccacaaattacacatcgaccacgaaattgaaactctgcagaacaagattaagaacctacgggaggtgcgtggacatctgaaaaaaaaaaggcctgaggagtgcgactgccataaaattagctaccatacccagcacaaagggaggctaaagcacagagggtcatcattacatcccttccgcaaaggcctgcaggaaaaagacaaggtgtggcttctgagggagcagaagcgaaaaaaaaaactgagaaagctcctcaagcggctccagaacaacgatacctgttcaatgcctggcttaacctgtttcacccacgataaccagcactggcagacagcgccattttggaccttgggccctttttgtgcctgtacgtccgctaacaataacacatactggtgtatgaggactattaacgagacccataattttttgttttgcgaatttgccaccggatttctggagtattttgatctcaacaccgatccttaccagctcatgaacgctgtcaacacgttggatcgagatgtgctcaaccagctgcacgtgcagctgatggagctgcgatcttgtaagggatacaaacaatgtaacccaagaacccgcaatatggatctcggtcttaaggacggcggatcatacgaacagtaccgtcagtttcagagacggaaatggcctgaaatgaagcggcctagcagcaagtcgctcggacaactttgggagggctgggaaggttag

SEQ ID NO: 242719 - DNA, 2559 bp, Artificial Sequence
  Description of Artificial Sequence: Synthetic coding sequence
atgggccctccaagcctcgtgctttgtttacttagcgctaccgtgttcagcttgctcggcggaagctcagccttcctgtcacatcatagacttaaaggccgattccagcgcgacagaaggaatatacgtcctaacatcatcctggtcctgactgatgatcaggacgtcgagctgggcagtatgcaagttatgaataagaccaggcgcatcatggagcagggcggagcacactttattaatgcctttgtgaccacccctatgtgctgtccttcccggtcgtccattctgaccgggaagtacgttcataatcacaacacatacacgaataacgagaattgttcaagtccctcttggcaggcccagcacgaaagtcgcacgtttgcggtttatctgaactctaccggttacaggaccgccttttttggcaagtacctgaacgaatacaatggatcatatgttccccctggttggaaggagtgggtgggactcctgaaaaattcgcggttttataactataccctttgccgaaatggcgtgaaagagaagcacgggtctgactactctaaggactacctaactgacctgatcacaaatgacagtgtgtcattcttccggacctccaagaaaatgtatccacacaggcctgttctgatggtgatttcccatgcagcccctcatggaccagaggactctgctcctcagtatagcagactcttccccaacgcttctcagcacattactcctagttataattacgcacctaatcctgataagcactggatcatgcgctatacagggccaatgaaacctatacacatggagtttactaacatgctacagcggaagagactgcaaaccctcatgagtgtagacgatagcatggaaacaatctataacatgctcgtagaaacaggagaactcgacaatacctacatcgtctacaccgcagaccacggatatcacattggccagtttgggctggttaagggcaaatccatgccctatgaatttgatatcagggtgccattctatgtccgaggtccaaacgtcgaggctgggtgtttgaacccccacatagtgttgaacatcgacctggcgcctaccattctggatatcgctggcctggacatacccgcagatatggacggcaagtctatactcaagctgctcgatactgagcgaccagtcaaccggtttcaccttaaaaaaaagatgcgagtgtggagggatagctttctggtagagcggggtaaactgttgcacaaaagggataatgacaaagtggacgcgcaggaggagaatttcttacccaaataccagagagtcaaggatctttgccaacgggctgagtaccagaccgcgtgtgagcaactggggcagaagtggcaatgcgtggaagacgcgaccggaaagctgaagctgcacaaatgcaaaggcccaatgagacttggcggatcccgggctttgagcaacctggttccaaagtattacgggcaagggagcgaggcctgtacttgtgacagcggagactacaagctgtctttagctggacgtcggaagaaattgttcaagaagaaatataaagcttcctatgtccggagtagatctatccgatcagtcgccattgaggttgatgggagagtgtaccacgtcggcctcggggacgccgcacagcctcggaacttgaccaagcgtcactggcctggcgcacctgaagaccaggacgacaaggacggtggcgattttagtgggactggcggtttgccagactactctgccgctaacccaatcaaagtcactcacagatgctatatcctggaaaatgatactgtgcagtgcgacctcgatctttacaagtccttgcaggcatggaaagaccacaagttgcatattgatcacgaaattgagactttacaaaacaaaattaagaatttgcgagaggtgaggggacatctaaaaaagaagagacctgaggaatgcgattgtcacaagatttcttaccatacccaacacaagggtcggctgaaacatcgcggttccagcctgcatcccttcaggaaaggattgcaggaaaaagataaggtttggttgctgcgcgagcagaagcgcaaaaaaaaactgagaaagctgttaaaacggctgcagaataacgacacttgttccatgcccggattaacctgtttcacacacgacaaccaacattggcaaactgcgccattctggacgctggggccattttgcgcttgtacaagtgcaaacaacaacacgtactggtgtatgagaacaatcaatgaaacacacaattttctgttctgcgagttcgcaaccggatttctagaatattttgatctcaacaccgatccatatcaattgatgaacgccgtaaacacactcgaccgtgacgtccttaaccagctgcatgtgcaactcatggaactaaggtcttgtaagggctataagcaatgcaacccaagaaccaggaatatggacttgggcctgaaggatgggggttcctacgaacaataccgcggacaactgtgggagggatgggagggctag

SEQ ID NO: 242720 - DNA, 870 bp, Artificial Sequence
  Description of Artificial Sequence: Synthetic coding sequence
ttttctgggacgggcggattgccagattatagcgctgctaatccgattaaggttacacacaggtgctacatcttagaaaacgacaccgtgcaatgcgatctggatctctataaaagcctccaagcttggaaagaccacaagctccacattgaccatgagatcgaaactctgcaaaataagatcaagaatcttcgcgaagtgcgaggacacttgaagaaaaaacggcctgaggagtgtgattgccacaagatttcttatcacacacaacataaggggaggttaaagcatcggggatcatctctgcacccattccggaaaggactgcaagagaaggacaaggtctggcttctcagggagcagaagcgaaaaaagaaactcaggaaattactgaagagactgcaaaataacgacacatgcagcatgccgggactgacatgtttcactcacgataaccagcattggcaaactgcccctttttggaccctgggcccattttgtgcctgtacatctgccaacaacaatacctattggtgtatgcgcactatcaatgagacccataactttttattttgcgagttcgcaactggttttctcgagtattttgacctcaatacagatccatatcagttgatgaatgcagtgaatactctggatcgggatgtgctgaatcagctgcatgtgcagctgatggaactgagatcttgtaaggggtacaagcagtgtaaccctagaacaaggaatatggacctcgggctcaaagatggaggcagctatgagcagtatcggcaattccaaagacgaaaatggccagagatgaaacgtccttcttctaagagcctcgggcagctgtgggagggctgggaggggtag

SEQ ID NO: 242721 - DNA, 2604 bp, Artificial Sequence
  Description of Artificial Sequence: Synthetic coding sequence
atgggcccaccttctctcgtgctgtgcctgctctctgccaccgttttcagcctcctgggtgggtcaagcgccttcctgtcccatcataggctcaagggccgtttccagagggaccgtcgaaacattcggccaaatatcattctggtgttgaccgatgatcaggatgtcgaactggggtcgatgcaggtgatgaataagacacgcagaattatggaacaggggggtgcccatttcattaacgcctttgtcacaacaccaatgtgctgtccttcgagaagctcaatcctcacagggaaatatgtgcataaccacaacacctacactaataatgagaactgctcgtccccatcctggcaggctcaacatgagtcacgcacatttgcagtttatctgaacagcaccggctataggacagcgttcttcggaaaataccttaatgagtacaacggcagctacgtaccacccggatggaaggaatgggtcggactcctgaaaaacagccgcttttacaattacactctgtgtagaaatggcgtgaaagaaaagcacggttccgactactctaaggactacctgacagacctaattacgaatgactcagtgtccttctttagaacctccaagaagatgtatccacaccgtccagtgctaatggtgatctcacatgcagccccacacggcccagaggacagtgctccacaatactcgagactctttcctaatgcttcccaacacattaccccttcctataattacgccccaaaccccgataagcactggatcatgcgctataccgggcctatgaagccaatccatatggaattcactaacatgctccagcgaaaacgtcttcagaccctgatgtccgtggacgactccatggaaactatctataatatgttggtcgagaccggcgaactggacaacacgtacatcgtgtacacggccgaccatggctaccacatagggcagtttgggctggttaagggtaagtccatgccctatgagttcgatattagggtaccattttacgtacggggtcccaatgtcgaggcaggatgccttaatcctcacattgttctcaacatcgatctggcacccactatcttggacattgctggtctggacattcctgccgacatggacgggaaatcaatcctcaaactactcgacaccgagcggcctgtgaacagatttcacctaaaaaaaaagatgagggtgtggcgggattcatttctggtcgagcggggaaaactcctgcacaagagggacaacgataaagtggacgcgcaagaggagaatttcctgcctaagtaccagagggtcaaggatctgtgccagagagccgagtaccagactgcatgtgaacagctgggccagaaatggcagtgcgtggaggacgcaaccggcaagctgaagctccacaagtgcaaaggcccaatgcgattaggaggttcacgagcactttcgaacctcgtgccgaagtattacggacagggcagtgaggcctgtacatgcgattccggcgactataagctgtcactggcagggaggaggaagaagttgttcaaaaagaaatataaggcctcatacgtgaggagccgaagcattaggtctgtagcaatagaagtggatggcagggtgtaccacgtcggcttaggcgatgcagcccaacccaggaatcttacaaagcggcactggcccggtgcgcctgaagatcaggacgataaggatggaggggacttctcaggaactgggggattgcccgattacagcgcagccaaccctattaaagtgactcatcgttgttacattctagaaaatgataccgtgcagtgtgacctggacctctataagagtttgcaagcctggaaagaccataagctgcacattgatcacgagatcgagacactgcagaataagatcaagaacctccgggaagtccggggtcatctgaagaaaaagaggccagaggaatgtgactgccacaaaataagctaccatacgcagcataaaggtagactcaagcaccggggttctagtctgcaccccttccggaagggactgcaagagaaagataaagtttggctcctgcgcgagcagaagcggaagaaaaagctcaggaaattgctcaagcgactgcaaaacaatgatacatgttctatgccaggcctgacttgttttacacatgataatcagcactggcagacagcccctttttggacacttggacccttttgcgcttgtaccagcgccaacaacaacacctattggtgcatgcgcaccatcaacgaaacccacaatttcttattctgcgagtttgccacaggtttcctggaatactttgatctgaacaccgacccatatcaactgatgaacgcagtaaacacgctggatcgcgatgtgctaaaccagctgcacgtccaacttatggaattgcggtcctgcaagggctacaagcagtgcaatccacggacgagaaacatggatcttgacgggggatcctatgaacagtaccggcagttccagcggcgtaaatggcctgaaatgaagcggcctagcagtaaatccctcggacagttgtgggagggatgggaggggtag

SEQ ID NO: 242722 - DNA, 2613 bp, Artificial Sequence
  Description of Artificial Sequence: Synthetic coding sequence
atgggtccaccctccctcgtcctgtgcctgctctctgctaccgttttttccttgctcggcggtagcagtgccttccttagccaccacaggctgaaaggcaggttccaacgggaccggagaaatattcgaccaaacatcattttggtattaaccgatgatcaggacgtggagctcggctcgatgcaggtcatgaataagacacgacgtattatggaacagggcggagcccactttataaacgccttcgtgaccactccgatgtgctgtccatctcggtccagcatactgacaggcaaatacgtccataatcacaatacctacacaaacaatgaaaactgcagctcgccttcttggcaagcccagcacgaatcaagaacttttgctgtttacctgaattcaacgggttaccggacagccttttttggaaagtacctcaatgagtataacggttcctatgttcctcccggatggaaggagtgggtgggcttattaaagaatagtagattttacaactatacactttgccgcaatggggtgaaagagaagcatggctctgattatagcaaggactacttgacagatctaattaccaacgactctgtgagcttctttcgcacgtcgaaaaaaatgtacccccatcgcccagtgctgatggtgatatcgcacgcagcacctcacgggccagaggactccgcccctcagtactccagactctttccgaacgcttctcaacatatcaccccaagctataactacgcacccaaccctgacaaacactggattatgagatacacaggtcccatgaaaccgatacatatggaattcacaaatatgctacagagaaagaggcttcagactcttatgagcgtggacgatagcatggagacaatatataacatgctcgtagagaccggggaacttgataacacgtatatagtttacactgctgatcatggataccatatcggccagttcggcctggtcaagggcaaatccatgccatatgagttcgacattcgcgtcccattctacgtgaggggtcctaatgttgaagctggctgcctgaacccccacatcgtgctgaatatcgatctagctcccaccatactcgatatagcaggcctggacataccggcagatatggatggcaagtcgatactgaagctgttagacaccgagcgcccagtgaatagatttcatttgaagaaaaagatgagggtgtggcgggacagcttcctggtcgaaaggggtaaacttctgcataaacgggataatgacaaggtggatgctcaggaagagaatttcctgcccaagtatcagagggtaaaagatctgtgtcagcgggctgaatatcaaaccgcttgcgagcagttggggcagaaatggcagtgcgttgaggatgcgacaggaaagttgaagctgcacaaatgtaaaggtccaatgcgcttaggcggaagcagagctctctctaacttggtgccgaaatactatggacaaggatcagaggcatgcacttgtgatagcggggattataagcttagtttggcagggcgacgaaaaaagctcttcaagaagaagtataaagccagttacgtacgcagtagaagtatcaggtccgtggcaatagaggtggacggtcgcgtctaccatgtgggcttgggggacgcggcacagcccaggaatctgaccaaaaggcactggccaggagcacctgaggaccaggacgacaaggacggcggtgatttcagcggcacgggcggacttcctgactatagcgcagcgaacccgatcaaggtcactcatagatgctacattcttgagaacgacaccgtgcagtgcgacctcgatctctacaaaagcctccaggcctggaaagatcataagctccatatcgaccacgagattgaaactttgcaaaataaaatcaagaacctgcgggaggttaggggacaccttaagaagaagcgacccgaagagtgtgattgccacaagatctcatatcatactcaacataaaggtcgcctaaaacacagaggctccagccttcacccttttaggaaaggtttacaggagaaggacaaggtgtggctgctgagggagcaaaagagaaaaaagaaactgcgtaaacttctcaagcgcttgcagaataacgatacttgcagcatgcctgggctaacttgtttcacgcacgacaaccagcattggcaaacagcccctttttggacactgggaccattttgcgcttgcacaagcgctaacaacaacacatattggtgcatgaggaccatcaacgagacacacaatttcctgttctgcgagtttgccactgggtttctcgagtatttcgatctgaatactgacccttaccaattaatgaacgccgttaacacactggaccgggatgtcctgaaccagctacatgtgcagctgatggagctgcggtcttgtaagggttataagcagtgcaatccgcgtactagaaatatggatctcggcctgaaggatgggggttcatacgagcagtatcgtcagtttcagcgtcgcaaatggccagaaatgaagcgtccctcttctaaaagcctcggccagctgtgggaaggctgggagggatag

SEQ ID NO: 242723 - DNA, 1125 bp, Artificial Sequence
  Description of Artificial Sequence: Synthetic coding sequence
atggctgctcctgctttgggactggtgtgcgggaggtgcccagagttaggacttgtcttactgctcctgctcctatccttgctctgcggtgctgccggatcccaggaagcgggaactggggctggagccggatccttggccggttcttgtggctgcggaacaccacaacgccctggagcccacggctctagtgcggctgcccacaggtacagtcgggaagcaaacgccccaggtccggtcccaggcgaacgtcagctggctcacagtaagatggtgcctatacccgcaggagtttttactatggggaccgatgacccccagataaaacaagatggagaagctcctgcaaggcgtgtgaccattgacgctttttatatggatgcttatgaggtgtctaatacagagtttgagaaatttgttaattccactggatacctgaccgaggcagaaaagttcggtgattcattcgtgttcgagggtatgctatcagagcaggttaagactaacatccagcaggccgtcgccgcagctccctggtggcttcctgtcaaaggagctaactggcgtcatcctgagggccctgactccactatactgcacaggccagatcatcccgtactgcatgtaagctggaatgacgcagtggcttattgcacatgggctggaaaaagattgcccactgaggccgaatgggagtattcatgccgaggcggtctccacaatcggttattcccatggggtaacaaactgcaacccaaaggtcaacactatgcgaacatttggcagggagagtttccagtgaccaacacaggggaggacgggtttcaggggaccgcacccgtagacgccttccccccaaatggatacggtctgtacaatatcgtgggtaacgcttgggagtggaccagtgactggtggacagtacaccattctgtggaggagactctgaaccctaaaggtcccccttcaggaaaagaccgtgttaagaaagggggtagctacatgtgtcatagatcttactgctaccgctatcgctgtgcagccagatctcagaataccccagattcgtcagcctccaaccttggctttcgttgtgccgctgaccggctgcctacgatggactag

SEQ ID NO: 242724 - DNA, 1281 bp, Artificial Sequence
  Description of Artificial Sequence: Synthetic coding sequence
atggccgctccagcccttggcctagtgtgcggcaggtgcccagagctggggttggtgctcctcctgttactgctgtctctcctctgcggggctgctggctcccaggaagccggtacaggtgccggagcaggctcccttgcaggaagctgcgggtgtgggacaccgcagaggcccggagcccatggaagcagtgcagccgcacatcgttattctcgcgaagccaatgcacctggccctgtgccaggcgaacgtcagctcgcgcactctaagatggtgccaatacccgctggtgttttcactatggggaccgacgatcctcagattaagcaagacggtgaggctcccgcaagaagggtgacgattgatgccttttacatggacgcctatgaggtgagcaacacagagttcgagaagttcgtgaactccacagggtacttgacagaagccgaaaaattcggggatagcttcgtattcgagggcatgctgtctgaacaggtgaagactaacatccaacaggccgtcgctgccgctccctggtggttgccagtgaaaggtgctaactggcggcatccagagggacctgactcaaccatcctgcatcgccctgaccaccctgttcttcatgtaagctggaacgacgctgtcgcctattgcacgtgggccggaaagcggttgccaacagaggccgaatgggaatacagctgccgcggtggcctccacaataggctgtttccgtggggaaataaactgcagccgaaagggcaacactatgctaacatttggcagggtgaatttccagtcacaaataccggcgaagacggctttcagggaacagcaccagtggacgcctttccaccaaacggctacggcttatataacatcgtcggtaacgcgtgggagtggacaagtgactggtggactgtgcaccactctgtcgaagagacactgaatccgaaaggccctccttccggcaaagatcgagtgaaaaaaggcggatcctacatgtgccaccgatcccaggagtattacgacccctatttccaggacgtggccagcgagatgctgcggagacacactgcctcacggtggaaagcttttagctctctggaaccatgctgttccattaggcgacaccagcagtatgccgcaatcgagagactgacctgtgggaaatttgagctgcgttgtgcgtctctgagaaaaattgactgtttaaacactaatatcgcttgtagctattccatgcgccaggatggcccacgcctgcattgtgtcgattag

SEQ ID NO: 242725 - DNA, 1287 bp, Artificial Sequence
  Description of Artificial Sequence: Synthetic coding sequence
atggcagcaccagccctgggattggtgtgtggcagatgccctgaacttggcttggtgttgctgctgctgctcctatcactcctgtgcggtgccgcagggtcccaggaagccggtaccggggctggggctggcagcctggctggaagctgtggatgcggaaccccgcagaggcctggcgcacatggcagcagcgctgcagctcatagatattcacgcgaagctaacgccccagggccagtgcccggagagcggcaactggctcacagcaagatggtccccatacctgccggtgtcttcactatgggaacagatgatccccagattaaacaggatggtgaagccccagcgagaagagtgacaatcgacgccttctatatggacgcctatgaggtgtctaacaccgaatttgagaagttcgtgaatagcacaggctacctcaccgaagccgaaaagttcggagatagcttcgtgttcgaaggaatgttatccgaacaggtgaagacaaacattcaacaagctgtggcggcagccccttggtggctgcccgtaaaaggggcaaattggaggcaccctgagggcccagactcaactatcctgcacagaccggaccatccggtgctgcatgtatcttggaatgatgccgttgcctattgcacctgggccggaaagcgattgcctacagaagccgaatgggagtacagttgtcggggtggactacacaacaggctgttcccttggggcaacaagctgcagcccaaaggccagcactacgcgaatatttggcagggcgagttccctgtgaccaacactggggaggatggctttcaaggcaccgcgccagtggatgcctttcctcctaacggctacggtctttacaacatcgtcggcaatgcttgggagtggaccagtgattggtggacagtacaccacagtgtcgaagagactttgaaccccaaggggccaccctctgggaaggaccgggtcaaaaaaggcggactgtcaaaagcacaccagagaatttcacaggaatactacgatccctactttcaggatgtagcatccgagatgctgcgtcgccacaccgctagtaggtggaaagcgtttagctccctcgagccctgctgctccatccggagacaccagcaatacgctgccattgaacgtctgacctgcggaaaatttgaactgcgctgtgctagcctgcggaaaatcgattgcctaaacaccaatatcgcgtgcagctatagtatgcgacaagatggcccaaggctgcactgtgtcgactag

SEQ ID NO: 242726 - DNA, 1050 bp, Artificial Sequence
  Description of Artificial Sequence: Synthetic coding sequence
atggccgctcccgcactgggactagtatgcgggaggtgccccgagttaggactcgtgttactgctgttactactgtccttgttatgcggtgccgctggatctcaggaggcagggaccggggctggcgcaggatcactagctggaagttgcggatgcggtactcctcagcgtccaggcgcacacggctcttcagcggcagcccacaggtattcccgagaagctaacgctcctgggcctgttccgggtgagagacagctggctcattccaagatggttccgatcccagcgggtgttttcaccatggggacggacgaccctcagataaaacaggacggcgaggctcccgctcgcagggtcaccattgacgcattttacatggacgcttacgaggtcagtaatactgaatttgaaaagtttgttaactcaacgggataccttacagaggtggccgctgctccctggtggctgcctgtgaagggggctaactggaggcacccagaaggcccagactctaccatcctgcaccgcccagaccaccccgtgctccatgtctcctggaacgacgccgtcgcatactgtacatgggccggaaaaaggctccccacggaagccgagtgggagtattcatgtcgaggaggattacataatagactcttcccttgggggaacaagttacagcccaaaggacaacactacgctaacatctggcagggcgaatttccggtcacaaacacaggagaagacggtttccagggcaccgcacctgtggatgcttttccacctaacggttatggcctgtataatatcgtgggaaatgcgtgggaatggaccagcgattggtggaccgtgcaccactcagttgaagagaccctgaaccccaaaggacctccttccgggaaagatcgggttaagaaaggcggaagttacatgtgccatcgatcttattgctatcgttatcgatgcgccgcaagaagtcagaacacccccgacagttcagcttctaacctgggtttccgttgtgccgcagacaggctccccacaatggactag

SEQ ID NO: 242727 - DNA, 1065 bp, Artificial Sequence
  Description of Artificial Sequence: Synthetic coding sequence
atggctgccccagctctcggcttggtgtgcggaaggtgccctgaattggggctggtgctgctgctgctactcctgagccttctttgcggcgctgccggatctcaagaagcagggacaggcgcaggcgcaggaagcctggcgggatcctgcggctgtggcaccccccagcggccaggagcccacggatcgagcgccgctgctcaccgctacagccgggaggccaatgcgcctgggccagtccctggggagaggcagctggcacattctaaaatggtgccaatcccagcaggggtgtttacaatgggcaccgacgacccgcagattaagcaagacggagaggcccctgccagacgggttacgatcgacgctttttatatggatgcctacgaagtaagtaacaccgaattcgagaagttcgtgaatagtaccggttatctgacagaggccgaaaagtttggcgactctttcgtttttgaaggcatgctgagcgagcaagtgaaaaccaacattcagcaggcagtggctgccgcaccgtggtggctgcccgtcaaaggagctaactggagacatcccgaaggcccagatagtacaatactgcatcgcccagatcaccccgttctgcacgtctcctggaatgacgcggtcgcctactgcacctgggcaggaaaaaggctgccgaccgaggccgagtgggaatactcgtgccgtggcggtctgcataacagactctttccttgggggaacaagctgcaacccaaggggcagcattatgctaatatctggcagggtgagtttccagtgaccaacacgggagaggacgggttccagggtacagcacccgtggacgcgttccctcctaatggctacggattatacaatatcgtaggcaatgcatgggagtggacttcagattggtggactgtgcatcactcagtcgaagagactctgaatccaagctattgctatcggtaccgatgcgccgctaggtcccagaatacccctgattcttccgcatccaatctgggttttagatgcgcagccgatcggcttccgacaatggactag

SEQ ID NO: 242728 - DNA, 1638 bp, Artificial Sequence
  Description of Artificial Sequence: Synthetic coding sequence
atgcttctgctgcaccgggctgtcgttctccgtctccaacaggcatgcagactaaaatccatcccttctaggatctgcatccaggcctgctccaccaatgatagttttcagccacagaggccatctcttacattctctggagacaactcgtcaacgcagggctggagggtgatgggcacattgctgggcctgggagccgtgcttgcttaccaagatcaccgctgccgcgctgcacaggaatccacacacatatacacaaaggaagaagtcagctctcataccagcccagaaaccggcatttgggttaccttggggtctgaggtattcgacgtcaccgaatttgttgacttgcatccaggcggtccatcaaagctcatgctggccgcaggcggtcctctggagcccttttgggcactgtacgccgtacacaatcagagtcacgtgcgggaactgctggcacaatacaagattggcgaactgaacccagaggacaaagtggctcccactgtagagacatctgacccctacgctgacgaccccgttcgacatccagccttgaaagtgaattctcagcgaccgtttaacgcagagcccccaccagagctgctgactgagaattacatcacccccaacccgattttttttacaaggaatcatctcccggttcccaatttagaccctgatacctatcgccttcacgtcgtgggcgcacctggcggacagtcactgagtcttagtctggacgatcttcacaactttccaagatatgaaatcaccgttacgttacaatgtgccggtaacagacggtcagaaatgacacaagtgaaagaggtcaaggggctcgagtggagaaccggagccatctctacggccagatgggcgggagcgaggctgtgcgacgtgttggcacaggccggacatcagctgtgcgaaacagaagctcacgtgtgtttcgaaggcctcgacagcgaccccactggcaccgcctacggcgcttcaattccgctagcgagagcaatggatccggaggccgaggttttattagcctacgaaatgaacggccagcccctccctagagatcatggctttcccgttcgcgtggtggtgcccggagttgtcggtgcccgtcacgtaaagtggttaggtcgagtgagtgtgcagccggaagaatcatatagccactggcagcgtagagattacaaaggtttcagcccctcagtggactgggagactgtcgactttgattccgctccatcaattcaggaactgcctgtgcagtctgccatcacagagcccagggacggcgagactgtagagagtggcgaggtcacaatcaaaggatatgcttggtccgggggagggagagcagtcatacgcgtggatgtatctctcgatggcggtctgacgtggcaagtcgcaaagctggacggcgaagaacagcgacctcggaaagcgtgggcatggcgactctggcagctgaaagctccagtgccggctggacagaaggagttaaatatcgtatgtaaagctgtcgatgacggttacaatgtacaacccgatactgtggccccaatctggaacctacgcggtgttctcagcaacgcatggcatagagtgcacgtgtatgtctcgccatag

SEQ ID NO: 242729 - DNA, 1638 bp, Artificial Sequence
  Description of Artificial Sequence: Synthetic coding sequence
atgctcctgctgcatcgcgctgtggtcctgaggttgcagcaggcgtgccgtctgaagtccatcccctctcgcatttgcatacaggcatgttccacaaacgattcttttcagccccagcgcccaagtctgacattttccggggacaatagtagtacccagggttggcgtgtgatgggaaccctgttgggcctcggagccgtgctggcctatcaagatcatcgttgtcgcgcagctcaggaatctactcacatctatacgaaggaggaagtctcatctcataccagtcctgagaccggaatttgggtgactttgggatccgaagttttcgatgtaaccgagtttgtcgacctccatcccggagggccaagtaaactgatgctggccgctggtgggccactggagcccttttgggcactttacgctgtgcacaaccaatcacacgttcgggaactgttggcacagtataagatcggtgaactgaatcccgaggacaaggttgcgcctacagtagagaccagcgacccttacgccgatgatcccgttcggcatcccgctctcaaggttaactctcagcgcccattcaacgccgaaccgcctcccgaactactcacagagaactatatcactcctaatcctattttcttcacccgcaaccatctgcccgtgcctaaccttgacccagacacatacagactgcacgttgtgggtgcccctggaggtcagtcgctgagcctttctctggacgatttgcataattttccaagatacgagatcacagtgacattgcagtgcgccggaaatcggaggtccgaaatgacacaagtgaaggaggtgaaggggttggaatggcgcacgggtgcaatttccaccgccagatgggctggcgcacggctgtgtgatgtattagctcaggcaggccaccagctgtgcgaaactgaagcacatgtctgcttcgaggggttagatagtgatcccaccggaaccgcttatggcgcttctatccccctagcccgtgctatggatccagaggctgaagtgctgctggcctatgagatgaatgggcagcctctccccagagaccatgggtttcctgtgcgcgtagtggtgcctggtgttgtgggggctaggcatgtgaagtggcttggcagggtttccgtgcaaccggaagagagttactcacattggcagagacgcgattataagggcttctccccttctgtagactgggagactgtggatttcgactcagcgcctagcatccaggagctaccggtccagtcggccatcacagagccgcgtgacggagagaccgtggaaagcggggaggtcaccataaaaggctatgcatggtctggaggcggacgagcggtaatccgggtggacgtgtctctggacggcggtcttacctggcaggtggccaaactcgatggggaggagcaaaggccaaggaaggcctgggcctggcggctttggcagttgaaagctcctgttcccgctgggcagaaagagttgaacattgtctgtaaagctgtagacgatgggtataacgtgcaaccagatacagtggcccctatctggaacctccgaggggttctctcaaatgcctggcatagggtccacgtatacgtctcaccctag

SEQ ID NO: 242730 - DNA, 1638 bp, Artificial Sequence
  Description of Artificial Sequence: Synthetic coding sequence
atgctactcctacaccgagctgttgtgttgcgccttcaacaagcgtgtcgattgaaaagcatcccctctcgcatatgtatccaagcctgctctacgaacgactcattccagccccagagaccgtctctgacatttagcggtgataacagtagcacgcaggggtggagggtgatggggaccttgttagggttaggtgccgtactggcctaccaagaccataggtgccgtgccgctcaagagtcaactcacatatacactaaggaggaggtctccagccacacaagcccagagacaggcatttgggttactctagggagcgaggtgtttgatgttacggagttcgtcgacctgcaccccggaggtcctagcaagctgatgttagcagcaggtggccctctggagcccttctgggcactctatgccgtgcataaccagtcacatgtgcgggaactgctggctcagtacaaaattggcgagctgaacccagaggacaaagtcgcgccaactgtagagacatctgatccctacgccgacgatccggttcggcaccccgcactgaaagttaactcccagcgacccttcaacgcagaaccacctccggaactcctcactgagaattacatcacccccaacccgatattcttcacacgaaaccatcttcccgtcccaaacttggacccggatacgtaccgtctccacgtagtgggcgctcccggaggccagtctttaagtctgtcgttggatgacctgcacaatttccctaggtacgagattaccgtgacactgcagtgtgcgggaaaccgtcgctctgagatgacccaagtaaaagaagtgaagggccttgagtggcgtacaggcgctatctctacggcccgttgggcaggcgctcggttgtgcgatgtgcttgctcaagctggacatcagctgtgtgagacagaggcacacgtgtgtttcgaggggttggatagtgaccccaccggcacagcttatggggctagcatccctcttgctagggcgatggaccctgaggccgaggtccttctggcttatgaaatgaacggccagcctctgccacgcgatcatggctttcccgttagagttgtggttcccggagtggttggggcaaggcacgtaaagtggttggggagagtgagcgttcagcccgaggaaagctattcacactggcagcggagggattacaaaggctttagtccctcagtagattgggagacagtggatttcgatagcgccccatcaattcaggagctgcccgtgcagagtgctatcaccgaacctcgggacggcgagaccgtggagtccggagaagttacaattaaagggtatgcctggtctggagggggacgggcagtaatccgtgtggatgtgagtctggacggtggcctcacttggcaagtggcaaaactcgacggagaagagcaacgcccacgaaaagcctgggcctggagactatggcagcttaaagcaccagtacccgcaggacagaaagagctgaatattgtgtgtaaggccgttgacgacggctataatgtgcagcccgatactgtggccccaatttggaatcttcggggagtcctttccaacgcctggcacagagtgcatgtatatgtgtccccctag

SEQ ID NO: 242731 - DNA, 1638 bp, Artificial Sequence
  Description of Artificial Sequence: Synthetic coding sequence
atgctgctgttgcaccgggctgttgtcctgcgcctgcaacaagcttgccgcctaaaatccatcccttcacgcatctgtattcaggcgtgcagcactaacgattccttccagccgcagaggcccagccttaccttttctggggataattccagcacgcaggggtggcgggtgatggggaccttgctgggcctgggcgcagttctcgcataccaagatcacaggtgtagagctgcacaggaaagtactcatatctacaccaaagaggaggtgtcatcacacacctcccccgagaccgggatctgggtgactctgggttctgaagtgtttgacgtcactgaattcgtggaccttcaccctggcggaccatcaaaacttatgctggcggctgggggtccactcgagccattttgggccctgtatgcagtccacaatcagtcccacgtcagggaactgttggcgcagtacaaaatcggagaactcaatcctgaagacaaagtcgctccaactgtggagacttctgatccttatgctgacgaccccgtgcgtcacccggctctgaaggtcaatagtcaaagaccttttaacgccgagcctccccctgaattgctgaccgagaattatataacacccaatccaatttttttcacccgtaatcacttaccagttccaaatctggaccctgatacataccggctccacgtcgtcggtgctccagggggacaatcattgtccttgtccctggacgatctgcacaacttccccaggtacgagatcacagtcacgctgcagtgcgccggaaatcgcagatctgaaatgactcaggtgaaagaagtgaagggcctggaatggaggacaggagccatcagtacagcaagatgggcgggagcaagactctgtgatgttctggctcaggccggacaccaactctgtgaaactgaggcccacgtatgctttgaaggtcttgattccgatccaaccggcaccgcctacggggcatccatcccgctagccagagcaatggacccagaagccgaggttctcctggcttatgagatgaacggtcagccgctccccagagaccatggcttccctgtccgtgtggtcgtccccggtgtcgttggagccagacatgtcaaatggctcggcagggtatctgtgcagcctgaggagtcctactcacattggcagagaagggattataaaggtttcagtccatctgttgattgggaaacagtggattttgatagcgctccatccattcaggagctgcccgtgcagtccgccatcactgaaccaagggacggcgagactgtagagagtggagaagtgacaataaagggatacgcctggtctggcggagggagggctgtgatacgggtcgacgtctccttggatggcggattgacctggcaagtagcaaaactggacggtgaggaacagcgcccacgtaaagcctgggcatggaggttgtggcagcttaaggcgccagtgccagctgggcagaaggaattgaacatcgtgtgcaaagcagtggacgatgggtataatgttcagccagatactgtagcacccatttggaacttgagaggggtcctttccaatgcctggcatcgagtgcacgtgtatgtgtctccatag

SEQ ID NO: 242732 - DNA, 489 bp, Artificial Sequence
  Description of Artificial Sequence: Synthetic coding sequence
atgcttctgctccacagagccgtggtgctgcggttgcaacaggcgtgcaggctcaaatccattccaagccgaatttgcatccaagcctgctcgacaaatgacagtttccagccccagcggccaagcctcactttttccggggacaactcctccacacaagggtggcgcgtaatgggaacactgttaggactgggtgctgtgctggcctaccaggaccacagatgcagggctgctcaggaaagcactcatatctatactaaggaggaggtcagtagccacacgtctcctgagactggcatttgggtcacactgggtagcgaagttttcgatgttacggaattcgtcgacctccatcctgggggtccgagcaaacttatgctggcagccggtggacccctggaacctttttgggccctgtacgctgtccataaccagtcccacgtgagagagctgctagcccagtacaagataggcgaactaaacccctag

SEQ ID NO: 242733 - DNA, 132 bp, Artificial Sequence
  Description of Artificial Sequence: Synthetic coding sequence
atgctgcttctccacagagcagtcgttctgaggctacagcaggcctgtagactcaaaagcattccctctagaatctgcatccaggcctgttctaccaatgactcgtttcagccgcagagaccatctctttag

SEQ ID NO: 242734 - DNA, 1638 bp, Artificial Sequence
  Description of Artificial Sequence: Synthetic coding sequence
atgctgcttttacaccgtgctgtggttctgcggctgcagcaggcatgccgcttgaagtctattccctccaggatatgcatccaggcttgtagtacaaacgatagttttcagccgcagcgaccctcattaacattctctggtgataactctagtacccaaggttggcgggtgatgggaaccctgttagggcttggggcagtcctcgcttatcaggatcatcgatgtcgcgcagcccaggagagcacccacatctataccaaagaggaggtctccagccacacctcccctgaaaccggtatttgggtgactctgggctccgaggtttttgatgtgacagagtttgttgacctgcatccaggtggcccttctaaactgatgctcgcagccggaggccctcttgagcccttctgggctctgtatgctgtacataaccagagccacgtccgggagttgctggctcagtacaagattggggagcttaacccagaagataaagtggctcccaccgtggaaactagtgacccctacgctgatgatcctgtgcggcaccccgctttgaaggtgaacagtcagcgcccattcaacgccgagccaccaccagaactgctcaccgagaattatattaccccaaatcccatctttttcactcgtaaccacttaccagtgccaaacttggaccctgatacataccgccttcacgtggttggcgctcccggaggacaatctctgtctctatctctagacgatctccacaattttccacggtacgaaataacagtgactctgcagtgtgcagggaatcgacgctcagagatgacccaggtcaaagaagtgaaggggctcgagtggagaaccggagcaatctctactgcgaggtgggcgggtgccagactttgtgatgtactggcccaggctggacaccaattgtgtgaaactgaggcccatgtttgcttcgagggattggatagcgatcccaccgggactgcatatggtgcttctataccgctggctcgagccatggatcccgaggccgaagtactcctagcctatgagatgaacggacagcccctccctagggaccacggttttcctgtgagagttgtggtgcccggagtggttggggcacggcacgtgaaatggttggggagggtgagtgtccaaccagaagaatcttattcacactggcaaagacgggattacaagggatttagtcccagcgttgactgggaaacggtcgactttgattcagccccttcaattcaagaactgccagtccagagcgccattactgagccccgagacggagaaactgtagagtctggtgaggtgactattaagggatacgcctggagtggaggaggtcgcgcagtgatccgggtggacgtgagcttggacggcggactgacctggcaggtggctaaactcgacggcgaggaacagcgccctcgtaaggcctgggcatggcgactgtggcagttgaaagccccagtgcctgccggacaaaaagaattgaatattgtgtgcaaagctgtggacgacggatataacgtccagccagatactgttgctccaatctggaacttacggggtgtgctgagcaacgcttggcatagagtacatgtgtatgtgtccccttag

SEQ ID NO: 242735 - DNA, 1638 bp, Artificial Sequence
  Description of Artificial Sequence: Synthetic coding sequence
atgctattgttgcatagggctgtggtgctgaggctgcaacaagcctgtagattgaaatcaattccatcaagaatatgcatacaggcctgcagcacaaacgatagctttcaacctcagaggccaagcctaacattcagcggcgacaattcctctacccagggatggcgcgtaatgggaacccttctgggtctgggcgctgtactcgcttaccaggaccacaggtgtcgcgctgctcaggaaagcacccacatctatacaaaagaggaggtttccagccacactagtcccgagacagggatttgggtgacactcggcagtgaagtgtttgacgttacagaatttgtggaccttcaccctgggggaccatccaaactcatgctggccgcaggcggaccgctcgaaccattttgggccctctacgctgtgcacaaccagagccatgtccgggaactattggctcagtataagattggcgagctcaacccagaagacaaagttgcccctaccgttgagacatctgacccctacgccgacgaccccgttcgtcacccagccctgaaagtgaattctcagagaccatttaatgccgaaccccctccagagctgctgactgagaactacatcacaccaaaccctattttcttcactaggaaccacctcccagtcccgaaccttgacccagacacttacagactacatgttgtgggagctccgggaggacaatcactctctctatcactggatgacttacataacttcccaagatatgaaatcacagtaacattacagtgtgccggaaaccggaggtcagagatgacacaggtcaaggaagtgaaaggcttggagtggaggaccggggcaatcagtaccgctcgctgggccggagccaggctctgtgacgtgctggcccaagctgggcatcagctttgtgagaccgaggctcacgtctgtttcgaaggcctggactctgacccaaccgggacagcatacggggcatcgatccctttagcacgggctatggatcccgaggccgaggtgcttctggcttacgagatgaacggacagccgctgcctcgtgaccacggttttccagtgagagtagtagtgcccggagtagtgggcgcaagacacgtgaagtggctcggcagggtttcagtgcagcctgaggaatcttactcccactggcagcggagggattacaaaggcttcagccccagcgtggattgggagactgttgatttcgacagcgctccgagcatacaggaactccccgtgcagtctgctatcacggagcctcgggacggcgagactgtggagtccggcgaagtcaccatcaaggggtatgcgtggagcggcggaggcagagccgtaatccgcgtggacgtaagcctcgacggcggattaacttggcaggtcgccaaactcgatggcgaagagcaaagacccaggaaagcttgggcttggagactgtggcagctcaaggcacctgtccctgcaggtcaaaaggaattaaacatcgtgtgcaaggctgtggacgatggctacaacgtccagcctgataccgtcgcccctatatggaacctgaggggtgtgctgtccaacgcatggcatcgcgtgcacgtgtacgtctcgccatag

SEQ ID NO: 242736 - DNA, 366 bp, Artificial Sequence
  Description of Artificial Sequence: Synthetic coding sequence
atgctgcttctccaccgggctgtcgttctgcgacttcaacaggcctgccggcttaagtcaataccatctagaatctgcatccaggcctgcagcaccaacgattcattccagccacagcgccctagcctgacttttagcggtgacaattcttcaacccaaggatggagggttatgggtaccctcctcgggctgggcgctgtgctagcttatcaagaccatagatgccgcgctgcacaagagtcaactcatatatacacaaaggaagaggtctccagccatacctcaccggaaacaggcatttgggtaaccctgggctccgaagtgtttgatgtcactgagttcgttgatctgcacccaggaggttag

SEQ ID NO: 242737 - DNA, 783 bp, Artificial Sequence
  Description of Artificial Sequence: Synthetic coding sequence
atggccgaaagtgaggccgaaaccccctcgacaccaggcgaattcgaaagtaagtacttcgaatttcatggagtacgcctgccaccattctgtcgtggcaagatggaagaaatcgctaacttcccagttcggcctagcgacgtttggatagtcacataccccaagtcagggactagtctcctacaggaagtggtatacctcgtctcacagggggcagatcccgacgaaatcggtctgatgaatatagacgagcagttacccgtattggagtacccccagcccggacttgacatcataaaagagctgacgtctccgcgactgattaaatcccacctcccgtatagatttctgccatccgaccttcacaacggggatagtaaagtaatctatatggccagaaacccaaaagacttggtggtctcgtactaccagttccacagatcactcagaactatgagttatagagggacctttcaggaattctgtcgaagatttatgaatgataagctgggatacggctcttggtttgagcacgtacaggaattctgggaacaccgtatggactcaaacgtcctgtttctcaagtacgaggatatgcatcgggaccttgtgacaatggtggagcagctggctcggttcctaggtgttagctgtgataaggcccagctggaggcactgaccgagcattgtcaccagctggtggaccagtgctgtaacgccgaagcacttcccgtgggccgtgcacactgtgtcttcgctcgaaaaatctttctctcctggtag

SEQ ID NO: 242738 - DNA, 855 bp, Artificial Sequence
  Description of Artificial Sequence: Synthetic coding sequence
atggccgagagtgaggctgagacaccctccacacctggagaatttgagtcaaaatatttcgaattccacggggttaggctccctccattttgccgcggaaaaatggaagagatcgcaaatttccctgttcgaccctcagatgtctggatcgtgacttatcccaaaagtgggaccagcttgctccaggaggtcgtctatctggtgtctcagggggcagaccccgacgagatagggctaatgaacatcgacgaacagctcccggtcttagaatatcctcagccaggtctggacatcattaaggagctaacgtctccccgactgattaagtcccatttgccttaccggtttctcccaagcgatttgcacaatggagactctaaggtgatctacatggcccgaaaccctaaggacctagtggttagttactaccagttccacaggagcctgaggactatgagctaccgtgggacgtttcaggaattttgtcgcagattcatgaatgataaactgggatacggtagttggttcgaacacgtccaggaattttgggagcatagaatggactccaacgtgctgtttctgaaatatgaggatatgcatcgggacctcgtaacgatggtagaacagcttgctagattcctgggagtttcgtgcgacaaagcacaattagaggccctgacagagcactgtcatcagctcgttgaccagtgttgtaatgccgaagcattgcctgttgggagaggcagagtggggctgtggaaagacatctttacagtctcaatgaacgaaaaattcgatttggtatataagcagaagatggggaaatgcgatctgaccttcgacttctatctgtag

SEQ ID NO: 242739 - DNA, 516 bp, Artificial Sequence
  Description of Artificial Sequence: Synthetic coding sequence
atggcagagagtgaagcagagacgccttccacaccaggggagtttgagagtaagtacttcgaattccatggcgttcggctgcctcctttttgtcgcggaaaaatggaggaaatcgcaaattttccagtgcgacctagcgacgtttggatcgtgacctatccaaagagcgttggctatggtagttggttcgagcacgtgcaggagttttgggaacatcggatggactcgaatgtgcttttcctaaagtatgaggatatgcatagagacctggtgactatggtcgaacagctcgctcgtttcctcggcgtgagctgcgacaaggctcagctggaggcattgacagagcactgccatcaacttgtggaccagtgctgcaatgccgaagccttacccgtcggtaggggacgcgtgggcctttggaaagatatcttcaccgtttcgatgaatgagaaattcgacttagtgtataagcaaaaaatgggtaaatgcgacctaaccttcgatttttacctctag

SEQ ID NO: 242740 - DNA, 171 bp, Artificial Sequence
  Description of Artificial Sequence: Synthetic coding sequence
atgctcgcaaagcttctgtgtgaccaagtggttggtgcgcctattgcagtaagtgctttctacgccggaatgtcaattctccagggtaaggatgacatcttccttgatctgaaacagaaattctggaatacttatatgcagacgcaatcttggctgtggaggtctctgtag

SEQ ID NO: 242741 - DNA, 888 bp, Artificial Sequence
  Description of Artificial Sequence: Synthetic coding sequence
atggagcttatccaggatacctcccggcctccccttgagtacgtgaaaggcgtgcccctaataaaatacttcgccgaagccctcgggccacttcagtcctttcaggctagacctgatgatttacttatcagcacctaccctaagtctggcacaacttgggtgagccagattttggacatgatttatcaggggggagatctggagaaatgccatcgagcgcctatttttatgcgggtcccctttctcgaattcaaggctcctggcatccccagcggcatggaaaccttgaaggatacgccggctcccaggctcctgaagactcacttgcctctcgccctgctcccacaaaccttactcgaccagaaagtcaaagtagtgtatgttgctagaaatgccaaagacgtggccgttagttattatcacttttatcacatggcgaaggtgcatccagaacctggaacctgggacagcttcttggagaagtttatggtgggggaagtctcctacgggtcttggtatcaacacgttcaagaatggtgggagttgagccggactcaccctgtattgtatttattctacgaggacatgaaggagaatcccaagagagaaatccagaaaattctcgaattcgtaggtcggtcccttccagaggaaacggttgactttgtggtgcagcacactagttttaaagaaatgaagaagaacccgatgacaaattacaccaccgtcccgcaggaattcatggatcacagcattagcccctttatgcggaagggcatggcaggcgactggaagaccaccttcaccgtcgcacagaatgaacgcttcgatgccgattacgcagaaaaaatggctggatgcagcctgtctttcagatccgagctctag

SEQ ID NO: 242742 - DNA, 888 bp, Artificial Sequence
  Description of Artificial Sequence: Synthetic coding sequence
atggagttgatacaagacacctctaggccacctctggagtacgtaaaaggagtgccactgatcaaatacttcgcagaggcgctgggcccactgcagagcttccaggccaggcctgatgatcttttaatttcaacatacccaaaatccggtaccacctgggtgtcccaaattctggacatgatatatcaggggggtgatctagaaaaatgtcaccgggctccaatcttcatgcgggtccccttcctcgaattcaaggcacccggaatccccagcggaatggagaccctgaaggatacacccgctcccaggctacttaagactcatcttccattggcactgttgccacagacactgctcgaccaaaaggtaaaagtggtgtatgtcgccaggaacgcgaaggacgttgccgtcagttattatcatttctaccacatggccaaagtgcatccagagcccggaacgtgggatagcttcctcgagaagttcatggtgggggaagtgtcctacgggagctggtatcaacacgtacaggagtggtgggaactctctaggacgcaccccgtgctgtacctattctatgaagatatgaaagaaaatccaaaacgtgaaatccagaaaattttggagtttgtagggagatctctgcccgaagaaactgtcgatttcgtggtgcagcacaccagttttaaagagatgaagaagaatcctatgacaaattataccacggtcccccaagagtttatggatcactctatttctccgttcatgcgaaaggggatggcgggtgactggaaaaccacttttaccgtggcacagaacgagcgatttgatgcagattatgccgaaaaaatggccggatgctctctgagcttcagatccgagctgtag

SEQ ID NO: 242743 - DNA, 654 bp, Artificial Sequence
  Description of Artificial Sequence: Synthetic coding sequence
atgcttgctaaactgctgtgtgatcaggtagtgggcgctcccatagctgtgtctgccttctacgccggaatgagcattcttcagggtaaggacgacatcttcctcgatcttaaacagaagttctggaacacatacatggtagtttacgttgctagaaacgccaaagacgtggcagtgagttactaccacttttatcacatggccaaagtccacccagaaccaggaacatgggattcattcctggagaaattcatggtcggtgaggtgtcatacggctcttggtaccagcatgtgcaggaatggtgggaactaagccgcacgcatccagtcctctacctcttctatgaggacatgaaagagaaccctaaaagagaaatacaaaagatattggagtttgtgggtagatcacttccagaagagactgttgacttcgtggtgcagcatacttcatttaaagagatgaaaaagaaccccatgaccaactacaccacagtgcctcaggagttcatggatcacagcatcagccccttcatgcggaaaggaatggccggagactggaagactactttcacggtcgcccagaacgagcgcttcgatgcagactatgccgagaaaatggctggttgctctctgtcattccggtccgagctgtag

SEQ ID NO: 242744 - DNA, 888 bp, Artificial Sequence
  Description of Artificial Sequence: Synthetic coding sequence
atggagttaattcaggatacctctagacctccgttggagtatgtgaagggggttccgttgattaagtacttcgcagaagcactcggccctctgcagagttttcaagccagacccgatgatcttttgatcagtacttatcccaagtctgggaccacttgggtgtctcagattctggacatgatctaccagggcggtgaccttgaaaagtgtcatcgggcacccatctttatgagggttcccttcttagagtttaaagctcctggaattccgagtggcatggagaccttgaaagacactccagctccaaggctgcttaagacccatctgcccttagctctattaccacagactctgctggatcagaaagttaaggtcgtgtacgtcgccagaaacgcaaaggatgtagccgtttcctactaccatttctatcacatggcaaaagtgcacccagagccaggaacttgggattcgttcctggaaaagttcatggtgggcgaggtatcttatggctcctggtatcagcacgtgcaagagtggtgggaactgtcaagaacccatcctgtgctttacctgttctacgaggacatgaaggagaatccaaagcgggagattcagaagattcttgaatttgtggggaggtcactcccagaagagaccgtggacttcgtcgttcagcacacttcctttaaggaaatgaaaaaaaacccgatgacaaattacactaccgttccgcaggagtttatggaccacagtatctcacctttcatgcggaagggcatggccggagactggaagacgacattcacggtggcacagaacgagaggtttgatgcagattatgccgaaaagatggccggttgctccttgtcattccggagcgaactgtag

SEQ ID NO: 242745 - DNA, 888 bp, Artificial Sequence
  Description of Artificial Sequence: Synthetic coding sequence
atggaactgatccaggataccagcagacctcccttggagtatgtgaagggcgtgccgttaattaagtattttgctgaggccttaggccctcttcaatccttccaggcaaggcctgatgatctcttaatttctacctatccaaaaagtggtacaacctgggtaagtcagatcctggatatgatctaccagggtggcgatctggaaaagtgtcacagagcacccatcttcatgagagttccttttctagagtttaaggcacctggaatccccagcggcatggagactctcaaagatacgccagccccacgcctgcttaagacacacctgcctcttgccctgctgcctcaaaccttgctggaccagaaggtcaaggtcgtgtatgtggcacggaacgcaaaggatgttgctgtgtcctactaccacttctaccacatggccaaagttcatccagagccgggtacctgggactcctttctggagaaattcatggtgggcgaggtgtcttatggatcttggtatcagcacgtgcaggagtggtgggagctttccagaacgcaccctgtactgtatctcttttacgaggacatgaaggaaaatccaaaacgggagattcagaagatccttgaattcgtgggcaggtctttgccggaggagacagttgactttgtagtccagcatacgtcctttaaggaaatgaagaaaaaccccatgaccaactacacaaccgtgcctcaggaatttatggaccacagcatttcaccttttatgcgcaagggaatggctggagattggaaaactacgtttactgtcgctcagaacgagagattcgatgccgactacgcagagaagatggccggatgctctctctctttccgatctgaactttag

SEQ ID NO: 242746 - DNA, 888 bp, Artificial Sequence
  Description of Artificial Sequence: Synthetic coding sequence
atggagttgattcaggacattagtaggccaccactggagtacgttaaaggcgtaccactcatcaagtatttcgctgaggccctcggccctctgcagtcttttcaggcccgtcccgacgatctgctgatctctacatatccaaagtcaggcaccacctgggtcagccagatcctggacatgatctaccagggtggggatttggagaaatgccacagggctccaattttcatgcgggtaccttttctagagtttaaggtacctggaatcccttcaggtatggagacattgaagaacacccccgctcccagacttttgaagacgcatctacctctggctctcctgccccagactctactggatcagaaggtcaaagttgtgtacgtagctagaaacgcaaaggacgtggccgtgtcttactatcatttttaccacatggcaaaggtctacccccacccgggaacttgggagtcttttttggagaagtttatggccggagaagtttcctatggtagttggtaccagcacgtgcaggaatggtgggaattatctagaacacaccctgtcctgtacctgttctatgaggatatgaaagaaaacccgaaaagagagatacaaaagattttggaatttgtaggtagatccctcccagaggagactgtggatttgatggtggaacacacaagctttaaggagatgaaaaaaaacccaatgaccaattacacgacagtgcgacgcgagtttatggatcacagcattagtccttttatgcgtaaaggtatggctggcgattggaagaccacttttacagtcgcccagaatgaaagattcgacgcagactatgcaaagaaaatggcaggttgctccctgtcattcaggtctgaattgtag

SEQ ID NO: 242747 - DNA, 888 bp, Artificial Sequence
  Description of Artificial Sequence: Synthetic coding sequence
atggagcttattcaggacataagtaggcctcctttagaatatgtgaagggcgtgcctctgattaaatacttcgccgaagcgctcggtccgctgcagtcgttccaggcccgacccgacgacttgctgattagtacttatccaaagtcaggaacaacctgggtttcacagattctggacatgatttaccagggcggtgacctcgagaaatgtcatcgtgctccgatcttcatgagagtgccgtttctggagtttaaggtgccagggattccgtctggaatggagactctgaagaacacaccagcacctcggctattgaaaacccacctgccccttgccctgctgccacaaaccctcttagaccagaaggtaaaagtggtctacgtggcccgtaacgctaaagatgtagcagtaagctactaccacttttatcacatggcaaaagtttatccccatcccggtacctgggagtctttcctcgagaagtttatggcgggtgaagtgagttacggatcatggtatcagcatgtgcaggagtggtgggaattatcacgtactcaccctgtactgtacttattctatgaggacatgaaggaaaatcctaagagagagattcagaagattttggaatttgtgggacgatcactgccagaagagaccgtagatctgatggtggagcacacaagctttaaggagatgaaaaaaaaccctatgacgaactataccaccgtccgtcgggagttcatggatcacagcatttcccctttcatgcgtaagggaatggcaggtgactggaagacgacatttaccgtcgcgcagaatgagcgcttcgacgccgactacgctaagaagatggccggttgttctctgtccttcaggagtgaactgtag

SEQ ID NO: 242748 - DNA, 579 bp, Artificial Sequence
  Description of Artificial Sequence: Synthetic coding sequence
atggaactgattcaagatatcagccggccaccgttggagtacgtaaagggtgtgcctctgatcaagtactttgccgaagcgctggggccattacagagttttcaggcgagacctgacgatctattaatttccacgtaccctaagtcgggaacaacctgggtatcccagatactggatatgatctatcaaggaggagacctagaaaagtgtcatcgggcaccaatttttatgcgggtgcctttcctcgagttcaaggtgcccggaattcctagcggaatggagaccctaaagaatactcccgctcccaggctcctgaaaacccatttacctctggctttacttccccagactctgctggaccagaaggtgaaggtcgtctacgtcgcacgcaatgccaaggacgtcgccgtgtcttattatcacttttaccacatggctaaagtataccctcatccaggaacttgggagagcttccttgagaagttcatggctggggaggtgtcctacggctcttggtatcagcatgtgcaagaatggtgggaattgagtaggacccatcccgttttatatctgttctag

SEQ ID NO: 242749 - DNA, 891 bp, Artificial Sequence
  Description of Artificial Sequence: Synthetic coding sequence
atggccctaacttccgacctgggcaagcagatcaaactgaaagaagtcgagggaactctactgcagcctgcaactgtggataactggagtcagatccaatcatttgaggcgaagccagacgacttactgatatgcacctaccccaaggcgggaaccacttggatacaggagattgtggatatgattgagcagaatggcgatgtggagaagtgccagcgcgctatcattcagcacaggcaccctttcattgaatgggcacgccctccccagccaagcggtgtcgaaaaggcaaaagctatgccgtcaccacgaatcttaaaaacccacctttctacccagctgctgcctccaagtttctgggagaataactgtaaatttctgtacgtagcgagaaatgccaaggattgcatggtgtcctactaccactttcagcgtatgaatcatatgttgccagacccaggcacttgggaggagtacttcgaaaccttcataaatggcaaggtggtgtggggctcctggttcgatcacgttaagggttggtgggagatgaaggatagacaccagatcctgttccttttctatgaagacattaaaagggatccaaaacacgaaattcgtaaggtgatgcaattcatgggaaaaaaagtggacgaaaccgtactggataagattgtgcaagagacatctttcgagaagatgaaagagaacccaatgactaacagatctacagtatcaaaatcaattctggaccaatctatctcttccttcatgcgcaagggtacggtgggtgactggaagaaccacttcactgtggcccagaatgagagattcgacgaaatttatagaaggaagatggaggggacgtccattaatttttgcatggaactgtag

SEQ ID NO: 242750 - DNA, 924 bp, Artificial Sequence
  Description of Artificial Sequence: Synthetic coding sequence
atggccctcacatccgacctaggcaaacagattaaattgaaagaagtagagggcactctcttgcaacccgctaccgtggacaactggtctcaaattcagagcttcgaagctaaaccagacgatttgttaatctgtacttatccaaaggcgggtactacctggattcaggagatcgttgatatgatagaacagaatggtgacgtggagaaatgccagcgggcaatcatccaacatcgccaccccttcatagagtgggccagacccccacagccaagtgaaaccgggttccatcatgtggcacaggccggactcaagttactttcatcctcaaacccccctgcctccacatcacaaagtgccaagatcacggacttactccctccctctttttgggaaaacaattgtaaattcctctacgtcgcacgaaacgccaaagactgtatggtctcttattaccacttccagaggatgaaccatatgcttccggatcccggaacttgggaagagtatttcgagacctttatcaatggcaaagtcgtgtggggcagctggttcgatcacgtcaaggggtggtgggaaatgaaagatcgccaccaaatcctgtttctgttttacgaggacatcaaaagagaccccaaacatgaaatcagaaaagtgatgcaattcatgggtaagaaagtcgacgaaactgtgcttgacaagatcgtgcaggagacaagctttgagaagatgaaagaaaatccaatgaccaatcggtccactgtttcaaaaagcatactcgatcagagtataagctcattcatgaggaaaggcacggtgggcgattggaagaaccacttcaccgtggcacagaacgagaggtttgatgagatctataggcgtaagatggagggaacatctattaacttttgcatggagctttag

SEQ ID NO: 242751 - DNA, 933 bp, Artificial Sequence
  Description of Artificial Sequence: Synthetic coding sequence
atggcgctgacatcagacctagggaagcagattaaactaaaggaggttgaaggcaccctgctgcagcctgccactgttgataactggtcccagattcagagcttcgaagcaaaaccagacgatcttcttatatgcacttacccaaaagccggtacaacctggatccaggagatagtggatatgatcgagcagaacggtgacgtggagaaatgtcagcgcgcaatcattcaacatagacatccatttatagaatgggcacgcccaccacagccgagtgtcctggtgctccgtcgctgctttctcctctcctactttaagggcgtggagaaggctaaggcgatgccctcccccagaattctgaagactcatctgagtacccagctgttgccaccatcattttgggaaaacaactgcaaattcctctacgttgctagaaatgccaaagactgcatggtgtcctattaccacttccagaggatgaaccacatgctgcctgaccctggcacctgggaagaatatttcgagacctttatcaacgggaaggtggtgtggggttcctggtttgaccacgtcaaggggtggtgggaaatgaaagatcgacaccagatcctttttttgttttacgaagatatcaagagggacccgaagcatgagatccgaaaggtgatgcagtttatgggtaagaaggtggacgaaacagttctggataagatcgttcaggagacctcttttgagaagatgaaggagaatcccatgaccaacagatcaaccgtttcgaaatctatattggatcagagcatctcctccttcatgcgcaaaggaactgtgggagattggaaaaaccactttactgtcgctcagaatgaaagattcgacgagatttacaggagaaagatggaggggacctctatcaacttttgcatggagctgtag

SEQ ID NO: 242752 - DNA, 639 bp, Artificial Sequence
  Description of Artificial Sequence: Synthetic coding sequence
atgggtccgccatccgccagcccacacagagaatgcatcccttggcagggcctcttgttaaccgccagcctgctcaacttctggaatccgccaaccaccgcgaaactgacaattgagtccatgcctttaagtgtggccgagggaaaagaagtcctgctactcgtgcacaacctccctcagcatttattcggctatagctggtataagggagagcgcgtggacggcaatagccttatcgttggttacgtgatcggaacccaacaggcaacccccggagcagcatacagcggtagagaaactatctatacaaatgcatctcttttgattcagaacgtgacacaaaatgacataggcttttacacccttcaggtcatcaagagcgacctggtgaatgaggaggcaacagggcagtttcacgtgtatcaggaaaatgccccaggactccctgttggcgctgtcgcaggtatagtgacaggagtcctggtgggcgtggctcttgttgcagccttggtttgcttcctgctgttggctaagaccggcaggccttggagcctgccccagctttgtctgctggatgttccttctttgcactgtcccggaccgcctacccagccgcaggactcttccttccacttatag

SEQ ID NO: 242753 - DNA, 1098 bp, Artificial Sequence
  Description of Artificial Sequence: Synthetic coding sequence
atggacggcccagccgagcctcagatacctggcctatgggatacctatgaagacgacatctctgaaatatcccagaagctccctggtgagtactttagatacaaaggtgtgcccttcccggtggggctgtacagtctggagagcatcagcctggctgaaaatacacaagacgttcgtgatgacgacatattcataatcacctaccccaagtctggtaccacatggatgatagaaattatttgcctgatccttaaagagggtgatccctcctggattcgctctgtcccgatttgggaacgcgcaccttggtgtgagaccattgtgggcgcatttagtcttcctgatcagtactctcctagactcatgtcctcacatctgccgatacaaatctttaccaaagccttctttagttcgaaggctaaggtgatttatatgggacggaacccccgagacgtggtggtcagtttgtaccattactccaagattgccggtcagctgaaggaccctggaacacccgatcagttcttacgggactttctgaaaggagaagtccagtttggctcctggtttgatcacattaaaggctggctgcgtatgaagggcaaggacaacttcctttttatcacctacgaggagctccagcaggacctccagggatccgtcgaaaggatttgtggcttcctggggagaccactcggcaaggaggcgttgggctcagtcgtagcccactccaccttttccgctatgaaggccaacaccatgtctaattatactctgttgcccccatcactgctcgatcaccgaaggggggcattcctgcggaaaggggtgtgtggagactggaagaatcacttcactgtcgctcaaagcgaggccttcgatcgggcttatagaaagcagatgagagggatgcctacgttcccctgggacgaagaccccgaggaagacggcagtcctgatcctgagccgtctccagaacctgagcccaagccctctttggaacccaacaccagcctggagagggaaccacggccaaacagcagcccatctcctagtccaggccaagcatctgagacgccacatccaaggcctagctag

SEQ ID NO: 242754 - DNA, 1053 bp, Artificial Sequence
  Description of Artificial Sequence: Synthetic coding sequence
atggcttctccgcctcccttccacagccagaagctgcctggggagtatttccgctacaagggggtgccctttccggtcggactttattcactagaatcaatcagtctggcagagaacacccaggacgtacgggatgacgatatatttattatcacttaccctaagagcggcactacctggatgattgaaatcatttgtctgatccttaaggagggagaccccagctggatccgaagtgttcccatatgggaacgagccccttggtgcgaaactatcgtgggagccttctccctccccgatcagtacagccctcgacttatgtcttctcacctcccaatacagatcttcacgaaggcattcttcagcagcaaggccaaagtcatttatatgggcagaaatcccagagatgtggtcgtttcactctatcattatagcaaaatcgctggacagctcaaggatcctggaactcctgaccagttcctacgcgactttctgaagggagaggttcagtttggcagttggttcgatcacatcaagggatggctgcggatgaagggcaaagacaacttcctgtttatcacttatgaggaattgcagcaggaccttcagggatctgtggagcggatatgcgggtttctggggaggcctctcgggaaagaggctttgggcagcgtggttgcgcattccacgttcagcgccatgaaggcaaacaccatgtcgaactacaccctcctgccaccttcgcttctcgatcataggcgtggagcgtttctgcgcaagggcgtatgtggcgattggaaaaatcacttcactgtggctcagagtgaggccttcgaccgggcttacaggaaacagatgagaggcatgccgacatttccatgggatgaggatcctgaagaagatggctcccccgacccggagccctcccctgaaccagaaccaaagccctcgctggagccgaatacgtcactggaaagggagcctcgcccaaacagctcaccttcaccctcgcccggacaggccagcgaaacgcctcacccgagaccatcgtag

SEQ ID NO: 242755 - DNA, 1041 bp, Artificial Sequence
  Description of Artificial Sequence: Synthetic coding sequence
atggtggaaaaggaagaggctggcggtggtatttccgaggaagaggccgctcagtatgacaggcagatccggttatggggcctcgaggcacagaaaaggttacgcgcatcccgagtgctgctggtgggactaaaaggtctgggagccgaaatcgccaagaacctcattctcgcgggtgtgaagggcttaactatgcttgaccacgaacaggtcactccggaagatccgggtgctcagtttctgattcggacagggtctgtaggtagaaatcgggcagaggcctcacttgaacgggctcagaacttgaaccccatggtggatgtcaaagtggataccgaggacattgaaaaaaaaccagagtcttttttcactcagtttgacgctgtttgtttgacgtgctgctctcgcgatgtcattgtcaaagtggaccagatctgtcacaagaactctatcaaattttttactggcgacgttttcgggtatcatggttacacatttgccaaccttggcgagcacgagttcgtggaagaaaagaccaaggtagccaaggtctcgcagggcgtggaggacgggcctgataccaagcgggcaaaactggactctagcgagactacaatggttaagaaaaaggttgtgttttgtccagtgaaagaagccctagaggtggactggagttcagagaaagccaaagcagccctgaagcgcacgacttccgactactttctgttacaagtcctattaaaatttagaaccgacaaaggtagggacccatcaagtgacacatacgaagaagactctgagctgcttctgcaaatccgcaatgatgtgttggactccctgggaatatcacctgatctgctgccggaggactttgtcaggtattgtttttccgaaatggccccagtctgtgctgtggtgggcggaattttggcacaggaaattgtaaaggcccttagccaaagggacccacctcataacaactttttttttttcgacggaatgaaaggaaacggcatcgtcgagtgtctaggacccaagtag

SEQ ID NO: 242756 - DNA, 801 bp, Artificial Sequence
  Description of Artificial Sequence: Synthetic coding sequence
atggtcgagaaggaggaggccggtggcggaatctctgaggaggaagccgctcaatacgatcgccagatccgcctctggggcctggaagcccagaagcggctgcgtgcttcacgtgtgctgctcgtaggtctcaaaggattaggtgctgagattgccaagaatttaatactggccggagtgaaagggcttacaatgctggaccacgagcaagtcacacctgaggatcctggcgctcaattccttatcagaaccggctccgtggggaggaaccgggctgaggcaagccttgagcgggcacaaaacttgaacccaatggtggatgttaaggtggataccgaggatattgagaagaaacctgagtcattttttacccagttcgatgctgtatgcttgacttgctgctctcgggatgtgatagtgaaggttgatcagatctgtcataagaattccattaagttcttcaccggagacgttttcggttatcacggatacacctttgctaatctcggtgagcacgagttcgtggaagaaaagacaaaagtagcaaaggtcagccagggagtggaagacgggccagatacaaagagggccaagctggactcaagtgaaacaactatggtgaagaagaaagtggtgttttgccccgtgaaggaggccttggaagtcgattggtcttctgagaaagctaaggccgctctcaaacgtacaacaagcgactattttctgctccaggggactgcatccccccgatggccgcagtgcgttcgttggcttgagggattttggcacagaaaattgtag

SEQ ID NO: 242757 - DNA, 900 bp, Artificial Sequence
  Description of Artificial Sequence: Synthetic coding sequence
atggtagagaaggaggaagctgggggaggaatctccgaagaggaagccgctcagtatgatcgacagattaggctatggggtcttgaggctcagaaacgcttgcgggcatcacgagtgctactggtcggacttaaggggttgggggctgagattgctaagaacctaattctagcgggtgtgaagggattgaccatgctggaccatgaacaggtcactccggaggatcctggggcacaatttcttatccggaccggcagtgttggcagaaacagggccgaagcttcactcgaaagggcccagaatctgaaccccatggtcgacgtgaaggttgataccgaagatattgagaagaagccagaatcgttcttcacccagttcgatgcagtgtgcctgacatgctgttccagagatgtgatcgtgaaagtggatcaaatttgccacaaaaattccattaaattctttacaggtgatgtgtttggataccacggttacacctttgccaatctaggcgaacacgagtttgttgaggaaaagacgaaggtggctaaggtgtcccaaggagtcgaggatgggccagataccaaaagagcgaagctggacagctcggaaactacaatggtcaagaagaaggtagtcttctgtcctgtgaaagaagctctcgaagttgattggagcagcgagaaggccaaagctgccctcaagcgcactacgagcgattactttctgctccaggggcctgtgtctgctggacccagtagtcagcagttattgctgctgagatggcacgaaggtgagtgggattgtggtgtcccttggcctcaggtcaatagcagattcggatcccctagagatgccaattgcagcatgccgacttgcatcccttgtccactgccttcatag

SEQ ID NO: 242758 - DNA, 900 bp, Artificial Sequence
  Description of Artificial Sequence: Synthetic coding sequence
atggttgaaaaagaggaggcaggcggaggcattagcgaagaggaggccgcacaatacgatcgtcagattagactctggggtcttgaggcgcaaaaacggctgagagccagtcgggtgctgctagtgggcctgaaaggtctgggggctgagattgctaagaacctgattctggctggtgttaaaggactaacaatgctggatcacgagcaggtgacacccgaggacccaggagcacagttcctgattcgcaccggttcagtgggtcgcaaccgggcagaggcctctttggagagagcccagaatctcaatcctatggtcgatgtgaaggtggacaccgaagacatcgagaagaagcctgagtccttttttacgcagttcgacgctgtgtgcctcacttgttgctcacgggatgtgattgtcaaagtggatcaaatctgccataaaaattccatcaaattttttaccggcgatgtgttcggatatcacggctacacatttgccaacctgggcgagcacgaattcgtagaggaaaagactaaggtagcgaaggtttcccagggagtggaagatgggccagacaccaagcgcgcaaaacttgatagttcagagacaaccatggtcaaaaaaaaggtcgtcttctgtcccgttaaggaagccctggaagttgactggagcagcgagaaggctaaggcagccctaaagagaacaacctcggattacttcctgctgcaggagctgtttccccgaatcgtagaacgtgtgtatgcccagcgacatccaagaagcaccgagcgcacccacgctaaaatgctcattccatttttgaccaaggaaaaacccggtttcttgggtgagatggctgtcagtaggagcggcgtcgggaaattgcagtgttcctag

SEQ ID NO: 242759 - DNA, 519 bp, Artificial Sequence
  Description of Artificial Sequence: Synthetic coding sequence
atgctcgagaaaactaaggtcgcaaaggtcagtcagggagtcgaggatgggccagacaccaaaagggccaagttggattcctctgagaccactatggtgaaaaaaaaggtggtgttctgccctgtcaaagaggccctcgaagttgattggtcctctgaaaaggccaaggcagctctgaagcggactacttctgattactttctgctacaggtcctcctaaagtttcggactgataagggtcgggatccttcatccgatacttacgaagaagactccgagctcttgttgcagatccgcaatgacgtactggacagtttgggcatttcaccagatctactccccgaggactttgtgcggtattgtttctcagagatggcccctgtatgtgcagtagtggggggaatactggcacaggaaatcgtgaaggcactctcacagcgggatcctccccacaacaatttctttttttttgatgggatgaagggcaacggcatcgtcgagtgcctaggcccaaagtag

SEQ ID NO: 242760 - DNA, 1935 bp, Artificial Sequence
  Description of Artificial Sequence: Synthetic coding sequence
atggacgatatcgctgatcggatgcggatggatgctggggaagtgacactggtcaatcacaatagtgtattcaagacacacttactcccccagacaggatttcccgaagaccagttatcactgagcgatcagcaaatactgtcctcccggcagggccacctcgacaggagttttacttgctccacacgttcagctgcttacaatccaagctattactccgataaccctagttctgattctttcttgggatctggggacctgcgcacgttcggccagagcgccaatggccagtggcgcaacagcacccccagctctagtagctctttgcaaaagtcacgcaattctcgaagcttgtatttggagactcggaaaacaagctcggggttgtccaatagcttcgctgggaagtctaatcatcattgccatgtttccgcctatgagaagtcgttccccatcaagcccgttccgtctccttcatggagcgggagctgcagacgcagcttactcagtccaaaaaagactcaacgcaggcacgtttcaactgcagaggagactgtgcaggaggaggaacgggagatctatcggcaattactccagatggtgaccggtaagcagttcaccattgcaaaacccaccacacacttccccctccacctttcccgttgtctctcttcaagcaaaaatactttaaaagactctttattcaaaaacggcaactcatgcgcctctcaaattattgggagcgacacgtcttcctcaggcagcgcttccattctgactaatcaggagcaactgagtcattccgtctactcactcagctcttatacacctgatgtggcctttgggtccaaagacagcgggaccctgcatcacccccaccatcatcatagtgtgcctcaccaaccagataacctggcagcatcgaacacgcagagtgaaggctctgattccgtgatcctcctaaaagtgaaggattcacagacacctactccttcctcgactttttttcaggccgagctgtggatcaaagaactgacatctgtatacgattctagggcacgcgagagactgcgacagattgaggagcagaaagctttagcattgcaacttcagaatcagagattacaagagcgtgaacacagcgtccatgattcggtagaactgcatttaagggtgcccttggaaaaggaaataccagtgaccgtcgtacaggagactcagaagaagggacataagctcactgacagcgaagacgagtttcctgaaataaccgaagaaatggaaaaggagattaaaaacgtgtttcgtaatggcaatcaggatgaggtcttatcagaggcattccgtcttacaattaccaggaaagacatccagaccctgaaccacctcaattggcttaacgatgagattatcaacttttacatgaacatgcttatggaaaggtcaaaggaaaagggcctgccgagcgtgcatgcatttaacacgttcttctttaccaaactgaagaccgccggttaccaagccgtgaagcggtggacaaagaaggtcgatgtgttctccgttgatattctgcttgtccccatccacctgggggtacactggtgtttggccgttgtggacttccgaaagaaaaatatcacatattacgacagtatgggagggataaacaatgaggcgtgccggattcttctccagtatctgaaacaggaaagtattgacaagaagcgcaaggaattcgataccaacggatggcagctcttctcaaagaagtcccaggaaatcccgcagcagatgaacggttccgattgcggaatgtttgcctgcaaatatgccgattgcatcacgaaagatagacccatcaatttcacccagcagcacatgccatattttagaaagagaatggtgtgggagattctccacagaaagttgctatag

SEQ ID NO: 242761 - DNA, 489 bp, Artificial Sequence
  Description of Artificial Sequence: Synthetic coding sequence
atgaagatccctctgactgccacaatttgcctgcccggttcttcaccccctggtctttgcatattcgcaaaggtgtccgatgtgaagcggttagaaatggatgatatagctgataggatgcgaatggacgctggtgaagttacccttgttaaccacaattcagtatttaagactcatctactgccccagacgggattcccagaagaccaactgtcactgtctgatcaacagattttatccagtagacagggacatctcgaccgctcttttacttgcagtacacgctctgcagcttacaacccgtcatactattcaggcccaggattaggtgtcttggccagatatagctggggtaaaatgctgactttcggtggacatcatggagtcacactgatgcagatacggcatatggccgtggcaggttttagctccttcataaattttcagatcatcctgcctcagactgtgttcttggcccaggccatttag

SEQ ID NO: 242762 - DNA, 1932 bp, Artificial Sequence
  Description of Artificial Sequence: Synthetic coding sequence
atggatgacatcgccgacagaatgcgcatggacgcaggcgaagtgaccttggtgaaccataatagtgttttcaagacacatctgttaccccagacagggttcccagaggaccagctgtccttaagcgatcagcagatcctgtcgagccgacagggccacctcgatcgaagctttacttgctcgactaggtcagcagcctataacccctcctattactctgataatccaagcagtgattccttcctgggctctggggacttgagaaccttcggccaaagtgctaatggacagtggcggaacagtaccccgtcctcgagtagttctctgcagaagagtagaaactctcggagcctttaccttgagacgcgaaaaactagctcaggactgtctaattccttcgcagggaagagcaatcatcattgccacgtcagcgcctatgagaagagcttccccatcaagccggtgccttcaccttcttggagtggctcatgcagaagaagcttactgagcccaaagaaaacgcaacggcgacacgtgtctacggcagaagagaccgtgcaagaagaagagagggagatctaccgacagctgctgcagatggttaccggcaagcaatttacgatcgctaagccaacaacacactttcccctgcacctgtccaggtgtctaagctcttccaaaaacacacttaaagacagtctttttaaaaatggcaactcctgcgcgtcacaaataattggcagtgacacatcatcctctgggtccgcctcaatcctcaccaaccaggagcaattgtcccattccgtgtatagcctgtcctcctacaccccggacgtggctttcggatccaaggacagtggcaccctgcatcacccacatcaccatcacagtgtgccacaccaacccgacaatctggcggcttctaacacacagagtgaagggtcagatagcgtgattctactcaaagttaaggacagtcagacaccgacacccagttcaacctttttccaggccgagctttggattaaggagcttacttccgtgtatgattctcgggctagggagcgtctgcgacaaattgaagagcagaaggcgctggcgttgcagctgcaaaaccagcggttgcaagagagagaacacagcgttcacgattcggttgaattgcacttgagggtgcctctggagaaggagatcccagtcaccgttgtccaagagacccaaaagaaagggcacaaactgacagattctgaggatgaattccctgaaatcactgaagaaatggagaaggagatcaagaacgtgttccggaatggtaatcaggacgaggtcttgtcagaggcctttcggttgaccataacacgaaaggacattcagaccctcaatcaccttaactggttaaacgacgaaatcatcaatttttatatgaatatgctaatggagcgctctaaggaaaagggtctgccttccgtacatgccttcaacacttttttcttcactaaactgaagaccgcgggatatcaggctgtgaagcgctggactaagaaggtggatgtgttctctgtcgatattttactagtaccaatccacctcggcgtacattggtgtctggccgtagtggatttcaggaaaaaaaacattacttactacgactcgatggggggtatcaataatgaggcctgtcggatcctgttacagtacttgaaacaagaaagtatagataaaaaacggaaggaattcgacacgaatggttggcagctgttttcaaagaaaagtcaaatcccccagcaaatgaatgggtccgactgtgggatgtttgcttgtaagtacgcagattgtattacaaaagataggccaatcaactttactcagcagcacatgccctacttccgaaaaaggatggtgtgggagatcctacatagaaagctgctgtag

SEQ ID NO: 242763 - DNA, 1935 bp, Artificial Sequence
  Description of Artificial Sequence: Synthetic coding sequence
atggatgatatcgctgacagaatgaggatggatgccggagaggtcactctagtgaaccacaattccgttttcaagacccacttgttaccccagacaggctttccagaagatcagctctccctgtccgatcagcaaattctttcctccaggcagggacaccttgatcgttcctttacatgttccacccggtctgccgcatacaatccctcctactactctgacaatcccagttcggactcttttctgggctccggagacctgagaaccttcgggcagtctgctaacggccagtggcgaaattccacacctagcagcagtagctcactgcagaaaagcagaaactctagatcgttgtatcttgaaactagaaagaccagttctgggcttagcaactccttcgcgggaaagtctaatcaccattgccatgtgtctgcgtatgaaaagagctttccaatcaagccggtgccatccccctcctggtctggttcctgtcgtagaagtctgctgtctcccaaaaaaacacagagaagacatgtgagcacagccgaagagacagtccaggaagaagagcgtgaaatctaccggcaactacttcagatggtgacaggtaaacagttcaccattgctaaaccaaccacacattttcctttgcacctgagcagatgtctgagctcctccaagaacaccctgaaggacagcctcttcaagaatggcaactcttgcgctagccagattattggctcagataccagcagtagtggctcggcctcaatcctgacgaaccaggaacagttatcccactctgtctacagtctctccagctatacaccagatgttgctttcggtagtaaagattcagggactttgcaccacccacatcatcaccactccgtaccccatcagcccgacaacctggcagcatccaacacacagagtgaaggatccgactccgtgatcttactgaaagttaaggattctcagacacccactccatctagtacgtttttccaagctgagttgtggattaaggaactcaccagtgtctacgattctagagccagggagcggctgagacagatcgaggaacagaaggcactggccctccaactccaaaatcagaggttgcaagaaagggaacactctgttcacgattcagtcgaattacacctgcgagtgcccctggagaaggagatccccgtgacagtcgtccaggagacccaaaaaaaggggcataagctcaccgatagtgaggatgaattcccggaaatcacagaggaaatggagaaagaaatcaaaaacgtctttcggaacggtaaccaggatgaggtgctctccgaagctttcaggttaaccatcacaaggaaagatatacagacactgaaccacctgaactggctcaatgacgagatcatcaatttctacatgaacatgctaatggaacgttctaaagagaagggtctgccgagcgttcacgcatttaataccttcttctttacaaagttgaaaactgctgggtatcaggccgtcaagaggtggacgaaaaaagttgatgtgtttagtgttgacatacttttggttcccattcatctgggggttcactggtgccttgcagtcgtcgactttagaaagaaaaacatcacatactatgactccatgggcggaataaacaatgaggcttgtaggatcctgctgcagtatttgaaacaggaaagcattgataagaagagaaaagagtttgacacaaatggatggcagctgttctcaaaaaaatcacaggagatcccccaacaaatgaacgggtccgactgtgggatgttcgcttgtaagtatgcggactgcataactaaggatcggcctattaattttacgcagcagcacatgccatactttaggaagcgtatggtgtgggagattctgcaccggaaactcctgtag

SEQ ID NO: 242764 - DNA, 1932 bp, Artificial Sequence
  Description of Artificial Sequence: Synthetic coding sequence
atggatgatatcgcagaccgcatgaggatggatgccggagaggtcactctggtcaaccataactccgtctttaagactcacctgctaccccagacggggttccctgaagatcagcttagcctttccgaccagcagattctgtcttcccgtcaggggcacctcgacagatcttttacatgctccacacgatcggccgcatacaacccaagctactattccgacaacccatcaagcgattcattcctgggatccggggatttaagaacctttggtcagtccgcgaacggccagtggagaaacagtactcctagttcctcaagtagtctgcagaaaagccgcaatagccggtctttgtacctggaaacccgtaagacctcgtcaggtctgagtaactccttcgcaggcaagtcaaaccatcactgtcatgtgtcggcctacgaaaaatcctttcccataaagcctgtgccatcccctagttggagtgggtcctgccgcagaagcctgctgtcaccgaaaaagacccaacggcgacacgtctccacagcagaggaaactgtgcaggaggaggagcgggagatttatagacagctgctgcagatggtgaccggcaagcagttcaccatcgcgaagccaactacacactttccactgcatctgtctagatgtctgtcatcctccaaaaatacactcaaggacagcctgtttaaaaatggtaacagctgcgcctcccaaattatcggttccgacacctcatcatcaggcagcgctagtattctgaccaatcaagagcagctgagtcactccgtgtatagtctgagctcttacaccccagacgtggcttttggttctaaagatagtgggactctgcaccacccccaccaccatcatagtgtcccacatcagccggataatctggctgcttcaaatacacaatccgaagggagtgattcggtgattcttctgaaggtgaaggattctcagactccaacaccatcaagcactttttttcaggccgaactttggataaaggaactaaccagcgtttacgattcacgtgcccgagagcgattacgccagatcgaggagcagaaggccctcgcattacagctacaaaaccagagactgcaggagcgagagcactcagtgcacgactcagttgagcttcatctgagggtgcccttggagaaggagatccccgtcacagtcgttcaggaaacccagaagaagggacacaagctcactgactctgaagatgaattcccagagattacagaagagatggagaaagagattaaaaatgtattcaggaatggtaatcaggatgaggtcctatctgaggccttccgacttactattacccgcaaagacattcagaccttaaatcacttgaactggcttaatgatgagatcattaatttctacatgaacatgctgatggagaggtccaaggagaagggcttgccctctgtgcacgcttttaacacctttttttttactaaactgaaaaccgccggataccaggcagtcaaacgatggacaaaaaaagtagacgtcttcagcgtggacatccttctggttcccatacacctgggagtgcattggtgcttggccgttgtggatttcagaaagaaaaacataacctactatgatagcatgggcggtattaacaatgaagcgtgccgcatcctgctgcaatatctgaaacaggagtctatcgataaaaaacgtaaagagtttgatacaaacggctggcagttattttctaaaaagagccagatccctcagcagatgaatggatctgattgcggcatgtttgcctgtaaatatgctgactgtataacaaaggatcgccctattaactttactcagcagcacatgccgtattttcggaaacggatggtctgggaaatccttcacagaaaactcctatag

SEQ ID NO: 242765 - DNA, 1935 bp, Artificial Sequence
  Description of Artificial Sequence: Synthetic coding sequence
atggacgatatcgccgaccgcatgcgtatggacgcaggcgaagtcacactggtgaaccacaatagtgtcttcaagactcatctgttgccgcaaaccggtttccccgaagatcaattgtctctttctgaccagcagatcttatcctctcggcaaggacatctggatagatcgttcacctgcagcactcgctcagcagcctacaacccctcctattattcagataatccctcatccgattccttcctgggctctggggacctgaggacctttggacaatcagcaaatggccagtggagaaactccacaccatcgagtagttcttcccttcagaaatctcgcaactcacgatctttatacctggaaaccaggaagactagtagcggcttgagcaacagtttcgctggcaagtctaatcaccactgtcacgtctctgcatatgaaaagtctttccctatcaaacccgtgccctctccatcttggtcgggctcttgccgaaggtcactgttgtcacccaaaaagactcagaggagacatgtgtctacagcagaggagactgtgcaggaagaagagcgggaaatttatcgacagttgctgcagatggtgaccggcaaacagtttaccatcgcgaaacctaccacccactttcccctgcacctgtccagatgcctgagttcttccaaaaatactttaaaagacagcctcttcaaaaatggcaactcatgtgcctcgcagatcatcggcagcgataccagcagctctggttccgctagtatccttaccaaccaggagcaactgtcccacagtgtgtactcccttagctcctatacgcctgacgtagcctttggttccaaggattccggaactctgcaccacccacatcatcatcactctgtcccacatcagccagacaacttggcagcaagcaacacacaatctgaaggttcggattcagtgatattgctgaaagtgaaagacagccagacacctactccaagctccaccttcttccaggctgagctgtggatcaaggaactcaccagcgtttacgactcccgagcgcgagagaggttgcgccaaattgaggagcaaaaggctctggcactccaactgcagaaccagcgcctgcaggaacgggagcactctgtacacgacagtgtcgagttgcatctgagagtacctctggagaaggagataccggttacagtggtgcaggaaacccagaagaagggacacaagctgacagactcagaggatgaattcccagagatcaccgaagagatggaaaaagaaatcaaaaacgttttcaggaacgggaatcaggacgaagtgctgtccgaggcgttccggttgaccatcaccaggaaggacattcagacactcaatcacctaaactggctcaacgacgaaataatcaacttctatatgaacatgttaatggagaggagtaaagagaaggggcttccttcggtccatgcctttaacaccttcttttttacgaagctcaaaactgcaggttatcaggccgtgaagcggtggactaagaaggtcgatgtattctcggtggatatcctgctggtgcccatccaccttggggtccattggtgcctggccgttgttgatttccgaaaaaaaaatatcacgtactatgattccatgggtggcattaataatgaggcgtgtagaattctgcttcagtacctcaaacaggagagcatcgataagaaaagaaaggaattcgatacgaacggctggcagctgtttagcaagaagtcccaggagattcctcagcagatgaacggaagtgattgtggtatgttcgcctgcaagtatgctgattgcatcaccaaggaccgacccattaatttcacccagcagcacatgccttacttcaggaagcggatggtgtgggagattcttcataggaagctcctgtag

SEQ ID NO: 242766 - DNA, 2268 bp, Artificial Sequence
  Description of Artificial Sequence: Synthetic coding sequence
atgaagaagcagcgcaagatcctgtggcgtaagggaatccatctcgcgttttccgagaagtggaatacgggattcggaggcttcaagaagttctacttccatcagcacttgtgtattcttaaggccaaactgggtcgccctgtcacatggaatagacagttgaggcattttcaagggaggaaaaaagcactccagattcagaagacctggatcaaggacgaacctttgtgtgcaaaaactaaattcaatgtggcgactcagaacgtcagtactctctcttctaaagtcaaacggaaagacgccaagcattttatctcctctagtaaaacccttcttcgcttacaggcagagaagctcctgtcctctgctaagaattcagaccatgagtactgtcgcgagaagaacttattgaaagctgtgaccgactttcccagcaatagcgcactgggccaggctaacggccatcgccctcggacagatcctcaaccaagcgattttcccatgaaatttaatggggaatcccaatcaccaggagaaagtgggacaatagtggtcaccctgaacaatcacaagaggaaaggcttctgctacgggtgctgtcagggcccagagcaccatagaaacgggggtcctctgatacctaaaaagtttcagctcaaccagcaccgaagaataaaactcagtcctctgatgatgtatgagaagttgtcgatgattaggttcagatataggatccttagatcgcaacatttccgaaccaagagcaaggtgtgcaagttacgtaaagcacagaggtcctgggtccagaaggttaccggggatcatcaggagacaagacgggaaaatggggaaggagggagctgctccccctttccatccccagagcctaaagatccttcttgtcgtcaccagccgtattttcccgatatggacagcagtgcagtggtgaaaggcactaatagtcatgtgcccgattgccacactaagggttcttcattcttaggaaaggaactgagcctcgacgaggcgttcccagatcagcagaacggtagcgccaccaatgcctgggatcagtcatcttgtagttcccccaaatgggagtgcacagaactgattcatgacattcccctgcccgagcaccgcagcaacacaatgtttatctcagagaccgaacgggaaattatgaccttgggccaggagaaccagacaagttctgtgagtgatgatcgcgtgaagttaagcgtgagcggtgcagacacctctgtctcgtccgtcgatggccctgtaagccagaaggcagtgcagaacgaaaacagttaccagatggaagaggatggatctcttaagcaatccatcctgtcttccgagcttctggaccatccctattgcaagtcgccactggaggcacccctcgtctgtagcggtttgaagctcgagaaccaagtgggcggaggcaaaaatagccaaaaggccagcccagttgatgacgaacaactctcagtgtgtctctccgggttcctggacgaggtgatgaagaagtatggttcactggtgcctctgagtgaaaaagaagtgctcggtaggctgaaagacgtgtttaatgaggacttttctaaccgcaagccctttattaacagagagattacaaactaccgggcaagacaccagaagtgcaactttcggatattctataacaagcatatgctcgatatggacgacttagccacgcttgatggtcagaactggttaaatgatcaggtgatcaatatgtacggggaactgattatggacgccgtgcctgacaaagtgcatttcttcaactcattctttcaccgtcagctggttaccaagggttataatggagtaaagcgatggaccaaaaaagttgacttgttcaaaaagagcctgctgctgatccctattcatttggaggtgcattggtcgctgatcactgtaactttgtccaatcgtatcatttctttttatgacagccagggaatccactttaagttctgtgtggagaatattcgtaaatacctacttacagaagccagagagaagaatcgacctgaatttctgcagggttggcagactgccgtaacaaagtgtatcccccagcaaaagaacgattccgactgcggagtgttcgttctgcagtactgtaagtgtctcgctctggagcaaccatttcagttttctcaggaagatatgcctagagtgaggaagagaatttataaggagctctgtgaatgtcgcctaatggactag

SEQ ID NO: 242767 - DNA, 3318 bp, Artificial Sequence
  Description of Artificial Sequence: Synthetic coding sequence
atggctgccggtaaatctggcggatctgcaggggagattacgtttttagaggccctggctaggagtgaatccaaacgggacggtgggttcaaaaacaactggtcatttgatcatgaggaggaatcggagggagacaccgataaggatggaacaaatctcctgtctgtcgacgaagatgaggacagcgagacttccaaaggaaaaaagcttaatcgaagaagcgaaatagtcgcaaatagctcaggcgagtttattctaaagacatacgtgcggcgtaataaatcagagagcttcaagactctgaaaggcaacccaattgggttgaatatgcttagtaataacaaaaaattgtcggagaatactcaaaatacctctctgtgcagcggaaccgtggttcacggcagacggttccaccacgcccatgcccagattcccgtcgtaaaaaccgccgcacagcgcaaggaatacccgccacacgtacaaaaggtggagataaatccagtgcgtctgagtcgattgcaaggggtggagcggataatgaagaagacagaggagtctgagtcccaggtcgagcccgaaattaagaggaaagtccaacagaaaaggcactgctcaacttaccagccgactccacccctctccccagcatcaaaaaagtgtctcacacacctggaagatctccagcgtaactgtaggcaagccattaccctaaatgagtcaaccggacccctcctcagaacctctattcatcagaatagcggcggtcaaaagtcccagaataccggactgacgaccaaaaaattttacggcaacaatgtggagaaagtacctatcgatattatcgtgaactgcgacgactcaaagcatacttatctccagacgaacggtaaggtaatcttgcctggcgctaagattcccaagatcacaaacctgaaagagcgcaagacctccctctctgatctaaacgaccccatcattctaagctccgatgatgatgatgacaatgatcgcactaatcggagagagtcaatctctcctcaacctgctgattctgcttgcagtagcccggcacctagcactggcaaggtcgaggccgctctgaatgagaacacctgtcgcgctgagcgcgagctgcgctctatcccagaggattccgaactaaacactgtcacccttccaagaaaggcaaggatgaaggaccaatttggcaattctatcattaatacccctctgaaacggaggaaagtgtttagtcaggaacccccagacgctttggcgctttcctgccagtccagcttcgatagcgtcatactgaactgtcgaagtatcagagttggaacattgtttagacttcttattgaacccgtcatcttttgtctggacttcatcaagatacagctggatgagcccgaccatgaccctgtggagattattctgaatacgagtgacctgacaaagtgcgagtggtgtaatgtgaggaagctccccgttgttttcctgcaggctattcccgctgtttatcagaagctttccattcagctgcaaatgaataaagaggataaggtgtggaatgattgtaaaggagttaataagctgacaaatctcgaggagcaatatataatattgattttccagaacggcttagacccccctgcgaatatggtcttcgagagcataattaatgaaataggtatcaagaacaacatttcgaatttctttgccaagattcccttcgaggaggctaatgggaggctggtcgcctgtactaggacctacgaggagagcatcaagggctcttgtgggcagaaggaaaataaaattaaaactgtctcatttgagtccaagattcagctaagaagtaagcaggagtttcaattcttcgacgaagaggaagaaacaggtgagaaccatacaatttttatagggccagtcgagaagttgattgtctacccccctccacccgctaagggcggaatcagcgtgactaacgaggatttacattgcctgaacgagggtgaattcttgaacgatgtcattatagacttctatcttaagtatctagtacttgaaaaactgaaaaaggaagatgctgaccgcatacatattttcagttctttcttctataagagactcaatcagagggaaagacgtaaccacgagactactaaccttagcattcagcagaaaagacacggccgagtgaagacctggacgaggcacgtggatatcttcgagaaagactttatcttcgtccctctgaacgaagccgcacactggttcctggcagttgtgtgcttcccgggattggaaaagccaaagtacgaaccaaacccccactaccatgaaaacgctgtgattcagaaatgcagcacggtcgaggatagttgtatttctagctccgccagcgagatggagtcctgttctcagaatagcagcgccaaacccgtcatcaagaagatgctgaataagaagcattgcatagccgtgatcgattcaaaccccggtcaggaagaatcagatcctcggtacaagagaaatatctgcagtgtgaaatactctgtgaaaaagattaaccatacagcctcggaaaatgaggagtttaataagggtgaatcgacatctcaaaaggtggcagataggaccaagtcagaaaatggccttcagaacgagtctttgagctctacgcatcatacagatggtctgtcaaaaatacgccttaactatagcgatgagtcacctgaggccggaaagatgctggaggatgaacttgttgacttcagtgaggaccaggacaatcaggatgatagttcagacgatggtttcttggctgacgacaattgcagctctgaaattgggcaatggcatctcaagcctaccatctgcaagcagccttgcatactcctgatggattccctcagagggccttcgcggtcaaatgtggtaaagatccttcgcgagtacctggaggtggagtgggaagttaagaagggctcgaagcgctccttttccaaggatgtgatgaaagggtcgaatccaaaggtacctcagcagaacaatttttccgattgcggcgtgtatgtcctgcagtatgtggagtctttctttgaaaaccccattctttcattcgaacttccaatgaatctcgccaactggtttccacccccacgtatgcgaaccaagcgcgaggagattagaaacattatcttgaagctgcaagaggatcagagtaaagagaaacggaagcacaaggacacttacagcaccgaggctccactcggggaggggacagagcagtacgtgaatagcattagtgactag

SEQ ID NO: 242768 - DNA, 3339 bp, Artificial Sequence
  Description of Artificial Sequence: Synthetic coding sequence
atggctgctggaaagtccggtggctcagcaggtgagatcaccttcctagaggcactggcacggagcgagtcaaaaagggacggcggatttaagaataattggagcttcgatcatgaagaggagtctgaaggggatacagataaggatggaaccaatttactttccgtggacgaggacgaggacagcgagacatcaaagggcaaaaaactcaacagaaggagtgaaattgttgccaactcaagcggcgaatttattctgaagacttacgtccgccgaaataaatcggaatccttcaaaacccttaagggcaacccaatcggcctgaatatgttgagcaataataaaaaacttagcgagaatacccagaacacatctttatgctccggcacagtggtgcatggtagacgcttccaccatgcgcacgcacaaatccctgtggtgaagactgctgcccagaggctcctatctaaccagattctgaaagagtacccgccacacgtgcagaaagtggaaatcaaccccgtacgactgagtcggttgcagggtgttgagaggatcatgaagaaaactgaggagtccgaatcacaggtcgagcccgaaatcaaacgcaaagtccagcagaagcgacactgttctacttaccaaccaaccccaccactgtcacccgcttccaagaaatgcctaacgcacctcgaagatcttcagcgtaattgtcgccaagcgatcactctgaacgagagcaccggtccccttttgcgcacaagcatccaccaaaacagtggtggccagaagagccaaaacactggtctgacaacaaagaaattttatggcaataacgtagaaaaggtgccgattgatatcatcgtcaattgcgatgactcaaaacatacctatctccagaccaacggcaaggtgatactcccaggcgctaagatccccaagattaccaacctgaaagagcgcaagacttccctgtccgacctgaatgatcctatcattctgtcatctgatgacgatgatgataacgacaggaccaaccgcagggaaagtatttcgccccagccagccgattccgcctgctctagccccgctccatcaacaggcaaagtggaagctgccctgaacgaaaatacatgtagagcagagagggagcttcgctctatcccagaggactctgagctgaatacagtcaccctccctcgaaaggcaagaatgaaagaccagtttggaaattccatcattaacaccccgctaaaacggcgaaaagtgttttcccaggagcctcccgacgccctagcgctcagctgccagtcatcctttgattccgttatcctgaattgcagaagcatccgcgtaggtaccttatttagactgctgatcgagccagtgattttttgtctagattttatcaagatccaactagacgagccagaccacgaccccgttgaaataatcttaaacaccagcgacctgacaaagtgcgagtggtgcaacgttaggaagcttccagtggtcttcctgcaggctattcctgctgtgtaccagaagttgagcatacagctgcagatgaataaagaggacaaggtctggaatgattgtaagggggttaataagctgaccaatttggaagagcagtatatcattctgatttttcagaatggcctggaccctcccgctaacatggtatttgagtccatcattaatgagataggcatcaaaaataacatttcaaacttctttgcgaaaataccattcgaggaggctaacggacggcttgtagcttgcaccagaacatatgaggaatcaatcaagggctcgtgtggacagaaggaaaacaagatcaaaactgtttcctttgagagcaaaatccagctgcgatccaagcaagaatttcaattttttgacgaggaggaggagacgggcgagaaccacacaatttttattggccctgtggagaagctgatcgtgtacccccctcccccagccaaagggggaatcagcgtaaccaacgaagatctgcattgtctgaatgagggtgaattcttgaatgatgtgatcatcgacttttacctgaaatacctggtcctcgagaagctgaaaaaggaggacgctgatcgaattcacattttcagctcattcttttacaaacgtttgaaccagagggaacgccgtaatcatgaaacaacaaatttgtctattcaacagaagcgacatgggagggtcaagacctggacccgacatgtagatatttttgaaaaggactttatcttcgttcctctcaatgaggccgcacattggtttctcgcggttgtctgttttcccggacttgagaagcccaaatatgagcccaatccacactatcatgaaaatgcagttattcagaagtgcagtactgttgaagatagctgcatttcttcttctgcatcggaaatggaaagttgctcacagaacagcagcgccaaacccgtgattaagaagatgctcaacaaaaagcattgtatcgccgtgattgactccaacccaggccaggaggagagcgacccacgctacaaaaggaacatatgctctgtgaagtactcagtgaagaagattaatcacaccgccagcgagaacgaggaattcaataagggtgagagtacctcccagaaggtggccgacaggactaaatcagagaacggactgcagaatgaatcattgtcctctactcatcacaccgacggtctttctaagatccgtctcaattatagtgacgagtctccagaggccggtaagatgctggaggatgagcttgttgacttctctgaagatcaagataatcaggacgacagcagcgatgatggcttcctggccgacgataattgctcctctgaaattggacaatggcatctcaaaccgacaatttgcaaacagccctgtatcctgctcatggactcgctcaggggaccgagtagatctaatgtggttaaaattcttagagaatacctggaagtggagtgggaggtgaagaaggggtccaaacgctcgttctctaaagatgtgatgaaagggtccaacccaaaagtgccccagcagaacaatttctctgactgcggagtctacgtactacagtacgtagagtccttttttgagaatccaatcctctcatttgagttacctatgaatttggcgaactggttcccccctcctcggatgaggaccaaaagagaggaaataaggaacatcattttaaagttacaagaagatcagtccaaggaaaagaggaaacacaaggacacctactcgactgaagctcctctgggagaggggacagagcagtacgtcaatagtatttctgactag

SEQ ID NO: 242769 - DNA, 3339 bp, Artificial Sequence
  Description of Artificial Sequence: Synthetic coding sequence
atggccgcaggcaaaagcggcggatcagcaggggaaattacattcttagaggccctcgctaggtctgagtcaaagagggacggtggatttaagaacaattggtcctttgatcacgaggaagagtcagagggggatactgacaaggacggaaccaatctgttaagcgtggatgaagatgaggattctgaaacttctaagggcaaaaagctaaatagacggtcagaaatcgtggctaactcgtccggtgagttcatcctaaagacctacgttcggaggaacaagagcgaatcattcaagactttgaagggaaaccctatcggcctgaatatgctgtcaaacaataaaaagttgtccgaaaacactcagaatacttctctgtgctcaggcacagtggtccatggcaggcgattccatcatgcccacgcacagatccccgtggttaaaactgcggctcaatcatccctggataggaaggagagaaaggagtaccctcctcacgttcagaaggtggagatcaatcccgttcggctttcacggctgcaaggtgtggagcggattatgaagaagacggaggagagcgagtctcaagtcgagcccgagataaagcgaaaggttcagcagaagcggcattgttctacctatcaaccaacacccccattgagtccagctagcaaaaagtgtctcacccacctcgaggatctccagagaaactgccgccaggcgatcactttgaacgaatccacaggccctttattaaggacatccatccatcagaactcaggtggacagaagagccagaacaccgggctaacaacaaagaagttctatggcaataacgtggagaaggtgccgatcgacatcatcgtcaattgcgatgattcaaagcatacatacctgcagactaatggcaaagtcattctacctggggcaaagataccaaagataacaaacctcaaagagcggaagacaagcctgagcgacctcaatgatcccattatcttgagctctgacgatgatgacgataatgacagaacaaacagacgggagagcatttctccacagccggctgattctgcctgctcatcgcctgcaccatctaccggaaaagtcgaggcagctctgaatgagaatacatgccgcgctgagagggagctccggtccattcccgaggattccgaactcaacacagttacgcttcctagaaaggctaggatgaaagatcaattcggcaactcaatcatcaacactcccttaaaacggcgaaaggtgttcagtcaggaaccgcctgacgcgttggcactcagctgccagagctcatttgactctgtaattttaaactgtcggtccataagggtgggaactctgtttcgactactgattgagcccgtgatattctgcctcgacttcattaagattcagctggatgaacccgaccatgaccccgtggaaatcattctgaatacatcggatctgacgaagtgtgaatggtgcaatgtgagaaagctccccgtagtgttcctgcaggctattcccgcagtgtatcagaaattgagcatccaacttcaaatgaataaggaggacaaagtgtggaacgattgtaaaggggtgaacaaactgaccaaccttgaggaacagtatatcattctgatctttcaaaatggcttagacccaccagcgaacatggtctttgagtctattatcaacgagatcgggatcaagaacaacattagcaatttctttgccaaaattccttttgaagaagccaacggaagattagttgcctgtacaagaacatatgaggaatccattaaaggatcttgcgggcagaaagaaaacaagatcaaaaccgtgtcattcgagagcaaaatccagcttcggtcaaaacaagaattccagttttttgacgaagaagaggaaacaggcgagaatcataccatctttataggccctgtcgagaagttaatcgtttatccaccacctcctgccaagggagggatttcagtaaccaacgaagacctgcattgtctgaacgagggcgagttcctgaacgacgtgataatcgatttttatttaaagtaccttgtgctggaaaaacttaaaaaggaggatgccgaccgcattcatatattctcgtccttcttttacaagcggctgaatcagagggaacgccgaaatcatgagaccacaaatctttctatacagcagaaaagacacggtagggtgaagacctggaccaggcatgtggacatattcgaaaaagattttatatttgtgcccctgaacgaagcagctcattggttcctggcagtcgtctgttttcccggtctcgagaaaccaaaatacgaaccaaatccccactatcacgagaatgcagtgatccagaaatgtagcactgtggaagacagttgcatcagcagctctgcttctgagatggaatcctgctcacagaactcttctgctaagccagtcattaaaaaaatgctgaataagaagcactgcatcgcggttattgacagtaacccagggcaggaagaatccgacccacgatacaaacgaaatatctgctctgtcaaatactccgtcaagaaaattaatcacacagctagcgagaatgaagaattcaataagggggagtcgacctcgcaaaaggtcgctgaccgcacaaaatcagagaacggacttcagaacgagtctctgagttccacccatcacacggacggactctcgaaaatccgtttgaactattcagatgaatctcccgaggccggtaaaatgctcgaggacgaactggttgactttagtgaagatcaggacaaccaggatgattccagcgacgacggttttctcgccgacgacaattgcagtagcgagatcggtcaatggcacctgaagcctaccatctgcaagcagccgtgtattctgctcatggattcattgagaggtccttcccgctccaacgtggtgaagatactccgggaatacttggaggtagaatgggaggttaaaaagggatctaaacggagtttcagcaaggatgtgatgaaaggatccaatcccaaggtcccccaacagaacaatttcagcgattgtggggtttacgtgttgcaatacgtcgagtctttcttcgagaacccaatcttgtcattcgagctgcccatgaacctagccaactggttcccgcctccacgcatgcgtacaaaacgggaggagatcagaaatataattctgaagctgcaggaagaccagtccaaagaaaaacgtaaacataaagacacctattcaactgaggcccctcttggggagggaacagaacagtacgtaaattcaatctcggattag

SEQ ID NO: 242770 - DNA, 1074 bp, Artificial Sequence
  Description of Artificial Sequence: Synthetic coding sequence
atggccgctggcaagtctggaggctccgcaggcgagatcacgttcctggaagccttagccagatcagaatctaagagggacggaggtttcaagaataattggtctttcgaccatgaggaagagtccgagggcgatactgataaggacggtactaacttgctgtccgtggacgaggacgaggacagcgagaccagcaaaggcaagaaactcaaccgtcgctctgagattgtggctaactccagcggggaattcatcctgaagacatacgtacggagaaataagtcagaatcctttaaaacacttaagggcaaccctatcggtttgaatatgcttagtaataacaagaagctgtccgagaacacccagaacacatccttatgctctggtactgtggtccatggcagaagatttcaccatgctcatgcccagatccctgttgttaagacagccgcacagtctaatcagatcctcaaagagtatcctcctcacgtccagaaagtcgagataaaccccgttcgattgtcacggctccaaggcgtggtaatactcagttctgatgacgacgacgacaatgacagaaccaatcggcgtgagagtattagtcctcagcctgccgactccgcctgcagctcacctgcgccaagtaccggtaaagtggaagccgcacttaacgagaatacgtgccgtgcagaacgtgagcttaggtctattcccgaggattccgagttgaacacagtaactctgccacgaaaggcaaggatgaaggatcagttcggcaactctatcattaacacgcccttaaagagaagaaaagtgttctcccaggaaccccctgacgcattggccctttcatgccaatcttcattcgactcagtgattttgaactgtagaagtatcagagtgggcacattattcagactgctgatcgaaccagtcatagtaattattaagattttcttcattactcacaaaaagccagaccacgaccctgtcgaaatcatcctcaatacttcagatctgaccaaatgtgagtggtgcaacgttcggaagctgcctgtcgtttttttgcagtag

SEQ ID NO: 242771 - DNA, 1107 bp, Artificial Sequence
  Description of Artificial Sequence: Synthetic coding sequence
atgaaggatcaatttggcaatagcatcataaatacccctttaaagcggagaaaggttttctcgcaagagccccctgacgccctggccctgtcctgccagtcatcctttgatagtgtgattctcaattgcagatcaataagagtcggcacactcttccggttgttaatagaaccagtcatcttttgtctcgattttatcaagattcagcttgatgaaccagatcatgaccctgttgagatcatactaaacacctctgatttaaccaaatgtgaatggtgcaacgtgagaaagttacccgttgtgtttctgcaggctatcccagccgtataccagaaattgtcaatccagcttcagatgaataaagaagataaagtttggaatgactgcaaaggggtaaataagctgacaaaccttgaagaacagtacattatcttgattttccagaatggtctggaccctcctgctaatatggtatttgaaagcatcattaatgagatcggcatcaaaaataacatctctaatttctttgccaaaataccattcgaggaggctaacgggagactcgtggcctgtacccgcacctatgaggagtcaattaagggtagctgcgggcagaaagagaacaaaattaagaccgtgagcttcgaaagtaagatccagctgagatcaaaacaagaattccagtttttcgacgaagaagaagagacaggagagaatcacacaatctttatagggcctgtggagaaactgatcgtgtatcccccaccacccgctaaaggaggcatctccgtgaccaatgaggacctccactgtcttaacgagggtgaattcctgaacgatgtgatcatcgatttctacctgaagtacctcgtactcgagaagcttaaaaaagaggacgctgaccgcattcacatatttagttcattcttctataagagactgaatcagagggaacggcgaaaccacgaaactacaaacctgagtatccagcaaaagcgtcacggcagagtgaagacctggactaggcacgtggacattttcgaaaaagacttcatattcgtgccactaaacgaggcatggttgaaacagaaccagaccaaactctag

SEQ ID NO: 242772 - DNA, 2955 bp, Artificial Sequence
  Description of Artificial Sequence: Synthetic coding sequence
atggataagcgcaaattaggacggaggccatccagttcagagattattacggaaggcaagcggaaaaagagcagctctgacttgtcagaaattaggaagatgctgaatgcaaagccagaggatgtccacgtgcaatccccactatccaaatttagaagttctgaacggtggactctgcccttacagtgggaacgaagtcttcggaataaagtaatttctctggaccataagaataaaaagcatatccggggttgccccgtcacctcgaagtcttcacctgagcggatcccccgagtgattctcactaatgtgctgggaaccgagctgggtaggaaatatatccgcaccccccctgtcacggaaggctcactgtcagataccgataatctccaaagcgagcagctctccagcagtagtgatggtagtcttgagtcttatcagaatctaaacccacataagtcatgctatctcagtgagcggggatctcaacggtctaagactgttgacgacaattctgcaaagcaaacagcccacaataaagaaaagagacgcaaggacgatggaatctctctgctgatctcagacacgcagcccgaagatcttaactcaggtagtcgcggatgcgatcacttggagcaggaatcaaggaacaaggatgttaagtacagcgactctaaagtggagcttacactgatctcgaggaaaacgaaaagaaggctgcggaacaacttaccggattcccagtactgtacctcattagacaagagcaccgagcagactaaaaagcaggaagatgattctactatcagtaccgagttcgaaaaaccgtccgaaaattatcaccaggatcctaagctgccagaagaaataacgaccaagcccactaagtccgattttaccaaactgagctcactcaattcacaggagttaacactcagtaacgccactaagagcgcctcagccggatcaaccacagagaccgtcgaaaactccaacagtatcgatattgtggggatttctagcctggtggagaaagacgagaatgaactaaatactatagaaaaaccgatcctgcggggtcacaatgaagggaaccagtccctgatttctgccgagcccatcgtagtgtcatcggacgaagaaggcccagtggagcataaatctagcgaaatcctaaaattgcagtccaagcaggacagagagacgacaaacgagaacgagagcactagcgaatcagccttactggagcttcccctgatcacctgcgaaagcgtgcagatgtcttccgagctgtgtccttataaccctgttatggaaaacatctcatcgattatgccaagcaatgagatggaccttcagctggacttcatattcacctccgtgtacatagggaagattaagggtgcaagtaaaggctgtgtgaccattacaaagaagtatattaagatccctttccaggtttccttaaacgagatctcactgctcgtggacacgacccacttgaaaagattcgggctgtggaaatctaaagatgacaatcacagcaagcgctcccacgccatcctctttttctgggtctcatctgattatttacaagagattcagacacaacttgagcatagtgtgcttagtcagcagagcaaaagcagcgaattcatctttttggaattacacaatcccgtcagccaacgtgaagaactaaaactcaaggatatcatgacagaaatatctatcatctcaggagaactggagctcagttaccccctcagctgggtgcaggcttttccacttttccagaacctcagtagcaaggagtccagcttcatccattattactgtgtcagcacttgttctttccccgcaggggttgcagtggccgaggagatgaaactgaagtccgtgagccagcccagcaacacggacgctgccaaacccacgtacacttttctgcaaaagcagtcgtccgggtgttactcactctcaattacgtctaatcctgatgaggagtggcgggaagtacgccacactggcctcgttcaaaaattgattgtgtaccccccacctcccactaaagggggtctcggcgtgaccaacgaagatttagaatgtctcgaggagggagagtttctcaatgatgtaattattgatttctatctcaaatacttgatcctggaaaaggcctctgatgagctcgtagaacgcagtcacatcttctccagcttcttttataagtgtctcacccggaaggaaaacaatttgaccgaggacaatccaaatcttagcatggcccagcgacgtcataaaagggtgaggacttggacccgtcatattaacatattcaacaaggactacatttttgtgccagtcaatgagtcatctcactggtatctagcagtgatctgttttccatggttagaggaggcagtgtatgaggatttcccccagactgtgagccaacagagtcaagctcaacagagccaaaatgacaataagaccatagataacgaccttaggaccaccagcacactctctctgtctgctgaggattcccagagcacagaaagtaacatgagcgttcccaaaaaaatgtgtaagagaccctgcatcctgattctggattctctaaaagctgctagtgttcagaataccgtgcagaacttgcgtgaatacctcgaagtggaatgggaagtgaaacttaaaactcaccgccagtttagcaaaaccaatatggtggatctctgcccaaaagtgccaaagcaggacaactctagcgactgtggcgtgtatctcttgcagtatgtggaaagtttttttaaagatccaatcgttaatttcgagctacctattcacttagagaaatggtttcccagacacgttattaaaaccaagcgcgaggacatccgcgagttaatacttaagctgcacctccagcaacagaagggctcgtcctcttag

SEQ ID NO: 242773 - DNA, 3054 bp, Artificial Sequence
  Description of Artificial Sequence: Synthetic coding sequence
atgctcaatgctaagcctgaggacgttcacgtgcagtcacccctgagtaagttcaggtcaagtgagcgatggaccttgccgctgcagtgggaacgctcactgcggaacaaggtgatcagcctggatcacaagaacaaaaaacatatccgtggttgccccgtgacaagtaaaagcagtcccgaaaggcagctcaaggtgatgctgactaatgtcctgtggaccgacctggggaggaagtttaggaaaaccctaccacggaatgatgcaaatttgtgtgatgctaacaaggtccagtcagatagtctgcccagtacgagcgtagatagtctggagacatgtcaaaaactggaacctctgcgtcagtctctgaacctctccgagagaattcctagggttatcctgactaatgtgctgggcaccgagctgggtcgtaaatacatcagaacaccaccagtgacagaggggagtttgagtgacacagataacctccagagtgagcagttgtcctcctcatctgatgggtcactcgaatcctatcagaatttaaaccctcacaaatcttgctacctgtcagagcggggtagccagcggagtaagacggtcgacgacaacagcgcgaagcagaccgcacacaacaaggagaagcggcgtaaggatgacggcatttcacttctgatttccgatacgcagccggaagacctgaactctgggtcacgtggttgcgatcatcttgagcaggagtcaagaaataaggacgttaagtactcagatagcaaggtggagctgaccctgattagccgcaaaactaagaggcgactgagaaataatctacctgactcccagtattgtacctctctagacaaatcaaccgaacagacgaagaagcaggaggacgattctacaatctcaactgagttcgagaaacctagcgaaaattaccatcaggaccctaagctgccggaagaaatcaccactaaacctaccaagtcagactttaccaagctctcctccctcaactctcaggagctcaccctttctaatgctacaaaaagcgcttctgccggatccaccactgagacagtcgagaactccaacagtatcgatatcgtgggaatctcgtctctggtcgaaaaagatgagaacgagttgaacacaatcgagaagccgattttgcgaggccataacgaaggcaatcagtccctcatctctgcggagcctatagtggtgtcttcagatgaggagggtcctgtagagcacaagagttcagaaattctgaagcttcagtctaagcaggacagagaaaccacaaacgaaaacgagtctacttccgaaagtgccctgttagagctgcctctcatcacatgtgaatcagtgcagatgagcagcgagctgtgtccctataatccggtgatggagaacattagtagtatcatgccaagcaacgaaatggaccttcagctggactttatcttcacctccgtttacatcggtaagatcaagggagcgtctaaaggatgcgttacaatcaccaaaaagtacatcaagatccccttccaagtcagcctgaatgagattagtcttctggtggataccactcatctcaagcgcttcgggctatggaaatcaaaagatgataaccacagcaagcggagccatgccatactctttttctgggtgtcttcagattaccttcaagaaatccagacgcagttggagcactctgtgttgtcccaacagtcaaagagttctgagtttatttttctcgaactgcacaacccagtgagtcagcgagaggagctgaaactgaaagacatcatgaccgagatctcgatcatcagcggcgaactggagcttagttatcccttatcatgggtccaggcttttcccttatttcaaaacttgtcttctaaagagtcttcctttattcactactattgcgtttcaacctgctccttccccgcaggcgtggctgtggcagaggagatgaaactaaagtctgtgtctcaaccatccaatacagacgcagccaaacccacgtatacattcctccagaagcagtccagtgggtgttattccttgtctatcacgtccaaccctgacgaggagtggagagaggtccgtcataccgggctcgtgcagaaattaatcgtataccctccgccaccaactaaagggggattgggcgtgactaatgaggacttggagtgtcttgaagagggcgaatttctcaacgacgtgatcattgacttttacctgaagtatctgatcttagaaaaggccagtgacgaactggtcgagaggagccacattttctcttctttcttctacaaatgcctcactcggaaggagaacaatctgactgaagacaaccccaatttgtctatggcgcagagaagacacaaaagggtgagaacgtggacacgccatattaacattttcaataaggattacatattcgtgccagtaaacgaatcctctcattggtacctggctgtcatttgttttccctggctggaggaggccgtctatgaggactttcctcagactgtgtcccagcagtcccaagctcagcagtcacagaatgataataaaaccattgataatgacctacgaactacaagcaccctgagcctttcagcggaggacagccagagcaccgagagcaacatgagtgtgccgaagaaaatgtgcaaacggccttgcatcttaattctcgatagcctgaaggcggctagcgtgcagaacacggttcagaatttgagagaatatctggaggttgagtgggaagtgaagttgaaaacccatcggcaatttagtaagacaaatatggtcgacctttgtccgaaggtgccaaaacaggacaattctagcgattgcggtgtgtacctgctacagtatgtggaatcattcttcaaggacccaatcgtgaactttgagctgccaattcatctggagaaatggttcccccgtcacgttataaagactaagagagaggatatccgggaattgatactgaagctccacttgcaacagcaaaagggatctagcagctag

SEQ ID NO: 242774 - DNA, 2661 bp, Artificial Sequence
  Description of Artificial Sequence: Synthetic coding sequence
atgctgaatgcaaagcctgaggatgtgcacgtgcagagtcctttgagcaagttcaggtcatccgagcgctggacgctgcccctgcaatgggagcgatccctgcgtaacaaggtgattagtttggaccataaaaacaaaaagcacatccgcggatgccccgttacttcaaaaagctcccccgagcgaggatcccagaggtccaaaaccgtcgacgacaatagtgctaaacagactgcacacaacaaggagaagcgaaggaaggacgatgggatttctctcctaatctcagacacgcaacccgaggacttgaacagtggatcaagaggatgtgaccatttggaacaggagagccggaacaaggatgtcaaatacagcgacagtaaagtcgaactgacactgatttctcggaaaaccaagcggagactgcggaacaatctgccagactctcagtattgcacatccctagacaagtctaccgaacagacgaagaagcaggaagatgattcaaccattagtaccgaatttgaaaagccaagcgaaaattaccaccaagaccccaagctgcccgaagagattaccacaaagcctactaagtcagactttacaaaactttcaagcctgaactctcaggagcttactctgtcaaacgcgaccaagtctgcaagcgcaggctctaccacagagaccgtggaaaactctaacagtattgacatcgtggggatctcgtccctggtagagaaagacgagaatgagctgaataccatcgaaaaaccaatcctccgcggacataacgagggcaaccagtctctgatttccgccgagcccatcgttgtaagctctgacgaggaaggcccagtggagcacaaatcaagcgagattctgaagctccagtcgaagcaggaccgcgagacaacaaatgagaacgagagcacaagtgagtctgcactgctcgagctgcccctgataacctgtgaatccgtccagatgtcctcggagctttgcccttacaatcccgtgatggagaatatcagctccatcatgcccagcaatgagatggatctgcagctggattttatttttacctcagtgtacatcggcaaaattaagggcgcatccaagggctgtgtcacgataaccaagaagtatattaagatacctttccaggtgtctctaaatgagatctctctactggtggacactactcatctgaaaagattcggactgtggaagtccaaggacgacaatcatagcaagagatctcatgcaattcttttcttttgggtcagttccgattacctccaggagatccagacccaactagaacacagcgttctatctcagcagagcaaaagctcagaattcatttttctggagctgcacaatcccgtgtctcaacgcgaggagctcaaactaaaggacataatgaccgaaattagtattatttccggtgagctggagttgtcttatcccctcagttgggttcaggcatttccactgtttcagaacctcagttctaaggaaagttcttttattcactattattgcgtgtcaacctgttccttcccagccggtgtagccgtggctgaggagatgaagctgaagtcggtgagtcagccctccaatacagatgcagccaagccaacatatacctttcttcagaaacagtcttcaggatgctactctctttcgatcacttccaatcctgatgaggaatggcgcgaagtgcgacatacaggactcgtccagaagctgatcgtgtacccaccccctccgaccaagggcggactgggggtgactaacgaagatctagagtgcctcgaagagggcgaatttttgaacgatgttatcattgatttctatctgaaatacctcattttggaaaaagccagcgatgagctggtcgagagatcccacatcttctcttcatttttttacaagtgtctaactaggaaagaaaacaacctgaccgaggacaatccaaacctcagcatggcccagcggagacacaaacgggtgcgtacctggaccagacatatcaatatctttaataaagattatatcttcgtgcccgtcaatgagtcctcccactggtacctggctgtcatttgctttccatggcttgaagaggccgtgtacgaggactttcctcagactgtgtcgcagcagtcacaggcacagcaatcccaaaacgacaataaaactatcgacaacgacctgagaaccacgtccacgctctctctcagcgccgaggatagtcagtccacagagtcgaacatgtctgtgccaaagaaaatgtgcaagcggccttgtatcctgatactggactctctgaaagctgctagcgtgcagaacaccgttcagaatctccgtgaatacctcgaagtcgaatgggaggtgaaacttaaaacacaccggcaattttcaaagaccaacatggtagatctttgcccaaaggtgccgaagcaggacaacagcagtgattgtggcgtttatttactgcagtacgttgaaagcttttttaaggaccccatcgttaatttcgagctgcctattcatctggagaagtggttcccccgtcatgttatcaagacgaaaagggaggacatccgggaactgattctgaaactacacctgcagcagcagaagggcagctctagttag

SEQ ID NO: 242775 - DNA, 717 bp, Artificial Sequence
  Description of Artificial Sequence: Synthetic coding sequence
atgaaaaaatttctgtacattaaaagtgtatttcacacgctgcgcatggcgcagcgcagacacaagcgtgtccgcacatggacccggcatataaacatctttaacaaggactatattttcgtgccagtcaacgaaagctctcactggtacctggcagtgatctgctttccctggttagaggaagcagtgtacgaggatttccctcagacagtgagccagcaatcccaggcccagcagtctcaaaacgacaacaaaaccattgacaacgacttgcggaccacatcaaccctctccctgtctgccgaggatagccagtcaacagaatccaatatgtctgtaccaaagaagatgtgcaagagaccatgtatccttattctggattctctaaaagcagccagcgtgcaaaacaccgtgcagaacttacgcgaatatctagaagtggagtgggaagtgaagctgaaaacacaccgccagttctctaagaccaacatggtagacctgtgtcccaaagttccaaagcaggacaattccagcgactgcggagtttatctgctgcagtacgtggaaagtttcttcaaagacccaatcgtaaacttcgaactgcctatccatctggaaaagtggtttccccgacatgtgatcaagactaaacgggaagatataagagaacttatcctcaaattacatctgcagcaacaaaaagggagcagtagctag

SEQ ID NO: 242776 - DNA, 2958 bp, Artificial Sequence
  Description of Artificial Sequence: Synthetic coding sequence
atggataaacggaaactcggtagaaggccatcttcctcagaaatcatcacagaagggaagcggaagaagagtagctcagacctcagcgagatcaggaagatgttaaacgctaagccggaggacgtgcacgtccagtctccgctgtccaagtttaggtctagtgagcgatggaccctccccctccaatgggagagaagtctcagaaacaaggtaattagtctcgaccataaaaataaaaagcacattcgtggctgtccagtgacctcaaaaagctcccccgaacgtcagcttaaggttatgcttacgaacgtactctggacagacttggggagaaagtttaggaagacgctccctcgcaacgatgctaacctgtgtgatgccaataaggtccagagcgatagtcttcccagcaccagcgtcgactcgctggagacctgtcaaaaattagaacccctccgccagtccttgaaccttagtgaacgaggctcccagagaagcaaaactgtcgacgacaattccgcaaaacagaccgcccacaacaaggaaaaaaggcggaaagatgacggaatctccctattaatatcagacactcagccagaagatcttaactctgggtcaaggggatgtgatcacttggaacaggagagtcgtaataaggatgtgaaatactcagacagcaaggtagaactcaccctcatttcccgtaaaacgaaaagacgcctgagaaacaatctgccagactcccagtactgtacatctttggataaaagcacagaacagactaagaaacaggaggacgactcaaccattagtactgaattcgagaagcccagtgagaattaccatcaagaccccaagcttcctgaggagattacaacaaagcctaccaagtctgattttactaaactctctagtctgaattcacaggagctcaccctgtccaacgcgactaaaagcgcttccgcgggaagcaccaccgagacagtcgagaatagcaatagtattgacatcgtcgggatttcatccctggtggaaaaagacgagaatgagttgaacaccatcgagaagccaatactccgtggtcataatgagggcaaccaatctttgatatctgctgaaccgattgtggtctctagtgatgaggagggtcctgtggagcataaatctagcgaaatcctgaaactgcagtccaagcaagatcgcgagactaccaatgaaaatgaatctacttcggagagtgctctactggagctaccacttattacatgcgagtctgtgcagatgtcctctgagctgtgtccctacaaccccgtgatggaaaatattagttctattatgcctagtaacgaaatggatctgcagctggactttatcttcacaagcgtctatattggaaaaattaaaggagctagtaaaggttgcgtcaccatcactaaaaaatacattaagattcccttccaggtttccttgaacgaaatctccctcctggtcgatacaacccacctgaagcggttcggcctgtggaaatctaaggacgataaccacagcaaacgatcccacgccattctcttcttttgggtatcaagcgattacctgcaagagatccagacgcagctcgagcattccgttttatcccagcagagcaaatcatccgaattcatcttccttgaacttcacaaccctgtgtcacagcgggaagaactaaagctgaaagacatcatgacagaaatttcgattatttccggagaactggagttgagctaccctctgagttgggttcaggccttccccctcttccagaacttgagcagcaaagaaagctcctttattcactattactgcgttagtacgtgtagcttccccgcaggtgttgccgtggctgaggagatgaagctgaagtcagtctctcagccctccaacacggatgccgcaaagccaacctatacgtttctgcaaaagcagtcctccgggtgttacagcctatctataacgtccaatccggacgaggaatggagggaggtcagacacacaggcctagtgcagaagctcatagtctacccacctcctccaaccaagggaggcctgggggtcactaacgaagatctggagtgtctggaggagggagagtttctgaatgacgtcatcatcgacttctatttgaaatatctcatactcgagaaggcttcagatgaattggtggagcgcagtcacatctttagctcgtttttctacaagtgtctgaccagaaaagaaaacaatttgacagaggacaatcccaatttatccatggcccagagacgccacaagcgggtccggacatggacacgccacatcaacattttcaacaaggactatatatttgttcccgtcaacgaatcaagtcactggtacttggcagtcatatgcttcccgtggctcgaagaggccgtgtatgaggattttccacagaccgtttcacagcagagtcaggctcagcagagccagaacgacaataagactatcgacaacgacttgcgcaccacatctaccctgagcttaagcgccgaggactcacagtccacggaatctaacatgtctgtccctaagaaaatgtgcaaaagaccatgcatactaatcctcgatagtttgaaggccgcttccgtgcagaacactgtgcagaacctgagagagtatctggaagttgagtgggaagtgaaattgaagacccatcggcagtttagtaagaccaacatggtcgatctgtgtcctaaggttcctaagcaagataacagctctgactgtggagtttatttgctccagtatgtggaaagtttctttaaggatccaattgtcaacttcgaactgccgatccatctcgaaaaatggtttcctcgtcacgtgatcaagaccaagcgagaagatataagggaactcatattgaagttgcatttacagcaacagaaaggatctagcagctag

SEQ ID NO: 242777 - DNA, 3153 bp, Artificial Sequence
  Description of Artificial Sequence: Synthetic coding sequence
atggacaagcgaaagctcggacgcagacctagcagctctgagattatcacagagggcaaacggaaaaagagcagtagtgatctgtccgagattcgtaagatgttgaacgcaaagcccgaggatgtgcacgtgcagtcacctctgtccaaatttagaagttctgagcgctggactctgcctctccagtgggagaggtctctgagaaacaaagtgattagtttagatcataaaaataagaaacacatccggggttgccctgtgacgtctaaatctagccctgagagacagttgaaagtgatgcttaccaatgttctatggacagacctcggacggaagttccggaaaaccttaccacgcaatgatgctaacttgtgcgatgccaataaggtgcaaagcgactccctgcccagcacttctgtcgactccctcgagacttgtcagaaattggagcccctgaggcagagtctgaatcttagtgagcgcatccccagggtgatactaaccaacgtgttgggcacagaattaggcaggaagtatatcagaacccccccagttactgagggttctctttccgatacagacaacttgcaatcagagcaacttagcagctccagcgacggcagcctcgagagctatcagaatctgaaccctcataagagctgctacttatcagagcgagggtcacaaaggtctaagaccgtggatgacaatagtgccaagcaaacagcgcacaataaggagaaacggaggaaagacgatggaatttccctactgatttctgacacccaacccgaggacttgaattccggctcccggggatgtgatcatttggagcaggagtcacggaataaggatgtgaagtactctgattccaaggtggagctgacactgatcagtaggaaaaccaagcggaggctgaggaataatctgccggatagtcagtattgtactagtctcgataagtccaccgagcagacgaagaagcaggaagacgattctacaattagcaccgagttcgagaagccatcagagaactaccaccaagaccccaaactgcccgaagagataactactaaacccactaaatccgacttcacaaagctcagcagcttgaatagccaggagctgacactttccaacgccaccaagtctgctagcgcaggatctacgaccgaaacagtggagaacagtaacagcatagatatcgtcgggatttctagtctggttgagaaggacgagaacgaactcaacaccatcgaaaagccgatcttgagggggcataatgagggtaatcagagccttatcagtgcagagcctatagtggtgtcgtccgatgaggagggtcctgtagagcacaagtcttcggagattctgaaactgcagtccaagcaggaccgagagaccaccaacgagaacgagagcacctcagagagtgccctcctcgaacttccactgattacatgtgaaagcgttcagatgtctagcgaattgtgcccttacaaccccgtgatggagaacatttctagcatcatgccgagcaacgaaatggatctgcagcttgacttcattttcacttccgtttacatcggcaagatcaagggagcctctaaggggtgcgttaccatcaccaaaaagtatataaaaatcccctttcaggtgtctctcaatgagatcagcctcttggtggacacaacacatctgaagcgcttcggtctatggaaatctaaggacgataatcattccaagaggtcacacgctattctgtttttttgggtctcctccgactacctccaagagattcagacacaactcgagcattcagtactctctcagcagtccaagagttcagaatttattttcctggaattacacaacccagtatcacaacgggaagagttgaagctgaaagatatcatgacagagataagcatcatcagtggcgaacttgaactttcttaccctttaagttgggtgcaagcctttccgctgtttcaaaatttgtcatccaaggagagttcatttattcactactactgtgtatcaacatgcagctttcctgccggagtggccgttgccgaagaaatgaaactgaaatcggtttcccagccctcgaatactgatgctgcgaaacccacctacactttcctgcagaagcaaagctctgggtgctactcactttctattacctccaatcctgacgaagagtggagagaggtgcgccatactgggttggtccagaagcttattgtgtaccctcctccccctactaagggaggacttggcgtcactaacgaagatctcgaatgtctcgaggagggcgaatttcttaacgacgtgattattgatttttacctcaagtacttgatactggaaaaagcctctgacgaactggtggagaggagtcatatctttagtagctttttttacaaatgcttgacccgcaaggagaacaatcttacggaagataatccaaacctgtccatggcacagaggcggcataaaagggtgcgaacatggacgcggcatatcaacattttcaacaaggactatatatttgtcccagtgaacgaaagctcccattggtacttagcagtcatatgtttcccctggttggaagaagctgtctatgaagacttcccgcagactgtgagccagcaaagccaagcccagcaatcccagaacgataacaaaacaattgataacgacctgcggacaacaagtaccttaagtctcagtgcagaggattctcagtccactgagtctaacatgtcagtgccaaagaagatgtgcaagcgcccatgcatcctcatactcgactcgctgaaagctgctagtgtacagaacacagtgcagaacttgagggagtatctggaagtcgaatgggaggtcaagctgaaaacccaccgccaatttagtaagaccaatatggtggatttgtgcccaaaggttccgaagcaagacaactctagcgactgcggcgtctaccttcttcagtacgtcgagagcttttttaaagaccctatcgttaatttcgaactgccgattcaccttgagaagtggttccctcggcacgttatcaagacaaagcgggaggatatacgcgaactgatattaaaactgcacttgcagcagcagaagggaagttctagttag

SEQ ID NO: 242778 - DNA, 1770 bp, Artificial Sequence
  Description of Artificial Sequence: Synthetic coding sequence
atgtaccgatggctggtgagaattctcgggactattttccgattctgtgacaggtccgtgccacctgcaagagctcttttgaagcgaaggcggagcgattcgactctcttctcaaccgttgacactgatgaaatcccagctaagaggcccaggctcgactgtttcatacatcaggtcaagaatagtctctacaacgccgcatcgctgtttgggtttccctttcagctgactaccaagccaatggttacttccgcctgtaacggcacccgaaatgtcgccccttcaggcgaggtgttctcaaactctagttcttgcgagctcactggctcagggtcttggaataacatgctaaaattgggcaacaaatcccccaatggaatcagtgactatccgaagattagagtgaccgtgacccgtgaccaacctcgccgagtcctcccatcttttgggttcactctcaattccgagggatgcaaccggaggcccggtggccgtcgacactccaagggcaaccctgagagctctctgatgtggaagcctcaggagcaagcggtgaccgaaatgatcagtgaagaaagcggtaagggactgcggagaccccattgtactgtggaggaaggggtgcagaaggaagagcgcgagaagtatcggaagctgcttgagaggctgaaggaatcaggccacggaaactccgtgtgcccagtaacctccaactaccacagctcccaaaggtctcaaatggacacgcttaagactaaagggtggggggaagagcaaaaccacggagtgaagacaactcagtttgttccaaagcagtatagactagtggagacacgaggaccactctgttccttgcgctcagaaaagcgctgcagcaaaggcaagattaccgacaccgaaaccatggtgggcataaggtttgaaaacgagtctcgcaggggataccaactggagccagatttatcagaggaggtctcagcgagactcaggctgggctcagggagcaacggcctgttaagaagaaaagtctcgattatcgagactaaagaaaagaattgttccggcaaggaacgcgacagacgcacagacgatctgttggaactgaccgaggacatggagaaagagatatccaatgcactaggacatggacctcaagacgagattcttagtagcgcttttaagctgaggatcacacggggagatatccagactctgaagaattaccactggctcaatgacgaggtgataaatttttacatgaatctactggtggaacggaataaaaagcaaggataccctgccctgcacgttttcagcacatttttctacccaaaactgaagagcggaggatatcaggcagtgaagaggtggactaagggcgtgaatctgtttgaacaggaaattatcctggtgcccatacaccgtaaagtgcactggtcactcgtcgtcatcgatctcagaaagaaatgtcttaaatacctggacagtatgggccaaaaaggacataggatatgcgagattttacttcagtatttgcaggacgagtccaagacgaaaaggaactcagatctgaacctcctggagtggacgcaccatagcatgaagccacatgaaatcccccagcagctgaatggctcagattgtggcatgtttacctgtaaatacgccgactatatctcacgggacaagcccattacttttacgcagcatcagatgcctttgtttaggaagaaaatggtgtgggaaatcctgcaccagcaactgttatag

SEQ ID NO: 242779 - DNA, 1242 bp, Artificial Sequence
  Description of Artificial Sequence: Synthetic coding sequence
atgtggaagcctcaagaacaggcagtgacggaaatgatctccgaggagtccggtaagggcctgcggagaccacactgtaccgtcgaagaaggggtgcagaaggaagagcgggagaaatatcgcaagctcctggagcggctgaaggagtctgggcatggtaatagcgtgtgcccagtcacgagcaactaccactcttcccagcgcagccaaatggacacattgaaaacgaaggggtggggggaagaacagaaccacggggttaaaacaacccagttcgtgccgaaacagtaccggttggttgagacaaggggccctctgtgcagcctgaggtccgagaagaggtgctccaaggggaaaattacggataccgagacaatggtgggcattcgatttgagaacgagtctcgcagaggataccaactggaaccagatcttagcgaagaggttagcgctcggctccgtctgggctcggggagcaacggcctactgagacggaaggtgagcataatcgaaaccaaagagaagaattgcagcggaaaggaacgagaccggaggaccgacgacctgctcgagctgaccgaggacatggaaaaggagatcagcaacgctctggggcacggtccacaagatgaaatcctgtcctctgcttttaagctacgaattactagaggagacatccaaaccctaaaaaactatcactggctgaatgatgaggttatcaatttttacatgaatctcttagtcgagcgcaataagaaacaggggtacccagctttacacgttttctccacatttttttatcctaagttaaaatcaggcggttaccaggccgtaaagcgctggacaaagggagtcaacctttttgaacaggagatcattctggttccaatccatcggaaggtccattggagcctggtggtaatcgacctgaggaagaaatgccttaaatatctggattcaatggggcagaaggggcacagaatctgcgagatcttgctgcaataccttcaagacgagtccaagaccaagcgcaattcagacctaaacctgctggagtggactcaccactccatgaaacctcacgagatccctcaacagctgaacggtagtgactgtggcatgttcacctgcaagtacgcagactatatttctagagataagcctattactttcacccagcaccaaatgccactgttccgcaagaagatggtgtgggagattctacaccagcaactgctgtag

SEQ ID NO: 242780 - DNA, 1383 bp, Artificial Sequence
  Description of Artificial Sequence: Synthetic coding sequence
atgtatagatggctcgtcagaattttaggcacaatcttcagattctgcgacagatccgttcctccggcacgcgctctccttaaaagaagaagatctgacagcactctcttttcaaccgtagataccgacgaaatccccgcaaaaagaccaaggctggactgttttattcaccaggtgaagaatagcctatacaacgcggcatcactcttcggattcccctttcaactcacaactaaacctatggtcacatctgcatgcaatgggacaagaaatgtggcaccttctggtgaggtgaacggtaatagtgtgtgccctgtcacatcgaactatcacagctctcaaagaagtcagatggatacactgaaaacaaaggggtggggagaggaacagaatcacggggttaagacaacccaattcgtacccaagcagtatagattagtagaaacccggggacctctgtgcagcctgaggtcagaaaagagatgttccaagggaaagataaccgataccgaaaccatggtcggcattcgctttgagaatgagagtcggagagggtatcagctggagccagatcttagcgaggaggtatccgcgagactccgcctcggttcaggctcgaacggcttattgcgaagaaaggtatcaattattgaaaccaaggaaaaaaattgctctggtaaggagagagacagacgcaccgatgacctactggaacttactgaggatatggaaaaagagatttctaatgccctgggacacgggcctcaggacgagatattgagctcagccttcaagttgcggataactcgtggagatatccagacgcttaagaactatcactggcttaatgatgaggtaattaatttttacatgaatctgctggtcgagaggaataaaaaacaagggtatccagcattgcacgttttttcaacctttttctatcctaagcttaagtcaggaggctaccaggccgtaaagcgatggacaaagggggtgaacttgttcgagcaggaaatcatcctggtacctatccacaggaaggttcactggtctcttgttgtgattgatttgcgtaagaaatgcctaaagtatcttgattcgatgggacagaagggtcataggatatgtgaaatcctcctccagtacctacaggatgaatccaaaactaaaaggaactccgatttaaacctcctcgaatggacgcaccactctatgaagcctcacgaaatcccccaacagctgaacggctccgattgtggtatgtttacctgtaagtacgccgattacatcagccgtgacaagccaataacatttactcagcatcagatgcccctatttagaaagaagatggtctgggagattttgcaccaacagctgctttag

SEQ ID NO: 242781 - DNA, 1740 bp, Artificial Sequence
  Description of Artificial Sequence: Synthetic coding sequence
atggactctcatccttgtctctactgtggtcctcaggactccgagggaacaaactggcagacctccccctcgaccctgtttagcactgtggatacagacgaaattcctgctaagaggcctagactagattgcttcatccaccaagttaagaattccctctataacgctgccagcctttttggtttccctttccagttgaccaccaaacccatggtcaccagtgcctgcaacggtactagaaatgtcgcaccatcaggagaggtgttttcaaactcctcctcatgcgagttgactggatctgggtcctggaacaacatgcttaagttgggaaacaaatctcctaatggcatatctgactaccccaagattcgggtgactgtgacccgggaccagcctaggagagtgctcccgtctttcggtttcaccctaaattcggaaggttgcaacagacgcccagggggtcgaaggcattccaaaggaaatcctgaaagctctctcatgtggaagccccaggagcaggctgttactgagatgatatcggaggaatctggaaaggggctgaggcgacctcattgtacagtggaagagggagtgcagaaggaagaacgcgaaaaatacaggaagctcctggaaagacttaaagagtcaggccatggaaattcggtgtgccccgtgacgtccaactaccactcctcccagcggagtcaaatggataccctgaagactaaagggtggggtgaggaacagaatcatggggtgaagactactcaatttgtgcccaaacagtaccgcctggtcgaaacccggggtcctttatgctcccttcgctccgaaaagaggtgcagcaagggcaaaatcaccgatacagagaccatggttggtattaggtttgaaaacgagtctcgccgtgggtatcagttggaacccgacctgagcgaggaggtatccgcccgtctcagactgggcagtggctccaatgggctccttcggcgtaaggtgtctatcatcgaaactaaagagaagaattgctcaggcaaagagagagatcgcaggaccgatgatctgttagaactgactgaggacatggagaaagagatttcaaacgcattaggtcacgggcctcaggacgagattttatccagcgctttcaagcttcgcattacacggggtgacatccagaccctgaaaaactaccattggctcaatgatgaggtgatcaacttctatatgaatctgctggtagagcggaacaagaaacagggctacccagcactgcatgtgttttccacctttttttatcctaaactgaaatcgggcggttatcaggcagtgaagcgttggaccaaaggagttaacctgttcgagcaggaaatcattcttgtgcccatccacagaaaggtgcactggagtcttgtggtcatcgacttacgcaagaagtgtctgaaatacctcgatagtatgggccagaaggggcaccgaatctgcgaaatcttgcttcagtacttacaggatgaatcaaaaaccaaacgcaattcagatcttaacctgctggagtggacacaccacagcatgaagccacatgagatcccccaacaactaaatggctcagactgcgggatgttcacctgtaagtatgcagactacatctctagagacaagccaattacctttactcagcatcagatgcctctgttccggaagaagatggtgtgggagatcctgcatcagcaactgttgtag

SEQ ID NO: 242782 - DNA, 1722 bp, Artificial Sequence
  Description of Artificial Sequence: Synthetic coding sequence
atgaaggaaaccattcagggcacgggtagctgggggcctgaaccacccggaccaggaatccctcctgcttactctagccccaggcgggaacgccttaggtggccacccccacctaagcccaggctaaagtccggcggaggatttggtccagaccccggtagcgggacgactgtgcccgcacggagattacctgttccccgtccatcttttgatgcatctgccagcgaggaggaggaggaagaagaagaggaagaagatgaagatgaggaagaggaggtcgctgcctggcggttgccccctaggtggtcccagcttggaacctctcagcgaccacggccaagcaggcccacccaccgaaaaacttgcagccagcgccgacggagagcgatgcgcgctttccggatgctgctgtacagtaagtcaacatctctgacctttcattggaagctttggggaaggcacagggggaggagaagaggcttggcccaccccaaaaaccatctctcaccacaacagggcggagcaactccacaagtgccttctccctgctgtagattcgacagtcccaggggcccacccccaccaagattggggctgctaggtgccttgatggccgaagatggagtgagggggtctccacctgttcccagcggccctcctatggaggaagatggcctgcgatggacaccaaaaagccctctcgatcccgacagcggcctattgtcctgtacactgccaaacggatttggtggacagtcagggcctgaaggagaacggtcccttgccccaccggacgctagcatactaattagcaacgtgtgctcaatcggcgaccatgtggctcaggagctgttccaaggtagtgatttaggtatggctgaggaggcagagaggcccggagagaaagccggacaacatagccctctccgggaagagcatgtgacgtgtgtgcaatccatcctggacgagttccttcaaacttacggaagcctgatacccctgagtacagatgaggtggtggaaaagctcgaggatatctttcagcaagaatttagtacgccatcaagaaaaggactcgtgcttcagctcatccaatcttaccaaaggatgcctggaaacgcaatggtccgcggatttagagtcgcgtacaaacggcacgtgcttaccatggatgacctggggaccctgtacggacagaactggcttaacgaccaagtgatgaacatgtacggagatttggtgatggataccgtgccggagaaggtgcatttttttaattcattcttttacgacaaactgcgcacaggctatgacggcgttaagaggtggactaagaatgttgacatctttaacaaggagctgctccttattcctattcatctcgaggtgcattggagtcttatcagcgtcgatgttcgcagaaggacaatcacgtacttcgacagccagagaacgctgaaccgccgttgccccaaacacatagccaagtatctccaagctgaagcggtgaagaaagatcggctggattttcatcaaggttggaaaggctactttaaaatgaacgtggctagacagaacaatgacagcgactgcggcgcatttgttttacagtattgcaaacaccttgctctgtctcagccatttagctttacgcagcaggatatgccaaaacttagaagacagatctataaggagctctgccattgtaagctgaccgtgtag

SEQ ID NO: 242783 - DNA, 1725 bp, Artificial Sequence
  Description of Artificial Sequence: Synthetic coding sequence
atgaaggaaacgattcagggcaccggttcctgggggccagaaccacctgggccagggattccaccggcttactccagcccccgtagggagaggctccgatggccccctccacctaaacccagactgaagtccggcggaggatttggcccagatccaggatccggcacgaccgttcccgctaggaggttacctgtgcccaggccaagctttgatgccagcgcctcagaagaggaggaagaagaagaagaggaggaggacgaagatgaggaggaggaggtggccgcatggaggttgccacctaggtggtctcaactcggcaccagccagaggcctaggccttcaagaccaactcataggaagacatgttcacagagacggcgacgggctatgagggctttccgcatgctgctgtacagtaaaagcacctccctgacatttcattggaaattgtggggtcgtcacagggggcgacgaagagggttggctcatcctaagaaccatttgtcccctcagcaagggggtgcaactccccaagtaccatcaccctgctgccggttcgattctcctcgtggacccccacctccacgcttagggctacttggagccctcatggccgaggacggagtaaggggcagccctccagtgcccagcggtccgcctatggaagaggacggtttgaggtggacacccaagtcgcccctcgatccagacagtggccttctctcttgcaccctacccaacggatttggtggccagtcaggacctgagggcgaaagaagcctggctcctcctgacgcctctattctcatatcaaatgtttgcagcattggcgatcacgtcgctcaggagctgtttcaggggtccgatctaggcatggccgaggaagcagagcggcctggggagaaggctggccagcattctcccttgcgtgaagaacacgtgacatgcgttcagagtatcctggatgagttcctgcagacctatggtagtctcattccgctgagtactgatgaagttgtagaaaagctagaggacatcttccagcaagagttcagtacgccttcgaggaaaggtctggtcctgcaactgattcagagttaccagagaatgcccggtaatgccatggtccgaggtttccgcgttgcctataaacggcacgtcctcaccatggatgacctcgggaccctgtacggtcagaattggctgaatgatcaagtgatgaatatgtatggagatctcgtgatggacacggtgcccgagaaggtacattttttcaacagctttttctatgacaagctccgtacaaaagggtatgacggagtcaagagatggacaaaaaatgtggacatctttaataaagaacttctgctaataccaattcatctagaggtgcactggtctctaatctctgtggatgtcagacgacggaccattacttatttcgactcccagcgaacgcttaatcgtcggtgtcccaagcatattgccaaatacctacaggccgaagccgtgaagaaagaccggctggatttccatcaaggatggaagggctattttaaaatgaacgtggctaggcagaacaacgattctgactgtggggctttcgtcttgcagtactgcaaacatctcgcgctttctcagcccttcagctttacacagcaggatatgcctaagctccgcaggcagatttataaggagctgtgtcattgtaaactcaccgtgtag

SEQ ID NO: 242784 - DNA, 3741 bp, Artificial Sequence
  Description of Artificial Sequence: Synthetic coding sequence
atgatggaaaccgaaagattggtcctgcccccaccagacccactggacttacccctgagagccgtagagttaggatgtaccggacattgggagctgctaaacctaccaggcgctcccgaatcaagtctcccacacggcttacctccttgcgcaccggacctgcagcaagaggccgagcagttattcctcagttccccggcatggctgcctctgcacggcgtagaacacagcgctcgaaagtggcaaagaaaaacggacccctggtcgctgctagccgttctgggcgcacccgtccctagtgacctgcaagcacagcgccacccaacaaccggccagattctggggtataaggaagtgctactcgaaaataccaacctgtccgccacgacttcgttgtctctgagacggcctcctggtcccgctagtcaaagcttgtgggggaaccccacgcagtatcctttttggccaggcggtatggacgagcctacaattacagacctcaataccagagaggaagctgaggaagagatagattttgaaaaagatttgctgaccatccctccgggattcaaaaaaggtatggattttgcacccaaagattgccctacacccgcacccggacttttgagcctgtcatgtatgctcgagccactcgacctgggaggaggggatgaagacgagaacgaggcagtgggacagcccggtggacccagaggggacactgtgtcggcatccccatgttcagcccctctcgcacgagcttcctcactcgaagatctggttctgaaggaggccagcaccgcggtttcaacccctgaagccccagagcccccttcacaagagcagtgggccataccagtggacgccacaagtcctgtgggtgatttctatcgactcattccacagccagcgttccagtgggcgttcgagcccgatgtgttccaaaaacaggccatcctccatctcgaacgccatgactccgtatttgtggctgcccatacctctgcgggtaagaccgttgtcgcagagtatgccattgctctcgcccagaagcatatgacccggactatctatacttctcctatcaaggccttgtcaaatcagaaatttcgggacttcaggaatacattcggcgatgtgggtctgctgacaggcgatgtgcagctgcatcctgaagcctcctgccttatcatgacaacagaaatccttaggagtatgctttattccggtagcgacgtgattcgtgacctggagtgggtcattttcgatgaggtacactacataaacgacgtggagaggggcgtggtgtgggaagaggtgttaatcatgctgccagatcatgtcagtattatactcttgtctgccaccgtgccaaacgcattggaattcgccgactggatcggtcggttaaagagacgccagatttatgtgatttctactgtgaccagacccgtgcccctcgagcattatttgtttacggggaacagctctaaaacacaaggcgagctgttcctcctgctcgatagccgaggagcttttcataccaagggatactacgccgctgtggaggccaagaaggaacgaatgtcaaagcatgcgcagactttcggagccaaacaacctactcaccaggggggacctgcacaggatcgcggagtgtatttgagcctactggctagtctgcgaacacgcgctcaattacctgtggtggtgttcaccttctcccggggtcggtgcgatgagcaggcttctgggctaacatcactcgatctcaccacaagtagcgaaaaatccgagatacacttgttcctccagcgatgcctggcacggctaagggggtcagatcgccagttgccacaggtgttgcacatgagcgagctgctcaatcgtggcctcggggttcatcactctgggatcctgccgatactgaaggagatagtcgaaatgctgttttctaggggcctggtaaaagtgttgtttgcaacggagacatttgccatgggagtgaacatgcctgcaagaactgtggtctttgactcaatgcgcaaacacgatggtagcacttttcgagacctcctccctggtgagtacgtgcagatggcgggtagggccggtcggaggggcctggatccaactggaacagtgattctcctctgcaagggacgcgttcctgagatggcagacctacatcgcatgatgatgggaaagccatcccagctgcagagccagttccgcctgacatataccatgatcttaaatttacttagggtagacgcccttcgtgttgaggatatgatgaaacgatcatttagtgagtttccatctaggaaagacagtaaagctcatgagcaagctttggcagaactcaccaagcgcctcggggcactagaagagccggatatgacagggcagttggtggatcttcccgagtactattcctggggcgaagaactcactgaaactcagcacatgattcaaagaaggattatggagagcgttaacggactcaagagtttgtccgcgggacgggttgtggttgtgaaaaaccaggagcaccataatgcgctgggagtgatcttgcaggtcagttctaactctactagcagagttttcacgaccttagtactgtgcgataagcctctcagtcaggacccccaggataggggcccagcgactgcggaggttccatatccagatgatctggtgggcttcaagctcttcctgcccgagggcccatgtgatcacactgtggtcaaactacaacctggcgacatggcagccatcacgacaaaggtgctgcgagtgaacggggagaagatactggaagacttttcgaaacgacagcaaccaaagttcaagaaagatccccctctggccgcagtgaccaccgccgtccaggagctgctgcgacttgcccaggctcatcctgctggcccacctacgctggatccggtcaacgacttgcagctgaaagacatgtctgtagtggagggaggtttacgggcaagaaaactcgaggagctcattcagggagctcaatgcgtgcactctcctcggttcccagcacagtacctgaagttgagggagaggatgcagattcagaaggagatggaaagactgcgtttcctcctgagtgaccaaagtctgctactgctgcccgagtaccatcaaagagtggaggtgcttcgtacattgggatatgtggatgaggcgggtaccgtgaaactggcaggacgtgtcgcttgcgccatgtcttctcacgagctgctattgactgaactcatgttcgataacgcgctgagcaccttgcgcccagaggaaatagcggctttattatcggggcttgtgtgccagagcccaggcgacgcaggagatcagttgcccaatacccttaagcagggaatcgagagagtccgtgcagtggccaagagaattggcgaggtgcaggtggcttgtgggctgaaccagactgttgaagagttcgtaggagagctgaacttcgggctcgtggaggtcgtttacgagtgggccaggggcatgcctttctcagagctggcgggtctatctggaactcctgaggggctcgttgtgcgctgcattcagagactggccgaaatgtgtagatctctgaggggtgcggctaggctcgtgggcgagccagttctcggagcgaaaatggaaacagctgccacactgttaaggagagatatagtgtttgccgcttccctttacacccagtag

SEQ ID NO: 242785 - DNA, 3741 bp, Artificial Sequence
  Description of Artificial Sequence: Synthetic coding sequence
atgatggagaccgagagactcgtgctacccccaccagatccgttagatttgccacttagggccgtggaattgggatgtacgggacattgggagcttctaaatttgccaggggctcctgaatctagtcttccgcatgggctaccgccatgcgccccagatctccagcaagaggcagagcagctgtttctcagcagtcccgcatggcttccactccatggagtcgagcattccgctcgcaaatggcaacgtaaaactgacccctggagccttctggcagtgttgggcgctcctgtgccatcagatctccaggctcagcgccatccaacaacgggacagatcctgggttacaaagaggtactgcttgagaataccaacctgagtgccacaacctctctgagtctcagacgcccaccgggaccagctagccagagcctctgggggaatcctacacagtacccattctggcctgggggaatggatgagccgacaattacagatctaaacacgagggaggaggccgaggaggaaattgattttgagaaggatttgctgaccatccctccgggattcaaaaaaggcatggacttcgctccgaaagattgtcccactcctgccccagggcttctgagtctgagctgcctactggagccccttgaccttgggggaggagatgaagatgagaacgaagccgttggccagcctggcggaccccgaggagacaccgtctctgcatcaccctgttccgctccactcgcgagagcctcgtcacttgaggatcttgtgcttaaggaagctagcacggcggtgtcaacacccgaagcccctgaacctccctctcaggagcaatgggctatccctgtggacgcaacaagcccagtcggcgatttttaccgtttaatcccacaaccggctttccagtgggccttcgagccggatgttttccagaaacaggcaatcctgcacctagagcgacatgactccgtgtttgtggccgctcacaccagtgcaggtaagactgttgtcgctgaatacgcaattgcacttgcccagaaacacatgacccggactatttatacatctcccattaaggcactctccaaccagaagtttagggacttccgaaataccttcggggatgtgggcctgttgacgggggacgtgcagctgcaccctgaggcctcatgccttattatgactactgagattcttagatcaatgctttacagcgggtcagatgtcattcgcgacttggaatgggtgatatttgatgaagtgcactatatcaacgacgttgagaggggtgttgtatgggaggaagtcttaattatgctcccagatcacgttagtatcatcttgctttccgccacagttccgaatgccctggagttcgcagattggatagggagattgaagcgtcgccagatctatgtaatttcaaccgtaacgaggccagtgccattggaacactacctgttcacaggcaattcatcgaagacacagggcgaactgtttcttctcctcgactctcgcggagctttccacaccaagggctactatgcagcagttgaagcaaaaaaggagcgcatgtccaaacacgcacagacttttggcgcaaagcagccaacacatcagggcggaccagcgcaggatcggggagtgtacctgtccctgctagcatcattgcgtacaagggcgcagctgcctgttgtggtcttcacattcagccggggacgctgcgatgagcaggccagtggactcacgagcctggacctgacaacctcctccgagaagtccgagatacacctctttctgcagcgctgtttagccagactcaggggaagcgaccggcagctcccacaagttttacacatgagcgaacttttgaacagaggactgggggttcaccattcgggcattcttccaatcctgaaagagatcgtcgagatgctgttcagtcgcggactcgtcaaagtcctcttcgcaacggagacattcgccatgggggtcaacatgccagcaagaaccgttgtatttgactccatgaggaagcatgatggcagtaccttcagagatctgctgccaggtgaatacgttcagatggccggtcgtgctggtcgcagaggcctagacccgacgggcacggttatccttctgtgcaaagggagggtccccgagatggccgatctacaccgcatgatgatggggaaacccagccagcttcagtcacaattccggctcacatacactatgattctgaatctgctcagagtagatgctcttcgtgtggaggacatgatgaaacgcagctttagcgagttcccatctagaaaagactctaaagctcacgagcaggccctggccgagttgactaagaggctgggcgctttggaggagccggacatgacggggcagcttgttgacctcccagaatactactcttggggggaggaactcacggagacccagcatatgattcagaggcgcatcatggaaagtgtgaatggattaaagtcactcagcgcaggaagagttgtagtcgtcaaaaaccaggagcatcacaatgcgctgggggtgattttgcaagtgtcttctaacagcacgtcaagggttttcactacgctagtgctgtgcgacaagccacttagccaggacccccaggaccggggaccagccactgccgaggtaccctaccccgacgacctggtgggattcaagttgttcctgcctgaaggcccatgtgaccatactgtggtcaaactccagcccggtgatatggctgccattaccaccaaggtgctccgtgtgaacggcgagaagattttggaggactttagcaaaagacagcaaccaaaattcaagaaagaccctccgctggccgctgtcaccacggccgtgcaggagctgttgcgactcgcccaggcacacccggctggccctccgactctggatccggtaaatgatcttcagcttaaggatatgtcggtcgttgagggaggtctccgggctcggaagctcgaagagctcatacaaggcgctcagtgtgtccactctcccaggttcccagcccagtacctgaagttgcgggagcggatgcaaatacagaaagaaatggaaagactgaggttcctcctgagcgaccagtccctgttattactacctgagtatcaccaaagggtggaggtcttaaggaccctgggatatgtcgatgaagcaggaaccgtgaagttggcagggcgagttgcatgtgctatgtctagccatgagctgctattgaccgagctgatgtttgacaatgccctgagcacgctgcggccagaagagatcgcagcccttttgtctggacttgtgtgtcaatcaccaggcgacgccggagatcagcttcccaacactttgaaacagggcatcgagcgagtgcgcgctgtggccaaacggatcggtgaggtacaggtcgcgtgtggacttaatcagaccgtagaagagttcgtgggcgagctgaacttcggcctggttgaggtagtttacgaatgggccagagggatgccatttagcgaattggccggtctaagcggcactcccgaaggcctcgtcgttaggtgtatacagagacttgcagaaatgtgcagaagtctgagaggcgctgcaagattagtaggggaacctgttctaggtgcgaagatggagaccgcagcgacactgttgagacgggacatcgtatttgcggcttcactgtacacccagtag

SEQ ID NO: 242786 - DNA, 3741 bp, Artificial Sequence
  Description of Artificial Sequence: Synthetic coding sequence
atgatggaaaccgagcgcctcgtcctgccgcctccagatcctctggatttgcctcttagggcagtggagctgggttgtacaggacattgggagctgctgaatctgcccggtgccccagaatcctccctgccacacggactgccaccctgtgcccctgatctacagcaagaagccgaacaattgttcctatcaagtcccgcatggttaccacttcacggtgtcgaacattcagcacgaaaatggcagcgcaaaacagacccgtggtcactattagctgtgcttggagcacccgtgccgtctgacttgcaggcccagagacatccaactaccgggcagatcttaggatacaaggaagtgttgcttgaaaatacaaatctttcagcaacgaccagcctgtcactaagacgccctccgggtcccgcatcacaatctttatggggtaatcctacccaatatccattctggcccggaggcatggatgagcctaccattaccgacctgaatacccgcgaggaggctgaagaggaaattgatttcgaaaaggacctcctgacgataccaccaggtttcaagaagggaatggatttcgctccaaaggattgtcctactccagcgcctggcttgttatcactgtcttgtcttctcgagccattagacctcgggggaggtgacgaggatgagaatgaggccgtcggacaacccggagggcctaggggggatacagtgagcgcatccccttgtagtgcaccgcttgcaagagcatcaagcttggaagatttagtcctgaaggaagcttcgactgcagtctctacccccgaagcacccgagcccccttctcaggagcagtgggccatcccggtggacgcaacatcccccgtcggtgacttctatcgcctgatcccacagccggcattccagtgggcatttgagccggacgtttttcaaaagcaggctatcctgcatcttgagcgacacgactctgtgttcgtggccgcacacacttctgccggaaagactgtagtggcggagtatgccatcgcgcttgcccaaaagcatatgacgaggaccatttatacctcccctattaaagcactctccaatcagaagtttagagacttccgtaataccttcggagacgttggattactgacgggagacgtccagcttcaccctgaggcaagctgcctcattatgactacagaaattctcaggagtatgctttatagtgggagtgacgtgatccgtgatttggagtgggtcatctttgacgaggtgcactatattaacgacgtggagaggggcgtggtctgggaggaagtgctgatcatgctgcccgatcatgtctctatcatcctgctaagcgccacagtccctaacgccctcgagttcgccgattggattggacggctgaagcggagacagatctacgtgataagtactgtaacaagacccgtgcccttagagcactacctctttacaggaaattcatcaaagacacaaggagaactcttcctcctgctggacagtcggggagccttccataccaaggggtattacgcagctgttgaggctaagaaggaacgcatgtcaaagcatgctcagaccttcggggcaaagcagcccacgcaccagggaggtccagcacaggatagaggtgtgtatctgagcctattagcgagtctcaggacgcgggctcaactgccagtggtggtgtttaccttttctcggggtcgatgcgatgaacaagcaagcggcttaacatccctggacctgactacaagcagcgaaaagtctgaaattcatctgttcctgcagagatgtctcgccaggctgagggggtctgacaggcagctacctcaggttctccacatgagtgagcttctaaatcgtggcctgggagtgcatcatagcggcatcctgccaatccttaaggagatcgtggaaatgctgttctcaagggggcttgtgaaggttctgtttgccactgaaacgttcgccatgggtgtcaacatgcccgctcggaccgtggtgtttgattctatgcggaagcacgacgggtctaccttcagagacctgctgccaggtgagtatgtacagatggccggtagggctggaagaagaggtcttgaccctacagggactgtaatccttctctgcaagggcagagtgcccgagatggcggacctgcaccggatgatgatggggaaaccttcccagctccagagtcagttccgattaacttacactatgattctgaacctattgcgtgtcgacgctttgagggtcgaagacatgatgaaacgcagtttcagtgaatttcccagtcggaaggacagcaaggctcatgagcaggccctcgctgaactgactaagaggctgggcgcactcgaggagccagacatgacggggcagttagtggatcttcccgaatattattcatggggtgaagagttgaccgagacacagcacatgatccaaaggaggattatggagagtgtgaatggcctgaaatctctatctgcgggaagagtggtggtggttaagaaccaggaacatcataacgctttaggagtgattttacaggtctcctctaactctacttcgcgcgtttttacaaccctagttctgtgtgataaacccctgagtcaggacccacaagaccgcggaccagccacagcggaagtgccataccccgacgacctcgtgggatttaagttgttccttcctgagggcccatgcgatcacaccgtggtgaagttgcagcctggcgatatggccgctattacaactaaggtgctgcgtgttaacggcgagaagattctggaggactttagcaagaggcagcagcctaagtttaagaaggacccgcctctggctgccgtgacgacggccgtccaggaactgctgaggttagctcaggcccaccccgcaggccctcctacgttagatccggtgaacgatctgcagctgaaagatatgagcgtagttgaagggggtctccgcgcaaggaagctcgaggaacttatccagggcgctcaatgcgtacatagtccacgatttcccgctcagtacctgaagttgcgggagcggatgcaaattcaaaaggagatggaacggctccggtttctcctatcggatcaatctcttttgttgctccccgagtaccatcagcgtgtggaggtcctaagaacattagggtatgttgacgaggccggaaccgtgaagttggccggtcgggttgcctgcgccatgagttctcacgaactgctgttaaccgagctgatgtttgacaacgcccttagcaccctcaggccagaggagattgctgcgctgctctcagggctcgtgtgccagagccctggcgacgccggagaccagcttcccaacacactcaagcaagggatcgaacgagtacgcgctgtggccaagcggatcggggaggttcaggtggcttgtggactgaaccagactgtggaggaattcgttggggagcttaattttggcctggtggaagtggtgtacgaatgggcgagggggatgcctttcagtgagctggcaggcttatctgggactcccgagggactggttgtgaggtgtattcagagactcgccgagatgtgccgctccctaagaggcgctgcccgactcgtgggtgaacccgtcctcggcgcaaagatggaaaccgcagcaactctgcttagaagggacatcgtgtttgctgcctcattatatacccagtag

SEQ ID NO: 242787 - DNA, 3741 bp, Artificial Sequence
  Description of Artificial Sequence: Synthetic coding sequence
atgatggaaacggagcggttagttcttccacctccagaccccctggatctgccgctgcgagccgtggagttaggatgcacgggtcactgggaactgctgaatttacctggcgcacccgagtcatcgctgccacacgggttgcctccatgcgcccctgacctccagcaggaagctgagcaactgtttctgagctcaccggcttggctgccactacacggcgttgagcactctgctagaaaatggcagcgcaagacggatccttggagtctactggccgttctgggggcacccgtcccctcggacctgcaagctcaacgccatcctacaacaggtcagatcttaggctataaggaggtgttgttggaaaacactaacctttccgctacaacatcactgagcttgcggcgaccccctggcccagcttctcagtccctgtggggcaatcctacacaatatccgttttggccaggcggaatggacgagcctactatcaccgatctgaacaccagagaagaagccgaggaagaaatcgatttcgagaaggacctgctcactataccaccaggcttcaagaaaggcatggactttgcaccaaaagactgtccaacaccagctccaggactgttgtctctaagctgtttgctggagccactggatttgggcggtggtgatgaggacgaaaacgaggctgtgggccaacccggtggacctcggggagacaccgtctcagcgtccccctgctctgcacctctggcaagggccagttcacttgaagatctggtcttaaaggaagctagtaccgccgtgtcaaccccagaagctcccgagcccccttcacaggagcaatgggccatacccgttgatgccacctcgcccgtgggagacttctacaggcttatcccacagcccgctttccagtgggcgttcgaaccggatgtgttccagaaacaggccattctgcaccttgagaggcacgattctgtcttcgttgctgcccacaccagcgccggaaaaaccgtggtggccgaatacgctattgctctggcccagaagcacatgactcgcaccatttatactagcccgatcaaggctttgagcaatcaaaagttcagagatttcagaaatacttttggcgacgtgggactactgacaggagacgtccagttgcatccagaggcctcctgcctcataatgaccaccgagattctacgatcaatgttgtattccggctccgacgtgattcgtgaccttgagtgggtgatttttgacgaagtccactatattaacgacgtcgagcggggtgttgtatgggaggaggttctaatcatgcttcctgaccacgtgtccatcatactgcttagtgcaacagtgcccaatgcacttgaatttgcggattggattggtagactgaagcggcgacagatttatgtgatttccaccgtcacccggcctgtccctctagaacattacttattcacagggaatagctcaaagacccagggagagctatttttactgctggattccagaggggcttttcatactaagggatattacgctgcagtggaggccaagaaggagagaatgtcaaagcatgctcagacttttggagctaagcaaccgacccatcagggcggacccgctcaggaccgcggtgtgtacctgagtcttttagcctctctgaggaccagagctcagctacctgtggtggtctttaccttctcccggggtagatgtgatgaacaggcatcgggcctgacgtctctcgatctgacgacttcttccgaaaagagcgagatacacttgttcctgcagcgctgtctggccaggctacggggaagtgacagacaacttccacaggttcttcacatgagcgaattgctcaaccggggtctgggcgtacatcacagtggcattctgcccattctaaaggagatcgtcgagatgttgttcagccggggattggtcaaggtcctgttcgccactgaaacattcgcaatgggtgtaaacatgcctgcacgtaccgtggtatttgactccatgaggaaacacgacgggagtactttcagggatctgctgccgggagagtacgtgcaaatggctggcagagctgggcgaagaggcttggacccaaccggcactgttatcctcctgtgtaagggaagggtacccgagatggccgatttacacagaatgatgatgggcaagcccagccagttgcagagtcagttccgtctcacctatactatgatcctgaatctcttgagggtcgacgcacttcgggtggaggatatgatgaaacgtagtttcagcgagtttccatcaaggaaggatagtaaggcacatgaacaggcgttggctgagctgaccaagcggctcggtgccctcgaggagcctgacatgacgggccagctggtcgaccttccggaatactactcatggggggaagagctgaccgagacacagcacatgatacagaggaggataatggagtctgtgaacggtctgaagtcactttctgcgggtagggttgtcgtcgtgaaaaatcaggagcatcacaatgctttaggcgtcatcttacaggtttcttccaacagtactagccgcgtattcacgacactggtgctgtgcgataagccactgtcccaagatccccaggaccgcggacccgctactgcagaggtcccgtacccagatgatctggtggggttcaagttgttcctcccggagggcccttgcgatcacaccgtcgtcaagttgcagccaggcgacatggcggcaattaccacaaaagtcttgcgggtcaacggcgaaaaaatactggaagacttttcaaagcggcagcaacccaagtttaaaaaggatccgccactggccgcagtgacaaccgccgtccaggagttgctgcggctggcccaggcccacccggcaggaccccctactctggatcccgttaatgatcttcagctgaaggacatgagtgtcgtggaaggcggactgcgagccaggaaattggaagagctgattcagggggctcaatgcgtgcacagccccaggtttccagcccagtacctcaaactgagggagaggatgcagatccagaaagaaatggagcgcttgcgattcctgctgtctgaccagtcattactgctgcttcccgaataccaccagcgggtagaggtgctcaggactctgggatacgtagatgaggcaggaactgtaaagctggccggtagagttgcctgtgccatgtccagccacgagctgctcctgactgagttaatgtttgacaatgccctgtctaccctccgaccagaagagattgccgctcttctgagcggactcgtgtgtcagagcccgggagatgcgggagaccaactgcctaatacgctgaaacaaggcatcgagcgcgtacgggcagtcgctaaaagaatcggagaagtacaggtcgcctgtggtctcaaccagaccgtggaagaattcgtcggggagctcaacttcggcctggtggaggttgtgtatgagtgggccaggggcatgcccttttccgaacttgcagggctaagtggtacccctgagggcctagtggttcgctgcatacagcggctggctgagatgtgcaggagcctccgcggagctgctcggctggtaggggaacctgtgttgggcgcaaagatggagactgctgccactctgcttcgacgggacatcgtcttcgcggctagtttgtacactcaatag

SEQ ID NO: 242788 - DNA, 3741 bp, Artificial Sequence
  Description of Artificial Sequence: Synthetic coding sequence
atgatggaaactgaaagactggtgctgccaccacctgacccattggacctcccacttcgcgctgtggagctgggttgtacagggcactgggaactcctgaatctgcctggcgctccagaatcatcattgcctcacggcctacccccttgcgccccagatctccagcaggaagctgagcagctgtttcttagctcaccagcctggctgccccttcacggagtggaacacagtgctaggaagtggcagcggaagaccgacccatggagcctccttgccgtgttaggagccccagtgcctagcgacctgcaggctcagcgccacccgaccacagggcagatcttgggctataaggaagtcctgcttgaaaataccaacctatccgcaaccacctccctctccctccggagacctccgggacctgcctctcagtcactttgggggaatccaacccagtaccccttctggccaggtggcatggatgagccaactattacagatctgaacacaagagaagaagcagaggaggaaattgactttgaaaaagacctgcttacgattcccccagggttcaagaaaggtatggatttcgcgccaaaggattgccccacgcccgcaccaggattgctgtccttgtcttgccttcttgagccactggacctcggcggaggcgacgaggatgaaaacgaagccgtcgggcagccagggggtcctcgcggtgataccgtttcagctagtccatgctctgccccacttgccagggcctcttccctggaggacctggtactgaaggaagcatccacagccgtctctacaccagaagcgccagagcctccctcacaggaacagtgggcaatccccgtcgacgccaccagccccgtgggcgatttttatagattgatcccgcagccagcttttcaatgggccttcgagcccgatgtatttcagaagcaggccattctccatcttgagcgccacgactccgtttttgtagcagctcatacatccgcaggcaagactgttgtggcggagtatgcaatagccctcgcacaaaagcacatgacacggactatctacacttctcccatcaaggccctctccaatcaaaaatttcgcgacttcagaaatacctttggcgacgttggactgcttactggggatgtccagctccaccccgaggctagttgccttattatgaccacagagatccttagaagcatgctgtatagtggctcggacgtcatcagagatttagagtgggtgattttcgatgaagtgcattacatcaacgatgttgagaggggcgttgtctgggaggaggtgctgataatgctcccagaccacgtgtcaatcatccttctatcagcgacggtgccaaatgcgctggaattcgccgactggattgggagactgaaacgtcgccagatatacgtgattagcacagtgacccggcctgtccctctagagcattatctgttcacaggtaattcttcgaagacccaaggggaactgttcctgctgctggactcaagaggcgctttccacactaagggctattacgctgccgtggaggccaagaaggagcgcatgtccaaacatgcgcagacatttggtgccaagcagcccacgcaccaggggggaccagcgcaggatagaggcgtatacctctcactgctcgccagcctaaggacccgggctcaactgccggtagttgtgttcaccttctcacggggtagatgcgatgagcaggcctccggcctcacctccctcgatctcactacttcctccgagaaatctgagatccatttattcttgcagcggtgcctagcccgactccgcggttccgacaggcagttgccacaagtcttacatatgagcgaacttcttaataggggcctgggtgtacatcactccggcatccttcccatactgaaagaaatcgtggagatgctcttctcccgagggctcgtgaaggtcctctttgccactgagaccttcgctatgggggtaaacatgcccgctcggactgtggtgttcgactcaatgagaaaacacgatggcagtacattccgggatctgctgcctggcgaatatgtgcaaatggctggcagagccggacgcagaggccttgatcctactgggactgtgatcctgttatgcaaagggcgagtcccagagatggccgacctgcatcgaatgatgatgggcaagcccagtcaactacagtcccagtttcggcttacctataccatgattctcaatctgctcagagtcgatgctctgcgagtggaagatatgatgaagagaagcttttcagagtttccgagtaggaaagattcaaaagcgcacgagcaggcgctggccgagttaactaaaaggcttggcgcactggaggagcccgacatgacaggccagcttgtcgacttgcccgagtattactcctggggagaggagttgaccgagacccaacatatgatccagcggcgtatcatggagtctgttaacggactcaaaagcctgtcagctggccgtgttgtggtcgtaaaaaaccaggaacaccacaacgccctcggggttatcctgcaagtttctagcaacagcacaagtagagtgttcacaacattggtcctttgcgataaacccctgtcacaggatccacaggataggggcccagccacagcggaggttccctaccctgacgacctggtggggttcaagctgttccttccggaaggcccatgcgaccatacagtggtgaagctgcagcccggtgacatggccgctattacaaccaaggtgcttagagtcaatggggagaagatcctggaggacttctcgaaacgacagcagcctaagttcaagaaggaccctcccctggccgctgtgacgacagctgtgcaggaactgctgcgactggcccaggcccatcctgccggaccccctacactggaccctgtgaacgatctgcagctgaaagacatgtcggtcgtggagggaggcctgcgcgcacgtaagctggaggaactgatacagggagcccagtgcgtacacagccctcgcttccctgcccagtatctaaaacttagagaacgcatgcagattcagaaggagatggagagactgagatttttgctgtctgatcagagtctactcctattacctgaatatcaccagcgtgtcgaggtactgcgtactcttgggtacgtcgacgaagccggaacagttaaacttgccggacgagttgcctgtgcaatgtcctcccatgaattgcttcttaccgagctgatgttcgataacgctttgtctactctgagaccggaggagatcgccgcactgttgtccgggttggtgtgccaaagcccaggtgacgcaggggaccagttacccaatactttgaaacaggggattgagcgggtgcgagctgtggcgaaaagaatcggggaagtccaagtcgcttgcggattaaaccagacagtggaagagtttgttggcgagctaaacttcggattggtggaggtagtgtatgagtgggcacggggtatgccatttagcgaattggcaggcttgtcaggcacaccggagggactggtagtgcgatgtatccaaagattggcagaaatgtgcagaagtctgcgcggagcggctagactggtgggtgagcccgtgcttggagccaagatggaaacagctgctacactgctacgtcgggacattgtgtttgcagccagtttatatacccaatag

SEQ ID NO: 242789 - DNA, 3267 bp, Artificial Sequence
  Description of Artificial Sequence: Synthetic coding sequence
atggatgaacccacaattacggacctgaatacccgtgaagaggcagaggaagagatcgatttcgaaaaagatctcctgacgatacctcccggattcaaaaagggtatggacttcgcccctaaggattgccccacacccgctccaggcctcttgagcctcagttgcatgctggagccgctggacctcgggggaggggatgaggatgaaaatgaggccgtgggacagcccggaggcccacgtggcgacaccgtgagcgcctccccttgcagcgcgccactggcacgagcctcaagcctggaagatctcgtgctgaaagaggcttcaacagcagtgagtaccccggaagcgcctgaaccgccatcacaagagcaatgggctattcctgtggacgcaacctctcctgtaggggatttttacaggctgattcctcaacccgcattccagtgggccttcgagcccgacgtgttccaaaagcaggctatcttgcatctagagcgacacgactcagtctttgtagctgcccacacaagcgccggaaagaccgtggtcgccgagtacgctattgcactcgcccaaaaacacatgaccaggacaatctacactagcccgatcaaggcattaagcaaccaaaaattccgggatttccgcaacacgttcggtgatgtcgggctcttgactggggacgttcagttgcaccctgaagccagttgccttatcatgaccacagaaatactgcgctcaatgttatatagtgggagcgatgtgatccgtgatctagaatgggtcatcttcgacgaagtacattacataaatgatgttgaaaggggtgttgtttgggaggaagtgctgattatgctccccgaccacgtctccatcatcttactgagcgcgacagtgccaaacgccctagagttcgccgactggatcggcagattgaaaagacgccaaatatacgtgatctccactgtcacgcgtcccgttccgctcgagcactacctgttcaccggtaactcctctaagacccaaggagagctgtttctgctgctggactcaaggggggcattccatacgaagggctattatgctgcagtcgaagccaaaaaagagagaatgagcaaacacgcccaaacgttcggagcgaagcagcctacacatcagggaggccctgcgcaggaccgcggagtctatctctcacttcttgccagcctaaggactcgagcccaactccccgtggtcgttttcacgttctcaagaggcagatgcgacgagcaagcctctggcctcacatccctcgatttgaccacttcaagcgagaagtcggagatccatctgttcctgcagaggtgcttagccaggctccgcggttccgatcgccagctgccccaggtactacacatgtctgaactcctgaataggggcctcggcgtacaccatagtgggattctccccatcctcaaagaaattgtcgagatgctcttctctcgaggactcgtcaaggtgctgttcgctacggaaaccttcgcaatgggggtaaacatgccagctcgcactgtggtcttcgactcgatgaggaagcacgacggttccacctttcgtgacctgcttccgggagagtatgtccagatggctggaagagctggacggagaggccttgaccccacagggacagttatattattgtgtaaaggccgtgttcctgaaatggccgaccttcatcgcatgatgatgggaaaaccttcccagctgcagtcccaattccgtttaacctacaccatgatcctgaacttactgagggtagacgcgctgcgtgtggaagatatgatgaaacggagtttttcagagtttccttcaaggaaggactccaaagctcacgagcaggccctcgccgaactgactaagaggctgggcgcactcgaagaaccggacatgactggacagctggtggatctgccagaatactactcctggggcgaggaattgaccgaaacccagcacatgatccagcggaggattatggaatccgtgaatggacttaaaagtttgtccgccggtagagtggtggtggttaaaaaccaggagcatcacaatgcactgggggtgatcctgcaggtgtccagtaactccacttcgcgcgtgtttacgactttagtcctatgtgataaacccctctctcaggatccccaggataggggacccgcaacggcagaagtcccgtatcctgacgaccttgtagggtttaaattgttcctgcccgagggcccttgcgaccacacagtcgtgaagctgcaacctggcgatatggcggcaattaccacaaaagttttgcgggtgaacggggaaaaaatcctagaagatttcagcaaaagacagcaaccaaaattcaagaaggaccctcccctggcagctgtcaccaccgctgtgcaggagctgctcaggttggcccaggctcacccagccggtccaccaaccctggaccccgtgaacgatctccagttaaaagacatgagtgtggtggaagggggtttgagggcacgaaagctggaggaactgattcaaggcgctcagtgtgtgcattcaccaaggttcccagcccaatatttgaaattacgcgaacgtatgcaaatacaaaaagagatggagcgcctgcgattcttactaagcgatcagtctctgctgcttctgcctgagtaccatcagagagtagaggtccttcgaactctgggctacgttgacgaagccggtaccgtgaaactggcaggacgggttgcgtgcgcgatgtcctcccatgaactgttgttaaccgaacttatgttcgacaatgctcttagcaccctgcgtcccgaagaaatcgcagctctccttagcgggctagtctgccagtcgcccggtgatgccggagatcagctaccaaataccctcaaacagggtattgagcgagtccgcgctgttgccaagcggataggcgaagtgcaagttgcgtgcggcctgaaccaaacggtggaggaattcgtcggcgaattgaactttggactagtagaagttgtctatgaatgggctagaggaatgcctttcagcgagctggccggactatccgggacacccgagggtcttgtggttagatgcatacagagacttgccgagatgtgcagatctctgaggggcgctgccagactggtaggcgaacctgttctgggtgcgaagatggagacagccgcaactctgctccgccgagacatcgtttttgctgcaagtctctatacccaatag

SEQ ID NO: 242790 - DNA, 3741 bp, Artificial Sequence
  Description of Artificial Sequence: Synthetic coding sequence
atgatggagacagagcgtttggtccttccaccacctgaccccctcgacctgcccttgcgcgctgttgaactgggctgcacaggacattgggaattgctgaatctgcccggagcccctgaatcctccctgccacacggcctccccccttgcgccccagatctgcagcaggaggccgagcagctctttctctcttctcccgcttggctgccactgcacggggtcgaacattccgccaggaagtggcaacgcaaaaccgacccttggagtctgctcgcagtgctgggcgctcctgtgcccagcgacttacaggcgcagcggcaccccacaactggccagattctaggctacaaggaggtgctcctcgagaacaccaatctatccgcaaccaccagcctgtctctgaggcggccacctgggcctgcttcacaatccttatggggaaaccccacccagtatcccttctggcccggtgggatggacgagccaacaataactgacctgaacacgcgggaagaggcagaggaagagatcgacttcgagaaggaccttttgacaattccaccaggcttcaagaaaggcatggacttcgcgccaaaggattgtccaactcccgcacccggactgcttagtttgagctgcatgcttgagccactggacctcggaggtggggatgaggacgaaaatgaagcagtcggacagcctggcggacctcggggagatacagtgtctgcctcaccgtgctctgcgccacttgctcgcgcatcctccctggaggacttagtgctgaaagaggcttctacggcggtctctaccccggaggctccagagccaccttctcaagagcagtgggctatccctgtcgatgccacatcccctgtgggggacttctatcgtttgattccccagccggcttttcagtgggctttcgagcctgacgtcttccagaagcaagcgattctacacttggaacggcacgattccgtgtttgtcgcggcacatacctcggctgggaagacagttgtggcagagtacgccatagcacttgcccaaaagcacatgacccgcacaatttatacttccccaatcaaggccctgtccaatcagaaattccgtgactttagaaacacatttggcgatgtgggactcttgaccggcgatgtacagctgcacccggaggcgagctgcctgatcatgacaacggagatccttcggagtatgctctactccggcagcgacgtgattcgcgacctagaatgggtgatcttcgatgaggtgcactacatcaacgacgtggagcgcggagtagtgtgggaggaagtgctgatcatgctccctgatcacgttagcatcatcctgctgtcggctaccgtacccaatgcgctagaattcgctgattggatcggtcgtctcaagcgcagacaaatttacgtcatctcaaccgttactcgtccagtgccccttgagcactacctttttacgggcaactcatccaagacccagggcgaactcttcctcttgcttgacagccgaggcgcttttcacaccaaaggctattacgccgcagttgaggccaaaaaggagcggatgtctaagcatgcccaaacgtttggagcgaagcagccaacccaccagggtggccctgctcaggatcggggagtttatctctctcttttggccagcctgcgtaccagggcacagctgcccgtggtggtattcaccttctccagggggaggtgtgacgagcaagcctcagggttgacgagcttggatctcaccacttcatctgagaaatccgagatccatttgttcctccagcgatgccttgctcggttgagggggtctgacagacagttgcctcaggtcctgcacatgagcgagttactaaaccggggtctaggtgtccaccactccggcattcttcctatcctgaaggagatcgttgagatgctgttttctcgcggactcgtgaaagtcttgttcgcgacggaaacattcgccatgggcgttaatatgcctgcgagaactgtggtcttcgacagcatgaggaagcacgatggatccacattccgagaccttcttcctggtgagtatgtgcagatggccggtagagcaggccgtaggggcctcgatcccactgggacagtcattctgctctgcaaaggtcgagtgccagaaatggccgatctccaccgaatgatgatgggcaagccctcccagctgcagagccaatttcgcctgacatacacaatgatcctgaatctcctgcgggtggatgccctgcgtgtggaggatatgatgaaaaggagcttcagtgaattcccttcgcgtaaggattctaaggctcatgagcaggcgctggccgaactgacaaagcgacttggtgcactggaagaacccgacatgactggtcaattggtcgatttaccggaatactacagttggggggaggagctgactgagacacagcatatgattcagcgtcgcatcatggagtcagttaatggcctgaaaagcttgtccgccggaagggtcgttgttgtgaagaaccaggagcatcacaacgcattgggtgtgatcctgcaggtctccagcaatagcacctcgcgcgtcttcactacactggtactgtgtgacaaacccctgagccaggacccccaggacaggggacctgctaccgccgaggtcccctatcctgacgacctcgtggggtttaaactgttccttcccgagggtccgtgtgatcatacagtagtaaaactgcagccaggggatatggcggctatcacaacgaaagtcctgagagtgaacggagagaagatccttgaggacttctctaagcgccagcagcctaagtttaagaaagatccacctctcgccgcagtgacaacagctgtgcaggaactgctacgtctcgctcaggctcatccagcaggtcccccaactctcgacccagtaaatgatctccagctgaaggatatgagtgtcgtcgaaggcggactgcgggctcgcaagctagaagaactgatccagggagctcagtgcgtgcattctccacgcttcccggcacagtatctcaagctgagagagagaatgcagattcaaaaagaaatggagcgactgaggttcctgctctccgaccagagtttgctactactgcctgaataccaccagcgggtagaggtgttaaggactttggggtacgtggacgaggctggtaccgttaagttagcagggagggtagcctgcgccatgagctcccatgagctgctgctgacggaactcatgttcgataacgccttgagtacgctcaggccagaggaaatagctgctctcctgagcgggctcgtctgtcagtcgcccggagatgcaggcgatcagctccccaacacactcaaacagggtatcgagcgagtccgggcagtcgcaaagcgtattggcgaggtgcaggtggcctgcggattgaatcagactgtggaggagttcgttggggagctcaattttggcctggtagaggtagtttacgaatgggctcgagggatgcccttctcagaattggccggactgagtgggacaccagaggggctggtcgtgcggtgtatccagcggctagcagagatgtgccgttctctgagaggcgcagccagactcgtgggcgagcccgtgctgggagccaaaatggagacagccgctactctgctgcggagggacatcgtttttgctgcctcgctatatacgcagtag

SEQ ID NO: 242791 - DNA, 3162 bp, Artificial Sequence
  Description of Artificial Sequence: Synthetic coding sequence
atggacttcgctccaaaggattgtcctacccctgccccaggcctcctttccctgtcttgcatgctcgaaccccttgaccttggcggtggtgatgaggatgagaatgaagctgtgggacaacccggaggcccaagaggggacactgtctctgcttccccttgcagtgctccccttgcgagggcaagtagcctggaagacctggttctcaaagaggcctccactgctgtctctacaccggaggctcctgaaccaccatcgcaagaacagtgggccatcccggtagacgccacctctcctgtgggggatttctatcggttaatcccgcagccggcattccagtgggcctttgagcccgatgttttccagaagcaggccatcctccacctagagaggcacgattccgtgtttgtggccgcacacacctctgctggcaaaaccgtcgtcgctgaatatgcaatagccttagcacaaaaacatatgacgcgcacgatctacaccagccccattaaagcactcagcaaccagaagttccgggacttcagaaatacgttcggggatgtcggcctgctgactggggacgtgcagcttcacccagaagctagctgtctgatcatgactaccgagatactgagaagcatgctgtattcaggaagcgatgtgatccgtgatctggagtgggtgatatttgatgaagtgcactatatcaatgatgtagagaggggtgttgtgtgggaggaggtgcttatcatgttgccggatcacgtctcaatcatcttactgagcgcgacagtacctaatgcgttggagtttgctgactggatcggcaggctaaaaagaagacagatatacgtaattagcacagttactcggcctgtgcctctggagcactacctgtttaccggcaactcctccaaaacacagggggagctttttctcttgctggattctagaggggcttttcacacgaaggggtattacgctgcagttgaagcaaagaaagagagaatgtctaagcacgcccaaacattcggagctaaacaacccacacaccaggggggacctgctcaagaccggggagtatacctgagccttttagctagcctccgtacgagggcacagctgccagtagtcgtcttcacatttagccggggaaggtgcgacgagcaggcttcgggattaactagtctggatctcacaaccagcagcgaaaaaagtgaaatccatctgtttctgcagcgctgcttggccagactgaggggcagcgacagacaacttccacaggtattgcatatgagcgaattgctcaaccggggtctgggcgtgcatcactctggcattctcccaattttgaaggagatcgtggagatgctgttcagtcgtgggttggtgaaggtgctttttgcaactgaaaccttcgccatgggagtgaatatgcctgccagaactgtcgtgttcgattccatgaggaaacacgacgggagtacattcagggacttgttgcctggtgaatacgtccagatggcgggtagggccggtcgacgaggtctggatccaacgggtactgtgatcctgttatgcaaaggaagggttcctgaaatggcagacctgcaccggatgatgatggggaagccttcacaattacagtcacaattcagactgacgtataccatgatcctaaacctgctcagagtggatgccctgcgcgttgaagacatgatgaaacgctcctttagcgaattcccatcacggaaggacagcaaagcccacgagcaggcgctggcggagctgactaaacgtttgggtgccttggaggaaccagacatgacaggccagctggtagacctgcctgagtactacagctggggagaggaactcacagagacacagcatatgatccagcgaagaattatggagtcagtgaacggcttgaaatccctgagcgccggtcgcgtggtcgtagtcaagaatcaagaacaccacaacgcactgggggttattctgcaagtgtctagtaactccaccagcagagtgtttaccaccttggtgctgtgtgataagcctctgagccaggatcctcaagacagagggcctgccacagccgaggtgccatatccagacgatctcgtggggtttaagctatttctgcccgagggcccttgcgaccacactgtcgtcaagcttcagcccggtgatatggccgctattaccacgaaggtcctcagggtcaatggcgagaagattcttgaggacttctccaaacgccagcagcctaaattcaagaaggatccacctctggctgctgtgactacagcagtgcaggagctgctacgcctcgcccaggcccatcccgcagggccacctacactggatcccgtcaacgatctgcagctcaaggatatgtctgtcgtagagggtggacttagggcccgaaaactggaggagttaatccagggcgcacaatgcgtgcacagtccacggtttcccgctcagtaccttaaacttcgtgaaaggatgcagatccagaaagaaatggagcgcctgagattcttgctgtcagatcagtcattgctcttgttgccggagtatcatcaaagagtggaggtgctcaggactctgggatatgttgatgaagcaggcaccgtcaagctggcgggacgcgtggcatgtgccatgtcctctcacgaacttctgctcacagagctgatgtttgacaacgccctttccacattaaggcccgaggagatcgcagctctgctatctggccttgtgtgtcagtcccccggtgatgctggggaccagttacccaataccttaaagcaggggattgagagagtaagagccgtggcgaaaaggattggggaggtgcaggtcgcttgcgggctgaatcagaccgtggaggagtttgtaggcgagctgaactttggacttgtggaagtcgtctatgaatgggcccgagggatgcccttctcagagctcgcaggtctatcaggcaccccggaggggctcgtggtacggtgtatccaacgactcgcagaaatgtgccgctctctgcgaggtgcggctcgcctggttggtgagcctgttctgggtgcaaaaatggaaacagccgcaactttattacggagggacattgtgttcgccgcttccctttatactcagtag

SEQ ID NO: 242792 - DNA, 3162 bp, Artificial Sequence
  Description of Artificial Sequence: Synthetic coding sequence
atggattttgcacccaaagactgtcctaccccggctcctggcctcctatcactgtcttgtatgctcgaaccgctcgacctgggtgggggagacgaggacgaaaatgaggcggtaggccagccagggggaccaaggggagacactgtctccgcgagcccctgcagcgcacccttagccagagcctcatccctggaagacctcgtgttgaaggaagctagtaccgccgtatcaacccccgaggcaccagagcctccctctcaggaacagtgggccatccccgttgatgccacatcaccggtgggcgacttttaccgtctgatcccccagcctgcctttcagtgggctttcgagcctgacgttttccaaaagcaggcaattctgcacttagagagacatgactccgtgtttgtcgctgctcatacttccgctggcaagaccgtggtggctgaatacgcgatcgctctggctcaaaaacatatgacccggacgatctatacaagtccaatcaaagcacttagcaatcagaaattccgagattttcgcaacacatttggagatgtgggcctgcttactggcgacgtgcagctgcacccagaggcctcctgcctgataatgactactgaaattctacgctctatgctctacagcggatcagatgtgattagagacctggagtgggtcatcttcgacgaagtgcactatatcaacgacgtggaaaggggagtcgtgtgggaagaagtgctgattatgctgccggatcacgtaagcattatcctactgagcgccactgtcccaaatgccctcgagtttgccgattggattggcagattgaaacggagacagatctatgtgatctcaaccgtgactagacctgtccccctcgagcactatctgttcactgggaacagttctaaaacccagggagagctgttcctcttgcttgactcccggggtgcttttcatacaaaagggtactatgccgctgtagaagccaaaaaagagcgcatgtctaagcatgctcagacctttggggcaaagcagcccactcaccagggaggtcccgcacaggataggggagtgtacctgagcctgctcgcctcactaagaacacgcgctcaactgcccgtagtcgtatttactttctccagaggacggtgtgatgagcaggcttcaggtctcacctcattggatctgaccaccagctctgaaaagagtgaaattcacctcttcttacagaggtgtctggctcggctgcggggatcggacagacagctccctcaggttttgcatatgtccgagctgctgaatcgcggattgggggttcaccatagcggaatcctgccaattttaaaagagattgttgagatgcttttttcacggggactggttaaagttctttttgctactgaaaccttcgcgatgggggttaatatgcccgctaggactgttgtatttgactccatgcggaagcacgacggttcaacttttagggacctactacctggggagtacgtgcagatggcaggcagggcgggacgcagagggttagaccctacaggaactgtgattctgctctgcaaaggcagggtgcctgaaatggcggatttacatagaatgatgatgggcaagccatctcagttgcagagccagttcagactaacttatacaatgatcctgaatctgttaagagtcgatgccttacgtgtcgaggatatgatgaagcgttccttcagtgaatttccttctaggaaagatagtaaggcacatgaacaggccctggctgagctgaccaagcggctgggagcccttgaagagccagacatgactggtcagctcgtggacttgcctgagtactattcttggggcgaggaactcactgagacccaacacatgattcagcgtcgcattatggagtctgttaacggactgaaaagcttgagcgccggacgagtggtggtcgtgaaaaaccaagagcaccacaacgcgctcggcgtcatattacaggtgtctagtaactctacttccagggttttcaccaccctggtcttatgtgataagccacttagccaagatcctcaagacagggggcctgccacagcagaagtcccttaccctgatgaccttgtgggtttcaagctcttcctgcctgaagggccatgtgaccacaccgtggtgaaactgcagcctggagacatggccgctattacgacaaaagtgctacgggtcaacggcgaaaaaattctagaagactttagtaaaagacagcagcctaagttcaaaaaagacccccctctcgctgcagtgaccactgccgtgcaggaactgctccgcctcgcccaagcccatcccgctggccctccgaccctggatccagtcaacgatctgcagcttaaggacatgtctgtggtcgaggggggactccgggcacgtaaattagaagaactgatacagggcgctcaatgcgtacacagccctaggtttcctgcccagtacctaaaactgcgcgagcggatgcagatccaaaaggagatggagcgcctccgctttttactgtccgaccagtccctactgttgctgcccgaataccatcagagggtggaggtcctgcgcactttaggatacgtggatgaggccggaacagtcaagcttgctggtagagtggcatgtgcaatgtcctctcatgaactgcttctgaccgagctaatgttcgataacgccctctcaacgctccgacctgaggagatcgccgctctgctcagcggactcgtctgtcagtcccccggagatgccggagaccagctgcctaataccctcaaacagggcattgaaagagtgcgagctgtcgcaaagaggattggtgaagttcaagtggcctgtggactcaaccagacggtggaagagttcgtcggcgaattgaatttcggcctcgtggaggtggtgtacgagtgggccaggggcatgccatttagcgagctcgctggacttagcggaacaccggaggggttagtggtcaggtgtattcagaggctggcagagatgtgcaggagcttacgcggtgcggcacgcttggtcggtgaacccgttctgggcgctaagatggagactgccgcaacccttctgaggagggacattgtcttcgctgcaagtctttacacccagtag

SEQ ID NO: 242793 - DNA, 693 bp, Artificial Sequence
  Description of Artificial Sequence: Synthetic coding sequence
atgatggagactgagaggctggtgctccctcctcctgaccctttggatctgcctctgagggccgtggagctggggtgcaccgggcactgggagttgctgaacctgcccggagctcctgagtcttcgcttccacatggcttgcccccttgcgccccagacttgcagcaggaggccgaacaattatttctgtctagtcctgcatggctgcccctgcacggcgttgaacattccgcaagaaagtggcaaaggaagacagatccctggtcactgctggccgtccttggtgctccagtgccctccgacctgcaggcacagagacacccgaccacagggcagatccttggctacaaggaggtgctgttagagaacactaacctatctgccactacttccctcagcctgaggaggcctccaggaccagcatctcaaagcctatggggaaaccccacacagtaccccttttggcctggtggcatggatgagcccactatcacggacctgaacacccgtgaagaggctgaggaggaaattgactttgagaaagatttgctgactataccacccggtttcaaaaagggaatggatttcgctcccaagggttctgtccatagttgtatacatcctcggggacctagggcttctatttctggagccgtaggccatccgtgcggtagacacctgccctgctggtag

SEQ ID NO: 242794 - DNA, 3267 bp, Artificial Sequence
  Description of Artificial Sequence: Synthetic coding sequence
atggatgaacccactattaccgatctgaacactagggaagaagctgaagaagaaatcgatttcgagaaggatctgctgaccatccctccaggcttcaagaaaggcatggattttgcccctaaagattgcccaacacccgctcccggactgctctcactgtcctgcctgctcgaacctctggatctcggtgggggtgatgaggatgagaacgaggccgtaggacagcctgggggaccaaggggggatactgtaagtgcatctccatgttcggcacctctcgctagagccagttcactggaagatttggtgctcaaagaagcctctacagccgtgagtactccagaggccccagaacctcctagccaggaacagtgggctattccagtggatgcaacaagcccagtgggtgacttctatcgtcttatcccccagccggctttccagtgggcattcgagcctgacgtcttccaaaagcaagcaatcctgcaccttgagcggcacgacagcgtgtttgtggccgcacacacatccgctgggaagacagtcgtcgccgaatacgctattgccctggcccagaagcacatgactagaacgatctacactagcccaatcaaggcattgtccaatcaaaaattccgggatttccggaacacttttggggacgtcggtcttcttacgggggatgttcagctgcaccccgaggcgagctgcctcataatgacgacagaaatcctaaggtccatgttgtacagtggctcggacgttatacgggatctggagtgggtaatcttcgacgaagtgcactacataaatgatgtggagaggggcgttgtgtgggaagaagtcttgatcatgctcccagatcacgtgagcatcatattactgtccgccacagtgcctaacgcactggaatttgcagattggattggcagactgaagaggcggcagatttacgtgatatccaccgtgacccggcctgtaccactggagcactatttatttacagggaatagtagcaaaacacagggtgagcttttcttgctgctggattctcgcggtgcgttccatactaagggatattacgccgcagttgaggcaaaaaaagagagaatgtcaaagcatgctcaaacattcggagcaaaacaacctacacatcaaggcggtcctgcacaggaccgtggggtgtacttatcactcctggcgagcctccgcacgcgggctcagttgcctgtagtggttttcacattttctcggggaagatgcgacgagcaggctagcggccttacttccctggatctgacaacctcctcagaaaaatccgagatacacctttttctacagcgctgcttagccaggctgaggggttcagacaggcagctaccgcaggtgctgcacatgtccgaattactcaatcgaggtctaggcgtgcaccactcaggcatactgcccattctgaaagaaatcgtcgagatgcttttcagcaggggcctggtcaaagtgctgtttgccactgagacctttgccatgggagtcaacatgccagcaaggactgtggtattcgactcgatgaggaagcacgatggatctacctttcgagatctactgcctggcgagtatgtgcagatggccggtcgcgctgggcgacgcggattggatcccacagggaccgtcatattgctctgtaaagggcgtgttccagaaatggcagacttgcaccggatgatgatgggtaagccatcccagcttcagtcacagttccggttgacctacacaatgattcttaatctgctaagagtggacgctctccgcgtcgaagatatgatgaagcgctccttctctgaatttccaagcaggaaggatagcaaagcccatgagcaggctctcgccgagcttaccaagcgactcggagctttggaagaaccagatatgactggccagctcgtcgacttgccagaatattacagttggggggaggagttgactgaaacccagcatatgatccagcggcgaatcatggagtccgttaacggccttaaatccctctccgccggtcgagtagttgtggttaaaaaccaggagcaccataatgcactgggagtcatactgcaagtgtccagcaacagtacttctcgtgttttcaccacccttgtactttgcgacaaacctttatcccaagacccgcaggacaggggtccagcaaccgctgaagtgccgtatcccgacgacctcgtgggatttaagctgttcttgcccgagggcccttgtgatcacactgttgtgaaactccagccaggagatatggcagctattactaccaaagttctccgtgtcaatggcgagaaaatcctggaggatttttcaaaacgccaacagccgaagttcaagaaagatcccccattggctgccgtgactactgcagtccaagagttgttgaggctggcacaagcccacccagctggtccgcctactttagacccagtgaacgacctgcagctcaaggacatgtctgtggttgagggcggtcttagggcaaggaagttagaggagctaatacagggggctcagtgcgttcactccccccgttttcctgcccaatatcttaagttacgcgagcgcatgcaaattcagaaagagatggagagactacggtttctgctatctgatcaatcactattactgttacccgaataccatcaacgcgtggaggttctcaggacactgggctacgtggacgaagcagggacagtcaagctggccggacgggtggcttgtgcgatgagctcacacgagttactgctcacagaattaatgtttgacaatgccttgtccacgcttagacccgaagagatagctgcgctgctgagcggcctggtgtgtcagtcccccggagatgcaggggatcaacttcccaatacactgaagcagggcatagagagggtcagagctgtggcaaagagaatcggagaagtgcaggtagcatgtggcctcaaccagacggtggaggaatttgttggggagctgaactttggcctggtcgaggttgtgtatgagtgggccaggggtatgccattcagcgagctggccggtctgtcgggaacccccgagggtttagtagttagatgtattcagcggttagccgagatgtgtaggtcattaagaggcgcagcgcgactggtcggagaacccgtattgggggcaaaaatggagacagccgcaacactcctgaggcgcgacattgtgttcgccgcatccctgtatacccagtag

SEQ ID NO: 242795 - DNA, 3162 bp, Artificial Sequence
  Description of Artificial Sequence: Synthetic coding sequence
atggattttgctcccaaggactgtcctacgccggctccaggcctgctctccctgagttgtctcctggaacccctggacttgggtgggggagatgaggacgagaacgaggctgttgggcagcccggaggcccacggggtgatactgtcagcgcgagtccctgctctgctccactcgccagggcgtcctccctcgaggacctggtactcaaggaagcgtccactgcagtctcgacccctgaggcacctgaaccaccttctcaggaacagtgggccattcccgtggacgccacatcccccgtaggggacttctaccgccttattccgcagccagccttccagtgggcctttgaacctgacgtgttccagaagcaggctatactccatctagaaagacatgacagcgtatttgtcgcagctcacacatctgccggtaaaactgtggtcgctgaatacgccatagctctcgctcagaagcatatgacacggacaatctatacgagtccaatcaaggctttgagtaaccaaaagttccgggactttaggaatacttttggagatgtgggcctcctgacaggcgatgtgcagctccaccccgaagcctcctgcctcataatgacaactgagattctgcggagcatgctctatagtggaagcgatgtcatccgagacctggaatgggtcattttcgatgaggtgcactacatcaacgacgtagaacgtggagtagtctgggaagaagtcctgataatgctgccagaccatgtctccatcatccttctgagtgccaccgttcctaatgcgctggagtttgcagactggatcggtcgtctgaagcggcgtcaaatctacgtcatcagcaccgtgaccaggcccgttcctctggaacactacctgttcaccgggaactctagcaagacgcagggggagcttttcctgctgttagacagcagaggagcatttcacacaaaaggttactacgccgctgtcgaggccaagaaagagagaatgtctaaacatgctcaaacgttcggagctaaacagcctactcaccagggtggcccagcacaggatcgaggcgtttacctgagccttctggcctcattaaggacccgtgctcagctgccagtggtggtattcaccttctcgagggggagatgcgatgaacaggcgtcaggactgaccagcctcgacctcacaacttcttcagagaaaagcgagatacacttatttttgcagaggtgcctcgctagactgagaggttcagaccgccagctgcctcaagtgcttcacatgagcgaactcctgaacagaggactgggagtccaccactccggcattctccctatcctgaaggaaatagtcgagatgctgttcagtcgcggactcgtgaaagtgttgttcgcaacggaaaccttcgccatgggcgttaacatgccagcccgtaccgtagtgtttgatagcatgagaaaacatgatgggtctacctttcgcgatctgctgcccggtgagtacgtgcagatggcaggcagggcgggaaggcggggacttgatcccaccggtactgtcattttgttatgtaaaggacgggtaccagaaatggccgatctccatcgtatgatgatgggaaaaccttcccagctgcagagccagtttagactgacatatactatgatccttaacctcctgagggttgatgccctgagagtagaagatatgatgaagcgaagtttctcggagttcccgtcccgaaaggatagtaaggcccatgagcaagcacttgcagagttaaccaagaggcttggtgcactggaagaacctgacatgacgggacagctcgtggacttgcctgagtattattcatggggagaagagctcaccgaaacccaacatatgatacagaggcgcatcatggagtccgttaacggcctcaagagtctgagtgccggaagagttgtcgtcgtgaagaatcaggaacaccataacgctcttggagtgatccttcaggtgagctccaattccacgagtagggtctttacaacactggtcctgtgcgataagccactctcccaagatcctcaggacaggggcccagctaccgctgaggtcccatacccggacgacctcgtgggcttcaaactttttctgcctgagggaccgtgcgaccacacagtagtcaagctccagccgggagacatggcggctatcactactaaggtgctcagagtgaacggcgaaaagatcttagaggatttctctaaacggcagcagcccaagttcaagaaagaccccccactggctgccgtcacaaccgcggtgcaggagctgctgagactggcacaggctcaccccgctggtcccccaaccctggaccctgtgaatgacctacagcttaaagatatgtccgtggttgaggggggattgcgagctaggaagttggaggaattaatccagggggcacagtgcgttcatagccccagattcccggcacagtacctgaaactcagggagcgcatgcagatccagaaagaaatggaacgattgaggtttctgctgagcgaccaatcacttctgttgctgccagaatatcaccaaagggtggaagtgctgcgcaccctggggtatgtggatgaagccggaaccgtcaaacttgcaggcagggtggcctgcgccatgagttcacacgagctgctgctcacagagctcatgttcgacaatgcccttagtacgctgcggccagaagaaatagctgcactgctctccggcttggtctgtcagtcgcctggagacgcgggtgaccagctgcccaacacactaaaacagggcatagagcgcgtacgcgcagtggcaaaaaggatcggcgaggttcaggtggcatgtggtctgaatcagactgtggaagagtttgtgggagagctgaactttggtctcgtggaagttgtgtatgagtgggccaggggtatgcctttcagcgagcttgcaggactctctggtacccccgagggcctggtggtgcgttgtatccagagactggccgaaatgtgccgctctctgcgcggagccgctcggctcgtcggagagccagtgttgggggctaagatggagacagcagcgaccctgctaagaagagatatcgtctttgcagcgagcctgtacacacaatag

SEQ ID NO: 242796 - DNA, 2643 bp, Artificial Sequence
  Description of Artificial Sequence: Synthetic coding sequence
atgatggagactgaacgcttagtcctgcctccccctgatcccttagacctgccccttcgggcagtggaattaggctgcacaggtcattgggaactgttgaatctgccaggtgccccagagtcctcacttccccatgggttgccgccatgcgcccctgacctccagcaggaggctgaacagctgtttctgtcttcaccagcttggctgcctctgcacggcgttgaacattcagctcgaaagtggcaaaggaaaactgacccctggtcactgctggccgtgctgggggctccagttccgtccgatttacaagctcagagacatcctaccacgggccaaattttggggtacaaagaggtgctacttgagcactatctgttcacagggaatagttcaaaaacacagggtgagctctttttactgctggactctcgcggagcttttcacacaaaaggctactatgctgcggtggaggctaagaaggagcgcatgtctaagcacgcccaaacctttggagcaaagcaacctacacaccaaggtggaccagcacaggaccgaggagtctacctaagcctgctggccagtctcagaaccagagctcaactcccagtggtcgtatttacattttcccgcggaaggtgtgatgaacaggcatccgggctaaccagcttggatctcacaaccagtagcgaaaagtctgagatccacctgttcttacagcgctgcctcgctaggctccgaggcagcgacagacagttgccacaggttctccatatgtctgaattgctgaataggggtttgggagttcaccattcgggaatcctcccaatcttgaaggagattgtcgagatgctgttttctaggggcctggtgaaagtgctattcgccacggagacgtttgctatgggagtcaacatgcctgctaggacagtcgtattcgattccatgcggaaacatgacgggtctacctttagagacttgctgcccggagagtacgtccagatggccggacgggctggacggcgaggattagatccaaccggcacggtaattctcctctgtaaaggacgagtgcccgagatggccgatctgcacagaatgatgatgggcaagccgagccaattgcagagtcagttcagattaacttatacaatgattcttaatttactccgcgtggacgcactacgggtagaggacatgatgaagcgttcctttagcgagtttccctcgaggaaggactctaaggctcacgagcaggccctggccgaactcacaaagcgcttgggcgcactggaagaaccagatatgacagggcaactggtggatctgcccgagtactattcatggggcgaagagttaacagagacacaacacatgatccagaggcgaattatggagagcgtgaacgggctaaaaagcctgtcggctggacgcgtagtcgtggtgaaaaatcaagagcatcataatgcgttgggcgtcattctgcaggtttcatctaactcaacaagcagggtcttcactaccctcgtgctgtgcgacaaacctctgagccaggatccccaagatcgcggacctgctacggccgaagtgccatatcccgatgatctggtggggtttaagctgtttcttcctgaaggcccttgtgaccacaccgtggttaagctacagccaggagacatggcagccattacaacaaaagtcttacgggtcaatggggagaagattttggaggatttctccaaacgacagcagccaaagttcaagaaggaccctccactagccgcagtgaccaccgcagtacaggagcttctaagacttgcacaggcacacccagctggcccacccactctagatcctgttaacgatcttcagctgaaggatatgtctgttgtggagggcggtcttagggccagaaagctggaggagctcattcagggggctcagtgcgtacactccccacgcttccccgctcaatacctgaagctgagggagagaatgcagatccaaaaggaaatggaacgcctacgctttctgttgagtgatcagtccctgctccttttgccagaatatcaccagcgcgtggaggtccttcgaaccctcggctacgtggatgaggcgggaactgtgaagctcgccggtagagtggcttgcgctatgtcttctcacgaattactgctgactgagcttatgttcgataatgctctgtccacactccggccagaagagatcgctgcactgctctctgggctagtttgtcagtcccccggagatgctggtgaccagctgccaaacactttgaagcaaggcattgagcgagtgagagcggtggcaaagcggattggggaggtgcaggtggcttgcgggctcaatcagacagtcgaagaattcgtgggcgaattaaatttcgggcttgttgaagtcgtttatgagtgggccagagggatgccattctctgaattggccggtttgtctgggaccccagagggattggtggtgcgttgtatccagcgcctggcagagatgtgtcggagtctcagaggggctgcaaggttggtgggtgagcctgtgctcggcgcaaaaatggaaacggccgctacgttgttacgccgtgatatcgtgtttgcagcaagcttatatacccagtag

SEQ ID NO: 242797 - DNA, 3267 bp, Artificial Sequence
  Description of Artificial Sequence: Synthetic coding sequence
atggatgagcctacaatcaccgatctcaacactagggaagaggccgaagaagagatcgattttgaaaaagatctcctgaccatcccccctgggttcaagaagggtatggatttcgcccctaaagactgcccaacccctgccccaggtctactctcactgtcttgtttgttggagcctttggacttggggggtggcgacgaggatgagaacgaggccgtcgggcagccgggtggacccagaggagacacagttagtgccagcccctgttccgccccattggcccgagcatcgtcactcgaggacctcgtgttgaaggaagcctcaacagctgttagcaccccagaagcccctgaacccccaagccaggagcagtgggctatccccgttgatgcaacctctccagtgggcgacttttatcgacttattcctcagcccgcattccagtgggcttttgagcccgacgtcttccagaaacaggctatcctccacctggaacgacatgactcggttttcgtggccgctcacacctctgcgggtaagaccgtggttgctgaatatgctatcgctcttgctcagaagcacatgacccgcaccatatacactagcccgatcaaggctctgagcaatcagaagttcagagattttcgaaacactttcggcgacgttggcctcctcacaggagatgtgcaactgcaccctgaggcgagctgcctgattatgaccaccgaaatactcaggagtatgctctactcagggtcagatgttatccgcgacttggaatgggtgattttcgacgaggttcattacattaacgatgtggagagaggagttgtgtgggaggaggttcttattatgctgcccgaccacgtctcaataatcctgctgagcgccacagttccaaatgctttggaattcgcggactggattggaaggcttaagcgcaggcagatctacgtcatttcaactgtgactagaccagtgcccctggaacattatctttttacgggtaatagctccaagacccaaggggagttattcctgctgctggacagcaggggcgcattccatactaaaggatactacgccgcagtggaggctaagaaagagcggatgagcaaacacgcccagactttcggagcgaagcagccgacacatcaaggcggtccagcccaggacagaggtgtgtatttgagcctgctcgcgtccctcaggacgagagcccagttacctgttgtcgtgttcaccttctcgcgaggtaggtgcgatgagcaagcttctgggctgacatctctcgacctgactacatccagtgaaaaatctgagattcacttatttctgcaacggtgcctggcaagactccgcggatctgaccgtcagcttccgcaagtgctccacatgagcgaactactgaaccggggactgggggttcatcacagtggcatcctgcctattttgaaggagattgtcgagatgcttttctcccgcggattggtgaaggtgcttttcgccactgagacattcgcaatgggcgtcaacatgcctgcacgcactgtggtcttcgatagtatgaggaagcatgacggaagtacatttcgcgatttactacccggtgagtacgtgcagatggccggtcgcgctggaaggcgaggcctggatcccacaggtactgtcatacttttgtgcaagggccgagtgcccgaaatggccgatctgcaccggatgatgatgggaaaacctagccagctgcagagccagtttaggctgacttacacgatgatactgaatttgctgcgggtggatgcgttgagagtcgaggatatgatgaaacgttcttttagcgagttcccctccaggaaagacagcaaagctcatgaacaggcactggccgagttgaccaagcgactgggggctttagaggaaccagacatgaccgggcagctggtggatttgccagagtactactcctggggagaggaactgaccgagacccagcatatgatacagcggcgaatcatggaatccgtaaatggcctaaagtccctgagtgcgggtcgggtcgtggttgtcaagaatcaggagcatcacaacgctctgggcgtcatcctgcaggtttctagcaactcgacctcaagggtgttcacaacactcgtactctgtgataagcccctctctcaggatccccaagataggggcccagccaccgccgaggtgccatatcccgacgacctcgtcggtttcaaactgttccttcctgaaggaccttgcgatcataccgtcgttaagctgcaaccgggagacatggccgctatcactacgaaggttttaagagtgaacggcgagaagatactggaggacttttccaagcgacaacaacctaaattcaaaaaagatccaccgttagccgcagtgactacagctgtgcaagagttactgagactggcccaggcccaccccgctggcccacctaccctggaccctgtgaatgaccttcaactgaaggacatgtctgtcgtggaaggcggtcttcgagcccgaaaacttgaggagttgatacaaggtgctcagtgcgttcactccccgagattcccagctcaatatctgaagttgagagaacggatgcagatccaaaaagagatggagagactcaggtttctcctcagcgaccagagtttattgctgctcccagaataccaccaacgtgtagaagtactcagaacactgggctacgtggacgaggccggaaccgttaagctggcgggtagagtagcctgtgcaatgtcttctcatgagcttttgctgactgagctgatgtttgataacgcactatccacgttgcggccagaagagatcgccgctttgttgtccggtctggtgtgtcagagcccgggagacgccggagatcagctgccaaacaccctgaaacaaggaatcgagcgggtgagggccgtagcgaaacggatcggagaggttcaagtggcttgtgggctgaaccagactgttgaggagtttgtgggcgagctcaattttgggttggtggaagttgtgtacgagtgggctagaggtatgcccttctccgaactggctggcctttcgggaaccccagaaggtttggtggtcaggtgtatacagaggctagctgagatgtgcaggtctttaaggggggcagcacgattggttggagagcccgtcttgggagcaaagatggaaacagcggctaccctgctgaggagagatatcgtcttcgctgcgagcttatatacacagtag

SEQ ID NO: 242798 - DNA, 2643 bp, Artificial Sequence
  Description of Artificial Sequence: Synthetic coding sequence
atgatggaaaccgaacgccttgtattaccaccccctgacccattagacctgcccctgagagccgttgagttaggctgcactgggcactgggagctcttgaacctgcctggagctcctgaatcttctttgccacatgggctgcctccatgtgcgcctgacctccagcaggaagccgagcagctctttctaagcagccctgcatggctccctctacacggtgttgagcactccgcaaggaagtggcaaagaaaaacagacccctggtctctgctagccgtactgggagcccctgtgcctagcgacctccaggctcagcgacatccgacaacgggccagatcctgggttataaggaagtgttgttggagcactacctctttaccggtaactccagtaagactcaaggtgaattgttcctcctgctggatagccgaggtgcctttcataccaagggttactatgctgcggtggaggcgaaaaaagaacgcatgagtaaacacgcgcagacatttggcgctaagcagcctacacatcagggtggtcccgctcaggatcgaggagtgtatctctccttattggccagcctgcggactagggcgcagttgccagtcgtggtctttacgttttcccgaggtcggtgtgacgaacaggcttcagggcttactagtctggacttaacaacaagcagcgagaagtcggaaattcatcttttcttgcagcggtgcttagcccgactccgcggatctgaccgccagctccctcaagttctgcacatgtcagaacttcttaatagaggcctcggggtgcatcacagcggcatccttcccattttgaaggagattgtcgagatgcttttttcaagagggttggtgaaggtcctcttcgctacggagaccttcgcaatgggcgtaaatatgcccgcacgaaccgtggtgtttgattccatgagaaagcacgacggttccacctttcgcgacctgcttcccggtgagtatgtccagatggccggtagggcagggaggagaggtcttgatcctactggcaccgtgatcttgttgtgtaagggcagggtgcctgaaatggccgatctgcaccgaatgatgatgggcaaacccagccagctgcagagccaattcagactcacttacacaatgattctgaatctactcagggtggatgccttgagagtggaggatatgatgaagaggtccttctctgaattcccatcaaggaaagacagcaaggcacatgagcaggcccttgcagagctcacaaagcggttgggagccctggaggagcctgacatgacaggtcagttggtggacctccccgaatattattcatggggcgaggaactgactgagactcagcatatgatacagcggaggattatggagagcgtaaatggtctcaagtctctttcagcgggacgcgttgttgtggtgaagaatcaggagcaccacaacgctttgggggtgatccttcaggtgtccagcaattccacatctcgcgtatttactactctggtgctctgcgacaagccacttagccaagatccccaggacagggggccagccactgcagaagtaccttacccagacgatctggtgggatttaagttgttcttgcccgagggtccctgcgaccacacagttgttaagttacagcccggagacatggcggctataaccacgaaggtgttacgagtaaacggggagaagatcctggaggacttcagtaaacgccagcagccgaaatttaagaaggacccacctcttgctgctgtcacaacggccgtccaggaactcctgcgcttagcacaagcccaccccgcaggtcctccaacgttagacccagtgaatgacctccagttgaaagatatgtcagtcgtggagggcggtctgagggctagaaagctagaggagctcatccagggagcccagtgtgtccactcccctaggttcccagcacagtatctgaagctccgagaacggatgcaaatccagaaggagatggagagattacgtttcttgctgtccgaccagagccttttactccttccagagtaccatcagcgtgtagaggtattacgtaccctgggctatgttgacgaagcaggaactgtcaagttagcaggacgtgtggcctgcgccatgagctcgcatgaactcctgctcactgaactgatgttcgataacgccctgtcgactctccgcccagaagaaatcgccgctctgttgtctgggctagtgtgtcaatcacctggagatgcgggagatcagctccccaataccctcaaacagggtatcgagcgggtccgtgccgtcgcaaagcgcatcggtgaggtgcaagtggcgtgtggcttgaatcagacagttgaagagttcgtaggggagttgaatttcggcttggtcgaggttgtttatgaatgggccaggggtatgccattcagcgagttagccggattgtccggcacccctgaaggactggtggtgaggtgtattcagcggctcgccgaaatgtgccgcagcctccgaggtgctgctcgtcttgtgggcgagcctgtgctcggagccaagatggagaccgcagcaaccctgctgcgcagagacatcgtgttcgctgcctcactctacactcagtag

SEQ ID NO: 242799 - DNA, 2643 bp, Artificial Sequence
  Description of Artificial Sequence: Synthetic coding sequence
atgatggagactgagaggctggtcctccctcccccagatccattggatctcccactgcgagcagtggagttgggatgtaccgggcattgggagctgctgaacctccctggggctcccgaaagttcactgcctcacggtttgcctccttgcgcgcctgacctgcagcaggaggcagagcagctatttctcagctcacctgcatggctacctcttcatggcgtggagcactccgctcggaagtggcagagaaagaccgatccgtggtcactcctggccgtccttggagcaccggttccttcggacctgcaagcacagcgtcacccaaccacagggcagatcctcggatataaagaagtcctcttggagcattacctctttaccgggaacagctccaagacccaaggagagctctttctgcttctggattcgagaggagcttttcacactaaaggatattacgctgccgtggaggctaagaaggagcgtatgagtaaacatgcccagaccttcggcgctaagcagcctacccaccaggggggacctgcacaggacagaggcgtgtacctctctcttctcgcaagcctcagaacacgggcacagctgcctgtggtcgttttcacctttagcagggggcgttgtgatgaacaggcctccggtctaacgtcccttgacttaactaccagtagcgagaagtcagaaatccacctgtttttacagaggtgcctcgcacgcctgcggggtagcgacaggcagctcccccaagttttgcacatgtccgagctgctgaacagaggacttggggttcaccactcaggtatcctgcccatcctgaaagagatcgtggaaatgctgttttccagagggctcgtgaaagtactgtttgccactgagacttttgccatgggcgttaacatgcccgctcggactgtcgtcttcgattcgatgaggaagcacgacggatctaccttccgcgatctgcttccgggagagtatgtgcagatggcaggaagagccggaaggagaggactcgaccctaccggaaccgtgatcctcctgtgcaaaggcagggtccccgaaatggctgaccttcaccgcatgatgatggggaagccctcgcaattgcagtcgcagttccgcctaacgtacactatgatactgaacctgctcagagtggacgcccttcgcgtcgaagatatgatgaaacgctccttctctgagtttcctagccgtaaagactcaaaagcccacgagcaagcacttgctgagctgaccaaacgccttggagcactggaggagccagacatgacagggcagctggtcgacctgcccgaatactattcatggggcgaggagctgactgagacccagcacatgatccaacgtcgaatcatggaatcagtgaatggcctgaaaagcctctccgccggtcgcgtcgtggtggtcaaaaatcaagagcaccataacgccctgggggtgatcttgcaggtgagtagtaacagcacctcgcgtgtttttacaacactggtgctgtgtgacaagcctttgtcccaggacccacaggatagaggacccgcaaccgccgaggtcccctacccagacgacctcgttggatttaaactgttcctccctgagggcccttgtgaccacacagtggtgaaactccagccaggggatatggccgctataacaaccaaagtgctcagagtcaacggcgaaaagattttggaggacttcagcaaacgacagcaacctaaattcaagaaggatcccccattggccgctgttacaacagccgtccaggagctattgcggctcgcccaggcacacccagccggacctcctacactggaccctgtcaacgacctccagctcaaagacatgagtgtggtggaagggggtctccgggctcgcaagcttgaagagttaattcagggcgcacaatgcgtgcattctccgagattccccgcacaatatctcaaactgagggaaagaatgcagatccagaaagaaatggagaggctccggttcctcttaagtgaccaaagtctcctgctcttgccggaatatcaccagcgggtggaagtactcagaaccctcgggtacgttgacgaagctggcacagtgaagcttgccggtagggtagcgtgcgccatgtccagccatgaacttctcctgaccgaattgatgttcgacaacgcactctctacactgagacctgaagaaatcgcggctcttctttctggtctcgtgtgtcagtcccccggtgacgcaggcgatcagctcccaaatacattgaagcaaggaattgagcgagttagggccgtcgctaagcggattggcgaggttcaggtggcgtgcgggctgaatcagaccgtggaagaattcgttggggaactcaacttcggtctcgtggaggtggtgtatgaatgggcccgaggcatgcccttttctgaattagccggactgagtggcacacctgaagggctggtggtgagatgcattcagagactcgccgaaatgtgccggtctctgcgaggggctgctcggctggtaggagaaccagttctcggagccaaaatggagactgcggctaccctactgcgacgggatatcgtgtttgctgcctctctgtatacacagtag

SEQ ID NO: 242800 - DNA, 693 bp, Artificial Sequence
  Description of Artificial Sequence: Synthetic coding sequence
atgatggagaccgagagactggtgttgcctccgccagatccactggacctgccactgagagcggtggaactggggtgtacaggtcactgggaactactgaatttgccaggagctccagagtccagcctgccacacgggctgccgccatgcgcacctgatctgcagcaagaggctgagcagcttttcctgagctcacccgcttggctacctctccatggggtagaacacagtgcccgaaaatggcagcggaaaacagatccttggtctctgctggcagtactgggggctcctgtacccagtgatctccaggcccagaggcacccaaccaccgggcagatattagggtataaggaggttctcctggaaaacaccaatctgagcgccacgacctcgctcagtctccgtcggccaccgggaccagctagccagtcgctttggggcaatcctacgcaatacccattctggcccggtggtatggacgaaccaaccatcaccgacctgaacacacgcgaagaggccgaagaggaaattgattttgagaaggacttattgacaattcctcctggctttaagaaggggatggactttgcacctaagggcagtgttcattcttgcatccatccgcgaggtcctcgagccagcatcagcggagcagttggacatccgtgtggcagacacctcccttgttggtag

SEQ ID NO: 242801 - DNA, 2643 bp, Artificial Sequence
  Description of Artificial Sequence: Synthetic coding sequence
atgatggagactgaaaggctggtattgcccccacctgatcctcttgacctgcctttgagggcagtcgaactgggttgtaccggtcactgggagcttctaaacctgcctggcgctcccgagagcagcctcccacatggtttgccgccttgtgcccctgacctgcagcaggaggcagaacagttgtttctgagctcacctgcatggctccctctccacggagtggagcactccgctaggaaatggcaaagaaagacagacccctggtccttgctggcggtactcggggcacccgtcccctccgacttgcaggcccagaggcatcccaccaccggacaaattctcggttacaaagaagtcctgctggagcattacctgtttactggcaactctagtaaaacccagggagagctgtttctcttactggacagtcggggagccttccatacgaaggggtactacgctgcagtcgaggcaaagaaagagcggatgtcaaaacatgcccaaacttttggggcaaaacaacctacccaccagggcggtccagcccaggacaggggcgtctacctatcccttttggcaagtcttagaaccagggcccagctgcccgtggttgtgtttaccttctctcggggacgctgcgacgaacaggcctccggcctgacctctctggatcttacaacatcgtctgaaaagtcagaaattcatcttttcctccaacggtgtctcgcaagactcagaggaagcgaccgccagttgcctcaggtgctccacatgagtgagctgttgaatagagggctaggggtgcatcactctggtatcctaccgattctcaaggagatcgtggagatgttattctctcggggtctcgtaaaagtgctttttgcaaccgaaacgttcgccatgggcgtgaacatgcctgctaggacagtggtctttgatagtatgcgcaaacacgatggatccacattccgcgatctgcttcctggtgagtatgttcaaatggctgggagggctggacgacggggtctggacccgacgggaacagttattcttctctgcaaagggcgtgtgcctgaaatggccgacctccacaggatgatgatgggaaagccttcccagttacagtctcaattccggttgacatatactatgatacttaatctgctgcgcgtggatgccctgcgtgtggaggatatgatgaagagatcattttcagaattcccatctaggaaggacagtaaggcgcacgaacaggccctggccgagcttactaagcgattgggggcacttgaggagccggacatgacaggccagctggttgatttgccggaatactattcttggggagaggagttgaccgagacacaacacatgatacagaggagaatcatggaatcagtcaacggcttgaagagcctgagcgctgggagagtcgtggtagtcaagaatcaagagcatcacaacgcgctgggagtgatcctccaagtaagttcaaacagcacatctagggtcttcacgacattagtgctgtgtgataagcccctttcccaggacccacaggaccgcggacctgccactgctgaagtcccttaccctgacgatttggtggggtttaaactcttcctgccagaaggaccctgcgatcacaccgttgtgaaattgcagccaggagacatggctgccatcactactaaagtgctgcgagttaacggcgagaagatacttgaggacttttccaaacggcagcagccaaagtttaaaaaggaccctcccctggccgctgtcacaacagcagtccaggagcttctcagattggcacaagcgcacccggcagggccacccaccctagaccccgtgaacgacttgcagttgaaagacatgtccgttgtcgagggtgggttaagagcgcgtaaactggaggagctgattcagggggctcagtgcgtacacagtccaaggtttccagcgcagtacctcaagctgcgagaacgtatgcagatccaaaaggagatggagagactacggtttctgttgagcgatcaaagcctgcttttgctgcctgagtatcaccagcgagttgaggtcttgcgaactctcgggtacgtcgacgaggccggtacggtaaaactggcaggacgcgtagcttgcgcaatgagctctcatgaactgttgttgactgagttaatgttcgataatgcattgtccacgttacggcctgaagaaattgctgccttgctcagtggtttggtatgtcagtctcccggagatgcgggagaccagctacccaacacactgaagcagggcatagaaagggtgcgtgccgtggctaagcggattggagaagtgcaggtagcctgcggattgaatcagacagtagaggaattcgtcggagaattaaattttgggctcgtagaagtggtgtatgagtgggctcgtggtatgcctttttcagagctggctggcctgtctggcacgcccgagggattggtggttaggtgcatccagagactggctgagatgtgtaggtcgctcagaggggctgccagactggtgggagagcccgtgctaggagcgaagatggaaaccgccgcaacacttctgcgacgggatatcgtattcgcggcatccctgtatactcagtag

SEQ ID NO: 242802 - DNA, 3267 bp, Artificial Sequence
  Description of Artificial Sequence: Synthetic coding sequence
atggatgagcccacaattacagacttgaatactagggaagaggccgaggaggagatcgactttgaaaaagacctgttgacgatccctccagggtttaagaagggcatggattttgctccgaaggactgtccgacccccgcaccgggactgctgtcgctgtcatgcctgctcgagccactcgatctgggtggtggcgatgaggacgaaaacgaagctgtcggccagccagggggaccccgaggtgacacagtctccgcctctccttgtagtgctcctctggccagggcaagcagcctcgaagacctggttctcaaggaagctagcacagcggtctccaccccagaagctcctgagcctcctagccaggagcagtgggccatcccagtggatgctacatcccccgttggagacttctaccgactgatcccacagccagcattccagtgggctttcgaacctgacgtcttccaaaagcaagcaatcctccatctggagcggcacgactcagttttcgtggctgcccatacctccgccggtaagaccgtggtggccgaatatgcaatagccctcgcccagaagcatatgactaggaccatctatacctcccccattaaggctctgagtaaccagaagtttcgggatttccgaaatacttttggggacgtagggttgctaaccggcgatgtccagctacatcctgaagcctcttgtctgattatgacgaccgagatcctacgtagcatgttgtattccggctcagacgtaattcgggatcttgaatgggtcatattcgatgaggtgcactatattaacgatgtggagcgtggagtcgtgtgggaagaggttctcatcatgctgcccgaccatgtcagtattatcttactgtcagcgaccgtgccaaatgccttggagtttgcggactggattggcagactaaaaaggcggcaaatctacgtgatttcgaccgtaaccaggcctgtgcctttagaacactatctgtttaccggaaactcatcgaaaacccaaggagagttatttctgctgttggatagccgcggagcatttcacacgaagggctattatgcagctgtggaggcaaaaaaagagagaatgtctaaacacgcccagacctttggcgctaagcagcccacacaccagggcggacccgcacaggacagaggggtctacctgtcactgctcgcttcactacgtaccagggcccagctgccggtagtggtgttcacttttagtagaggtagatgcgacgaacaggcctctgggctcacctctctggacttgactacaagctccgagaaatccgagatccacctgttcctccagcgctgcctggcacgcctgcgcggttctgatagacagctgccacaggtactccacatgtctgaactcttgaaccgcggactgggagttcaccactcagggattcttcctatcctcaaagaaattgttgaaatgctctttagcagaggcctggtcaaagtcctgttcgctacagagacttttgcgatgggggtcaacatgccagcccgaacggtggtatttgatagcatgagaaaacatgacggatctaccttccgggatttgctccccggtgagtacgttcagatggccggacgggctggcagaaggggcttggatccaacaggtactgtgatacttctctgtaagggaagggtaccagagatggccgaccttcacagaatgatgatgggcaagccatcccagttgcaatctcagttccgcctcacctacactatgattctcaatctgttaagggtggacgcactcagagtggaggacatgatgaaacgctctttctccgaattccctagcagaaaggactcaaaggcacacgaacaggccctggcagagcttacgaagcgcctgggcgctctggaagaacctgacatgaccgggcagctggtcgatctgccagagtactactcgtggggggaagaactgactgagacccaacacatgatccagcgcaggattatggagagcgtcaacggactcaaatccctgtcggcagggagggtggtagtggttaaaaatcaagaacaccataacgctctcggcgtcattctgcaagtttcttcaaattccacaagccgtgtttttacaacacttgtgctatgcgacaagcctctgtcacaggacccacaagaccgcggacctgcgacagccgaggtgccttaccctgacgatctggtgggattcaaactcttcttgcccgagggaccatgtgaccacactgtcgtgaaactgcagcccggagatatggccgcaattacaacaaaggttttgcgggtcaacggagaaaagatactggaggatttctccaagcgacagcaaccaaagttcaaaaaggacccgccactggccgctgtgaccacagctgtccaggagctactcagactggcacaggctcatcctgctggacctcccacattagacccagtgaacgatcttcagcttaaggacatgtccgttgtcgaggggggactgagggcaaggaagctcgaagagctgattcaaggcgctcagtgcgttcattcacccaggttccccgcacagtatctaaaactgcgcgagcggatgcaaatacagaaagagatggagcgccttcggtttcttctgtctgatcagagtctactgttactgcctgaataccaccagagagtcgaagttcttagaaccctgggttacgtggacgaggcagggacagtaaaacttgctggacgcgtggcctgcgccatgagttcccatgagttgcttctgacagaactgatgttcgacaatgccttgagtacactgagaccagaggaaatcgcggctttactgtcaggactagtgtgccagtctccaggcgacgccggagatcaactgcctaatacactgaagcaagggattgaacgtgttagggcggtcgcaaaaagaatcggggaggtccaagtcgcttgtggcttgaatcagacagtggaggaattcgtgggcgagctgaacttcggcctggtcgaggtggtttacgagtgggctcgtggcatgccgttctcagaactggcaggcctgagcggcactccggaagggctggtagtcagatgtatccagcgtctggccgaaatgtgtcggtccctgaggggcgcagccaggctagttggagagcccgtgttaggagcaaagatggagacggccgctacactcctaaggagggacattgtgtttgccgcttccctctacacccagtag

SEQ ID NO: 242803 - DNA, 3267 bp, Artificial Sequence
  Description of Artificial Sequence: Synthetic coding sequence
atggacgaaccaaccatcactgacctcaatacccgggaggaggctgaggaagagattgactttgaaaaagatctgctgacaatcccccctggattcaagaaggggatggattttgcaccaaaagactgccccacccccgctccagggctactgtccctcagttgtttacttgaacctttggatcttggaggtggcgatgaagatgaaaatgaagccgtcggccagcccggagggccaaggggcgataccgtgtcagcttctccttgctccgcacccctggccagggccagttccctcgaggacctcgtgctgaaagaggccagtactgcagtgagcacgcccgaggcgcctgaacccccttcccaggaacaatgggcaataccagtggacgcaacctcgcctgtcggagacttttaccgattaataccccagcccgcattccagtgggccttcgaacctgacgtctttcagaaacaagctatcctgcacctggaaagacacgattcagtgtttgtggctgctcacacctctgctggcaagacagtcgtcgctgaatacgccatcgccctggcccagaagcatatgacccgcaccatctacacatcaccaattaaagctctgagtaatcaaaagtttcgggactttagaaacacctttggagacgtaggtttgctgacaggggacgtgcaactgcaccccgaagcctcctgtctgattatgaccaccgaaatactacgctctatgctgtatagtggttctgacgtgatacgggacctcgagtgggttatcttcgacgaagtgcattacatcaacgatgtggagcgcggtgtcgtgtgggaggaggtactgattatgctccctgatcacgtgagcattatacttctcagcgccaccgtacccaatgcgctggaattcgcagattggatcgggcgtctgaaacggaggcagatctacgtgatctcgaccgtcacccgccctgtcccactcgaacattacctgtttacggggaattcatccaaaacccaaggggagctctttttgcttttggactctagaggcgctttccataccaagggctactatgctgccgtagaggccaagaaggagcgcatgagcaagcacgcgcagacattcggcgcaaaacaaccaacgcaccaagggggtcccgcacaggacagaggagtgtatctttcactattagcttctctccgtacccgcgcacagctgcctgtcgtggtgttcacattctcaagaggacggtgtgacgaacaagcatccggcctgacttctctggatctgacaacctcctcagaaaagtcagagatccatctgttcctgcagagatgtctggcgaggcttcgaggaagcgaccgccagctgccacaggtactacatatgtccgagctgctcaatcgcggactgggcgttcatcattctggcattctgccaatcctaaaagagatcgtcgaaatgctcttctcccggggactcgtgaaggttctctttgcgaccgaaacatttgcaatgggggtgaatatgcccgctcgaacagtggttttcgactctatgcgaaagcatgatggcagtaccttcagagacctgctccctggtgaatacgtgcagatggccggaagagctggacgccgtggcctggatcccaccggcacagttattttactgtgtaagggtcgggttccagaaatggccgacctccacagaatgatgatggggaagccaagccagttacagtcccaattcagactgacatacacgatgattctcaacctcctccgagtggacgccctcagagtggaggacatgatgaagcggtcattcagtgaattcccgtcaaggaaggacagcaaggcgcacgaacaggcgcttgctgagctcaccaaaaggcttggtgcacttgaggaacccgacatgactgggcagctggttgacttgcccgaatactatagttggggagaggagctcacagagacccaacacatgatccaacgcaggattatggagtcagtcaacggcctgaaatccctgtccgccggacgggttgtcgtcgtcaaaaatcaagagcaccacaacgcattgggcgtgatactgcaggtcagcagcaattcgacatcccgagtgtttacaaccctcgtgctgtgtgataaaccactttctcaggacccacaggatcgaggccctgccactgccgaagttccataccctgacgacttggttggctttaagctttttttgcctgagggcccatgcgatcatacagtggtcaagctgcagcctggcgacatggccgcaattaccaccaaggtcctcagggtgaatggcgagaagatactcgaagatttttcaaagcggcagcagccaaagttcaaaaaggacccccctctagctgccgtgacgactgctgtgcaggagctgcttcggctagcccaggctcaccccgcagggccacccaccctcgaccctgtgaacgatctgcagctgaaagacatgagtgttgtggagggtggactgagagcgcgaaagctggaggaattaatccaaggagcccagtgcgtgcactctccacgctttccagcccagtatctcaagctgcgcgagcggatgcagatacaaaaagagatggaaaggttgcgatttttgctttcagatcagagtctgttactgctgcctgagtaccatcagcgcgtcgaggttctccgtacgctgggatatgtcgatgaggccggaacagtcaaactggctggtagggtagcatgcgccatgtctagccatgaattgctactgaccgaacttatgttcgacaacgccttatcgactctccggccagaggagatcgccgctttgttaagtggtttagtctgtcagtcccctggcgatgctggcgatcaactgccaaatacactgaagcaggggattgagcgggtccgggctgtcgccaaacggatcggagaagtgcaggttgcctgtggactcaaccagacagtcgaggaattcgttggcgagctcaactttggactggtagaggttgtttacgaatgggccagagggatgccattcagcgagctggccggactgtccgggactccggaaggcctggtagtgcgttgtatccagcgattagccgagatgtgccggtccctaagaggcgctgccaggctggtaggcgagcctgtgctgggcgctaagatggagacagcggctaccctactgaggagggatatagtgttcgccgcatctctctacacccaatag

SEQ ID NO: 242804 - DNA, 693 bp, Artificial Sequence
  Description of Artificial Sequence: Synthetic coding sequence
atgatggagacagagcgccttgtgctgccccctcccgacccactcgatttacccctcagagccgtggagctgggctgtactggacattgggaacttctcaatcttcctggagcgccagaaagctcattgcctcatgggcttcctccatgcgctcccgatctgcagcaagaagcagagcaactgttcctgagcagccctgcctggctcccactgcatggcgtggaacacagcgccaggaagtggcagcgcaaaactgacccttggtctctcctggctgtgctgggcgcacctgttccatctgacctgcaggcacagaggcatcccactacagggcagatactcgggtacaaggaggttctgctcgagaacactaatttaagcgctacgacctccctctctctgcgacggccacctggtcccgcatctcaaagtctgtggggaaacccaacacagtacccattctggccagggggaatggacgagcctacaataaccgatcttaatacaagggaggaggcagaggaggagattgactttgaaaaagacctgctcacaatccctccgggatttaagaagggcatggactttgcgccaaagggaagcgtgcactcttgcatccacccgcgaggacctagagcctccatcagcggagcagttgggcatccctgtggacgtcacttaccctgctggtag

SEQ ID NO: 242805 - DNA, 3267 bp, Artificial Sequence
  Description of Artificial Sequence: Synthetic coding sequence
atggacgaacctacaatcacagacttgaacacacgggaggaagctgaggaagagatcgatttcgagaaagacctcctgaccattccacctggattcaaaaagggaatggactttgcacctaaagactgtcctactcccgctcccggactgctatctctttcgtgcatgctcgagcccttggatctcggtggaggggatgaagacgagaacgaggctgtgggccagccgggaggcccaaggggagataccgtgtctgcatccccatgcagcgcccctctggccagggcctcatccctggaagacctcgttctgaaagaggcatccaccgctgtgtcaacacctgaagcaccagagcccccatctcaggaacaatgggccatcccggtagacgcaacgtcaccagtgggtgatttctacaggctcattccacagcccgctttccaatgggcttttgagccagacgtcttccagaaacaggccatcctgcacttggaacggcacgactccgtcttcgtggctgctcatacttccgccggaaagactgttgtagccgagtatgctattgccctcgcccaaaagcatatgacccggaccatctacaccagtcctattaaggcactgtccaaccagaaatttcgcgactttcggaacaccttcggggacgtgggccttcttactggggacgtgcagcttcaccccgaggcatcttgcctgattatgactaccgagattttgaggtctatgttgtattccggatcagacgtaatccgcgacctggagtgggtgatcttcgacgaggtgcattatataaatgatgtggaacggggagtagtgtgggaagaagtactgattatgctccctgatcacgtgtccataatcctgctatcagccacagtgccaaatgccttggaattcgccgattggattggcagactcaagcgcagacaaatatatgtgatttccacggtgacccgaccggtgccgctcgaacactacctctttacaggcaactcttctaagactcagggggaactctttctgctgctcgactctagaggggctttccatacaaaagggtactacgccgcagtggaagcaaaaaaagaacgtatgtcaaagcatgctcagactttcggagcaaagcagcctacgcaccagggtggaccggcacaggacagaggagtctatttgagcctgttagctagcctgcgcacacgggctcagctccccgtcgtcgtgttcacctttagccggggacggtgcgatgaacaggccagcgggctcacgtccctagatttgaccacctcatcagagaagagtgagattcatctgtttctacaaagatgtctggcaaggctgcggggatccgatcgtcaactcccacaggtactgcacatgagtgagctcctcaaccggggtctgggtgttcaccacagcggcatcctacccatcctgaaagagatagtggagatgctgttcagtaggggattagtgaaagttctctttgctactgaaacgtttgcgatgggtgtcaatatgcccgctcgaacggttgtgttcgatagtatgcgcaagcacgacggatctacattccgagacctactgcctggtgaatacgtgcagatggccggaagagccggacgtcggggtcttgaccctaccgggaccgtaatcttgttgtgtaaaggccgtgttcccgagatggccgacctacatcgcatgatgatgggcaaaccgtcccagctacagagccagttccgcctgacttacaccatgatcttaaacctgctccgggttgacgcactgcgggtggaagatatgatgaagcgatctttctcagaatttccctctcggaaagattctaaagcccatgaacaggccctggccgaactgaccaaacgattgggggcactcgaagagccagatatgacaggacagcttgttgatctgccagagtactactcttggggggaagaactaacggaaacacagcacatgatccaaagacggattatggagtctgtaaatggccttaagtccttgtccgcaggtagagtcgtcgtagtgaagaatcaagaacatcataacgcgctgggagttatactccaagtctccagtaattccacctctcgagtgttcacaaccttagtattgtgcgacaaaccgctgagtcaggatccgcaggatcgcggacccgctacggctgaggttccatatcccgatgatttggtcgggttcaaactgtttctcccagagggtccatgtgaccacacagtcgtcaaactgcagcccggtgacatggccgcaattactacaaaagttcttcgcgttaacggagaaaaaatccttgaggacttcagtaaaagacaacagccaaaattcaaaaaggaccccccactggccgctgtgaccacagccgtgcaggagctactgagattagcccaggcccaccccgcaggaccccctactctggatcctgtcaacgatttgcagctaaaggatatgtcggtggtcgagggcggtctacgcgctagaaagctggaggagttgatccagggtgctcaatgcgtccatagccccagatttccggcacaatatctgaaactgcgcgaacggatgcagatccagaaagaaatggagagacttcggtttctcctttcagaccagtcattactccttctcccagaataccatcagagagtggaggtgctgcggacgttaggatacgtggacgaagccggaaccgtcaagctcgcagggagggtggcttgtgccatgtcctcacatgagcttttgctgactgagctcatgtttgacaatgccctgagcacattacgtccagaagagattgctgcccttctgtccggcctcgtgtgtcagtctcccggtgacgccggagaccagctgcccaatactttaaaacaaggtatagagcgtgtccgggctgttgcaaaacgaataggagaggttcaagttgcatgcgggttgaaccaaacggtcgaggagttcgttggcgaactgaatttcggattagtggaagtggtatatgagtgggcccgagggatgcctttctcggaattggccggtctctcagggacaccagagggcctggttgttcgctgcattcaacgactagccgagatgtgtcgatcactccggggagccgcacgcctggtgggggagcccgtgctgggagctaagatggaaactgccgcaaccctcttaaggagggatatcgtatttgcagcctctctctatacccagtag

SEQ ID NO: 242806 - DNA, 693 bp, Artificial Sequence
  Description of Artificial Sequence: Synthetic coding sequence
atgatggagacggagcgcttagtgcttccaccaccggatcccctggacctgccacttagagctgtggagctcggttgcaccggccactgggagctgcttaacttacccggtgcaccagaaagcagtttaccacacggtctgccaccctgtgccccagacttacagcaggaggcagagcagctgtttctgagttctccggcttggctccccctgcatggcgtagaacattcagcccgtaagtggcaacgcaaaacggatccctggagcttgctcgccgttctgggggcacccgtaccatctgaccttcaggcccagcggcatcctacgaccggccagatcctcgggtacaaggaagtgttactagagaacacaaacctgtctgccacaacctctttatccctacggaggccaccgggacccgcttcgcaatcactgtgggggaatccaacgcaataccccttctggcccggaggcatggatgagccgactatcacagacctgaacacacgggaagaggccgaagaggagatcgatttcgagaaagaccttttgacaattccccctggctttaaaaaggggatggattttgccccaaagggatcggttcatagctgcattcacccaagaggccctagagcctccatctctggagccgtcggacatccttgcgggaggcatctcccatgctggtag

SEQ ID NO: 242807 - DNA, 2643 bp, Artificial Sequence
  Description of Artificial Sequence: Synthetic coding sequence
atgatggaaaccgaaaggcttgtactccctccaccggatcctctggatcttcctttgcgggcagtcgagctcggttgtacaggccattgggagctcctgaatttacccggtgctccagaatcatcactcccccacggattacccccttgtgcacccgacctgcagcaggaggctgagcagctgtttctgagttcccccgcatggctgccactgcacggcgtcgagcactctgcacggaagtggcagcgaaagaccgatccatggagcctgttggctgtcttaggagcccctgtaccttcggatctgcaagcccagcgtcatccaaccacgggccagatactcgggtacaaagaggtgctgttagagcactacctgttcaccggcaattccagcaagacgcagggcgaactctttctccttttggattctaggggagctttccatacaaaaggttactatgcggctgtcgaagcaaagaaagagcgcatgtccaagcacgcccaaacattcggcgcaaaacagcccacgcatcaggggggtcctgctcaggaccgaggcgtgtatttgagtctgctggcgagcctgagaaccagggcacagttgcctgtggtggtgttcactttttcaagggggaggtgcgacgagcaggcttccggattaacctcccttgacctgaccacatccagtgaaaagagcgaaattcatctttttttgcagcgatgcctcgcgaggctcaggggcagcgaccggcagctgccacaagtcctccacatgtcggagctgctaaacagaggccttggagtgcaccatagcggaatattgcccattctcaaagaaatcgtcgaaatgttgttttctcgaggtctggtgaaagtcctgtttgccaccgaaactttcgccatgggggtgaacatgccagcacgcactgtcgtgttcgacagcatgcggaagcatgatggctctactttcagggatctacttcctggagagtatgtgcagatggctggtcgcgcaggacggagaggactggacccaaccggtacagtgattctcctttgcaagggtcgtgtgccagaaatggcagatttgcatcgaatgatgatgggcaagccctcccagctgcagagccaattccggttaacgtataccatgatactgaacctgctgagggtggacgctctgagagttgaggacatgatgaaacggagcttctcggagttccctagccggaaggactctaaggctcacgagcaagcactggctgagttgaccaagcgccttggtgcactggaggagcccgacatgacggggcaactggtggacctgcccgaatactacagctggggcgaggaactgactgaaacccagcacatgatccagcgcaggatcatggaaagcgtcaatggtctgaagtccctgtccgccggaagagtggtcgtggttaagaaccaggagcaccataatgcactgggtgtgatcctgcaagtgtcctctaactcaacatcacgtgtgttcaccacccttgtcctgtgcgacaaacccctatcccaggatccacaggatcgcggaccggctactgcagaggttccataccctgacgatctggttggattcaaactgttcctccccgagggcccatgtgatcacactgtagtcaaactccagcccggagacatggctgccatcaccactaaggtcttaagagtcaacggggaaaaaattctcgaagatttcagcaaaaggcagcagccaaagttcaaaaaagaccctccactcgctgctgtgactaccgcagtgcaggagctgctacgtttagcgcaggcacacccagccggaccgcctacgttagatcccgtcaatgatctacaactcaaggatatgagtgtggtcgaagggggacttagggctcgaaagcttgaggaactgatccagggcgcacagtgcgtccactcgcctcggtttcctgcgcaatatttgaaactgcgggaaaggatgcagatacagaaggagatggagaggttgcggtttctgttgtccgaccaaagcctgttgctgcttcccgagtatcaccaacgggtcgaagtgctgagaacacttggatatgttgatgaggctggcaccgtgaaactcgccggacgggttgcctgtgctatgagcagccacgaactgctgctcactgaattaatgtttgacaatgctctgtctacgctgaggcccgaggagattgccgcactcctgagcggcttagtgtgccaaagccccggagatgccggtgaccagctccctaatacccttaagcagggcattgagagagtgcgggctgttgcaaagcgaattggggaagttcaggtggcctgtggattgaaccaaacagttgaagagtttgtaggcgagctgaattttggattggtcgaagtcgtctacgagtgggccagaggcatgccattctccgagctggcgggtctttcagggacgccagagggcctggtcgtgcggtgcatacaaaggttggcggaaatgtgccgttcacttaggggcgcagcaaggctggtgggagagcccgtactgggagcaaagatggagacagccgctaccctgctacgcagggatattgtcttcgcggcatctctctatacccaatag

SEQ ID NO: 242808 - DNA, 693 bp, Artificial Sequence
  Description of Artificial Sequence: Synthetic coding sequence
atgatggagactgagcgattggtcctgccgccaccagacccactggatttgcctttaagagccgtcgagctgggatgtacggggcattgggagctcctcaacctgcctggagctcccgaaagttctctcccccacgggctgcctccttgtgccccagatctccagcaggaggctgagcagcttttcttatctagccccgcttggcttcccctccacggggtcgagcactctgcaaggaaatggcaacggaaaacagacccatggagtctgctggctgtccttggggcaccagtgcccagtgacctgcaggcacagcgccaccccaccacaggacaaatccttggatacaaggaggtgcttctggagaatactaatctaagtgctaccacatctctaagccttcggagacccccagggccagcgagtcagagcttgtggggcaaccctacccagtatcccttttggcctggaggaatggacgagcctactatcacggatcttaacacacgcgaagaggccgaggaggagatcgatttcgagaaagacctgctaacaatccccccaggcttcaagaaaggaatggatttcgccccaaaaggctccgttcatagctgcattcaccctagggggccaagggcctcgatttctggcgctgtaggccacccctgtgggagacatctgccttgttggtag

SEQ ID NO: 242809 - DNA, 3162 bp, Artificial Sequence
  Description of Artificial Sequence: Synthetic coding sequence
atggactttgcacctaaagactgtcccacgccagctcctggcttgctgtctttgtcatgtctgttagagccactggatctcggaggaggtgacgaagacgaaaacgaagctgtaggccagccgggaggtcctaggggtgacaccgtatccgcgagtccttgtagcgccccattggcaagggcctcaagcctggaggacctggtgctgaaggaggcatccactgcagtttctacgccggaggcacccgagcctcctagccaagagcagtgggcaattcccgttgacgctacctccccagtgggcgacttctatcgcctcatcccacagcccgcttttcagtgggcattcgagcccgatgtgtttcagaagcaggccatcctgcatctggaacggcacgattctgtcttcgtcgcagctcacacttccgcgggaaaaactgtggtggccgaatacgccatcgctctggcccagaagcacatgactcggactatctacaccagtcccatcaaggctctctcaaaccagaaatttcgtgattttcggaacaccttcggcgatgttggactactgacaggggacgttcagctccaccccgaggcttcatgtcttattatgactaccgaaatcctacgcagcatgctctacagcgggagcgatgtgattcgtgacttagagtgggtgatttttgacgaggtgcactatatcaacgatgtcgagcggggagtcgtctgggaagaagttcttattatgctgcctgaccacgtgtcaattatcctgttgagtgccaccgtgcccaatgccctggagttcgcagactggatcgggcgactcaagcggagacagatctatgtcatttccacagtcaccaggcctgttccacttgagcattacctgtttaccgggaattctagcaaaacccagggagaactgtttctgctgcttgatagccggggagcctttcacactaaaggctattatgctgccgtggaagccaaaaaagagaggatgtcaaaacacgctcagacgttcggagctaaacagcccacgcaccaaggcggaccagcacaggaccggggagtgtacctcagtcttctcgcttcccttagaaccagagctcagcttcctgtcgtagtattcacgttctcaaggggcagatgtgacgaacaggcctctggactgacatctcttgaccttacaacctcatcggagaaatccgagatccacctcttcctgcaaagatgcctagcacggcttcggggttccgaccgccagctaccccaggtacttcatatgtctgagttgctaaataggggtctgggcgtgcaccactccggaatacttcccatcctcaaggagattgtcgaaatgttattctcgagaggccttgtcaaggttctcttcgccaccgaaacttttgcaatgggagtcaacatgcccgcacggactgtggtgttcgattccatgcggaaacacgatggctcaacatttcgggatctcctccccggagaatacgtgcaaatggccggaagggcaggtcgcagggggttggaccctaccggtacagtgattttgctgtgtaagggacgggtgcctgaaatggcagacctgcacaggatgatgatgggcaaaccgtcacagctgcagtcccagtttagattgacatacacaatgattttgaaccttctcagggttgatgcccttagggtggaagacatgatgaaaagatccttttctgagttcccatccaggaaagatagcaaggcccacgaacaagctttagccgagctgactaaacgtctgggagccctggaagagcctgatatgaccggacagcttgtggatcttccagagtactattcctggggggaggagctcacagaaacacagcacatgatccagaggagaattatggagagtgtgaatggcttgaaaagcctgagcgctggtcgggtggtcgtcgtcaagaaccaggaacatcacaacgctttgggagtgatcctgcaagtgagttccaatagcacctcacgggtttttactactctggttctgtgcgataaacccttgagccaggacccacaagaccggggacctgccaccgcagaggtgccctacccagacgacctggtaggatttaaattgtttctacccgagggcccttgtgatcacacagtggtgaaactccagcccggagacatggcagctataacaactaaagtattaagagttaatggcgaaaaaatcctggaggatttctccaaacgccagcagccaaaatttaagaaggatccccctctcgctgctgtgactacagcagtgcaggagttgctgagactggcacaggcccaccccgctggcccacccaccctcgatcccgtcaacgacctgcaactcaaagacatgagcgtggtggagggaggcctgagggccagaaagttggaggaactgatccaaggagcccagtgtgtacatagtcctaggtttcctgcccagtacctcaaacttcgggagcgaatgcaaatccagaaggagatggaacggttgaggttcctgctctcggaccaatctctcctgctgctacctgagtatcaccaacgcgtcgaggtactgcgcacacttggctatgtggatgaagccggtacggtcaagctcgcgggtagagtcgcctgtgctatgagcagccacgagttactgctgaccgagttgatgtttgacaacgcactaagcacattgcgcccagaggaaatcgccgctctactatcgggtttggtctgtcagtctcctggtgatgcaggcgaccaattacccaatacactgaaacagggaatagaacgtgtgagagccgttgccaagcgcatcggggaggtacaagtggcatgcggtctcaaccagactgtggaagagttcgtcggggagttgaacttcgggctggtggaggttgtatacgagtgggcccgaggcatgccattttcggagctcgctggactgagcggcacccctgagggattggtcgttaggtgcatccaacgactcgccgagatgtgccggtctcttcgcggagccgcacgcctggtaggcgagcctgtgctgggcgctaagatggagaccgctgctaccctcctgagaagagatattgtttttgctgcctctctgtatacccagtag

SEQ ID NO: 242810 - DNA, 3162 bp, Artificial Sequence
  Description of Artificial Sequence: Synthetic coding sequence
atggattttgcaccaaaggactgcccaacccctgctcctggtctgttaagcctgtcctgcttgttagaaccacttgacctggggggaggggatgaggacgagaacgaagcagttggccagcccggaggcccaagaggggacaccgtctccgccagcccgtgctcagctcctcttgctcgcgcaagcagcctcgaggaccttgtattgaaggaggcctccacagccgtttcgacccctgaggcaccagagccgccaagccaagaacagtgggccatcccggtggatgcaacatcccccgtcggcgatttttaccgactgattccgcaaccagcatttcagtgggccttcgaaccggatgtgttccagaagcaagccatcttacacttggagcggcacgactccgtttttgtggcagcccacaccagtgctggaaagacggtggtggcagaatatgcaatcgccctcgcccagaaacacatgactagaaccatctacacctcgcccatcaaggccctgtccaaccagaaatttcgcgacttcagaaatacattcggggatgtgggcctcctgaccggagatgttcagttgcatcccgaagccagctgtctgattatgaccacagagatcctgcgtagcatgctctatagcggatcagatgtcattcgcgatctcgaatgggtcatctttgacgaagtgcactacataaatgatgttgagcgcggtgtcgtctgggaggaggttcttatcatgctgcccgatcatgtgagtataatattgctcagtgctacagtgccaaacgcccttgagttcgccgactggattggcaggctgaagcgtcggcaaatatacgtgatttcaaccgtgaccaggcctgtaccactggagcactacctcttcaccggcaatagcagtaagacacagggtgagctgttcttgcttctggatagtaggggagcattccataccaaaggctactatgccgcagtcgaggcaaagaaggaacggatgtctaaacacgctcagaccttcggggcaaaacagcccacccatcagggcggtcctgctcaagacaggggagtctatttatccctcttagcatccctcagaactcgcgctcagctgcctgtcgttgtttttaccttttcgcgcggtagatgtgatgaacaggcttccgggctaacttcacttgaccttacgactagcagcgagaagtccgaaatacatctattcctgcaaagatgtctggccagacttaggggctctgaccgccaactgccccaagtgcttcatatgtcggaactccttaataggggattaggcgtgcatcatagtggaattttacccatcctcaaagaaatcgtcgagatgctgttttccaggggcttggtcaaggtgctgttcgctactgagacattcgccatgggcgtcaacatgcctgccagaacggtggtgtttgactcgatgcgaaagcacgacggcagtacatttagggacctcctgccaggggagtatgtgcaaatggctggcagggcgggaaggagagggctcgaccccaccgggacagtgatactgttatgcaagggaagagtgccggagatggcagacttacatagaatgatgatgggaaagccaagccagttgcagagccagttccgcctgacgtacacaatgatactcaacttgctgcgcgtagacgctttgagagtcgaggacatgatgaagaggtctttcagcgagtttcccagcaggaaagactccaaggcacacgaacaggcattagccgaacttactaagaggcttggcgcattagaggagccagatatgactggacaactagtagacttgcccgaatactacagttggggagaggagttgacggaaacccagcacatgattcagagaagaattatggaaagtgtgaatggtctgaagagtctctctgcgggaagagttgtggtcgtgaaaaatcaggaacaccataatgccctcggtgttattctgcaggtgagctccaacagtacatcccgggtttttaccaccttggtcctttgcgataagccactttctcaggatccacaggacaggggaccagccaccgctgaggtcccctaccccgacgacctggtggggtttaagttgtttctccctgaaggcccatgcgatcatacggtggtgaagcttcagcctggcgacatggctgctattaccactaaggtccttagagtcaacggcgagaagatactcgaggatttctctaagaggcagcagcctaaattcaagaaagatcccccactggcggcagtcacaacagccgtccaggaactgctgaggttagcacaggctcaccccgctgggcctcccaccctggaccctgtgaacgacttacaacttaaagatatgagcgtggtggaggggggattaagggctaggaaactagaagaactgattcagggagcccaatgcgttcatagccccagattccccgctcagtacctgaagctgagggagcgcatgcagatccagaaagagatggagaggctgcggttcctgctgtccgaccagagtctcctcttacttcccgagtaccaccagagggttgaggtgttaagaaccctcggctacgttgacgaggctgggacagtcaaattagctgggagggttgcttgcgctatgagttcgcacgagttgttgctcaccgaactgatgtttgataacgctttgtctactttgcgccctgaagaaatcgccgcattactgtccggactggtctgtcagagcccaggggatgccggagaccagctgcccaatactcttaaacaggggatcgagagagtgagggccgtagccaaacgtattggtgaagtccaggtcgcctgcggcctgaaccagactgtcgaggaattcgtcggtgaattgaacttcgggttagttgaagtcgtctatgaatgggcacggggaatgccctttagcgagctcgccggtctgagcggcactccagagggtctcgtggtgagatgcattcagagactcgccgaaatgtgccgctctctgcggggtgctgctaggctagtgggtgagcctgttctaggcgcaaagatggaaactgcagcaacacttctgcgcagggatatcgtctttgcagccagcctgtatacacagtag

SEQ ID NO: 242811 - DNA, 3162 bp, Artificial Sequence
  Description of Artificial Sequence: Synthetic coding sequence
atggacttcgcacccaaggactgcccaaccccagcccctggactccttagtctgtcatgtctcctggagccactggatctcggcggaggcgatgaagacgaaaacgaggctgttggccaacccggaggcccacgaggcgatactgtttcagccagcccttgctccgctccactggcaagggccagttcactggaggacttagtcctcaaggaggctagcactgcggtcagtacccctgaagctccagagccgccttctcaggagcaatgggctattcccgtggatgccacatccccggtcggcgatttttaccggctgatccctcagccggctttccagtgggcctttgaacccgatgtgtttcaaaagcaggccattctgcaccttgagcgccatgactcagtattcgtagctgcccacacctccgctggcaagaccgttgtggccgaatatgcgatcgcattagctcagaagcatatgacaagaactatttacacatcacccattaaagctctgagtaaccaaaaattcagggactttcgcaacacctttggggacgtggggctgctcaccggggatgttcagctgcatcccgaggctagttgccttatcatgacaaccgagattttgagatccatgctatattccgggtccgacgttattagggatctagagtgggtgatatttgatgaagttcattatataaacgacgtagaaaggggagtcgtgtgggaagaggtcctgatcatgctgcccgatcatgtgagtatcatactgctgtctgctactgtgcctaacgcactggaattcgctgattggatcggtcgccttaagcgaaggcagatatacgtcatttcgacggtcaccagaccagtgcctctggagcactacctgttcaccggcaacagttctaagacccagggcgagttgtttttgctgctggacagcagaggagccttccatactaaggggtactacgcagcggtggaggctaaaaaggagcggatgtcgaagcatgcccagacattcggggcaaagcagcctactcaccaggggggacccgctcaggatcgcggagtgtacttgtcactcttggctagtctgcggactcgtgctcagcttcctgtggtcgtcttcacatttagtcgaggtcgctgtgatgagcaagcaagtggactcacatctttagacctcactactagttctgagaagagtgaaatacatctgttcttgcagcggtgccttgccagattacgcggaagtgatcgtcagctccctcaagtgctccatatgtcagagcttttgaacagaggtcttggagtccaccattccgggattcttcccatcctcaaggagattgtggaaatgctttttagcagaggactggtgaaagttctgttcgccacagaaacatttgctatgggtgtaaatatgccggcaaggaccgtggtgttcgatagtatgagaaagcacgacggatcaacatttcgggacctcctgccaggggaatatgtccagatggcaggtcgggcaggcagacgaggcttagatccaactggcaccgtgatcctgctttgcaaaggcagagtgcccgagatggcagatctgcaccggatgatgatgggcaaaccttcccaactgcagtctcaatttaggctgacatacacgatgatattgaacttattgagagtcgatgccctccgcgtggaggatatgatgaaacgctcatttagcgagtttcctagtcgcaaagactcaaaggcccatgaacaggccctcgcagagctgacaaaacgcctaggcgcactggaagagccagacatgactgggcagctggtcgacttgccggagtattatagttggggagaggagctcactgaaacacagcacatgatccagagacgaatcatggaatctgtgaatggactaaagtccctttctgctggacgggtcgtggtcgtgaagaatcaagaacatcacaacgcactgggtgtgattttacaagtatcatctaattccacctctagggtgtttactacactggtactctgcgacaagccactgagccaggatccccaggaccggggtccagcgactgcggaggtgccttaccccgacgacctggtggggttcaagctctttttgcctgagggaccctgcgatcacaccgtggtaaaactccagcccggagatatggcagccattaccactaaggttctacgggttaatggcgagaagatcttggaggattttagtaaacgccagcagccgaagtttaagaaggatccccctctggcggctgtaaccacggctgtgcaggagttgctgagactggcacaggcacacccagcgggtccacctaccctggaccccgtgaatgacctgcagttaaaggacatgagtgtcgtggagggagggctgcgcgctaggaaactcgaagagctgatacagggggcacagtgtgtacattcaccaaggtttcccgctcagtatctcaaattgcgagagagaatgcagatccagaaagagatggagagattgaggttcctcctgtccgaccagtcactgctgctgctgcccgagtatcatcagcgcgtagaggtcttgcgaacactgggttatgttgatgaggcgggtaccgtgaaactggcaggcagggtggcgtgcgccatgagctctcacgagctgttactcaccgagcttatgtttgacaacgctctcagtaccctaagacctgaagagattgcggcattgcttagtgggctcgtctgtcagtctcccggtgatgcgggagaccaactcccgaatactctcaagcagggtatcgaacgagtgcgggctgtcgctaagcgcatcggagaagtccaagtagcatgtggactcaaccagaccgtggaagagtttgtgggcgaactaaactttggcttggtggaggtggtttacgaatgggcaaggggaatgcctttcagtgagttagcagggctcagcgggacccctgaaggcttagtagtacgctgcatacagagactcgccgagatgtgtaggagccttcggggagccgctcggttggtaggggagccagttctcggcgctaagatggaaaccgccgcaacactgctccgaagagatatcgtttttgctgctagtctctatacccagtag

SEQ ID NO: 242812 - DNA, 465 bp, Artificial Sequence
  Description of Artificial Sequence: Synthetic coding sequence
atggcaaccaaggcagtgtgtgttttgaagggcgatggtccagtccaaggcatcattaacttcgaacaaaaagaatcaaatggcccagttaaagtctgggggagcattaagggcttaacggaggggcttcacgggttccacgtacatgagttcggagataacacagcagggtgtacatccgcgggtccccatttcaaccctctgagtcgtaaacacggaggcccaaaagacgaggagaggcatgttggtgacttagggaatgttacagcagataaggacggtgtggccgatgtcagtatcgaggattcggtgatttctctttctggtgaccactgcatcatcggcagaactctagttgtgcacgagaaagctgacgacctcggcaaaggagggaatgaggaatctactaagactgggaacgcgggttcccgtctggcctgtggcgttatcggcattgctcaatag

SEQ ID NO: 242813 - DNA, 108 bp, Artificial Sequence
  Description of Artificial Sequence: Synthetic coding sequence
atggctacaaaggctgtatgtgtcctcaaaggagacggccctgtccagggcatcattaactttgaacagaaagagagtaacggacccgaaggggtaggtaaacactag

SEQ ID NO: 242814 - DNA, 1074 bp, Artificial Sequence
  Description of Artificial Sequence: Synthetic coding sequence
atggattcagtcgagaagaccaccaaccggagcgaacagaagagccgcaaattcttaaaaagcctgatcagaaagcagccccaggaactactgctcgttatcggaactggagtgagtgccgcagttgccccagggatccctgccctgtgttcctggagatcttgtattgaggcagtgattgaggctgcggaacaactggaagtacttcaccccggtgacgtggctgagttccggaggaaagtcacgaaagaccgtgatcttctagtggtcgcccacgatttaatccgcaaaatgagtccaagaactggagatgcgaaacccagctttttccaagattgcctcatggaggtttttgacgacctggagcaacacatccggtcacctgttgtgctacagtcaatcttgagcttgatggataggggtgctatggtgttgacaacgaactacgataatttgttggaggcctttggtagaagacagaacaagccgatggaaagtctggatctgaaggacaagacaaaggtgttggagtgggctagagggcacatgaagtatggagtcctacacatccatggactttacacggatccttgcggggttgtactggatccaagtggttacaaagacgtgacccaggacgctgaggtgatggaggtgctgcagaacctgtacaggacaaaatcattccttttcgtggggtgcggcgagacgctgagggatcagattttccaggcccttttcctttattccgtgcctaacaaagtggacctcgagcattatatgttggtattgaaagaaaacgaagatcacttcttcaagcaccaagcagacatgcttctgcacgggatcaaggtggtgtcttacggcgattgcttcgaccattttcccggttacgtgcaggatctggccacacaaatctgcaagcaacaatccccagacgctgatcgggtggactcaaccactctcttgggcaacgcctgccaggactgcgccaaacgaaagctcgaagaaaacggtatagaagtgtctaaaaagcgtacgcagagtgacaccgatgacgccggaggtagttag

SEQ ID NO: 242815 - DNA, 636 bp, Artificial Sequence
  Description of Artificial Sequence: Synthetic coding sequence
atggacccacggaaggtcaatgaattaagggcttttgtgaaaatgtgcaaacaggatccgtccgtgctacataccgaggaaatgcgtttccttagagagtgggtggagtccatggggggtaaggtcccacctgctacgcagaaggcaaagtcagaagaaaacaccaaggaggagaagcccgactctaagaaggtggaagaggacctgaaagccgatgaaccttccagtgaggaaagtgacctcgaaatcgataaagagggagtgattgagccggacactgacgccccacaggaaatgggtgacgagaacgctgagataaccgaagagatgatggaccaggccaacgacaagaaagtggccgctatcgaggcgctaaacgatggtgagcttcagaaggccattgacctctttacggatgcgattaaactgaaccccaggctggctatactgtacgccaaaagagcatcggtgtttgtcaagctgcagaagccgaacgccgcaattagagattgtgatagagccatagaaatcaacccagactccgcccagccctataagtggaggggaaaggcccacaggctgcttggacactgggaagaggccgcacacgatctggcgttggcatggacccagtag

SEQ ID NO: 242816 - DNA, 489 bp, Artificial Sequence
  Description of Artificial Sequence: Synthetic coding sequence
atgggaggcaaggtcccccctgctacccaaaaggctaagtcagaggagaacactaaggaggagaaaccggattctaaaaaggtggaggaggaccttaaggcagacgaaccaagcagcgaggagtcagacctggaaattgacaaagaaggtgttattgagccggatacagatgctccccaagaaatgggcgatgagaatgcagagataacagaggagatgatggatcaggccaacgataaaaaggtcgctgcgatagaggccctgaacgacggggagctccagaaggccatcgacctcttcaccgatgctattaaactgaatccgagactggccatcctctacgccaagagggcaagcgtattcgttaaattgcagaagcctaatgctgctatccgtgattgtgatagggccatagagataaatccagatagcgcccagccttataagtggagagggaaggcacaccgcctgctggggcactgggaatag

SEQ ID NO: 242817 - DNA, 366 bp, Artificial Sequence
  Description of Artificial Sequence: Synthetic coding sequence
atggatccaaggaaagttaatgagctccgggcttttgtgaaaatgtgcaagcaggatccctctgtactgcacacggaagagatgagatttctacgggagtgggtggagtccatgggcggaaaagtgccaccagctactcaaaaagccaagagcgaagaaaacaccaaggaggagaaaccagacagcaaaaaagtggaagaagatctgaaggccgatgagccgtcttcagaggagtcggaccttgaaattgataaagaaggcgtaattgaaccggatacagatgccccacaggaaatgggagatgagaacgcagagatcaccgaagagatgatggaccaagccaacgacaagagtgggtgttattag

SEQ ID NO: 242818 - DNA, 2568 bp, Artificial Sequence
  Description of Artificial Sequence: Synthetic coding sequence
atgggttctgatcgggctcgcaaggggggtggcggtcccaaagacttcggagccggactgaagtacaattctcggcacgagaaagtcaacgggctcgaggagggggttgagttcttaccggtgaacaatgtgaagaaggtggaaaaacatggccctggacgttgggtggtgctggctgctgtcctcattggcctcctgctcgtgttgctagggattggattcctggtttggcatctgcagtatcgggatgtgcgggttcagaaagtctttaacggatacatgcggattacgaatgagaactttgtggatgcttatgagaacagtaatagcactgagttcgtcagtctggcctccaaagttaaagacgctctgaagctgttgtattcgggcgtcccattcttgggaccgtaccacaaggagagcgccgtgaccgctttctcagagggtagtgtgatcgcatactactggagtgagttctctataccacagcatctggttgaggaggcagaaagagtaatggccgaggagagggtggtcatgctccctcctcgcgcacggagtctgaaatcattcgtcgtgacctctgtcgtggctttccccaccgacagcaagacagttcagcggactcaggacaactcttgttcttttggcctgcacgctcgaggggtggaactcatgcgctttaccactcctggctttcccgattccccttatcccgcacacgcacgctgccagtgggctttgcggggagatgccgattctgttttgtccctgactttcaggtctttcgacctcgcctcctgcgacgagcggggaagtgatctggtgaccgtttataacaccctctccccgatggagccccacgcactggtccagctctgcggcacatatcctccctcatataatttgacctttcattcatctcaaaacgtcctgttaataacgctcatcacaaatactgagcggcgtcaccccggatttgaggctacctttttccagttgcctcgcatgtcctcttgcgggggaaggctcagaaaggcccagggcactttcaacagtccctactacccagggcattacccgccaaacatcgattgtacttggaacatcgaggtgccaaataatcaacatgtgaaggtccggttcaagtttttctacctgcttgagccaggggtgcctgccggaacatgcccaaaagactatgtggaaatcaacggtgaaaagtattgcggagagcgctctcagtttgtagtcacatcaaatagtaataaaataaccgtgcgcttccattctgatcagagctacaccgacaccggttttttggccgagtatctatcctatgatagcagtgatccttgtcccggtcaattcacttgtaggaccggcagatgcattcggaaagagctccgctgtgacgggtgggctgactgcacagatcatagcgacgaactcaactgtagctgcgatgcaggacatcagttcacttgtaagaataagttttgcaaacccctgttctgggtttgcgacagcgtcaatgactgtggcgacaattctgatgagcaggggtgttcctgccctgcgcagactttccggtgctcaaatggtaagtgtctgtcaaagtctcagcagtgcaatgggaaggacgactgcggagatggcagcgacgaggctagctgcccaaaggtgaacgtagtgacctgcactaaacacacctataggtgcctcaacgggttgtgtctctccaaaggcaatccagagtgtgatggcaaagaagactgcagcgatggcagcgatgagaaggactgtgattgcgggcttagaagcttcacccgtcaggcaagggtagtaggaggcacagacgcagatgagggagagtggccctggcaggtgagcctgcatgcactcggacaggggcatatctgtggcgctagtttaatctcccctaactggctggtgtctgccgcacattgctacatagacgaccgcggtttccgctatagcgaccccacacagtggacggcctttctcgggttacacgatcagagtcagaggtctgcccctggcgtgcaagagaggcgtctaaagaggattatctcccacccattttttaacgattttaccttcgactacgatattgccctgctggagctcgagaaacccgctgagtatagttcaatggtgcgcccaatctgcctgccagatgcctcgcacgtcttccctgcagggaaagccatttgggtaacaggctgggggcatacccaatacgggggtaccggagctctgattctgcagaagggagagattcgtgtcatcaatcagactacttgcgaaaacctgctcccacagcagatcactcccagaatgatgtgcgtaggcttcctgagtggtggggtggattcttgccagggagactcaggagggcctctctcctccgtggaagccgacgggcgaatcttccaagctggcgtggtcagttggggagacggctgcgcccaacgaaataaaccgggtgtttatactcgtctccctctgtttcgtgactggatcaaggagaacaccggtgtgtag

SEQ ID NO: 242819 - DNA, 3414 bp, Artificial Sequence
  Description of Artificial Sequence: Synthetic coding sequence
atgactatgaccgctaacaaaaattctagcatcacccatggagctggaggaaccaaggcccctagaggcactttgtcccgttcccagtctgtaagcccaccgccagtcctctcccccccacgcagtcccatctaccccctttcggacagcgagacatcagcttgtagatatcccagtcactcatcttctagggtcctattgaaggaccggcatcctcccgcacctagtcctcagaacccccaagacccatcccccgacacatcccctcccacttgcccattcaaaactgctagtttcggatacctggaccggtctccgagcgcatgcaaaagggatgcacagaaggaatcagtgcagggcgcagcacaggacgtggcgggagttgctgcatgcctgcctctagcgcaaagtactcctttcccaggaccggctgccggtccacgcggtgtactgctgaccagaaccggcactagagcccatagtttggggattcgggaaaagataagcgcctgggaaggaagacgagaggctagtcccagaatgtctatgtgcggggagaaacgggagggctcaggatccgagtgggccgcatccgaggggtgcccctctcttggctgccctagcgtggttccttctccctgttccagtgaaaagacctttgacttcaaaggacttaggcggatgagtcggaccttcagcgagtgctcttaccctgagactgaggaagaaggagaagccttgcccgtcagggattctttctatagactggagaagcggctgggacgctctgagccctcagcattcttaaggggccacggctcccggaaggagtccagcgcagttctgtcgcggatccagaagatagagcaggtcttgaaggaacagccgggacgcggtctgccccagctgccaagttcctgttacagtgtggaccggggaaagcgcaagactgggaccctggggtccttggaagagcctgccggaggcgctagcgtgtcagcgggtagtcgagccgttggtgtggcaggcgtggctggagaagccggtcccccacctgagcgggagggtagcggttccactaagcccggaacccccggaaatagcccctcctcacagcggcttcctagtaagtctagcctggatccagcagtcaaccctgtgcctaaacccaaaaggacctttgaatacgaagcagataagaaccctaagtccaaaccttctaatgggttacccccttcaccaactccagcagcaccgccaccgctgcccagtactcctgcaccacccgtcaccagacgcccaaaaaaagatatgcgagggcaccgcaagagccagtcacgtaagtcgttcgagtttgaagatgccagcagtctccaaagcctttaccccagctcacccacagaaaacggtacggaaaaccagcccaaattcggcagcaagtccacactagaggaaaacgcctacgaagatattgtgggcgaccttcccaaggaaaacccctacgaggacgtggatctcaagtctcgacgggctggccgtaagtctcaacagcttagcgagaattctcttgactccctccatcggatgtggtctccacaggatcgaaaatacaacagcccaccaacccaactttctctgaaacctaatagccaatcccttaggagcggaaactggagcgaacggaaaagtcaccgactgcccaggctccccaagcgccactcgcatgacgacatgctcctactggctcaactctctctgcccagttccccatctagcctgaacgaggacagtctgtcaactacatccgagctcttgtcgagcagaagggccagaaggattccgaaactggtccagaggatcaactctatttacaacgccaagcgtggtaaaaaacgactaaagaagttgagcatgagctcaattgagaccgccagcttgagagacgagaacagtgaatccgaatccgactcagacgacaggtttaaggcccacacacaaagattagtgcacatacagtcaatgttgaagcgagccccttcataccgaactctggagctggagctgcttgaatggcaggagagagaactttttgagtacttcgttgtagtgtccctcaaaaaaaagccctcacgaaatacgtatcttccagaagtaagttatcaatttcctaagttggacagaccaacgaagcagatgcgcgaagctgaggagcgcctaaaggctattcctcaattctgttttccggatgccaaagactggctgcccgtttccgagtacagctccgagacattttcattcatgttgactggggaggatggcagtagaagatttgggtattgtagacggcttctgccttctgggaagggcccaaggctgccagaggtgtactgtgtcatttcgcgactcggctgtttcggcctgtttagtaaagttctggacgaagtagagagaaggagaggaatttccgcagctcttgtgtaccctttcatgagatctttgatggagagtccttttcccgctcccggtaaaaccattaaggtcaagactttccttcccggtgcaggaaatgaggttctggaattgagacgtcctatggacagcaggttggagcatgtcgactttgaatgcctttttacctgcctgagtgtgagacagcttattaggatctttgcatcactgctcttggagcgcagagtcatctttgttgccgataagcttagcacactaagttcttgtagccacgcggttgtggccttactgtatccattctcttggcagcataccttcattccagtgctgcctgcctctatgattgatatagtttgctgccccacccccttcctggtcgggttgttgagtagtagtctgccaaagttgaaagagctgccagtcgaagaagcattgatggtcaaccttggaagcgaccgatttataagacagatggacgacgaggatactctgctcccgagaaaattacaggccgctctggagcaggctctggagcggaaaaacgagctgatatcccaggacagcgactccgatagcgatgacgaatgcaacaccctcaatggcctggtcagtgaggtgtttattcgctttttcgttgaaaccgtggggcactacagcttattcctcacacagagtgagaaaggcgagcgcgctttccagcgtgaagcatttagaaaatcagtggcctcgaaaagcatccgccgatttttagaagtttttatggagagccagatgtttgccggtttcattcaggaccgtgaattgcgcaagtgtcgcgctaaggggctctttgagcaacgagtcgagcagtacctggaagagctccccgacaccgagcaatctgggatgaacaagttcctgcggggactgggaaacaaaatgaagtttttgcacaagaaaaattag

SEQ ID NO: 242820 - DNA, 3414 bp, Artificial Sequence
  Description of Artificial Sequence: Synthetic coding sequence
atgacgatgaccgctaataaaaattcaagcatcacccatggggctgggggtacaaaggcaccaagaggcacactgtcgcgttcgcaatcagtgagtccccctcctgtgttgtcaccgccacgttctcccatctaccctctgtccgactctgaaacttctgcatgccgatacccgagccacagctctagtagggtcctgttaaaggaccggcaccctcctgctccgagtccccagaacccgcaggacccatcacccgacaccagtccgccaacatgtccatttaagaccgcttcttttgggtaccttgaccgaagcccatccgcttgtaagcgggatgcgcagaaagaatccgtacagggagccgcacaggacgtggctggcgtagccgcatgtttacccttggcccagtctactccatttcccggtccagccgcagggccacgaggcgttctcctgacgcggactggaacacgcgcacatagtctgggcatacgcgaaaaaattagcgcttgggaggggagaagagaggcttcccccaggatgtcgatgtgtggtgaaaagcgagaggggagtggcagcgagtgggccgcttccgaaggctgcccgagtctcggatgtcctagtgtggtgccttctccctgctcttcagagaagacatttgacttcaaaggactgagacgtatgtccagaacctttagcgagtgtagttacccggaaacagaggaggagggcgaagccctgccagtgagagactcgttctatcgtctcgaaaaaagacttggccgatccgaaccctccgcttttctgcgtggccacggtagccgtaaggaatcttcagcggtcctatctcggatccagaaaatcgaacaggtgcttaaggagcagcctggtcgcggactgccacagctcccatcttcttgttactccgtggatcggggaaagagaaagaccggcaccctgggttctttagaagaaccggcaggcggagcctctgtctccgccggaagccgagccgtgggcgtggccggagtcgctggcgaagccggtccacccccagaaagggagggttcgggttccactaaacccggaacccctgggaattcaccgtcatcccagaggttgccgtctaagtcatcactggacccagccgtgaatcccgtgccaaagccgaagagaactttcgaatacgaggcagacaaaaacccaaaatcaaagccgtccaatggacttcccccttctcccaccccagccgcaccaccgccacttccctcaacacccgctccaccagtgacgcgacggccaaagaaggacatgagaggccataggaaatcacagagccggaagagttttgagtttgaagatgcctcttcactccaatctttgtacccaagctctccaactgagaatggcacagaaaaccaacctaaattcggcagtaagtcgacactggaggaaaacgcctacgaggatatcgtaggcgacctgccaaaggaaaatccctacgaggacgtggatctcaagtccaggcgagctggacgaaaatcccagcaactatctgagaactcgttggacagcctgcaccggatgtggtcaccccaggatcgaaagtacaattctccccctactcagttgtccctgaagcctaattcgcagagcctgagatcagggaattggtccgaacgcaagtctcatcggctccctaggctcccgaaacggcattcacacgatgacatgttgttgctcgcccagttatcccttcccagctccccctcttccctgaatgaagattcactgtcaacaacgagcgagctgttgtctagtagaagggcgaggcgcatcccaaagttagtacagcggatcaactcaatttataatgccaagcgaggtaaaaaacggctcaagaaactctctatgtcttctattgaaactgctagcctgagggatgagaattctgagagcgagtccgacagcgacgatcgtttcaaagcacacacgcagcgcctggtccatatccagtctatgttgaagcgcgctcccagttatcgtaccctggaactcgaacttctagagtggcaggagagagagttatttgagtattttgtggttgtgagccttaagaagaaaccctcccgaaacacttatctgcctgaggtctcttatcagtttccaaagctagatcgtcccaccaagcaaatgagagaggcggaagagagactgaaggccattccacagttttgcttcccagacgccaaagactggctgcctgtgagcgagtactcctccgagaccttttcctttatgctgacaggagaggacggctctcggaggttcggttattgccgtcggctgctgcctagcggcaagggaccccgtttgccggaagtgtactgcgtgattagcaggctcggctgtttcggcttgttttctaaggttctcgacgaagtggaacgccgacggggaatcagcgccgcactggtttaccctttcatgagatcgttgatggaatctccgttcccagccccagggaagactattaaggtcaagacatttcttcctggcgctgggaacgaggtgctggaattacggaggcccatggacagtagactggagcacgtggatttcgaatgcttgttcacgtgcctgtctgtgagacagctgatacggatttttgccagtttactgcttgagcggagggtcatcttcgtcgctgataagttatctacactctcttcttgctcacatgccgtggtcgcactgttgtacccattcagctggcagcacaccttcatccctgtgctgcccgcttccatgatcgatattgtgtgctgtccaactcccttcctggtaggtcttctttcgtccagcctgcctaagttaaaagaattaccggttgaggaagcactcatggttaatttggggtcagacagatttatccgccagatggacgatgaggatacgctccttccacggaagctgcaggcagcactcgagcaagccctggagcgtaaaaatgaactcatttctcaggattcagacagcgacagtgacgatgaatgcaacaccttaaacggcttggtgtctgaagtgttcattcgcttttttgtggagacagttggccactactccctatttctcacccagtctgaaaagggggaaagggcttttcaacgggaagccttcagaaaatcagttgcctccaagtctattagacgttttctggaggtatttatggagtcccaaatgttcgccggatttattcaggacagagagctgcgcaagtgccgagccaaggggctcttcgagcagagagtggagcaatatctcgaagagctgcccgatacagagcagtcaggcatgaacaagtttttgagaggactggggaacaagatgaagtttctgcataaaaagaattag

SEQ ID NO: 242821 - DNA, 1263 bp, Artificial Sequence
  Description of Artificial Sequence: Synthetic coding sequence
atgacaagccggaagaacgggggaggagctcacagctggcaggagacaccctgggaacagcgcagggcgctgggccttcagagagccgagatgactatgacagccaataagaactcatctatcacgcatggtgccggaggtaccaaagcgccacgcggtaccctgtccagaaaatcctttgagttcgaagacgcctcatcccttcaatcactgtacccatcttccccaactgagaacggaaccgagaatcagcctaagtttgggagcaagtcaaccctggaggaaaatgcctatgaagacatcgtgggagatctgcccaaagagaacccatacgaggatgtggaccttaagtccaggagggcgggacggaaatcccaacaattgtctgagaatagcctggacagcctgcacaggatgtggagcccacaggatcgcaaatataattctcccccaacccagttaagcctgaagcccaattcccaaagcctgagaagcggcaattggagtgaaagaaagtcccaccggctgcctagacttccgaagcgacactcacatgatgacatgttactgttagcccagctcagcttgcctagttcgccttcctccttgaacgaggattctctcagtacaacttccgaattactgtccagccgccgtgcccgtagaatccccaaactggtgcagcgtatcaactctatctataacgcgaagcggggtaaaaagagactcaaaaaactctcaatgtcatccattgagacggcaagtctgagagatgagaatagcgagagcgagagtgactctgatgataggtttaaagctcacacacaacggctcgtccatatccagagcatgttaaaacgggcaccctcctatcgaactctcgagctcgagcttcttgagtggcaagagagagaactcctgagtaccttgtggtggtgtccgtcgagacggtctcaccgcgagactccaacctctccaaaatcccccacatctttccccagaaacgtacttagccccgcactgcacgttgccgcaggctctttctcgttcctgaggctctgctcctcaagaacttcttttaggaggtctgtccaaacccccgcatggtctccctctcctgcccaactggctctgctggacagacctaccaagcagatgcgggaggctgaagaaagattaaaagcgataccgcagttctgctttccagatgcaaaagattggctcccggtgagtgagtatatgcgacccttcctgtcctgttag

SEQ ID NO: 242822 - DNA, 174 bp, Artificial Sequence
  Description of Artificial Sequence: Synthetic coding sequence
atgactatgactgctaataagaattccagtatcacccacggagcgggaggtactaaagcacccagagggaccctatcccgcagtcaatccgtatcacctcctcccgttctgtccccacccagatcccctatttatcccctctcagactctgaaactagtgcttgcaggtactag

SEQ ID NO: 242823 - DNA, 123 bp, Artificial Sequence
  Description of Artificial Sequence: Synthetic coding sequence
atgactatgactgccaacaaaaattcatccattactcatggggcagggggaacaaaagcccctagagggactctgtcgagaagtcagagcgtgtctccacccccagtcctttcaccaccgtag

SEQ ID NO: 242824 - DNA, 144 bp, Artificial Sequence
  Description of Artificial Sequence: Synthetic coding sequence
atgtggtctcctcaagacaggaaatacaattcccctcctacccaactatccttaaaaccaaattcacagtcacttaggagcgggaattggtctgagcggaaatcccaccgcctccccagactgccaaagagacactcgcattag

SEQ ID NO: 242825 - DNA, 219 bp, Artificial Sequence
  Description of Artificial Sequence: Synthetic coding sequence
atgacaatgacagccaacaaaaactcttcaataacacatggagcgggaggtacgaaggcacccagaggaactctgtcccgcaagtcgtttgagtttgaagacgcctcatctctacagtcattgtacccttcgtcaccaacggaaaatggaaccgagaatcaaccaaagttcgggagtaagagtaccctcgaggagaatgcctatgaggatatagtgtag

SEQ ID NO: 242826 - DNA, 375 bp, Artificial Sequence
  Description of Artificial Sequence: Synthetic coding sequence
atgacaatgacggccaacaaaaacagttctattacacacggcgctggcggaacaaaagcacctcgcggaacactgtcgcgatcccagtctgtatctccacccccagtcttatctcctccaaggtccccaatataccccttatccgactcggagacatcagcttgtaggtacccaagccactcgagttcacgggtgctcctgaaggaccgacatccccctgccccatccccccagaaccctcaagatccttcaccggacacttcccccccaacttgtcctttcaagaccgccagcttcggataccttgaccgaagtccatccgcttgtaagagggacgctcagaaggaatcagtgcagggggcagcccaagattag

SEQ ID NO: 242827 - DNA, 429 bp, Artificial Sequence
  Description of Artificial Sequence: Synthetic coding sequence
atgactatgaccgccaacaagaactcgagtatcacccatggcgcaggcggtactaaagctccgaggggcacgctgagccgctcacagtccgtctccccgccacctgtgctgtcccctcccagatcccctatttacccactatcagactctgaaacctcagcgtgtagatacccctctcattctagcagtagagtgttgctaaaggatcgacatcctcccgctccttcaccccaaaacccacaagacccaagccccgatactagccccccaacatgtccgtttaaaacagcctcttttggatacctggatcgaagccctagcgcttgcaagcgcgatgcccagaaggaaagcgtgcagggcgctgcacaggacgtggccggagtggcagcatgccttccgctggctcagtctaccccattcccagggtag

SEQ ID NO: 242828 - DNA, 2154 bp, Artificial Sequence
  Description of Artificial Sequence: Synthetic coding sequence
atgactatgacagccaacaagaacagttctatcacccatggcgcagggggaacgaaggccccaagaggaactctctcacggaagtcctttgagttcgaggacgcgtcgtcgcttcagagcctctacccctcctctcccacagaaaacggcacagagaaccagcctaagtttggttccaagagcacacttgaggagaatgcttatgaagatatcgtgggcgacctacccaaggaaaacccttacgaagatgtagatctgaaatcacgcagggcaggcagaaaatctcagcagttgagcgaaaacagtctggactcactccatcgcatgtggtcaccccaagatcggaaatataactcccctccaactcaattgtcactcaagccaaatagccaatccctgagatcaggaaactggtcggaacgcaagagtcaccgattgccaaggttgccgaagaggcactctcacgatgatatgctgttactggcccagcttagtctgccatcgagcccaagtagtctgaatgaagattcactgtcaactaccagcgaactgctctcctctcgtagagccagacggattcctaagcttgtgcagcgcataaattccatttataacgccaagaggggcaagaaacgactgaaaaaactgtccatgagttcgatcgaaaccgcttccctgagggacgaaaatagcgaatccgagtcggactccgacgatcgcttcaaggcccatacgcagcggcttgtgcatatccagagcatgcttaagcgtgccccaagctatcgtacactcgaactggaactgctggagtggcaggaacgtgagctgtttgagtatttcgtggtggtttccctgaaaaaaaagccaagtcgcaacacctacctccccgaagtctcatatcagtttcccaagttggacagacctacaaaacaaatgcgtgaggctgaagagcgattgaaggccatccctcaattctgtttccccgatgcaaaggactggcttccagtatccgagtattcaagcgagacatttagtttcatgctgacaggcgaggacgggtcaaggagattcggatattgtcgcaggctcctacctagcggaaaaggccctagactgccagaggtatattgtgttattagccgactgggatgttttggtctgttttctaaggtcctagatgaggtcgagcggcgtcgcggaattagtgctgccctcgtttatccctttatgcggagtttgatggagtcaccgtttcccgctcccggtaagactatcaaggtgaagactttccttccgggtgcgggaaacgaggtgctggagctgcgacgccctatggattcgaggctggaacatgtggacttcgaatgtttgttcacctgtctgagcgtgcggcagctgataagaatctttgcctctctcctgctcgaacggagagttatcttcgttgccgacaagctctcgacactcagtagctgttcccacgccgtcgtggcactcctctacccatttagttggcaacacacttttatccccgttctgcctgcttccatgatcgacattgtgtgttgccccaccccttttttagtggggcttctcagctcgagccttcctaaactaaaagaattgcccgtagaggaggctcttatggttaacctcggttccgacaggttcatccgccagatggacgatgaggacaccctgcttccgagaaaacttcaggctgcactagagcaggccctggagcgcaaaaatgaactcattagtcaggactccgacagcgattcagatgatgaatgtaacactctcaacggtttggtgtccgaagtgtttatccggttctttgtcgaaacagtggggcactactctctttttttgacgcagtctgagaagggagaacgagcctttcagcgggaggccttccgcaagtcagtcgcttctaaatctatccgacgcttcctcgaggtatttatggagtctcagatgttcgcgggatttattcaggatcgcgagctacggaagtgtcgggcaaaaggactgttcgaacagcgggtcgaacagtacctggaggagctgccagatactgaacagagtggaatgaacaagtttctaagaggactggggaataagatgaagttcttacataagaagaattag

SEQ ID NO: 242829 - DNA, 159 bp, Artificial Sequence
  Description of Artificial Sequence: Synthetic coding sequence
atgacaatgaccgctaataagaattccagcattactcatggagctggcggtacaaaagctcctcgcggaaccctgtctcggagccagagtgtatcacctcctcccgtcttgtcaccccctaggtctcctatttatcccttgtccgactccgaaacctag

SEQ ID NO: 242830 - DNA, 336 bp, Artificial Sequence
  Description of Artificial Sequence: Synthetic coding sequence
atgacaatgacagccaataagaattcttctataacccatggtgccggaggaaccaaggccccacgtgggaccctctcacgatctcaaagcgttagccctcctccagtgttaagtcccccaagaagcccgatctatccactgagtgacagcgagacatccgcttgccgctacccatcccactcttcctcgagggtgttgttaaaagaccggcatcctccagcacccagccctcagaaccctcaggatcctagtcccgacactagcccacccacatgtccttttaagaccgctagttttgggtatctggaccggagccctagtgcctgcaagaggtag

SEQ ID NO: 242831 - DNA, 162 bp, Artificial Sequence
  Description of Artificial Sequence: Synthetic coding sequence
atgacgatgaccgcgaataagaatagctctatcactcacggcgcaggcggaactaaggctccgcgtggcactctttcaagatcacagagtgtcagccctcccccagtgttatcgccaccaaggagcccaatctatcccttatctgattccgagacatcatag

SEQ ID NO: 242832 - DNA, 252 bp, Artificial Sequence
  Description of Artificial Sequence: Synthetic coding sequence
atgactatgaccgcgaacaaaaatagcagtataactcacggggcaggtggtacgaaggctcccagagggactttgtcccgtagtcagtctgtgtctcctccaccagtcctgtccccgcctaggtcacccatatatcccctctccgattccgagacatcagcctgtcgatacccctcgcacagcagctctcgggtgttgttgaaggaccggcaccctccagcacccagccctcaaaaccctcaggatccttag

SEQ ID NO: 242833 - DNA, 288 bp, Artificial Sequence
  Description of Artificial Sequence: Synthetic coding sequence
atgacgatgacagcaaataagaattcatccattactcacggagcaggagggactaaagcacccaggggaacgctgtcccggtcccagagtgtcagtcccccaccggtgttgtcccctcctcgtagtcccatttaccccctctctgactcagagacatccgcatgccgatacccatcacattcttcctcccgcgtcttactgaaagaccgccacccacctgccccaagcccccaaaatcctcaggaccccagccctgatacttctccccctacctgtcccttcaagtag

SEQ ID NO: 242834 - DNA, 465 bp, Artificial Sequence
  Description of Artificial Sequence: Synthetic coding sequence
atgaccatgaccgcaaacaagaatagcagcattacccacggcgcagggggtaccaaggccccaagaggtaccctgtctaggtcccagagtgtgtcaccacctccggttttgagtccgcctaggagtcctatctatcccctgagtgattctgaaacaagcgcttgccgttatccatcacatagctccagcagagtgttactaaaggaccgccatccacccgctccttcaccgcagaacccgcaggaccccagtccagacacttcacctccgacttgtccattcaagacagcatcattcggctatctggaccggagtcccagtgcctgcaagcgagatgcccagaaagaaagtgtacagggggctgcacaggatgtagctggcgtagctgcgtgtctgcctttggctcagtcgacccctttccccggacccgctgccggtcctaggggcgtcttgctaacacggtag

SEQ ID NO: 242835 - DNA, 540 bp, Artificial Sequence
  Description of Artificial Sequence: Synthetic coding sequence
atgtggagtcctcaggacaggaagtataactccccgcctacccaactgagcctcaagccgaattcacaaagtctgcgcagcggcaattggtcggaacgcaagtcacacagactgcctcggctgcccaagaggcattcccatgacgacatgcttctcctggcacaattgtctcttccttcatccccatcttcactcaacgaggactcattgtctacaacttctgaactcctgagctctcgtcgtgctcgccgtatcccaaagctggtgcagagaatcaactccatttataacgcaaaacggggaaaaaagcgactgaagaaactctcgatgtcatccatcgaaactgcttcccttcgtgatgaaaattctgagtccgaatcggactccgatgaccggttcaaagcccacacacaaaggttggttcatatccagtccatgctcaaaagagcacctagctacagaacccttgaactggaactgcttgagtggcaggagagagagctgttcgagtattttgtggtggtatccttgaaaaagtag

SEQ ID NO: 242836 - DNA, 2154 bp, Artificial Sequence
  Description of Artificial Sequence: Synthetic coding sequence
atgacaatgaccgctaacaagaattcctcgataactcacggtgctggcggtaccaaagccccaagaggcactctcagtaggaaatcctttgagtttgaagacgccagtagcctccagtcactctatccctcatcccccacagagaatgggacggaaaaccagcctaagtttggcagtaagtctactttggaggagaatgcatacgaggatatagtcggcgacctgcccaaggagaatccatatgaagacgtcgaccttaaatcaaggcgcgctggaagaaaaagccagcaactgagcgaaaactcacttgactcccttcaccggatgtggagtccgcaagaccgaaagtataacagccctccaacccagctgtcacttaagcctaattcacagtccctacgcagcggcaactggagcgagagaaaatcccatcggcttcccagactccccaagagacatagccatgatgatatgttacttctggctcagctcagtctccctagcagtccaagtagtctaaacgaggatagtctgagtactactagtgagctcttgagcagcaggcgagctcgccgaattccaaaactcgtgcagagaataaatagcatttacaatgcgaagagaggtaagaagcgcctgaagaagctgtcaatgtcatctattgaaactgctagtctgagagacgaaaacagcgagtccgagagtgactccgatgaccgcttcaaagctcacacccagcggttggtacatatccaatcaatgctcaaaagggcccctagttaccggacacttgagctcgaattattagaatggcaggaaagagagctgttcgagtattttgtggtggtgtcactgaagaagaagccttcgcggaatacctacctgcctgaagtgagctatcagtttccaaaactcgacaggcccacgaagcagatgagagaagcggaagaacgcctcaaagcgattccccagttttgctttcctgatgctaaggattggttaccagtgtctgagtatagctccgagacattcagttttatgttgacaggagaggatggctcacggaggttcggatactgccgcagactactcccctcgggcaaggggcctcgcttaccagaggtctactgtgtgatttctcgactgggctgtttcggacttttctcaaaggtcctggatgaggtggagcggaggaggggaattagcgccgctttggtttacccatttatgcggtccctgatggagtcgccttttcccgcacccggtaaaaccatcaaagttaagacattcctgcccggagctggaaatgaagttctggagcttcgaagaccaatggattcaaggctggagcacgtggattttgagtgcctgtttacgtgcctaagtgtgcgccaattaatccgaatctttgcaagtcttctgctggagcgcagggtcatttttgtggccgataagttgtctactctgtcctcctgttctcacgccgtggtcgcgctgctctaccctttttcatggcaacataccttcatccccgtcctcccagcttctatgattgacatcgtttgttgtcccaccccctttctggtgggcttgctttcttcatccctgcctaaattgaaggagcttcccgttgaagaggccctaatggtcaacttgggttccgaccggttcatcaggcagatggatgatgaagacactcttctcccaagaaagctgcaggccgctctggaacaagctcttgagaggaagaatgagctgatctctcaggattccgattccgactccgacgatgagtgtaatacccttaacggcttggtgtctgaagtgttcatacggttcttcgtggaaactgtcggtcactattccttgttccttacgcagtccgagaaaggagagcgagccttccagagagaagcattcaggaaaagtgtggcttctaagtccatcagaagattcctcgaagttttcatggagagtcaaatgtttgctgggtttatccaggaccgggaactgagaaagtgtagagcaaagggcctatttgaacagcgtgtcgaacagtacctggaggaactacccgatacagaacaatcaggaatgaataaattcctgcgtgggctagggaataaaatgaaattcttacataagaagaattag

SEQ ID NO: 242837 - DNA, 411 bp, Artificial Sequence
  Description of Artificial Sequence: Synthetic coding sequence
atgaccatgaccgcaaacaagaacagtagtatcacacacggcgctggcggtaccaaagctcccaggggcaccctgtctagaaagtcatttgagttcgaggacgcaagctccctccaaagcctttatccatccagtccgacagagaacgggacagagaaccaaccgaaatttggcagtaaaagcaccctcgaagaaaatgcatacgaagatatagtcggtgatctgcccaaggaaaacccatacgaagatgtggacctcaagagtagaagggccggacgcaagagccagcaattaagtgaaaactctctggactccctgcaccgaatgtggagccctcaagataggaagtataactcccccccaacccagctgtccttgaagccaaacagccagtctctgcgctctggatag

SEQ ID NO: 242838 - DNA, 225 bp, Artificial Sequence
  Description of Artificial Sequence: Synthetic coding sequence
atgactatgacagctaataagaattcctccatcactcatggcgctggcggaacaaaagcacctcgcggaaccttaagtagatcccaaagtgtcagccccccaccagttctcagtcctcccagaagccctatctacccactctccgattcagagacaagtgcatgccgatacccatctcacagctcgtccagagtgctccttaaagatcggcatcctccagcatag

SEQ ID NO: 242839 - DNA, 420 bp, Artificial Sequence
  Description of Artificial Sequence: Synthetic coding sequence
atgactatgacagccaacaaaaattccagtattactcatggagcaggcggtaccaaggcaccacgaggaactctgagccgctcacagtccgtgtcaccacccccagtgctgagccccccacgctcaccaatttacccccttagtgattctgaaacgtcagcctgtagataccccagccatagttcaagccgcgtgctgctgaaagatagacaccctcccgcaccatctccacagaacccccaggatccctcgccagatacttcaccccctacatgtccattcaaaactgcttcctttggatacctggatcggtcaccatctgcctgcaaacgggatgcgcaaaaggagtcagttcagggggcagcacaggacgtagccggagttgccgcatgtctccctctggcccagagcacaccctag

SEQ ID NO: 242840 - DNA, 1830 bp, Artificial Sequence
  Description of Artificial Sequence: Synthetic coding sequence
atgtggagcccacaggatcggaaatataattctccccctacacaactttccctgaagcccaatagccagagccttcgctcagggaattggtccgagaggaaaagtcatcgactccccaggctgccgaaacggcacagtcacgacgacatgttgctgctggcgcagctgtccctccctagcagtccaagttccctaaatgaggactctctatccactacctctgagctgttgtcctcccggcgtgcccgtaggattcccaagctggtccagcgtattaatagcatatacaacgctaaaaggggcaagaagaggctcaaaaagcttagcatgtccagtattgaaacagcaagcctgagggatgaaaacagcgagtccgagtctgactcggacgatcgtttcaaagcccacacccaaagattagtacacattcaaagcatgctgaagcgagccccttcttaccgcacgctggagctggagctgcttgagtggcaagagagggagttgttcgagtacttcgtggtggtgagcttgaagaaaaagcccagcagaaacacttatctccccgaggttagctaccagttcccgaaattggataggccaacaaagcaaatgcgcgaagctgaggagagacttaaggctataccccagttctgtttcccagatgcgaaagactggctgcctgttagcgaatactcctcagagacgtttagcttcatgctcactggcgaggacgggtcccggaggtttgggtattgcagacgactactcccatccggtaaagggcctaggctgcctgaggtctattgtgtgatctctcgtctgggctgtttcggtcttttttccaaagtgctggacgaagtagaacgtcggagaggtattagcgccgctctggtttatcctttcatgcgcagcctcatggaatcccctttccctgcacccggaaagacaataaaggtgaagacctttcttcccggagctggcaacgaagtgctcgagctgaggcggcctatggatagcaggttagagcatgtcgacttcgaatgtctattcacctgcctgtcagtccggcaactaattcgcatcttcgcgtctctgttattggagcggagagtgatattcgtggcagacaagctgagcactctttcctcctgcagccacgccgtagtcgccctgttataccctttcagctggcaacacacattcatacctgtcctgcccgcatccatgattgatatcgtgtgctgtccaactccatttcttgtcggcctcctatcaagttctctccccaagctaaaagaactccctgttgaagaggcactcatggtgaatctggggagcgacaggtttattagacagatggatgatgaggacaccctattgcctcggaagctgcaggccgctttggaacaagccttggaacggaagaacgagctgataagccaggattccgatagcgattctgacgatgagtgcaataccctgaatggcctggtctccgaagtgtttatccgcttctttgtggagactgtggggcactactccctgtttctcacacagagcgagaaaggcgagcgggcatttcagagggaagcctttagaaagtctgtcgcaagtaaaagcattcgccgatttttggaggtcttcatggaatctcagatgtttgccggatttatccaggatagggaactcagaaagtgcagggctaagggacttttcgagcagcgcgtagaacagtacctcgaggagctgccagacaccgagcaatccgggatgaataagtttctgcgagggttgggtaacaaaatgaagttccttcacaagaagaactag

SEQ ID NO: 242841 - DNA, 234 bp, Artificial Sequence
  Description of Artificial Sequence: Synthetic coding sequence
atgaccatgactgcaaataagaattcaagcatcacccacggagctggtggtactaaagctcccagaggtacactcagtcgcaagtcctttgaattcgaggacgccagtagcctgcaaagtctgtatcccagcagtcctactgaaaatggcacagaaaatcagcccaagttcggcagcaaaagcaccctggaggaaaatgcctacgaagatatcgtcggtgacttgccaaaatag

SEQ ID NO: 242842 - DNA, 81 bp, Artificial Sequence
  Description of Artificial Sequence: Synthetic coding sequence
atgactatgactgctaacaagaactctagtattactcatggcgcaggtggaacgaaggcccctcgtggtacactgagttag

SEQ ID NO: 242843 - DNA, 1035 bp, Artificial Sequence
  Description of Artificial Sequence: Synthetic coding sequence
atgtggagccctcaggaccggaagtacaactcccccccaacacaactcagcctgaaaccaaatagccagtcactcagatccgggaactggtccgagcggaaatcccataggctgccacgcctgcccaaaagacattcccacgacgatatgctgcttttggcgcagttgtcccttccttcttcaccgtcatctcttaacgaggacagcctgtcaacgacaagcgagttattgtcctcaaggcgagctagaagaattccgaagctcgtacagcgcatcaacagtatatataatgccaagagaggcaagaagagactgaagaagctgtcgatgtcttcaatcgagactgcctcactgagggatgagaattccgagagcgaatcagattctgacgaccgcttcaaggcacatacacagcgtctggtgcacatccagtctatgctgaaacgagctccgtcatacaggacattggagctggaattactcgagtggcaggagagggagttatttgagtacttcgtcgtggtgagtctcaagaagaaaccaagtcgtaacacctatctccccgaagtttcatatcagttcccaaaattggacaggccaacaaagcagatgagagaggccgaagagaggctgaaggccatcccccagttttgctttccagatgctaaagattggctgccagtttccgagtactcctccgaaacattcagcttcatgctcaccggagaggatggttcccgccgttttggttattgcaggaggctacttcccagcggaaaaggcccaaggttacccgaggtatattgcgttataagtagactcggatgtttcggactgttctcaaaggtgctagacgaggtggagcggagacgcggtattagtgctgccctggtgtatccttttatgcgctcgctgatggagtctccctttccagctcccggtaagacaataaaagtcaagactttcctccctggcgcagggaatgaagttctggaactgaggaggccaatggacagccggctcgagcacgtatag

SEQ ID NO: 242844 - DNA, 231 bp, Artificial Sequence
  Description of Artificial Sequence: Synthetic coding sequence
atgaccatgacagcgaataagaattcaagcattacgcatggcgctgggggtacaaaggccccaagaggcacactctcaaggaagtcattcgagttcgaggacgcctcgtcgctgcaaagtctttacccctcgagtccgacggagaatggaacagagaatcagcccaaattcggctcgaagtccactttagaggagaacgcatacgaggacatcgtcggcgatctgccctag

SEQ ID NO: 242845 - DNA, 225 bp, Artificial Sequence
  Description of Artificial Sequence: Synthetic coding sequence
atgacaatgactgctaacaagaactcttctattacacacggggctggaggaaccaaagcccctaggggtactctatctcgcagccagagcgtgagcccaccacccgtactgtcgccccctaggtctccaatctatcctctgagtgattccgagacatcggcatgccggtatccatcccactcctcaagccgggtactgctaaaggatcggcatccacctgcctag

SEQ ID NO: 242846 - DNA, 435 bp, Artificial Sequence
  Description of Artificial Sequence: Synthetic coding sequence
atgaccatgactgccaataagaattcttccatcactcatggcgctgggggaacgaaggctccccgaggaacccttagccggagtcagagcgtgtcaccacccccagttctcagccctcccaggtctcctatctatcctcttagcgattcggaaacctcagcctgtcggtacccctcacattcctcctctcgcgtactgttgaaagacaggcacccgccagcgccttcaccgcaaaaccctcaagaccccagtccagataccagcccaccaacatgtcctttcaaaacagctagtttcggatatctagaccgatctccatctgcttgcaagcgagacgcacagaaggaaagcgtgcagggcgcagcacaggatgtcgcgggagtggcagcatgccttccgctcgcccagagtactccttttcccggtcctgcgtag

SEQ ID NO: 242847 - DNA, 3414 bp, Artificial Sequence
  Description of Artificial Sequence: Synthetic coding sequence
atgactatgacagctaacaagaactcctctataactcacggggcaggaggcaccaaggcccctaggggaactctatctaggagccagagcgttagccctccaccggttctgtcaccacccaggtcccccatatatcctttgagcgactccgagacgtcagcatgcaggtacccttcacactcaagttcacgggtgttgctcaaggatagacaccctcccgctcctagcccacaaaatccacaggatccttctcccgatacttctcctccgacttgccccttcaagactgccagctttggatacctggatagaagccccagtgcatgtaaacgcgacgcacagaaggagtcggtacaaggagctgcacaagatgtggccggtgttgcggcatgtctacctttggcacagtccactccctttcccggaccagcagctggaccgaggggggtgctgttaacacggactggcacgcgagcccactccctgggtataagagaaaaaatttcagcctgggaaggacgacgcgaggcctccccacgcatgtcgatgtgtggagagaaaagagaaggctccggatcggaatgggcagcgagtgaaggttgtccgagcctgggttgtccctctgtcgttccctctccctgcagcagtgaaaaaacttttgacttcaaagggctgaggcgaatgagtagaacatttagcgagtgttcttatcccgaaacagaagaagaaggagaggctttacccgtaagagactccttctaccggttggagaagcgactgggcaggagtgagccatcagcctttttgagaggacacggtagccgcaaagagtcctccgccgtgctgtctcgcatccagaaaatcgagcaggttttaaaagaacagcccggacgaggcctcccccagctacctagttcctgttattctgttgatcggggtaagcgaaaaacgggcacgctcggttctttggaagaacccgctggtggcgcatccgtatcggccggtagccgagctgtgggcgtagctggagtggcaggcgaggctgggccaccacccgaacgcgaaggttccggatctaccaagccaggcacaccaggaaattcgcccagtagccagcgtctgccttctaaatcctctctggaccccgcagtgaaccccgtgcctaaacccaaacggacttttgaatacgaagctgacaagaatcctaagtcaaagccttccaacgggctgccccctagccccacccccgcagccccaccccctctaccctccacaccagctcctcccgtcacaaggagacccaaaaaagacatgcgaggccatagaaagtcgcaatctcgtaagtctttcgagttcgaggacgccagctctttgcagagtctctacccctctagtcccacggagaatggaaccgaaaatcagccaaagtttggttccaagagcaccttagaagagaatgcgtatgaagacatcgtgggggaccttcctaaggaaaacccttatgaggacgtggatctcaagtcccgcagggccggtagaaaatctcaacagctaagcgagaactcgctagacagtttgcatcgcatgtggtcccctcaggatcggaagtataactcaccacctacacagctttcattgaaacccaattctcaatccctgagatccggaaactggtcggagcgcaagtcccataggctccctcgtctacccaagaggcattcccacgacgacatgctcttactggcacagctctccctgccatcgagcccaagctcgctcaatgaggactctctctccaccactagcgaactgctctcctcccggcgtgctagaaggatcccgaagctggtacagcgcataaactctatttataacgctaaacggggtaagaagagactcaagaagctttctatgtctagcatcgaaacagcttcactgagggatgagaactctgaaagcgagagcgattccgacgatcgcttcaaagcccacactcagcgcctggtgcacattcaatccatgctcaaaagagcccctagctatcggaccctcgagcttgagctgttggagtggcaagagcgcgagttatttgaatacttcgtggtggtgtccctcaagaagaagccctcccgtaacacctaccttccagaggtgagttaccagttcccaaagctggaccggcctactaagcagatgcgggaagctgaggagcgcctgaaggccattccacagttctgctttcccgatgccaaagattggctacctgtctcagaatacagctcggaaacgttctcatttatgttgaccggcgaagacggcagccgacgcttcggctattgtcgacggttgctcccatcagggaaggggccaagactccctgaagtttattgcgtcatctcccgactggggtgttttggcctgttctccaaggtccttgatgaggtcgagcggaggaggggaatttctgccgcacttgtgtacccttttatgcgatccctcatggaaagtccttttccagcccctggcaagaccattaaagtaaaaacctttctacccggtgcaggaaatgaggtactggagctgaggaggccaatggacagtcgcctagagcacgtggatttcgagtgtcttttcacttgcctgtctgtacgacagctaatccggatctttgcatcgctcctgctcgagcgtagagtaatattcgtcgctgataaattaagcaccctgagttcatgttcgcatgcagtcgtggcgctgctgtatccgttttcctggcagcataccttcatcccagtcctgccggctagtatgatcgatattgtgtgctgtcctaccccctttctggtaggactcctcagctccagtttacccaaactgaaggaactgcctgtcgaagaagccttgatggtgaatctgggcagtgacaggttcatccgccagatggatgacgaagacacgctactcccacgtaagctgcaggctgccctggagcaagccttagagaggaaaaacgagctgatctctcaggacagcgacagcgacagtgacgatgaatgtaatactctgaacggtctcgtcagcgaggtcttcattcggttttttgtcgagacagtgggacactactccctgttccttacccagtccgagaagggagagcgtgccttccagcgcgaggccttccgcaagagtgtggccagtaagtctatccggagattcttggaagtgtttatggagtctcagatgttcgccggtttcatccaagacagggaattacggaagtgcagggccaaaggcctattcgaacagcgcgtggagcaatatctggaggagcttccagatacggaacagagcgggatgaacaagttccttcggggactgggtaacaagatgaagttcctccataagaaaaattag

SEQ ID NO: 242848 - DNA, 369 bp, Artificial Sequence
  Description of Artificial Sequence: Synthetic coding sequence
atgacaatgaccgctaataagaacagtagtatcactcatggcgctggcggaacaaaggcccctcgtgggactctatcccgttcccagagtgttagccctccacccgttctgtccccgccacgatcccccatctatccactgagcgacagcgagaccagcgcctgccggtatcctagtcactcctcttctcgcgtcctgttgaaggacagacaccctccggctccctctccacagaatccccaggatccctcacccgatacatcacctccaacgtgtccttttaagacagcgtccttcggctacctggatcgctcaccttccgcctgtaagcgcgacgctcagaaagaaagcgtccagggcgcagcctag

SEQ ID NO: 242849 - DNA, 93 bp, Artificial Sequence
  Description of Artificial Sequence: Synthetic coding sequence
atgaccatgaccgcgaacaaaaattccagcatcacacatggggctggaggcaccaaggctccccgtgggaccttgagtcgttcacagagttag

SEQ ID NO: 242850 - DNA, 1758 bp, Artificial Sequence
  Description of Artificial Sequence: Synthetic coding sequence
atggctgaagcagctaccgggtttctggaacagcttaagtcttgtatcgtgtggagctggacttacctttggactgtttggttttttatagttctcttccttgtgtacattttgcgggtgcctctgaagatcaacgataatctttcaaccgtgagtatgttcctgaacaccctcacgcctaagttttatgtggctctgacgggaacgtcctcgcttattagtggattgatcttgattttcgaatggtggtacttccgaaaatatgggacgtcatttattgagcaggtctctgtttcccacctgcgtcctctgttaggaggggtggacaacaattcttcaaacaacagcaacagcagcaacggcgactccgatagtaaccgacagagcgttagcgaatgcaaggtctggcgaaaccccctgaacctgttccgtggcgcagagtacaacaggtacacttgggtgacaggtcgagaaccacttacctattatgatatgaacctcagcgcccaggatcaccagactttcttcacatgtgatagcgatcatttaagaccagcggatgctatcatgcagaaggcatggagagagaggaatccacaggccaggatctccgctgcccatgaggccctcgagattaacgaaattcgctctagggtagaggtgcccctcattgccagctctaccatttgggaaatcaaacttctcccaaagtgtgcaaccgcgtacattctactcgcggaggaggaggccaccacaattgccgaagcagagaaactgtttaagcaggccctgaaagcaggagacggatgctatcgtcgatctcagcagttacagcaccacggaagccagtatgaggctcaacaccgtcgggacaccaatgtgctagtgtatataaagcggcgtttagccatgtgcgcccgaagattgggtcgtactagagaagctgtgaaaatgatgagggacctcatgaaggagttccccttactttcaatgtttaatattcacgagaatctcttagaagccctgctggaactgcaggcttatgccgatgttcaggccgtgctcgccaagtatgatgacatcagcctgcccaagagcgccacaatctgttataccgctgctctgctgaaggcacgagctgtctccgacaaattctctcctgaggcggcttcacggagaggactgtccacagctgaaatgaacgctgttgaggctatccatcgcgcagtcgaatttaacccccacgtccccaaatacctgctggaaatgaaatccttgatccttccccctgagcatatcctgaagcgcggtgactccgaggctatcgcttacgcctttttccatcttgcccattggaagagggtggagggggcacttaacttacttcattgtacttgggagggaacattcagaatgataccttatcccttggaaaagggacatctgttctacccgtacccaatctgcaccgagacagctgacagagaacttttgccctcgtttcatgaggtgtcagtctatccaaaaaaggagctgccctttttcattctgtttacagctggtctgtgttcctttaccgcgatgttggcgttgctgacccaccagtttcctgagttaatgggcgtctttgcaaaggctatgattgatatcttttgcagcgccgagttcagggactggaactgtaaatctatcttcatgcgcgtcgaagacgaacttgaaatcccccctgcccctcagagtcaacacttccagaactag

SEQ ID NO: 242851 - DNA, 1500 bp, Artificial Sequence
  Description of Artificial Sequence: Synthetic coding sequence
atgagtatgtttctgaatacgctaaccccaaaattctacgtagcgctcaccggaacctccagtctgatttcaggtcttatcctgattttcgaatggtggtatttcagaaagtatgggaccagctttattgagcaggtatccgtgagccacctccgacctttgctgggtggcgttgacaacaatagtagcaacaacagcaactcatcgaatggggattcggattcaaaccgccaatccgtgagcgaatgcaaagtgtggcgaaaccctctcaatctgttcaggggggcagaatataaccgttacacatgggtcaccggcagagagccactgacttattatgatatgaacttatccgcccaggatcaccagactttttttacctgcgactctgatcatctgcggcctgctgatgccattatgcagaaggcctggcgcgaaagaaatccacaggccagaatttctgcagcccacgaagcactggagataaacgagtgcgcaacggcttacatcttgttagccgaggaggaggcaactacgatagctgaggctgagaaactatttaaacaggcactcaaggcgggagatgggtgttatcggagaagccagcagttacagcaccacggctcacagtatgaggcacaacacaggcgggataccaatgtgttagtatatataaaacgtaggctagcaatgtgtgcacgaagattaggcaggaccagagaagcggtcaaaatgatgcgagatctgatgaaggagttccctctattgtctatgttcaacatccatgaaaaccttttggaggccctattggagcttcaagcatatgcagatgtacaggccgtactggccaagtacgacgatatctctctacccaagtcagccaccatttgctacactgcagcactccttaaagctcgggcagtttctgataaattcagcccagaggctgcttctagaaggggcctgtccacggccgaaatgaatgctgttgaagccattcacagggctgttgaattcaacccacacgttccaaaataccttctcgaaatgaagtctctgattctgccacctgagcacattttaaagcggggagactccgaggccatagcttatgccttttttcacttagcccactggaaaagggtggaaggcgcactgaatctcctgcattcatttcgcatgataccgtatcctctggaaaagggacacctcttctacccatacccaatctgtaccgagaccgctgatagggagctattaccaagctttcacgaagtgagtgtgtaccccaagaaagagctcccctttttcatcctgttcactgctggactttgtagttttaccgctatgctcgccctactaacacatcagttccccgagctcatgggcgtgttcgctaaagctttcttatctacactcttcgctcctctgaatttcgtcatggagaaggttgaaagtattcttccgtctagcctgtggcatcagctgactcgcatatag

SEQ ID NO: 242852 - DNA, 1536 bp, Artificial Sequence
  Description of Artificial Sequence: Synthetic coding sequence
atgttcggaactgaatcctccctctcaatgtttcttaataccctgacacctaagttctacgttgcactgacgggaacttctagtttaatctctggcctgattttgattttcgagtggtggtactttcggaaatatggcacttcatttatcgagcaggtgtctgtgtcccacctgagacccctgctcgggggagtggataacaactcatccaataattcgaattctagcaacggtgattctgactctaatcggcaatctgtgtccgagtgtaaggtttggaggaatcccctgaacctgttccggggagcagagtataatcggtacacctgggtgacaggtagagaaccattaacatactatgacatgaatctgagtgcgcaggatcatcagacttttttcacatgcgacagcgaccacttacgacccgcagacgccattatgcagaaagcctggcgagagaggaaccctcaggccagaatatctgcagcccatgaagccctggagattaacgagtgcgcgaccgcttacatactactcgctgaggaagaggcaacaaccatagccgaggccgaaaagttgttcaagcaagccctgaaagcaggagacggatgctatcgccgtagccaacaattacagcatcatgggtcacagtacgaggctcagcatcggagagatacgaacgttttggtgtatatcaagaggcgcctggccatgtgcgccaggcgcttgggacggacgagagaagccgtgaagatgatgcgagatttgatgaaagaatttcccctcctgagtatgttcaatattcacgaaaacctgttggaggcgttgctggaactccaagcctatgcggatgtgcaagccgtcctggctaagtatgatgatattagtcttcctaagtccgctaccatctgttacaccgctgccctcctaaaggccagggccgtgagtgacaagttttcgcctgaggccgcatctaggagaggtctgtccactgctgagatgaacgcagtcgaggccatccatcgtgctgtggagttcaatccacacgtacctaaatatctgctggagatgaagagtctcattttaccccctgagcatatccttaaacgtggggattcagaggccatcgcgtacgcatttttccacctggcgcactggaaacgagtagagggagccctgaacctccttcattgcacatgggagggcacgttcaggatgattccttaccctcttgaaaagggacatctgttctacccttatcctatctgtacagagacggccgaccgtgaactcctcccaagtttccacgaggtgtccgtttatccgaaaaaagaacttccctttttcatcttgtttacagctggtttgtgttcattcacagctatgctcgccctgctgacccaccagttcccagagcttatgggagtgtttgcaaaggcctttctgtccactttatttgctccactgaattttgtaatggagaaagtggagtctatcctgcccagcagtctgtggcaccagctgacacggatctag

SEQ ID NO: 242853 - DNA, 1605 bp, Artificial Sequence
  Description of Artificial Sequence: Synthetic coding sequence
atgttcggtaccgaaagcagcctaagtatgttcctaaacactctcacccccaaattctatgtagcactgactggcacgagttcacttatctctggtctgattctcatctttgaatggtggtacttccgaaagtatggtacatcttttattgagcaggtttccgtcagccacctgagacctctcctgggaggcgtggacaataattcttctaataattccaattcatcaaacggcgattctgactccaatcggcagtccgtgtctgaatgcaaggtttggaggaacccattgaatctctttcggggagcggagtataatcgttacacctgggtcactgggcgagaaccacttacttattatgatatgaatcttagcgcccaggatcatcagaccttcttcacatgcgatagcgatcatctgaggcccgctgatgcaatcatgcagaaggcctggcgagaacggaacccgcaggccagaattagtgcagcccacgaggctctcgaaatcaacgaaatccggtcccgtgtggaagtacccctgatcgccagcagcaccatttgggagatcaaactacttccaaaatgcgctacggcttatattctgttggctgaggaagaggcaaccacaattgctgaggccgaaaagctgttcaagcaagcgttgaaagctggcgatggatgttatagacggagtcaacaacttcagcaccatggttcgcagtacgaggcccagcacagaagagacacaaatgttctcgtatatatcaagaggcggctggccatgtgtgcacgcaggcttggacgaacccgggaggcagtgaaaatgatgcgggatctcatgaaggagttcccactgctgagcatgttcaacatccacgagaatctactggaggcccttctggaactgcaggcatacgccgatgtgcaggccgtgttagcgaagtacgatgacatcagtctgcctaagagcgctaccatttgctacacagctgcattactcaaggccagggccgtaagcgacaagttttccccagaggcagcgtccagacgcggactgagtactgccgagatgaacgctgtcgaggccatccatcgcgcagttgagtttaacccacacgtacccaagtatctgctcgagatgaaatccctcatcctgcctccagagcatattctcaagcgtggggattctgaagccattgcatatgcttttttccatctcgctcattggaaaagggttgagggggcactcaacctccttcactgtacctgggagggaaccttccgaatgataccctatccattggagaagggacatttgttctacccatatcctatctgcactgagaccgcagaccgggagctccttccctcttttcatgaagtctccgtctatcctaaaaaggagttgcctttcttcattttgttcaccgctggactgtgcagtttcactgcaatgctggcacttttgactcaccagttcccggaactaatgggggtcttcgctaaagcttttctctctacgctgttcgctcctctcaatttcgtgatggagaaggtagagtcgatactgccctctagcctctggcaccagcttactcgaatctag

SEQ ID NO: 242854 - DNA, 1665 bp, Artificial Sequence
  Description of Artificial Sequence: Synthetic coding sequence
atggctgaggctgctaccgggttcctggagcagttgaagagctgtatcgtctggtcgtggacatatttatggacggtctggttctttatcgtcctgtttctagtctacatcctacgcgtacctctgaagataaacgacaaccttagtaccgtttccatgtttctgaataccctgacccctaagttttacgtcgcattgaccggaacatcctctctcataagtggactgatacttatcttcgagtggtggtacttccgcaaatatggaacctcatttatcgaacaggtgtcagtcagtcacttgcgcccacttctgggcggagttgataataacagctcgaacaacagcaatagctctaacggtgattctgactcaaaccgacagtcagtatccgaatgtaaagtgtggcgcaaccccctgaacctgtttcgcggagctgagtataacaggtacacctgggttacaggccgagagccactgacatactatgacatgaatctgagcgcacaagatcaccagacattttttacttgtgattccgaccacctccgtccggcagacgccatcatgcagaaggcctggagagaaaggaacccacaggccagaattagtgctgcgcacgaggcactggaaatcaacgagtgtgcaaccgcctacattctcctggctgaggaggaagccaccactatcgcggaagctgagaagctctttaagcaggccctgaaagccggagatggctgttatagacgttcgcagcagcttcagcaccatggcagccagtacgaagcccagcatcggcgagacacaaatgtcctggtctacataaaaagacggttggctatgtgcgccaggagactaggacgcaccagagaggccgtgaaaatgatgcgcgacttaatgaaggagttccccctgttatcgatgtttaacatccacgaaaacctcctggaggccctacttgagctccaggcctatgcggacgtacaagcagttttggccaaatatgatgacatctccctgccaaaatctgctacaatttgctacactgcggctctattgaaggcccgtgcagttagtgataaattttcccccgaggcggctagccggaggggcctcagcacagcagagatgaatgccgttgaagcaatacatagggctgtcgagttcaatcctcacgtccctaagtatcttcttgaaatgaagagtctcattctaccacccgaacatatcctgaaacgaggggactctgaagccatagcctacgccttcttccatcttgcccactggaagcgcgtggaaggagcgttgaacctgttgcattgcacatgggagggaacctttcgcatgataccctaccctctggagaaggggcatttgttttacccctatcccatctgcactgagaccgccgatcgcgaactgctgccctcgttccatgaagtctcagtttatccgaaaaaggagctcccattctttatcctgttcacagccggattatgtagttttactgccatgctggcactccttacacatcagttccctgaactaatgggggtttttgctaaagctttcttatccactctcttcgcccctttgaactttgtgatggagaaggtggaaagtatcctgcccagttccttgtggcaccagttgacacgcatctag

SEQ ID NO: 242855 - DNA, 189 bp, Artificial Sequence
  Description of Artificial Sequence: Synthetic coding sequence
atgtctatgtttctgaacacacttacccccaaattctatgtcgcactgacaggaacgtcatctttaattagcggcctgattctgatttttgagtggtggtacttcaggaagtacggcacttcgtttattgagcaggtctcagtgtctcacctgaggccgcttctaggcggagtcgataacaattcatag

SEQ ID NO: 242856 - DNA, 264 bp, Artificial Sequence
  Description of Artificial Sequence: Synthetic coding sequence
atgagtatgtttctcaatactctcacgcctaaattctatgtcgctctcactggcacaagctcacttatcagtggtctgatactgatcttcgagtggtggtatttcaggaagtatggcaccagctttattgaacaggtctcagtttctcatctccggcctctcctcggaggcgtcgataacaattcaagcaacaactccaacagcagcaatggagatagtgatagtaatcgtcagtcagtgtctgaatgcaaggtttggaggtag

SEQ ID NO: 242857 - DNA, 1323 bp, Artificial Sequence
  Description of Artificial Sequence: Synthetic coding sequence
atggccgagaataatgagaacatatcaaagaatgtcgacgtccgtccaaagacttccagatcccgatccgccgacagaaaagatggctacgtctggagcggtaaaaagctgagttggtcaaaaaagtccgagtcatactccgacgccgagaccgtgaacggaatcgaaaagacagaggtgtcactccggaaccaagaacggaaacattcatgtagctcaatagagctggacttggatcactcctgtggccaccggttcctgggccgttcactaaaacagaagctgcaagatgccgtgggacaatgctttcccataaagaattgtagcagtcggcactcgtcaggcctgccctccaaaagaaagattcatatctccgaactgatgttagataaatgcccctttcctccacggtccgatcttgccttccggtggcacttcatcaagcggcacacagcacccataaattccaagagtgacgaatgggtaagcaccgatctgtcacagaccgaattgagggatggtcaactcaagagaaggaacatggaagagaacatcaattgtttctcccacaccaatgtgcagccctgtgtaatcacaacagataacgctctgtgtcgagaaggacccatgacaggttcagttatgaatctagtttccaacaactccattgaagactctgacatggattctgacgatgagattctcactttgtgtacctccagcaggaaacgcaataagccaaaatgggacctcgacgacgagatcctacagctcgaaacacctccaaaataccacacccagatcgattacgtgcattgtctcgtccccgacctgctgcagatcaacaacaacccctgttattggggcgtgatggataagtacgcagccgaggctcttttagagggcaaacccgagggcaccttcctgctccgagatagtgcccaagaagactacttgttttcagtttctttcaggagatactcaagaagcctgcacgcaaggattgaacagtggaaccacaatttctccttcgatgcccacgacccctgcgtgttccattccccggacatcacaggcctgctggaacactacaaagatcccagtgcctgtatgtttttcgaacctcttctttcaactcccttgatccgtacgttccccttctccctgcaacacatttgcaggaccgttatctgtaactgcaccacctacgacggtattgatgccctgcctattccgtcctccatgaagctgtacctaaaggaatatcactacaaatccaaggtcagggtattgcggatcgatgcacccgagcaacagtgctag

SEQ ID NO: 242858 - DNA, 1323 bp, Artificial Sequence
  Description of Artificial Sequence: Synthetic coding sequence
atggctgagaacaacgaaaacatctctaagaatgtggacgtcaggcccaaaacctccagatcacggtcagcggatcggaaggatggttatgtctggtcaggaaagaaactgtcatggtcgaaaaagtccgagtcttactccgacgcagagacggtgaatggaattgagaaaaccgaagtttctctcagaaaccaggaacgcaaacattcttgcagctccatcgagctcgatctggatcatagctgtggacacaggtttctcgggagatccttgaagcaaaagctgcaggacgccgtagggcagtgctttccaatcaaaaactgtagtagccggcacagttctggattaccgtcaaaacgaaagatccacatttccgaactgatgctcgacaagtgcccattcccaccaaggtccgatctcgccttcaggtggcacttcatcaagagacacaccgctccaatcaactctaaaagcgatgagtgggttagcacagatctgtcacagaccgagctcagagacggccagctgaagcgccgaaatatggaggagaacataaactgctttagccataccaatgtgcagccatgcgtcatcaccaccgataatgccctgtgtcgcgaggggcctatgacaggctccgtgatgaacctagtaagcaataacagcatcgaggacagcgacatggacagcgacgatgagattctgaccctctgcacctccagccgaaagcggaataagccaaaatgggatctggatgacgaaatactgcagttagaaacaccgccaaaatatcatactcagatagattacgttcactgcctggtgcccgatctcctgcagatcaacaacaacccatgttactggggcgtgatggacaagtatgcagccgaagccttactcgagggaaaaccggagggaactttcctccttcgcgacagtgcccaggaggattacctttttagcgtcagctttcggaggtatagtcgaagccttcatgccaggattgaacaatggaatcataacttcagctttgacgcccatgatccctgtgtgtttcattcacccgatatcacgggtcttcttgagcattataaggacccgtcggcctgcatgttctttgagcctctcttgagcactcctctgatccgcacgttcccattcagcttgcaacacatttgtcgcactgtgatatgcaactgcacaacctacgacggtattgacgccctccctatccctagctcaatgaaactgtacttgaaggaatatcactacaagtctaaagtccgtgttctgcgaatcgacgctcccgaacagcagtgctag

SEQ ID NO: 242859 - DNA, 1323 bp, Artificial Sequence
  Description of Artificial Sequence: Synthetic coding sequence
atggcagaaaacaacgaaaacatttccaagaacgttgacgtaagaccgaagacttcacgctcaaggagcgcagatcggaaggacgggtatgtgtggtctggtaagaaactatcttggagcaaaaaatccgagtcctactccgatgccgaaaccgtgaacgggatcgagaagaccgaggtgtccctccgaaatcaggaaagaaaacacagttgcagttcgatagaactcgatttggatcattcatgtggacatcgcttcttgggcagaagcctcaagcagaagctgcaggacgctgtgggacagtgcttccccatcaaaaattgttcatcacggcattcaagtggactgccctctaaaagaaaaattcacatatcagagctgatgcttgacaagtgtccctttccgcctaggtccgacttggcatttagatggcactttatcaagcggcataccgccccaatcaactctaaatctgatgaatgggtttccactgacttatctcaaacagaactgcgtgatggacagctgaagcggcgaaacatggaggagaacattaattgtttttcacataccaatgtgcagccttgtgttataactacggacaatgcactgtgtcgggaaggcccaatgaccggctctgttatgaacttagttagcaacaattcaattgaagatagcgacatggattctgatgatgagattctgaccctgtgcacctcgagcagaaagcggaacaagccaaaatgggatctggacgacgagattttacagctggagactccccctaaataccacacacagattgactatgtgcactgccttgtgcccgatcttctccagataaataacaacccttgctactggggggtgatggataaatacgccgctgaagccctgttggagggcaagcctgaaggcacctttctcttacgggatagtgcccaggaagactatctgttcagcgtatctttccgcagatattctcggagtttacatgcgagaattgagcagtggaatcacaatttcagcttcgatgcccatgatccatgtgtttttcattcccccgatatcacggggcttttggagcactataaagaccctagcgcatgcatgttctttgagcctcttctttcaacccccttgatcagaacgttcccattctcgttgcagcatatttgccgtaccgtaatctgcaattgtaccacatacgatggaatcgacgcattacctattccctcgagcatgaaactgtatctgaaggagtaccattataagtccaaggtccgagtgctgagaattgacgccccagagcagcagtgttag

SEQ ID NO: 242860 - DNA, 1611 bp, Artificial Sequence
  Description of Artificial Sequence: Synthetic coding sequence
atggataaagttggtaagatgtggaacaacttcaagtatagatgccagaatcttttcggacatgagggtggctctagaagtgagaacgtggacatgaactctaaccggtgcctgtcagtaaaggaaaaaaacatctctataggagacagcacacctcagcagcagtcctctcctctgagagaaaacatagcgctccagctcgggctgtctccttcaaagaacagctccagacggaaccagaattgcgccacggagattccgcagatcgtggagatctccatcgagaaagacaacgattcatgcgtgacaccaggtacacgtctagccaggagagactcctactcccgccatgctccgtgggggggtaagaagaaacactcatgctcgacaaagacgcagtcctcactggacgctgacaaaaagttcggcagaaccagatctggacttcagcgcagggagcgtcggtacggagtgagctccgttcacgatatggacagcgtatcaagccgaacggtagggtcccgctcacttaggcaacgcctacaggatacggtcggcctgtgtttcccgatgcgaacatactctaaacaatccaagccccttttctcaaataagcggaagatacacctgagcgaactgatgctagagaagtgtcccttccctgcaggaagtgatcttgcccagaaatggcatcttatcaaacaacacaccgctccagtgagcccacactccacattttttgatacgtttgatcctagtcttgtctccaccgaagacgaagaagatagattacgcgagcgcaggagacttagtatagaggagggggtcgatccccctcctaacgcgcagatccacacatttgaggcaacagcccaggtcaatcccctgtataagctaggccctaagcttgcacccggtatgacggagatttcaggggactcatcagccatccctcaggccaactgtgattcagaggaggataccactactctgtgccttcagtcacgccgtcagaagcagagacagatttcaggagactctcatactcacgttagcagacagggggcttggaaggtgcatacccaaattgactacatccattgtctggtcccagacctgctacagatcaccggcaacccatgttattggggcgtgatggaccgatatgaagctgaggccctgttggaagggaaaccggaggggacctttctgcttcgcgattccgcacaggaggattacttgttcagcgttagttttcgcaggtacaacagaagcttgcacgcaagaattgaacagtggaatcacaatttctccttcgatgcccacgacccatgtgtgtttcacagcagcaccgttacaggccttctcgagcattataaggatccaagctcctgcatgttcttcgaacctttgctgacgatctccctgaatcggaccttcccgttctcactccagtatatctgccgcgcagtgatatgtcgctgtacaacctacgacgggatcgacggcctgcctcttcccagcatgctccaagactttcttaaagagtatcactataagcaaaaagtccgcgtgagatggcttgagcgcgagccggtaaaggccaagtag

SEQ ID NO: 242861 - DNA, 1611 bp, Artificial Sequence
  Description of Artificial Sequence: Synthetic coding sequence
atggacaaggtgggcaagatgtggaacaattttaagtaccgctgtcagaatctgtttggtcatgaggggggatcccggtctgaaaacgtggatatgaactcgaaccggtgtttaagcgtgaaagaaaagaacatctccatcggtgactctacccctcaacagcagagctcccctctccgcgagaacatcgctctgcagctgggattgtccccaagcaaaaattccagtcggagaaatcagaattgcgctaccgagatcccacaaatcgtggaaatttccatcgagaaggacaatgatagttgcgtgacaccaggaactaggttggccagacgtgatagttactctcgccatgctccctggggcggaaaaaaaaagcacagctgcagcaccaagacacaatcaagtctggatgcagacaaaaaattcggcagaactcgcagcggactccagaggcgggagcggaggtatggtgtcagcagtgtccatgatatggatagcgtgtccagccgcactgttggctcacggtccctgagacagcggctccaggatactgtgggcctctgttttccaatgcgcacatacagtaagcagtctaaaccgttgttctcaaacaaacgaaagatccacttgagcgaactgatgctcgaaaaatgtccatttcctgctggctctgacttggcacagaaatggcatcttatcaagcagcacaccgcaccggtttcacctcactccaccttctttgacacttttgatccaagtctggtatccacggaagacgaagaggatcgcctgcgggaaagacgcagactcagcattgaggagggtgtcgatccccctcctaatgcacagatccacacttttgaagccacggcccaggttaatcctctctacaagctgggccctaaattggcaccgggaatgacagagatctcgggggactcaagtgccattccacaggcaaattgtgattctgaggaggacactacgactctgtgtctccaatccaggaggcagaagcagcgtcagatctcaggcgattcccacacccatgtctcaagacaaggtgcctggaaggtccacacacagatcgattatatccactgcctggtgcccgaccttttgcagattacaggcaacccatgttattggggcgtcatggaccggtacgaggccgaggctctgctggaaggaaagcccgagggaacctttctcctgagagattccgcacaggaggactacttattttcggtgtcctttcggagatataacagatccttacacgcaagaatcgaacagtggaatcataacttttctttcgacgctcatgatccttgcgtgttccattcaagcactgtgactggactcctcgagcattacaaggacccttcctcttgcatgtttttcgaacccctgctcactatctcgctaaatcgcactttccccttctctctccagtatatctgcagggccgtaatatgtaggtgtacaacctacgatggaattgacggtcttccactgcccagcatgctgcaagattttctgaaggagtatcactataaacagaaagttagagtgagatggcttgaaagggagcctgtcaaagctaagtag

SEQ ID NO: 242862 - DNA, 3264 bp, Artificial Sequence
  Description of Artificial Sequence: Synthetic coding sequence
atgagtgacagtgaggattccaattttagcgaggaagaagattccgaacgctcctcggatggggaagaggcggaggtagatgaggagcgcaggagcgctgccggaagcgaaaaagaggaggaacctgaggacgaggaggaagaagaagaagaggaggagtacgacgaggaagaggaggaggaagatgacgaccgtccacctaagaagcccagacacggcggttttatactggacgaagccgacgtcgacgacgagtacgaagatgaagaccagtgggaagatggcgctgaagacattctggaaaaggaggagatcgaggctagcaatatagataacgtggttctcgacgaggaccggtctggcgcaagaagactgcagaacttgtggagggaccagagggaagaggaactgggcgagtactacatgaagaaatatgcaaagtcctccgtgggggagacagtttatggtggatctgacgaactttcggacgacattactcagcaacaactgctccctggggtgaaggacccaaacctgtggactgtcaaatgcaagatcggggaagagagggcaacagccatctccctgatgcgaaagttcattgcctaccagtttacggatacccccttacagatcaagtctgtggtggcacccgaacacgtgaaaggatacatttatgttgaagcatacaaacagacccacgtgaagcaggcaatagagggagtcggcaatctgcgccttggctactggaatcaacagatggtccccatcaaggagatgacggacgtgcttaaagtcgtcaaggaggtggctaacctgaagccgaagtcttgggtcagactcaagagaggaatatacaaggacgatatcgcccaagtagactacgtcgaaccaagccagaacacgatctccctgaaaatgatcccccgaatcgactatgataggataaaagcgaggatgagcctcaaggactggtttgctaagcgcaaaaagttcaagcgcccaccacagaggttgtttgacgccgaaaagattcgctctctgggaggagacgtcgcgtcagacggcgatttccttatctttgagggcaacaggtacagcaggaaaggctttcttttcaagtcctttgctatgagcgcagtgattactgagggggtcaaaccaacactatctgaattggagaaattcgaagatcagcccgaaggtattgatctggaggtggtgactgagagtaccggtaaggagagggagcataactttcagcccggagacaatgtggaggtgtgtgaaggggaacttattaatctgcaagggaagattctgtcagtggatggcaacaaaataactattatgcccaagcacgaggacctgaaagacatgctcgagttccccgctcaggaacttcggaaatactttaagatgggagatcacgtaaaagttattgctggccgatttgaaggcgacacaggactgatcgtgagggtggaggagaatttcgttatactcttctccgatctgacaatgcacgaattaaaggttctccccagagacttgcagttatgttcggagactgcttcaggcgtcgacgtcggcggacagcatgagtggggggagctggtccaacttgatccgcagacagtcggggttatcgtgcgcctggaacgagaaacattccaagtgctgaatatgtatggtaaagtcgtcacagtcaggcatcaggctgtcacacgcaagaaggataaccgatttgccgtcgccctagactcggaacaaaataatattcacgtgaaagatattgtgaaggtgatcgatggaccacattcagggcgagagggagagattcgacacctgtttagatccttcgcgttcctgcactgcaaaaagctggtcgaaaacggtggcatgttcgtctgcaaaaccaggcatttggtactggccggaggctctaaaccaagagatgtaacaaacttcacagtggggggtttcgctccaatgagccccagaattagcagccccatgcatccttctgctggagggcaacgaggaggctttgggagtcctggcggaggatctggtggcatgtctcggggaagaggtaggcgggacaacgaattgatcggacagacggtgaggatctcccagggaccatataaaggatatataggggttgtgaaagacgccaccgaatcaactgctcgtgtcgagcttcatagtacctgtcagacaattagcgtcgacaggcagagactgaccactgtaggaagtaggcgcccaggaggcatgacatctacctacggacgaacacctatgtacggcagtcagaccccaatgtacggctctggtagccgtacccccatgtatggatctcagacccccctccaagatgggtctagaacacctcactacggatcacaaacaccactgcatgatgggtcaagaacacctgcccagtcaggtgcttgggacccaaacaaccccaacactccatcccgcgcagaagaggaatatgagtacgcctttgacgatgaacctactcccagtccgcaggcgtatggcggtaccccgaaccctcaaactcccggttaccccgatccaagcagcccgcaggtgaatccccagtataatcctcagacccctggcacccccgctatgtataacaccgaccagttcagcccttacgctgccccttctccgcaggggtcgtatcagcccagcccctctccccagtcatatcaccaggtcgccccttcacctgctgggtaccagaatacccatagcccggcaagctaccacccaactccatctcctatggcctaccaggccagtccgtcaccctctcctgtcgggtacagcccaatgacacccggtgcccctagtccgggaggttataaccctcataccccaggctccggaattgagcaaaactcaagcgattgggtgaccactgatatacaagtcaaggtgcgggacacatacttggatacgcaggttgtgggtcagaccggggttatccgcagcgtgaccggtggaatgtgttccgtatacctcaaggactccgaaaaggtggtgtccatttcctccgaacacttggagccaattactccaactaagaacaacaaagttaaagttattctgggggaagaccgagaggccaccggcgtcctgcttagcatagacggggaggatggcatagtacggatggaccttgacgaacaactgaagatcctgaatctcaggtttcttggaaagctgctcgaagcatag

SEQ ID NO: 242863 - DNA, 3198 bp, Artificial Sequence
  Description of Artificial Sequence: Synthetic coding sequence
atgtccgactctgaagattcaaatttttccgaggaggaagactcggagaggtccagtgatggggaagaagccgaagtagacgaagagagaagaagcgccgctggctcggagaaggaggatgacgatcggccaccaaagaaacctcgccacggaggctttatcctggacgaagcggacgtggacgacgaatatgaagatgaagaccagtgggaagacggagccgaggacattttggaaaaagaggaaatcgaggcatcaaacatcgacaacgtggtgctggacgaagatagatcgggcgcaagacggctacaaaacctttggagagaccagagagaggaggagctaggagagtactacatgaagaaatatgcaaaatcttctgttggcgaaacagtctacggtggatcagacgaactgtcagatgatatcacccagcagcaactcctgcccggagttaaggatccaaatctgtggaccgtgaagtgcaagatcggcgaggagcgtgccacggctatctccctgatgagaaaattcattgcctaccaattcacagacacacctctccagatcaagtcggttgtagcccctgaacatgtgaaaggttatatatacgtggaagcttacaagcagacccacgtgaagcaagccatcgagggagtaggtaatttaaggctgggatattggaaccaacagatggtaccaataaaggagatgactgacgtgctcaaggtggttaaggaggtggccaatctcaaacctaaatcttgggtccgccttaaacgcggaatctacaaagatgacatcgcacaggtggactacgtggaaccctcccagaatacaatatccttgaagatgatccccagaatcgattatgacaggatcaaagctcgtatgtcacttaaagattggtttgcaaagaggaaaaagtttaagcgcccaccgcagcgcctattcgatgccgaaaaaattaggtcattgggtggggacgttgccagtgacggcgatttcctcatttttgaggggaaccgatacagccgcaaaggctttcttttcaaatcttttgctatgagcgctgtgattacagaaggagtgaaacccaccctctccgagctggagaagttcgaagatcagccggaaggtattgacctggaagtagtcacggagtccaccggaaaagagcgtgagcacaattttcaacccggtgacaatgttgaagtctgtgaaggagagctgatcaacctgcaaggcaagattctgagcgtcgacggtaataaaatcacgataatgcctaagcatgaggaccttaaagacatgctcgagtttcctgcacaagaactcagaaagtattttaagatgggcgatcatgtaaaggtgatagcgggaaggttcgagggagacaccggcctaatcgtgagagtggaggaaaattttgtgatcctgtttagcgatctgaccatgcacgaactgaaggtgctgccacgagacctccagttgtgtagcgagaccgcctctggggttgatgtagggggacagcacgaatggggagagctggtacaactggatccgcagaccgtaggcgtgatcgttcgcctggagagggaaacttttcaggtgttaaacatgtacggcaaagtagtcacagtccggcaccaggcagtcacgagaaaaaaggacaacaggttcgccgtggccctggattcagaacagaacaacattcacgttaaagatatcgtgaaagtgatcgacgggccacactccggcagggagggtgaaattcgacacctgtttagatcattcgcatttttgcattgcaaaaaactggtggaaaatggagggatgttcgtgtgcaagacacgtcacttggtcctggccggagggtccaaacccagagacgtgactaattttacagtgggcggattcgcacctatgtcacccaggatctccagtccaatgcatccatccgcaggaggacagcgaggcggattcgggagccctggaggcggatccggcggaatgtccagagggagggggagacgtgacaacgagctgattgggcaaaccgtccgtatcagccaagggccatataagggatacataggggtcgtgaaggacgcaacagagtctacagctagagtagagctgcactcaacatgtcagaccatttccgtggacaggcagcgcctcaccaccgtcggatccaggcgtccagggggaatgacgtcaacctacgggcgaacccctatgtatggtagtcaaactcccatgtacggcagcggaagcagaacccccatgtacggatctcagacccctttgcaggacggcagtagaaccccgcactatgggagtcagacgcctctgcacgacggcagcaggacacccgctcagtcaggtgcgtgggaccctaacaaccccaataccccctctagggccgaggaagaatatgaatacgcctttgacgacgaacctacaccttctccacaagcctatggcggaacacccaacccgcaaacaccgggttaccctgacccatcctcacctcaggtaaacccacaatacaatccccaaacccctggcacaccagcgatgtacaataccgaccaattttctccatacgctgccccaagcccgcagggatcctatcagccgtcaccatctccccagtcataccaccaggtggcgccatcgccggcaggatatcagaacacccattctccagcttcataccaccccactccatcacctatggcttaccaggcatcacccagtcctagccctgtgggttattcacctatgaccccaggcgcaccaagtcctggcggttacaacccacatacacccggatccggcattgagcagaactcttctgactgggtgacaaccgacatccaggtaaaggtgcgtgatacctacctcgacacccaggtggtcgggcagactggggtcatacgctcggtgactggtggaatgtgctcagtctatctcaaggactcagagaaggtggtgtcaatctcgagcgagcacctggagcctattacgcctaccaagaacaacaaggttaaggtcattttaggagaagatcgagaagcaacgggggtgcttctctctatagatggcgaggacggcattgtgcgtatggacctggatgagcaacttaagattcttaatttgcggttcctgggaaagctactcgaagcatag

SEQ ID NO: 242864 - DNA, 3252 bp, Artificial Sequence
  Description of Artificial Sequence: Synthetic coding sequence
atgtctgactccgaagattcgaatttctcagaggaagaagattccgagagatcctccgatggagaggaagcagaggtggatgaggagcgacgctcagcagctggtagtgaaaaagaagaggagcccgaggacgaggaggaggaagaagaggaggaggaatacgatgaggaggaggaggaagaggacgacgataggcccccaaaaaaacctagacatgggggtttcattctggacgaggctgatgtggacgatgaatacgaagacgaagaccagtgggaggacggggctgaggacattttggagaaagcaagcaacattgataacgttgtcctcgacgaagatcgatctggcgctagaaggctgcagaacctgtggcgggaccagagggaggaagagttgggagaatattacatgaagaaatacgctaagagttcggttggagagaccgtttatggaggatccgatgaactcagcgacgacataactcagcaacagctcctgcccggtgtgaaagaccccaatctgtggaccgtgaaatgcaagatcggcgaggagcgcgcaactgcgattagtttgatgcgcaaatttatcgcgtatcagttcactgacacccccctgcaaataaagtcagtggttgcccctgagcacgtgaagggctacatctacgtggaagcctataagcagactcacgtgaagcaggccatcgaaggggtcggtaacctgcggcttggttactggaaccagcagatggtgcccattaaagaaatgactgatgttttgaaagtggtgaaggaggttgcgaacctgaaaccaaagagctgggtgaggctgaagcgcggaatttataaagacgacatcgctcaggttgactacgtagaaccttcacaaaatactatctctcttaagatgattccccgtatcgattacgaccgcattaaagccaggatgtcactgaaagactggttcgctaagcggaaaaagttcaaacgtccaccccagcgcctctttgacgctgaaaaaattcgcagcctgggcggagatgtggctagcgacggcgactttctcattttcgagggaaaccggtactcgcgaaaaggattcctgtttaagagctttgccatgtcggctgttattactgaaggggttaaacccacattatcagagctggagaagttcgaagaccagccagagggaattgatctggaggtagtgaccgaatctaccggaaaggaacgagagcacaactttcaacccggagacaacgttgaagtgtgcgagggtgaactgattaacctccaagggaaaatcctcagtgtggacggcaataagattacaatcatgccgaagcacgaggacctcaaagatatgttagagttcccagcccaggagctgagaaagtactttaagatgggagaccatgtgaaggtcatcgctggccgatttgagggcgacacaggtctgatagtgagagtggaggagaacttcgtaatactcttctccgatcttacaatgcacgaactaaaggttctgcctcgggacctgcagctttgttccgagacagcctcaggagttgatgtcgggggacagcatgaatggggggagcttgtgcagttggaccctcagactgttggcgttatagtcagactggagcgcgaaactttccaggtcctaaacatgtacggaaaagtcgtgactgtgcgccatcaggcagtgactcggaaaaaggataatcgctttgcagttgcactggactcagagcagaacaatatccatgtgaaagatattgtaaaggtcatcgacgggccacactcagggagagagggagagatcaggcacctgtttaggagctttgcttttctgcattgtaagaaacttgtggagaacggaggcatgttcgtgtgcaagacccgtcatctcgttctggccggaggtagtaagccacgcgatgtcaccaacttcacagtcggtggcttcgctcccatgtccccgagaattagctccccaatgcatccatctgccggagggcaacggggagggttcggatcaccagggggagggtccggtggcatgagcagaggacgtggccgtcgggacaacgaactgataggccagaccgtgcgcatcagccagggtccatataagggctatatcggcgtcgtgaaggacgctacagaatccaccgcaagagtcgagctccactcaacatgtcagactattagcgtagatcggcagcggctgacaaccgtcggcagccgcaggcctgggggaatgaccagcacctacgggaggactccaatgtacgggagccagacgcccatgtacggatccggctcacgcacccccatgtacggttcacagacccccctgcaagatggctctagaacaccccactatggctctcagactcccctccatgacgggtctcgaactcctgcccagtccggggcatgggacccaaacaatccaaatacacctagcagagcggaggaggaatatgaatatgcttttgacgacgaacctacaccttctccccaggcttatggcggaacgcctaacccacaaactcccggatacccagatccgtccagtccccaagtgaatcctcaatataatccacaaacaccaggaacaccagctatgtacaatacagatcagttctcaccttatgccgctcctagcccgcagggatcctatcagccgagcccctcacctcaaagctaccatcaggtggccccatcacctgccggataccagaatacccactccccagcttcttaccacccgacgccatctcctatggcctaccaagcaagtccatcaccctctcctgttgggtatagcccaatgacacccggtgcaccgagtcctggcggatataacccacacactcctggaagcgggatcgagcagaactcctccgattgggtgaccacggacatccaggtcaaggtgagagacacttatttggatacacaagtcgtcggtcagactggcgttatccggtctgtaactggcggaatgtgttctgtctacctgaaagactctgagaaggtggtctcaatttcgagcgaacatctagaaccgatcacccctaccaaaaacaataaggtgaaagtgattctgggcgaggaccgcgaggctacaggggttctcctttccattgatggagaagacggaattgtgcgaatggatcttgatgaacagctgaaaattctgaacctgaggttcctgggcaagcttctggaggcttag

SEQ ID NO: 242865 - DNA, 3264 bp, Artificial Sequence
  Description of Artificial Sequence: Synthetic coding sequence
atgtcagacagcgaggactcaaacttttcggaggaagaggactccgaacggtcatcagatggggaggaagcagaagtcgacgaagagaggagatcagccgctggatcggagaaagaggaagagcccgaggatgaggaggaggaagaggaggaagaggagtacgatgaagaggaggaagaggaagatgacgacaggccccctaaaaagccacggcacggtgggtttatcctggacgaggcagacgtcgacgatgagtacgaggacgaggaccagtgggaggatggagccgaagacatcctggagaaagaggagattgaagcctcaaatatagacaatgtcgttttggatgaggaccggagtggggcacggagactgcaaaatttatggcgagatcaaagagaggaagagctcggtgagtattacatgaagaagtacgccaagtcatccgtgggggagaccgtgtacggcggttctgacgagctgtcagacgacatcacgcaacagcagctgctaccaggggttaaggatcccaatttatggactgttaagtgcaagattggtgaggaacgcgcaaccgctatctccctgatgcgtaagtttatcgcttatcagttcaccgatacgcctctacagattaagtccgtagtagcacccgagcacgtcaagggatatatctacgtggaagcatataaacaaactcacgtaaagcaagcgattgagggggtcggtaatcttcggctgggatactggaaccaacaaatggtcccaatcaaagagatgaccgatgttctgaaggtcgttaaggaggtagccaacttgaagcctaaatcctgggttcgcctcaagcgcggtatctataaggacgatattgctcaggtggattacgtcgagccatcacagaatacaatcagcctgaagatgattccacgcatagattatgaccgcattaaggcccgaatgtcactgaaggattggttcgctaaaaggaagaagttcaagaggccccctcagaggctgttcgatgcagagaaaattcgaagcctgggcggagacgtggctagtgacggcgacttcctgatctttgagggcaacagatacagcaggaaaggctttttatttaagtctttcgcaatgagcgcagtgatcacagagggagtcaagcccaccctgagcgaactcgagaagtttgaggaccaaccggagggcatcgacctggaggtggtcacagaaagcactggcaaagaacgtgaacataatttccagccaggtgataacgtagaagtttgtgaaggtgaactgatcaacctgcagggcaaaatcctgagcgtggatggaaacaagattacaattatgccaaagcacgaggacctgaaggacatgctcgagtttcctgctcaggaactgagaaagtatttcaagatgggcgatcacgtaaaggtaattgcgggtagattcgagggcgatacgggcctcattgtgcgggttgaggagaactttgtgatcctgttcagcgatttaaccatgcacgagttgaaggtactcccaagggacctgcaactgtgtagcgagactgcatccggcgtggacgtgggaggccagcatgagtggggagagttggtccagctggacccccagaccgtgggcgtgattgtgcggctggagcgagagacttttcaggtgttgaatatgtatgggaaggtggttaccgttcgacatcaagctgtcactcgcaaaaaggataaccgtttcgccgtcgccctggattctgagcagaacaatattcatgttaaggatatcgtgaaagtgatcgacgggcctcactcgggcagagagggcgagatcagacatttgttccgatcctttgctttcctacattgtaaaaaactggtggaaaacgggggaatgttcgtctgcaaaactcggcacttagtgttagccggagggtctaagccaagagacgtcactaacttcaccgttgggggatttgcacctatgagtcctcgaataagttccccaatgcatccatctgccggaggtcagaggggaggttttggcagccccggagggggatctggtggtatgagtagggggagaggacggcgtgataacgaattaatcgggcagactgtgcgtattagccagggaccctataaggggtatataggagtggtgaaagatgccaccgaaagcactgccagggtcgaactgcatagtacctgtcagaccatctctgtggacaggcaaaggctgaccaccgtaggttcccgtagacctggcggaatgacatccacgtacgggagaacccccatgtacggttcacaaactcctatgtacggctcggggagcagaacccccatgtatggaagccagacaccgttgcaggacgggtcgcgcaccccccattatgggtctcagacaccgttgcatgacgggagccgaactccagcccaatcgggagcctgggaccctaataaccctaatacgccttctagggccgaggaagagtacgaatacgcctttgatgacgagcctaccccatctccccaggcctacgggggaacacctaacccccagacaccaggctacccggatccatcgagtccccaggtaaatcctcagtacaacccacagacccccggaacccccgctatgtacaataccgatcagttttcaccatacgccgcacccagtccacagggtagctatcagccgagccccagcccacaaagttaccaccaagtagcaccatcgccagctggttaccagaatacccattcgcccgcttcctatcatcccacgccttcccctatggcctaccaggcaagcccgagcccttccccagttggatactctccgatgactcccggagcgccaagcccaggcggatataacccccatactcctggatctggtattgagcagaacagttctgactgggtcaccaccgatattcaggtcaaggtccgtgatacctatctggatactcaagtggttggacagaccggggtcataagatctgttaccggcggaatgtgttcggtatatttgaaggattcagaaaaggttgtgagtatttctagcgaacacctggaaccaatcactccaacaaagaacaacaaggtaaaagtgatactgggcgaagaccgggaggccacaggtgtcctactcagcatagatggagaggatggaatcgtgcggatggacctggatgagcagctcaagattctgaatctccggttcttgggcaagttgctagaagcatag

SEQ ID NO: 242866 - DNA, 3264 bp, Artificial Sequence
  Description of Artificial Sequence: Synthetic coding sequence
atgtccgactccgaggatagcaacttcagcgaggaggaggactctgagcggagttccgatggagaggaggctgaagtggacgaggagcgtagaagcgcggctggttccgaaaaggaagaagaacccgaggatgaggaggaggaggaagaagaagaagagtacgacgaagaagaggaggaagaggatgatgatagaccacccaagaaacctagacacggtgggtttatcttggacgaagccgatgtggatgacgagtacgaggacgaggatcagtgggaggacggcgctgaggacattctcgagaaggaggagatcgaagcctctaacatagataacgtcgtactggatgaagacaggagtggcgctaggcgcctgcagaatctttggagggatcagcgtgaggaggagctgggagagtactacatgaaaaaatatgccaaaagctcagtgggcgagaccgtctatggcggatcagatgagctcagtgacgatatcactcaacagcagctgctgcccggagtaaaagaccccaacctgtggactgtgaaatgtaaaatcggtgaggaacgcgctactgccatctcactgatgcggaagtttattgcgtaccagttcacagatacaccacttcagattaagagcgttgtggcaccagagcatgtcaaaggctatatctatgtagaggcgtacaaacagactcatgtgaagcaagccatagagggtgtgggaaatttgcgtctcggctattggaatcagcagatggttcccattaaagagatgaccgacgtgctgaaggtggtgaaggaagtggccaacctgaaaccaaagagctgggtgagattaaaaagaggaatttataaggacgatatcgcccaagtcgattacgttgagcccagccagaacacgattagcctgaaaatgatacctcgcattgattacgatcggatcaaggcgaggatgtcattgaaggactggtttgctaagagaaaaaaattcaagcggcctcctcaacggctgttcgatgccgagaaaatcagatctttagggggagacgtagcatctgatggggattttctgatcttcgaaggtaatcggtacagcagaaaaggctttttgtttaagtctttcgccatgtccgcagtgataactgagggcgtcaagccaacactctctgaattagagaaattcgaagaccaaccagaaggaatagacctagaggtagtgaccgaaagtacagggaaagagagggaacacaactttcagccgggtgacaacgtagaggtctgtgagggcgaactgattaacttacaaggcaaaattctgtcggtggatggcaataagattactatcatgcctaagcatgaagacttgaaagacatgttggagtttccggcacaggagttaaggaaatactttaagatgggggatcacgtgaaggtaattgccggacgattcgaaggcgatactggcttgatagtccgcgttgaggagaacttcgtaatcctctttagtgacctcactatgcacgaactcaaggttctgcccagggatctgcagttgtgctcggagactgcttccggggtcgatgtgggagggcagcacgaatggggcgagttggtccaactggacccccagaccgtaggagtgattgtccggctcgagagagaaacgtttcaggtgctgaatatgtacggaaaagtagtgacagtgcgacatcaggcagtgacgagaaagaaagacaataggttcgccgtcgcactcgactctgaacaaaataacattcacgtgaaagacatcgtgaaggtcatagacggccctcattcaggccgagagggagagatccggcacctgtttaggagcttcgccttcctccattgtaagaaactagtggaaaacggaggaatgttcgtgtgcaagaccagacacctagttctcgccggagggtcaaaacccagggacgtcactaacttcacggtaggtgggttcgccccaatgtcccctcgcatttcaagccccatgcaccctagtgctggcggacaaaggggcggatttggatctccaggcggaggaagtggaggaatgtcccgcggaagagggcgaagggacaacgagctgattgggcagactgttagaatatcccaggggccatacaaaggttacattggtgttgtgaaggatgccacagaatccactgcccgagtcgagctgcactcgacatgccaaacaataagcgtggatcgccagaggttgactacagtggggtccaggaggccaggcggtatgacatcaacctacggcagaacccccatgtacggtagccaaacccctatgtacggatccggttctagaacccccatgtatgggagccagaccccacttcaggatggcagccgaactccacattacggtagccagaccccgttgcacgatggatccagaacacccgctcagtctggcgcttgggacccgaacaatcctaataccccatcacgggctgaggaagaatacgagtatgccttcgatgatgagcctacccctagtcctcaggcttacggaggaaccccaaatcctcagacgcctggctaccctgacccatcttcccctcaggtaaacccccagtataatccccagactccgggtacacccgcaatgtataataccgatcagttctctccatacgctgccccaagtcctcagggtagctaccaaccctctccctctcctcagagttatcaccaggtggctccctccccagcaggctatcagaacacacacagccccgcaagttatcaccctacacctagcccaatggcctaccaagctagccccagcccatctccggtgggttatagccctatgactcccggtgcaccatcacccggtggatataatccccacacccctggatctggtatagaacagaattccagcgattgggtgaccacagatatccaggtgaaagttcgcgacacctacctcgatacccaggtcgtaggccagactggcgtaatccgaagcgtgaccggaggtatgtgcagcgtctatctcaaagattcagagaaggtggtctctatatcgtctgagcacctggaacccattaccccaacgaagaataacaaagtgaaagtgatattaggcgaggaccgggaggctacaggcgtccttctgtccatcgacggtgaggatggtatcgttcggatggatctggatgagcagttgaagatcctgaacctccgctttctggggaagctactggaagcctag

SEQ ID NO: 242867 - DNA, 3264 bp, Artificial Sequence
  Description of Artificial Sequence: Synthetic coding sequence
atgtcagactctgaagattcgaatttctctgaagaggaggactctgagcgaagttctgacggggaggaagcagaggtcgatgaggagcggagatccgccgctggtagcgagaaggaggaagaaccagaggatgaagaagaagaggaagaggaggaagagtatgatgaggaagaggaggaagaggatgacgaccggcctccaaaaaagcccaggcacggcggatttattctggacgaagctgacgtggatgacgagtacgaggatgaggaccaatgggaagacggggcagaagacatcctcgagaaggaggagattgaagcttccaatattgacaatgttgtgctagacgaggacagatccggcgctcgccgtctgcagaatctctggcgcgaccagagggaggaggagctgggggagtattatatgaaaaagtacgccaaatcctctgtaggcgagacagtttacggcggttctgatgagctgtccgatgatataacccaacagcaactccttcctggcgtgaaggatcccaacttgtggactgtcaagtgtaaaataggcgaggagagagccaccgccatatcccttatgagaaagttcattgcatatcagttcaccgacacacccctgcagattaagagcgttgtggcccctgagcatgttaaagggtacatctatgtcgaggcttacaagcagacacacgtcaaacaagcgatcgaaggggttggcaatctgagattaggatactggaatcagcagatggtgcccataaaagaaatgacggacgtgctgaaggtcgtgaaggaagtcgccaacctgaaaccaaagtcttgggtgagactgaagcgtggcatatacaaggatgacatagctcaggtcgactatgtggagccctcacaaaacacgatcagcctcaaaatgatccccaggattgattacgatcgcataaaggctagaatgtcccttaaggactggtttgcaaagaggaaaaaatttaagcggccacctcagaggttattcgatgctgaaaaaattcggtccttggggggagatgtggcgtcagatggggacttccttatctttgaaggcaatcgatactcgagaaaggggtttctgtttaagagctttgctatgagcgccgtaattacagaaggggtaaagcctacactatccgagctagagaagtttgaggatcagcccgagggcattgacttggaggtagttactgaaagcacggggaaagaacgggagcacaatttccagccaggagataatgtagaggtgtgtgaaggggagctaatcaatctccaggggaagatactgagcgtggacggaaacaaaattaccatcatgccgaagcacgaagacctcaaggatatgctggagttccctgcccaagagcttcggaaatactttaaaatgggagaccacgtgaaggttattgcaggaagattcgagggtgataccggccttatcgtgcgggtagaggagaactttgtcatactgttcagcgacctcaccatgcatgagctaaaagttctccctcgggacctccagctgtgcagtgagacggcttcaggagtggacgttggtggtcagcacgagtggggtgagttagtacagctggatcctcagaccgttggcgtgattgtacggctagagcgtgagactttccaagtcctcaatatgtacggcaaagttgtcacggtacggcaccaggcagtaacgagaaagaaagataataggtttgccgtggctctggacagtgaacagaataacattcatgtgaaagacatagtaaaagtcatagatggccctcactctggtcgcgagggggaaataagacatctcttcagatcatttgcattcttacattgcaaaaaattggtggagaacgggggtatgttcgtgtgtaaaacaagacatttagtgcttgctggcggttctaagcctcgtgacgtcaccaattttactgtgggaggtttcgcacctatgagcccccgaatatccagtccaatgcatccatctgccggagggcagcggggtgggtttggcagccctgggggtggaagcggaggcatgagcaggggccgagggcgtagagataatgagctcattgggcagaccgtgcgtattagccaaggcccttacaaaggatatattggcgtcgttaaggatgccacagaatccacagcgagggtcgaattgcacagcacctgccagacgatttctgtcgacaggcagcgcctaacaaccgtgggctcccgcaggccaggaggaatgacctccacgtatggacgcacacctatgtatggcagccagacccctatgtatggcagcggtagccggacgcctatgtacgggtcacagacccctttgcaagatggatcaaggacccctcattatggttcccaaacccctttgcacgacggcagccggacacctgctcagtctggtgcttgggaccccaacaaccccaacacaccttccagagccgaggaggagtacgagtatgccttcgacgacgagccaacccccagtccccaggcgtacggagggacaccaaatccccagacaccaggctaccccgatcctagttcaccccaagtgaacccacagtataacccccagacccccggaacgccagcaatgtacaacacagaccaattcagtccctatgccgctccttccccgcagggatcttaccagccgagcccatcaccacaatcttaccaccaggttgctcctagtcccgcaggctaccagaacactcatagccccgctagctatcacccaacaccctcccccatggcgtaccaggccagcccgagcccctctccagtgggttacagcccgatgacacccggagccccatccccgggaggttataatccacacacaccaggctccgggatagagcagaactcgtcagactgggtaacaaccgacattcaggtcaaagtacgggatacctatctggacacacaggtggtaggccagaccggtgtgatccgttcagtgaccggcggaatgtgttctgtgtatttaaaagatagcgagaaagtggtgagcatcagcagcgaacacttggaacctatcaccccaactaagaataataaggtcaaggtgatcctcggtgaagacagggaggccaccggggttttgctgagcatagacggggaggatggcatcgttagaatggacttggacgaacagctaaagatcttaaacctcaggttcctgggtaagcttctggaggcctag

SEQ ID NO: 242868 - DNA, 5180 bp, Artificial Sequence
  Description of Artificial Sequence: Synthetic coding sequence
atgagtgatttcgtggagagcgaggcagaggaaagtgaagaggagtacaatgatgaaggagaagtcgtcccacgggttactaagaagtttgtagaagaggaagatgacgacgaagaagaagaggaagagaatctggacgatcaggatgaacagggtaacctgaaggggtttataaatgatgatgacgacgaggacgaaggcgaggaagatgaggggtccgactccggagattccgaagatgacgttggccacaaaaaaagaaaacgcacatcttttgacgaccgactcgaagacgacgacttcgacctgattgaggagaacctgggagtgaaggtgaaacggggtcagaagtaccgaagagtcaaaaagatgtcagatgacgaggatgacgatgaagaagagtacggtaaggaagagcacgagaaggaggccattgccgaggagatctttcaagacggtgagggggaggaagggcaggaggcaatggaggcccctatggctccacccgaagaggaagaggaggacgatgaagaaagtgacattgacgacttcattgtggacgacgacgggcagcccctcaagaagcccaaatggaggaagaaactgcccggttacactgacgccgcactgcaggaggctcaggagatattcggggtagattttgactacgacgaattcgaaaagtataatgagtacgacgaagagctcgaggaggagtatgagtacgaagacgacgaagccgaaggcgaaattcgggtccgtcccaaaaagactaccaaaaagcgggtgagtcgtcgctcgatattcgaaatgtatgagccctctgagctggaatcctctcatctcacagatcaggataacgaaatccgcgcaacagatttacccgaacgctttcagcttcggtcaataccagtcaaaggagcggaggatgacgagctggaagaggaggcagattggatatacagaaacgcctttgcgacacccaccatttcactgcaggagagctgcgactacctggatcggggacagcccgcttcctcgttttcccgcaagggccctagtactatccaaaagatcaaggaggcgctaggatttatgcggaatcagcatttcgaggtgccattcatcgctttctaccgcaaggagtacgttgagcccgaactgcatatcaacgatctctggagagtctggcaatgggacgagaagtggacgcagctgagaatacggaaggagaatctgactcggctattcgaaaagatgcaagcctaccagtatgaacagatttcagctgatcccgacaagccattagccgatggcatcagggctttagatacaactgacatggagagactgaaagatgtccagtccatggacgagcttaaggatgtctataatcacttcctgctctattatggaagagacatacccaaaatgcaaaacgcagcaaaggccagtagaaagaagctgaaaagagtcagggaagaaggcgatgaagaaggggaaggcgatgaagcagaagacgaagaacaaagaggacccgagttgaagcaggccagtcgacgggacatgtacacaatttgccaatcagccggactcgatgggctggcaaaaaagttcgggctgacaccagagcagtttggggaaaacctgcgcgacagctaccagcggcatgagacagaacaattccccgctgaacctctcgaactggctaaggactacgtgtgcagtcaatttcctacgccagaagccgttctggagggcgcacgatatatggtggccctgcagattgcaagagagccgctcgtgaggcaagttctcaggcaaacctttcaagagcgcgcaaaactcaatatcacccctacgaaaaagggtaggaaggatgttgatgaggcccattatgcttattcctttaagtatcttaagaacaaaccagttaaagagctacgcgatgaccagttcctaaaaatatgcctggcagaggacgagggacttctgaccacggacataagtattgacttgaaaggagttgagggttacggaaatgaccagacatacttcgaggagatcaagcagttttattatcgagacgaatttagccaccaggtccaggaatggaaccggcagcgtactatggcaattgaaagggctcttcagcagttcttgtatgtgcaaatggccaaggagttaaaaaataagctgttagccgaagctaaggagtacgtgatcaaagcttgcagccgaaagctgtacaactggctgagggtggcaccctaccgtcctgaccaacaggtagaggaggacgacgactttatggacgaaaatcaagggaaaggcatccgggtactcgggattgccttttcaagcgcacgggatcaccccgtattctgcgctcttgtgaacggcgaaggcgaagtcaccgactttctgcggcttccacatttcacgaaaagacgtaccgcatggagggaggaggagcgtgagaagaaagctcaggatattgagacactcaagaaattccttcttaacaaaaaaccccatgttgtaacggtggcaggcgaaaacagggatgcacaaatgctcatagaagacgtcaagcggatcgtgcatgagctggatcaggggcaacaactcagctccataggcgtagagctcgtggacaacgaactcgcaattctctacatgaattctaagaaatctgaggcagagtttcgagattatcctcccgttttgcgacaagcagtttctctggcacgtcggattcaggatcctttgatagaatttgcacaggtgtgctcttccgacgaggacatcctatgtctaaagttccacccccttcaggaacatgttgttaaagaagaactgctgaacgccctctactgcgagttcatcaacagggtgaatgaggttggagtcgacgtaaatcgagccatcgcacacccctactcccaggcgctcattcaatatgtctgtggcctgggcccacgcaagggaacacatttgctgaagattctcaaacaaaataatacaaggctggaatccagaacgcaactcgtcaccatgtgtcacatgggacctaaagtgttcatgaattgtgcaggcttccttaaaatagacacagcctcactcggtgattctactgacagctacattgaagtattggacggcagccgcgtccacccagaaacttatgaatgggcgagaaagatggcggtagatgcactggaatatgacgaatccgcagaagatgccaaccctgcaggcgcacttgaggagattttggagaacccagaaagattgaaagacctggacctcgatgcgtttgcggaggaacttgagagacagggttacggagataagcatatcaccctgtacgatataagggcagagctgtcctgtagatataaggacctgcgcaccgcctatcgttctccaaacacggaggagatttttaacatgctaacaaaagagacacctgagaccttttatattggaaaactgattatttgtaatgttacgggtatagcgcaccgcagaccccagggcgaaagctacgatcaggcaattcggaatgatgagacaggcctgtggcagtgtcctttttgtcagcaggataacttccccgaactatccgaggtctggaaccacttcgatagcggatcctgcccgggacaagcgataggtgtgaaaacaaggctggacaatggagtgacaggattcatcccaacaaagttcctgtccgataaggtggtgaagcgccctgaagaacgagtgaaagtggggatgaccgtccattgtcgcatcatgaaaatcgatattgaaaaattttctgcagatctcacatgccgcaccagtgatctcatggacaggaacaacgaatggaaactgcctaaggacacatactacgattttgatgccgaggctgccgatcacaaacaggaggaagacatgaaacggaagcagcagcgcaccacctacataaaaagggtgatcgcacacccatcctttcacaatataaattttaagcaggccgaaaagatgatggaaacgatggaccagggcgatgtgattattcgcccatctagtaagggcgaaaatcatctgactgttacctggaaagtgtccgacggcatctatcagcacgtggacgtcagggaggaaggtaaagaaaacgccttttcattgggggctacgctctggatcaatagtgaagagtttgaagatctggatgaaattgtcgcacggtatgtgcaacctatggccagctttgctcgcgatctgctcaaccataagtattaccaagactgctctgggggagacaggaaaaaactcgaggagctgcttattaagacaaaaaaagagaagccgacctttattccctacttcatttgcgcctgcaaagaacttcctggcaaatttttgctggggtaccagcctcgaggcaagcctcgcatcgaatacgttaccgtcacccccgaaggcttcaggtacagagggcagattttccccaccgtgaatgggctgttcagatggttcaaggaccactatcaggatccagtcccagggatcactcccagctcatctagtcgtacacgtacccccgcttctatcaatgctacaccagcgaatataaacctcgccgacctcacacgtgccgtcaacgcactccctcagaacatgacatcccagatgttctccgctatagctgctgtcacaggtcagggccagaaccccaatgccacccccgcacagtgggccagttcacaatacgggtacggagggagcggcggaggctcgtctgcttaccacgtttttcccacccccgcacagcagcccgtggcaacacctcttatgaccccttcttatagctatacaactccctcccagcctattaccacaccccagtaccaccagttacaggccagtacgactccgcagagcgcgcaggcccaaccacaaccaagcagctcctcacgacagcggcaacagcagccaaagtccaattctcacgcagccattgactggggtaaaatggccgagcaatggttgcaggagaaggaggctgagcgcaggaagcagaagcaacggttgacaccaaggccatctccgagcccgatgatcgagagcacacctatgtccatcgctggggacgcaactcccttacttgacgagatggaccgcta

SEQ ID NO: 242869 - DNA, 2181 bp, Artificial Sequence
  Description of Artificial Sequence: Synthetic coding sequence
atgtctgacttcgtcgaatcagaggccgaggagtctgaggaggagtataacgatgagggcgaggtggtgcccagggtgacaaaaaagtttgtcgaggaggaggacgacgacgaagaggaggaggaggaaaatctcgatgatcaggacgaacaagggaatctcaagggttttatcaacgacgatgacgatgaggatgagggggaagaggacgaagggagcgactctggagactcagaagacgatgtgggacataaaaaaagaaagaggacctccttcgatgatagactggaggacgacgactttgatctaatcgaggaaaacttgggggtaaaagtaaagcgcggtcaaaagtaccgcagagtcaaaaagatgagcgatgacgaggatgacgatgaggaagagtacggcaaagaggagcacgaaaaggaagccatcgcagaagagatattccaagacggggagggcgaggagggtcaggaggcaatggaagcgcctatggcaccgccagaagaagaagaggaagacgacgaggagtcagatatcgacgattttatcgtggacgatgacggccagcctttaaagaaaccgaaatggcgaaaaaaattaccgggatacacagatgcggctctgcaagaggcccaggaaatcttcggtgttgatttcgactatgatgagtttgaaaagtataacgaatacgatgaggaactggaagaagaatatgagtacgaggacgacgaggctgagggagaaatacgcgtccgacctaagaaaacgaccaagaagcgggtaagccggcgatccattttcgaaatgtacgagcctagcgagcttgagtcaagccatctgaccgaccaggataatgaaatccgtgctactgacctccccgaaaggtttcagctgcgctccatccccgtgaaaggcgctgaggatgacgaactggaggaggaagctgactggatataccggaatgccttcgcaacccctaccatcagcctccaggaatcttgcgactacctggaccgaggccagccagcatccagcttttcacgaaaggggccttctaccatacagaaaatcaaggaagcgctcggcttcatgaggaaccagcacttcgaagtcccattcatcgccttttatcgtaaggaatacgtggaaccagagctacatataaacgatctgtggcgtgtgtggcaatgggacgaaaaatggacccaactgaggatccgcaaggagaacctaacaagacttttcgagaaaatgcaggcctatcagtatgagcagatatctgcagatcccgacaagcccttggctgacgggatacgcgctcttgacactactgacatggaacgcctaaaggatgtgcagtcgatggatgagctcaaagacgtttataaccattttttactgtactacggtagagatattcccaagatgcagaatgccgctaaagcctcaagaaagaaactgaaacgggttcgcgaagagggcgacgaagagggggaaggagatgaggctgaggacgaagaacagcgcggacccgagctgaagcaggcgtctcgacgggacatgtacactatctgtcagtctgcgggactcgatggtctggctaagaagttcggccttacacccgagcagtttggcgagaacctgcgggattcttatcagaggcacgagacagaacagttcccggctgaaccactcgaactcgcgaaggactatgtctgcagtcagtttccaacacccgaagcagtgttggaaggtgccagatacatggtcgcgctacagatcgccagagagcctctcgtgagacaggtcctccgccaaacattccaggagcgggctaaattaatgacaccctcatactcctatactactcccagtcaacccatcacaacccctcagtatcaccagctgcaggccagcactacacctcagtcagctcaggcacaaccccagccctcctcttcttctcggcaacgacagcaacagccaaagtccaatagccatgctgccatcgactggggcaaaatggctgaacagtggctgcaggaaaaggaggcggagcggagaaagcagaaacagcggttgacaccacgaccctcccccagtcctatgatcgagagtacccctatgagtatcgctggggacgccactcccctgctcgatgagatggaccggtag

SEQ ID NO: 242870 - DNA, 2361 bp, Artificial Sequence
  Description of Artificial Sequence: Synthetic coding sequence
atgtccttcagtcgcgcactgctgtgggccagactacccgctggacggcaggctggacacagagcagctatttgcagcgccttacgccctcattttggaccattccctggagtcctggggcaagtcagcgtcctcgctactgcctcttctagcgcgtccggtgggtcaaaaattcccaatacgtccctattcgtacccctgaccgtaaagccccagggtccatcagccgacggggacgtgggtgcagaactgacaagacctctggataagaacgaggtgaaaaaagtgctggataaattctacaaaaggaaagagattcaaaaactgggagccgactatggactagacgctcggctgttccatcaggcgtttattagctttagaaactatattatgcagtcccattcccttgatgtggacatacatatcgttctgaacgatatttgtttcggggctgcgcacgccgatgatctgttccctttctttcttcgacacgccaagcagatcttcccagtgctggattgtaaagacgatctgaggaagatctcagacttgcgaatcccaccgaactggtaccccgacgctcgagctatgcagcgaaaaattattttccacagcgggccaaccaattcaggcaagacgtaccacgcaattcagaaatacttctcagcgaagtccggggtttactgcggcccactcaaactgctcgcccatgaaatttttgaaaaatccaacgcagcgggagtgccctgcgacttagtaactggtgaggagcgggtgaccgtgcagccaaatggcaaacaggcttctcatgtgtcctgcactgtggagatgtgttcagtgacgactccctacgaggttgccgtgattgatgaaatccagatgataagggaccctgctcgcggatgggcatggacccgggctctcctgggcctgtgcgccgaggaagttcacctgtgtggtgagcccgcagcgatcgacctagtcatggagctgatgtataccacaggggaggaggttgaggtacgcgattataagaggctgactccgatttctgtgctagatcatgccctagagagcctcgataatctgcggccaggagactgcattgtctgcttcagcaaaaatgatatctacagtgttagccgccaaatcgagatacgagggctggagtcggccgtcatatatggaagcctgccaccaggaaccaaactggctcaggcaaagaaattcaacgacccaaatgacccatgcaagatccttgtcgcaacagatgctatcggaatgggtctcaacctctcgattcgaagaattatattctattcattgatcaagccttctatcaacgagaagggggagcgggaactggaaccgatcacaacaagccaggcactccagatcgcgggaagggctggccgattcagcagtcgctttaaagagggcgaggtcaccactatgaatcatgaagacctctcgttactgaaggaaatccttaagcgcccagtcgatccgataagggcagccggtctacatcccaccgccgaacagatcgagatgtttgcttatcacctccccgatgcaacccttagcaatctgatcgacatatttgttgacttctctcaggttgacgggcagtattttgtgtgtaacatggatgactttaagtttagcgccgaactgatccagcacataccactctcgctgagggtgaggtacgtcttctgtactgcacctattaataagaagcaaccattcgtgtgctcatctcttctgcagttcgcccgtcagtatagtcggaacgagcccctgacattcgcctggctgagaagatacattaagtggccactgctgccaccaaagaatatcaaagatcttatggacctagaggccgtgcacgatgtgctggatctgtatttgtggctctcctacagatttatggacatgttcccagatgcttctttaatcagagatctgcaaaaggagcttgacggtatcattcaagatggggttcataatatcactaagctgatcaagatgagcgaaacacacaaactgctaaaccttgagggattccccagcggctcacaatctaggttaagcggcaccctcaagagtcaagctcgccgaacgaggggaacgaaggcactcgggagcaaggctacagaacctccttcacctgacgccggagagctttctctggcttctaggctggtgcagcagggactgctcacccctgatatgctaaaacagctggaaaaagagtggatgactcagcagaccgagcataacaaagaaaagactgagagtggaacacaccccaaaggcaccaggcggaaaaagaaggagccggatagcgattag

SEQ ID NO: 242871 - DNA, 792 bp, Artificial Sequence
  Description of Artificial Sequence: Synthetic coding sequence
atgtcattctctcgggcactcctatgggcacgcctccccgcaggcagacaggccggacacagggcggcaatctgcagcgcgctgaggccacattttggccctttccccggagtgctgggccaagtcagcgtgctggcgactgcctcaagtagcgccagcggtggctccaagatcccaaatacatcgctgttcgtgcccctgactgttaaacctcaaggcccttctgccgacggcgacgttggcgcagaactcaccagacccctggacaaaaacgaagtggccgtgattgatgagattcagatgatccgcgatccagcgagaggctgggcatggacccgcgctctactgggcttgtgcgccgaggaggtgcatctgtgcggagagcctgcggctatcgatttggttatggagctgatgtacactaccggggaggaagtggaggtccgcgattataaacggctgactcccatttccgtgctggaccacgcattggaaagcctagataatctgagacccggtgactgcatcgtgtgttttagcaaaaatgatatctattccgtttcacgccagatcgaaattcgcggacttgagtccgctgtgatttatggttccctcccgccaggcacaaagcttgctcaagcaaagaaattcaacgaccctaatgacccctgcaaaatcctggtggccacggacgctattgggatgggcctcaatctttccatcaggcgcatcatcttctattctcttatcaaaccttccattaacgagaaaggggagagggagctggagtag

SEQ ID NO: 242872 - DNA, 1233 bp, Artificial Sequence
  Description of Artificial Sequence: Synthetic coding sequence
atggccgctgtgggcgctgaggctagaggagcttggtgcgtaccttgcctcgtgtcactcgataccctccaagagttgtgtcgtaaagaaaaactcacttgcaaatctatcgggatcaccaaacgaaatctgaataattacgaagttgagtatctatgtgattataaggtagtgaaggatatggagtactatcttgtgaaatggaagggctggcctgactctaccaacacctgggagccacttcagaatctgaagtgtcccctgctattacagcagttttcgaatgataagcacaattatctcagtcaagttaagaagggcaaagctatcactccaaaagataacaacaaaaccctcaagcctgccatcgccgagtacatcgttaagaaagccaagcaacggattgctctccaacgatggcaggatgagctgaacaggaggaagaaccacaaaggaatgatctttgtagagaatactgtggatctcgagggcccaccctcagacttttactatattaatgaatataaacctgcccctggtatctcactggtgaacgaggctacatttggttgctcttgtaccgattgcttttttcaaaaatgttgtccagccgaagccggagttttgttggcatacaacaaaaatcaacagatcaaaatccctccgggtactcccatctatgagtgtaactctagatgtcagtgcggacctgactgccctaatagaatagtgcaaaagggtacccaatactcactttgcatctttagaacctcaaatggcaggggctggggggtgaaaacactcgttaagataaaacggatgagctttgtaatggaatacgtgggtgaggtcatcacatctgaggaagccgagcggagaggtcagttttatgacaacaaaggcataacctacctgttcgaccttgattatgagagcgacgagtttaccgtcgatgccgcaagatatggtaacgtgagtcacttcgtcaatcactcttgcgaccctaacctccaggttttcaatgtctttatagataacctggatactaggctgccacgaatcgctctgtttagtactagaacgatcaacgctggcgaagaactgacatttgactatcagatgaaaggatctggagacatcagttccgattccatagaccactctccagccaaaaagcgagtgagaactgtttgtaagtgtggagctgtgacatgccggggttacttgaactag

SEQ ID NO: 242873 - DNA, 693 bp, Artificial Sequence
  Description of Artificial Sequence: Synthetic coding sequence
atggccgctgttggggctgaagcccgaggggcttggtgcgtgccttgtctggtttctttggatactctccaggagctgtgccgcaaggagaaacttacctgtaaaagcattggaataactaagcgaaatcttaataattatgaggtcgaatacttgtgcgactataaggttgtcaaagacatggagtactatcttgtgaaatggaaaggatggcctgacagcacgaatacctgggagcctctgcagaacctcaagtgcccactcctcctgcagcaatttagcaacgataaacataactatttgtcgcaagtcataacctcagaggaagccgaaagacgcggacagttttacgacaacaagggtattacgtacctctttgacctggactatgaatccgacgagtttaccgtggacgccgcacgctatggcaatgtatcgcactttgtcaatcacagttgtgatcccaaccttcaggtcttcaacgtcttcatcgacaacctcgacaccaggttgcccaggattgcgttgttcagtacccgaactataaatgccggagaagaactgacatttgactatcagatgaaaggttccggcgatataagctccgatagcatcgaccacagccctgctaaaaagcgggtgcgtaccgtgtgtaagtgcggagctgtaacatgtaggggctacctcaattag

SEQ ID NO: 242874 - DNA, 459 bp, Artificial Sequence
  Description of Artificial Sequence: Synthetic coding sequence
atggagtactaccttgtaaaatggaaaggatggccggattccaccaatacgtgggagccactccagaatctgaagtgccccctgctcctccagcagttcagtaatgataaacacaactatttgtcccaggtgatcacaagcgaggaggcggagagacggggacagttctatgacaataaaggaatcacataccttttcgatctcgattatgaatcagacgaatttaccgtggatgccgctcggtacggcaacgtgtcccacttcgtgaaccacagctgtgatccgaatctgcaggtatttaacgtctttatcgataatctagatacaaggctccccaggatcgcccttttcagcacccggactataaatgccggagaggaactgacctttgattatcagatgaaaggcagtggtgatattagttctgatagtatcgaccattctcctgcaaagaagtag

SEQ ID NO: 242875 - DNA, 1053 bp, Artificial Sequence
  Description of Artificial Sequence: Synthetic coding sequence
atggaatactacctggtcaagtggaaaggatggccagactctacaaacacttgggaaccgttgcagaacctcaagtgtcccttgttgctgcagcagttttccaacgataagcataattatttgagccaagtgaagaagggaaaggctattaccccaaaagataataacaaaactcttaagccagccatcgccgagtacatcgtgaaaaaggcaaagcagcgaattgcccttcagcgttggcaagacgagcttaaccgacgaaaaaaccataagggcatgatcttcgtcgagaatactgtagatctggaggggcctccctccgatttctactacatcaacgaatacaaacccgcacctgggatctctctggtgaacgaagcgacctttggatgctcctgcaccgactgcttcttccagaaatgttgccctgctgaggccggtgttctgctggcgtacaataaaaatcagcagatcaagattcctcccggaactcctatatacgagtgcaatagtagatgtcaatgcggcccagactgtccaaatagaatcgtgcaaaaaggaacccagtattctctctgtatcttccgcacttccaatggcagagggtggggtgtgaaaacgctggtgaaaataaagcgcatgtctttcgtaatggagtatgtcggtgaggtgatcacaagcgaggaagctgagaggagaggacagttctacgacaacaagggtattacatacctgtttgacttggattatgaatctgatgaattcacagtcgacgcagcacggtatggcaacgtatctcatttcgtcaaccattcatgtgacccgaacctccaagtgttcaatgtgttcatagataatctggacactcgccttccaagaattgcactgttctcaaccaggaccatcaacgctggtgaggagctgacatttgattatcaaatgaagggaagtggtgatatttcaagtgactcaatcgaccacagtccagccaagaagcgtgttcgaactgtgtgtaagtgcggcgctgtgacctgtagggggtacctgaactag

SEQ ID NO: 242876 - DNA, 2658 bp, Artificial Sequence
  Description of Artificial Sequence: Synthetic coding sequence
atgaagtggttgggggagagcaaaatcatggtggtcaatggcagaaggaatggaggaaagttgagcaatgaccaccagcaaaaccagagcaagctacagcacaccggtaaggacacactgaaggctggaaagaacgctgtcgagagacgctcaaaccgatgcaacggcaattccggatttgagggccagtcccggtatgttccgtcgagtggaatgtcagcaaaagagttgtgtgagaacgacgacctagctacgagcctcgtccttgacccatatctcggcttccaaacacataagatgaacacctctgccttccccagtagaagctctcgtcacttctcgaagtccgacagcttcagtcataacaaccctgttcgtttccgacccattaagggtaggcaggaagagctcaaagaggtcatcgaaaggttcaagaaggacgaacacctcgagaaggcgtttaaatgtctgacatctggcgagtgggcccgacactacttcctgaacaaaaataagatgcaggagaagctctttaaggagcacgtgttcatttatctcaggatgtttgcaacagacagcggtttcgagatcctgccctgtaaccgatattcttctgagcagaatggagctaagatcgtcgctaccaaggagtggaaaaggaatgataaaatcgagttgctcgtgggctgcatcgcagagctgtcggaaatcgaagaaaatatgcttctgaggcacggagagaacgacttctccgttatgtacagcactagaaaaaattgcgcacaactgtggctagggccagcagcgttcatcaatcacgattgccggcctaattgcaaatttgttagtaccgggagggacaccgcttgcgtgaaagctttgagagacattgaacccggagaagaaatcagctgctattatggcgacggattcttcggcgagaataatgagttttgcgaatgttacacatgtgaacgcaggggaacaggggcttttaagtcccgcgtagggctcccagctccagcccctgtgattaacagtaagtacgggctcagggagaccgacaaacgacttaacagactcaagaagttaggggactcttcaaaaaactccgactcacagtccgttagcagcaacacggacgcagatacaactcaggagaagaacaacgcgacctctaaccggaagagttcagtgggtgtcaagaagaatagcaagtcccgaaccctgacacgtcagagtatgtctagaattcctgccagctccaatagcacgtccagtaaacttacccacattaacaacagccgggtacccaagaagcttaagaagcccgcaaaacccctgctgtctaaaatcaagctgcggaatcattgtaaacgtctggagcagaaaaacgcctccagaaagctggagatgggtaacctcgtccttaaggaacccaaagtcgtgctgtataagaacttaccgatcaagaaggacaaggagcctgaaggtcctgcacaagcagcagtggcgagcgggtgcttgacacgccatgctgcaagggaacacagacagaaccccgtccggggagctcatagccagggagagagtagtccctgcacctacatcaccagaaggagtgtgagaactagaaccaatctaaaggaggcatccgatatcaaattagaaccaaacaccctcaacggttataagtcttcggtgactgaaccgtgcccagatagcggagagcagctgcagccggctcccgtccttcaagaggaagagctggcacatgaaacggcacagaagggtgaagccaagtgccacaagtcagacacaggtatgagcaagaagaagtcacggcaaggtaagctcgttaagcagttcgcgaagatagaagaaagcacacccgtgcatgactcgcccggaaaggacgacgctgtacctgatttgatgggaccccattcagaccagggagaacactctggaaccgtgggcgtccctgtgtcatacaccgactgcgcaccttcacccgtcggctgttcagtggtcactagcgactcattcaaaacaaaagatagctttagaactgccaaatccaagaagaagcgtaggatcactcgctacgacgcacagctgatcctcgaaaataacagcggcatccccaaactgaccctgcgtaggcgccacgattcctcaagtaagacgaatgaccaggaaaatgatggcatgaacagcagtaagataagcatcaagctcagtaaggaccacgacaacgataacaacctctacgttgcaaagctcaataacggattcaattctggctctgggtcctctagcacaaaactcaaaattcagctgaaacgggacgaagaaaatcggggttcttataccgaaggcctccatgagaatggcgtgtgctgctcggatcctctcagcctgctggagtccaggatggaggtggatgattattcccaatacgaggaagaaagcaccgacgatagcagttcatctgagggagatgaggaagaagacgactacgacgacgacttcgaagacgactttatcccgttgccccctgccaaacgcttgaggcttattgtgggcaaggatagcatcgacatcgatatcagttccagaagacgtgaagaccagtcactgaggctgaatgcctag

SEQ ID NO: 242877 - DNA, 1182 bp, Artificial Sequence
  Description of Artificial Sequence: Synthetic coding sequence
atgaagtggctcggagagtctaaaattatggtggtcaacgggaggagaaacggaggcaagctctcaaacgaccatcagcagaatcagtcgaagttgcagcacactggtaaggataccttgaaggccggaaagaacgccgtcgaaaggcgttctaaccgctgcaatggtaattcaggttttgaaggccaaagtagatatgtgccatcctcgggaatgagtgctaaagaactgtgtgagaacgacgatctcgccacgagcctcgtgctggacccatacctcgggttccagacccacaaaatgaatacttctgctttcccgagccgaagttcacgccatttttccaaatccgactctttctcacacaataatccagttcgcttccgtcctattaaaggtcgacaggaggagttgaaggaggtgattgagcgcttcaagaaggacgagcacctggaaaaggcattcaagtgtctgaccagtggcgagtgggcgaggcattatttcctcaacaagaacaagatgcaagaaaaactgtttaaagagcacgttttcatttacctccggatgttcgcaactgacagcggcttcgagatactgccatgcaaccgttattcttcagagcagaacggggcaaaaattgtagccacgaaagagtggaaaaggaatgacaagatagagcttctggtgggctgcatagccgagctgtcggagattgaggagaatatgctcttacggcacggggaaaacgacttctctgtgatgtactctacaaggaagaattgtgcacagctgtggctgggacccgctgctttcatcaatcacgactgtagacctaactgcaagttcgttagtacgggcagagacacagcctgtgtcaaagctctccgggatattgagcctggcgaagaaatcagctgttactacggggacggcttctttggggaaaataatgagttttgtgaatgttacacctgcgagcggagaggaactggggcattcaaaagcagagtaggtctgcctgctcccgcaccggtgattaacagtaagtatggcttgcgagagaccgacaagcgtttaaatcgcctgaagaaattgggagattccagcaagaacagcgactcccagtcggtgtcctctaacaccgatgccgacacaacacaggaaaaaaataatgccagcaaatag

SEQ ID NO: 242878 - DNA, 1182 bp, Artificial Sequence
  Description of Artificial Sequence: Synthetic coding sequence
atgaagtggctgggcgaatctaagatcatggtggtgaatgggcgtagaaatggcggaaagttaagtaacgaccatcaacagaaccagagtaagcttcagcacactggaaaggacaccctcaaagcaggtaagaatgccgtggagaggaggtctaaccggtgcaacggtaacagcggctttgaaggacagagcagatacgttcccagctcgggcatgtcggccaaggagttgtgtgaaaacgatgacctggctacctccctggtgcttgacccttatctgggattccagactcataaaatgaacacaagtgccttcccctctaggtcaagtcgccatttctctaaaagcgactccttctctcacaataatccggtgcgctttaggcccatcaagggtaggcaggaagagctaaaggaagttatcgagcgcttcaaaaaggacgagcatctggagaaggcattcaagtgtttgacatctggggagtgggccaggcattactttctaaacaaaaataaaatgcaggaaaaactgttcaaggagcatgtgtttatctatctgagaatgtttgccaccgatagcggctttgaaattctaccatgtaataggtactcttcagagcagaatggtgccaagatcgtcgccaccaaagagtggaagcggaacgacaaaatagagctgctggtagggtgtatagccgagctctcggagatcgaggagaacatgctgctacgacatggcgagaacgactttagcgtcatgtacagcacacgaaagaattgtgcacagctctggctggggcctgcagccttcatcaatcacgattgccgccctaattgcaaattcgtttcaaccggcagagatacagcatgcgtgaaagcattgcgtgatatcgagcctggagaggagatcagctgttactacggtgatgggttcttcggagagaataatgaattctgcgagtgttacacctgcgagcgccgtggcaccggtgccttcaaaagccgggttggcctccccgcacctgcgccagtcatcaattccaagtatggcctacgcgagaccgataagaggctaaatagattgaaaaagctgggggacagttcgaaaaatagtgactctcagagcgtgagctctaacactgatgcagatacaacccaggagaagaataacgccagcaaatag

SEQ ID NO: 242879 - DNA, 357 bp, Artificial Sequence
  Description of Artificial Sequence: Synthetic coding sequence
atgaaatggttgggtgagagcaaaattatggtcgtgaacggacgcaggaacggtgggaaactgtcaaacgaccaccaacagaaccagtccaagctacaacacaccggaaaggataccctcaaagcgggtaagaacgctgtggagcgaagatccaaccgctgtaatggcaactccggatttgaggggcaatcaaggtatgtaccctcgtctgggatgtccgctaaagagctgtgcgagaatgatgatcttgccactagtctggtgttggacccctatctaggcttccagacacacaagatgaacacttctgccttcccttcacgcagcagtagacattttagcaagagcgacagttag

SEQ ID NO: 242880 - DNA, 1389 bp, Artificial Sequence
  Description of Artificial Sequence: Synthetic coding sequence
atgggccctgatagagtaactgcacgggagctctgcgagaacgacgatctagcgacatcattggttctggatccatacctgggctttcggacccacaaaatgaacgtgagccctgtgcctcccctgagacgccagcagcacctgagatctgccttagaaacctttctgcgccaaagagacctggaggccgcttatagagccctgactcttggtggatggactgccagatatttccagtcacggggtcctagacaggaggccgctttgaagacacacgtataccggtatctcagagcgttcctgcctgagtctggattcacaattctgccttgcacgcgctattcgatggagacaaatggtgcaaagattgtgtccacaagggcctggaaaaagaacgagaagttggagctgctcgttggatgcatcgctgaactccgagaggccgacgagggtttgctaagagccggagagaatgacttctccatcatgtatagcactcgtaagcggagcgcccagttatggctggggcctgcagccttcattaaccacgattgtaagcccaattgtaagtttgtgcccgcagacggaaacgctgcctgcgtaaaggttctgcgggacatcgaacccggtgacgaggtcacatgcttctacggcgaggggtttttcggagagaagaacgaacactgcgagtgtcatacttgcgaacgtaagggggagggtgcgttccgcaccaggccaagggaacctgccctgcctccaaggcctttagataaatatcagctgcgagagacaaaacgacggctccagcaggggctggatagcgggagcaggcaggggctgctgggacctagggcttgcgtgcatccatctccccttcggagggaccccttctgcgctgcttgccagccattacgactgccggcatgctcggccagacccgatactagtcccttgtggctgcaatggcttcctcaaccacagcccagggttagacccagaaagagacgacgaccacggcctagacgcgctcctgtgttgtctactcaccacgctgcccgtgtctcactccaccgatggggtggctgtggtcctcattgccggctgcggggagaggcactggtggcgctgggacagccacctcacgctcgatgggctcctcaacaggattggcattgggccagacggtatggattaccatatgtggtacgggtcgacctgaggagactagctccggctccccctgccacacccgcacccgctggcacccctggacccattctcattcctaaacaagctctggcatttgcgccattcagcccgccaaagaggctcagactggttgtgtctcacggaagcattgatctggacgtcggaggagaggagctctag

SEQ ID NO: 242881 - DNA, 390 bp, Artificial Sequence
  Description of Artificial Sequence: Synthetic coding sequence
atgcctcgtcgcggtagatggctgtcctgcagtcctgaggctgaagggattcgaagggtgggctcacgcgcagcactgagggtgcatcccttggaacaccgtcctcgttggggcacccctgggggtatgactaaaggctctcggttcctcgcgccagaaagcgagctgtcatgggggccaggcgacgctactcccggactgtggttttttattagtgatggcgtgggcgaggatctctggaatagcgcgggttggtctagcgtgcctgaaggctttggacagcgcatgaggggcccaggtctgaccccccacacggacgcaggcggagacgggaataaacgtcgtcactctgagagattgtgccgggctagtgtattacagccaccctag

SEQ ID NO: 242882 - DNA, 744 bp, Artificial Sequence
  Description of Artificial Sequence: Synthetic coding sequence
atgcacttggccagattggtcgggtcatgtagtctccttctgctgctaggtgccctgagcggatgggccgcttccgatgacccaattgaaaaggtgatcgagggcattaaccgagggctgagcaatgccgaacgggaggtgggcaaggcccttgacggaattaattccggcattacccacgcgggacgggaggtggagaaggtcttcaatgggctgagcaatatggggagtcacacagggaaggaactcgacaaaggcgtgcagggtctcaaccatggcatggacaaagtcgcccacgagataaaccacggaattggtcaagctggcaaagaagcggagaaactaggacacggtgtgaacaacgccgcaggacaggccggaaaagaagccgacaaggcagtgcaggggttccataccggcgtccaccaggctggaaaggaagccgagaaactgggccaaggcgtcaaccatgccgcagatcaagctggcaaggaggtggagaagcttggccagggggctcaccacgccgcaggccaggccggaaaggagctgcagaatgctcataacggagttaatcaagcttctaaagaagctaaccagctcctgaatggaaaccaccagagtggcagctcatctcaccaaggtggcgctaccactactcccctcgccagcggggcttctgtcaatacaccatttatcaacctgcctgccctgtggaggtccgtggccaacatcatgccatag

SEQ ID NO: 242883 - DNA, 1773 bp, Artificial Sequence
  Description of Artificial Sequence: Synthetic coding sequence
atgcacctggctcggcttgtgggtagttgctctcttctactgctgctcggggcactctccggatgggccgcatcagacgacccaattgagaaagttattgagggtataaaccggggattatctaacgccgaacgcgaggtcggtaaagcccttgatgggatcaattcaggcatcacccacgcgggtcgggaagtggaaaaggtattcaatggcctgtccaatatgggtagccatacgggaaaagagcttgacaagggcgtgcagggtctgaatcatggcatggacaaggtggcacatgagattaaccacggaatcggtcaggccggtaaggaagccgagaagctggggcatggagtgaacaatgccgctgggcaggttggaaaggaggctgacaagttaatccaccacggagtccaccatggagccaaccaggctggttccgaagcgggtaaattcggacaaggcgtagataatgctgcaggccaggccggtaacgaggctggtcgcttcggccaaggtgtccatcacgccgcaggtcaggcgggaaacgaggccggtcgatttggtcagggcgttcatcacgctgccggacaggccggaaacgaagctggaaggttcggtcagggcgctcaccacggcttgtcagaaggctggaaagaaaccgagaagttcgggcaggggatccatcatgccgcaggtcaggtcgggaaggaagcagaaaagttcgggcaaggagcccatcacgctgctggtcaagcagggaatgaggcaggccgatttggccagggggtccatcacggcctcagcgagggttggaaggagactgaaaagtttggacagggcgttcatcataccgctggccaagtagggaaggaggctgagaaatttggccaaggagcacaccacgccgctggtcaggccggaaatgaggcaggaagattcggtcagggggcacaccacgccgctggtcaggcagggaatgaggctgggaggtttgggcagggagtgcatcacggactaagcgaggggtggaaggaaacagaaaaatttggccagggcgtgcaccacgccgctagccagtttggtaaggagacagagaaactgggacatggcgtgcaccacggcgtcaacgaggcctggaaagaagcagaaaagttcggccaaggcgtccaccacgccgctagccaggtcggcaaagaagaggacagggtcgtgcagggtctccatcatggagtctcccaggccggaagggaggccggacagttcggacatgacattcaccacacagccggacaggctgggaaagaaggggatatcgcggtccacggggtacagcctggtgtgcatgaggctgggaaagaagctggccagttcggtcaaggagtacatcacaccctcgaacaagcaggaaaggaggcagataaggcagttcaagggttccataccggtgtacaccaagccggtaaagaagccgaaaaactaggccagggagtcaaccacgccgctgatcaggctggcaaagaagttgaaaagctcggacagggcgcacaccacgccgctggccaggccggaaaggaattgcagaacgctcacaatggcgttaaccaggcctcaaaagaagctaatcaactgctgaacggtaatcaccagtccggctcctctagtcaccagggcggtgcaacaacaacaccgcttgcctccggtgcaagcgtgaacacacctttcattaacttaccggcactgtggcggagcgtcgcaaacattatgccctag

SEQ ID NO: 242884 - DNA, 288 bp, Artificial Sequence
  Description of Artificial Sequence: Synthetic coding sequence
atgggatcacatacaggaaaggagctcgacaaaggagtgcagggactgaaccatggcatggataaggtcgcgcacgagataaatcacggtattgggcaggctgggaaagaggccgagaaactcggacacggagtcaataatgcagccggtcaggggaaccaccagtctgggagcagcagccatcagggcggagccaccaccacaccactggcctccggcgcttctgtgaatacccccttcatcaatctgccagccctgtggagaagcgttgctaatattatgccctag

SEQ ID NO: 242885 - DNA, 738 bp, Artificial Sequence
  Description of Artificial Sequence: Synthetic coding sequence
atgtggctgtgcccattagccctgaatcttatcttgatggctgcgagcggcgctgtgtgtgaagtgaaagacgtgtgtgtgggctcaccgggtataccgggtacccctggatcacatggtctgccaggcagggacggacgggacggtctaaagggagatccaggtcctccagggccaatgggtccacctggcgagatgccatgtcctcctggaaacgacggtcttcccggtgccccaggaataccaggtgagtgtggcgagaagggagagcccggagaacgcggtccaccaggattgcccgcacacttggacgaagaactccaagctaccctgcacgactttcgtcatcagatcttgcagacaagaggagctttgagcttgcaggggtccattatgaccgttggggagaaggtcttttcgtcaaatggacagtctatcactttcgatgccatccaggaggcctgtgccagggccggaggcaggatcgccgttcccaggaatcctgaggaaaatgaggccattgccagcttcgtgaaaaaatataacacttatgcttacgtcggccttaccgagggaccctctcccggagatttccgatacagtgacggcacacccgtcaactataccaactggtacaggggcgaaccagcgggtcggggtaaggaacagtgcgtggagatgtacacggatggacaatggaacgaccgaaactgcctctactctcggctgaccatttag

SEQ ID NO: 242886 - DNA, 570 bp, Artificial Sequence
  Description of Artificial Sequence: Synthetic coding sequence
atgggtcctcccggagagatgccctgccccccaggcaacgatgggttgcccggagctccaggaatcccaggagagtgcggtgagaaaggcgagcctggggagcgcggacctcctgggctccccgcacatctagacgaggagttacaggccaccctgcacgactttagacatcagatccttcaaactagaggcgctctgtcccttcagggctcaatcatgaccgtcggagagaaggtgttcagcagcaatggacaatcaatcacatttgacgccatccaggaggcctgtgccagagccggaggacggatagctgtacccagaaatcctgaagagaatgaggccatcgctagttttgtgaagaaatacaatacatatgcctatgtcggcctgacagaggggcctagtcccggagacttccgctattctgacgggacccctgttaattacaccaattggtaccgcggagaacctgcgggacgcggaaaggagcaatgcgtggaaatgtacactgatgggcagtggaacgatcgtaattgtctctattctagattgactatctgcgagttttag

SEQ ID NO: 242887 - DNA, 747 bp, Artificial Sequence
  Description of Artificial Sequence: Synthetic coding sequence
atgtggctgtgtccactggctcttaatcttattctgatggccgcatcaggagcggtctgtgaggtcaaagacgtctgtgttggcagtcctggcattcccggaactcctggcagccatggacttcccggacgggacgggagagatggcctgaaaggagatcctgggcctccgggtccaatggggccaccaggggaaatgccgtgtcccccaggtaacgatggactgcctggagctcctggcattccaggtgagtgcggcgagaagggagaacctggcgaaagaggtccaccaggcttgcccgctcacctcgatgaagaactccaggccactctgcacgactttaggcatcagatccttcagacaagaggagccttgtcgctgcagggtagcattatgaccgtaggcgaaaaagtgttttccagcaacggtcagtccataaccttcgatgccattcaagaggcttgtgcccgtgccggagggaggatcgctgtgccaaggaatccagaggaaaacgaagccatcgccagcttcgtcaagaaatacaacacttacgcgtacgtgggtctaactgaggggccttctcccggagattttcgctacagcgatggcaccccagtgaattacaccaattggtataggggggagcccgctggtcgcggtaaagaacagtgtgttgagatgtacacagatggacagtggaatgacaggaactgcttatactccagactcacaatctgtgaattttag

SEQ ID NO: 242888 - DNA, 747 bp, Artificial Sequence
  Description of Artificial Sequence: Synthetic coding sequence
atgtggctttgtcctctcgctcttaatctaattctgatggcagcgtccggggcagtgtgtgaagtgaaagacgtctgtgttggctctccgggaatccctggcactcccggaagccacggtctcccgggtagagacggacgcgacgggttgaaaggggatccgggaccgcctggccctatgggcccaccgggtgagatgccgtgtcctccaggtaacgacggactccccggtgcaccaggaattcctggggagtgcggtgaaaaaggcgagcctggagaacgagggcctccaggactgcccgctcacctggacgaggagctacaagccacgttgcatgactttcgacatcagatactgcagaccaggggagctctctccctgcaagggtcaattatgaccgttggggagaaggttttttcttcgaatggccagtcaataacattcgatgctatccaagaggcttgcgcacgagcagggggtcggatagccgtcccccgaaaccccgaggagaacgaagcaattgccagtttcgtgaagaagtataacacctacgcgtacgtcggattgacagaaggcccaagtccaggcgattttcggtatagcgacggaacacccgtcaactataccaattggtacaggggggagccagccggtcggggaaaagaacagtgtgtcgagatgtataccgacggccaatggaatgatcggaattgcttatactctcgcctcacaatctgtgagttctag

SEQ ID NO: 242889 - DNA, 792 bp, Artificial Sequence
  Description of Artificial Sequence: Synthetic coding sequence
atgagaccttgccaggtgcccggtgccgctacagggccaagggccatgtggctgtgccctctggcactcaaccttatcctgatggcagcttctggggctgtgtgcgaagtgaaagacgtctgcgtggggtctcctgggatcccgggtacccctgggagtcacggcttgccaggcagagacggacgggatggtctgaagggggatcccggtcctcccggacccatgggccctccaggagagatgccctgtccccctggtaatgatggcctgcccggagcgcctggcatccctggagagtgtggggagaaaggggaacccggagaacggggtcccccaggtcttccagcccacttagacgaagaattgcaggccaccctccacgatttcaggcatcagatcctgcaaacaagaggagccctgagtctccaaggcagtatcatgaccgttggagagaaagtttttagctccaacggtcagtcaataactttcgacgctatacaggaggcctgtgccagagccggagggagaatcgccgtgccaaggaatcccgaggaaaacgaagcgatagcttcttttgttaagaagtacaatacctatgcctacgtcgggctgaccgaggggccatccccaggcgactttcggtacagtgacggaactcctgtcaactacaccaactggtacaggggtgaaccagcgggacgcggaaaggaacaatgcgtggagatgtatacagatggtcagtggaacgacaggaattgcctgtactctagactgaccatctgcgagttctag

SEQ ID NO: 242890 - DNA, 747 bp, Artificial Sequence
  Description of Artificial Sequence: Synthetic coding sequence
atgtggttatgtcccctggccctgaacctaatcctgatggccgcttccggggcagtgtgcgaggtaaaagatgtgtgtgtgggcagtcctggtatccccggaactcctggaagccatggcttgcctggcagggacgggcgtgacgggctaaaaggcgatccgggacctcctggacccatgggaccaccaggcgaaatgccgtgccctccaggcaatgacgggctgccaggtgcacctggcatcccaggcgaatgtggagaaaagggggagcctggggagcgcggtcccccaggcctgccggcacaccttgatgaggaacttcaggcaacactgcatgattttagacatcagatcctgcagacgcggggagccctaagcttacagggatctattatgacggtgggcgagaaggtattcagctcgaatggtcagtccatcacgtttgacgcaatccaagaagcctgtgcgagagccggaggtaggattgcagtgcccagaaacccggaggaaaatgaagctatcgccagttttgtgaagaagtacaatacctacgcctacgtgggcttaaccgagggccctagcccgggtgacttcagatactccgatggaactcctgtcaactacacgaactggtaccgtggagagcccgcagggagaggcaaggaacagtgtgtggagatgtacacggatggccaatggaatgatcggaactgcctctacagcagactgaccatttgcgaattttag

SEQ ID NO: 242891 - DNA, 477 bp, Artificial Sequence
  Description of Artificial Sequence: Synthetic coding sequence
atgtggttgtgcccactggccctgaacctcattctaatggccgcatctggagccgtgtgtgaggtgaaggacgtgtgcgtgggatctccaggaattccaggcactccgggatcacacggacttccaggcagggacggacgcgacgggctcaaaggcgatccgggacccccagggcctatgggaccacccggtgaaatgccctgccctcccggtaatgacggactgccaggagccccagggatcccaggcgagtgtggggaaaagggggaacctggcgagcggggacccccaggcttgcctgctcatcttgatgaagagctgcaggcgacgctgcatgattttagacatcaaattctgcagactcgcggagcactcagcttgcagggaagtatcatgacagtaggcgaaaaagtattcagctcgaacggtcagagcataacatttgacgccatacaggaagcctgtgccagagcgtag

SEQ ID NO: 242892 - DNA, 477 bp, Artificial Sequence
  Description of Artificial Sequence: Synthetic coding sequence
atgtggctgtgccccttggctctgaacctgatcctgatggccgcatctggtgctgtgtgcgaagtaaaggacgtgtgtgtcggatcccctggaatcccgggtacacctggctctcacggcctaccaggccgagatggcagggatgggctgaaaggcgacccaggtcctcctgggccaatggggcctcccggagagatgccctgtcctcctggcaatgatggattgcccggtgctcctggcatcccaggcgagtgtggagagaagggcgagcccggtgagagaggtccgcctggactacccgctcaccttgatgaggagttgcaggctactctacatgacttccggcatcagatcctgcaaaccagaggtgcgctcagtctgcagggcagcattatgacagtgggagagaaggtgtttagctctaatgggcagagcattacttttgacgctatccaagaagcttgtgccagagcatag

SEQ ID NO: 242893 - DNA, 747 bp, Artificial Sequence
  Description of Artificial Sequence: Synthetic coding sequence
atgtggctttgtcctctggccctcaccctgattctcatggccgcaagcggcgctgcctgcgaagtaaaggacgtatgtgtgggctctccaggcatacccggaacccccggaagccatggactgcccggtcgagacggcagagacggggttaaaggcgacccgggaccccctggacctatgggaccccctggcgaaacgccctgtccccctggtaacaatggtctcccaggcgctcctggagtccctggcgagcgcggagagaaaggggaggccggagagcgcggtcctccgggacttcctgctcatctggatgaggagctgcaggcaactctacacgattttagacatcagatcttacaaacacgaggtgccttatcactgcagggcagcattatgactgttggggagaaagtttttagcagcaacggacaatccataaccttcgacgctatccaggaggcttgcgcacgcgctggcggacgcatcgctgtgccccgaaaccccgaagaaaatgaagctatcgccagcttcgtgaagaagtataacacctacgcatatgttggtcttactgaaggaccttctccgggagacttccggtacagtgacggtacacccgtgaattacacaaattggtacagaggcgaacccgctggcaggggcaaggagcaatgtgtggagatgtacacagacggacaatggaacgatcgaaactgtctgtattctaggctcaccatttgtgaattctag

SEQ ID NO: 242894 - DNA, 747 bp, Artificial Sequence
  Description of Artificial Sequence: Synthetic coding sequence
atgtggttgtgcccactggccctaacacttatcctgatggctgcttccggcgcagcctgtgaggttaaggacgtgtgtgtgggaagcccagggattccaggaacacctggaagccacggtctgccaggacgcgatggaagagatggggtaaaaggtgaccccggtcctccgggacccatgggaccacccggagagacaccatgtcccccagggaacaatgggttgcccggagcccctggcgtgccaggcgaacgcggtgaaaagggcgaggcgggagagagagggcctcctggcttaccggctcatctggacgaggaactacaagcaactcttcacgatttcaggcaccagatcctgcagacacgaggagctcttagcctgcagggaagcatcatgacagtcggggagaaagtgtttagtagcaatgggcagagtattacatttgatgccatacaagaggcctgtgcccgagcaggcggacgcatcgccgtgcctcgaaaccccgaggaaaacgaggcaattgcatctttcgtgaaaaagtacaacacctacgcctatgtgggactgacggaaggaccctccccaggcgactttagatacagtgatgggaccccggtcaattacacaaactggtacaggggagagcccgcaggccgtggtaaagaacagtgcgtcgaaatgtacacagacggacaatggaacgatcggaactgcctatacagtagactgacaatatgtgagttctag

SEQ ID NO: 242895 - DNA, 477 bp, Artificial Sequence
  Description of Artificial Sequence: Synthetic coding sequence
atgtggctctgcccacttgccctgaccctgattttgatggctgcctccggggcagcatgcgaggtaaaagacgtatgtgtcggcagtcccggaattcccggtacacccggatcacacggtcttcctgggagagacggccgtgatggcgtgaagggggatcctggtcctccaggcccaatgggcccacctggggaaacaccttgtccacctggcaacaatgggctgcctggcgcaccgggagttcctggagagaggggtgagaaaggcgaggccggagagcggggaccacctggcctgcctgcccaccttgatgaggagctgcaggccaccttacacgatttcagacatcaaatcctccagacccgtggggcactgtctctccagggtagtatcatgacagtgggcgagaaagtattttcatccaatggacagtcaatcaccttcgacgccattcaggaagcctgtgcaagggcttag

SEQ ID NO: 242896 - DNA, 645 bp, Artificial Sequence
  Description of Artificial Sequence: Synthetic coding sequence
atgcggccatgccaggtgcctggcgcagccaccggtcctcgggctatgtggctgtgcccgttggccttaacactgatccttatggcggcttcgggagccgcttgcgaggtgaaggatgtatgcgtagggtccccaggtattcctggaaaaagaggcgagaagggagaagcaggtgagcgcggtcctccgggtctaccagcacatctggacgaggagctgcaggccaccctccacgatttccgccatcagatacttcagactaggggagcgctctctttgcagggatcaattatgactgtgggcgagaaggtcttttcttcaaacggacagtctattacgttcgacgccatccaggaggcatgtgccagagccggtggcagaatcgctgtgcccaggaatcccgaagagaacgaggccatagcctcctttgtgaaaaagtataatacgtacgcctatgtaggcctgaccgagggaccctcccctggggacttccggtattctgatggtaccccggttaactacacgaattggtatcgcggtgagcctgctggaaggggtaaggaacagtgtgtggaaatgtatactgacggccaatggaatgatcgtaactgtttgtatagccggttaacaatttgcgaattctag

SEQ ID NO: 242897 - DNA, 1146 bp, Artificial Sequence
  Description of Artificial Sequence: Synthetic coding sequence
atggccgagtcacatcttttacaatggctgcttctgctgctgccaaccctgtgcggccctggaactgctgcctggactacatcttctctcgcatgtgctcaggggcctgagttttggtgccagtcactggaacaggcccttcagtgcagagcactgggccattgcttacaggaagtctggggccacgtcggcgcagacgacctgtgccaggagtgtgaagacattgtgcacatcctgaataagatggccaaggaagctatctttcaggacaccatgagaaagtttctcgaacaggagtgtaacgtgttgcccctcaagctgctgatgccgcagtgcaaccaggtgctggatgactactttccgcttgttatcgactactttcagaaccagactgacagtaatgggatctgtatgcacttaggattgtgcaagagccgacagcctgaaccggagcaggaaccgggaatgagcgaccctttgccaaagccactaagggaccctctgcctgatccgctgctggataaattggttctgcctgtgttgcccggtgccctacaggcaagacccggaccccacactcaagatctctctgaacagcaatttcccatccccctcccttattgttggctttgcagggctctcatcaagcggattcaggccatgatccctaaaggcgcactggcagtcgcggtggcacaagtttgtagggtggtgccactcgtggccggtggcatctgccagtgcctggctgaacgctactcggtgatcttactggacaccctgctgggtagaatgctcccccagttggtttgcagacttgtactacgctgttctatggatgacagtgccggaccaagatcaccaaccggggagtggctgccacgggatagcgaatgtcatctgtgcatgtctgtaaccacccaagcgggaaacagctccgagcaggcaatcccccaagcgatgttacaggcctgcgtgggctcttggttagatcgtgaaaagtgtaagcagtttgttgagcaacacacgccccagttgctcaccctagtccccaggggctgggatgcacacaccacatgccaggcgctcggcgtctgcggcactatgtcctcacccttacagtgtattcattccccagacctgtag

SEQ ID NO: 242898 - DNA, 1128 bp, Artificial Sequence
  Description of Artificial Sequence: Synthetic coding sequence
atgctcctcttcctcctatctgccctggttctgctgacacagcctctgggctatctggaagccgagatgaaaacttactcacatcggactatgccaagtgcctgcaccctggtcatgtgttcctctgtggagtctgggctccccggtagagacggaagggacggtcgagaggggccacggggagaaaaaggcgatcctggtctcccaggggctgcgggtcaggccggaatgcctggtcaggccggaccggttgggcctaagggcgacaatggctccgtaggagagccaggcccaaagggcgatactgggccttctggtccaccaggccctccaggcgttcctggtcccgctgggagagaggggcctctcggaaaacagggcaatattggcccacaaggaaaaccaggcccaaagggcgaagccggacctaagggtgaagtgggggcacccggaatgcagggatccgctggggctcggggtctcgccggtccgaagggcgagcgcggagttccgggagaacggggagttcctggaaacaccggtgctgccggttcagccggagctatggggccacagggctcgcccggagcacggggaccacctggtttgaaaggtgataaaggaatccccggagacaagggtgccaaaggcgaaagcggactgcccgacgtcgccagcttgcggcaacaggtggaggcattacaggggcaagtgcagcatctgcaggccgcatttagccagtacaagaaggttgaactgttcccgaacggtcagagcgtgggggagaagatcttcaaaactgctggtttcgtcaagcccttcacagaagctcagctactgtgtacccaggcagggggtcagttagccagccctcgcagcgccgcagagaacgctgctttacagcaactagtggtcgctaagaatgaagctgccttcctcagcatgaccgactcgaaaacggagggaaagtttacttaccccacaggtgagtccctggtgtatagtaattgggccccaggcgagccaaacgacgacggtggcagcgaagactgtgttgagatattcaccaatgggaaatggaatgatagggcttgtggtgaaaaacggctggtggtgtgtgaattttag

SEQ ID NO: 242899 - DNA, 657 bp, Artificial Sequence
  Description of Artificial Sequence: Synthetic coding sequence
atgtttttgtccacttccaagcatggaagacaagaggcaatgcttttgtttctgctcagcgcccttgtgctactgacccagcccctcggatatcttgaggccgagatgaaaacgtattcgcaccgcacaatgccgtcggcctgcacattagtgatgtgttccagcgtcgaaagtggtcttcctgggagagacggacgcgacggtcgggaagggccacgcggagagaaaggcgaccctggcttgcctggagccgctggccaagcaggcatgcctggccaagctggcccagtcgggcctaagggggacaacgggagcgttggagaaccgggaccaaagggggacacaggtcccagcggacctcccggtcccccaggcgtaccgggtcccgctggtcgagaagggccactgggcaaacaagggaacatcggtccccagggcaaacccggtccaaaaggagaggccggtcccaagggagaggtgggcgcacccggaatgcaggggtcagcaggggctaggggcctcgctggaccgaagggggaacgaggggtgcccggagaaagaggtgtgcctgggaatactggcgcagcaggttctgctggcgctatggggccacagggctctccgggtgcgaggggcccacccggtctgaagggctag

SEQ ID NO: 242900 - DNA, 903 bp, Artificial Sequence
  Description of Artificial Sequence: Synthetic coding sequence
atggccgcagtagcggcactgcagcttggcctacgggcagctggactggggcgagcccctgcgtccgccgcttggaggtcagttctgcgcgtgtccccgcgaccaggggtcgcttggcggccatcaaggtgtggcagctccgctgctgaagcatcggctacaaaagccgaagacgactcgttccttcagtgggtgctgctcctgatcccagttaccgcatttgggttagggacgtggcaggtgcaacgccgaaagtggaagctcaacctcatagctgagcttgagagccgcgtgctcgccgagccagttccactacccgctgatcctatggagctcaagaatctggagtatagacctgtaaaggtccgaggatgctttgaccattctaaggagttgtacatgatgccgaggacaatggtcgaccccgtccgcgaggccagagagggaggcctgatatcctcttcaactcagtctggcgcttacgtggtcactccctttcattgtacggacctgggcgtcacgattctagtaaataggggcttcgtgccccgtaagaaagtcaaccccgagacacgacagaaaggccagatagagggagaggtggatctgattggtatggtgagattaacagaaaccagacagccttttgtgccagagaataacccagagcggaatcactggcattaccgcgaccttgaggccatggccagaataactggcgcagagcctatctttattgacgcaaatttccagagcacagttcctggtggacccatcggtggccaaacccgagtaaccttgagaaatgaacaccttcagtacattgtgacttggtacgggctcagcgctgcaacctcgtatctatggttcaagaagttcctgagaggcactccgggagtctag

SEQ ID NO: 242901 - DNA, 813 bp, Artificial Sequence
  Description of Artificial Sequence: Synthetic coding sequence
gctccagccagcgcagcatggagatccgtcctgcgtgtctcaccgcgacccggtgtagcatggagacccagccggtgcggctcgagcgccgctgaagccagtgcaactaaggcagaggatgactctttcctgcagtgggtcctgctccttattccagttaccgcattcgggcttggcacatggcaggtgcagagacgcaagtggaagctgaacctgatcgccgaactcgaatccagagttctcgccgagcctgtgcccttgccagcggatcccatggagctcaagaacctagagtataggcccgtcaaagtgagaggttgctttgaccattccaaggagctctacatgatgcctcggaccatggtggatcccgtgcgagaggctcgggaagggggacttattagctcttcgacccagagcggtgcctacgtagtcacaccttttcattgtacagacttgggaaagaaggtcaaccccgagacccgacagaaaggccagatcgagggcgaggtcgatttaatagggatggtacgattgacagagacccgccagccctttgtgcccgagaacaaccctgagagaaatcactggcactatagggacctcgaggctatggccagaatcaccggggcagagccaatatttattgatgcaaattttcagagtaccgtgccaggtggtcccatcggaggacagacccgtgttaccctgagaaacgaacatctccagtatattgtgacctggtatggtctaagtgccgctacgtcatatctgtggtttaagaagtttttgaggggaactcctggagtttag

SEQ ID NO: 242902 - DNA, 771 bp, Artificial Sequence
  Description of Artificial Sequence: Synthetic coding sequence
atgtcagaactgcccggtgatgtgcgggcatttctccgagaacatccgagtctcaggctccagactgacgcccgaaaggtgagatgtatactgacaggccacgaactcccttgtagactacccgagctgcaagtgtataccagggggaagaagtatcaaagattggttagggccagtccggctttcgactacgcggagttcgagcctcacatcgtgcccagcacaaaaaatccacaccagcttttttgtaaattgaccctgaggcacatcaacaaatgcccagagcatgttctgcgccacacccagggaagaaggtaccagagagccctttgcaaatatgaggaatgtcagaagcagggtgtggagtacgtgcccgcttgcttagttcaccgcagacgccgtagagaggaccaaatggacggcgatggacccaggccgagggaagctttctgggaacccacctcctctgatgaaggtggtgctgcatcagatgatagcatgacagacctatacccacccgagttattcacaaggaaggaccttggctccacggaggacggggatgggacggatgattttcttacagacaaagaggacgaaaaggcaaagccccctagagaaaaggccacagatgaatcgcggcgtgaaaccactgtctacagaggacttgtgcagaaacgagggaagaagcaattgggttccctgaagaaaaagtttaagtctcatcatcggaaacctaagagcttttcgagctgtaaacagccaggttag

SEQ ID NO: 242903 - DNA, 810 bp, Artificial Sequence
  Description of Artificial Sequence: Synthetic coding sequence
atgggccagaatgaccttatgggcaccgccgaggactttgccgatcagtttctgagggtgaccaaacagtacctgcctcatgtagctcgcctgtgcctcatatcaaccttcctggaggacggcatccggatgtggttccagtggtcagaacaacgcgattatatagataccacatggaactgcggttatctgctggccagttcctttgtcttcctcaacctcttaggccagctgaccgggtgcgtattggtcttatcaagaaacttcgtccaatatgcttgttttggcttgttcgggataattgcgttacagactatagcctattcaatattgtgggatttgaaatttctcatgcgcaacctggctctcggcggagggctcctcctgctgctggcggagagccggtctgagggtaagtccatgtttgcaggggtccccaccatgcgtgagtcttcacctaagcaatatatgcagctggggggtcgggtgctcctggtgctcatgtttatgacgctcctgcattttgacgccagcttcttttcaatcgtccaaaatatcgtaggcaccgcgctaatgatcctggtggcaatcgggttcaagacaaagctggctgccttgacccttgtggtctggcttttcgcgattaacgtgtactttaatgccttctggactataccggtgtacaagccaatgcatgattttctaaaatacgatttttttcagacaatgagcgtcattggtgggcttctcctcgtcgttgcgctgggcccaggaggggtgagtatggatgaaaagaagaaagagtggtag

SEQ ID NO: 242904 - DNA, 561 bp, Artificial Sequence
  Description of Artificial Sequence: Synthetic coding sequence
atgggccagaatgatttaatgggcactgctgaggattttgctgaccaatttctgcgagtaacgaaacagtatctgcctcatgttgccaggttgtgtctgatctctacgttcctcgaggacggaatccggatgtggtttcaatggtcggagcaacgagactatatagataccacgtggaactgcggctatctgttagccagtagctttgtcttccttaatcttctcggacaacttaccggatgtgtcttagtcctgtccagaaatttcgtgcaatatgcatgcttcggattatttggaatcatcgcacttcagaccatcgcctacagcatcctttgggatctgaagtttctgatgagaaacctggccctcggcggaggattactgctgttactagccgagagtaggtccgagggcaaatcaatgttcgccggtgttcccaccatgagagagtcttcacctaagcagtacatgcagctcggcggacgggttttgctggtgctcatgttcatgaccttgctgcatttcgatgcctcatttttttcccagccttctcagcagtag

SEQ ID NO: 242905 - DNA, 567 bp, Artificial Sequence
  Description of Artificial Sequence: Synthetic coding sequence
atgggccaaaatgatctcatgggcactgctgaagattttgctgatcaattcctacgcgtcactaagcaatacctgccacacgtcgctaggctgtgccttatcagtacctttctcgaggacggtatccgtatgtggtttcagtggagcgaacagagggattacatcgacactacatggaactgcggctatctacttgcgtcatctttcgttttcctgaacctgctcggtcagctgacgggctgtgtccttgtgcttagcagaaacttcgttcagtatgcttgctttggtctattcggaattatagcattacaaactatcgcatatagcatcctgtgggatcttaaattccttatgcgcaatttagccctgggcggtggtctgctgttgttactggccgaaagccgtagtgaaggaaaatccatgttcgccggagtgcctaccatgagggagagctctcccaaacatacctgtctcgcaaaaaccagaggtaggcagggtctggtacgcggaggattcaacaagactgcctccttttatgtctcttcttccttgccccttccttggtag

SEQ ID NO: 242906 - DNA, 783 bp, Artificial Sequence
  Description of Artificial Sequence: Synthetic coding sequence
atgcgctccttggccactgagttccttcgggtcacaaagcagtacctgcctcatgttgcgcgattatgtctgatctccactttcttggaggacggaatccggatgtggttccagtggtctgagcagagagactacatagacactacttggaactgcggttatctgctcgcaagttcatttgtctttttaaacttgctggggcaactcacaggctgcgtgctagtgctgagtcgcaacttcgtccaatacgcctgtttcggcttgtttggcatcattgcactgcaaacaatagcctattctatattgtgggacttgaaattcttgatgagaaacctggctcttggaggtggtctgctcttactcctggccgagagccgctccgagggtaaatccatgttcgcaggcgtccctaccatgcgggaaagctctccaaagcagtacatgcagctgggagggagagtgttgttggtattaatgttcatgaccttgcttcacttcgacgcctcctttttttcgattgtgcaaaatatcgtgggaactgccctcatgatcctcgtggccattggttttaagaccaaattggcagccctgaccctggtggtgtggctgttcgccattaacgtgtactttaatgccttctggacgatccccgtgtataagcctatgcacgacttcttgaaatacgatttttttcagactatgagtgtcatcggcggactgcttctcgtggtcgctctagggccaggcggtgtgtcaatggatgagaaaaagaaggaatggtag

SEQ ID NO: 242907 - DNA, 387 bp, Artificial Sequence
  Description of Artificial Sequence: Synthetic coding sequence
atgggccagaatgacttgatgggaaccgcagaggactttgccgatcagttccttcgcgttacgaaacagtacctcccacatgttgctcggctgtgtctgattagcacctttttggaagatgggattagaatgtggttccaatggtctgaacaacgcgattacatcgacactacctggaactgcgggtaccttctggccagttcctttgtattcttgaatctcttagggcaactcaccggttgcgtgctcgtcctgagtcggaattttgttcaatacgcctgctttggactgttcggaattatcgccttacaaacaatagcttatagtatcctctgggaccttaagttcctgatgcggctgtctagaacaagctgggcacaactttag

SEQ ID NO: 242908 - DNA, 1086 bp, Artificial Sequence
  Description of Artificial Sequence: Synthetic coding sequence
atggcgagcctgctggcaaaagatgcctacctgcagagcctggctaaaaaaatttgtagccattctgcccctgaacagcaagcacgcaccagagctgggaaaacacagggatccgagacagccggtcctccaaagaagaagaggaagaaaacgcagaagaagttcagaaagagggaggagaaggccgcagaacataaggctaaaagcctgggtgaaaaatcacctgcagccagcggggcacggaggcctgaggccgctaaagaagaagctgcttgggcttcttcttccgctggcaacccggcagacggcttggccacggagcccgagtctgtgtttgccctcgacgtgctaaggcagcggttgcatgagaagatacaggaggctagaggtcaaggtagcgctaaggagctgagccccgcagcacttgagaagcgcagaaggcgcaagcaagaacgtgaccgcaaaaagcgaaagagaaaggaacttagggctaaggagaaggccagaaaagccgaagaagcaacagaggcccaggaggtcgtggaggctaccccggagggcgcttgtacagagcccagggaaccccctggactgatattcaataaggtagaagtctccgaggatgaacccgcaagtaaagctcagcgcaggaaagaaaagcgccagcgggtgaaaggcaacctgacccctttgaccggaaggaattatcggcaactgctagagcgcttacaggctagacagtcacgcctcgatgaattgcggggacaggatgagggaaaggcacaggagcttgaggccaaaatgaagtggacaaacctcctgtacaaagccgaaggtgtaaaaatccgtgatgatgagcggttgctccaggaagccttgaaacggaaggagaaacgcagagctcagagacaacggagatgggaaaagaggactgccggagtagtcgaaaagatgcagcagcgccaggacagacggaggcaaaacctacgcaggaagaaggccgcaagggctgaaaggcggctgcttcgagcacgcaagaagggccgaatcctgccccaagatttggagcgtgctggactagtgtag

SEQ ID NO: 242909 - DNA, 789 bp, Artificial Sequence
  Description of Artificial Sequence: Synthetic coding sequence
atggccatgagctccggcggatccggaggcggagttcctgagcaggaagattccgtcttattccgcagagggactggtcagagcgacgactccgatatttgggacgataccgcgcttattaaggcctatgacaaggctgtcgcaagcttcaaacatgcccttaagaacggggatatctgtgagacgtccggaaagcccaaaactactccaaaaaggaagcctgctaaaaaaaacaagtcccaaaagaagaacacagctgccagcctccaacaatggaaagtgggagacaagtgctccgctatctggagcgaggacggctgtatctacccagcgacaattgcttctatcgattttaaaagagagacgtgtgtagtggtgtataccggttacggtaacagagaggagcagaaccttagcgacctgttgagtcccatttgcgaggtcgcaaataacattgagcagaatgcgcaagagaacgaaaatgagtcgcaagttagtactgacgaatcagaaaacagccggagcccaggcaacaagagcgacaatatcaaacccaagtctgccccatggaactccttcctgccaccaccccctcctatgcccggacccaggctgggccctgggaagattatcccccctccccctccgatctgtccggattctctcgacgatgccgatgctctaggcagcatgctcatcagttggtatatgagcggatatcacaccggatactatatggggttccgtcagaaccaaaaggagggacggtgctcacactctctcaattag

SEQ ID NO: 242910 - DNA, 885 bp, Artificial Sequence
  Description of Artificial Sequence: Synthetic coding sequence
atggcgatgtccagtgggggatctgggggaggggtccctgagcaggaggattcagtgctgttccgacgcggaacaggccaatctgatgactccgacatctgggacgataccgctctgatcaaggcctacgataaggcagtcgcttctttcaaacacgctctaaaaaacggcgatatttgcgagacatccggcaagcccaaaacaacaccaaagcgcaagcccgctaaaaagaacaaatcccagaaaaagaatacagctgcatctctccaacagtggaaagtgggcgacaagtgctccgcgatctggagtgaggacgggtgcatctaccctgcaaccattgccagtatcgattttaagcgagaaacatgcgtggtggtctatacaggatacgggaatagggaggagcagaacctgagtgacctgttgtcaccaatttgcgaggtggctaataacatagagcagaatgcacaggaaaacgaaaacgaatctcaggtgtctacggatgaaagcgagaactctcgttcgcccggaaacaagtcagataatatcaaacccaagagtgccccatggaatagttttctgcccccaccaccacctatgcccggtcctagactaggcccaggaaagcctggactgaagttcaatgggccacccccacctccacctccccctcctccccacctactgtcttgttggctacctcctttcccctccggcccacccataatcccgccaccgcctccaatttgtcccgatagcctggatgatgctgatgccctaggatctatgctcatctcctggtatatgtctggctaccatactggttattatatgggattcaggcagaaccagaaggagggacgctgcagtcactccttgaactag

SEQ ID NO: 242911 - DNA, 789 bp, Artificial Sequence
  Description of Artificial Sequence: Synthetic coding sequence
atggccatgtcctcgggaggctccggtggtggcgtgcccgaacaggaggactctgtgctgttccgccgaggcaccggtcaaagtgacgatagcgacatttgggacgataccgcactcatcaaagcatatgataaagccgtcgccagcttcaagcatgctttgaaaaacggcgacatttgtgagacgagcgggaagccaaagaccacccctaaaaggaagcccgcaaaaaaaaataagtcacaaaagaagaatacagccgcttcccttcaacaatggaaggtgggggataagtgttccgccatttggtctgaagacgggtgcatttaccccgctactatcgcctccattgattttaaaagggaaacgtgcgtcgtggtgtacaccggatatgggaacagagaggagcagaatctcagcgatctgctgagcccaatttgcgaagtcgccaacaacatagagcagaacgcgcaggagaatgaaaatgagtcccaggttagcacggatgagagtgagaactccagatctcctggaaataaaagtgacaatatcaagcccaaaagtgctccctggaactcgtttctgccacctcctcctcctatgcctggcccacgcctcggacccggaaaaatcattcctcctcctcctcccatatgtccggactctctggacgatgccgatgcattgggcagcatgctgatctcctggtatatgagcggctatcatactggttattacatgggcttcaggcaaaatcaaaaggagggaagatgctcccacagtttgaactag

SEQ ID NO: 242912 - DNA, 849 bp, Artificial Sequence
  Description of Artificial Sequence: Synthetic coding sequence
atggctatgtcatccgggggaagcgggggtggagttcccgagcaagaggatagtgttctgtttaggagggggaccggccagagcgatgatagcgacatctgggacgatactgccttgattaaggcttacgacaaggcggtagcatctttcaaacacgccctgaagaacggcgacatatgtgagacatccggcaagccaaagacaacgcctaaacgcaagcccgcaaaaaagaataaatcccagaagaaaaatacagccgctagtctacagcagtggaaggtgggtgacaaatgctccgcgatctggtctgaggatggttgcatttaccctgcgacaatagcttctatagatttcaagcgggagacttgtgtcgtagtctatacaggttacggcaatagggaggagcaaaatctgtccgatttgctcagtcccatatgcgaggtcgctaacaatatcgagcaaaatgcgcaagagaacgaaaatgaatcccaagtgagcactgacgagtcagaaaatagtaggagccccggaaacaagagcgataacatcaagcccaagagtgccccatggaacagtttcctcccaccaccccctccaatgcctggacctcggttaggaccaggaaaaccaggtctcaagtttaacggccctccacctccaccccctcccccaccaccccatttgttatcatgctggctgcctcccttcccatcaggaccccctatcatcccgccacccccacctatctgccctgatagcctggacgatgccgacgccctcggatcaatgctcataagttggtatatgagcggctatcacacaggatattacatggaaatgttagcatag

SEQ ID NO: 242913 - DNA, 885 bp, Artificial Sequence
  Description of Artificial Sequence: Synthetic coding sequence
atggccatgtccagcggcggatcagggggaggcgtacccgaacaagaagatagcgttctcttcaggcggggtacgggccaatccgatgactcggacatctgggatgatacagccctcattaaagcttacgacaaggccgtggcttcgtttaagcatgccctgaagaatggagacatatgtgagacctccgggaaacccaaaacgacccctaagcgaaagcctgcaaagaaaaacaagagccaaaaaaagaataccgccgcttcattacagcagtggaaggtgggggacaagtgcagtgctatctggagtgaagatggatgcatttatcccgcaactattgcttcaatcgatttcaagagggagacctgtgtagtcgtctatactggatacggaaatcgggaagagcaaaatctctcagatctgctgtcgcccatttgcgaggttgccaacaacattgagcagaacgcccaggaaaatgagaacgagagtcaggtttcaaccgacgagagcgagaatagtcgttcaccgggaaacaagtcagacaacataaagcccaaaagcgcaccatggaatagttttctaccgccacccccacccatgccaggccctcgtctcggacctggcaagcctggcttgaagtttaacgggcctcctcccccaccaccaccccctccgcctcatttgctctcatgttggctccctccattcccaagcgggcctccaatcatccccccacctccccctatttgtcctgattccctggacgatgcagatgcactgggcagcatgctgatttcctggtatatgtcgggctatcacactgggtattatatgaccggtttccactgcgtatcccaggatggtctaaacttgttgacaccatag

SEQ ID NO: 242914 - DNA, 684 bp, Artificial Sequence
  Description of Artificial Sequence: Synthetic coding sequence
atggccatgagttcagggggtagcggaggaggtgtcccagagcaggaggactctgtacttttcaggcggggtacgggccagtcagacgactcagatatatgggatgacacggccctcatcaaggcatacgataaagctgtcgcctctttcaagcatgccttaaaaaatggcgacatttgcgaaacaagtggcaaacctaaaacgacaccaaaacggaaacctgccaagaagaacaagagtcaaaaaaaaaataccgcggcttcactgcagcagaatgaaaatgaaagtcaggtgtctaccgacgagtctgagaattccagaagccccggtaataagtccgataatatcaaacccaaaagcgctccatggaactcctttctgccaccccctccaccaatgcccggaccccgtctgggccctgggaagccagggctgaagttcaacggccctccccctcccccacctcccccacctccgcatcttttatcgtgttggctccctcccttccccagcgggccaccaatcataccccctccacctcccatatgtcctgattctctcgacgatgccgacgcgcttggatctatgttgattagctggtatatgtcggggtaccacacgggatactacatgggttttcgccagaaccagaaggagggcaggtgctctcactccttgaactag

SEQ ID NO: 242915 - DNA, 849 bp, Artificial Sequence
  Description of Artificial Sequence: Synthetic coding sequence
atggccatgtcttctggagggtccggtggcggtgtgcccgagcaggaggatagcgtcctatttcggagggggactggacagagtgacgatagtgacatatgggatgacacagctctgataaaagcttatgacaaagctgtggcatctttcaagcatgcattgaaaaacggggacatctgcgaaacctctgggaagcccaaaaccacacccaagcgcaagcccgcaaaaaaaaacaaatctcagaagaagaacaccgccgcaagcctccagcaatggaaagtcggcgataaatgtagcgcgatctggtcagaagatgggtgcatatacccagccaccattgcctcaattgacttcaagagagaaacatgtgtggtggtgtatacagggtacggcaatcgagaagaacaaaacctgtctgacttattgagcccaatatgtgaggtggcaaacaatattgaacaaaacgctcaggagaacgagaacgaaagtcaagtttcaactgacgagagcgagaactcccggagccccggtaacaaatcagacaacattaagcccaagagcgcgccatggaactccttcctgccccctccccctccaatgcctggcccacgcctaggccctgggaaacctgggttgaaatttaatggccctccccctcccccacctccaccgcctccacacctgctgtcgtgctggctccctccattcccctctggacctccaattatccctccccctccaccgatctgtcccgacagcctagatgatgccgatgctctcgggagcatgttaatctcttggtatatgtcaggctatcataccggatattatatggagatgctcgcgtag

SEQ ID NO: 242916 - DNA, 789 bp, Artificial Sequence
  Description of Artificial Sequence: Synthetic coding sequence
atggccatgtcatctggcggatctgggggtggtgtgcccgagcaagaggatagtgtcttgtttcggagagggacaggccagagtgacgactcagatatttgggatgacacagctctcattaaggcttacgataaggcagtcgcaagcttcaaacatgctcttaagaacggcgacatctgtgaaacgagcggtaaacccaagaccactcctaaaaggaagccagctaagaagaataagtctcagaagaagaatacagctgccagtctgcagcagtggaaggtgggggacaaatgcagtgctatctggagcgaggatggctgtatctacccagccaccattgcttccattgacttcaaacgggagacctgcgtagtggtgtataccgggtatgggaaccgcgaggaacagaatttgtcggatctgttgtctcctatttgcgaagtggcgaacaacattgagcagaatgcccaggagaacgaaaatgagtcacaagtgtccacagatgaaagcgagaactcccgcagccccggtaataagtctgacaacatcaagccaaaatctgccccttggaactccttcttgcccccaccgccaccaatgcctggacccagactgggtcctggtaagatcatccccccaccgccacccatctgccctgattccttagacgacgccgatgccctcgggagtatgctgatctcctggtatatgagtggatatcacactggttactacatgggattcaggcaaaaccagaaagaaggtcgctgttcccattcactgaattag

SEQ ID NO: 242917 - DNA, 885 bp, Artificial Sequence
  Description of Artificial Sequence: Synthetic coding sequence
atggcaatgagcagcggtggctccggtggtggtgtccctgaacaagaggacagcgttctatttcggcgaggcaccggtcagagcgacgacagtgacatctgggatgacaccgccctgattaaagcctacgataaggctgtggcaagctttaagcacgcactgaagaatggagacatttgtgagacatctggtaagccaaaaacaacgcccaaacgtaagccagctaaaaagaataagtcacaaaagaaaaacaccgcagcaagtcttcaacaatggaaggtaggcgacaagtgctccgctatctggtccgaagatggctgtatctaccctgcaacaatcgccagtattgattttaagcgggagacgtgcgttgtcgtgtatactggctatggcaacagagaggaacagaacttatctgacctgctcagccctatttgtgaggtggctaataacattgagcaaaacgctcaggagaacgagaatgaatcacaggtctccaccgacgagagcgagaactccaggtctccgggtaacaagtccgacaatatcaagccgaagagcgcgccttggaactccttccttcccccaccaccacccatgcctggaccacggttgggcccaggaaagcccggtcttaaattcaatggccctcccccaccaccacccccacctccccctcacctcttgtcttgctggctgccgccatttccttcggggcctccaatcatacctccaccccctcctatttgccccgactcgctagacgatgccgatgctttaggttctatgctaatctcatggtacatgtcggggtatcacaccggttactacatgggtttccgacagaatcagaaagagggcaggtgctcccatagtctgaactag

SEQ ID NO: 242918 - DNA, 885 bp, Artificial Sequence
  Description of Artificial Sequence: Synthetic coding sequence
atggctatgagctctggaggcagtggtggaggagtgcctgaacaggaggattcggtcctgttcaggaggggaaccggacaatccgacgacagcgatatatgggacgatactgcactcattaaggcttacgacaaagctgtcgcctctttcaagcacgccttaaaaaacggcgacatttgtgagacatcagggaagcctaagacaactcctaagcgcaaaccagcgaagaaaaataagtctcaaaagaagaatactgctgcctccctgcagcagtggaaagtgggcgataagtgctctgccatctggtccgaagatggatgcatatatccggctacaatcgccagcatcgattttaaaagagaaacctgtgtagtggtctacacagggtacggtaatagagaagagcagaatcttagtgacctgctcagcccaatctgcgaagtcgctaacaacatagagcagaatgcgcaggagaacgaaaacgaatcccaggtttcgacagacgagagcgagaatagtcgcagccccggtaacaagagtgacaatatcaaacccaaaagcgccccttggaattccttcctacccccaccgccacctatgcccggaccaagattaggcccagggaaacccggactgaagttcaacggtccccctcctccaccgcctccacctccaccccacttactgtcctgctggttgccacctttcccttccggccctcccatcatccctcccccaccccctatttgtcccgactcattggatgacgctgatgcactgggaagtatgctgatttcttggtatatgagcgggtatcataccggctactacatgacaggttttcactgcgtctctcaggatgggcttaacctgctgaccccttag

SEQ ID NO: 242919 - DNA, 684 bp, Artificial Sequence
  Description of Artificial Sequence: Synthetic coding sequence
atggcgatgtcatccggtggttctggcggtggcgtgccagagcaagaggattccgtcctcttccggaggggaactggccagtctgacgacagtgatatttgggacgacacagcattaatcaaagcttacgataaggctgtggcaagttttaagcatgctctaaaaaacggcgatatttgcgagacatcaggtaagcccaaaactacacctaaacgaaagcccgcaaagaagaataaatcccaaaaaaagaacaccgcagcgtctctccagcagaacgagaacgagtctcaggtcagcacagatgaatctgagaacagccgcagtcccggaaacaaatctgataacatcaagcctaagtcagccccttggaactcattcctgccaccacctcctccaatgcctggtccccgtctgggccctggaaagcccggtctgaaatttaatgggcctcctccacctccccctcctccacctccacatctgctctcctgctggcttccaccattcccatcaggcccaccaataatacctcctcctcctcccatctgtccagacagcctggacgacgctgatgcactagggtccatgctcatatcatggtacatgtccggctaccataccggatactacatggggtttcgccaaaaccagaaggaaggaaggtgcagtcattccctaaattag

SEQ ID NO: 242920 - DNA, 4494 bp, Artificial Sequence
  Description of Artificial Sequence: Synthetic coding sequence
atgccccgttgcatagcgcacttttgcgagaaaccaccttcggtgtcttactcaattcttgagtcagtgagcaaagctaagtttgccgcaggcagcgtagtaagcttcaaatgtatggaggggtttgtactcaacacaagcgccaagattgaatgcatgaggggcggacagtggaaccctagtccaatgtcaatccagtgcattccagtacggtgtggggaaccaccgtccatcatgaacggatatgccagtgggagcaactacagcttcggagccatggtcgcctacagttgtaataagggcttttatataaaaggggagaagaaaagcacctgtgaggcaacaggacagtggtcatctcctattcccacttgtcacccagtttcatgtggggaacccccaaaagtcgagaacgggtttctggagcacacaaccgggagaatctttgaatctgaggtaaggtaccagtgcaatcccggttacaaaagcgtggggagccctgtgttcgtctgccaagccaaccgccattggcacagcgagagtcccctgatgtgcgtgccacttgattgcggaaagcccccacccatccaaaacggttttatgaaaggggagaacttcgaagtgggatccaaggtgcagttcttctgcaacgaggggtatgaattggtgggagactcttcctggacatgtcaaaaatctggcaaatggaacaaaaaaagtaatccaaagtgcatgcctgccaagtgcccggagccaccgctactcgagaaccagcttgtcctaaaggaactcactactgaggtgggcgtcgttactttttcatgcaaggaggggcacgtgctgcaaggcccatccgtcctaaaatgtttgccctctcagcagtggaatgactccttccctgtgtgcaagatcgtgctctgtactcccccaccactgatctctttcggagtgcctattccctcgtctgctctgcatttcgggagcaccgtgaaatactcctgcgtcggcggttttttcctgcggggaaatagtacaactctttgccagcccgatgggacatggtcgagtccattgccggagtgtgttccggtcgagtgcccacagcccgaagaaatccctaacggcatcatcgatgtgcagggtctggcctatctgtccacagcactatacacctgtaaacccggattcgagcttgtgggaaacaccaccacattgtgcggggaaaatggacattggttggggggaaaaccaacctgcaaggctattgaatgcctcaaaccaaaagaaattctaaacggcaaatttagttacacagacttacattacgggcagaccgttacgtactcctgcaatagaggcttccgtctggaagggccttctgctctcacctgcctggagaccggcgactgggacgttgatgctccctcttgtaatgcgatccattgcgatagccctcaacccatcgaaaacggattcgtggagggagctgattacagttatggagcaatcatcatttattcctgtttcccaggatttcaagtagctgggcacgcaatgcagacatgcgaggagtctggatggagcagttctatcccaacttgcatgcctatcgattgcggactgcccccacacatagactttggagattgtaccaagctaaaagacgaccaaggttacttcgaacaggaggatgatatgatggaggtgccttatgtgacaccacaccctccatatcacttgggcgctgtagccaagacttgggagaatacgaaagaaagccccgctactcattcatcgaattttttgtatggtactatggtttcatacacctgtaatcccggatacgagctcctgggtaatccagttctgatatgccaggaagacggcacatggaatggcagcgcacctagctgcatttccatcgagtgcgatctcccaacagctccagagaacggattcctgcgttttaccgagacatctatggggtctgctgtccagtactcgtgtaaacctgggcacatcctggcaggttccgatttaagactgtgtttggaaaaccgcaagtggtcgggagcttcgccgaggtgtgaggcaatttcctgcaagaagccaaatcctgtgatgaacggatccatcaaagggtcgaactacacgtatcttagtactctgtactacgaatgtgacccagggtacgttctgaacggaaccgagcgccgtacctgccaggatgacaaaaactgggatgaggatgaacctatctgtattccagttgactgtagcagtccgccagtatccgccaatgggcaagtgcggggtgacgaatatacctttcagaaggaaatagaatacacctgtaacgagggctttttactggagggcgctaggagcagggtgtgccttgcgaacggtagctggtccggggcaacaccagattgcgtccctgtcagatgcgccactcccccacaactggctaatggagtgaccgaggggctggactatgggtttatgaaggaagtgacctttcactgccacgaaggatacatcttgcatggcgctcctaagctgacttgccagtctgatggcaattgggacgccgaaatccctctgtgcaaaccagtgaactgtgggccaccagaagacttggcccatggatttccaaacggtttcagttttatccacggtggacacatccagtaccagtgcttcccagggtacaagctgcacgggaacagcagcaggcgctgcctcagtaacgggagctggtcaggaagcagtccctcctgcctcccatgtagatgcagtacgcccgtgatcgagtacggcaccgtgaacggcaccgacttcgattgtggaaaggcggctcgtatccagtgttttaaggggttcaagttgttgggcctgtctgagattacctgcgaagccgatggacaatggtcctctgggtttccccattgtgaacacacatcgtgcggaagcctgccaatgattccgaatgcctttattagcgaaacctcttcatggaaagagaacgtcatcacctatagctgcagatctggctatgtcatccaagggagttccgatctgatctgcacagagaaaggcgtatggagtcagccatatccagtctgcgagcccctttcctgtgggtccccgccaagcgtagccaatgccgtggcaaccggcgaggcgcacacatacgagtctgaggtcaagctccgctgcctggaaggctatacaatggacactgatactgacaccttcacatgtcagaaggatggacggtggttccccgaacgaatcagctgttctccaaagaagtgccctctccccgagaacataactcacatcctcgtccatggggacgattttagcgtgaatcggcaggtcagtgttagttgcgcagaggggtacacatttgagggagtgaatatttctgtctgtcagctagacgggacatgggagcctcctttttccgacgaatcctgctcccccgtatcttgcggaaagcctgagagtcccgagcacggtttcgtcgtaggatcaaagtacactttcgaatcaactatcatttatcaatgcgagccagggtacgaactagaaggtaatagggaaagagtctgccaagagaatagacagtggtcaggcggtgtcgcaatctgcaaagagaccaggtgcgagacacctctggaattcctcaatggtaaagctgacatcgagaatagaacaacaggtccaaatgtggtgtattcttgcaacaggggctactccctggagggacctagtgaggcacattgtaccgaaaatggcacatggtcacatcccgtcccactgtgcaaacccaatccatgcccagtgccgtttgttatacccgagaatgcactactcagcgagaaagaattttatgttgaccagaacgtgtctattaaatgccgggaaggcttcctgctccaaggacacgggatcattacttgcaaccccgacgagacatggacacaaactagcgctaagtgcgaaaaaatttcttgtgggccacccgcacacgtcgagaatgctatagcaaggggagtccattaccagtatggagacatgataacctactcctgttacagtggctatatgctggaaggcttccttaggagcgtctgcctggagaacggcacatggacctccccccctatctgtcgcgctgtgtgccgctttccatgtcagaacggtggtatttgtcagagacccaacgcttgttcctgccctgagggctggatgggaaggttatgtgaggaacctatttgcatcctgccttgcttgaatggtggccgatgcgtggccccttaccaatgtgactgtcctccaggatggaccgggagtagatgccataccgccgtgtgccagagcccctgtctgaacgggggaaaatgtgtccgtccgaatcgatgtcactgcctgagttcatggacgggacataattgcagccgtaaacgacgtaccggcttttag

SEQ ID NO: 242921 - DNA, 4650 bp, Artificial Sequence
  Description of Artificial Sequence: Synthetic coding sequence
atgtggccgagactggctttttgctgttggggcctcgcgctagtgagcgggtgggcaactttccagcaaatgtccccatcaagaaactttagcttcagacttttccccgagactgcgccaggagccccaggcagcattccagcgccacccgcacccggagatgaggctgcgggaagtagagtagagagattgggacaggcgtttaggcgacgtgtgcgcctgctgagagagctttctgaacgattagaactcgtctttcttgtagatgattcttccagcgtcggggaggtcaatttccgcagtgaactgatgttcgtgcggaagttgctgagcgatttcccagtggtgcccaccgccactagggtagccatcgtaactttctctagtaaaaactatgttgtccctcgggtcgattacattagtacacgcagagccagacagcacaagtgtgcattgctgcttcaggaaattccggctattagttatcggggaggcggaacttatactaagggggcattccagcaagcggcacagatcctgctccatgccagggagaatagtaccaaggtcgtctttctcataaccgatggatactctaatggcggtgaccctagacccattgccgcaagcctacgggacagcggtgtagaaatttttacgtttggcatctggcagggcaacattcgcgagctcaatgacatggcgtccaccccgaaggaggagcactgctatctcctccatagctttgaggaatttgaggcattggcaaggagggcactgcatgaagatctaccaagtgggagttttattcaggacgatatggtgcattgttcctacctgtgtgatgaaggtaaagactgttgcgaccggatgggctcctgtaagtgtggaacacacacagggcactttgaatgtatctgcgagaagggatactacggcaaagggctgcagtatgagtgcacggcttgcccgagcggtacctataaacccgagggcagtccaggaggcatatcctcttgcataccctgcccggatgagaaccatactagcccacccggatccacttctccagaggattgcgtgtgcagagaaggctatcgggcttcggggcagacttgtgagttggtgcactgccctgccctgaagcctcccgagaatggatatttcatccaaaacacatgtaataatcactttaacgctgcgtgcggagtgaggtgtcacccgggttttgacctggtggggagctcgatcattttgtgcctgccaaatggcctttggtcaggcagcgagagttattgccgcgtgcgaacctgccctcacctccgccagcctaagcatggtcacatttcctgtagtacaagagagatgctctacaaaaccacatgcctggtggcgtgcgatgagggctacaggctggagggatctgataaattgacctgtcaagggaattcccagtgggacggtcccgagcccaggtgcgtggagaggcactgctcgactttccagatgcccaaggacgtcataatatcaccacacaactgtggtaagcaaccggctaagtttgggaccatatgctacgtctcctgccggcaaggctttatcctgtccggagtaaaggaaatgcttagatgcaccacttccggcaagtggaatgttggtgtgcaggcggctgtctgtaaggatgtggaagcaccccagatcaattgcccaaaagacatagaggccaagaccctcgagcagcaggacagcgctaacgtgacttggcagattccgaccgcgaaggataattctggggagaaagtcagcgtgcatgtccaccctgcgttcaccccaccctatctatttcccatcggcgacgtagctattgtgtacactgccactgacctttccgggaatcaggccagctgtatattccatatcaaggtgatcgacgccgagccacccgtgattgattggtgtaggtccccacctcccgtgcaggtcagcgaaaaggtgcacgccgctagttgggacgaacctcaattttctgacaactctggagctgagttggttattacgagatcccatactcagggtgacctcttccctcaaggagaaacgatagtgcagtataccgcaacggacccttctggcaataaccgcacatgcgacatccacatagtaattaagggatctccttgtgagattccctttacaccagttaatggagactttatatgtactccagataacaccggggtgaattgtaccctgacctgtctagagggctacgattttacggagggttccacggacaaatattactgcgcctatgaagacggggtgtggaaacctacttacacaactgagtggcccgactgcgcaaaaaaacggttcgctaaccacgggttcaagtctttcgagatgttctacaaagccgcacggtgcgacgacactgatctcatgaaaaaattctcagaagccttcgagacaactctgggcaagatggttcccagcttttgctccgacgccgaagacattgactgtcgtttggaggagaacttgactaagaaatactgcctcgaatataactatgattacgagaacggcttcgctatcggtcccggaggctggggcgctgctaaccggctcgattactcctatgatgactttctggatactgtacaggagaccgctacaagtattggcaacgccaagtcctccagaattaaacgttccgcgccattgtctgattataaaattaaactaatcttcaatataactgcttccgttcccctccctgacgaacggaatgatactcttgaatgggagaatcagcaaagacttcttcaaaccttggaaacgattacgaacaagctgaagcggaccttgaacaaagaccccatgtattcatttcagttggcttccgagattttgatagccgactcgaattcccttgagaccaagaaggccagccctttttgccggcctggcagcgtgttaagaggccgaatgtgcgtgaactgtccactgggcacctattataatctcgaacatttcacctgcgagagctgtaggattgggtcttaccaggacgaggaaggacagttggagtgtaagttgtgcccatctggtatgtacacagaatatatacattcccgcaatattagtgattgtaaagcacaatgcaagcagggcacttactcttacagtggcctggagacatgtgaatcatgccctctgggaacctaccagccaaagttcggctcgagatcatgcttatcctgccccgagaatacttccacagttaagagaggggcagttaacatctctgcgtgcggagtaccgtgtccagaaggcaagttcagccgcagtggactgatgccgtgccacccttgtcccagggactattaccagcccaatgccggaaaagctttctgtctcgcatgtcccttttacggcacaactccttttgccggatctaggtccattaccgagtgttcgtcgttctcatcaacattcagtgcggctgaagagtcagtggttcccccagctagccttggccatataaagaaacggcacgagatctcaagccgggtgttccatgaatgtttttttaacccctgtcacaacagtgggacgtgccagcagctgggcagagggtatgtttgcctgtgccctctgggatacaccgggctgaaatgtgagacggatatcgacgaatgctctcccttaccctgccttaataacggagtgtgcaaagatttggtgggagagtttatatgcgaatgcccttcgggctacacaggacagcggtgtgaagaaaacatcaacgagtgctctagctctccttgcctcaataaaggtatttgcgtagatggcgtggctggctaccgctgcacgtgtgtcaaaggattcgtgggcctccattgcgaaaccgaagtaaacgaatgtcaaagcaatccttgcctcaataacgctgtctgtgaagaccaggtgggcggtttcctgtgcaagtgcccacctggatttttggggacccggtgcggcaagaatgttgatgagtgcctgtcccagccttgtaaaaacggtgctacatgcaaggacggcgctaactcatttcgctgcctttgcgctgccggattcacaggctcccactgtgaacttaacataaacgagtgccagtccaacccatgccgcaaccaggccacctgtgtcgacgagctgaactcatactcctgcaaatgccagccagggtttagcgggaagcgctgcgaaacagagcaatccacaggattcaatctggactttgaggtgtccggtatctatgggtatgtcatgctggatggcatgctgccgtcactgcatgcgctaacatgtacattctggatgaaatcatcagatgatatgaattacggtacccccatctcctatgctgtcgacaacgggagcgataacacgttactcctgaccgactacaatggttgggttctgtacgtgaatggcagggagaaaattactaactgtccttctgttaacgacggcagatggcaccatatcgccattacgtggacttctgccaatggaatctggaaggtgtacatcgatgggaagctttccgatggaggcgctgggctgtcagtggggctgcccatcccaggcatgttttag

SEQ ID NO: 242922 - DNA, 2538 bp, Artificial Sequence
  Description of Artificial Sequence: Synthetic coding sequence
atgagtccttcaagaaacttctcttttcgattatttcccgaaaccgcccctggggcacccggatcaataccagctcctcccgctcccggtgatgaggccgcaggaagcagggtggaacgtctgggtcaagcatttaggcgcagggtgaggctgctgcgtgaactgtccgagcgtctggaactagtcttcctcgtggacgactcttccagtgttggagaggtgaactttcggtctgaactcatgttcgtgaggaagctgctgtcggatttccctgtggtgccaaccgcaacccgcgtggcgattgtcaccttcagttccaaaaactatgtcgtaccgagggtggattacataagcacgcgcagggctcgtcagcacaagtgtgcactcttgctccaggagatcccggcaatatcctataggggcggtggcacctataccaaaggagctttccagcaagcggctcagattctgcttcatgctcgcgaaaattccaccaaagtggtgttccttataacagatggatactcaaacgggggagaccccaggcccattgcggcttctctcagagatagcggggtcgaaatcttcacctttggcatctggcagggaaatataagggagcttaatgatatggcctcaactcctaaagaggaacactgttatctcctacattctttcgaagagtttgaagcccttgccagaagggctctgcacgaggacctgccctccggcagcttcattcaggacgatatggtgcactgttcgtacctgtgcgacgagggaaaggactgttgtgaccgcatgggctcctgtaaatgcgggacgcatactggtcacttcgagtgtatatgtgaaaagggctactatggcaaggggctccaatatgaatgcaccgcttgcccttcaggaacttataagccagaggggagcccaggtggaatcagctcctgcatcccctgccccgatgagaatcatacaagccccccaggatcaactagccctgaggactgcgtctgccgcgagggttatcgggcaagtggtcagacctgtgaattagttcactgtcccgctctgaagcctcctgaaaacggctattttatccagaacacctgcaataatcatttcaacgctgcttgcggggtgcggtgtcacccagggtttgatttggttggctcctctataatcctttgtttacctaacggcctgtggagcggtagcgaatcctactgcagagtgcgaacatgccctcatctgcgccagcccaaacacgggcacatctcatgttctactagagaaatgctgtataagactacttgtttggtagcctgtgacgagggctataggttggagggtagcgataagcttacctgtcagggcaatagccagtgggatgggcctgaacctcgctgcgttgaacggcattgttccacattccagatgccaaaagacgtgatcattagccctcataattgtggcaaacaaccagctaaattcggaaccatctgctacgtgtcatgccgccagggcttcatcctctccggggtaaaggaaatgcttcgctgcactactagtggcaagtggaatgttggagtgcaagcggcagtttgtaaagatgtggaggcccctcagatcaactgccccaaggacatcgaggccaagactctggagcagcaggactccgccaatgtcacttggcagatcccaacggcaaaagacaattctggtgagaaggttagcgtacacgtacatcctgcctttactcctccatacctgttccccattggtgacgtcgcaattgtatatacagccacagacctgagcggtaaccaggccagttgtattttccacatcaaggtaattgacgcagagccccctgtcattgactggtgcaggagcccccctcctgtgcaggttagtgaaaaagtacacgctgccagctgggatgagccccagttctccgataacagcggtgctgaactagtcatcaccaggtcccacacccagggagatctatttccccagggggagactatagtccaatacactgccactgatccctccggtaataatagaacttgtgacatacatatcgttatcaaggggagtccctgcgagattcccttcacaccggtgaatggagatttcatctgtaccccagacaacaccggagttaactgtaccctgacgtgtctggagggatatgactttacagaaggctcaactgataagtactattgcgcatacgaagacggcgtctggaagccaacctacacaaccgagtggccagactgcgccaaaaaacggttcgcgaaccacggctttaaaagcttcgaaatgttctataaagccgctaggtgcgatgataccgacctgatgaagaaattcagtgaggcttttgagaccacactggggaagatggtgccgtcattctgctcagatgctgaggacatcgattgcaggctggaggagaacctgacaaagaagtactgtcttgaatataactacgattatgagaatggatttgccatcggtaattag

SEQ ID NO: 242923 - DNA, 1548 bp, Artificial Sequence
  Description of Artificial Sequence: Synthetic coding sequence
ctggagaaccagcttgtccttaaagagcttaccacagaagttggcgtcgtaacgttctcttgtaaagaagggcacgtgctccagggccctagtgtgctcaagtgtctgccatcccagcaatggaacgattcctttcctgtgtgtaaaatagtgctgtgtactcctccgcctctcatttcctttggggtgcctataccgtcaagtgcacttcattttgggagcacagtcaaatactcatgtgtcggtggatttttcctgcgtggcaacagcacaaccctgtgtcaacccgacggtacctggtccagtcctctgcccgagtgtgtgcccgtcgagtgtccacagcccgaagagatcccgaatggtattatcgatgtgcaaggactggcatatctgtcaaccgcactgtatacctgcaaacctggatttgagctggtcggcaacacgactacattatgcggcgaaaacggccattggctcggaggtaaacctacctgcaaagctattgagtgcctcaagccaaaagagattctgaacggaaaattcagctacactgatctgcattacggacaaactgtcacttacagttgcaacaggggcttcagactcgagggcccatccgctctgacctgtcttgagaccggcgactgggatgtagacgccccttcctgcaacgctatacactgcgattccccacagcccatagagaacggctttgtggaaggcgctgattacagttacggggctatcattatctatagttgtttcccgggatttcaggtcgccggacacgccatgcagacttgcgaggaatcgggttggtccagcagcattccaacctgcatgccgatagattgcggcttgccgccacacatagattttggggattgcaccaaattgaaagacgatcagggttatttcgagcaggaagacgacatgatggaagtgccatatgtgaccccacatccaccataccatctgggagctgtggcaaagacttgggaaaatacaaaagaatcgcccgctacacattccagcaattttctgtacggaaccatggtgtcttatacctgcaatccaggctacgagcttctcgggaatccagttctgatttgccaggaagacggaacgtggaatggcagtgccccttcttgcatctcaattgagtgcgatctgcccaccgctccggagaatgggttcttacgctttacggaaacatccatggggagcgcagtccagtatagctgcaagccaggtcacattctggccggttctgatctgcgcctgtgcctcgaaaataggaaatggagtggtgcttcccctcgctgtgaggcgatcagctgtaagaagccaaatcctgtgatgaatggttccattaaagggtctaactacacatatctctccacgctgtactatgagtgcgacccagggtatgttttgaacggtaccgagcgaagaacctgtcaggatgacaaaactggaatgagaatgagccctttcgccttcttatggacagctgttcacccacagagtcagccaatggccaggtag

SEQ ID NO: 242924 - DNA, 10647 bp, Artificial Sequence
  Description of Artificial Sequence: Synthetic coding sequence
atgtctccatcaaggaacttttcttttaggctcttccccgagactgcacctggggcacctggctccatccccgctcctcccgcaccgggagacgaggccgctggctctagagttgaaaggctgggccaggcatttcgtagaagggtacgcttattacgggagctgtccgaacggctagagttggtgtttctggttgatgactcctcatctgtgggggaggttaacttcaggagtgagctcatgttcgtgcgcaaactgctgagcgatttcccagtcgtcccaaccgccacccgcgtcgcaatagtcaccttttctagcaaaaattatgtggtgcctagagtcgattacatctcaaccaggagagcacgtcaacacaagtgcgccctactccttcaagagataccggctattagctacaggggaggaggaacgtatacgaagggtgcattccaacaagccgctcaaattctgctgcatgcccgagagaatagcacgaaggttgtatttctgatcacagacgggtattcaaatggtggcgaccctcgtccaatcgccgcaagcctgcgggacagcggcgtcgaaatctttacttttggcatctggcaaggaaacatcagagaattgaacgacatggccagcacccccaaggaagaacattgctacctcttgcattccttcgaggagtttgaggccctggcaaggagggcgctgcacgaggacctgcctagcggatcttttattcaggacgatatggtgcactgtagctatctctgtgatgaagggaaggattgttgcgaccgaatggggtcatgcaagtgcgggacacataccggccatttcgagtgtatatgcgaaaaaggctattatggtaagggtttacagtatgagtgtactgcttgtccaagcgggacctataaaccggaaggatctccagggggaattagcagttgtattccctgtcccgatgagaatcatactagccctcccggatcaaccagcccagaggactgcgtgtgtagggaggggtaccgggctagcggccagacctgcgaacttgtgcattgtcctgcactgaaaccccctgaaaacggatacttcatccagaatacctgtaacaaccatttcaatgccgcttgcggggtgagatgccacccaggcttcgacttggtggggtcaagtattattctgtgtcttccaaacggactttggtcagggagcgagagttattgcagggtacggacatgtccccatctgcgacaacccaagcatgggcatattagctgctcaactcgcgaaatgctgtataagacaacctgtctggtagcctgcgacgaggggtaccgactggaaggaagcgacaagctgacctgccagggaaattctcaatgggacggaccggagcccaggtgtgtcgaacgccactgctctacttttcagatgcccaaggacgtgatcatctcacctcacaactgcgggaaacaacccgcaaaattcggaactatttgctacgtgagctgcaggcagggttttatcttatcaggcgtcaaagaaatgctccgttgcacaacgtctggaaagtggaatgtgggggtgcaggcggcagtttgcaaggatgtggaagccccacagatcaactgccccaaggatatcgaagccaagacgctcgagcagcaggattcagcaaacgttacatggcaaattcctactgctaaagataacagtggggaaaaagtctcagtccatgtccatccagcttttactcccccttacctgttccccatcggggacgtggctatagtctataccgcaacagatctgtcagggaatcaggcaagttgtatctttcacatcaaggtcattgatgcagagccacctgtgattgactggtgtaggtctccccctcccgtgcaggtttccgaaaaagtacacgctgcaagttgggacgaaccacaattcagcgacaacagtggcgcagaattggtgatcactaggtcccacacccaaggtgatcttttcccccagggggagacaatcgtccagtacacagcaacagatccgtcaggtaacaacaggacctgtgacatacacatcgttattaaagggagcccttgtgagatccctttcacacccgttaacggcgactttatatgcacccctgacaacacgggggtcaattgcactctgacctgcctcgaaggctatgactttactgagggctctactgacaagtattattgcgcctacgaggacggggtttggaagccaacatacacaacagagtggccagactgcgctaagaaacgttttgccaaccacggctttaaatctttcgaaatgttctacaaggcagctaggtgcgacgatacagatctaatgaagaaattttcagaagcttttgagaccacactcgggaagatggtcccatccttttgctccgacgccgaggacatcgactgcaggctcgaggagaatctgactaaaaaatattgccttgaatataattatgactacgaaaacggattcgccataggaccaggcggatggggagccgcaaacagactggactatagctatgatgattttttggacactgtccaggaaaccgccacctccatagggaatgccaagagtagccgaatcaagcggagtgcacccctgtccgattacaagattaagctgatcttcaatatcacagcaagtgtgcccctgccggacgagagaaacgacaccctggaatgggagaatcagcagcggctgctacagactttggagaccatcacaaacaaactgaagcgaacacttaacaaggaccctatgtatagctttcaattggcttctgaaatcctcattgccgacagcaattccctggaaacaaagaaggccagccctttttgcaggccagggtcggttctccgtggacgcatgtgcgtaaactgccctttgggaacctactataatctggagcatttcacttgtgaatcatgcagaatcggctcctatcaggacgaagaaggacagttagagtgtaaattgtgcccaagcggcatgtataccgagtatattcactctaggaacattagcgattgtaaggcccagtgtaaacagggcacctattcatattccggcttggaaacatgtgaaagctgtccattaggtacataccagcctaagtttgggagcaggtcttgtctcagctgtccagagaacacctcaacagttaaaagaggcgctgtcaacataagcgcttgcggggtgccatgccccgaaggaaaattcagcagatccgggctgatgccttgtcacccatgcccccgagactattatcagcctaacgcagggaaggcgttttgtttggcgtgccccttttacggcacgactccatttgctggcagccgcagcattacagagtgtagctccttttcatcaacctttagcgcagcagaagagagtgtggtgcccccagcctcgctggggcatattaagaagaggcacgaaatctcatctcaggtcttccacgagtgctttttcaacccctgtcataacagcgggacatgtcagcagcttggcaggggatacgtgtgtctgtgccctctgggctacaccgggcttaagtgcgaaacggacattgacgaatgttcccccttgccttgcttgaataatggtgtttgtaaagatctcgtcggtgaattcatttgcgagtgtccatcggggtataccggacagcgctgtgaggagaacattaatgagtgttcatcctcaccatgcctgaataaaggcatatgcgtcgacggtgtggctggctaccggtgcacttgtgtgaaggggttcgtcggattgcactgcgagactgaggtaaacgagtgtcagagcaacccgtgtcttaacaacgctgtgtgtgaagatcaggtaggcggatttctctgtaaatgtcccccaggattcctggggacgagatgtggaaagaatgtcgacgaatgcctgagccagccgtgtaaaaatggcgctacctgcaaggatggagccaatagcttcaggtgcctgtgcgctgcagggtttactggttctcattgcgagctgaacattaatgagtgccagagtaatccgtgcagaaatcaggccacttgcgtggacgaactgaattcctattcctgcaagtgtcagccgggttttagcggtaagaggtgtgagaccgagcagagcactggcttcaacctcgactttgaggtgtctggaatttacggttatgtcatgctggatgggatgttgcccagcctacacgctctgacctgcacattttggatgaaaagttcagacgacatgaactatggaactcccatcagctacgctgtcgacaatggtagcgataatactctcttgctaaccgactataatggatgggtcctttatgtaaacggtcgcgagaaaattaccaattgcccgagcgtgaacgatggtaggtggcatcatatcgccataacctggacttcagccaatgggatttggaaggtatacattgacggcaagctatcagacggtggggctggtttgtcggtgggactgcctatcccgggaggaggcgcattagtcttagggcaggaacaagataagaaaggagaaggcttctctccagcagaatcctttgttggcagcatctctcaactgaatctctgggattacgtactgtcaccacagcaggtgaaatctcttgcaacctcttgtcctgaggagctgtctaaaggtaacgtcttggcctggccagattttttatctgggattgtgggtaaggtgaaaatagacagtaagagtattttctgttcagattgcccaagactcgggggatccgtgcctcacctaagaacagcctccgaggacctcaaacctggtagtaaggtgaacctgttctgcgatcccggttttcaactggtggggaacccagttcaatactgccttaatcagggccaatggacacagcccctgcctcattgtgagcgaattagttgtggcgtccccccacctctggaaaacgggtttcatagtgccgacgacttttacgccggttcaaccgtgacctaccagtgcaacaatgggtactaccttctgggggactccagaatgttttgcactgataacgggagttggaacggcgttagcccaagctgcctcgacgtagacgagtgcgctgtgggatcagactgtagtgagcatgcaagctgtcttaacgtggatggcagctatatatgctcttgtgtccctccctatacaggagatggtaagaattgtgcagagccaattaagtgcaaagctcccggtaatcccgagaatgggcactcttctggggagatctatacagtcggagccgaagttacctttagctgtcaggaaggataccagcttatgggtgttacaaaaattacatgccttgaaagcggagaatggaatcacctgatcccttattgtaaggcagtcagctgtggtaaacccgctattccagaaaacggttgtattgaggaacttgccttcactttcggtagcaaagtcacctatagatgtaataaggggtatacgctggctggtgataaagagtcttcctgtttggctaatagctcctggtctcacagcccccctgtctgcgaaccggtcaaatgttcatctcccgagaacatcaataatggaaagtacatccttagcggcctaacttacctcagcacagcaagctatagttgtgacaccgggtactccctccagggcccttctattatagagtgtacagcatcaggcatatgggaccgggctccgccagcttgccaccttgttttctgcggtgagccacctgctatcaaggatgccgtgataactggaaacaacttcacttttcgcaacacagtcacttatacatgcaaggaaggttacacactggccggtctcgataccatcgagtgcctcgctgacggtaaatggagtagaagcgaccaacagtgcctggccgtgtcttgtgacgaaccaccaatcgtggatcacgctagtccagagacagcacataggctgtttggggacattgccttttattactgctcggatggctactctctcgctgataattcacagttgctctgcaacgcccagggcaaatgggtacccccagagggtcaagatatgccccgatgcatcgcccatttctgcgaaaagcctccttccgttagttacagcatcctcgaatcagtgtcgaaagctaagttcgctgccggatccgtggtctcatttaaatgtatggaggggttcgtgcttaacacctcagctaagattgaatgcatgcgcggaggccagtggaatccctcgccaatgagcatccagtgcataccagtgagatgtggggagccgccatcaattatgaacggctatgcttccggtagtaactacagctttggcgctatggtcgcatatagttgcaataagggattttatattaagggcgagaagaaaagcacctgtgaagccacaggacagtggtcgtctccaatacccacttgtcatcctgtgagctgcggtgagccacctaaggtggaaaatggcttcctggagcataccaccggaaggatcttcgagtctgaggtacgttatcagtgtaaccccggttataagtcagtgggctcacccgtgtttgtctgtcaggccaatcgccactggcactctgaaagcccactgatgtgtgtgccactggactgtgggaaacctccccctatccagaacggtttcatgaaaggcgaaaactttgaggtggggagcaaagtccagtttttttgtaacgaagggtacgagctggtgggggactctagttggacatgtcaaaaaagcggtaaatggaacaagaaatccaatcctaaatgtatgcccgctaaatgtcctgaacctcccttgctggaaaatcagctcgtgttgaaagagctcacgaccgaagtaggtgtcgtgacattctcctgtaaggaaggacatgtcctacagggtccatccgtgctcaagtgcttgccttcacagcagtggaacgactcctttcctgtgtgcaagatcgtactgtgcacccctcccccactgatttcctttggagtgcccattccctccagcgcacttcactttggaagcacagtgaagtatagttgcgtgggcggattctttctccgagggaacagcacaaccctatgccagcctgacggcacgtggagctctcctctgcccgagtgcgttcctgttgagtgtccacaaccagaggaaattcctaatggtatcatagatgtccaggggctagcttaccttagcacagccctatatacgtgcaagcccggtttcgaactggtaggaaacactactacattgtgcggagaaaatggccactggcttgggggtaagcccacctgtaaggccattgagtgcctgaagcccaaggagattttgaatggaaaattcagctacactgacctgcattacgggcaaaccgttacttactcctgtaaccgcggattccgactggaaggcccttccgctctgacttgtctggagactggtgattgggatgttgatgctccctcatgtaatgcgatccactgcgacagccctcagccaattgaaaacggcttcgtggagggggctgactatagctatggagcaatcattatttactcatgctttccgggattccaggtggccggacacgccatgcaaacatgtgaagagagcggatggtccagtagcataccaacatgcatgccaatcgactgcgggctgccccctcatatcgattttggcgactgtacaaagctgaaagatgatcagggctattttgagcaagaggacgacatgatggaggtgccctatgtcactcctcatccaccgtaccatcttggagctgttgctaaaacgtgggagaatactaaggagtccccagccacccacagctccaatttcttatacggcaccatggtgtcctacacgtgtaaccccggatacgagttgctgggtaatcccgtactgatctgtcaggaggacggcacatggaatggctccgccccttcttgtatttctatcgaatgtgacctgcctactgccccagaaaatggatttctgcgctttacagagacatctatgggaagtgcggttcagtactcatgcaaacctggacatattctcgcaggaagcgatcttcggttatgtctagagaatagaaagtggtccggggcttccccacgctgcgaggctatcagttgtaagaagcccaatcccgtgatgaatgggagcattaaagggagtaactatacctacctatcaactctgtactatgaatgtgaccctggttatgtgttaaacgggacggaaagacggacatgccaagacgacaagaattgggacgaggacgaacccatttgcatccctgtggactgctcaagtccgcctgtgtccgctaacggccaggtgagaggggatgaatacactttccaaaaggagatcgagtacacatgtaacgagggatttctgctcgagggagcgcgtagccgggtgtgtctggccaacggcagctggagtggagccaccccggactgcgtacccgttcggtgtgcaactccacctcaacttgccaacggtgttaccgaaggactggattacggttttatgaaggaggtgacttttcactgtcatgaaggctacattttgcacggggctccaaagctgacatgccagtcagacggaaattgggatgctgaaatacctttgtgtaaacccgtcaattgcgggccaccagaggacctcgcgcacggtttcccaaacgggtttagctttattcatggaggacacatccagtaccagtgctttccaggctataagctccacgggaatagtagcagacggtgcctgtcaaatggctcctggtccggctccagcccttcatgtctcccctgcaggtgtagcacgcccgtgatagagtacggcaccgttaatggcacagattttgactgcggcaaggcagctaggatccaatgctttaaggggtttaagctactaggactgagtgaaatcacttgcgaggcagatggccagtggagcagcggtttcccccactgtgaacacacctcttgtggctcgctgcccatgattcctaacgccttcatctcagagacttcaagctggaaggaaaacgtcattacatatagctgccggtccggctatgtcatccaaggaagttctgaccttatctgtaccgagaagggcgtgtggagtcagccgtacccagtctgtgagcccctttcttgcggaagccccccatccgtggctaatgccgtcgcaacgggggaggcgcatacgtatgaaagcgaagtgaagctacgatgtctggaaggctacaccatggacactgataccgatactttcacttgtcaaaaagacgggaggtggttccctgaacggatttcatgttccccaaagaaatgcccgctaccggaaaacattactcacatcctggtacacggtgacgatttcagcgtgaaccgccaagtctctgttagctgtgcagagggatacactttcgaaggtgtgaatattagcgtttgtcaattggacggaacctgggagcccccattttccgatgagtcttgtagtccagtgtcctgcggtaaaccagagtctcctgagcacggctttgtggttggctccaaatacacctttgaatccacgataatctatcagtgtgagcctggatatgagctagagggcaatcgggaacgggtgtgccaggaaaatcgacagtggtctggtggagtggccatctgtaaagagacaaggtgtgaaacccctcttgaattcctcaatggaaaggccgatattgaaaaccgaacaaccggcccaaacgttgtgtattcttgtaatagggggtattctctggaaggacctagcgaggctcactgcacagagaacgggacctggtctcaccctgtacccctatgtaagccgaacccctgtccggtaccattcgtgatacccgagaatgccctgctgagtgaaaaagagttctacgtggatcagaacgtgtcgataaaatgtcgcgagggattcctgctgcagggtcacggaataattacctgcaaccctgacgaaacgtggacacagacgagcgcaaaatgcgaaaaaataagttgcggcccacccgctcacgtggagaacgcaattgctagaggcgtgcactatcagtatggtgatatgattacctactcttgctatagtggatatatgctggagggcttcctgcggtcggtctgtctggagaatggaacctggacatcacctcccatttgtagggctgtgtgccgctttccttgccaaaatggtggaatttgccagcggcctaacgcatgtagctgtccagaaggctggatgggacgactctgcgaggagcctatctgcatcctcccatgcctgaacggtggcaggtgtgtcgctccgtaccagtgtgactgtcccccaggatggaccgggtctagatgtcataccgccgtatgtcagtcaccctgtctcaacggaggaaagtgtgtgagacctaatcgttgccactgcttatcttcatggactgggcataactgctcccgaaaaaggagaacaggcttttaa

SEQ ID NO: 242925 - DNA, 10716 bp, Artificial Sequence
  Description of Artificial Sequence: Synthetic coding sequence
atgtggccgaggctggctttttgctgctgggggctcgcactagtctcaggctgggcaacctttcaacagatgagcccttcccggaacttttcattcaggttgtttccggaaactgcacccggtgctcccggttcgattcccgcacctcccgctcccggagacgaggctgccggtagcagagtcgaaagacttggtcaagcatttcgtcggcgtgttcggcttctgcgagaactgtccgagcgtttggaacttgtgttcctggtcgatgattcatcttctgtgggtgaagtcaacttccggtccgagcttatgtttgtaaggaaactattaagtgactttccggtggtgccaacagcaacaagagtcgccatagttacttttagcagcaagaattatgtcgtccccagggttgactacataagcaccagacgggctcgccagcacaagtgtgccctcctgttgcaggagattcccgcaatttcctataggggtggtggcacatataccaagggggctttccaacaggctgcacagatattgctccacgctcgagaaaactctaccaaggtggtgtttctgattaccgatgggtacagcaatggtggggaccctaggcccattgcggcatccctgcgtgactcgggagtggaaatctttacttttggaatttggcaggggaacatccgggagctgaatgatatggcaagcacacctaaagaggagcactgttatctgctgcactctttcgaggagttcgaagcattggcacggcgtgcgctgcacgaagaccttccttccgggagtttcattcaggacgacatggttcattgtagctatttatgtgacgaaggcaaggactgttgtgatcgaatggggagctgcaaatgtggtactcacactgggcactttgagtgtatctgcgaaaaggggtactacggaaagggattacagtatgagtgcacagcctgcccatccggcacatacaaaccagaaggttctccaggtggcatcagcagttgcattccttgcccggacgaaaatcatactagccccccaggaagtacttcaccagaagattgtgtttgccgagaagggtatagagcctctggtcaaacatgcgagttggtccactgccccgcactgaagccgcctgaaaatgggtattttattcaaaatacctgtaataatcacttcaatgctgcatgcggggttaggtgtcaccccggtttcgacctcgtgggtagttctatcattctatgcttgcccaatggcctgtggtcaggaagcgagagttactgtagagtgaggacatgccctcacctgaggcaacctaagcacggacatatttcttgctccacaagagagatgttgtacaagactacctgtctcgtcgcctgtgatgagggatatcggttggagggatcagataagttaacctgccagggtaacagccaatgggacggcccagagcccagatgtgtggagcgccattgctctaccttccagatgcccaaagacgtgattattagccctcataactgcgggaagcagcccgctaagttcggtacaatctgctatgtcagttgcaggcagggatttatcctttcaggtgtgaaggagatgttacgatgcaccacatccgggaagtggaacgtgggggttcaagccgctgtgtgcaaggatgtagaagcaccacagatcaattgccccaaggatatagaggcaaagacccttgagcagcaggactccgccaacgtgacatggcagatccccaccgcaaaagacaactctggcgaaaaggtgtccgttcacgtccaccccgcattcacaccgccttatcttttccctattggggatgtcgcaatcgtctataccgccacggatctgagtggaaaccaagcctcgtgtattttccacattaaagtaatagacgccgagcctcctgtgatcgattggtgtaggagtcctccccctgttcaggtaagcgaaaaggtgcatgccgcatcctgggacgagccccagttctccgataatagcggtgccgaactagtcataacgcgctcccatacacagggagatttatttccacagggagagacaatcgtacaatacacagccacagacccaagcggcaacaatcgcacgtgcgatatccacatagtgatcaaaggttccccttgtgaaattcctttcacccctgtaaacggggacttcatatgcacaccagacaacaccggagtgaattgcaccctcacatgcctcgagggatacgacttcacggagggaagcacggataagtactactgcgcctacgaagatggggtgtggaagcccacttatactacggaatggcctgattgtgccaaaaagcggtttgcgaaccacggattcaaaagtttcgaaatgttttataaggcggcaagatgcgacgatactgacctcatgaagaagttctctgaagctttcgagacaaccctcggcaaaatggtcccctccttctgttctgatgccgaagatatagactgtcggctggaagaaaacttgactaaaaaatactgtctggagtacaattatgactacgaaaacgggtttgctattggacctggaggctggggcgcagcaaaccgattggactattcttacgatgactttttagataccgtgcaggagaccgctacctcaatagggaatgccaaatcaagtagaattaaacggagcgccccattatccgactataaaatcaagctcatatttaatattacagctagcgtgcctctacccgatgagaggaatgatacactggagtgggagaatcagcaacgcctgctacaaacactggagaccataaccaacaaactcaagaggacactcaacaaagacccaatgtatagtttccagcttgcttcagagattctcatcgcggactctaactccctagaaactaaaaaagcatcgcccttctgtagacccggatctgtgctgagaggcaggatgtgtgtaaactgccctcttggcacgtactacaatttagagcattttacctgtgaatcctgcagaataggaagttaccaggacgaagaaggacaactggaatgtaagctgtgtccatccggcatgtatactgaatatattcactcaaggaacatctctgattgcaaggcacaatgtaaacagggcacttacagttattccggactggaaacctgcgagagctgtcctttggggacctatcagcctaagttcggatcacgctcctgcttgtcctgccccgaaaacacgagcactgttaagcggggtgccgtaaatattagtgcatgtggtgtgccttgccccgaggggaagttcagcagatccggcctcatgccttgccatccttgccccagagattattaccagcccaatgccggaaaagcattctgtttggcttgccctttctatgggaccacgccatttgctgggtcacggtccattacagagtgctcatcattcagttctacatttagcgctgcggaggagtctgtcgtacccccagccagtctaggccacatcaagaagcgtcacgaaatcagtagccaggtgtttcacgaatgcttcttcaatccctgtcataacagcggaacatgccagcaactgggaagaggttatgtctgtctttgccctttggggtatacaggcctaaagtgcgaaaccgatattgatgagtgttcaccgttgccttgcctgaataacggcgtgtgtaaagatctggtgggggaattcatttgcgaatgccccagcgggtacactggccaaagatgcgaggagaacatcaacgagtgtagctccagtccatgtctgaacaagggtatttgtgttgacggagtagctgggtatcgttgtacctgcgtcaaggggttcgtgggtctgcactgcgaaaccgaggtgaatgagtgtcaaagcaatccttgccttaacaatgccgtgtgcgaggatcaggtgggagggtttctctgcaaatgcccccctggtttcttgggcacacggtgtgggaagaatgtggacgaatgtttgagccagccttgcaaaaatggcgctacctgtaaagacggcgcaaactcttttcgttgtctatgcgctgcgggattcacagggtctcactgtgagcttaacattaacgagtgccagagcaatccctgccggaaccaggctacatgcgtagacgaactaaatagttattcatgtaaatgccagccaggattctccggcaaacggtgtgaaacagaacagtccacgggatttaatctagatttcgaggtcagtgggatctatggttacgtcatgctggatggcatgctgccttcactccatgctctcacgtgtaccttttggatgaaatctagcgacgatatgaactacggtacaccgatctcctacgctgttgataatggttctgataacactctcttgctcacagactacaacggctgggtgctatatgtcaatggaagggagaagatcacaaactgcccctctgtaaacgatgggcgatggcaccacatcgcaatcacctggacatccgctaacggtatctggaaagtgtacattgatgggaagttgagtgacggtggcgctggcttgagcgtcgggcttcctattcctggcggaggagcccttgtattgggccaggagcaggacaagaagggcgaaggattcagccctgcagagtcttttgtaggctccatctcccagttaaacctctgggactacgtcttatcaccacagcaggtgaaatccctggcgacttcttgtccagaggagttgagcaaaggcaacgtgttagcttggccggatttcctgtcaggcatcgtaggaaaggtaaaaattgacagtaagagcattttttgctcagactgccctcgactgggaggaagtgtcccccacttgcgaaccgcctcagaagacttaaaacccggttccaaagttaatttgttctgcgatccaggattccagcttgttggcaaccccgttcagtactgccttaatcagggccaatggactcagccccttccacattgtgaacggatctcctgtggcgtgccacctcccctggagaatggctttcattctgccgacgatttttacgccggatccactgtaacctatcagtgcaacaatggatactatcttctgggtgattctaggatgttttgcacagacaacgggtcttggaacggcgtgtcccccagttgccttgacgtggacgaatgtgctgtcggtagcgactgcagtgagcatgcgtcttgcctgaatgtggatggctcctacatatgcagttgtgtcccaccatatactggcgacggaaagaattgtgccgagccaattaagtgcaaagcacctggaaatcctgagaacggccattcctcgggggagatctatactgtcggagccgaggtgacctttagttgtcaggaagggtatcagttaatgggcgttaccaaaatcacttgcctcgaaagcggggaatggaaccacctgattccttactgtaaggctgtctcttgcgggaaacctgctatcccagagaacggttgcatcgaggagctggcctttactttcggctccaaagtgacttaccgctgtaacaaaggatataccctcgcgggagacaaagaatcctcctgtctggctaattcttcgtggagccattcccctccagtgtgcgagccagtaaagtgttctagtcccgaaaacatcaacaatgggaagtatattctctcgggtctgacatatctttctacggcaagctatagctgcgataccgggtactcgttgcaggggcctagtattattgaatgcacagcaagcggcatctgggatcgggctccaccagcttgccacctggtcttctgcggggagccacccgcaataaaggacgccgtgataacgggcaacaacttcacctttcggaacacagtgacctacacctgtaaagagggctatactttagctggactggataccatcgagtgtctggccgacggtaaatggtcgaggagtgatcagcaatgcctggctgtgagctgtgacgagccaccaatcgtagatcatgcttctccagagacagcgcaccgcctcttcggggacatagctttttactactgttctgacggctacagcctggcagataacagccaactgctgtgcaacgcacaaggcaagtgggtgccccctgagggccaggatatgccacgttgcattgcccacttttgcgaaaaaccaccctctgtgtcctacagcatactggagtccgtgtccaaggctaagttcgccgcaggcagtgtcgtgtcttttaaatgcatggaaggctttgtgttgaacaccagtgcaaagatcgagtgtatgagggggggacaatggaacccctcaccaatgtcgatacagtgcattccggtgaggtgtggcgagcccccatctatcatgaatggctacgccagtggatcaaattactcatttggcgcaatggtggcttatagttgcaataagggcttttacattaaaggagagaagaaaagcacatgtgaagctacgggccagtggagttccccaattccaacctgccaccccgtcagttgcggggaaccgccaaaggtggaaaatggctttctcgagcacaccactggccgaattttcgaaagcgaagtaagatatcagtgcaacccaggttacaagtcagttggtagccccgttttcgtatgtcaggcaaatcggcactggcatagtgaatcccccctgatgtgtgtccctctcgattgcgggaaacccccaccaatccagaacggttttatgaagggagagaactttgaggtggggtccaaggtgcaatttttttgtaacgaaggttatgagttggtcggtgacagctcttggacctgtcagaagtccggtaagtggaacaaaaaatccaatccaaaatgtatgccagctaaatgtccagagcccccactacttgaaaaccaactggttctcaaggaacttaccacggaggttggggtcgtaacattcagctgtaaagaaggacacgtcctccaggggccttccgtgcttaagtgtctgccatctcaacagtggaacgattcatttcccgtttgtaagatcgtcctgtgcacccccccaccattgatcagtttcggagtgcctatccccagctccgctctgcactttggcagcacagtgaaatacagttgtgtcggcggtttcttcctccggggtaattcaacgaccttgtgccagcctgacggtacctggagtagtcccttaccagagtgtgttcctgtcgagtgccctcagccagaggagatccctaacggcatcattgacgtgcaggggcttgcctatctgtcaactgcactttatacatgtaaaccagggttcgaactggtaggcaataccaccacactgtgcggtgagaacgggcactggttagggggtaaaccaacatgcaaggcgatcgagtgtctcaaacctaaggaaatactgaacggcaaattcagttacactgatctacactatggacagaccgtgacctatagctgcaaccggggatttaggctggaggggccaagcgccctgacatgtctggagacaggtgactgggacgttgatgctccaagttgtaatgccattcactgcgattctccgcagccgatcgaaaatggctttgttgagggcgcagattattcctatggcgcaattattatctattcatgttttccgggattccaggtcgccggacacgcaatgcagacctgcgaagaaagcggctggtcgtcttccattcctacgtgcatgcccatagattgcgggcttcctccacacatcgactttggcgactgcactaagctaaaggacgaccagggctattttgagcaggaagatgatatgatggaggttccatacgtgacaccgcaccctccctatcacctgggcgcagttgccaagacatgggaaaataccaaggagtcccctgccacgcattcctcaaactttctgtatgggaccatggtgagctacacctgcaaccccggttatgagctcttagggaatccagttctgatctgtcaggaagatggcacgtggaacggaagcgcgccaagttgcatctctattgagtgcgatctgcctaccgccccagagaatggattcctgcggtttacagaaacatctatgggcagtgccgtccagtacagttgtaagccgggacatatattggccggatcagacctccggctatgcttggagaaccgtaagtggagtggcgctagcccaaggtgcgaggcgatcagctgtaaaaagcctaacccagtcatgaacggcagtattaaaggttccaattacacctacctgtcaaccctgtactatgaatgtgatccaggctacgttctgaatgggaccgaacggcgtacctgtcaggacgacaagaactgggatgaggatgaaccaatttgcatccccgtagactgttcctcacctccagtatctgccaacgggcaggttcggggagatgaatacacgttccagaaagaaatcgagtatacttgcaatgaaggatttctcctcgaaggggctagatctagggtgtgtctggccaacgggtcctggagcggggcaacaccagactgcgttccagtgcgttgtgccacacctccacaattagctaacggcgtgaccgaagggctggattatggttttatgaaggaagtgaccttccactgtcacgagggttacattctccatggtgctcccaaattaacctgccagtccgacggaaattgggacgccgagatccccctctgcaagccggtgaattgtgggccaccagaggacctcgcccacgggtttcccaatgggttctcattcattcatggagggcacatacaatatcagtgctttccaggttataagctgcacggcaattcatctcgtcgttgtctttctaacgggagctggtctggctcgtccccatcttgtctcccttgtagatgttccactcccgttatagaatacgggactgtgaacggtacagattttgattgcgggaaggccgcaagaattcaatgtttcaagggcttcaagttgcttggcctatcggagataacatgtgaagccgacggccagtggtcgtccggatttccacactgcgagcatacaagctgcggaagtctccccatgattccaaacgccttcatcagcgaaacgagcagttggaaggaaaatgtgataacttactcttgcaggagcggatacgttatccagggtagttccgacttaatttgcacggagaagggagtttggtcacagccttaccctgtgtgcgaacctctcagctgtggatctcctccaagcgttgccaatgctgttgctaccggcgaagctcacacatacgagtcagaagtgaagcttaggtgtctcgagggctataccatggatacagacaccgacacctttacttgccagaaggacggacgctggtttcccgagcggatctcctgttcccctaagaagtgccccctgcccgaaaacattacacacatcctggtacatggagacgacttctcagtcaacagacaagtgtccgtcagctgcgcagagggatatacattcgaaggtgtgaatataagtgtgtgccaactggacggtacgtgggaaccccctttcagtgacgaatcttgtagcccagtgagttgtggaaaacccgagagtcctgaacatggattcgttgtaggctccaaatacaccttcgaatcaaccatcatctaccaatgtgagcctggttatgaactggaaggcaatcgcgagagggtctgtcaggagaaccggcagtggagcggaggagtggcgatatgcaaggaaacacgctgtgagacacctttagagttcttgaacgggaaggctgatattgagaacagaactactggccctaacgtggtttatagttgcaatcgcggatacagcttagaggggcctagcgaggcccactgtaccgaaaatggcacctggtcacaccctgtgccactgtgcaagccaaacccctgtccagtcccattcgtcatccctgaaaacgccctgctgtccgagaaagaattttatgtggaccagaatgtctccatcaagtgtagagagggatttctcctgcagggccacggaataatcacttgcaatcccgatgaaacttggacccagaccagtgcaaagtgcgagaagatctcttgcgggcctccagcgcacgtggaaaacgccattgccaggggggttcattaccaatacggggacatgatcacgtactcatgctattcgggctacatgcttgaagggtttttgagaagtgtatgtttagagaacggtacttggacctcccctccgatatgtcgtgcagtctgccggttcccctgtcaaaacggtggcatttgccaacgaccaaacgcgtgtagttgccccgaaggttggatggggagactgtgtgaggagcctatctgtattctcccgtgtctgaacggagggcgatgtgttgccccatatcagtgcgattgtcctccagggtggaccggttctcggtgccacacagccgtctgtcaatctccatgtctgaacggaggcaaatgtgtgcgcccaaaccgctgtcattgtttaagctcctggaccgggcacaactgttcacgtaagcgacgtaccggattctaa

SEQ ID NO: 242926 - DNA, 1356 bp, Artificial Sequence
  Description of Artificial Sequence: Synthetic coding sequence
atggatttcgatgtcgggcgtacaacacacctgagctcaagcccttgcagtgcatctaatggaggggagtcaggccaagtcagcaagcggcgatgtctaattggtgagtctggtcacgacaccccgtggtgttccccaatcaaggttaaatacggagacgtttactgccgagcacctcagggtggttactacaagacagctctcggtaccagatgtgacattcgctgccagaagggttacgagctgcatggcagcagcttgctgatctgccagagcaacaagagatggagcgacaaggtaatatgcaagcaaaaacgatgtcccacactagccatgcccgcaaacggaggattcaaatgcgtggacggcgcttacttcaacagccgctgtgagtactattgcagcccaggatacacattgaaaggtgaaaggacagttacgtgcatggataataaggcctggtctggccgaccagcatcttgtgtggatatggagccgccacggatcaaatgtcctagcgtgaaggagcgcatcgcagagcccaacaaactgacagtgcgcgtgagttgggagactcctgagggccgtgatactgcagacggcatattgacagatgtgattctaaagggcctcccaccgggatctaatttcccggaaggagatcacaagatccagtacacagtgtacgatcgcgctgagaataaaggaacttgtaaatttagggtgaaggtgagagtgaagcgctgcgggaagcttaacgcccctgagaacggttacatgaagtgctcttcggacggcgataattacggagcaacctgtgaattttcatgcatcggcggatatgagttgcagggctcaccagctagggtttgccagtcgaaccttgcttggagtgggacagaaccgacctgcgccgcaatgaatgttaacgttggcgtacgaaccgccgctgccctgctggaccagttttacgaaaagagaagactgctgatcgtgtcaacacctactgcacgcaacttgctgtaccggctgcagctgggcatgttacagcaggcccagtgcggactcgaccttaggcatattactgttgtggagctggttggcgtcttccccaccctcatcggccgtatcggcgctaagatcatgccaccggctctggctttgcagctccgcttgctgctgagaatccccctctactcattcagcatggttctggtcgacaaacatgggatggacaaagagcgatatgtctcactggtgatgccagttgcgctttttaatttaatcgacacctttccactacgcaaggaagagatggtactccaggcagaaatgtcgcagacctgcaacacctag

SEQ ID NO: 242927 - DNA, 1395 bp, Artificial Sequence
  Description of Artificial Sequence: Synthetic coding sequence
atgggatctccagctcataggcccgcactgctgctgctgttacctcctcttttgctgctactgctccttagagtacccccttccaggagttttcctgggtcaggagactctcccctagaagacgatgaggtgggctactcacacccccgttacaaggacacaccctggtgtagtccgataaaagtcaaatatggcgacgtgtactgtagggctccccagggcggttattacaagactgctctgggaacacgatgcgatatcaggtgtcagaagggatatgagctacacggcagtagccttcttatttgtcaaagtaataagagatggagcgataaggtcatatgtaaacagaaaaggtgtcccaccctggcaatgcctgctaatggagggtttaagtgtgtggacggggcatactttaacagtcgctgtgaatactattgtagcccaggttatacgctcaagggtgaacggaccgttacctgtatggataacaaagcctggagtgggaggccagcctcttgcgtcgacatggagcctcctcgaattaaatgtccaagtgtgaaggagagaattgccgagcctaataaattgaccgtccgcgtaagctgggagacacccgaaggaagagataccgctgacggcatcttgaccgatgtaattctgaagggtttacccccaggttccaacttccccgagggcgatcacaaaattcagtatacagtgtatgaccgagcagagaacaaaggcacatgcaaatttagagtgaaggttagggtgaagaggtgcggaaagctgaatgctccggaaaatggctatatgaaatgctcttccgatggggataactacggcgctacctgcgaattctcctgtatcggcggttatgaactgcagggctcccctgctcgcgtgtgtcagagtaacctggcatggagcggtaccgagccaacatgcgcagccatgaacgtgaacgttggtgtccgcaccgctgccgcattattggatcagttctacgagaaacgcagactccttattgtatcaacaccaacggccaggaacctcttatacaggctgcagctgggcatgctgcagcaggcgcaatgcgggctcgatctccgccatatcactgttgtcgagctggtcggcgtgtttcctactctgattggccgaatcggagctaagataatgcctcccgctctcgcactccagcttagactcctgttgagaattcctctgtattccttcagcatggtgctggtggacaagcacggtatggacaaggagcggtacgtgtctctcgtgatgccggtggcactctttaacctaattgacacattcccccttcggaaggaagaaatggtgctccaggctgagatgtcccagacgtgcaacacttag

SEQ ID NO: 242928 - DNA, 1218 bp, Artificial Sequence
  Description of Artificial Sequence: Synthetic coding sequence
atgggaagcccggctcacaggcctgccctcttactcctgctgcccccactgttgcttctgttgctgctgcgagtccccccatcacgctccttcccgggttcgggagattctcctctggaagacgatgaggtgggctactctcacccacgctataaggacactccttggtgctccccaatcaaagtgaaatatggcgacgtgtattgccgtgcccctcagggaggctactataagaccgctctaggaactagatgcgatataagatgtcaaaaagggtacgaattgcacggatcatcgctgttaatctgccagagtaacaagcggtggagcgataaggtaatctgcaaacacatggagcctccccgaatcaagtgccccagcgttaaagagcgcattgctgagcctaataagttaaccgtgagggttagctgggagactcccgaaggacgagataccgccgacgggattctcacagatgtcattctgaagggtctccctccagggtccaattttccggaaggggaccacaaaattcaatataccgtgtacgacagagccgaaaacaaaggaacatgtaagttccgggttaaggtccgagtgaagcgctgcggcaaactgaatgcccctgaaaacggatatatgaaatgctcctccgacggggacaactatggagccacctgtgagttctcttgtatcgggggatatgagctgcaagggtcaccagctcgcgtgtgccagtcaaatctggcttggagtggaacggagccaacttgcgctgccatgaatgtgaacgttggcgtgagaacagctgcagctttactcgatcagttctatgaaaagcggagactgctgatcgtctctacccccacagctcggaacttattgtatcggctacagttgggaatgctgcagcaggcccaatgcggtctggatctgcgtcatatcacggtcgtcgagttagttggcgttttccctacactgattggcaggattggcgcaaagattatgcctcctgcattagcattgcagctgaggctgctgctgcgcattccgctctacagctttagcatggtgctggtggacaagcatggcatggataaggaaagatacgttagcctggttatgcccgttgcccttttcaacctgatagacacatttcctctgagaaaagaggaaatggtgctccaggccgaaatgtctcaaacgtgtaatacttag

SEQ ID NO: 242929 - DNA, 1140 bp, Artificial Sequence
  Description of Artificial Sequence: Synthetic coding sequence
atgggaagccccgctcaccgcccagcactgctcttactgcttcctcccctattgctcctgctcctgctaagggtgcccccatctagatcttttcctgggagcggagactctccacttgaggatgacgaggttgggtactcccaccctcgctataaggacaccccctggtgttctcccatcaaagtcaaatatggggatgtgtattgccgggctcctcagggcggttactacaaaacagccctcggaaccagatgtgacattcggtgccagaaggggtacgaattacatgggagtagcctccttatttgtcagtcaaataagagatggtcggacaaagtgatttgcaaacaaaagcggtgtccgacattagctatgcccgcaaacggcggtttcaagtgcgtggacggtgcctatttcaacagtcgatgtgagtactactgttcccctgggtacacactgaaaggcgaacggacagtcacctgcatggataataaggcctggtccggtcggcctgcctcatgtgtagatatggaacctccccgtataaaatgcccctccgtgaaagagagaattgctgaacccaacaagctaactgtgcgcgtgagctgggaaacccccgagggtcgcgatactgcagatggaattctgactgatgtgattttaaaggggttacctccaggatctaatttcccagagggggaccacaagatccaatacacagtgtatgatagagcagagaacaaggggacatgtaagtttcgggtgaaagtgagagtcaaacgttgtggaaagctcaacgccccagagaacggctacatgaagtgcagttcggatggagataattatggtgctacctgcgaattcagctgtatcggaggctacgagctgcagggtagcccagccagggtatgccagagcaacctggcatggagtggcaccgagcccacatgtgccgcaatgaacgtaaacgtcggtgtgcgcacagccgcagctctgttagatcagttctacgagaagcggcgactcctgattgtgagcacacctaccgccaggaatctgctttataggttgcagctaggtatgcttcaggcagtggcagccaacccaacgctgctgctccagtacggggcaagcggctag

SEQ ID NO: 242930 - DNA, 1335 bp, Artificial Sequence
  Description of Artificial Sequence: Synthetic coding sequence
atgggtagccccgcacacagacctgccctgctgctgcttttaccacccctgttgcttttgctcctcctgcgagtccccccaagtagatcctttcctgatacaccttggtgcagccctattaaggtgaagtacggtgatgtgtactgccgggcaccacagggcggatactacaaaacggcactgggtactcggtgtgatataaggtgccagaagggatacgaactgcatggctcttctctgttaatctgccagtcgaataaaaggtggtccgacaaggtgatatgtaagcagaagcgttgccccacgctggctatgcccgcaaatggcggatttaagtgcgtggatggggcttacttcaactcgaggtgtgagtactattgctccccaggatacaccctgaaaggcgagagaacagtaacctgtatggacaataaggcttggtcaggccgaccggcatcctgtgtcgacatggaaccacccaggattaaatgcccctcagtaaaagaacgcatcgctgagcccaataagttgaccgttcgggtgtcttgggaaacaccagaagggcgtgacaccgccgatggcatcctcacagacgtgattttgaaaggcctgccccctggctcaaactttcccgagggcgatcacaagattcagtataccgtgtacgaccgagctgagaataagggtacctgcaagttcagagttaaagtcagggttaagagatgcggaaaactcaacgcacctgagaacggctatatgaagtgtagctccgacggcgacaactatggagctacctgcgagtttagttgcattggcggatatgaacttcagggaagtcctgctagggtctgtcaaagcaacttagcttggtccggaacagagccaacatgtgcagctatgaatgtcaacgtgggcgtgagaaccgctgcagcgctgctagaccaattctacgagaaaagacggttactgatagtctcaacacccaccgcgaggaacctactgtacaggctacagctgggcatgctccagcaggcccaatgcggcttggatctgcggcacatcaccgtagtggaactcgtcggagttttcccaacgctgatcggacgaatcggcgcaaaaatcatgccacccgctctggccctgcaactccgcctgttgctgcgcatacccctgtatagcttcagtatggttctggttgacaagcacgggatggataaagaacggtacgtttccttggtgatgcccgttgcactttttaacctgatcgacacatttcctctcaggaaagaggaaatggtcctccaggccgagatgagccagacttgcaatacatag

SEQ ID NO: 242931 - DNA, 1398 bp, Artificial Sequence
  Description of Artificial Sequence: Synthetic coding sequence
atggcctcacagctgactcagagaggggcactttttcttctgttcttcctcactccggctgtcaccccaacctggtatgcaggttccggttactaccccgacgaaagttacaatgaagtttatgctgaggaggtcccacaggctcctgctctcgactacagagtgccacgctggtgctatactctcaatattcaggatggtgaagccacgtgctactcgcctaaaggaggaaattaccactcatccctaggaactagatgcgaactgtcctgtgacaggggcttccgattaatcggccgtaggtcagtgcaatgcctgccctccagacgctggtccggtaccgcctactgccggcagatgcgatgccatgcactccctttcatcacatctggaacttatacttgcacaaacggcgtgcttctggatagcagatgtgactactcttgcagctcaggttaccatctcgaaggggaccggtcgcggatctgtatggaggatggaaggtggtcagggggtgaacccgtatgtgtggatatagaccccccaaaaatccggtgcccgcattccagagagaagatggccgagccagaaaagcttaccgcacgtgtttattgggacccacctttggtcaaagattccgctgatggtactatcacaagggtaaccctacggggacctgagcctggtagccattttccggaaggtgagcacgtcatcaggtataccgcgtatgatcgagcctacaaccgagccagttgtaaatttatcgttaaggtgcaagtcagacggtgcccgaccctcaaaccccctcagcacggatatttaacctgtacaagtgccggagacaactacggtgctacctgcgagtatcattgcgatggaggctatgaccgccagggcactccgagccgggtgtgccagtccagcagacagtggagcggtagtcctccgatctgcgcgccaatgaaaattaatgtcaatgttaattcggccgctgggctgctagaccagttttatgagaaacaacggctgctcatcatcagcgctcctgacccttccaatcggtattataagatgcagatcagtatgctgcaacagagtacttgcggtttggacctgcgccacgtcacaatcatcgagctggttggacagccacctcaagaggttggacggatcagggaacagcaattatctgcgaacatcattgaggagctgcggcagttccaaaggctcacacgttcctatttcaatatggtgctaatcgacaaacaggggatcgaccgcgatcggtacatggagccagtcacacccgaagaaatatttacattcatcgatgattacctgctgagcaaccaagagctcactcagagacgcgaacagcgcgatatttgcgagtag

SEQ ID NO: 242932 - DNA, 1452 bp, Artificial Sequence
  Description of Artificial Sequence: Synthetic coding sequence
taaacttttatggtagaagatgcagtcgaggctattggttttggcaagtttcagtggaagctgtccgtcctcacaggtctggcctggatggcggacgcgatggagatgatgatcctctctatactggcacctcaattacattgtgaatggagactccccagctggcaagtcgccctgttaacatccgtggtgttcgttggcatgatgtcatcctccactctttggggcaacatcagcgaccaatacggcaggaaaacgggcctgaagatttcggtactctggactctgtactacggcatactgagtgccttcgcaccagtgtactcttggatactcgttctgcggggacttgtcggcttcggcatcggaggcgtacctcaaagcgtcacactgtacgccgagtttctgccgatgaaggcccgagccaaatgcatcctactgatcgaggttttttgggctattggaactgtgttcgaggtcgtgctcgccgtattcgtgatgccttctctgggatggagatggctgctaatcttatcagctgtgcccttgctcttattcgccgtactgtgtttttggttgcctgagagcgctcggtacgacgtactttccggaaatcaggagaaggccattgctacattgaagcggatagctactgaaaatggcgctccgatgcctttaggaaaactgatcatttccagacaggaagatagaggcaagatgcgggatttgttcaccccacacttcagatggaccacacttctgctgtggttcatttggttcagcaacgccttttcttactacggactggtgttattgacaacagagttattccaggcaggagatgtgtgcggtatctccagtaggaagaaagcagttgaggctaaatgttcactggcctgcgagtacttaagcgaagaggattatatggatctcttgtggaccactttgtccgagtttcccggagtgctggtgactctgtggatcattgacagactgggacggaagaaaacaatggccctgtgtttcgtgatcttttctttttgtagtctcctgcttttcatatgcgtggggaggaacgtactgaccctgctgctgtttatagcacgggcattcattagcggcggattccaggccgcatacgtctacactccagaggtttacccaactgccacacgcgctctgggactgggtacctgcagcgggatggcacgtgtcggggctctcattactcctttcatcgcccaggttatgcttgaaagttctgtttaccttaccttggcagtttattccggatgttgcctgctggcggctctggcctcctgcttcctgcccatcgagaccaagggcagggggctgcaagagagcagtcatagagagtgggggcaggagatggtcggtcgcggaatgcacggagctggggtgacccgcagcaacagcggatcacaggagtag

SEQ ID NO: 242933 - DNA, 39 bp, Artificial Sequence
  Description of Artificial Sequence: Synthetic coding sequence
atggaggaggatctgtttcagcttagacagctcccctag

SEQ ID NO: 242934 - DNA, 1023 bp, Artificial Sequence
  Description of Artificial Sequence: Synthetic coding sequence
atggctgccggtagactgataatcaagacagaatttttgccgactaagtatagagggtatatgttgccgctgagtcaggtcttctggctggccggttccttattgatcataggcctcgccagcgtgataattccaacaattggctggcggtggttaattcgcgtggcctccatcccgggaatcatcttgattgtggccttcaagtttattcccgaaagtgcacgcttcaacgtgtcgacaggtaacactcgggcagccttggccacactagagagggttgccaaaatgaacaggagcgtgatgcccgagggtaagctagtggagccagtgctggaaaagaggggacgctttgccgacctcctggacgcaaagtacttgagaacaactctgcagatctgggtcatatggctgggaatttcttttgcctattacggggtcatcttggcttccgccgagctgcttgaaagggatctggtatgtggcagtaagtcagacagcgctgtagtggtgactggaggggactccggagaatcgcagtcaccgtgctactgtcacatgtttgcccctagtgactacaggacaatgatcatctctaccatcggagagattgcgttgaacccgctgaatatattggggattaacttcctgggacgtcgactgtctctgagcattacaatgggatgtaccgcactgtttttcctccttcttaacatttgcacatcttcagccggactcatcgggttccttttcatgctgcgcgctttggtggcagctaatttcaacacagtttacatctacacagcggaggtctatccaactactatgcgcgcacttggcatggggacatctggatcgctttgtagaatcggcgcaatggtcgcccctttcatctctcaggtgctcatgtccgcatccatcctgggggctttgtgtctcttttcctcggtatgtgtggtgtgtgctatctccgcgttcactctgcctattgagactaaaggtcgcgctcttcagcagatcaagtag

SEQ ID NO: 242935 - DNA, 1479 bp, Artificial Sequence
  Description of Artificial Sequence: Synthetic coding sequence
atggccaccaagcctactgaacctgtgacgatcctttcactcaggaagttaagcctcggcaccgcggagccccaggttaaggagccaaaaaccttcactgtcgaggacgcagtggaaaccataggctttggccgattccatatcgcattatttcttattatgggctccactggcgtggtggaggctatggagataatgttgatcgccgtcgtgtcgccagttatcagatgcgagtggcagctggagaactggcaggtagctttggtcacaactatggtgtttttcggttacatggtgttcagtattcttttcggcctacttgccgatcgctacggaaggtggaaaatcttgctgattagcttcctgtggggagcctacttttctctccttacatcctttgcaccaagttacatctggtttgtctttctgcgaaccatggtcggctgtggcgtgtccggccactctcaggggcttatcatcaagactgaatttctgcctaccaaatatcgcggatatatgctgccgttaagccaggtattttggctcgccggtagtctgttaataatcggtctggcatctgttatcatacctacaattggatggagatggctgatccgtgtcgccagcatccctggaataatcctgatcgtcgccttcaagttcattcctgagagcgcacggttcaatgtttccacagggaacactagggcagcgctggctacattagagagggtggcaaagatgaacagatcagtgatgcccgaggggaagctcgtggagcccgtcctcgagaagaggggacggtttgctgacctcctagacgcaaagtatctgcgaactacactgcaaatttgggtcatttggctcggcatttccttcgcctactacggggtgatcctagcctcagccgagctgcttgaaagggaccttgtgtgcgggagcaaatctgattctgctgttgtcgtcaccggcggtgatagtggcgaatcccaatcgccgtgttactgccatatgtttgcacctagcgactataggactatgatcattagtactattggtgagatcgcactgaatcccttgaacatcctgggaattaactttttgggccgacggctcagtctgagcatcaccatgggatgtaccgctctgttctttttgctgctaaatatctgcacgtccagcgcgggtctgattggattcctctttatgctgcgggctctggttgctgccaatttcaacactgtttacatttatacagccgaggtatatccgactacgatgcgcgctctgggcatgggtaccagtggttctctctgtaggattggggctatggttgctccctttatttcccaggtgcttatgagcgcctcgatcctgggggcactttgtctctttagttccgtgtgcgtggtctgcgccatcagcgcgtttaccctccccattgaaacaaagggcagggcccttcagcagattaagtag

SEQ ID NO: 242936 - DNA, 1023 bp, Artificial Sequence
  Description of Artificial Sequence: Synthetic coding sequence
atggctgccggaagactcatcatcaaaaccgaatttctgcccaccaagtatcggggatacatgctgcccctaagccaagtcttctggttagccggaagcctgctgattattgggttggcaagtgtcataatccccacaatcggctggcgatggttgatcagagtggcctctataccgggaatcattctcattgtcgctttcaagtttatacccgaatctgccagattcaatgtgtctaccggaaatacacgcgctgctctcgctacgctggaacgtgttgcaaaaatgaacagatctgttatgcctgaggggaaacttgtggagcccgtgttggagaagaggggcaggttcgctgatctactggatgccaagtacctgagaaccacgttacagatttgggtgatctggctgggaatttcctttgcctactatggcgttatacttgcctcagccgagctacttgagcgggacctcgtgtgcgggtccaaaagtgactctgccgtggttgtgaccggaggtgactcaggtgaatctcagtccccatgttattgccacatgtttgctccctccgattatcgtactatgattatctctaccataggcgagatagctctgaaccctctaaatattctgggcatcaattttctcggaagacgactgagcctcagcataaccatgggctgtactgcgctgtttttccttctgttgaatatctgtaccagttccgccggtcttatagggttcttgttcatgttgagggcacttgtggccgcaaactttaataccgtatatatctatacagcagaagtttaccccaccacaatgcgcgctcttggcatggggacaagtggaagtctgtgtaggatcggcgctatggtagctccatttatttctcaggtcctgatgtctgcttcaattctgggcgctctgtgtttattttccagcgtatgcgtggtctgcgccatttcagcctttactctgccaatcgagacgaagggaagagcgttgcagcagatcaagtag

SEQ ID NO: 242937 - DNA, 1758 bp, Artificial Sequence
  Description of Artificial Sequence: Synthetic coding sequence
atggggagtctcaaagaggagcttctgaaagccatttggcacgcgttcacagcgctagaccaggatcatagcggcaaggtatcaaagtcccaactgaaggtgctgagtcataacctgtgtaccgtcttaaaagtaccacacgaccctgttgccctagaagaacatttcagagacgatgacgagggcccagtgtctaatcagggctacatgccctatttgaatcgcttcatcctggaaaaagttcaagataacttcgacaagatcgaatttaatcgcatgtgttggacgctgtgcgtgaaaaagaatctcacaaaaaatccattacttattacagaggaggatgcatttaagatctgggtcatcttcaactttctttctgaggataaataccctctcatcatcgtctctgaagagattgagtaccttctaaagaaattgacggaggccatgggcggaggctggcagcaagaacagtttgagcactacaaaataaacttcgacgattcgaagaacgggctcagcgcgtgggagctgatagagctcatcgggaacggacaattcagtaagggcatggatcgccagaccgtatcgatggctatcaacgaggtgtttaacgaactcattctcgacgtcctgaagcagggctacatgatgaagaagggacaccgacgaaaaaattggactgagagatggttcgtactgaaacccaatattatatcctactatgtatctgaagacctcaaggataaaaaaggggatatcctcctggatgaaaattgttgtgttgagagcctccccgataaggatggcaagaagtgtctcttcctggtgaaatgttttgataagaccttcgagatatccgcgagtgataagaagaagaagcaagagtggatccaggccatacactccactatacaccttttaaaactgggctcaccaccaccacacaaggaagcacggcagcggcgtaaggagcttagaaaaaagcagctcgccgagcaggaggagctggagcggcagatgaaggagttacaagcagcgaacgaatccaaacagcaggagctggaagccgtaaggaagaaattagaagaagcggctagccgcgcagccgaggaagaaaagaaacggttacagacccaggtggaactgcaggcgagattcagcactgaactcgagcgggagaaactgatcaggcaacagatggaggaacaggtcgcccagaaatcatccgagctggagcagtaccttcagagggtgcgtgaattggaggacatgtacctaaagctgcaggaggcactggaggatgaacgccaagctcggcaggacgaggaaactgtgcgcaaattacaagccagactgctcgaggaggagagctccaagcgagcagagttagaaaaatggcatctcgaacagcagcaagcgatacaaactacagaagccgagaaacaagagctcgagaaccagcgagtgctcaaggagcaggccctacaagaggctatggagcagctggagcaattagagctggagcggaagcaagcgctggagcagtatgaagaagtaaagaagaaactcgaaatggctaccaacaagacaaagtcatggaaggacaaggttgcccatcacgaagggctgattcgcttgatcgaacccggttccaagaaccctcatctcattacaaattggggtcctgcagctttcaccgaggctgaactcgaggaaagggagaagaactggaaggagaagaaaaccacggagtag

SEQ ID NO: 242938 - DNA, 3129 bp, Artificial Sequence
  Description of Artificial Sequence: Synthetic coding sequence
atggaacaagatactgccgcagtagccgcaactgtggctgccgctgacgccaccgcaaccatcgtggtcatagaagacgaacagccaggccctagtacttctcaggaggagggtgcagccgctgctgctactgaggccaccgcagctactgagaagggggaaaaaaagaaggagaaaaatgtgagtagctttcagcttaaacttgcagccaaggcacctaaatctgagaaggagatggatcccgagtacgaggaaaagatgaaggccgatagagcaaagcggtttgagtttctgttaaagcagactgaactctttgctcatttcattcagcctagcgcacaaaagagccctacatcccctctcaacatgaagctcggccgtcctcgaattaaaaaggacgaaaaacagagtttgatatccgccggtgattacaggcatagacggactgagcaagaggaagacgaggaacttctgtccgagtccagaaagacttctaacgtatgtatcaggtttgaagtcagtccatcctacgtcaagggaggtccactgcgggattaccaaattagaggactgaactggcttattagcctctatgagaacggggtgaacggtatcctggccgacgaaatggggctcggaaagacgcttcagaccattgctttgctcggctatctaaagcattataggaacatccccggaccacacatggttctcgtgccaaaaagtactttgcacaactggatgaacgagttcaaaaggtgggtccccagccttagagtgatttgctttgtgggagacaaggacgccagagctgcctttatcagggacgagatgatgcctggggaatgggacgtctgtgtcactagctacgaaatggtcattaaggaaaagagtgtgtttaagaagttccattggcgatatctggtgatagacgaggcccaccgaataaaaaacgaaaaatcaaaactctctgaaatagtgcgagagttcaagagtacaaaccgccttctgctgactggaacacctctccaaaataatctacacgagctctgggctctgctcaatttcctgcttcctgatgtattcaatagcgccgacgacttcgactcctggtttgacacaaagaattgtttgggggatcagaagctggtcgaaaggctgcacgccgtcctgaagccctttctgcttcggcgtataaaaactgacgtggagaaaagcctgccacctaaaaaggagatcaaaatatacctgggactgagcaaaatgcagcgagagtggtatacaaagattctgatgaaggacattgacgttctgaattcctccggtaaaatggataagatgcggttgctaaatatcttgatgcagcttcggaagtgctgcaatcacccatatctgtttgatggcgcagaacccggacccccttacactacagacgaacatattgtgagtaattcaggaaaaatggtggttctggacaaactgctggccaaactcaaggaacaaggctccagggttctgatattctctcaaatgaccagactgctcgacatccttgaggactattgcatgtggcgcggttatgagtattgtcgcctcgacggacagacacctcatgaggagagggaggaagcgattgaggcctttaatgctcctaactctagtaaatttatattcatgttgagtaccagggctggcggtcttggtataaacctcgcaagcgcagacgttgtgatcctgtatgactcagactggaatcctcaagttgatctgcaggccatggacagagctcacaggatcggccagaagaagcctgtcagggtctttaggttaatcaccgataacaccgtggaggagcgcatagtcgagagagcagagattaaattaaggctggattccattgttattcagcaagggcgactgatcgaccagcagtccaacaagcttgctaaagaggagatgctccagatgatcaggcacggcgctacacacgtgtttgcaagtaaagagagcgaattgaccgatgaagacattaccaccatcctcgagaggggtgaaaagaagactgcagaaatgaatgagcgtctgcagaagatgggagaatcaagcctgaggaactttaggatggatatcgagcagtcactgtataagttcgagggggaagattacagggaaaagcagaaattggggatggtcgagtggatcgagccgcctaagcgcgagcgcaaggctaactatgccgtggacgcctactttagggaggctctgagggtatccgaacctaagattccgaaggctccgaggccaccaaaacaacctaatgtgcaggatttccaattttttcctccgcgactcttcgaattacttgagaaggagattttgtactaccgtaagaccatcggttataaggtgcccaggaaccccgatatccctaacccagctctcgcgcagcgagaggaacagaaaaagatcgacggtgctgaacccctgacccccgaggagacggaggaaaaggagaaactgctgactcagggtttcacaaattggacaaaacgggatttcaaccaatttattaaggctaatgagaagtatggtagggatgatatcgataacatcgccagggaggtcgaagggaaaagccccgaggaggttatggagtatagcgctgttttttgggagaggtgcaacgagttgcaagacatcgagaaaatcatggcccagatcgagcgaggggaggctcgaatccagcgccgaatctctattaagaaagctctggacgcaaaaatagctagatacaaggcgccattccaccagctgcgcatacagtacggaacctccaaaggcaagaactacactgaggaggaagatcggttcttgatttgtatgcttcacaaaatgggctttgaccgagagaatgtgtacgaggaactccgccagtgcgtcaggaacgcccctcagtttcggttcgattggttcatcaaatcgagaacggcaatggagtttcagcggagatgtaacacattgatttctttgatcgagaaagagaacatggagatagaggaacgcgaaagggctgagaaaaaaaaacgggctaccaaaacaccaatggtgaagtttagcgctttttcatag

SEQ ID NO: 242939 - DNA, 3165 bp, Artificial Sequence
  Description of Artificial Sequence: Synthetic coding sequence
atggagcaggacacagcggcagttgcagccactgtggcagctgccgatgcaacagcaaccatcgttgtgatcgaggatgaacagcccggaccctccactagccaggaggaaggcgcagccgctgctgcgacagaggctacagcagcgacggagaagggtgagaaaaaaaaggagaagaacgtctcatcctttcaattaaaactcgctgccaaggctcccaagagcgagaaggagatggaccccgaatacgaggaaaaaatgaaagccgaccgcgctaagcgatttgaattcctgttgaaacaaacagagctcttcgcccacttcattcagcccagtgctcaaaagtctcctaccagccccctgaacatgaagctcgggaggcccagaatcaagaaggacgagaagcagagcctcatcagcgcgggagactacaggcatcgacgcactgagcaagaggaagatgaggagctgctctcggagtcccgcaaaacctccaatgtgtgcataaggttcgaagtgagcccctcctacgtgaagggaggccctctcagagactaccagatcagaggcttaaattggctcatttctctgtacgaaaacggagtgaatgggattctcgccgacgaaatggggctcggcaagacgctccaaacgattgcactgttgggatacctgaagcactatcgcaacataccagggcctcatatggtgctcgtaccgaagtccactctgcacaattggatgaacgaatttaagcgatgggtgccctccctgcgagtgatctgcttcgtcggggacaaggatgctagggcagctttcattcgcgatgaaatgatgccaggtgaatgggatgtatgcgtcacttcctatgaaatggtcattaaagagaaatcggtctttaaaaaattccattggcgctatttggtgattgacgaggcccaccgtattaagaatgagaagagcaagctgagtgagatagtgcgggaattcaaaagcaccaacagattattgttaacaggaacacccttgcagaacaacctccatgagttatgggctttgctaaattttctcttgcctgacgtattcaattctgctgatgattttgacagctggttcgacacgaaaaactgcctgggagaccaaaagttggtcgagaggcttcacgctgtcctaaaacccttcctgctccggagaattaagaccgacgtggagaaatcattacctccaaaaaaggaaatcaaaatctacctcggactgagtaaaatgcaacgggagtggtacacaaaaatcttaatgaaagacatcgatgtcctgaattccagcggaaagatggacaaaatgaggctccttaacatactcatgcagctacgtaagtgctgtaatcacccctacctcttcgatggagccgagcccggtccgccatatactaccgatgagcatatcgtgtctaattctggcaagatggtagtactggacaagctcctggcgaagttgaaagaacaaggcagtcgagtgcttattttctcccagatgacccgattgctcgacatcctagaagattattgtatgtggcggggatacgaatactgtcgtctggacggccaaaccccccatgaggagcgcgaggataaatttttggaagtcgaatttctcggacagcgggaagccattgaggccttcaatgcccctaattcaagcaagtttatcttcatgctgagtactagggccggagggttggggattaatctggcaagcgccgatgtggtgattctctatgatagcgattggaaccctcaggttgatttacaggccatggaccgggctcatcggattggccagaaaaagcccgtccgcgtgtttagactgattaccgataacaccgtggaggaacgcattgttgagcgagctgagattaaactccgccttgactctatcgtgattcagcaggggaggcttattgaccaacagtcaaataaactcgcgaaggaagagatgttacagatgattcgacacggagctacacacgtctttgcatccaaggagtcagaacttaccgacgaggatatcactaccatattggagagaggggagaaaaaaaccgcagaaatgaatgaacggctgcagaagatgggtgaaagctccttgcgaaactttcgaatggacatcgagcagtccctgtataagttcgaaggtgaggactatagggagaagcagaaattggggatggtcgagtggatcgagcctcccaagagggagcggaaagccaattatgcggtggacgcctattttcgcgaagcactgcgcgtgtcagagccgaaaatacctaaggccccaaggcctcccaaacaacccaacgttcaggactttcagtttttcccccctcgcctttttgaactgcttgagaaggaaatcctctactaccgtaaaaccatcggttacaaggtccctaggaacccagatattcccaatcctgccctggctcagagggaggagcagaaaaaaattgacggagcggaaccactaacacccgaagaaaccgaggaaaaagaaaaacttctgactcaaggcttcactaattggaccaaacgggatttcaatcagttcataaaggcgaacgagaaatacggacgggacgatattgataatattgcccgagaggtcgagggtaaatcaccagaagaggtcatggaatattcagccgttttttgggagcgttgcaatgagctgcaggatattgagaaaattatggcccaaatcgagcggggagaggcgcgtattcagagacgaatttcgattaaaaaagctttggacgccaagattgccagatacaaggctcctttccaccagctgaggattcagtatggtacatctaagggcaagaattatactgaggaagaggatagattcctgatatgcatgctgcataagatgggattcgatcgggagaacgtgtatgaagagctgaggcaatgtgtgcgcaacgcccctcaatttaggtttgactggttcatcaagtccaggacagctatggaattccagaggcgctgcaacactttaatttcattaatcgagaaagagaacatggagatcgaagaacgggaacgcgcagaaaaaaaaaagcgcgcaaccaagactccaatggttaagttttctgctttttcttag

SEQ ID NO: 242940 - DNA, 3129 bp, Artificial Sequence
  Description of Artificial Sequence: Synthetic coding sequence
atggagcaggataccgctgcagtagccgctactgtggctgccgctgatgctactgccactattgtggtaattgaggatgaacagccaggaccttctacatcccaggaggagggcgctgccgctgccgctaccgaagcgacagcggctaccgaaaagggagagaaaaaaaaagaaaagaacgtgagcagcttccaactaaaactggccgctaaagctcccaagtccgagaaggaaatggacccggagtacgaggaaaagatgaaggctgacagggcaaaacgatttgaatttctgctgaagcagaccgagctgtttgcccattttatccagccttcagcgcagaagtctcctacgtctccacttaatatgaaactcggcagacctaggataaagaaggatgaaaaacagtctttgatcagcgctggcgactataggcaccgtaggacagaacaggaggaagatgaggagctcttgagcgagtctcgtaagacctctaacgtttgcatccgcttcgaagttagcccctcttatgtgaagggaggaccactgcgcgattaccagatccggggtctaaattggctgatttccttatatgaaaatggggtgaacgggatcctggccgacgaaatgggtctgggtaaaactctccaaactatagctctgctcggctacctgaaacactaccgtaacatccccggaccacacatggtgctggtccccaagtccaccttacataattggatgaacgagtttaaaagatgggtcccatctctccgagtgatatgtttcgttggagataaagacgctcgagcagccttcatcagagacgagatgatgccaggtgaatgggacgtttgtgtgacttcatacgagatggtcatcaaagagaagtctgtatttaagaaatttcattggaggtatcttgtcatagacgaggctcaccgtatcaagaatgaaaagagtaagctgtccgaaatcgtgcgcgaatttaaatccactaaccgtttactgcttaccgggactcccttgcagaacaatctgcacgagctgtgggcactgcttaacttcttgctccccgatgtattcaatagtgctgacgattttgactcctggttcgacactaaaaactgcctgggagaccagaaactggtggaacggctgcacgcggtcctgaaaccgtttctgcttcgccgtatcaagactgacgtcgagaaatccctccccccaaaaaaggagattaagatctatcttggcttgtctaagatgcagcgcgagtggtatacaaaaatcctcatgaaagacattgacgttttgaacagctccggtaaaatggacaaaatgagacttctaaacattctcatgcagctccgtaagtgctgcaaccacccttatctcttcgacggggcagagcctggccctccctacacgacagacgaacacatcgtgtctaattctggaaaaatggtggtgctggacaagctcctggccaaactgaaggaacagggtagtcgcgtactcattttttcacagatgacgcggctcctggatatcctggaagattattgtatgtggagaggttacgagtattgtcgactcgatggccagaccccgcatgaggaaagagaggaagctatcgaggccttcaacgcccctaactcgtctaaatttatcttcatgctttcaacaagagccggaggtctcggcataaacctcgcctctgccgatgttgtgatcctgtatgattctgattggaatccccaggtggacctccaagcgatggatcgggcacacaggataggacagaaaaaaccggtacgcgtcttccggctcattacagataacacagtagaggaacggattgtggaacgagccgaaattaaactccgtttggattcaattgtcatacagcaaggtcggctgatagatcagcagagcaataaattggctaaggaagaaatgctccagatgattcggcatggggctacacacgtgtttgcttcaaaggagagtgagctaaccgacgaggatattaccactattctcgaaagaggagagaaaaaaacagccgagatgaacgagaggctgcaaaagatgggggaaagttcccttcgaaattttaggatggacattgaacagagtctatataaattcgaaggggaagattacagggaaaagcaaaagcttgggatggtggagtggatagaaccacctaagagagagagaaaagccaactacgctgttgacgcctacttccgagaggctcttcgcgtcagcgaacccaagattcctaaagcacctcgtccacctaagcagcccaatgtgcaggattttcaattctttccaccacggttgttcgagctgttggaaaaagagatcttgtactacaggaagacaatcgggtataaggtcccacggaatccagacattcccaatccagccctcgcccagcgagaggaacagaaaaaaattgatggagccgagcctctgaccccagaggaaactgaagaaaaggagaagctgctgacacagggctttaccaattggaccaagagagatttcaatcaatttataaaggccaacgagaagtatggcagggacgacattgataacatagccagagaagtggaaggtaaatcccctgaggaggtgatggagtattcagctgtattttgggagcggtgtaacgagcttcaggacatcgagaaaattatggcacagattgagagaggcgaggcgcgaatccagcggaggatttccattaaaaaggccctcgatgctaagattgcacggtacaaagctccattccaccaactgcgaattcagtacgggacctccaagggcaaaaattacacagaggaagaagatcggtttctgatatgtatgctgcataagatgggcttcgatcgtgagaatgtttacgaagaactacggcaatgcgtccgcaatgccccacagtttagattcgattggttcataaagtcccggactgccatggagtttcaacgcaggtgcaacacactgataagtttgatcgagaaggagaacatggaaatcgaggagcgagaacgcgctgagaagaagaagcgggcaactaagacacccatggtaaagttcagtgccttcagctag

SEQ ID NO: 242941 - DNA, 3018 bp, Artificial Sequence
  Description of Artificial Sequence: Synthetic coding sequence
atggagcaggatacggcagccgtggccgcaacggttgcagctgcggacgctactgccaccattgtggtcattgaagacgagcaacccggtccctccacctcccaggaagagaagaacgtctcgtctttccagcttaagcttgcagccaaagctccgaagagcgagaaggagatggaccctgagtatgaagaaaagatgaaagccgaccgagcaaaaaggttcgaattcttactaaaacagacagagttgttcgcgcatttcatccagccatccgcgcagaaatctcccacaagcccactgaacatgaaactcggaaggccaagaatcaagaaagacgagaagcagtccttgatctccgccggtgattaccgccacaggcggacggagcaagaagaggatgaggaacttttgtctgaaagcagaaagacaagtaatgtgtgcataagatttgaggtttcaccttcctacgtcaagggtggacccctgcgcgattatcagatccgcggactgaattggttgatcagtctttatgagaatggggtaaacgggatcctggctgacgagatgggtctgggcaagactctgcagaccatagcactgctgggctatctcaaacactaccggaacatccctggaccccatatggtgctcgtccccaagagcacactgcataactggatgaatgaatttaaacggtgggtccccagtcttagggtcatctgcttcgtcggagataaggacgcgagggccgcttttattcgcgacgaaatgatgccgggtgaatgggacgtgtgcgtgacttcatatgagatggtgattaaggagaagagcgtatttaagaagtttcattggagatatctagtcattgatgaagctcaccgtatcaagaatgagaagtctaagttgtcagaaattgtgagggagtttaaaagcaccaatcggctattgctgactggcaccccactgcagaacaacctccacgagctgtgggcgctgctaaactttctgttgcctgatgtgttcaattctgccgacgatttcgattcatggttcgacaccaaaaactgtctgggcgaccagaagttagtggaaagattgcacgcagtgttgaagccgttccttcttaggcgtatcaaaactgatgtcgagaagagtcttcccccaaaaaaagagatcaagatctacctgggccttagcaaaatgcagcgtgagtggtataccaaaattctcatgaaggacatcgacgtactcaactcctcagggaagatggacaagatgcggctgttaaacatcctgatgcagctgcggaaatgttgcaaccatccatacctttttgatggcgctgaaccgggacccccatacacaaccgacgagcacattgtctccaactccggtaaaatggtggtgctcgataagcttctggctaaactgaaggagcaggggtcacgcgtcctcatctttagccaaatgaccaggctgctcgatatccttgaagactactgcatgtggagggggtacgagtattgccggctcgacgggcagacgccccatgaagaaagggaggataagttcttggaggtcgagttcctgggtcagcgggaggcaatagaggctttcaacgcccctaatagctcgaaatttattttcatgctctccaccagggccggaggactcggaatcaacctggcatcggctgacgtggtgatcctgtacgatagcgactggaacccgcaggtggatctgcaggccatggacagggcgcaccgcatagggcaaaagaagccggttcgagtgttccgcctgattacagacaacacagtcgaggagcgcatagtggagcgcgctgaaattaaattgcgtctggacagcatcgtaatccagcaggggagattgattgaccagcagtctaacaaacttgccaaagaagaaatgctccagatgatcaggcacggcgcaacacacgtctttgcgagcaaggagtcggagctgacagacgaggacatcacaacgatcctggagaggggtgaaaagaaaacagccgagatgaacgagcgactccaaaaaatgggtgaatctagtctaaggaactttagaatggacatagaacagagtttgtataaattcgaaggtgaagattaccgggagaaacagaaactgggcatggtggagtggatcgaaccgcctaagcgggagagaaaggcaaactacgccgtggatgcatactttcgggaagccttacgggtgtccgagccgaaaatccccaaagccccaagaccgcctaagcagcctaacgtgcaggacttccagttcttcccaccccgattgtttgagctcctcgagaaggagatcttgtattaccgaaagacaattggctacaaggttccgagaaatccggatatacctaacccagcgctcgcacagcgagaagaacagaagaaaattgatggggctgaacccctgacacctgaggagacagaggaaaaagaaaaattactgactcaaggcttcaccaactggacaaagagagactttaaccaatttattaaggcaaatgagaagtacggcagagatgacatagataacatcgcacgtgaggtcgaaggaaagtccccagaagaggttatggagtatagcgctgttttttgggaacggtgcaacgagttgcaagacatcgagaaaattatggcacagatagaacgtggggaagccagaatccagagacgcattagcatcaagaaagcgctcgacgcaaaaatcgcgaggtataaagctccgttccaccagctgcggatccagtacgggacttccaagggcaagaactacaccgaagaggaagatcgattcttgatttgtatgcttcataaaatgggctttgatagggagaacgtatacgaggagctgcgacaatgtgtcagaaacgccccacagttccgctttgactggtttatcaaatcacggaccgccatggagtttcagcgacggtgtaacactctgatttcactgatcgagaaggagtag

SEQ ID NO: 242942 - DNA, 837 bp, Artificial Sequence
  Description of Artificial Sequence: Synthetic coding sequence
atgctgatgaaacggctcgccgcacgatgttttgcaggcctgctgatcctctcacccctcacagtcatcagcgattcaagacctgcggactcaggaaaagcgatagaagacggaaacttagaggagatggaggaggaggtccgtttgaagaaacggaagaggcgccgaaacgttgacaaggacccagcgaaagaagacgtggaaaaggctaaaaaacggagaggcagacctccagccgagaagttgagtccgaacccccctaagctgaccaaacagatgaacgctataatcgacacagtgatcaattacaaagactcaagcggacggcagttgagcgaggtgttcatacaactcccatctcgcaaagaattacccgagtattatgagctcattcgaaaacccgttgacttcaaaaagatcaaggagcggattcgaaatcacaaatatcgtagcctgggagaccttgaaaaggatgtcatgctgttgtgccacaatgcccagaccttcaatctcgaaggctcccaaatctacgaagatagtatcgtgttacagagcgttttcaagagcgcaaggcagaaaatagccaaggaggaggagagcgaggacgaatctaacgaagaagaagaggaagaagacgaggaagagtctgaatcggaggcaaaatccgtcaaagtgaagatcaagcttaacaaaaaggatgataaaggtcgcgacaaagggaaaggtaagaaaagacctaaccggggtaaagcaaaaccagtggtcagtgacttcgactccgacgaggaacaggacgaaagggaacagtctgaggggagcggaaccgatgacgaatag

SEQ ID NO: 242943 - DNA, 711 bp, Artificial Sequence
  Description of Artificial Sequence: Synthetic coding sequence
atggaggaagaggtgcgacttaaaaagaggaaaaggcgaagaaacgtggataaggaccctgccaaggaggacgtggaaaaggctaaaaagagaagaggccgaccacctgctgagaagctgtcacccaaccctcctaaacttactaaacaaatgaacgcgattatcgatacggttatcaactataaggattcttccgggcgacaactctctgaggtttttattcagttgccgtccagaaaggaactgcccgaatattacgagttgatccgcaaaccagtcgattttaagaaaatcaaagaaaggatccggaatcacaagtatcgctccctgggagatttggagaaagatgtgatgctgttgtgtcacaacgcccagactttcaacctggaaggtagtcagatctacgaagactcaattgttttgcagtcagtgttcaaaagcgcaagacagaagattgccaaagaagaggaaagtgaagacgagagcaatgaagaggaggaagaggaagacgaggaggaaagcgaaagtgaggccaaatcagtcaaggttaaaattaaactgaacaagaaggatgataaaggcagggacaagggaaaagggaagaagcggcctaatcgaggtaaggccaagcccgtggtcagcgatttcgattcagatgaggagcaggacgagagggagcaatctgaaggcagcggaacggatgacgagtag

SEQ ID NO: 242944 - DNA, 4773 bp, Artificial Sequence
  Description of Artificial Sequence: Synthetic coding sequence
atgagtacccctaccgacccaggagccatgccccaccccggaccttcccctggacccggtccttcgccaggtccgatcctcggcccttctcctgggccaggtccctctccaggctcagtgcactccatgatggggccatcacccggaccaccttccgtgtcccacccaatgcccacaatgggatcaacagatttcccacaggagggcatgcaccaaatgcacaagccgattgatggtatccacgacaaaggtattgtcgaagatattcattgtggttcaatgaagggtacagggatgagacctccacacccaggtatgggccctccccagtcccctatggatcagcactcccagggctacatgagccctcatccttcacccctgggggcacctgagcatgtcagttcccctatgtccggcggtgggcctacaccaccgcagatgcccccatcacaacccggagcgctgattcccggagatccccaggccatgagtcaaccaaaccgtgggccatcacctttttcccctgtgcagttgcaccagctacgcgcacagattctggcctataaaatgctagctagaggtcagcctctccccgaaacccttcagctcgcggtgcaaggaaagagaacccttcccggactacagcagcagcagcagcagcagcagcagcaacagcaacaacagcaacagcagcagcagcagcagcaacaaccccagcaacagcctcctcagccccaaacacagcaacagcagcagccagccctggtgaactacaaccggccatcaggccctgggcctgagctgagtgggccatctactccccagaagcttcctgtgccagctccaggtgggagacctagccccgcaccacccgctgccgctcagccaccggcagcagctgtacccggtccatcagtgccacagcctgcacctggccagccatccccagtgctgcagctgcagcagaagcagtccagaatctcaccaatccagaagccccagggtctggatccggtggaaatcttgcaggaacgcgagtataggcttcaagcccgtatcgctcacagaatacaggagctggagaatctccccggatctctcccgccagatctgcggactaaagctactgtcgagctgaaagccttgcggctgcttaactttcaacggcagcttagacaggaagtggtagcctgtatgaggcgagacaccaccctggagacagcactgaattccaaagcctacaagaggtcaaagaggcagacacttcgggaagctcgaatgaccgagaagcttgagaagcaacagaagatcgaacaagaacggaaacgacggcagaaacaccaagaatatttaaacagtatcttacaacacgccaaagatttcaaggaatatcatcggtccgttgcaggaaagatacaaaaactcagcaaggccgtggctacttggcacgcaaatactgagcgcgaacaaaaaaaagagactgaacggattgaaaaggagaggatgcggaggctgatggcagaagacgaagaaggttacagaaaactgatcgatcaaaagaaggaccgcagactggcgtacctactacagcagaccgatgagtacgtggctaacttgacaaacctcgtttgggaacataagcaagcgcaggctgccaaagaaaaaaagaagcgtcgccgtaggaaaaagaaagctgaggagaatgccgagggcggagaatcagccctggggcctgatggcgaacctatagacgagtcctctcaaatgtcagacctcccagttaaagtcacacataccgagactggcaaggtactgttcggaccagaggctccgaaggcctcacaactggatgcctggcttgaaatgaatccaggctacgaggtggctcccaggagtgattccgaggagtcagattccgattacgaggaggaggacgaggaggaggaaagtagcagacaggaaactgaagaaaagatcctgctggaccccaactccgaagaggttagtgagaaggatgctaagcagattattgagaccgctaagcaggatgtcgatgatgaatactcaatgcagtactctgccagaggaagtcagagctattacacagtggcccatgccatcagtgaacgggtggagaaacagtcagccctactgatcaacggcaccctgaaacactaccagttgcaaggcctcgagtggatggtgagcttgtacaacaataaccttaacggaatcctcgccgatgaaatgggcctcggcaaaaccattcaaaccatcgccctcattacctatctgatggaacacaaaaggttaaacggtccatatcttattatcgtaccactcagcactttgagcaattggacatacgaatttgataaatgggctcccagcgttgtgaagatcagttataagggcaccccagccatgaggaggtccttggtgccccaactcaggtccggcaaatttaacgtgctcctgacaacgtacgagtacattatcaaagacaagcatatcctggctaagatcaggtggaagtacatgattgttgacgaggggcacagaatgaagaatcatcactgcaagttaacccaggtgctaaatacccattatgtagcgccacgaaggatactcttgacaggtacacctctgcagaataagctgccagagctttgggcccttctcaactttctgctaccaaccattttcaagtcttgcagtacttttgaacagtggttcaacgctccatttgcaatgacaggagagcgggtggacctgaatgaagaggagacgatcctgatcattcgccgtcttcataaggtgctacggccttttctgctgcggagacttaaaaaggaggttgaaagccagctccctgagaaggtcgagtacgtgatcaagtgcgatatgagcgccttacagaaaatactttaccggcacatgcaggcaaaaggaattctgcttacagacggctccgagaaggataaaaaggggaagggcggtgcaaagactctcatgaatacaataatgcagctgaggaaaatctgtaatcatccttacatgtttcagcatatcgaggagtcctttgccgagcatctggggtatagcaatggggtgataaatggcgctgaactgtatagggctagcggaaagtttgaattattggacagaatacttccaaaactgagagctacaaaccacagggtcctgctgttttgtcagatgacatcactgatgacaattatggaagactatttcgctttcagaaactttctctacctgcgcttggacggcacgaccaagagcgaggacagagccgcacttctcaaaaagttcaatgaaccagggtcccagtacttcatattcttgttgagtacgagagcaggcggactcggtctgaatctgcaagcagccgacacagtcgtgatattcgattcagattggaacccccatcaagaccttcaggctcaagacagggcccaccgaattggacagcagaatgaagtgagggtccttcggttatgtacagtgaatagcgtggaagagaagattcttgccgctgcaaaatataaactcaacgtggaccagaaggtcattcaagcaggcatgtttgaccagaagtcctcctcacatgaacgcagggcctttttgcaggcaattctcgagcatgaggaagagaatgaggaggaggacgaagtgcctgatgatgaaaccctcaatcaaatgatagcaaggcgtgaggaggaattcgatttgttcatgcgcatggacatggaccgtcgccgagaggatgcgaggaatcccaagagaaagccacgcctaatggaggaagacgagctgccttcatggatcattaaggatgacgctgaagtggaacggctgacctgcgaggaggaggaagagaagatcttcgggagaggttctaggcagaggcgagacgttgactacagcgatgcacttacagagaaacagtggctgagggccattgaggatggtaatcttgaagagatggaggaagaggtgagattgaagaagagaaagagaaggagaaatgtcgataaggatcctgctaaggaagacgttgaaaaggccaagaagcggaggggcaggccacccgcagagaagctttcacctaacccgcctaaacttaccaaacaaatgaacgctattattgacacagttatcaactataaggataggtgcaatgtggagaaggtgcccagtaattcacagttagaaattgaagggaactcatccggacgacagctgagcgaggtgtttattcagcttcccagccgcaaagagctccctgagtactacgaactgatacggaagcctgtagatttcaaaaaaattaaggaacgtatcaggaatcacaaatacagaagcctgggggacctggagaaggatgtgatgctgttatgccacaacgcccagacattcaatctagaagggagccaaatctacgaggatagcatcgttttacagtcggtgttcaagtctgctcgccagaagatcgccaaggaggaagagtcggaagatgaatcgaatgaggaggaggaagaagaggacgaagaggaatcagaatccgaagctaagtcagttaaggttaagatcaaattgaacaagaaagacgacaagggtagagacaaaggaaaaggcaagaagcgacctaatcggggtaaggccaagcccgttgtaagcgattttgattctgatgaggagcaagatgagcgcgaacagtccgagggctctggcacagatgacgagtag

SEQ ID NO: 242945 - DNA, 4719 bp, Artificial Sequence
  Description of Artificial Sequence: Synthetic coding sequence
atgtcaacaccaacggatcccggtgctatgccccatcccggaccatcccccggaccgggtccatccccagggccaatcctggggccaagccctggaccaggcccttccccgggttccgtgcactccatgatgggcccaagtcccggacccccaagtgtgagtcaccctatgccaacgatgggctctacggatttcccacaggaaggaatgcaccagatgcacaaaccaattgatgggattcatgacaagggtatcgtggaggacattcattgcgggtccatgaagggcacaggcatgcggccaccacaccctggtatgggaccgcctcagagccccatggatcaacactcccaggggtacatgtccccacaccccagcccactcggagctccagagcatgtgtcctctcccatgtcgggcggaggtccaacccccccacaaatgcctccatcccagccaggtgccctcatccccggagatccccaagccatgtcacagcccaataggggaccatctcctttctcccccgtccaactccatcagctgagggcacaaatcctcgcctacaaaatgctggcccgtgggcagccgctccctgagaccctgcagctggccgtccagggaaagcggactttacctggtctgcagcagcagcagcagcagcagcagcagcagcaacaacagcaacagcagcaacagcagcaacaacagcagcctcagcagcagccgcctcagcctcagacccagcagcagcagcagcctgctttggtcaattacaaccgcccatcaggtcccggacctgagttaagcgggccaagcactccacaaaagctgcctgtaccagcccctggcggacggccatctcccgctcccccagccgctgcacagccaccagcagccgcagtgcccggtcccagtgtgccacagccagccccaggccaaccaagccctgtgttacagttgcagcagaaacagtcccgtatctcaccaattcagaaaccccaaggactggaccctgtagaaattcttcaggaacgggaatatcggcttcaggcacgaatcgcgcatcggattcaggaactggaaaacctccctggcagtcttccaccagatctcagaacaaaagcgacagtcgaattaaaggcccttagactgcttaattttcagcgacaactgagacaggaagtggttgcatgcatgcgcagagacactacactcgagacagcactgaacagcaaggcctataaacgaagcaaacgccagacactaagggaagcgcgtatgacagagaaacttgagaagcaacagaaaattgagcaagagcggaaacgacgacagaagcaccaggagtatctcaactcaatactgcagcatgccaaagactttaaagaatatcatcgctctgtggctggcaaaattcagaagctctctaaggccgtagctacatggcacgctaatacggaacgtgagcagaaaaaggagacggaacgcatcgagaaagagcgtatgcggagattgatggctgaagatgaagagggctatagaaagctgatcgatcaaaagaaggaccgcagattagcctacctgttgcaacagacagatgagtacgttgcaaatctgacaaacttggtttgggaacacaaacaggcgcaggccgcaaaggagaagaagaaaagaaggaggagaaaaaagaaagctgaggagaatgctgaaggaggcgagagtgcactgggccctgacggtgagcccattgatgagtcatcccagatgtcggatctccccgtaaaagtgacccacacggaaaccggaaaggtgttatttggtcctgaggcacccaaggcttcacaattagatgcgtggttggaaatgaaccccggatacgaggtcgcccctaggtctgactcagaggagtccgactcagactatgaagaggaggacgaagaggaggaatcctccaggcaggagaccgaggagaagatcctcctagatccaaatagcgaggaggtctccgaaaaggacgcgaagcagattatcgaaacggctaagcaggatgtagacgatgaatactccatgcagtatagcgctcgcggtagtcagagctattacactgtagcacatgccatctccgagagagtcgaaaaacagtccgctctcctgatcaacggcacattaaagcactatcagcttcaggggcttgaatggatggtgagtctttataacaataaccttaacgggattttggccgatgagatgggactcgggaaaacaatacagacaatcgcactaatcacatacctcatggagcataagcgactcaatggcccttacttaattattgttcctctgagtactctctccaattggacctacgaattcgacaaatgggccccttctgtcgtgaagatctcttacaaaggtacaccggcaatgaggcgtagtctcgtgccacagctcagaagtggcaaatttaatgtgctgctgacaacgtacgagtatatcattaaagataaacacattctcgccaagattcggtggaagtacatgatcgttgacgaagggcaccggatgaagaatcaccactgcaaactgactcaggtgcttaacacacactacgtggcgcctcggcgtattctcctgactggcacccccttgcagaataagcttccagaactgtgggcactgcttaatttcctacttcccactatcttcaagagttgctctacattcgagcagtggttcaatgctccatttgctatgacgggtgagcgtgtcgatcttaatgaagaggagaccatccttattattaggagattgcacaaagtgctgcggccattcttactaagaaggctcaagaaagaggtggaatcacagctcccagaaaaggtggagtatgtcataaagtgtgatatgagtgccttgcaaaagatcctctataggcacatgcaggccaaggggattctgctgacggacggatctgagaaggacaaaaagggaaaaggcggagcaaagaccctgatgaacactatcatgcaactgaggaagatttgtaaccacccctatatgttccagcacattgaggagtcttttgcagagcatctgggatactctaacggagttataaacggtgccgaactgtacagggccagtggtaaatttgagctactggaccggattctccccaaattgcgagcaaccaatcaccgggttctcctattctgtcagatgactagcctgatgactatcatggaggactacttcgcattcaggaattttctctacctgcgcttagacggcaccacaaaaagtgaggatcgcgcagccctgctcaaaaaattcaacgagcccggaagccaatacttcatcttcctcctctctacccgggctggtggacttggtctgaacctgcaggccgctgatactgtggttatttttgattctgattggaacccccaccaagatcttcaggcccaagaccgggcacatcgcattggccagcagaacgaggtgagagtcttgcgactctgcactgtgaacagcgtcgaagagaagattcttgcagcggctaaatataagttgaacgtcgatcagaaggtaatccaggctgggatgttcgaccagaagagcagttcccatgagcgccgtgcattcttgcaggctatactcgaacatgaagaagagaacgaggaggaggatgaggtcccagacgacgagacacttaatcagatgattgcccgaagggaagaggaattcgacctctttatgcgcatggatatggaccggagaagagaggacgcaaggaaccccaagaggaaaccaagattgatggaggaggacgagttaccctcctggatcatcaaggacgacgctgaggttgagagactgacctgtgaggaggaggaggagaaaattttcgggagagggtcacgtcagcgacgtgacgtcgattacagcgatgctcttaccgagaaacagtggttgagagctatcgaggatggaaatctggaagagatggaagaggaggtgagactgaaaaaaaggaaacggaggcgcaacgtggacaaggatcccgctaaagaagatgtggaaaaagcaaagaagcgtaggggcagaccacccgcagagaagctgtcccccaacccccctaaactgaccaaacagatgaacgcaataatagacacagttatcaactacaaggattccagtggaaggcagctttctgaggtctttatacagttgccctcacgcaaagaactaccagaatattacgaacttatcaggaaacccgtagatttcaaaaaaatcaaagagagaatcagaaatcataaatataggtctcttggcgatcttgaaaaggatgtgatgctcctgtgtcataatgctcagaccttcaacctagaaggctctcagatctacgaggactctattgtacttcagagtgtctttaaatccgccaggcagaaaattgcaaaggaagaggagtccgaggacgaaagcaacgaagaagaagaggaggaggacgaggaagaaagcgaatctgaggcaaagagcgttaaggtgaaaattaaactgaacaaaaaggacgacaaaggccgtgataagggaaaagggaagaagaggccaaaccggggtaaagcgaagcctgtcgtttctgacttcgactcagatgaagaacaggacgaaagagaacagagcgagggtagcggcacggacgatgaatag

SEQ ID NO: 242946 - DNA, 360 bp, Artificial Sequence
  Description of Artificial Sequence: Synthetic coding sequence
atgttactgtgccataatgcccaaacattcaatctggaaggctcacagatatacgaagattctattgtcctgcagagcgtgtttaaaagtgcaagacagaaaatcgctaaggaagaggaaagtgaggacgaatctaatgaagaggaggaagaggaagatgaagaagaatctgagtctgaggccaaatccgtaaaagtgaagattaaactcaacaaaaaggacgataaaggtcgagataaaggtaagggaaaaaaaagaccaaaccggggaaaggctaaacccgtcgtctccgactttgacagcgacgaggaacaggatgagagggagcagtcagaagggagcggcactgatgatgaatag

SEQ ID NO: 242947 - DNA, 711 bp, Artificial Sequence
  Description of Artificial Sequence: Synthetic coding sequence
atggaagaggaagtgagactgaaaaagaggaagcgcaggcgcaacgtcgacaaggaccctgccaaggaagacgtggagaaggccaagaaaagacgtggcaggccccctgcagagaaactgagccccaatccgcctaaactaaccaagcaaatgaatgctatcatcgacaccgtgataaactataaggactcaagtggaaggcaactctccgaggtcttcattcaactgccctctaggaaggaactacctgaatattatgaactaattcgaaaacctgtcgattttaaaaagattaaagaacggatacgcaaccacaagtatcgtagtctgggcgacttagaaaaagacgttatgctgctgtgccacaacgctcaaacgttcaaccttgagggcagtcagatctacgaggacagtatagtgttgcagtccgttttcaagagcgctcggcagaagatcgctaaagaggaggagtccgaggatgaatcaaatgaagaggaagaggaagaagacgaggaagaaagcgaaagtgaggcgaagtcagtcaaagtcaagatcaagctgaacaagaaagatgacaaaggccgtgataagggcaaaggtaaaaaaagacccaaccggggtaaggcaaaacccgtggttagtgactttgactcagacgaagagcaggatgagagagagcagagcgaaggttccggtactgacgatgagtag

SEQ ID NO: 242948 - DNA, 711 bp, Artificial Sequence
  Description of Artificial Sequence: Synthetic coding sequence
atggaggaggaggtccgcctcaagaagcgaaaaagacgcagaaatgtggataaggaccccgcaaaagaggatgtggaaaaggcaaaaaaaagacggggaaggccccctgcggagaaactgtcacctaatccacccaagctgacaaaacaaatgaatgccataattgataccgtcattaattacaaggattcatccgggcgtcagctcagcgaggtgttcattcaactcccctcacgtaaagagcttcctgaatattatgagctcatcagaaagccagtggacttcaagaagataaaagagcgcatcaggaaccataaataccgcagtctgggggacttggaaaaggacgtgatgctcctttgccacaatgcacaaacattcaacctggaaggctcgcagatttacgaggattcaatcgtgctgcaatccgtctttaagtcagcgaggcaaaaaatcgccaaagaagaggagagcgaagatgagtccaatgaggaagaagaagaagaggatgaggaggagtctgaatcagaggctaagtctgtaaaagtgaagatcaaactgaataagaaggacgacaagggaagagacaaaggaaaaggcaagaaaaggccaaataggggaaaagccaagcccgtggtgagtgactttgacagcgacgaggaacaagatgagcgagagcagtcagagggttcaggaaccgatgatgagtag

SEQ ID NO: 242949 - DNA, 765 bp, Artificial Sequence
  Description of Artificial Sequence: Synthetic coding sequence
atggaggaggaggttcgactcaagaaaaggaagcgacgcaggaatgtcgacaaagaccccgcaaaggaggatgtggagaaggccaaaaagaggcggggacgcccacctgcagaaaagctttcgcctaaccctcctaagctgactaagcaaatgaatgccatcatcgacaccgtgatcaattataaagaccgctgcaatgtagagaaggtccccagtaacagtcaattggagatagagggaaactctagcgggagacagctttccgaagtctttattcaactgccatctagaaaggaactccccgagtactatgaattaatcaggaaaccagtggacttcaagaaaattaaagaacgtatcagaaaccacaagtatcggagtttaggcgacttggaaaaagatgtgatgttgctatgccacaatgcccagacgttcaatttagaaggttcccaaatctacgaagacagcatcgtcctccagagcgtgttcaaatccgctcgtcaaaagatcgccaaggaagaggagagcgaagacgagtctaacgaggaggaagaggaagaggacgaagaggagtccgagtcagaggctaagagcgtcaaagtgaagataaagttgaacaagaaagatgacaaagggagggataaaggaaaggggaaaaagcgcccaaatcggggtaaagccaagccagttgttagcgactttgattctgacgaagagcaggatgagcgcgagcaaagtgagggctctggcacagacgacgagtag

SEQ ID NO: 242950 - DNA, 4719 bp, Artificial Sequence
  Description of Artificial Sequence: Synthetic coding sequence
atgtcaacacctacagatcctggagctatgccccatccgggaccaagtcccggacctggtccgtcccccggtccaatcctgggacctagccccggtcccggtccaagccccggaagtgtgcacagcatgatgggaccctctccaggccctccttccgtgtcacatcccatgcctactatgggatccactgactttccacaggaagggatgcatcagatgcataaacccatcgacggtattcacgataagggaatcgtggaggacatacactgcgggtccatgaagggaacagggatgcggcctcctcaccctggcatggggccacctcagtcaccaatggatcagcactctcagggctacatgtctccacacccctccccactcggtgcacccgagcacgtgtcatcaccaatgagtggcggaggaccgacgccgccacagatgccaccttctcagccaggcgctctgattccgggtgacccccaagctatgtcccagccaaacagaggtccaagtccattcagccctgtgcagctacaccaactgagggcgcaaattctagcctacaagatgctggcacgtgggcagccactccctgagaccctccaattggccgtgcaggggaagcggaccctcccaggcctgcagcagcaacagcagcagcagcagcaacaacagcagcaacagcagcagcagcagcagcagcaacagcagccccagcaacagccccctcagccccagacacagcaacagcaacaaccagcgctggtgaattacaaccgcccttcaggtccaggacccgagctgtcaggcccatccacccctcagaagctgcccgtcccagcacccggaggcagaccttctcctgccccacctgccgcagcacaacctcccgctgccgcagttcccggacccagcgtcccgcaacctgccccagggcaaccctcccctgttctacagcttcagcaaaaacagtcaaggatcagtcccattcaaaagccgcagggtttggatccagtagagatcctgcaagagcgggagtaccgcttacaggcacggattgctcatcggatacaggagctcgaaaatctgccgggtagcctgcctccagacctgcggactaaagccactgtcgagctgaaggcccttaggctgcttaacttccaacgccagctgaggcaggaggttgttgcctgcatgcggagggacacaacgttggagaccgccctcaactcaaaggcctacaagagatccaaacgccagacattgcgagaggcccgaatgacagaaaagctcgaaaagcaacagaaaatagaacaggagaggaaaaggcgccaaaagcaccaggagtacctgaattctatccttcagcatgctaaggattttaaggagtaccatcgtagcgtggctggcaagattcagaaactgtctaaagccgtggcaacatggcacgcaaacaccgagagagagcagaagaaggagactgagcggatcgagaaggagcgaatgcgaaggttaatggctgaggatgaggagggatatcggaagttaatcgaccagaaaaaggacaggcggctcgcctacctgctgcagcagacagatgagtatgtggctaacctgaccaacctcgtgtgggagcataagcaagcccaggctgccaaggaaaaaaaaaagagaaggagaagaaagaaaaaagctgaagagaatgcggagggcggtgaaagcgccttggggcctgacggcgaacctatcgatgagtcctcacaaatgagcgatttaccagtgaaggtaactcacactgagacaggtaaagtgctgttcggacccgaagcaccaaaagccagtcagttggacgcctggttggagatgaatcccggatacgaggttgctccgaggtcagacagcgaagagtccgatagtgattacgaggaggaggacgaggaggaggaatcctcgcgccaagagacagaagagaaaatactgctggaccctaacagtgaggaagtgagcgaaaaggacgctaaacaaatcatcgaaaccgccaagcaggacgtcgatgacgaatacagcatgcaatattccgcccgaggttcccagtcatactataccgtagcccatgccatttcagagcgtgtcgagaaacaatcagctctgctcatcaatggcaccctcaaacactatcagctgcagggtttggaatggatggtgtctctttacaacaacaatctgaacggaatcctagccgatgagatgggactggggaagacgatccaaacaatcgccctgatcacatatctgatggaacacaagagactgaatggaccttatctaattattgtgcctctaagcacactcagcaactggacttacgaatttgacaaatgggcgccatcagttgttaaaatttcttataagggaacccccgctatgcgaagaagcctggtgccacagctgagatctggcaagttcaatgtacttttgacaacatatgagtacatcatcaaggacaagcatattcttgcgaaaatcagatggaagtatatgattgtagatgaagggcatagaatgaagaaccaccactgtaaattaacacaggtactgaacacacactacgtggccccaaggaggatcctgttgaccgggacgcctctgcagaacaaactgccagagttatgggctctcctgaacttcctgctccctacaattttcaagtcctgtagtacatttgagcagtggttcaacgcgccattcgcgatgaccggcgaacgagtcgaccttaacgaagaagagaccatcctgatcatccgcaggctacataaggtgctgcgtccttttctcctgcggcgactaaagaaagaggtcgagtcacaactgcccgagaaagtcgagtacgtaattaagtgcgatatgagcgcactgcagaagatcttatacaggcacatgcaggctaagggaatcctcctgacagacggcagcgaaaaggacaagaaaggcaaagggggagctaaaaccttgatgaatacgatcatgcaactgagaaaaatctgtaatcatccatatatgttccagcatatcgaagaatcctttgccgaacacctcggctactctaacggggtaattaacggtgctgagctgtatagggctagtggaaaattcgagcttctcgacagaattttaccaaagttgagagcaacgaatcacagagtgctgttattctgtcaaatgacatcacttatgactataatggaagattatttcgcctttcggaattttctgtacctccgtctcgacggaactacaaagtcagaggatagagcggcattgttgaagaagtttaatgagccagggagccaatactttatatttctcctttccaccagggccggtggacttgggttgaatctgcaggctgcagacacggtggtcatatttgattctgattggaatccccatcaggatctgcaggcccaggatcgtgcccatcggattgggcagcagaacgaagtgcgggtgctgcgattatgtaccgtgaattccgtggaggaaaagatcctcgccgctgctaaatataagttgaatgtggaccagaaagtgatacaagccggtatgttcgaccagaagtccagtagtcacgaaaggagggcctttttgcaggctatactggagcacgaagaagaaaatgaagaagaagatgaggtgcctgacgacgagacgcttaatcagatgattgcgagaagggaggaggagtttgatttgtttatgcggatggatatggatcggaggcgagaggacgctcggaatcctaaaagaaaacctcgcctcatggaagaggacgagctgccttcctggatcataaaagatgacgccgaggtggagaggttaacttgtgaggaggaggaggagaagattttcggaaggggatcgcggcaaagacgcgatgtggattatagcgatgctttaactgagaaacaatggttgcgggcaattgaagacggcaatctcgaagaaatggaagaggaagtgagactgaagaagcggaagcgtaggagaaacgtggacaaagaccccgctaaggaagacgtggagaaagccaagaagcggaggggacgccctccggctgagaagctgtcccccaatcctccgaagctgaccaagcagatgaatgctatcattgacacagtcattaactataaagactccagcggccgacaactttctgaagtttttattcagctgccgtcccgaaaggaactccctgaatactacgagttaattcggaaaccagtggactttaaaaaaataaaagaaagaatacggaatcacaaatatagaagtctaggagacctggagaaagacgtcatgcttctgtgtcataatgctcagacattcaacctcgaagggtctcaaatatacgaagactccattgtgctccagtctgtcttcaagagtgctcgccagaaaatcgcgaaggaagaggagagcgaggacgaaagtaacgaagaagaggaggaagaggacgaggaggaatctgagtctgaggctaagagcgtaaaagttaaaattaaactgaacaagaaagacgacaaggggagggataaggggaagggcaaaaaacgacctaatcgcggtaaggcaaaacccgtggtatccgattttgactcagacgaagaacaggacgaacgggagcagtccgagggctccgggacagacgatgagtag

SEQ ID NO: 242951 - DNA, 4773 bp, Artificial Sequence
  Description of Artificial Sequence: Synthetic coding sequence
atgtccacaccaacagatcctggcgcaatgccccaccctggtccgtcccctggtcctggacccagccctgggcctatcttgggtccatcccctggcccaggaccttctcccggttcagttcatagtatgatgggacctagcccagggcctcccagcgtgtcacatccgatgccaacaatgggctcaaccgattttcctcaggagggaatgcaccagatgcataagcccatcgacgggatccatgataaaggcatcgtggaggatattcactgtggatcaatgaaaggaactggtatgcggcctccacaccctggcatgggcccaccgcagtctccaatggatcaacacagtcagggatacatgtcccctcacccgtcccccctgggcgctccagaacatgtcagctcacctatgtcaggaggaggtcctacccctccacagatgcctccttcgcagcctggcgctcttattccaggcgatcctcaggccatgtctcagccaaatcggggaccttcccctttttctcccgtccagttgcaccaactcagggctcagattcttgcatacaaaatgctagccaggggacaacccttgcccgagacgttgcagttggccgtgcaaggtaagcggacacttcccggtcttcaacaacaacagcagcagcagcagcagcagcagcagcaacaacagcaacaacagcagcaacagcagcagccccagcaacagccgccacagcctcagacccaacagcagcagcaacctgcactggtgaactacaacagaccatccggtccaggacctgagctgtcggggccttctacccctcagaagctaccagtgccagctcccggtggccgtccgtcacccgcacccccagcggcagcacagccgccagctgctgccgtcccaggcccatctgtcccccagccggcacccggacagccctccccggtactccagctgcaacagaagcagagtagaattagtcccatccagaagccacagggactggatcccgtagagatcttgcaagaaagagaatacaggctgcaggccagaatagcgcatcgcatacaggaactcgagaatctgccgggatctctgccaccggacctacgcaccaaagctactgtcgagctgaaggccctgaggctcttgaactttcaaagacagttgcgtcaggaggtagtggcctgcatgagacgcgatactacgctggaaaccgcgcttaactctaaagcctacaagaggtcaaaacggcagacgttgagggaagcccgaatgaccgagaagctggaaaagcagcagaagattgagcaggagcgtaagcggaggcaaaagcatcaggagtacttaaatagtatcttgcagcatgccaaggactttaaggaatatcaccgtagcgtggcaggtaaaatccagaaactgtccaaggccgtcgcgacatggcatgcgaatacagaacgggagcagaaaaaagaaacggaacgcattgaaaaggagcgcatgcgcagactgatggccgaagatgaggaggggtatcggaagctgatagaccaaaaaaaggaccggagactggcatatcttctgcagcaaaccgacgagtacgtagctaacctgactaatctcgtctgggaacacaaacaagcccaagcggctaaggagaagaaaaaacgcagacgtagaaaaaagaaagctgaggagaatgccgagggtggcgaatctgctctcggccctgacggcgaaccgatcgatgaatcaagtcagatgtcagatctgcccgtgaaagtgactcacacagagaccggaaaagtcctctttggacctgaagccccaaaagcaagccaacttgacgcatggctggaaatgaacccaggttacgaggtggcgcctcggagtgacagcgaagaatcagatagtgactacgaagaagaagatgaggaagaagaaagctcaagacaagagacagaagagaaaatactgctcgaccctaattccgaagaagtgagcgaaaaagacgccaagcagatcattgaaaccgccaagcaggatgtggatgatgagtactctatgcaatatagtgctcgaggaagtcagagctactacacagtagcccatgcgattagcgagagagtcgaaaaacagtcagcactgctcataaatggcacgcttaagcattatcagctgcagggtctggagtggatggttagtctgtacaacaacaatcttaatggtatcctagccgacgaaatggggttagggaagaccattcagactattgccctgattacctatctgatggagcataaaagattaaatggcccttacctcatcattgtgcccctgtccactctcagcaactggacatacgagttcgataaatgggctccctccgtggtcaagatcagttataaaggtaccccagcaatgagaaggagtttagtgccgcagctcagatcagggaaatttaatgtccttttaactacctacgagtacattatcaaagataagcacatactggcaaaaatacgctggaaatacatgattgtggatgaaggccacagaatgaagaatcaccattgtaaactcactcaagtgctcaacacccactacgttgcccctaggagaattttgttgactggcacgccactgcagaataaacttcccgagctgtgggcactactgaactttctcctgcccacaatcttcaagtcttgtagtaccttcgagcaatggtttaacgccccttttgctatgaccggagagagggtggacctgaacgaggaggaaactatactgataatccgcaggctgcacaaagtccttcgaccttttctcttaagacgtctcaagaaagaagttgagtcacagctcccagaaaaagtggaatacgtcattaagtgtgacatgtccgcactccagaagatcctgtaccgccatatgcaggcgaaggggattcttttgacagacggttccgagaaggataagaaggggaagggtggcgcaaaaacccttatgaacactatcatgcaactacgcaagatctgtaatcacccttacatgttccagcacatcgaggaatcttttgccgaacatctcggctacagtaatggcgtcatcaacggcgctgagctctaccgggcatctggaaagttcgagctgctggatcgaattttgccaaagctgagggcgacaaatcaccgggtgctcctgttctgccagatgaccagtctgatgaccattatggaggattatttcgcctttcgcaatttcctgtacttgcgcctcgacgggaccactaaatctgaagacagggctgctttactgaagaagtttaacgaacctggctcccaatacttcattttcctgctcagcacccgggctgggggactgggtttgaacctgcaggctgccgacactgtggtgatatttgatagcgattggaatcctcaccaggacctgcaggcacaggacagagcacaccggatcggtcaacagaatgaagtgcgggttctccgcctgtgtacagtaaattcagtagaagagaagattctcgcagctgccaaatacaaattgaacgtggaccagaaggtgatccaagccggaatgtttgaccagaagtcttcatcgcacgagcggagggcattcctgcaagctatactcgaacatgaggaggaaaatgaggaggaggatgaggtaccggacgatgaaactttaaatcaaatgattgcccgacgggaggaggagttcgatctcttcatgagaatggatatggacagaagaagagaagatgccagaaatcctaagcgtaaaccccgtctcatggaggaggatgagctcccgagctggatcattaaagatgatgccgaggtagagagactgacttgcgaagaggaagaggagaaaattttcggtcgtggcagtaggcaacgcagggatgtggactattctgacgcacttaccgagaagcagtggcttagggctatcgaggacggcaacttggaggaaatggaagaggaagtccgcctcaaaaagcggaagcgaagaaggaatgtggacaaggaccccgcaaaggaggacgtcgagaaagctaagaaaagacgtggcaggccccctgcagagaagcttagccctaatcctcccaaactaaccaaacagatgaatgcgatcattgacacggtaatcaattacaaggacaggtgcaacgtggagaaagtgccaagtaacagccaactggagattgaaggaaatagcagtggccgtcagttgagtgaggtgtttatccagctgccttctcgcaaggagctgcccgagtactacgagttaatccgaaagcccgtggatttcaagaagatcaaagaaagaatccggaaccataaataccggtccctgggtgacttggagaaggacgtgatgcttctttgccataatgcgcagacatttaacttagaggggagccagatttatgaggatagtatcgtccttcagagcgtttttaaaagtgccagacagaagatcgcaaaggaagaggaaagcgaggacgaatccaacgaggaggaggaagaggaagatgaagaagagtctgagtctgaagcaaagtctgtgaaggttaaaatcaagctcaataagaaagacgataaggggcgagacaaaggaaagggaaagaaaagacctaaccggggtaaggccaagcccgtagtttctgattttgattctgatgaggaacaggatgaacgggagcagtcagaagggagcgggaccgacgacgagtag

SEQ ID NO: 242952 - DNA, 534 bp, Artificial Sequence
  Description of Artificial Sequence: Synthetic coding sequence
atggaggaagaggtacgcctcaagaagcgaaaaagacgcaggaacgtcgacaaggacccagccaaggaggacgtagaaaaagccaagaagcgccgaggcaggcctcctgcagaaaagctgagtccgaatccaccgaaactcactaaacagatgaatgctattatcgataccgtgatcaactacaaggatagctccgggaggcagctgagcgaagtttttattcagctgccttcccgtaaagaacttcccgagtattacgagttgatcaggaagcccgtggatttcaaaaagatcaaagagaggatcagaaatcacaagtatcgcagtcttggcgatctcgagaaagacgtgatgttattgtgccataatgctcaaactttcaacctagaggggagtcagatttacgaagatagcattgttctccagtccgtcttcaagagcgcacgacagaaaatagccaaggaggaagagtctgaagatgagagtaatgaggaagaggaggaggaggatgaggaggagagtgaatctgagtag

SEQ ID NO: 242953 - DNA, 816 bp, Artificial Sequence
  Description of Artificial Sequence: Synthetic coding sequence
atgaagcggttggcagcccgttgctttgctggcctgctaattctgagcccattgactgtgatttctgactctcggcctgcagactcaggcaaggccatcgaggacgggaaccttgaagagatggaggaagaggtgcgtctcaagaagaggaagaggcgtcgtaatgtggacaaggacccagcaaaggaggatgtcgaaaaagctaagaaacgccgtggacgaccccctgccgagaagctcagtcctaaccccccaaaacttactaagcagatgaatgcgataatagacactgtgattaattataaagattcgtccggacgccagttatctgaggtgttcattcaacttcccagcaggaaggaactccccgagtattatgaacttattaggaagcctgttgattttaaaaagatcaaggagcggataagaaatcataaataccgaagtctgggagaccttgaaaaggatgttatgttgctgtgtcacaatgcacagaccttcaacctggaaggatcccaaatctacgaggattcaattgttctgcagtccgtatttaagagcgcgcgtcaaaagatcgcgaaggaggaggagtccgaggacgaatccaatgaagaggaagaggaggaagacgaagaggaatctgagtctgaggccaagagcgttaaggtgaaaatcaagctcaacaaaaaggatgacaagggtagggacaagggcaagggcaaaaagcgtccaaatcgcggaaaagcaaagcccgtcgttagcgacttcgattctgacgaagaacaggacgaacgcgtgagcgtggctgactggtag

SEQ ID NO: 242954 - DNA, 462 bp, Artificial Sequence
  Description of Artificial Sequence: Synthetic coding sequence
atgaagaggctggccgcaagatgctttgccggtctgctaatcctcagtcccctgacagtgatcagcgatagccgcccagcagactcagggaaggccattgaggatggcaatttggaagagatggaggaggaagtccggttgaaaaagaggaaaagacggcgtaatgttgacaaggatcctgcgaaggaagacgtggagaaggcaaagaagcggaggggcaggcctcctgcagagaagctctccccaaatccgcctaagctcacaaagcagatgaatgctatcatcgacaccgtgataaactataaggactcttccggtcgccagctgtctgaggtcttcatccagctaccgtctcggaaagagctgcccgaatattatgagctcatccgtaagcccgtcgattttaagaaaataaaggagaggatcagaaatcacaaataccgcagcttgggagacttgtag

SEQ ID NO: 242955 - DNA, 468 bp, Artificial Sequence
  Description of Artificial Sequence: Synthetic coding sequence
atgtccacccccacagaccctggagccatgccccatcctgggccttctcctggtccaggcccatcccccggtcccatcctgggccctagcccaggacccggaccctcgccaggcagcgttcacagcatgatggggccatcacctggacccccttcagtcagtcatcccatgcctaccatgggtagcaccgacttcccccaggagggtatgcatcagatgcacaagccgatcgatgggattcacgacaagggtatcgtagaggacattcattgcggtagcatgaagggcaccggcatgagaccccctcacccaggtatgggcccacctcagtcccctatggaccagcacagtcaggggtacatgagccctcacccgtccccgctgggagcgcctgaacatgtcagctcacccatgtcgggcggagggcctacacctccccaaatgcccccatcccaaccgggagcatag

SEQ ID NO: 242956 - DNA, 1680 bp, Artificial Sequence
  Description of Artificial Sequence: Synthetic coding sequence
atgagcacaccaacggacccaggggctatgccacacccgggaccaagccctgggcctggtccctccccagggccaatcttaggtccctctccaggccctggcccttctcctggctccgtacactcaatgatggggccttctcctggtccgcctagcgtctcacaccccatgcccactatgggcagtacagactttccacaggaggggatgcaccagatgcacaagccaattgatggcatccatgataaaggtatcgtggaggacatccattgcggaagcatgaaaggcaccggcatgaggccgcctcacccagggatgggcccaccacagagcccaatggaccagcatagtcagggctacatgtcaccacatccaagcccactgggggcaccggaacacgtttcctcgccgatgagtgggggtgggcctacccctccgcagatgccccctagccagccaggagcgctcatcccgggtgaccctcaagccatgtctcaacccaatagaggcccatctcccttttcccccgtacaactgcaccagttgagggcacagatattagcctacaaaatgctggccaggggccagccgctgcccgaaaccttgcaactagcagtgcaagggaagagaactcttcctggactacagcagcaacagcagcagcagcaacaacagcaacagcagcagcagcagcagcagcaacagcaacagcaaccacagcagcagccccctcagcctcagacccaacaacagcagcagcctgccctagtcaattataaccggccttctggtcctggcccagaactgagcggtccttctaccccacagaagttgcccgtgcccgctcctggcggaaggccatctcccgctccgcctgctgcagcacagccacctgcagccgctgtccctgggcctagcgttccccagccagctcctggacagccaagccccgttctgcagctgcaacagaagcagtcaaggatcagtcctatccagaagccccagggtctcgaccccgtcgaaatattgcaggagcgggaataccggttacaggcgcgtatagcacatcgcattcaggagcttgaaaatctccctggcagcttgcctcccgacctgaggactaaagcgactgtggagctcaaggcgctgcgcctacttaacttccagcggcagcttagacaggaagtggttgcgtgcatgcgacgagacactaccctggagaccgccctcaattcaaaggcatataagcgttctaaacgccagactctgagagaggccagaatgacagaaaaactggagaaacaacaaaaaatagagcaagagcggaagaggagacaaaaacatcaggagtacctgaattccattctgcagcatgctaaagacttcaaggaataccatcggagcgttgccggtaagattcaaaagctgtcaaaggccgtcgcaacctggcacgccaataccgagcgggaacagaagaaggagacagagcgtattgagaaagagcgaatgagacggctaatggcggaggacgaagaaggatacagaaagctcattgaccagaagaaggatcgccgtttagcatacctactacagcagacagacgagtacgtggcaaatctgaccaacctggtatgggaacacaagcaggcccaggctgccaaggaaaagaaaaaacgctag

SEQ ID NO: 242957 - DNA, 516 bp, Artificial Sequence
  Description of Artificial Sequence: Synthetic coding sequence
atggaggaagaggtcagattaaagaaaagaaaacgccgaaggaacgtcgacaaggatcccgctaaagaagatgtggagaaagctaaaaagcgccgaggtagacccccagccgagaaactgtcgcccaaccccccaaagcttactaaacagatgaatgctatcattgatactgtgatcaactacaaggacagatgtaacgtcgaaaaggtgcctagtaattcccaactcgagattgagggtaacagcagtggaaggcagctttccgaggtatttattcagttgccatctaggaaagagctccccgaatactacgaactgatccgaaagcccgtggatttcaagaaaatcaaagagagaataagaaaccataagtatcgcagcctgggggatcttgaaaaagacgtcatgctgctgtgtcataacgcacagactttcaacctcgaggggagccagatctacgaggacagcatcgtactgcagtcggtgttcaaatctgctcggcaaaaaattgcctag

SEQ ID NO: 242958 - DNA, 201 bp, Artificial Sequence
  Description of Artificial Sequence: Synthetic coding sequence
atgtcaacccccacagaccctggtgccatgcctcacccaggtccaagccctggcccagggccaagtccgggtcccatcctgggtccatccccagggcctgggccatctcccggtagcgttcatagtatgatgggaccctctcccggtcctccatccgtttcgcacccaatgccgacaatggggtccaccgatttcccctag

SEQ ID NO: 242959 - DNA, 4944 bp, Artificial Sequence
  Description of Artificial Sequence: Synthetic coding sequence
atgtccacacctgatcctccactaggaggtaccccaagaccagggccatcaccaggccctgggcctagcccaggcgctatgctcggaccgtcgcccggaccttccccaggttccgcccatagcatgatggggccatcaccagggccacccagcgcaggacacccaatccctacccaggggcctggaggttatccccaagataatatgcatcagatgcacaaacccatggaaagcatgcatgaaaaaggcatgtccgatgaccccaggtataatcaaatgaaaggtatgggcatgaggagcggaggacacgccggaatgggtcccccaccctccccgatggaccagcactctcaggggtacccatcacccctgggcggaagtgaacatgcttcaagtcccgtgccggcatccggcccaagttcggggccacaaatgagctcaggacctggaggcgcacccctggacggagctgatccccaggcgttgggtcagcaaaacagagggccaacccctttcaatcagaatcagttacatcagcttagggcccagatcatggcttataagatgctggctagaggccagcccctgcccgatcacttgcagatggctgttcagggaaagcggcctatgcctggtatgcaacagcagatgcctactctgcctccgcctagtgtcagcgccacaggtccgggaccgggacccggtcctgggcctgggcctggccctggcccagccccaccaaattattcacgcccacatgggatgggaggccctaacatgccgccacccggtccatccggagtgcccccagggatgcccggacaaccaccgggagggccacctaaaccctggccagaaggtcctatggctaacgcggcagctcccacttctactccacagaagctcattcctccccagccaacaggcaggccatcgcctgcgccaccagccgtcccacctgctgcttctcccgtcatgccaccgcagacccaatccccaggacaacctgcacagcctgctcctatggtcccacttcatcagaagcagtcaaggattacacccattcagaaacctcgcggactcgaccctgtagagattctgcaagaacgggagtatagactccaggcacgaatcgcacacaggattcaggagctcgaaaacctcccaggttcactggccggagacttgcggactaaagccactatagagctgaaggccctgcggcttttaaatttccagagacaattgagacaagaggttgtcgtgtgcatgcggcgtgacacggcattggaaactgcactgaatgctaaggcgtacaaaaggagtaaacgtcagtcccttcgcgaagctaggatcactgaaaaactagagaagcagcagaaaatcgaacaggagcgtaagcgaaggcaaaaacaccaggagtacctcaactctatattgcagcacgccaaagattttaaggaataccatcgcagtgtaaccggtaaaatacaaaaattgaccaaggcagtggctacttaccacgctaacactgaaagggagcagaaaaaggaaaatgaaagaattgaaaaggaaaggatgcgacggctgatggcagaggatgaagagggatatcggaaattaatcgatcagaagaaggacaagcgtctcgcttatctcttacagcagaccgatgaatatgtggccaatctgactgagctggtccgacaacacaaggcagctcaagttgccaaagaaaagaaaaagaaaaaaaaaaagaaaaaggcagagaacgctgagggccagacacccgctatcggaccagatggggaaccgctcgacgagactagccagatgagtgatcttcccgtaaaggtcattcatgtggaaagtggcaagattctcaccggtacagatgcaccaaaggcagggcaactggaggcgtggttggagatgaatcccggttatgaggtggccccacgatctgacagtgaagaatccgggtctgaggaagaagaggaggaggaagaagaagaacaaccccaggccgcacagcctcctaccttgcctgtggaggagaagaaaaagatacccgaccctgatagcgatgacgtgtcggaagtggacgccaggcacattatcgaaaacgccaagcaagatgtggatgatgagtacggagtctcgcaggcattggcaaggggtttgcagtcatactacgccgtggcccacgccgtgactgagcgggtggataagcaatccgccctgatggtaaatggcgtactgaaacagtaccagataaaaggactggaatggctcgtttccctatataacaacaatctcaatgggattctcgctgacgagatgggcctggggaagactatccagacaattgcacttataacctatctaatggagcacaaacggattaacggccctttcctaatcatcgtgccactgtcgacactgagcaattgggcctacgagtttgacaaatgggcgccttctgtggtgaaggtgtcttataagggcagtcctgcagcccgaagggcattcgtccctcagttgcggtccggcaaattcaacgtcttactgaccacctacgaatacattatcaaggataagcatattctcgccaaaattaggtggaagtacatgatcgtggacgaggggcacagaatgaaaaatcaccattgcaaactgacacaggtgcttaacacccactacgtcgcgcctagacggctgctactgacaggcacacctttacagaacaaactgccagaactatgggctttgctcaacttcttactgcctaccatctttaaatcatgcagcactttcgaacagtggttcaatgccccattcgccatgacaggggagaaggtggacctaaatgaggaagagactatcctgataattcgccgactccataaggtgcttcggccttttctgttgcgacgcctcaaaaaggaggttgaggcccagctgcctgagaaggtggaatatgtgattaaatgcgatatgtctgcactccagcgcgtcttgtacaggcatatgcaggccaagggcgtactacttaccgacggttctgaaaaggacaagaagggaaagggcggaacaaagaccctaatgaacaccatcatgcaactgaggaagatttgcaaccatccctatatgtttcaacacattgaggaaagtttctcagagcatctgggctttactggcggtatcgtgcaagggttggatctgtacagggctagcggtaaattcgagctgctcgaccggattctgcctaagctgcgagccaccaaccataaggttttgctgttttgccagatgactagcctcatgaccatcatggaggattacttcgcctatcgaggatttaaatatttacgtctggacggcaccaccaaggcggaggacagggggatgttgctgaagactttcaatgaacccggatcagagtacttcatcttcttactgagcactcgagccggtggattaggccttaatttgcaatctgctgatactgtaattatctttgatagcgattggaatccccaccaagaccttcaagctcaagatcgcgctcaccgcatcgggcagcagaacgaagtcagagtacttcgactgtgcacagtcaacagcgtagaagagaagatcctcgccgcagctaaatataaactcaacgtggatcaaaaagtcatccaagcaggcatgttcgatcagaagtcgtcgtctcatgagcggcgtgcctttctgcaggcaatcctagaacatgaagagcaagatgaatcacggcactgctccactggatcaggcagtgccagcttcgctcacacagccccaccaccagcgggtgtgaatcccgacctcgaggagcctccgctgaaggaggaggatgaggtgcccgacgatgagacggtgaatcaaatgattgcaaggcacgaggaagagttcgatctgttcatgcgtatggacctcgacaggaggcgagaggaggctcgcaaccctaaacgcaaacctcggcttatggaggaggacgaattaccttcatggattattaaagacgacgcagaagtggaacggttaacttgtgaggaggaggaagagaagatgtttggacggggtagcaggcaccgaaaggaggtcgactactcagattctctgaccgagaagcagtggcttaaggctatcgaggagggaacccttgaagaaattgaggaggaagtaaggcagaaaaagtctagccgaaaaagaaagcgggactcagacgccggatcgtccacccccacaacttccacgaggagtcgtgacaaagatgacgagagtaaaaaacaaaaaaaacggggacgaccccctgccgagaagctgagtcccaatccaccgaacctgaccaagaagatgaaaaagattgttgacgccgtgatcaagtacaaagactcctcctctggtagacagctgtccgaggtcttcattcagctgccatcacgcaaggaacttcccgagtactatgagctcataagaaaaccagtcgatttcaagaagattaaagagcgtattcgtaaccataagtataggtccttgaacgatcttgagaaagatgtaatgctgctgtgtcagaacgcgcaaacgttcaacctggagggcagtctgatctatgaagattcaatcgtgctgcagtctgtctttacctctgtgcggcagaagattgaaaaggaggacgactctgagggcgaagaaagtgaagaggaagaggagggcgaggaagaggggtcggagagcgagtcaagatcagtgaaggttaagatcaagctgggacgtaaggaaaaggcccaagatcgcctgaaaggcggacgcaggcgcccatccagggggagccgggctaagccggtggtctcagacgatgacagtgaagaagagcaagaggaagatcggtccggaagcggaagtgaagaagattag

SEQ ID NO: 242960 - DNA, 5039 bp, Artificial Sequence
  Description of Artificial Sequence: Synthetic coding sequence
atgtccacccccgatcctccgttgggaggaacacccagacctggccctagtccaggccctggtcccagccctggcgctatgctcgggccttcccctggcccatcacccggtagcgctcattcaatgatggggccaagccccggtcctccgagcgccggacacccaatccccacccaagggccaggcggatatccgcaggacaacatgcatcaaatgcacaaaccaatggagtctatgcacgagaagggaatgtcagatgaccccagatacaatcagatgaaaggaatgggaatgagatcaggcggtcatgccggaatgggccctccgccttcgccaatggatcagcactcccagggttacccatcgcccctcggcggatccgagcatgccagtagtcccgttcctgcgtctggaccctcttcaggccctcaaatgtctagcggccctggcggagccccactggatggtgccgatccacaggctctgggacagcagaacaggggtcccacccccttcaaccagaatcagttgcatcagcttcgcgctcagataatggcttataaaatgctagcaagagggcagcccttaccggatcatctgcagatggcggtccagggtaagaggcctatgcccggaatgcaacagcagatgcccaccttgccccctccttcagtaagcgccaccggcccaggaccaggacctgggccaggacccggaccaggcccagggccagcgcctcccaattacagtcgtccccacgggatgggaggtcccaacatgcccccacccggaccctccggtgttcctcccggtatgcccggacagccccctggcggacccccaaaaccttggcctgagggacctatggccaacgccgctgcaccaacctctacaccccagaaattaatcccccctcagcctactggcaggccttctcctgcaccccctgctgtgccccctgcagcttctcccgttatgccacctcagactcagtctcccggacagccagcccagccagcaccaatggtgccgctgcatcagaaacagtctaggatcactcctatacagaagcccagaggtctggatcccgttgaaattcttcaagaaagagagtatcgcttacaggctcgaatcgcccatcggattcaggaattggagaatctccccggaagcctggccggagacctgcgcacgaaagccacaattgagctcaaggctctcaggctgcttaatttccaaagacagcttcgccaggaagttgtggtttgcatgcgacgagatactgcactggagactgcactgaacgctaaagcgtacaaacggagcaaaagacagtcccttagggaagccaggatcaccgagaagctagaaaagcagcagaagatcgagcaagagcgcaaacgtcggcagaagcaccaagaatacttaaatagcatccttcagcatgcaaaagatttcaaggaatatcatcggagtgtgaccgggaaaattcaaaagttaaccaaagccgtggctacctaccacgccaatactgagagagaacagaaaaaagaaaatgagagaatcgagaaggaacgcatgaggaggttgatggccgaggacgaagagggataccggaagttaatcgaccagaagaaggataaaaggctagcttatctgctgcagcagactgacgagtacgtggccaatctaacagaactggtgcgccagcataaggctgctcaggtggccaaagaaaagaaaaaaaagaaaaagaagaagaaagccgagaatgcagaaggacagacccctgccatcggcccagacggggaacccctcgatgaaacttcccagatgagtgacttgccggtgaaggtaattcatgtcgagagcggtaaaatcctgaccggcacggacgccccaaaggctggtcagttggaggcctggctggaaatgaacccaggatacgaagtggccccaagatccgatagcgaggagtcgggctcagaagaggaagaggaagaagaggaggaggagcaacctcaggccgcacaaccacccaccctgccagtggaggagaagaaaaagatccccgatcccgatagcgatgacgtctccgaagttgatgccaggcacattattgaaaacgcgaagcaggacgttgatgatgaatatggggtgtcccaggcactggccagaggcctccagagttactatgccgtggctcatgccgtaacggagcgcgtggataaacagagtgcactgatggttaatggcgtgctgaaacagtatcaaatcaagggtttagaatggttggtgagcctgtacaataataatctgaacggcattttggcagatgaaatgggcttgggcaagacaatccagaccatcgctctaatcacgtatttgatggaacataagcgcattaatggaccctttctaattatcgtgccattgagcactttatccaactgggcgtatgaattcgacaagtgggctccgagcgtcgtaaaagtttcctataaaggtagtcccgctgctcgcagggcattcgtgccgcagctgcggagcggcaagttcaatgtcctgctcaccacctacgagtatatcataaaggataagcacatcctggcaaaaataagatggaagtacatgattgtggatgaagggcatcgcatgaaaaatcatcactgtaaactgacccaggtcctgaatacccactatgtagccccacggagacttctgttaactggtacaccgctccaaaacaaactgcccgaactctgggctctgctcaatttcttactaccaacgatattcaaatcttgtagcacctttgagcagtggttcaatgccccattcgccatgaccggcgagaaagtggacctgaatgaagaagaaaccatactgataatccgtcgtttgcacaaagtcctgaggccattcctgcttcggcgacttaaaaaggaggtcgaggcccagctgcccgagaaagtggaatacgtgataaagtgtgatatgtctgcactccagagagtcctgtaccgccacatgcaggcgaaaggagtcttacttacagatggcagcgagaaggacaaaaaagggaaaggaggcaccaaaacacttatgaacacaatcatgcagttaagaaaaatctgtaaccatccgtatatgttccagcatatagaggagtcctttagcgagcacctgggattcaccggtggaattgtgcagggcttagatctgtaccgcgctagtggaaagtttgagctgctggatcgcattcttccaaagctccgggctaccaatcacaaagtgctgctgttctgtcagatgaccagccttatgaccattatggaagactacttcgcataccggggattcaagtatctgagactggacggaaccacaaaagcagaggatcgcggaatgttactcaaaaccttcaatgagcccggttcggagtacttcatttttctgttgagcacccgagctggcggacttggacttaacttgcaatctgcagatactgttatcatctttgactctgactggaatcctcatcaggaccttcaggcacaggaccgcgctcatcgcatcggacagcagaacgaagtcagggtgctgaggctatgtactgtcaactcagttgaggagaagatattggccgcagccaaatataagctgaacgttgaccagaaggtaattcaagctggtatgttcgaccagaaatcgtcttcccatgaacgtcgcgcatttctgcaggccatcctagaacacgaagagcaggacgagtctcgtcattgctccacgggttccggatctgcgtcatttgcacatacggccccacctccggcaggcgtgaacccagatctggaggagccgcctctgaaggaggaggacgaggttcctgatgatgaaacagttaaccaaatgattgctaggcatgaagaggagttcgacctttttatgaggatggatttagacagacggagagaggaagcccgaaacccaaaaagaaagccaagacttatggaggaagatgagctcccaagctggatcatcaaagatgatgcagaagtcgagcggttgacttgtgaagaagaagaggaaaagatgtttgggcgagggagccggcaccgcaaagaagtagactacagcgattcccttaccgaaaagcagtggttaaagaagatcaccggcaaagacattcacgacacggcttcatccgtagcgaggggactgcaatttcaaaggggactgcaattctgtacacgagcttccaaggcgattgaagaagggaccctggaagagattgaggaagaggttcggcaaaaaaagagttcacgtaaacgcaaaagagattctgacgccggatccagtactccgaccacgtcgacgcggtcccgggataaggacgacgagtctaagaagcaaaagaaacggggaaggccaccagcagagaagctgtcccccaatcccccaaatctgactaaaaagatgaagaaaattgtcgacgccgtcatcaagtataaggacagctcatcggggaggcagttgtccgaggtgttcattcagctgccatccaggaaggagctgcccgaatactacgaactgattcgcaagccggtagattttaagaagattaaagagcgcatcagaaatcacaagtatcggtctctgaacgacctcgaaaaggatgtgatgctgctatgccagaatgcacagacattcaacctggaaggctcccttatttatgaggattccattgtgctccagtctgtgttcacaagtgttaggcaaaaaatcgagaaggaggatgactctgaaggggaagaatcggaagaggaagaggaaggagaagaagaaggttcagagtcagaaagcagatccgtcaaagtcaagatcaaactgggtagaaaggagaaagcacaggacaggctgaagggagggaggagaagaccttcccgcggttcaagagcaaagcccgtggtgagcgacgacgattctgaggaggagcaggaggaggacagatccggatctgggtccgaagaagatta

SEQ ID NO: 242961 - DNA, 4854 bp, Artificial Sequence
  Description of Artificial Sequence: Synthetic coding sequence
atgtccaccccagaccctcctctggggggaacccctaggcccggaccaagtcccggacctggccctagccctggagctatgttaggacctagccccggtcccagtcccggaagtgctcatagtatgatgggcccatcacctgggccaccctctgcaggacacccaatacccacccagggaccgggagggtatccccaagataacatgcaccagatgcataaacctatggaatctatgcatgagaagggaatgtccgatgatcccaggtataaccagatgaaggggatgggcatgcgcagtggtggtcacgccggaatgggccctccccctagccccatggaccagcattcccaggggtacccttcccccttgggcggaagtgagcatgcttcctctcccgtcccagcctctggaccgagcagcgggcctcaaatgagttcgggacccggtggagctcccctagatggggcagatccacaagccctgggccaacagaaccggggacccacaccattcaatcagaatcagctgcaccagcttagggctcagataatggcttataaaatgttggccaggggacagcctttgcccgaccacctgcagatggcagtacagggtaagagacctatgccaggcatgcagcagcagatgcctacgcttcctcctccatcagtgtctgctactggtccaggccctggccctgggcctggcccagggcctgggcctggtcccgcacctccgaactacagcaggccacatgggatgggcggacctaacatgcctcctccgggacccagtggtgtccctccgggaatgcccggacagcccccagggggtccacccaaaccttggcccgaggggccaatggcgaatgccgctgccccaaccagcacaccccagaaactgatcccacctcaacctaccggcaggccatcgcctgcacctcccgctgtgcccccagcagcctcgcctgtcatgcccccacaaacacagtcaccgggtcagccagcccagccggcacccatggtccctcttcaccagaaacagtcccggattacgcctatccaaaagcccagaggcctcgatccagtggagatcctccaagagagagaatacaggctccaggcccgaattgcccataggattcaggagctggaaaacctgcctggaagtttggctggagacctgcggacgaaagccacaatagaactaaaggcccttcggctgctgaactttcagagacagctccgacaggaggttgtggtgtgtatgaggagggacacagccctcgaaacagcactgaatgctaaagcttacaagagatccaagcgccagtctctgagggaggcacgcattaccgaaaaattagaaaagcaacagaagatcgagcaggagcggaaaaggagacagaaacatcaagagtatctgaattctattctgcaacacgcaaaagatttcaaggagtaccaccgttctgtaactggcaagattcaaaaactgacaaaagccgtggccacatatcacgcgaatacggagcgcgagcagaaaaaggagaacgagcggatcgagaaagagaggatgaggcgacttatggctgaggacgaagagggctaccgaaaactgatcgaccagaaaaaggataaacgcctggcataccttttgcagcagactgacgaatacgtcgctaatctgacagaactcgtacggcagcacaaagctgcacaggtcgcgaaagagaaaaagaagaaaaaaaagaagaagaaagctgagaatgctgaggggcaaacaccagcgatcggtcctgatggagaacctctggacgagacttctcagatgtctgacctccccgttaaggttatacacgttgaatcagggaagattctgacaggcacagatgctcctaaagctggccagctggaagcctggttagagatgaatcccggttacgaagttgcccctaggtccgacagcgaggaaagcgggtctgaggaagaagaagaggaggaagaggaggagcaaccgcaagccgcacaacctcccaccctgcctgtggaggagaaaaagaaaatcccggatccagactctgatgatgtgtctgaggtggatgcaagacacatcattgaaaacgctaaacaagacgtcgacgacgagtatggagtaagtcaggctctagcccgaggcttacagtcctactacgccgtcgctcatgctgtgacggagagagtggataagcaaagcgcgctgatggtgaatggggttttaaagcaatatcagattaagggcctggagtggctggtgtcgctctacaataataacttgaatggaattctggctgatgagatgggcttgggtaagacaatccagacgattgccctaattacctatttgatggaacataagcggatcaatggaccctttctgatcatcgttccactgtcaacactgtccaactgggcctacgagttcgataaatgggctcctagtgtagtgaaagtatcctacaagggaagcccggcagcgaggcgggcttttgtaccacagctgcgatccgggaaatttaatgtgctgctcacgacttacgaatacattatcaaggacaagcacattctagccaagatcagatggaagtacatgatagtggacgagggccatcggatgaaaaatcaccactgtaagttaacccaggtgctgaatactcactatgtggcccctaggaggctgttacttacaggtacaccattgcaaaacaaacttcctgaactgtgggctctgctaaattttctgttgcctacaatcttcaaatcgtgtagtacattcgagcaatggtttaatgctccattcgccatgacaggagagaaggtggatctaaacgaggaagaaacaattctgattatccgtcggctacataaggtgctcagacccttccttctccgcagattgaagaaggaggttgaggctcagctgcccgagaaagtggagtatgtgattaaatgtgacatgagcgctctccagagagtactgtacaggcacatgcaggccaaaggggtgctgctgacagacgggtcagagaaagataagaaaggtaaaggtggcaccaagactctcatgaacacgattatgcagttgaggaaaatctgcaaccacccttacatgttccagcatattgaggagtccttttcagaacatctgggcttcaccggcggtatagtccagggcttagacctgtaccgggcttccggaaaatttgaattgctggatcgaatactgcccaagctcagggcaaccaatcacaaagtgttactgttttgtcagatgaccagcctgatgacaataatggaggactactttgcatacagaggtttcaaatacttgcgtcttgacggaacaacaaaggccgaggatcggggtatgctgctaaagacattcaacgagccgggatctgagtactttatttttctcctgtccacaagagcaggcggactcgggctcaacctccagagtgcggatactgtgatcatttttgacagcgactggaaccctcatcaagatctccaggcccaggaccgcgcacaccgtatcgggcagcagaatgaggttcgggtgctgcggctctgcaccgtgaactctgtagaagagaagattttggctgcagcaaagtataaactgaacgtagaccagaaagtaatccaggccggtatgttcgatcaaaagtcttccagtcatgagaggagggccttcttgcaagccatcttggaacatgaggagcaagacgaggaggaggatgaagtgcctgatgatgaaaccgtgaaccaaatgatcgctaggcacgaggaagaattcgacctctttatgcggatggatttggatagaagacgggaggaggcccgtaatcccaaacgcaagcctaggctgatggaggaagatgagcttcccagttggatcattaaggacgatgccgaggttgaaagactcacctgtgaggaagaggaagagaagatgttcggcagagggtcaagacacagaaaagaggtggattatagtgattctctcaccgaaaagcagtggctaaagaccctgaaggctattgaggaaggaactttggaagaaatagaggaagaggtgcgtcagaagaagtcctcccgcaaacggaagagagactctgacgccggttcctcgacccccacaaccagtacaagatcccgggacaaagacgacgaatccaaaaagcagaagaaaagagggaggccccctgccgaaaagttgagccccaacccacctaatttgaccaagaaaatgaagaagatagtcgacgcagtcattaaatataaggactcctccagtggccgacagctctccgaagtgtttattcagctgccgagtaggaaggagcttccggaatattatgagctgatcaggaaacccgtagacttcaaaaaaattaaggagcggattaggaaccataagtatcgctccctgaacgacttggagaaggatgtgatgttgctgtgccaaaatgctcagacctttaatctggaggggtcccttatatatgaggattctatcgtgcttcagtctgtgttcacatctgtgcggcagaaaatagaaaaggaagatgactccgagggagaagagagcgaagaagaagaagagggagaagaggagggctccgagagcgaatcacgctccgttaaagtaaaaatcaagctcggacgaaaagaaaaagcccaagaccgtctcaaaggcggacgtcgtaggccttctcgaggctctagagccaaacccgttgttagcgacgacgattcagaggaggagcaggaagaagaccggtctggatccggatctgaagaggactag

SEQ ID NO: 242962 - DNA, 5045 bp, Artificial Sequence
  Description of Artificial Sequence: Synthetic coding sequence
atgtccacgcccgaccccccattaggtggaacaccaaggccagggccttcacctggaccgggtccttcccccggagcgatgctgggacctagtcccggtcctagtcccggatcagcacactcaatgatggggcctagtcctgggccacccagcgccggtcaccccatccccacacagggccctggcggatatccccaggataatatgcatcagatgcataagcccatggaatctatgcatgaaaaaggtatgtcagatgatcctagatacaaccagatgaaaggcatggggatgcggtccggagggcatgctgggatgggcccaccacccagtcctatggaccaacactctcagggttacccctctcctctcggtgggtccgaacacgcatcctcaccagtgcctgccagtgggcctagttcagggcctcaaatgagcagcggccctggtggagcaccgttggatggggctgatccacaagcactggggcaacaaaatcgcggtcctacaccattcaaccagaaccaattacatcagcttcgagcacagatcatggcctacaagatgctggccaggggccagcctctgcctgatcaccttcagatggccgtccaggggaagcggcctatgccagggatgcaacagcagatgccgaccttgcctccgccttccgttagtgccacggggcctgggcctggcccagggcctggcccaggacccggacctgggccagcacctccaaactactctcggcctcacggtatggggggacccaatatgcccccaccgggaccttcaggtgtgccacccggtatgccaggtcagcctccgggtggcccaccgaagccttggcccgagggccctatggctaacgctgctgcgccaacaagcacaccacagaagctgattcctccccagcccaccggcagaccttcacctgccccaccagccgtaccaccagccgcaagcccagtgatgcctccacaaacacagtctcctggtcagccagcgcagcccgcaccgatggttccactccatcaaaagcaaagccggattacgcctatccaaaagcccaggggtctcgatccagtggagatccttcaggaacgcgagtatcgcctgcaggcgagaatcgctcaccgaatccaggaattggagaatctacctggttccctggccggtgacctcaggacaaaagccacaattgaacttaaggcactgcggcttctgaacttccagaggcaactcaggcaggaagttgtcgtgtgcatgcgcagagacacggccttggagactgccctgaacgcaaaggcgtacaaacgctctaagcgccagtctctgcgggaggcacgaatcaccgagaaattagaaaagcagcaaaagatagagcaggaaagaaagcgcaggcagaaacatcaggaataccttaattcaatcttgcaacacgcaaaggattttaaagagtatcacaggtccgtaacaggcaaaatccagaaactcaccaaagctgtagccacatatcatgcgaataccgagcgagagcaaaagaaagagaatgaaagaattgagaaggagcgcatgagacgtcttatgggccagagggaaaaatcccgccgaggtctgggatctcagagctgggccaggatcttcgccgaccttagcgaccaccaaaatgattgcgtcacgagtgtcaccgaaagcctggttggtcagattctagcggcttgctcaggagaagagggtgaggtcgagtggaagggacgagatagagtcagacggctcagggccgaagacgaggagggataccgaaaactgattgatcaaaaaaaggataaacggctcgcctatcttctgcagcaaaccgatgagtatgtggctaacctgactgagctcgtccggcaacacaaagctgcacaagtggccaaggaaaaaaaaaagaagaaaaagaaaaagaaagccgaaaacgccgagggccaaactcccgcaataggaccagacggagagccgctggatgaaaccagccagatgtctgacctgcctgtaaaagtgatacatgttgagtccggcaagatacttacaggaacagacgctccgaaggccggacagctcgaggcctggttggagatgaatccaggctacgaggtggcacctagatctgattctgaggagtccgggtcagaagaggaggaagaagaggaagaggaagaacagccccaggccgcacaaccgccaacactgccagtcgaggagaagaagaaaatcccggatcctgatagtgatgacgtgagcgaggttgatgcacggcacataatcgaaaacgctaaacaggatgtagacgatgagtatggagtgagccaggcactggctcgtggcctgcaaagctactacgcagtggctcatgccgttacagagcgcgtagacaaacaatccgccttaatggtcaacggtgtcctgaagcagtaccaaattaaaggactggaatggctggtaagcctctacaataataacttaaacgggattcttgccgacgagatgggcctgggcaaaacaatacagactatcgccctcattacttacctgatggagcataagaggatcaacgggccttttctcatcatcgttccactgagtaccctcagcaactgggcttacgagttcgataagtgggctcctagcgtcgtgaaagtatcatataaaggttctcccgctgctagaagagcattcgtgccccagttgagatcgggaaaatttaacgtactgcttaccacatatgagtatatcattaaggataaacacatcttggctaagatacggtggaaatatatgatcgttgacgaaggccaccgaatgaagaaccaccactgtaagctgacacaagtccttaatacacactacgtcgctccacgccgactattgcttaccggtaccccgctccagaacaagcttcctgaactctgggctctactgaactttctgctcccgactatttttaaatcttgcagtacattcgagcagtggtttaacgctccctttgcaatgaccggcgaaaaggtagacctcaacgaagaggaaaccatccttatcatccgaagactccacaaggtactgaggcctttccttctcaggcgtctcaagaaggaagtagaggcgcaattgcctgagaaggtggagtacgtgatcaagtgcgatatgagcgccctgcaacgcgtactctacaggcatatgcaggccaaaggagtcctgcttacagatggttctgagaaagataagaagggtaagggtgggacaaagacccttatgaacacaatcatgcaactccggaaaatctgtaaccatccttatatgtttcagcacatcgaagagtccttctctgagcacctcggtttcaccggcggaatcgtccagggtcttgacctatatcgcgcaagcggaaaattcgaactgttagaccggattctgcctaaactgcgggcaacgaaccacaaggtccttctcttttgccagatgacgagtctgatgaccatcatggaggactacttcgcctatcgaggatttaaatacttgcgcttggatggcacaaccaaggctgaggataggggcatgcttctcaaaacattcaacgagcccggttcggagtactttatttttctcctgtcaacacgagcaggcggattgggcctcaacttacagtcagccgatacagtcataatcttcgatagtgactggaacccacatcaggatctccaagctcaagatagagctcaccggattgggcaacagaacgaagtgcgcgtccttcgcctctgtacggtcaattccgttgaagaaaagatcctggcagctgccaaatacaagcttaacgtggaccaaaaggtaattcaagctggcatgttcgatcagaagagtagcagccacgagcgcagagccttccttcaggccatactcgaacacgaagaacaggatgaggaagaagacgaagtacctgatgatgaaacagtgaaccagatgattgctcgccatgaagaggaatttgatctgtttatgcgcatggacctggataggagacgcgaggaagcaaggaatcccaagcgtaaaccccgactgatggaggaagatgaactgccaagctggatcataaaggatgatgctgaagttgagcgactaacatgtgaggaggaggaggaaaagatgtttggaagaggttctcgtcataggaaggaggttgactactcggactctttaacggagaagcagtggctgaagaccctcaaagctattgaagaggggacgctggaagaaattgaggaagaggttcgccagaagaaaagctccaggaaacgtaagcgagattctgacgctgggagcagcacccctaccacctccacccggtctcgagacaaagatgacgagtccaagaagcagaagaaaagaggcaggccgcctgccgagaaactctcgccaaatccacccaatcttaccaagaagatgaaaaagatagtagacgctgtgatcaagtacaaggatagcagcagcggcaggcaacttagtgaagtattcatccaattacctagcaggaaagagctgccagaatattacgaactcatcagaaagccagtcgatttcaagaaaattaaggaacgcatccgcaatcataaataccgcagcctcaacgatctggagaaagatgtgatgcttttgtgccaaaacgctcagacttttaaccttgaaggtagcctgatctatgaagatagcatcgtactccagtctgttttcacatcggtccgccagaaaattgagaaggaggatgacagtgagggagaagagagcgaggaagaagaggagggcgaagaagagggcagcgaatccgagtcccgatccgtgaaagtgaaaataaagctaggcaggaaagagaaggctcaagaccgcctcaaaggcggacgaaggcggccttcgagagggagtagagctaagccagtggtctcagatgacgatagcgaagaagagcaggaggaggatagatccgggagtggaagtgaggaggatta

SEQ ID NO: 242963 - DNA, 4944 bp, Artificial Sequence
  Description of Artificial Sequence: Synthetic coding sequence
atgagtacacccgacccacccttgggtgggaccccgaggcctggtccaagtccaggtcctgggcctagccctggcgctatgcttggccctagccctggaccgagcccgggtagtgcccattccatgatgggtccatcacccggacccccatctgccggtcaccctatccccactcaggggccagggggatatccgcaagataatatgcaccagatgcataaacctatggagagcatgcacgaaaaggggatgtcagacgaccccaggtataaccagatgaaaggcatgggcatgcgcagtgggggtcacgcaggcatgggtcccccacccagtccaatggatcagcactcccagggatatccatcacccttaggaggatccgagcacgcgtcgagtcctgttccagccagcggcccttcaagtggtccacagatgtcttccgggccaggcggagccccactggacggagccgatccccaagcacttggccagcaaaatagagggcctacaccatttaatcagaaccaactccaccaattaagagcacagatcatggcatataagatgctcgcacgaggccagcctttgcctgatcacctccagatggccgtccaaggtaaaagacctatgcctgggatgcagcagcagatgcccaccctgcccccaccatctgtgtctgctacaggaccgggacctggaccaggacctggaccgggtccgggacctgggccagctcctcccaattatagcagaccgcacggcatgggcggtccaaacatgcctccacccggtccatctggcgttccacctgggatgccgggacagccacccggaggacccccaaagccgtggccagagggtccgatggccaatgcagcagcccctacttccactcctcaaaagctgattccaccacagcccaccgggcgaccatcaccggcaccacctgctgtgcccccagcagctagtccggtcatgccaccacagacccagtccccaggacagcccgctcagccagcccctatggtccctctacatcaaaaacagtctaggatcacccctatacagaaacccagggggcttgacccagtggagattctgcaggagcgggaatatagactccaagctaggatcgctcatagaattcaggagctcgaaaatctcccagggagtctggctggtgaccttaggaccaaagccactattgagctcaaagccctcaggcttctgaactttcaacgccagttgcgccaggaggtagtggtttgtatgcggcgtgacactgccctggagaccgctttaaatgcaaaggcttacaagcggtctaagcgtcagtctctccgagaggctcgcatcacagagaaactagagaagcagcagaagatcgagcaagaacgcaaaaggcgccaaaaacaccaggaatatctgaacagcatcctgcaacacgcaaaggattttaaagagtatcacagatctgtgacagggaaaatccagaaacttaccaaggcagtggcaacttatcacgcgaatacagaacgagagcagaagaaggaaaacgagcgtattgagaaggagcgcatgaggaggcttatggctgaggacgaagaaggctatcgaaagctgatcgatcaaaaaaaggataagcggctggcataccttttgcagcaaaccgacgagtacgtggcaaacttgactgagctggtgcgtcagcacaaagcagcccaagttgccaaggagaagaagaaaaagaaaaaaaagaaaaaagccgagaacgccgaagggcaaacgcccgcaattggcccagacggggaacccctagacgagacatcacaaatgagcgacttgcctgtgaaggtaatccacgttgaatcaggaaagatcttgacaggcacagatgcgcctaaggctggccaactggaagcttggctggagatgaatcctggctatgaagtagcgcctcggtccgattcagaggagtcagggtcagaagaagaggaggaggaggaagaggaggaacaacctcaggcagcgcagccccctaccctccctgtggaggagaaaaagaagatcccagatccggactctgacgatgtgtctgaggtggacgccagacacattattgagaacgccaagcaggacgtggacgatgaatacggcgtctctcaggctttggcgagaggtttacagagctactacgccgtggcccatgctgttacagagcgggtagacaaacaatccgccctgatggtgaatggtgtcctgaagcagtatcagattaagggtctggagtggttagtatctctatacaacaataatctgaacgggatcctcgcagacgaaatgggattggggaagaccattcaaacaatcgccttaattacttacttgatggagcacaagcgcataaacggcccttttctgataatagtccccttaagcacgctctccaattgggcatacgagttcgataaatgggctccttcggtcgtgaaagtttcttataaggggtcaccggcagcgaggcgcgctttcgttccccagttaagatcaggtaaatttaatgtcctgttaaccacatacgaatacattatcaaagataaacacatactggcaaaaattaggtggaaatacatgatcgtggatgaaggccaccggatgaagaaccatcattgcaagctgactcaggtactcaatacgcactacgtggctccgagaaggctgctgctgaccggtactccactgcaaaataagctgcccgagctctgggccttgttgaatttcttgttaccaaccattttcaagagctgctcaacattcgaacagtggttcaacgcgccatttgccatgacaggcgagaaagttgacctgaacgaagaggaaacaatcctaataatacgtcgtctccacaaagtattgagaccgtttctgctgcggagattaaagaaagaagttgaggctcagctccccgagaaagtcgaatatgtgattaagtgtgatatgtcagcattacagagagttctgtacagacacatgcaggctaagggggtgctgttaaccgatggatcagaaaaagataaaaaaggcaagggcggtacaaaaacactgatgaacacaattatgcagttgcgtaaaatctgcaaccacccctacatgttccagcacatcgaggaaagctttagtgagcacctcgggttcacggggggaattgtgcagggcctagatctctaccgggcaagtggcaagtttgagctgctggacaggattctgccgaagcttcgagccactaaccacaaagtgctcctgttctgtcaaatgacgtcattgatgacaataatggaggactatttcgcctacagaggcttcaagtatctaaggttggacggaactacgaaggccgaggaccggggtatgcttttaaagaccttcaatgaacccggatctgagtacttcatcttcctgctctcaacgcgcgcagggggactgggactaaacctgcagtcggccgacacagtcattatcttcgacagcgattggaaccctcaccaagatctgcaggcgcaagatagggcacacaggattgggcagcagaatgaggttagggtgcttcggctgtgtaccgtcaactcagtagaagaaaagattctggctgctgcaaaatataaactgaatgtggatcagaaagtgatacaggcgggaatgtttgaccagaaatcctctagccacgagcgcagggcatttctccaggctattctggagcacgaagaacaggatgagtcacggcactgctcaaccggctccgggtctgcgtccttcgcccacactgcccctccacccgctggagtgaatcccgacctcgaagagcctccgctcaaggaggaagatgaggtccccgatgatgaaacagtcaaccagatgatcgcacgccatgaggaggagtttgacttattcatgcgaatggatctcgacaggcgacgagaagaggctcggaatcctaagaggaaaccacgactgatggaagaagacgagcttccctcttggattatcaaagacgacgcggaggttgagagactgacctgcgaagaagaagaggaaaaaatgtttggacgcggatctcgtcacaggaaagaggtggattattctgattcccttacagagaagcagtggctcaaggccattgaagaaggcaccttggaggaaatcgaagaagaggtgagacagaaaaaaagcagcagaaaaagaaaaagagacagcgacgcaggtagttctaccccaaccacctctacaagatcacgggataaggatgacgagagcaaaaaacagaagaaaagaggccgacctccggctgaaaaacttagtcctaacccccctaacctcaccaagaaaatgaaaaaaattgttgacgcggtgattaaatataaggatagttcatccggtcgccagctctctgaggtatttatacagctaccaagtagaaaagagctccctgagtattacgagttgatcagaaaacctgtggactttaaaaaaatcaaagagcggataagaaaccacaagtataggagcttgaacgatctggagaaggatgtcatgttactatgtcagaatgcccagacctttaatctggaaggatcgctcatctacgaagactccattgtgttgcagagtgttttcacaagtgtccgccagaagatcgagaaggaagacgattctgagggcgaggaatcagaggaagaggaggagggcgaagaggaaggatctgaatctgaatcgaggagtgttaaggtcaaaatcaagctgggcaggaaagaaaaggcccaggaccgtctgaagggcggacggagaagaccctctagaggctctcgcgctaaacccgtggtcagtgacgatgactctgaggaggaacaggaagaagatcggagcggatctggcagcgaagaggactag

SEQ ID NO: 242964 - DNA, 4842 bp, Artificial Sequence
  Description of Artificial Sequence: Synthetic coding sequence
atgtcaacaccagaccctccgcttggcggaacaccaaggcctggcccttcacctgggcctgggccttcgccaggcgcaatgttgggacccagtccaggaccttcccctgggagtgcgcactccatgatgggcccttctcctggtccaccctccgcaggtcatcccattccgacacagggcccaggcggatacccccaggacaacatgcaccaaatgcataaacctatggaatcaatgcatgagaaaggcatgagtgatgacccgcgttataatcaaatgaaaggcatgggaatgagatcaggcggacatgccggaatggggcctccaccaagcccaatggaccagcatagccagggctacccttcccccttagggggttctgaacacgccagcagcccagttcccgctagcggcccaagctcgggcccacagatgagctctggacccggtggagcccctctagacggtgccgaccctcaagcactgggccagcagaatagaggcccaactccttttaaccaaaatcagcttcatcagcttagggcgcagatcatggcttacaagatgctcgccagagggcagcccttacctgaccacctgcagatggcagtgcaaggaaagcggccaatgccaggaatgcagcaacagatgccgactctgccccctccctccgtatccgctactggcccaggcccaggtcctggccctggacccggaccaggtcctgggccagcgccaccaaattacagtcgtcctcacggtatgggcggtcctaacatgccgccacccggtccctctggcgtaccccctggaatgcccggtcagcctcccggaggacctccaaagccgtggcctgagggacccatggccaatgcggctgcccctacctctacccctcaaaagttgattcctcctcaacctacaggacgcccttcacctgcgccacccgctgtaccccctgctgcctcccctgtgatgccaccccagacccagtcacccggacagccagcgcagcctgctcctatggttcctctgcatcagaagcaaagccgcataacccccattcagaaaccacgcggtcttgaccccgtcgagattctgcaggagagagaatataggttacaagcccgtatagcgcaccggattcaagagctagagaatctgccgggatcccttgcaggcgatctcaggaccaaggccaccatcgaacttaaggctcttcgcctgctcaacttccagcgccaactgcgccaagaggtcgtggtctgcatgcgacgggacactgccctggagacagccttgaacgccaaagcttataagagatcgaagcgccaaagcctgcgggaggcccgtataactgaaaagctggaaaagcagcagaaaatagagcaggagagaaaacgcaggcagaagcatcaggagtacctgaacagcattctacagcacgctaaggatttcaaagagtaccaccggagcgtgacggggaagattcagaaactcacaaaagctgtcgccacctaccatgccaatactgaaagggaacagaagaaagagaatgaacgcattgagaaggagagaatgagacgccttatggccgaagacgaggaagggtaccgcaaactcatcgaccagaaaaaagataaacgcctggcatatctgctgcagcagaccgatgaatatgtagcgaatctgactgagctagttcgccagcacaaggctgcacaggtggccaaggagaagaagaagaagaaaaagaagaagaaagccgaaaatgccgagggccagacccccgctattggacctgacggcgagcctcttgacgagacgagccagatgagcgacctgccagtgaaggtgattcatgtggaatcaggcaagatccttactggcacagacgctcccaaggccggacagcttgaggcatggctcgagatgaaccccggatacgaggtggcaccgaggtccgattccgaagaatctggcagtgaggaagaggaggaggaagaagaggaagagcagcctcaggccgctcaaccccctactctgcctgttgaagagaaaaaaaagatcccagacccagattccgacgatgttagcgaggtggatgccagacacatcattgaaaacgccaagcaggacgtggacgatgagtacggcgtgtcccaggccttagccaggggcctccagtcctattacgcagttgcccacgctgtcacagagagagtcgataaacagtctgcactcatggtcaatggcgtattgaagcagtatcagattaaaggactggaatggcttgttagcctgtataacaacaacctgaacggcatcctcgccgacgagatgggtctggggaagactatccagaccattgcattaataacctacctcatggaacacaagcgaatcaacggccctttcctgattatcgtgccgctatcaactcttagcaattgggcctacgagtttgataaatgggctccttctgttgtgaaggtgtcctacaagggaagtccagcagcccgacgcgcattcgtgccgcagcttaggtccggcaagttcaacgtgctcctgacgacttatgagtacatcattaaagacaagcatattcttgcaaagattcggtggaagtacatgattgtcgacgaagggcatcggatgaaaaatcaccactgtaagctaacacaggtgctcaacacacactatgtggcccctcggaggttgctacttacaggcacacctctgcaaaataagctgcctgagctgtgggccttgctgaatttcctactcccgacaatctttaagtcctgttctacattcgaacaatggtttaatgcgccattcgcgatgacaggagagaaagtggacttgaatgaggaggaaaccatcctaatcatccgccgattgcacaaggtactgcgcccatttcttctgcgcaggctcaaaaaagaggtagaggcacagctacccgaaaaggtcgagtacgtgattaaatgcgatatgtcagctctacaacgtgtattgtatagacatatgcaggcaaagggggtcctgctcacagatggctcagagaaagacaagaaggggaaagggggaacgaaaacactgatgaatacaattatgcaacttcgcaagatatgcaaccatccctatatgtttcagcatattgaggaaagcttctctgaacacctgggcttcactgggggtattgtacaaggcctggatttgtacagagcctctggtaagttcgaattgctggatcgcattctccctaagttgagggctaccaaccacaaggtccttctgttttgccagatgacgtcgttgatgaccattatggaagactacttcgcttaccgtggttttaaatacctccgcttggatggtaccaccaaagctgaggaccgagggatgctgttgaagactttcaatgagcccggatctgagtactttatctttctgttaagcactcgagcgggaggcctcggactcaaccttcagagcgctgatactgtgattatatttgactctgattggaacccgcaccaggatctgcaggcccaggacagggcccatcgcattgggcagcagaatgaagtgagggttcttcgcctttgtacggttaacagtgttgaggaaaaaatcctagccgcagctaagtacaaactcaatgtggaccagaaggtgatccaagctggcatgttcgatcagaagagctcttcccacgagcgccgagcgttcctgcaagccatcctagaacacgaagaacaggacgaagaagaggacgaagtgcctgatgatgaaaccgtgaaccaaatgattgcacggcatgaagaagaatttgacctgttcatgaggatggatctggaccgcagacgcgaagaagcaaggaaccctaaaaggaagcctcggctgatggaagaggatgaacttccaagctggattatcaaagatgatgctgaggttgaaagactcacttgcgaggaggaagaggaaaaaatgttcggtagaggaagtaggcatcggaaggaggtcgactattctgattctttaacagaaaaacagtggctcaaggctatagaagagggcacactcgaggagattgaggaggaggtacggcagaaaaagagctctagaaagcgcaagcgtgattccgatgccggatccagcacgccgacaacttctacccgtagtcgcgataaggatgacgagtctaaaaagcagaagaaacggggacggccaccagccgagaagctctcccccaaccctcctaacttgacgaaaaagatgaaaaaaatagtagacgcagttatcaaatataaggactcaagcggcagacaactgtctgaggtgttcatccagctgccttctagaaaggagctgcccgaatattatgagctaatccgaaaacctgtcgactttaaaaagatcaaggaacggattcgcaaccacaagtatagaagtttaaacgacctggagaaggatgtgatgttgttatgccagaatgcccagacatttaacctggagggcagtctaatttacgaagacagtatcgtgctccagagcgtgttcaccagtgtcagacagaagatagaaaaagaggacgatagtgagggcgaggagtccgaggaagaagaggagggagaggaggaggggtctgaatcagagtcccgtagcgtgaaagtgaagattaagttagggagaaaggagaaggctcaggatcgtctgaagggcggtagacgccgaccctcccggggatcaagagcgaagcccgtggtgtcagacgacgactcggaagaagagcaggaggaagatcgctccgggtcagggtcggaggaagactag

SEQ ID NO: 242965 - DNA, 4851 bp, Artificial Sequence
  Description of Artificial Sequence: Synthetic coding sequence
atgtcgacccctgacccgccactcggcggaacccctcggccaggaccgtctcccggaccaggtcctagccctggagccatgctgggaccctccccaggtccgagccccggttctgctcacagtatgatgggaccttcgccaggaccaccctccgccggtcaccccattccaactcagggccctggcggatacccacaggacaatatgcaccagatgcacaagcctatggaaagcatgcacgaaaaaggcatgtctgacgacccgaggtataaccaaatgaagggcatgggtatgcgctcagggggacatgccggtatgggccctcccccaagtcccatggaccagcactcacaggggtacccatctcctctggggggatcggagcacgcatcgtcccccgtgcctgcctctggacctagtagcgggccacagatgtcctcgggtcccggtggcgcaccattggacggagccgacccacaagctctggggcagcaaaatcggggaccaactccattcaaccagaatcagctacaccagctgagggcccagattatggcctacaaaatgctcgctcgaggtcagccactgcccgatcatttacaaatggcggtccaaggaaagagacctatgcccggaatgcagcaacagatgccgactctccccccaccgagtgtgagcgcgactggtcctggtcctggcccagggcctgggccaggacccggaccagggccagcaccacctaactactccaggccacatggcatggggggacctaacatgcccccaccaggcccatcgggtgttccccctggcatgccagggcagccgcctggtgggccacccaaaccctggcccgaagggcctatggccaacgcggctgcccctacgtccacgcctcagaagctgatccccccacagccaactgggaggccgtcccccgctcctccagcagtaccacccgctgcatctcctgtcatgcctccacagacccagagtccgggacaacctgcccagccagcccctatggtgcctttacatcagaagcagtcaaggataacccccattcagaagcctaggggtctcgaccccgtcgaaatcctgcaggagcgggaatatcggctccaagcacgcattgcacatcggatccaggagctggagaacctgcctggctccctggctggagatttgagaacaaaggctaccattgagcttaaggcgcttagactgctgaacttccagcggcaactgaggcaagaagttgtggtgtgcatgcgtcgtgatacagcgctggaaacagcgctcaatgcaaaggcatacaagcggtcaaagagacagtcacttcgggaagccaggattacagaaaaactcgagaagcaacaaaaaattgagcaagaacggaaaaggcggcagaaacaccaggagtacctgaatagtatccttcagcatgctaaagattttaaggagtaccacaggtctgtgaccggcaaaattcaaaagctaaccaaggctgtcgccacatatcacgcaaacactgaacgcgagcagaagaaagagaatgagagaatcgagaaggagcgtatgcggaggctcatggccgaggacgaggaggggtacaggaagttgatcgaccagaaaaaagacaaacgcctcgcctatctgctgcagcaaacagatgaatatgttgcgaatctgactgagctcgtccgccagcataaggcagcccaggtcgcaaaagagaagaaaaagaagaaaaagaagaaaaaggccgaaaatgctgaaggccagactcccgcaatcggaccagacggagagccactggacgagacctctcaaatgagtgatttgccagtgaaggtgatacacgtcgagagtgggaagatcctcaccggcaccgacgcgccaaaagctggacagctggaggcttggttggagatgaaccctgggtatgaggtggccccaagaagcgattctgaggaatccggcagtgaagaagaagaggaggaggaagaggaggagcaaccgcaagcagctcagccaccaaccctacccgttgaggaaaaaaaaaagatacccgacccagactctgacgacgtgtcagaggttgatgctcggcatattatcgagaatgctaagcaggatgtagacgatgagtatggcgtgtcacaagccttagcccgaggcctgcagtcctactacgccgtggcccacgccgtcactgagagggtggacaagcagtccgccctgatggtgaatggtgttctgaaacaatatcagatcaagggattagaatggcttgtctcgctatacaacaataatctgaatggcatcctggcagatgaaatggggctgggaaagacaattcagacgatcgcattgatcacatacttgatggagcacaagaggatcaatgggccatttctgatcatcgtgcccctgagtacactgagcaactgggcgtatgagttcgacaagtgggctcccagtgtggtcaaagtgtcatataaagggtcccccgctgctcgacgagcattcgtcccccagctccgctctgggaagtttaacgtcttgttaacgacttacgagtatattatcaaggacaagcacatactggccaagatacgctggaagtacatgatagtcgatgaggggcatagaatgaagaaccaccactgcaaactgactcaagtgctcaatactcactacgtggcaccaagacgactcctgctcaccggcacacctctacaaaacaaactgccagagctgtgggccctgctaaatttcctcctgcccacaattttcaagagctgctccacattcgagcagtggttcaacgcaccatttgcaatgactggcgaaaaggtagatctaaatgaggaagaaaccatcctgatcatcagacgcttacataaggtcctgaggcctttccttttgcgcagacttaagaaggaagtggaagcacagctgccagagaaggtcgagtacgtgattaaatgtgacatgtccgcattgcagagagttctttacagacacatgcaggccaaaggcgtgctgctcacagacggatccgagaaagataaaaaagggaagggaggtacaaagactctaatgaatacaattatgcagctcaggaaaatttgtaatcacccatatatgttccagcacattgaggagagtttcagcgaacacctcgggttcacgggcggtatcgtccagggactggatctgtaccgggcatccgggaaatttgagctgctggacagaatccttcctaaactcagagctaccaatcacaaggtgttgcttttctgccagatgacttcgttgatgaccatcatggaggattacttcgcttacagaggctttaagtatctgaggttggatggcaccaccaaggccgaggatagagggatgctacttaaaacgttcaacgagccagggagcgagtattttatcttcctgctcagcaccagagccggaggattgggattgaacctacaatctgccgacaccgtgatcatctttgactccgactggaatccccaccaagacttacaggctcaggatcgagcgcaccgcatcgggcagcagaatgaggtccgagttctacgcctctgcacagtgaattccgtcgaagagaagatcttggccgcagctaagtacaagctcaacgttgatcagaaagtcattcaggcaggaatgtttgatcagaagtccagcagccacgaacgacgagcctttctgcaagccatactagagcatgaggagcaagacgaggaggaggatgaggtcccagacgacgagaccgttaatcagatgatagcgcgacacgaagaggaattcgaccttttcatgcgcatggatctggataggcgccgtgaggaggccagaaatccaaaacgtaagccacgcctgatggaagaagacgagttgccgtcgtggataatcaaggacgatgccgaggtagaaagactgacatgcgaggaggaagaggagaaaatgttcggcagaggctcccgccatcgtaaggaagtagattactccgattccctaaccgaaaagcagtggctgaagacgctgaaggctatagaagaggggacactcgaggagattgaggaggaagtgcgccaaaaaaaatccagcaggaagagaaaaagagacagcgatgccggtagctccacacccactacatcaaccaggtcgagagacaaagacgacgaatccaagaagcaaaagaagagagggaggccccctgccgagaaactgtcccccaatccgccaaatctaacaaagaagatgaaaaaaattgtcgatgccgtcatcaagtataaggactcgtcaggacgccagctttcagaggtcttcattcagttgccctcccgcaaggagttgccagaatattacgaactgatcaggaagcccgtggatttcaagaagatcaaggaacgcatccgcaatcacaaatacagatctctgaacgatttggaaaaagatgtaatgctgctgtgtcaaaacgctcagacattcaacctggaaggaagcctaatttacgaggattcgatagtactgcagagtgtcttcactagcgttaggcagaagatagagaaggaagatgacagcgagggcgaggaatctgaagaagaagaggaaggggaggaggagggctccgagtccgaatctcgatctgttaaagtgaagatcaagttaggcagaaaggagaaggcccaggatcggctgaaaggaggacgcaggcgcccttcaagaggttctagggccaaaccagtcgtgagcgacgatgacagtgaagaagaacaagaagaggaccgatccggttcaggatctgaggaggattag

SEQ ID NO: 242966 - DNA, 4845 bp, Artificial Sequence
  Description of Artificial Sequence: Synthetic coding sequence
atgagtacccccgatcccccactgggtggtacgcctcgacccggaccctcacccggacccggacccagccccggagccatgctgggaccatccccgggtcctagtccagggagtgcccatagcatgatggggccttccccgggacccccaagtgccggacaccctatcccaacacagggtcccggtggataccctcaggacaatatgcaccagatgcataagccaatggagagcatgcatgagaaggggatgtcagatgatccacgatacaaccagatgaagggaatggggatgcgcagtggtggccacgctgggatgggccctcctccatctcctatggaccaacacagtcagggataccccagtcccttggggggatccgagcacgcgtcttcacctgtgcccgcttctggtcccagctctggccctcagatgagtagcggtcctggaggagctccgctggacggggcagatccacaagcactgggccagcagaacaggggtccgacccccttcaatcagaaccagctgcaccaactccgagcccaaatcatggcctacaagatgctcgctagaggtcagcccctcccagatcacctccaaatggccgtgcaggggaaacggccaatgcccggaatgcagcaacagatgccgactttgccaccccctagcgtatctgccacaggccctggacccggacccggacctggaccaggcccaggtccaggcccagcccctcccaattactcaagaccccatggaatgggtggcccaaatatgcccccacccggaccttcgggagtcccccctggaatgcccggacagcccccaggcggacccccaaagccatggcccgaaggacctatggccaatgcggctgctccaacttctacaccacagaagttgatccctccacagccgactggacgtccgtcccctgcacccccagctgtgcctccagctgcatcccccgtcatgccaccccagactcagtcccccggacagccagcacagccagcaccaatggtgcctctacatcaaaagcagtcccggattacccctattcagaagccgaggggattggatcccgtcgagattctccaggagagggagtataggctccaagctaggattgcccacagaatccaagagctggagaatctccccggaagtctggccggtgacctgcgcaccaaagccacaatcgagctgaaagccttacggctgttgaactttcagaggcagctgcgccaggaggtggtagtctgtatgcgtagagacaccgctctggagacagccttaaatgctaaagcttataagcggagcaagcgccaaagccttcgagaagctcggattaccgagaagctcgagaagcagcaaaagattgagcaggaaaggaagcgcaggcagaagcatcaagaatacctgaacagtattctccaacacgccaaagatttcaaagagtatcacagatctgtaaccggcaaaattcagaaactgactaaggccgtggccacttatcacgccaatactgaaagagagcagaagaaggagaatgaacgtatcgaaaaggaacgcatgcgtcgtctcatggcagaggacgaggagggataccgcaaactcattgaccaaaaaaaagataaaaggctggcatacttactgcagcagacggacgagtacgtcgccaatctgacggagctcgttcgccagcataaagcagcacaggtggcgaaggaaaagaagaagaaaaaaaaaaagaaaaaggcagagaacgctgaaggacagacgcccgcaattgggcctgacggcgagcctttggacgaaaccagtcaaatgtccgacctgccggtcaaggtgatccacgtggagtccgggaagatactgactggtacagatgccccaaaggccggacaattggaagcctggcttgagatgaatcccggttacgaggtggcgcctaggtcagactctgaagaatctgggtcagaggaggaagaggaagaggaagaagaggagcagcctcaggcggctcaaccaccgacattgcccgtggaggagaaaaagaagatccccgacccggattctgacgatgttagcgaggtcgacgcaaggcatataatcgagaacgcgaaacaggacgttgacgatgaatatggggtgagccaggccctcgcaagagggcttcaatcatattatgcagtggctcatgccgtaacagaaagagtggataagcaatctgctcttatggtgaatggcgttctgaagcagtatcagatcaagggcctggagtggttggtgagcctgtataataataatcttaatggaatattggctgacgagatgggtctgggaaaaaccatccagaccatcgcactgatcacctacctgatggagcacaagcgaattaatgggccttttctcatcatcgtacccctgagcaccttatctaattgggcctatgagtttgacaagtgggcaccctcagtggtgaaggtcagttacaagggatctcccgctgccagaagagcattcgtgcctcagctgagatcaggcaagtttaatgtccttctcaccacctatgagtatattattaaggataaacacattctcgcgaaaatcagatggaaatacatgattgtggacgaaggacatcgcatgaaaaatcatcattgcaaattgacacaggtgctgaatactcattatgtcgcccctcgtcgccttctcctgaccggtacccctttgcagaacaagctgcctgagttatgggctctgttgaactttctgctgcccaccatttttaaatcctgcagcacctttgagcagtggtttaatgccccattcgccatgaccggcgaaaaggttgatcttaatgaagaggagaccattctaattattaggcgtctccacaaggtgctacggcctttcctcctgcggagacttaaaaaggaagtcgaggcccagttgcccgagaaagttgagtatgtgatcaagtgtgacatgagtgcccttcagagagttctgtatcggcatatgcaagccaagggagtgcttcttacagatgggtcagaaaaggacaagaaaggcaagggcggaacaaagacactgatgaacacgattatgcagctccgcaagatctgtaaccatccctacatgtttcagcatattgaagagtccttctctgagcatcttgggtttaccggcggaattgttcagggactcgacctttaccgggcttcaggcaaattcgagcttctcgataggatattacctaagctgagggcaaccaatcataaggtgctcttattctgccagatgacctcactgatgacaatcatggaggattatttcgcctacaggggcttcaagtatctgagattggacggtaccaccaaggctgaggacagagggatgctgctcaagactttcaacgaacctggctcggagtatttcatatttctcctaagcacccgcgctggcggtctgggtctcaatcttcagagcgccgatactgtgataatctttgacagtgattggaacccgcatcaagatctgcaagctcaggacagggcccacagaatcggccaacagaatgaagttcgggtgctgcgcttgtgtaccgtgaactctgttgaggaaaaaattctggcagccgcaaaatacaagctcaacgtggaccagaaagtgatccaggcaggcatgttcgaccagaaatcttcatcccatgaaagaagagcctttcttcaggctatcctagaacatgaagaacaggatgaggaggaagacgaggtgcccgacgatgaaaccgtcaatcagatgatcgcccgtcacgaagaggaattcgacctgtttatgcgcatggatctcgatagacggcgagaggaggctcgtaatcccaaacgcaagcctcggcttatggaagaggacgaactcccgtcttggattatcaaggatgacgccgaagtggagcgtttgacttgcgaagaggaagaggaaaagatgttcggacgcggaagtagacatcgcaaagaggtggattattccgatagtctgaccgagaaacagtggcttaaggcaattgaagagggaaccctggaggagatagaggaagaagttcgccagaaaaaaagctctagaaagcgaaaaagggattccgatgccggtagttccacaccgaccacatccaccaggagtcgtgataaggacgatgagtcaaaaaagcaaaaaaagcgcggtagaccccctgccgaaaagctgtcccccaatcctcccaacctgacaaagaagatgaaaaaaattgttgatgccgtcatcaaatataaagacagctcttcagggcgacagctctcagaagtattcatccagctccccagccggaaagagctgccggaatattacgagctgattagaaaacctgtggatttcaaaaagatcaaagagcggatccgaaatcataagtaccgaagcttgaatgatctggagaaagacgtgatgttactgtgccagaacgcccagaccttcaacctcgagggttccctaatctatgaggacagcatagttttgcaatcggtttttacctcagtcaggcagaagatcgagaaggaggatgactcagagggggaggagagcgaggaggaggaggaaggcgaggaagaaggcagcgagtccgagagccgcagcgtgaaggttaagatcaagctcggcaggaaggagaaggctcaggataggctgaaggggggacggaggagaccatcccgaggatctcgcgcaaagccagtggttagcgacgacgactccgaagaagaacaggaagaggatagatcaggctctggctctgaggaagattag

SEQ ID NO: 242967 - DNA, 3159 bp, Artificial Sequence
  Description of Artificial Sequence: Synthetic coding sequence
atgagctccgccgcagaaccgcctcctcctcccccacccgagtctgcaccctcgaaaccggctgcctctatagcgtccggaggctcaaactccagcaataagggcggtcccgagggtgttgcagcccaggccgttgcctccgctgcctcagccggtcctgccgatgcagaaatggaagaaatctttgatgatgcgtcacctggaaagcagaaggagatccaggagcccgaccctacttacgaggagaagatgcagaccgaccgcgctaaccgattcgaatacctgttgaagcagacagaactcttcgcacacttcatacaacctgctgcacaaaaaacgcccacctctcccttaaagatgaagccaggcagacccagaattaagaaagatgagaagcaaaatctcctttctgtcggggactaccgccatcggaggacggaacaagaagaggacgaggaactgttgacagaatccagtaaggccacgaatgtctgcaccaggttcgaggatagcccgagctacgttaagtgggggaagttgcgtgattaccaggtacggggactgaattggctgatttccctttacgaaaacggcatcaacggcatactagctgatgaaatggggctgggcaaaacactccagactatttctctcctaggttatatgaaacactatcgcaatatacccggaccgcacatggtgcttgtgcctaagtctactcttcataactggatgtccgaatttaaacggtgggtccccacattgaggagcgtctgtctgatcggggataaagaacagagggccgcattcgtcagggacgttttactgcctggagagtgggacgtctgcgtgacatcttacgagatgttgatcaaagagaagtctgtttttaagaagttcaactggcgctacctcgtgattgacgaggcccaccgtataaagaatgagaaatctaaacttagtgagatagtgcgagaattcaagacaaccaaccggctcctcctgaccggcactcccctccagaataatctacacgagctttggtctttgctgaatttcctgctgcccgatgtatttaactcagctgacgacttcgatagttggttcgatacaaacaactgtctcggggaccagaagctcgtggaaaggctccacatggttcttcgcccttttcttctgagaagaataaaggctgacgtagagaagtctttgccacctaagaaggaggtaaagatttatgtgggcctgagcaaaatgcagcgtgagtggtacaccaggattctgatgaaggatattgatatccttaattccgctggaaagatggacaagatgaggctactcaacatcctgatgcaactgagaaagtgctgtaatcatccctacctgtttgacggggcagaacctgggccaccctacactacagacatgcacttagttacaaattcagggaaaatggtggtgctggacaaactgctccccaaattaaaagaacaagggagtagagtgctaattttttcccagatgacccgcgtgctggacatccttgaggactattgtatgtggagaaactacgagtattgtcgtcttgacgggcaaacccctcatgatgagcgccaagatagcatcaatgcgtacaacgaacccaacagcacaaagttcgtgttcatgcttagcacccgcgcaggtggtttgggtatcaacctagccactgcggacgtagtcatcctttatgactctgattggaaccctcaggttgatctgcaggcgatggaccgggcacatcggattggtcaaactaagacagtacgggtgttcaggttcatcacggacaacaccgttgaagagagaatcgtcgaacgcgcagagatgaagcttaggttggattccatcgtgatccagcaggggaggctggtggatcagaatctgaataagattgggaaagacgagatgctgcaaatgatccgtcacggggctacacatgtcttcgccagcaaggaatccgaaataacggacgaagatattgatggaatccttgagcggggagcgaaaaaaaccgcagaaatgaatgagaaactctctaagatgggcgagtctagcctgagaaactttacgatggacacggagtcatcggtttataactttgagggagaggattacagggaaaagcagaagatcgcgtttactgaatggatcgagccacctaagagggagcgtaaagcaaactacgccgtggacgcttacttccgagaagctctgcgcgtgtccgagccaaaagctcccaaagctccacgccctcctaaacagcctaacgtgcaggattttcaattctttccccctcgtttgtttgaactgttagaaaaggagatccttttctacaggaaaaccatcgggtataaggtccctcggaatcccgagctgccaaatgccgctcaggcgcaaaaggaagaacagctgaaaatagatgaggccgagtctctcaacgatgaagaactcgaagagaaagagaagctgctaacgcagggtttcacaaattggaataaacgggacttcaaccaattcattaaggcaaatgaaaagtggggacgagacgatatcgagaacatcgctcgggaagtagaagggaaaacaccagaggaagtcatcgagtacagtgcagtgttctgggagcggtgtaacgaactccaggacattgagaagatcatggctcaaatcgaacgcggagaggcacgcatacagcgacggatcagtatcaaaaaggcattggacactaagataggccgatacaaagcaccctttcaccagctgagaatctcatatggaacaaacaaaggcaagaactacacagaggaagaagaccgcttcctgatttgcatgctccacaaactgggctttgataaagaaaacgtgtatgacgaattgaggcagtgtattcggaattcacctcagttcaggttcgattggttcctcaaaagccggacggctatggagcttcaacggaggtgcaataccctgatcacactgattgaacgggagaacatggaactcgaggaaaaagaaaaagctgagaagaagaagcgtgggccaaaaccctcaactcaaaagagaaaaatggacggagcacctgacgggaggggtcgaaaaaaaaaattgaagctctag

SEQ ID NO: 242968 - DNA, 2988 bp, Artificial Sequence
  Description of Artificial Sequence: Synthetic coding sequence
atggaggagattttcgatgacgcctcccccggaaaacagaaggagattcaggaacctgatcccacctatgaggaaaagatgcagacagatagagctaatcggttcgagtacctgttgaagcagacagagctattcgctcatttcatccaacccgctgcccagaagacccccacatcccccctgaaaatgaaaccaggcaggcctcgaatcaagaaagacgagaagcaaaaccttctgtccgtcggtgactatcgacacaggagaaccgagcaagaagaagatgaagaactgctcactgaaagctcgaaagctacaaatgtttgcacgcggttcgaggattccccgagttacgtgaagtgggggaaactgcgcgactaccaggtgaggggccttaactggttgatctcactctacgagaatggcataaatggcatactcgccgatgaaatggggctggggaagacactgcagactattagcctgctgggatacatgaagcattaccgcaacattcccggtcctcatatggtcctcgtgcccaagagcactttgcacaactggatgtccgagttcaaaaggtgggttcccacactaagatctgtctgcctgataggcgacaaggagcaaagagccgcattcgtccgcgacgtcttactgccaggggagtgggatgtttgcgtcactagttatgaaatgctgataaaggaaaaaagtgtttttaagaagttcaattggcgatacttggtgatcgacgaagctcaccgaatcaagaatgaaaagtctaaactgtccgagatcgtgcgcgaattcaaaacaactaaccggttgctacttaccggaacccctctgcagaacaatcttcacgagctgtggtccttgctgaattttctcctccccgacgtgttcaatagcgccgacgacttcgacagctggttcgacacaaataactgtctgggtgatcaaaaactggtcgagcggctccatatggtcttgcgccctttcctcctccgcagaataaaggccgacgtggagaagtccctcccgccaaaaaaagaagtgaagatttacgtggggctttcaaaaatgcagcgagaatggtatacaagaatcctgatgaaggatatcgatatccttaactccgccggtaaaatggataagatgcgcctgctgaatatccttatgcaactacgcaaatgttgtaatcacccctatttatttgacggcgctgaacctggcccaccatatacaacagacatgcacctggtgaccaattccggcaaaatggtggtgctcgacaaactgttgcccaaactgaaggagcaggggagtagagtacttattttttctcagatgacaagggtgcttgacatcctggaggactattgtatgtggcggaactacgaatactgcagacttgatggacagaccccccacgacgaaaggcaggattccatcaacgcgtataatgagcctaattctactaagtttgtgttcatgttgtctacgagagccggagggctcggcatcaatttagccaccgcggatgttgtgatcctctatgactctgactggaatccacaggtagatttgcaagccatggaccgagcgcaccggatcggccaaactaagacggtgcgggtcttcaggtttattacagacaatacagtagaagagagaatcgtggagagagccgagatgaaactccggctagactcaatagtaatccagcaggggagattggtagaccagaaccttaacaaaatcgggaaggatgaaatgctacagatgatcaggcacggtgccacacacgtctttgcctcgaaggaaagcgagatcaccgacgaggacattgatggtattttggagcgcggagcgaagaagaccgcggagatgaatgagaaactgtcaaaaatgggtgagtcatctttgcgcaatttcacaatggacactgagagcagcgtttataacttcgagggggaggattatagggagaagcaaaagatcgcttttaccgaatggatcgagcctccaaaacgcgagcgtaaagccaactatgccgtggatgcgtatttccgggaggccctacgggtttccgagcccaaggcccctaaggccccacgtccccctaaacagcccaacgtgcaagatttccaatttttcccacctagattattcgagctgttggagaaggaaatccttttctaccggaagactatcgggtacaaggtccccaggaaccctgaactaccgaacgccgcacaggcccagaaagaagaacagctaaagatagacgaagccgagtctctcaacgacgaggaactggaagagaaggaaaaactcctcacacaaggatttacaaattggaacaagcgggacttcaatcagtttatcaaggctaatgagaagtggggcagagacgacatcgagaacatagccagagaagtcgagggaaagaccccagaagaggtgatcgagtacagtgcggtcttttgggaacgatgtaacgagttgcaggacattgaaaagattatggctcagattgagagaggggaagccaggatccagcgaaggatttcaattaagaaggctcttgatacaaaaattggacgctacaaagccccatttcaccagctcagaatctcctacggaaccaacaaaggcaagaattacaccgaagaagaggaccgcttcctcatttgtatgctgcacaagttagggtttgataaagagaacgtgtatgatgagcttagacagtgtattcggaatagcccacagttcagatttgactggtttctgaagagtcgcaccgccatggaacttcagaggcggtgcaacaccttgattaccttgatcgaaagggaaaacatggaactagaagagaaagagaaggccgagaaaaaaaagagagggcctaagccgtcaactcagaaacgcaaaatggacggcgcacccgatggaagggggagaaaaaaaaagctcaaactctag

SEQ ID NO: 242969 - DNA, 2988 bp, Artificial Sequence
  Description of Artificial Sequence: Synthetic coding sequence
atggaagagatatttgacgatgcttcaccaggtaaacagaaggaaatccaggaaccagacccgacttatgaagaaaagatgcagacagacagggcaaatagatttgaatatctcctgaaacagacggaattgttcgcccatttcatacaacctgccgcacaaaagacccctacgtccccgctgaagatgaaacctggacgcccaaggatcaaaaaggacgagaagcagaacctcttgtccgtgggggattaccggcaccgcaggactgagcaagaggaagatgaggaactactgaccgaatccagtaaagcaaccaatgtatgtacccgtttcgaggacagcccctcctatgtcaagtggggcaaactgcgcgactatcaagtccgcggacttaattggcttatctccttatatgagaatggaataaatgggatcctggcagatgaaatgggcctgggtaagaccctgcagaccatatctctgttagggtacatgaagcattatagaaatatccctggccctcatatggtactggttccgaaatccacactgcacaattggatgtctgagttcaaaaggtgggtgccaaccctgagatctgtatgcctgattggcgataaggagcaacgggctgcctttgttagggacgtcctcctgcccggagagtgggacgtttgtgtcaccagctacgaaatgctgattaaggagaaaagtgtcttcaagaagttcaactggcgatacctggtgattgatgaagctcacagaattaaaaatgagaagagcaagctatctgaaatagtgcgggagttcaagacaaccaaccgccttctattaactggaaccccactacagaataatctgcatgagctttggagcctcctgaattttctgcttccagatgtattcaactccgctgacgattttgattcttggtttgatacaaacaattgtctgggggaccagaagctggtcgagcgattacacatggtcctgaggccctttcttctgcgtagaattaaagcggacgttgaaaagtcgctgcctcccaagaaggaggtaaagatctacgtggggctaagcaagatgcaacgggaatggtacacgaggatccttatgaaggatatcgacattctcaattcagcaggtaagatggacaagatgcgcctgctgaacatattaatgcaacttcggaagtgttgcaatcacccctacctgtttgatggggctgaacccggacccccttataccacagacatgcacctcgtgaccaactccggaaagatggtggtcttggacaaattgctgcccaagctgaaggaacaggggagtcgggtactgatttttagccaaatgacccgagtgctcgacatccttgaggattattgcatgtggagaaactacgagtattgtaggttagacggccagaccccacacgatgagagacaagattccataaatgcctacaatgagcctaacagcaccaaattcgtctttatgctgtctacaagggccggtggccttgggatcaatcttgcaactgcagatgtggttattctgtacgatagcgattggaacccccaggtggacttacaggccatggaccgggctcaccgtatcggacagaccaaaaccgtaagggtatttcggtttattaccgacaacacggtcgaagagaggatcgttgagcgtgcagagatgaaacttaggctagacagtattgtgatccagcaaggccgactcgtggaccagaacctgaacaagataggaaaggatgaaatgcttcagatgatccgccacggcgcaacacatgttttcgcgtcaaaggagtccgagattactgacgaggacatagatggaattcttgagcggggtgccaaaaaaacggcagagatgaacgagaagctgagcaagatgggagagtctagtctgaggaacttcacaatggatacagagagtagcgtgtacaattttgagggtgaggattaccgggagaaacagaaaatcgccttcaccgaatggatcgagcctccgaagagggagaggaaagctaattacgctgtcgacgcctactttcgggaggccctgcgggtgtctgaaccaaaagccccaaaggcccctcgtccccctaagcagccgaatgttcaggactttcagttctttccacctcggctgttcgaacttctggaaaaggagatccttttctatagaaaaaccatcggatataaagtgcctcgcaaccccgagttgccaaatgctgcccaggctcagaaggaggagcagttgaaaatcgatgaggcagagtctctgaatgacgaggaacttgaagaaaaggagaagctgctgacacaggggttcactaattggaacaagcgcgactttaaccagtttatcaaagcaaacgagaagtggggtagggacgacatcgagaacatagcccgagaggtggaaggtaagacgccagaggaagttatcgagtactcagctgtgttttgggagagatgtaacgaactgcaagacatagagaaaataatggctcaaatcgagcggggtgaggctaggatacaaagacgaattagtatcaagaaagctttagacaccaagataggaagatataaggcgcctttccaccagcttaggatctcctacgggacgaacaaaggaaaaaattataccgaagaggaagaccgatttctaatctgtatgttacacaagcttgggttcgacaaagagaatgtatacgatgagctgaggcagtgcatccgtaatagcccccagttcagattcgattggtttttgaaatcacggactgccatggaattgcagcgcagatgcaatacattaattaccctcatcgagagagaaaacatggagttggaagaaaaggagaaagctgagaagaaaaagagaggcccaaagccaagcacccaaaaacggaagatggacggggctcctgacggtaggggccgaaaaaagaagctgaagctctag

SEQ ID NO: 242970 - DNA, 2865 bp, Artificial Sequence
  Description of Artificial Sequence: Synthetic coding sequence
atgagcctgcccctaaccgaagaacagagaaagaagattgaagagaacagacagaaggcattagctaggagggccgaaaaactgctcgctgaacaacatcagcgaacttcttcggggacgagcattgccggtaatcctttccaagccaagcagggaccctcgcaaaacttccctagagagtcatgcaagcctgtgagtcacggcgtgatctttaaacagcagaatctctcgagctcctcaaatgccgatcagaggccacacgatagtcacagtttccaggctaagggcatttggaaaaagcccgaagaaatgcctactgcctgccctgggcacagcccgcgatcgcagatggctcttacggggatcagcccccctctggcacagtcaccgcctgaggttcccaagcagcagctcctaagctatgaattgggtcaaggccacgcccaggcgagccctgagattcggtttacaccatttgccaatcccactcataagcctctggctaagccgaagtcatctcaggagaccccggcacacagctcgggtcagcctccaagggatgccaagttggaggctaagactgccaaagcttccccatctggacaaaacatctcatatatccactcatcctctgagtctgtgaccccccgtaccgagggaaggctgcaacagaaatccgggtcatctgtgcagaagggagtcaactcccagaaaggtaagtgtgtcagaaacggcgaccggtttcaggtgctgatcgggtataatgctgagctcatcgctgtatttaagaccctacctagcaaaaattacgaccctgataccaaaacctggaattttagcatgaacgactactcagcgctcatgaaagcagctcagagcttgcccaccgtgaacctgcagccattggaatgggcctacgggtctagcgaaagcccatctacctcgtctgaaggacaggcagggttaccatcagcaccatcactgagttttgtgaagggaagatgtatgttgatatcccgcgcatactttgaggccgatatcagttattcgcaggacctgatcgccctgttcaagcaaatggattcaagacgctacgacgtgaaaaccaggaagtggagcttcttactcgaggagcattccaaactgatcgccaaagttagatgcctgccccaagtgcagctcgatcctctacccacaaccctaactctggcatttgcctcccagctgaagaagaccagcctctccctgactccagacgtgccggaggcagacctgtcagaggtcgaccccaaattggtatcaaacttgatgcccttccagagagccggagtcaatttcgctattgctaagggcggtaggttgcttttggctgatgatatggggctcggcaaaactattcaagcgatatgcattgctgccttctacagaaaggagtggccgctgctcgtggtggttccatcaagtgtccgatttacatgggagcaggcatttctgcgatggctaccctccctcagccccgattgcatcaatgttgtggttacaggaaaggacagattgactgctggccttatcaatattgtttcatttgacctgctaagcaagttggagaagcaactgaagactcctttcaaggtcgttattatcgatgaatctcattttttgaagaattcccggaccgcaagatgtcgagcagctatgcccgtgctcaaggtagctaagcgagtgatactgctgtccggtacccccgcaatgagtcgaccagccgaactgtacacgcaaattattgcagtcaaacccacattttttccacagtttcatgccttcgggttgagatattgcgacgccaagcgcatgccttggggctgggattattctggctcatccaacttaggggaactgaaattgcttctggaagaggcagtgatgctgaggaggctcaagtcagatgttctctcccagctgccagcaaagcagaggaagatcgtcgttatcgcacccggtcgcattaatgccagaactagggccgctctcgatgcagcagctaaggagatgaccacaaaagataagactaaacagcagcagaaggacgctctaatcttgttttttaatagaactgccgaagcaaagatccctagtgtgattgagtacatcctggacctgttagaatctggtagggaaaaattcctggttttcgcccatcataaagtggtcttagatgctatcacacaggagcttgaacgaaaacacgttcagcacatcagaatcgatggttccacttcttcagccgagcgcgaggatctgtgccaacaattccagctgtcagagcgtcacgctgtagccgtactatctattaccgcagcaaacatgggtctcacctttagcagcgcagatctcgtggtgttcgcggaactgttttggaacccgggtgtgctgattcaggccgaggatagagtccaccgcattggccaaacatcatcagtaggcatacactacctggtggcgaaaggcactgcagacgattatttatggcctctgattcaagagaagatcaaggtccttgctgaggccggtctgtccgagaccaatttcagtgaaatgacagagtccaccgattatctttataaagaccctaaacagcagaaaatctacgatctttttcaaaagagttttgagaaggaagggtccgacatggagttgctggaggcagctgagagtttcgaccccggttccgcttccggaactagtggtagctcctcacagaatatgggcgacacgctagacgagtcttctctcaccgccagcccacaaaagaaaagaaggttcgaatttttcgacaattgggattccttcacaagcccgctgtag

SEQ ID NO: 242971 - DNA, 2865 bp, Artificial Sequence
  Description of Artificial Sequence: Synthetic coding sequence
atgtctctgcccctgacagaggagcagagaaagaagatagaggagaaccggcagaaggccctcgccaggagggccgaaaagttgctcgccgaacagcaccagcgaacttccagcggaacttccatcgccggaaacccttttcaagcaaaacaggggccatcccaaaacttccctcgggagtcatgcaaacccgtgtctcatggcgtaatctttaagcagcaaaatctgagctcatcatctaacgcagatcagaggccacacgactcccactcatttcaagctaagggaatttggaaaaaacctgaggaaatgcccaccgcttgtcccggacatagcccgagatcccagatggctctaacaggtatatctccccctctggcgcagtcccctccggaagtgcccaaacagcagttgctgagctacgagttgggacagggccacgcacaggcttcaccagagattcgcttcaccccttttgcgaaccccacccacaagcctttggccaaaccgaaatccagccaagaaacacccgctcactctagcggccagcccccacgggacgccaagctcgaggccaaaaccgcaaaggccagtccttccggacagaacatttcttacatacacagctcgagtgaaagtgttacccccaggacagagggcagactccagcaaaaaagcgggtcctctgtacagaaaggagtgaacagccagaaaggcaaatgtgttagaaacggagacagattccaggtgttgattggttataacgctgagctgatagccgttttcaaaaccttgccgtccaagaattatgaccccgacaccaaaacctggaatttcagtatgaacgattacagcgcacttatgaaagctgcgcagtctcttcccactgtgaacctgcagcctctggaatgggcttatgggagttccgagagccccagcacaagcagcgaaggccaagcagggttgccaagtgctccgtccctgtccttcgtcaagggcaggtgcatgctgatcagccgggcatacttcgaggcggatatctcctatagccaagacctgatcgcgttatttaagcagatggattcaaggaggtatgacgttaagactaggaaatggagctttctgctcgaggagcattccaagttgattgctaaggttaggtgccttcctcaggttcagctggacccactgccaacgacactcaccctggccttcgcctctcagttaaagaagacctccctttctctgacccctgatgtcccagaagcagacctctccgaagtggacccaaagcttgtgtccaacctaatgccatttcagcgcgctggagtgaatttcgccatcgcaaaaggtggcaggcttttgctcgctgacgacatgggcctcggcaagacgatccaggcaatctgtatcgctgctttctatagaaaggagtggcctcttcttgtggtggtgccctcctctgtgcggttcacctgggaacaggcgtttctccggtggctgccctccctgtcaccagactgtataaatgtcgtcgtaactggcaaagacagactgactgctggattaatcaatatcgtgagttttgatcttctctctaagctcgagaagcagcttaagactccattcaaggtagtgatcattgacgagagccacttcttgaagaattcccgcaccgctagatgtagggctgctatgcccgtgttgaaggtcgccaaaagggtcattctcttgtctggaacacccgctatgagtcggcctgcagaactctacacccagataatcgctgttaagcccaccttcttcccccagttccacgctttcggtttaaggtattgtgacgcaaaaagaatgccttgggggtgggattattctggtagcagcaatctgggagagctgaaactcttactagaagaggctgtcatgctaagaaggctgaaaagtgacgtgcttagtcaactgcctgctaagcagcggaagattgtcgttatagcaccaggacgcatcaatgccagaacacgggcagctttggatgctgccgctaaagagatgacaacaaaagacaagacaaagcagcagcagaaggatgcgttgattctttttttcaacaggacggctgaagccaagatcccatccgtgatcgagtacatcctcgatctgctggagtcggggagagaaaagttcttggtcttcgcccatcataaggtagtcctggacgcaataacgcaggagctagaacgtaagcacgtccagcacatccgaattgacggttcaaccagctccgccgaaagagaagacctgtgtcagcaattccaactgagcgagagacatgctgttgccgtcttgtcaatcaccgccgctaatatgggattaaccttttcctcagcagatctcgtcgtatttgccgaacttttctggaaccctggcgttctgatccaggctgaagaccgggtgcaccgaataggacagacgtcatccgtgggcatccactacctggtggccaagggcactgccgacgactatctgtggccactgattcaggagaagattaaagtcctggctgaggcaggattgtccgaaacaaatttcagcgaaatgactgaatccacagattatctgtacaaggatcctaagcagcaaaagatatacgacctgttccagaagagcttcgagaaggagggatctgacatggagctcctggaggccgcagaatcctttgatcctggaagcgcatccggaactagtggaagctcgtcgcagaatatgggcgacacgttggatgaaagtagcctgacggcttccccacagaagaaaaggaggtttgagtttttcgataattgggatagttttacttctccgctatag

SEQ ID NO: 242972 - DNA, 60 bp, Artificial Sequence
  Description of Artificial Sequence: Synthetic coding sequence
atgagcctgcccctcacagaggaacagagaaaaaagatagaagaaaacagacagaagtag

SEQ ID NO: 242973 - DNA, 441 bp, Artificial Sequence
  Description of Artificial Sequence: Synthetic coding sequence
atgtctttgcccctcaccgaagagcagaggaagaagatcgaagagaatcgacaaaaagcacttgccaggcgggcagagaaattgctggcagaacagcatcaacggacatcttcaggaacatccatagccggaaatccgtttcaggctaaacagggcccaagtcagaattttcccagggaatcttgtaagcccgtgtcacatggggttatatttaaacagcagaatcttagttcttcctccaacgccgatcagcgtccacacgatagtcactcattccaggctaaggggatctggaaaaagcccgaggagatgcccaccgcttgtccaggtcactctccccgttcccagatggcccttacagggatctctcctcctctcgcacaatctccaccagaggtgccaaagcagcagcttctgagctacgagctgggacagggatag

SEQ ID NO: 242974 - DNA, 279 bp, Artificial Sequence
  Description of Artificial Sequence: Synthetic coding sequence
atgagcttgcccttgacagaagagcaacggaaaaagattgaggaaaatagacagaaagctttagccaggagggctgaaaaactcctcgccgaacagcaccagcgcactagcagcgggaccagcattgccggaaatccgttccaggctaagcaaggaccaagccaaaacttccctcgcgagagctgtaaaccagtttctcacggcgtgatcttcaaacagcaaaacttaagctcctcctccaatgccgaccaacgccctcatgacagtcactccttctag

SEQ ID NO: 242975 - DNA, 393 bp, Artificial Sequence
  Description of Artificial Sequence: Synthetic coding sequence
atgtctctcccgctcacagaggagcaaaggaagaagattgaggagaataggcagaaagccctcgccaggcgggctgagaaacttttggcagaacagcaccagcgaacttcttctggcaccagcatcgccggaaacccgttccaagcaaaacaaggaccgagccagaatttccctcgtgagtcttgcaaaccagtttcccacggggtgattttcaaacagcagaacctgtccagcagctcaaacgcagaccaacgccctcatgattctcattctttccaggccaagggcatctggaaaaagccagaggagatgcctacggcctgtcctggccacagtccacggagccaaatggccctgacgggaataagcccacctctggcccaatccccctag

SEQ ID NO: 242976 - DNA, 3318 bp, Artificial Sequence
  Description of Artificial Sequence: Synthetic coding sequence
atggcagcagcagcaggaggaggaggccctggaactgcagtcggagccacgggaagtggtattgcagcagcagctgccggactggccgtatacagacgaaaggatggcggtcccgcaaccaagttctgggagtctccggagacagtctctcaactggacagtgtgcgtgtgtggctcggaaagcattataaaaagtacgtacacgcggacgcccctactaataaaacattagcagggctcgtggtgcagttgttgcagttccaggaagatgcgtttgggaagcatgtgacgaacccagctttcaccaaattgccagctaagtgcttcatggattttaaagccggaggagcgctttgtcatatcctcggagcagcctataaatacaaaaacgagcaggggtggcggagattcgacctccagaatccttcccgtatggaccgtaatgtggagatgtttatgaacattgaaaagacccttgtgcagaacaattgtctgacgcgcccaaatatctatctgatcccagacatcgacttgaagcttgccaacaagctaaaagacatcattaaacgccaccagggtaccttcaccgacgaaaaatcaaaggcctcccatcatatttacccctactcctctagtcaggacgacgaggaatggcttagacctgttatgaggaaggagaagcaggtactggtgcactgggggttttacccagacagctacgacacgtgggtccatagcaatgacgtggatgcagaaatagaagatccgcctatccctgaaaaaccctggaaagtccacgtgaaatggatcctggatacagatatctttaacgagtggatgaacgaggaggattacgaagttgatgaaaatagaaagccagtgtcctttaggcagaggatttcaacaaagaatgaggagcccgtgcgatcccctgagcgtcgcgataggaaggcctccgctaatgcaaggaagcgcaagcatagccctagtccaccaccgcctacacctactgaatcacgcaagaagtctggcaagaaagggcaggcctcactctacggaaaaagacggagccagaaggaagaagatgaacaagaggatttaaccaaggatatggaagatcccacccctgttcccaatattgaagaagtagttctccccaaaaacgtcaatcttaaaaaggattccgagaacactcccgtgaagggcggaaccgtggctgacctggacgagcaagatgaagagacggtgacggccggaggcaaagaagatgaagacccggctaaaggcgaccagagtcgctctgtcgacctgggagaagacaatgtcacggagcaaacaaatcatatcatcatcccttcatatgctagctggttcgattataattgcatccacgtcatcgagagacgggcactaccagagttctttaacggaaagaataagagtaagacgcctgagatctatctcgcatacagaaattttatgatcgacacctatcggctgaacccccaggaatacctgacatcaaccgcatgcagaagaaacctcaccggtgacgtgtgtgctgttatgcgggtccacgctttcctagagcagtggggccttgtcaattaccaggtggaccccgagagccggccaatggcgatgggcccaccacccactccacactttaatgtcctcgcagacacaccttcaggactggttcccttacacctccgctctcctcaggtgcccgctgcccaacagatgcttaacttccctgagaagaacaaggaaaaacctgtcgacttgcagaatttcggactgcgaacggatatttactcaaaaaagacgttggctaaaagtaagggagcgagcgccggtagggagtggactgagcaagagactctgctacttttagaggccctcgagatgtacaaagacgactggaataaagtgtctgagcacgtgggatcgaggacacaagacgagtgtattctgcacttcctgaggcttccaatcgaagatccgtacctggagaacagcgacgcttcactggggcctctggcatatcagccggttcccttttcacagagcggcaatccagttatgagcaccgttgcgtttctcgcttctgtggtggaccctcgagttgcatcagccgcagctaaggcagcactcgaggaattttcacgggtgcgcgaggaggtccctttggagcttgtggaggcgcacgtgaaaaaggttcaggaggctgccagggcctcgggcaaggtcgatcccacctacggcttagagtctagttgtatcgcgggtaccggccctgatgaacctgaaaagctggagggcgcagaagaagagaaaatggaagccgaccccgacggacaacaacctgaaaaggctgaaaacaaggtggagaacgaaactgatgagggagacaaagcacaggatggagagaatgaaaaaaatagcgaaaaagagcaggactcggaagtgagcgaagacaccaagtccgaggaaaaagagacagaggagaataaggagctgaccgacacatgcaaagaacgtgaatcggacactggcaagaagaaagtggagcatgaaatatctgaggggaacgtggccacagccgcagccgctgctcttgctagtgcagctaccaaagctaaacatctcgctgcagtggaagagcgcaagattaagagcctcgtcgcccttctggtggagacacagatgaaaaaattggaaataaaactgcgacacttcgaagagctggaaaccatcatggaccgggagaaggaagccttagagcagcagcggcagcagctcttaacggagcggcagaatttccatatggagcagctgaagtacgccgagctcagggcccgacagcagatggaacagcagcagcacgggcagaatccacagcaagcacaccaacatagcggtggtcctggcctagctccgcttggagccgcagggcacccagggatgatgccacatcagcagcctcccccttatccactgatgcaccatcagatgcccccaccacacccaccgcagccaggacagatccccggacctggcagcatgatgcccggtcagcacatgccgggaaggatgatcccaacagtggccgcaaacatccacccatcgggatccgggcctacgccacccggtatgccaccaatgcctggtaacatccttggacctcgagtgccactgaccgcacccaacggcatgtacccacctccccctcaacagcagcccccacctcccccacctgcggatggcgtacccccacccccagctccaggacctccagcttcagcagcaccttag

SEQ ID NO: 242977 - DNA, 3645 bp, Artificial Sequence
  Description of Artificial Sequence: Synthetic coding sequence
atggccgtgaggaagaaggatgggggaccgaatgttaaatactacgaagctgccgacacagtcacccagtttgacaacgtccggctctggctgggcaaaaactataagaagtatattcaggccgaacccccaactaacaaatcactatcaagcctcgtggtccagcttctgcaattccaggaagaagtgtttggcaagcacgtgtctaatgctccccttacaaagctacccatcaaatgttttctagacttcaaggccggaggctcattgtgccatatcctggccgcagcatataaattcaaatccgaccagggttggcgacggtacgatttccagaacccctcccgcatggaccggaatgtcgagatgtttatgacaatcgaaaaatcactggtgcagaacaactgtctttcacgacctaatatctttttgtgccccgaaattgagcccaaactgctgggcaagttaaaggacatcatcaagcgacaccagggcactgtgaccgaagacaagaacaacgccagccacgtggtttaccccgtgccgggaaacctcgaagaggaggaatgggtccgtccggtaatgaaaagagataagcaggtgctgctgcactggggatattaccctgacagttatgatacctggatccccgcttctgagattgaagcctccgtcgaggacgccccaacacctgagaaaccgcgtaaggtgcatgccaagtggatcctagacacagacactttcaatgaatggatgaacgaagaggactacgaagtaaacgatgataaaaaccctgtgtcacgccgtaagaagataagtgcgaaaacgcttacagacgaagtcaactctccagatagtgataggcgtgacaaaaaagggggtaattacaagaagcggaagagatcgccatctccaagtcctactcccgaggccaagaagaagaacgcgaaaaagggtccctctaccccttacaccaaaagtaagcggggacaccgcgaggaagaacaagaagaccttaccaaggatatggatgagccgtcaccagtcccgaacgtggaagaagttactctgcccaagacagtcaacaccaaaaaggactctgagtccgcccctgtgaaggggggaaccatgacagatctggacgaacaggaagacgaatccatggagactacgggcaaggacgaggatgaaaactcgacggggaataagggcgaacagaccaagaatcctgatctccacgaagataatgtgactgaacagactcaccacattataattccgtcatacgcggcttggttcgattacaattccgttcacgccattgagcggcgtgccctccccgagttctttaacgggaagaacaagtccaaaacacctgagatttatctggcgtaccggaatttcatgattgacacataccgcttgaatcctcaggagtacctgacatcgactgcgtgtcgcaggaacctggccggagacgtttgtgccatcatgagggtgcacgccttcctcgaacagtggggactgatcaactatcaagtggacgcagagtctcggcctactcctatgggccctcctcccaccagccattttcatgtactggcagacaccccctcagggctcgtccccctgcaaccaaaaaccccccagcaaacatccgcgtctcagcaaatgctcaacttccctgacaaaggaaaagagaagccaactgacatgcaaaactttggactgcgcacggacatgtatacaaagaagaacgtgcccagcaaaagtaaagcagctgcctcagctacccgggagtggactgaacaagagaccctcctcctattagaagccctcgagatgtacaaggatgactggaacaaagtctcagagcacgtggggagtcgaacccaggacgaatgcatattacactttctgcggctgcccatcgaagatccttatcttgaagattccgaggctagtctgggtccactggcttatcaaccaatccccttttcccagtccggcaaccccgtgatgagtacagtggcttttcttgcaagcgtcgtcgatcctagggtagcgagcgctgcagcaaagtccgcactggaagaattcagcaaaatgaaagaagaggtgcccacagcgttagtggaagcccatgtacgaaaggtggaagaagccgctaaagttaccggcaaggctgaccctgcttttggtttagagtcttccggcatcgccggtaccacaagcgacgagcccgaacgtattgaagaatcggggaatgacgaggcaagggtcgaagggcaggccacagacgagaagaaagaaccaaaagaacccagagagggaggcggagccattgaagaagaggctaaagaaaaaacctcggaggctccaaaaaaagatgaggaaaaaggcaaggagggggactccgaaaaggagagcgaaaaaagcgacggcgatccaatcgtggatcccgaaaaggaaaaagagcctaaagagggccaggaggaggtgctgaaggaagttgtggagagtgaaggtgagcgcaagaccaaggttgaacgggatattggagaggggaatctcagcacggccgctgccgctgctcttgccgctgcagcggtgaaggcgaaacacctggcggctgtggaggaaagaaaaataaaatctctcgtcgcccttcttgtcgaaacacaaatgaagaaattggagataaaattaaggcatttcgaggagctggagacaatcatggacagggagcgcgaagctctggagtatcagcggcagcagttgctggctgaccgtcaggccttccatatggagcagttaaaatatgccgagatgcgggcacggcagcaacattttcagcagatgcaccagcaacagcagcagcccccacccgctctgccgccaggcagccaacctataccccctactggagcggcaggaccccctgcagttcacggcctggcagtcgctcccgcaagcgtggtccccgctcctgcaggcagcggagctccaccgggatcactgggcccatctgaacaaatcggtcaggcgggttctacagctggcccacagcagcagcaacctgctggcgctcctcaacctggtgccgtaccgcctggcgttccgccacctggtccacacggcccatctccattccccaatcagcaaacacccccaagtatgatgccaggagctgtgcctggtagcggacatcctggggtggcaggcaatgcacccctggggctgccattcggcatgcctcctccccctccacctccggcacctagcattatccccttcggctctttagctgattccatctcaatcaaccttcctgcccctcctaatctacacggccaccaccaccacctccccttcgcccctggtacactcccgcctccaaacctcccagtgtccatggctaatcccctgcatcccaacttgcctgccactaccaccatgccgtcttctctccctctcggccctggactgggctccgccgcagcccaaagtccagctattgttgccgctgttcaggggaatcttcttccctcagccagccccctgccagaccctggcacccctcttccccctgaccccacagccccttccccaggtaccgtcaccccagtgcctccaccccagtag

SEQ ID NO: 242978 - DNA, 3393 bp, Artificial Sequence
  Description of Artificial Sequence: Synthetic coding sequence
atggctgtccggaagaaagatgggggtcccaatgtgaagtattacgaggccgctgacacggttacacagttcgacaacgtaagactctggctgggaaaaaattacaaaaaatacattcaggcggagccccctacaaataagagtctgtcttccctggttgttcaactgttgcaatttcaggaggaagtgtttggaaagcacgtgtccaacgcccctctgaccaaacttcccatcaaatgttttctagattttaaggcgggtggctccttgtgccatatcctggccgctgcctataaattcaaatccgatcaggggtggagacgctacgatttccagaatccatctcgcatggatcggaacgttgagatgtttatgacaattgaaaaatcattagtgcaaaataactgtctctctaggccaaatatttttctgtgccccgaaatcgaacccaagcttctcgggaagttaaaagatatcattaaacggcaccaaggcacagttactgaagataagaacaatgcatcacacgtcgtgtaccctgtccccggaaacctcgaagaagaagaatgggtgagacccgtcatgaaaagggacaagcaggtactgctccactggggctattaccccgatagttacgacacatggattccagccagcgagatcgaggcctccgtcgaagatgcccctacaccagagaagcctaggaaggtgcacgcaaagtggattctggatactgatacgtttaatgagtggatgaacgaagaggattatgaggtcaacgacgacaagaatccggtgagtaggaggaagaagataagtgcgaaaactttgactgatgaggtgaattcacccgactccgatcgcagagacaagaagggaggcaactataagaagcgcaaacgcagcccgtctcctagtccgacccccgaggcaaaaaagaaaaatgctaaaaagggcccttcgactccatacaccaagagcaaacgcggacatagggaggaggaacaggaggacctgacaaaagacatggatgaaccctcccctgtgcccaatgtcgaggaagtaactctgcccaagactgtcaatacaaaaaaggacagcgagagcgccccagtgaaggggggaacaatgacagatcttgacgagcaagaagatgaaagcatggagacgacagggaaagatgaggatgaaaacagcacaggtaataaaggcgagcaaaccaagaatcccgacctccacgaggataatgtgaccgaacagacccaccacatcatcatcccttcctatgcggcatggttcgattacaatagcgtgcatgccattgaaaggagagcgctgccggagttcttcaacggaaagaataagtctaagacccccgagatctatctggcttaccggaacttcatgattgacacctataggttgaatcctcaggagtaccttacttcaaccgcgtgcagacggaaccttgccggagatgtgtgcgcaataatgcgcgttcacgcatttctggaacagtggggactgatcaactaccaggtggacgccgagtctcgccctacgccgatgggaccaccacccacatcccacttccatgtactggcagataccccaagcgggctggtgccactgcaacctaagacccctcaggggagacaggtggacgcggacacaaaagccggtcgcaaaggaaaagagctcgatgatttggtgccagagacagcaaagggcaagcccgagcttcagacctcagcttcccagcaaatgctgaatttccctgataaggggaaagagaagcctacagatatgcaaaacttcggactccggaccgacatgtacactaagaaaaacgttccttcaaagtctaaggctgcagcttccgctactcgcgagtggactgagcaggaaactctgcttctgctggaagcgctcgagatgtataaggatgattggaataaggtatcagaacatgtgggtagccgcacacaggatgaatgtatcctgcactttctgcgcttacccattgaagacccctatctggaggattcagaagcctctctgggacctctggcctatcagcctatacctttcagccaatcgggcaaccccgtgatgtcaacagtggctttcttggctagtgtagtagacccacgcgtcgccagcgcagccgctaagagcgccctggaagagttctctaagatgaaagaagaagtgcccacagctctggttgaagcccacgtgcgcaaggtcgaagaggcagccaaggtcacaggaaaggcggatcccgctttcggcctcgaatctagcggcatcgccggtaccacaagtgacgaacccgaacggattgaggaaagcgggaacgatgaggctagggtagagggccaggctactgatgagaaaaaggagcccaaagaacccagggaaggcggaggagccattgaggaagaagccaaggaaaaaacttctgaagcaccaaagaaagacgaagaaaaaggcaaggagggagacagcgaaaaggagtctgaaaaatcggacggggaccctatagtggaccccgagaaggagaaagaacctaaagagggacaggaggaggttttaaaggaagtggttgagtctgaaggcgaacgaaagacaaaagtggagagggatattggagaaggcaatctgtcaactgcggcagccgctgccttggccgctgctgctgtgaaggcaaaacacctggctgccgtggaagaacggaaaattaagtcattagtggctctgctggtggagacgcagatgaagaaactggagattaaactgcggcactttgaggaactggaaacaattatggatcgtgagcgggaagccttggagtatcagagacagcagttgctggccgacaggcaagctttccacatggagcagttgaagtacgcagagatgcgcgcacgccagcaacacttccagcagatgcaccagcagcagcagcagccgccaccagctctgccaccgggaagccagcccattccaccgaccggcgctgccggaccaccggctgtgcatggcctcgccgtggccccagctagcgtcgtcccagcaccagctggatctggcgctccacccggaagcctcgggccttcggaacagattggccaagccggatcaacagccggaccccagcagcaacagccggcaggcgcacctcagcccggtgccgtccctcccggagtgccgcctccgggacctcatggtccttccccttttcccaaccagcagacccctcccagcatgatgcccggagctgtgccaggctccggccatcctggagtagctgatcctgggacaccactgccccctgaccccacagccccatctcctggaactgtaacccctgtaccgcctccgcagtag

SEQ ID NO: 242979 - DNA, 3459 bp, Artificial Sequence
  Description of Artificial Sequence: Synthetic coding sequence
atggctgtcaggaagaaagatggcggaccaaacgttaaatactatgaggcagccgataccgtgactcagttcgacaacgttagattgtggcttggaaaaaattataagaaatatatacaggccgaacctcccacgaacaagtctctatcctctttggtagtacagcttctgcaatttcaagaagaggtgttcggcaaacatgttagtaacgcacccctcacaaagttacctatcaaatgtttcctggactttaaggccggtggcagcttgtgccatatactcgcagccgcttacaagtttaagtccgaccaaggttggcggaggtacgatttccagaatccctcaaggatggaccggaatgtagagatgtttatgactatagaaaagtcgcttgtgcaaaacaactgcctaagtaggcccaacatctttttgtgtcccgagatcgaaccaaaactcctggggaaactgaaggacattatcaaacgccaccagggaacagttactgaggataaaaataatgcaagccacgtggtgtatcctgttcctgggaaccttgaagaagaggaatgggtgagaccagtcatgaaacgagataaacaggtgctattgcattggggatattatcctgattcatacgatacatggattcccgctagtgagatagaggcctccgttgaagacgcgccaacacccgaaaagccaagaaaggttcacgctaaatggatcctagatactgacaccttcaacgagtggatgaacgaagaggactatgaggtgaacgatgataagaatcctgtgagcaggcgcaaaaaaatcagtgcaaaaacgttgacagatgaagtgaacagtcctgacagtgaccggagggacaagaagggcggaaactataaaaaacggaaacgcagcccgtccccctcccccacccctgaagccaagaagaaaaacgcaaaaaagggtccatctaccccttacactaaaagcaaacgaggacatagagaggaggagcaggaggatttaactaaggacatggatgagccatctccagtaccaaatgtcgaggaagttacacttccaaaaaccgtcaacaccaaaaaagactccgagagcgcacccgtgaaagggggaaccatgacagacctggacgaacaagaggacgagagcatggagaccacaggcaaggatgaggatgagaatagcactgggaacaagggcgaacagacaaagaatccagacctgcacgaggacaacgttactgaacagacgcaccacattattataccttcgtacgctgcttggtttgattacaacagcgtgcatgcaatagaacggagggccctccctgagttttttaacggaaaaaacaaaagcaagactcctgaaatatacctcgcttaccgcaactttatgatagacacttatcgactgaaccctcaggaatatctgaccagcactgcgtgtagacgcaacctcgcaggagatgtctgcgccatcatgagggtccacgcctttctagaacagtgggggctgatcaattatcaagtggatgctgaatcacgccctacacccatgggacccccaccaacgtcccacttccacgtgctagcggatactccatccggtttagtccctctccaacccaagaccccccagggcaggcaggttgatgccgatacaaaggcaggacgcaaggggaaagaactggacgacctggtgcctgaaaccgctaagggcaagcctgagttacagacctccgcctctcagcagatgctgaatttccctgacaagggcaaggaaaagcccactgacatgcagaacttcggcctgaggaccgacatgtacaccaagaaaaatgttcccagtaagtcaaaagcagcagcaagtgccactagagagtggaccgagcaggagacactgctgctgctggaggcactggaaatgtacaaagacgattggaacaaagttagcgagcatgttgggagcagaacacaggatgaatgtatcttacactttctgcgcctgcccatcgaggatccctatttggaggattccgaggcttccctcgggcctttggcttaccagccaatcccctttagccagagtggaaacccagtgatgtctaccgtggccttcctcgcctctgtggttgatccgcgagtggcgtcagcggcagctaaatccgctctggaggaattttcaaaaatgaaagaagaagttccgacagcactcgtggaagcccatgttaggaaggtggaggaggcagctaaagttacgggaaaggcggaccctgcatttgggttagaatcttccggtattgccggaaccacctctgacgagcccgagcgcattgaagagagtggcaatgacgaggccagagttgaagggcaggccacagatgaaaaaaaggaacctaaggaacccagagagggaggaggagccatcgaagaagaagccaaagaaaagacgtctgaagccccaaagaaggatgaagaaaaaggtaaagaaggcgatagcgaaaaggaatccgaaaagtcagatggagacccaatcgtggatcccgagaaggagaaagaaccaaaggagggacaagaggaggtgttaaaggaagtggtggaatccgaaggtgagagaaaaacaaaggtggaacgtgatattggtgagggcaacctgagtacagccgctgctgcagccctcgccgctgcagctgtgaaagccaaacacctggccgcagttgaagagagaaagatcaagagtttggtggctctgttagtcgagacccaaatgaagaagctagagataaaattgaggcacttcgaggagctggagacaataatggatagagaaagggaggccctcgagtaccagaggcagcagctgctggctgacagacaagcatttcacatggagcagttgaagtacgctgaaatgcgggctaggcagcagcattttcagcagatgcatcagcaacagcagcaacctccaccagccctccccccaggttctcagccgattccacccaccggcgctgccggacccccagccgttcacggtctcgcagtggctccagcaagcgtggtgccagctcccgcaggaagtggggctccgcctggtagtctcgggccttctgagcagattggccaggcgggatccacggcaggcccacagcagcagcaacccgctggcgcaccacagccaggagccgtgccacccggagtgccgccacctgggcctcacgggcctagccctttcccgaatcagcagacacctccgtccatgatgccaggggcagtccctggtagtggtcaccccggagtggccgcacaaagccctgctattgtagctgccgttcaagggaacctgctgccgtccgcttcgccgctccctgatcccggtaccccactgccgcctgacccgacggctcccagccccggaacagtgacccccgtaccacctccccagtag

SEQ ID NO: 242980 - DNA, 1425 bp, Artificial Sequence
  Description of Artificial Sequence: Synthetic coding sequence
atggctgccagggcgggatttcagagtgtggctcccagcggcggagctggcgctagcggcggtgctggggctgctgctgctctcgggcctggcggaacacccggacccccagtgaggatggggccagcacccggtcagggcctttaccggtcccccatgcccggagctgcctaccctcggccaggcatgctgccaggaagtcgcatgactcctcaaggtccttccatgggccctccaggctacggcggtaatccctctgtcagacccggtcttgcccagtctggtatggaccagagccgcaaaaggcctgcccctcagcaaatccagcaggtccagcagcaggccgtgcagaacaggaatcacaatgcaaagaaaaaaaaaatggccgataaaatcctgcctcaacgtataagggagctggtgccagagagtcaggcgtacatggatctgttggcctttgaaaggaaacttgatcagaccattatgcggaaaaggctcgatatccaggaggctcttaagaggcccatcaagcagaagagaaagctcaggatattcatctctaatactttcaatcctgcaaaaagcgatgccgaagacggtgaaggcaccgtggccagttgggaactgagagtcgaagggcgactgctggaggacagcgccttgtctaagtacgacgcaaccaagcagaaacggaagttttcgtccttctttaaaagcttggtgatcgagctcgataaggacctatacgggccagacaatcacttggttgaatggcataggacagctacaacacaagagactgatggttttcaagttaagaggcccggagacgtgaatgtgagatgtactgtcctgcttatgctggattaccaaccaccccaatttaagttggacccgaggctggccagactgctgggcatccatactcagacacggccagtcatcatccaggctctgtggcagtatataaagacacacaagctacaggatccacatgagcgggaattcgttatatgtgacaagtatttacagcaaatcttcgaaagtcaacgtatgaagttttcagagataccacagaggcttcacgccttgctgatgccccctgagcctatcatcatcaaccacgtgatatcggtagatccaaacgaccagaaaaagaccgcgtgttatgacatagacgtggaagtggatgatactctcaagacgcagatgaactctttcctcctgagcactgcatctcaacaagagatagcaaccctcgacaacaagactatgacagacgtggttggaaatccagaagaggaacggagggccgagttctactttcagccctgggcacaggaagctgtgtgcagatacttttactctaaggttcagcaacggaggcaagaattggagcaggcgctgggaataaggaacacttag

SEQ ID NO: 242981 - DNA, 1548 bp, Artificial Sequence
  Description of Artificial Sequence: Synthetic coding sequence
atggccgctcgcgctggatttcagtcagttgcgccttccggaggcgctggcgcttctggcggagcgggagctgccgctgcccttggacccggtgggacaccaggcccaccagtacggatgggaccagccccaggccaaggcctataccgctcaccaatgccaggggcagcataccctcgccctgggatgctgcccggatcacggatgactccccaaggtccatccatgggcccacctggatacggcggaaatccctcggtgagaccgggtctggcccagtcaggtatggatcaaagccgtaaacgcccagcgcctcaacagattcagcaggtgcaacagcaggccgtccaaaatcgcaaccataatgctaagaaaaaaaaaatggccgataaaattttaccccagaggattagggaactggtcccagagagtcaagcgtatatggatctcttagcgttcgagaggaagcttgatcaaacaatcatgcgcaagaggcttgacatacaggaagcactcaaacgccctattaagcagaaacgcaaacttaggatttttatttcaaacactttcaaccccgcaaaatctgacgccgaggatggcgagggtacggtcgcctcttgggaattgcgagtagagggacggctgctggaagattcagctctgagcaaatacgacgccaccaaacaaaaacggaagtttagcagcttttttaaatctctggtcattgagctggataaggacttgtacgggccagataaccatctggtggaatggcaccggaccgcaactacccaggagacagatggatttcaagtcaaaagacccggagacgtgaacgtaagatgcacagtgctgctgatgctggattatcagcctcctcagtttaagcttgaccctcgcttagcgagactgctggggatccatacccagacaaggccagtcatcattcaggccctgtggcagtatattaaaactcataagctgcaggatccacatgagagagagttcgtgatatgcgacaagtatctgcagcagatttttgaaagccagcgcatgaaattttctgaaattccccaacgtcttcacgccctgctgatgccaccggagcctatcattatcaaccatgtcatctctgtcgacccaaatgaccaaaaaaaaaccgcttgttacgatatcgatgtggaagtggacgacactctgaagacacaaatgaattcctttctgctctccacagccagccagcaggaaatcgccacccttgacaataaaattcatgaaaccatagaaaccatcaaccagctgaaaactcagcgcgagttcatgctgtccttcgcaagagatccgcagggttttatcaatgactggctccaaagccagtgcagggacctgaagactatgacagacgtagtcgggaatcccgaggaagaacgcagagccgagttttatttccagccgtgggcccaggaggctgtgtgtaggtacttttatagtaaggtccagcagaggcgtcaggagctcgagcaggcccttggtataagaaatacttag

SEQ ID NO: 242982 - DNA, 876 bp, Artificial Sequence
  Description of Artificial Sequence: Synthetic coding sequence
atgatgcctctcaacaagcggggatcttcccttccctttaaatctcttgtgatagaactagacaaagatttgtacggccctgataatcacctggtggaatggcacaggacagccacaacccaagagactgacgggttccaggtcaagcgtccaggcgatgtgaacgtgcgctgtactgtcttacttatgctcgattaccaaccccctcagttcaaattggacccaagactggcacgtctcttgggcattcatacccagacccggcctgttatcatccaggccctgtggcagtacatcaaaacccacaaactgcaggaccctcatgagagggaattcgtgatttgtgacaagtatctgcagcagatcttcgaaagtcagaggatgaagttctcagaaatcccacagaggctacacgccctcctaatgcctccagaacccattattataaatcatgtgatctccgtggacccaaacgatcagaagaaaacagcttgctatgacattgacgtagaggtagacgataccctgaaaactcagatgaatagtttccttctgtcaaccgcaagccagcaagagattgccaccctggataacaagatacacgagaccattgagacgataaaccaattgaaaactcaacgagaattcatgttgagctttgctagagatcctcaagggttcatcaatgactggctccaatcccaatgccgcgatcttaaaactatgacagatgtggtgggaaatcctgaggaagagagacgcgctgagttctatttccagccatgggcacaggaagcagtatgccggtacttttactccaaggtgcaacagcgcaggcaggaactggaacaggccctggggatcaggaatacttag

SEQ ID NO: 242983 - DNA, 1362 bp, Artificial Sequence
  Description of Artificial Sequence: Synthetic coding sequence
atgtctaagattagcgaggcagtcaagagggcacgcgctgctttcagctctggaaggacacgcccactacagtttaggatccagcagctggaagcgctccagcggctgattcaggagcaagagcaggagttagtcggtgctctggccgctgatttgcataagaatgaatggaacgcttattacgaggaagttgtctacgtgctcgaggagatcgagtacatgatccagaagctccccgaatgggccgctgatgaacccgtggagaagaccccccagacccaacaggatgagctctacattcactcagaacctctcggcgtcgtcctggtgatcggcacttggaattatcccttcaacctcaccatccagcctatggtgggcgcaattgcagcaggaaatagcgtggtgctcaagccaagtgagttatcagaaaatatggcctccctcctggcgactataatcccccagtacctcgacaaagacctgtaccctgtcatcaatggcggtgtcccagagacaaccgagctcctcaaggagcggtttgatcatatcctgtacacgggttccacaggcgtgggaaaaattatcatgacagcggctgccaagcacctcacccccgtgactcttgagcttggcggtaaaagcccttgttacgttgacaaaaactgcgatttggacgtggcatgcagacgcatcgcgtgggggaaattcatgaacagtgggcaaacttgcgtcgccccagattacattctctgtgatccttccatccagaatcagatcgtggaaaaattaaagaaatcactgaaagagttttatggggaggacgcgaaaaaatcacgggactatgggcgaatcatttctgctcgtcacttccaacgggtgatgggtctgatagaggggcagaaagtggcatatgggggaaccggggatgccgctacacggtatatagctccaacaatcctcacagacgtggatccacagtcacctgtgatgcaggaagaaattttcggccctgtgctgccgatcgtatgcgtgcgcagccttgaagaagctatccagttcatcaatcagcgggagaaaccactcgctctctatatgttctcaagtaacgataaggtaatcaaaaagatgatagcggagaccagcagtggtggggtcgccgctaacgatgtgattgtgcacattacactgcacagcctgccattcggcggagtgggcaattccgggatgggctcctatcacggtaagaaatccttcgaaacgttttcacaccggcgatcttgtttagtgagaccacttatgaatgacgagggtctgaaagttagatatccgcctagcccagcaaaaatgacccagcattag

SEQ ID NO: 242984 - DNA, 1452 bp, Artificial Sequence
  Description of Artificial Sequence: Synthetic coding sequence
atgggccgtcgagtgggcgtagaggtgactcccagatgggctccacagaaatgtcagggagcgagaccgcagcgacccggtatgtcacctggtaatcggatgcccatggccggactgcaggtcggtcccccagccggatctcctttcggggcagcggctcctctgcggcctggaatgccacccaccatgatggatccctttaggaaaagactactggtgccacaggctcaacccccaatgcccgctcaaagacggggactcaagagaagaaagatggcagacaaagtcctgccacaaagaattcgggagctggtgccggagagccaagcctacatggatctgctggccttcgagcgtaagcttgaccagacaatagccagaaagcgaatggaaatccaggaggctattaaaaagccattgacgcagaagagaaaactgcggatctatatctctaacacctttagcccgtccaaggcagagggtgactctgccggaaccgctgggacaccaggaggcacgcccgctggagacaaagtagcatcctgggagctaagagtagagggcaaactgctggatgatccatcgaaacagaaaagaaagttctcttcttttttcaaaagcttggtgatagagctggacaaggagctgtatggccctgataatcacctcgtggagtggcacaggatgcccactacgcaagagacagacggtttccaggttaaaagaccaggagatctgaatgttaagtgcactctgctgttaatgttagaccaccagcccccacagtataaactcgatccccgactggcaaggctgcttggagtgcatactcagacgcgagccgctatcatgcaggccctctggctgtatattaagcacaaccagctgcaggacggtcatgagcgagagtacatcaactgcaataggtattttagacagatcttttcctgcggcagattgcggttctctgagattccaatgaagcttgcaggccttctccagcaccctgaccccattgtcataaaccacgtgatatcagtggatccaaatgaccaaaagaagacagcctgctatgatatagacgtggaggttgacgacccactaaaagctcagatgagcaacttcctggctagtacgacaaaccagcaagaaatcgctagtctggacgtgaaaatccatgaaaccatcgagagtatcaaccaacttaaaacccagagagattttatgttgtcattcagcactgatccccaagacttcattcaggagtggctcagatcccagaggcgcgacttaaagatcattaccgacgtgatcggaaatccggaggaagaacggagagcagctttctaccatcaaccttgggcccaagaggcagtgggcaggcatatctttgctaaggttcaacaaaggaggcaggagctggaacaggttctgggtattaggcttacctag

SEQ ID NO: 242985 - DNA, 1596 bp, Artificial Sequence
  Description of Artificial Sequence: Synthetic coding sequence
atgtcaggtagaggtgccggaggctttccgctcccccctctgtcgcctggaggaggagctgtcgctgccgcacttggcgcaccgcctcccccagcaggcccaggaatgctcccaggcccagcactccggggaccagggcctgcgggtggggtcggcggtcccggtgctgccgcttttagaccaatggggcctgccggacccgctgcccaatatcagcgacctggaatgtcccccggaaacagaatgcccatggccggactccaagtggggccaccagctgggagcccatttggtgccgcagctccactgcgacctggaatgcctccaaccatgatggacccctttaggaagcgccttttggtgccccaagcccagccccctatgcccgcacagaggcgcggactgaagagaaggaagatggcagataaggtcctgcctcagcggattcgcgagttagtgcctgagagccaggcttatatggatctgcttgcctttgaaagaaagctggatcaaacaatcgccaggaagagaatggagatccaagaggcgattaaaaagcctcttacccagaaaagaaaacttaggatttatatttcaaacacgttctccccatcaaaagcagaaggggacagtgccggtactgcaggcaccccaggcggaacacccgcaggcgataaggtggcatcatgggaactgcgcgtcgaaggcaaactgctggacgacccttccaaacagaagcggaaatttagctcttttttcaaatctctggtaatcgagctggacaaggaactgtatggaccagataatcacctggtggaatggcatagaatgcctaccactcaggaaaccgatggcttccaggtaaaaagacctggcgatctcaacgtgaaatgcacactgctcctgatgctcgatcaccagccgccacaatacaagctcgacccacgcctggcaaggctgctgggggtccacacacagacgagggcggctatcatgcaggctctgtggctctacattaaacacaaccagcttcaggacgggcatgaacgcgaatatattaactgtaacagatatttccgccagattttcagctgcgggaggctgaggttctctgagattccgatgaagttggcgggattgctacagcatcccgatcccatagtcattaatcacgtgatttctgtagacccaaacgaccagaagaagaccgcctgttacgatattgacgtggaggtagacgacccgctgaaagctcagatgagtaacttcctggcttcaaccacaaatcagcaggaaattgctagccttgatgtcaaaatccacgaaactatcgagtctattaatcagttgaagacccagcgggactttatgttgtcattcagcacagacccacaggatttcattcaggagtggctgaggtcccagagaagggacctgaaaatcattaccgacgttatcggtaaccctgaagaggaacgacgcgctgccttctatcaccaaccatgggctcaggaggctgttggccgacacatctttgccaaggttcagcagcgccgacaagagttggaacaggtgctcgggatcagacttacatag

SEQ ID NO: 242986 - DNA, 1485 bp, Artificial Sequence
  Description of Artificial Sequence: Synthetic coding sequence
atgtcggggcgaggagccggtggattccctcttcctccgctttcgccgggtggcggtgccgctttcaggcccatgggaccagccggtcccgcagcccagtaccagaggcctgggatgtcccctggaaataggatgcccatggctggccttcaggtgggaccaccggctggcagccccttcggcgctgctgctcctcttcgccctggtatgcctccaactatgatggaccccttccggaaaaggttacttgtgcctcaggcccagcctccaatgcctgcccagcgccgtggcctgaagcgcagaaagatggcagacaaggtactccctcaaaggatacgtgagttggtgcccgaaagtcaggcttatatggatctgctcgcttttgagagaaagttagatcagaccatcgctaggaaacgcatggagattcaagaggccattaagaagccattaactcaaaagaggaaacttaggatctatattagcaacacctttagccccagcaaagccgagggcgattctgccggtaccgccggaacgcccggtggcactccagctggggacaaagtcgcatcttgggagcttcgcgtggagggaaagctattggacgacccgagcaaacagaagcggaaattttcctccttctttaagtctctggtgatcgagctggacaaggaactgtacgggccagacaatcatctggtcgagtggcaccgtatgccgacgactcaggagaccgatgggtttcaggtaaagaggcctggcgatcttaacgtcaagtgtactctgttactcatgcttgaccaccagccaccacagtataaattggaccccagacttgcccgactcctgggcgtgcacactcagactagggcagctatcatgcaggctctatggttatatatcaaacacaaccaactgcaagacggccacgagagagagtatatcaactgcaaccgttacttcaggcaaatcttttcttgcgggagactacggtttagtgagattcctatgaaactggcaggtttgcttcaacacccagatcctattgtgataaaccacgtgatcagcgtggaccctaacgatcaaaagaaaaccgcctgttatgatatagacgtcgaggtggacgacccacttaaggcacagatgagtaatttcctggcttccaccacaaaccagcaagagatagccagtctggacgtgaagatacacgagacaatcgagtctattaatcaactgaagacccagagagactttatgctgtccttctcaaccgaccctcaagacttcatccaggaatggctccgttcccagcgacgcgacctgaaaatcatcactgacgtaataggcaatcctgaagaagagcgacgcgctgcattctatcaccaaccgtgggctcaggaagccgtggggaggcacatattcgctaaggtccagcaacggaggcaggagcttgagcaggttctgggtatccgcctgacgtag

SEQ ID NO: 242987 - DNA, 1452 bp, Artificial Sequence
  Description of Artificial Sequence: Synthetic coding sequence
atggccgctgatgaggttgcgggaggggcacggaaagccaccaaatcaaagctgttcgaatttctggtccatggcgttaggccaggcatgcctagcggagccagaatgccacaccagggggcaccaatgggaccacctggatccccttacatgggctcccctgccgttcgcccagggctggcgcctgcaggtatggagccagccagaaaacgcgcagcaccccctccgggtcaaagccaggcacagagtcaaggtcagcccgtgccaacagcgccagcgagaagcaggagcgctaaaaggaggaaaatggctgacaagatcctgccccagaggattagggagttagttcctgaatcacaggcgtacatggatctcctggccttcgaaagaaaactcgaccagacaatcatgaggaagagagttgatatccaggaggccctgaaaaggcccatgaaacagaaaaggaaactgcgcctttatatctcaaacacctttaaccctgcaaagccagacgctgaagacagcgacggatccatcgcaagttgggagctcagagttgaggggaaactcctggacgatccgagtaaacagaaacggaagttctcgtccttcttcaagagtctggtgatcgaactcgataaagacttgtacggaccagataatcatctggtcgagtggcaccgtacgcccactacacaagagacagatgggttccaggttaagagaccgggagacttgagcgtgcggtgtactttactgctcatgctcgattatcagccgccacaatttaagctggacccgcgattggcacgtctgctgggcctccacacccagtccaggagcgccatagtccaggcactgtggcagtatgtgaaaacaaaccgactccaggattcacacgataaggagtatataaacggtgacaagtactttcagcagatatttgactgcccacggcttaagttctcagaaattccccagcgcctgacagcgctgcttcttcccccagacccaattgttatcaatcacgtaataagcgtggatcccagtgatcaaaagaaaacagcctgctacgatattgatgtagaagtagaagagcccctgaaagggcaaatgtcatcttttctgctctccacagccaatcagcaggagatcagcgccttggacagcaagatacacgaaacaatagagagcatcaatcagctcaaaattcaacgggatttcatgctaagcttctctcgggaccctaaaggatacgtccaggacttgctccgctcacaaagtagagatcttaaggttatgacagacgtggctggcaatcctgaagaagagcgtcgggctgagttctatcaccaaccttggtcacaggaagcagtgagtagatacttctactgcaagattcagcaacgtcgccaggaactagaacagtctttggttgtgcgcaacacctag

SEQ ID NO: 242988 - DNA, 1308 bp, Artificial Sequence
  Description of Artificial Sequence: Synthetic coding sequence
atgacacctggtctgcagcatcccccaacagtggttcagaggcctggcatgccaagcggcgctagaatgccacaccagggagccccaatgggacctcccggatccccttacatgggctcccctgctgccccagctaggtcccgttctgccaagagacgcaagatggcggataagattctgccccagaggattagagagctggttcccgagagccaagcatatatggacctgctcgccttcgaacgcaagctggaccagaccatcatgcgaaagcgggtggacattcaggaagctctgaagcggccaatgaaacagaagagaaaactgcgcctctacatctccaacacatttaaccctgccaaacctgacgctgaggattccgatggatccattgcctcctgggagctgagagtggagggcaagctgttggacgatccttctaagcagaagaggaagttcagttctttcttcaagagtctggtcatagagttagataaggacttgtacggacccgacaatcatcttgtggagtggcacagaactcccacaacacaagaaaccgacgggttccaggtcaagcggccaggcgacttgtcagtgaggtgtacacttctgctgatgctcgattaccaacccccacagtttaaactagatccacggctcgcccgattgctgggtttacacacacagtcaagatccgcgatagttcaggcactgtggcagtatgtgaaaacaaaccggttacaagactctcatgataaggagtacatcaacggcgataagtactttcagcaaatatttgattgtccacgtttaaagttctccgagatcccacagaggctgactgcgctgctcctcccaccagatccaattgtgattaatcatgtcattagtgtcgatccatccgaccaaaagaaaaccgcttgctatgacattgatgtcgaggtcgaggagcctctaaagggacagatgagttctttcctgctgtccacagcaaaccagcaggaaatttccgcattggactctaagatccacgagaccatcgaatctatcaatcagctcaaaatccaaagagattttatgctctccttttcccgtgaccccaagggttatgtgcaggacctcctgagatcccagagcagagacctgaaggtgatgacagatgtcgctggcaacccagaggaagagaggagagctgagttctaccatcagccgtggagccaggaagcagtgtcacggtacttctactgcaagatacaacagcgtagacaggagcttgagcagagcctagtggttcgtaacacttag

SEQ ID NO: 242989 - DNA, 1413 bp, Artificial Sequence
  Description of Artificial Sequence: Synthetic coding sequence
atgaccccgggtctgcagcaccccccaactgtggtccagagacccggaatgccgtcaggcgctcgtatgccccaccaaggcgcacctatgggccctcctggctcaccctatatgggaagcccggctgttcgaccaggactggccccagctggtatggaaccagcccgaaaacgggcagccccaccccctggtcagagccaggcccagtcgcagggtcagcccgtacctacagcgccagcaaggagccggtccgccaaacgaaggaaaatggccgacaagatactcccccagcggataagggaactggttccggagtctcaggcctatatggacctgctggcctttgagcggaagttagaccagactatcatgcgcaaaagagtcgatattcaggaggccctgaaaaggcccatgaagcagaagcgcaaactgcgcttgtatatcagcaacaccttcaaccctgcgaagccagatgcagaggacagtgacggatcaatcgcatcatgggagcttagggttgaaggaaagctattggatgatccgtctaagcagaaaaggaagtttagcagtttttttaaatccctggtcatcgagctggataaggacctgtacggtcctgataaccacttggtcgagtggcaccggactccgactacacaggaaaccgatggattccaagtcaaaaggcccggagacctgtcagtacgatgtaccctgttgctgatgctggactaccaaccaccccagtttaagctggatcccaggttagccagacttctggggttgcacacccagtcacgctccgcaatcgtccaggcgttgtggcagtacgtgaaaaccaatcggttgcaggactctcacgataaggagtatattaacggcgacaagtattttcaacagatctttgactgtcctcgacttaaattcagcgaaattccacagagactaacggctcttctgttaccgcctgaccctattgtgatcaatcatgtgatttctgtagatccatccgaccagaagaaaaccgcctgctacgatattgacgtagaagttgaggagcctctgaaagggcagatgagtagttttctcctgtcgactgcaaaccaacaggagataagtgctttagattccaaaatacacgaaaccatcgaaagcattaaccagctgaagatccagagagacttcatgttgagcttctctagggatccgaagggctatgttcaggatttgctacggagtcagagtagagatctgaaggtcatgacagatgtcgccggaaaccccgaagaggagcggagagccgagttttaccaccagccctggtcacaagaagcagtaagtcgctacttctactgtaaaattcagcagcgacggcaggaactagagcagtcactggtcgtgaggaatacctag

SEQ ID NO: 242990 - DNA, 1413 bp, Artificial Sequence
  Description of Artificial Sequence: Synthetic coding sequence
atgactcccggattgcagcaccctcctacggtggtgcagcggcctggcatgccatctggggctcgaatgccccaccagggtgctccaatgggcccacccggatccccctatatgggatctcctgcagtgcgcccaggtctggccccagcaggaatggagccggctagaaaaagggccgctcccccaccaggtcagtcacaggcacagagtcagggtcagcccgtgccaacagcacctgcacggtctaggtcagctaagcgccgaaagatggccgacaaaatcttgccacaaaggattagagaactggttccagaaagccaagcatacatggatctcctcgcctttgagaggaaactggaccagactattatgagaaagagggtggacatccaggaggccttgaaacggccaatgaagcagaaaagaaagttgaggctctacatttcaaacacctttaatcccgctaagccagacgcggaggactcagacggcagtattgccagttgggaactgcgcgtggaaggcaagctgttggatgatccatctaaacagaagagaaaattcagttctttctttaagagcttggttatcgaattggataaagacttgtacggcccagataatcacctcgtggagtggcaccgcacacctactacccaagagactgacgggttccaggtgaagagaccaggcgaccttagcgtcaggtgtactctactcctcatgcttgactaccagcctccacaatttaaactagatcctcggctcgcacggcttctgggtcttcatacccagagtagaagtgccatagtgcaggctctgtggcagtacgtcaaaaccaaccgcctgcaagatagtcatgataaagagtatattaatggcgacaagtactttcagcagattttcgactgccctcggcttaaattttctgagatcccacaacgcctcacagccctcttgttgccccctgaccccatagtgatcaaccatgtcatatcagtcgacccaagcgaccagaagaagaccgcctgctacgatattgacgtcgaggtagaggagcccctcaaaggccagatgtcttctttccttttatcaacagccaaccagcaggaaataagtgccctggattccaagatccacgagactatcgagtccattaaccaactgaagattcagcgggatttcatgcttagcttctcccgtgatcccaaaggatacgtgcaagacctgttacggtcgcagagtcgggaccttaaagtgatgaccgacgtggccggtaatcctgaggaagaaaggcgggctgagttctaccaccagccatggtctcaggaggctgtgagccgctatttctactgcaaaatccagcagcggagacaggagctggaacaatccctggtggtgcggaacacatag

SEQ ID NO: 242991 - DNA, 420 bp, Artificial Sequence
  Description of Artificial Sequence: Synthetic coding sequence
atgacacctggacttcagcatccgcctaccgtggtgcagcgcccaggaatgccgagcggcgctcgtatgccgcatcagggtgcaccaatgggtccacccggtagtccttatatgggatcaccagcagtgagacccggtttagccccagcaggcatggagccagctcggaaaagagctgccccacccccagggcagtcacaagcccagtctcaaggacaaccggtgcctactgcacccgcaaggtccaggagcgcaaaacgacgaaaaatggcggacaagatcctgccgcagcgcatcagggagctcgtgcccgaatcccaagcctacatggatctactcgcttttgagcgtaaactggaccagacaatcatgagaaaaagagttgacatccaagaagccctaaaacgacccatgaaatag

SEQ ID NO: 242992 - DNA, 3081 bp, Artificial Sequence
  Description of Artificial Sequence: Synthetic coding sequence
atgaatctatttaacctggatcggtttcggttcgaaaagcggaacaagattgaagaagccccagaggccacaccacagcctagtcagcccggtcccagctctcctatttctctgtcagccgaagaagaaaacgctgaaggcgaggtgtccagagcaaacactccagactcagatatcacagagaagacagaggatagcagtgtgccagaaacccctgacaatgaacgcaaagcctcaatatcttacttcaaaaaccagcgaggcatccagtatatcgatctctcctcagactcggaagatgttgtgtccccaaactgttctaacactgtccaggagaagaccttcaataaagataccgtgattatagtttccgagcctagcgaggacgaagagtcccagggactgccaacaatggctcgaaggaatgacgacatctctgagcttgaagacctcagtgaattggaggatctcaaggatgccaagctgcaaacactcaaggaactgttcccacagaggagcgataatgaccttctcaagttgatagagtccacttcaaccatggatggcgctatcgccgcagctctcctgatgttcggagacgctggcggaggcccacgcaaacgcaagcttagttcctccagtgagccctatgaagaagacgagttcaacgacgatcaatcgataaagaaaacgcgcctcgaccacggtgaggaaagcaacgagagcgcggagagctctagtaactgggagaagcaagagagcatcgtacttaaactccaaaaggaatttcctaactttgataaacaggaactgcgcgaggttctaaaggagcacgagtggatgtacactgaggcattggaatccctgaaagtgttcgccgaggatcaagacatgcagtacgtctcccaaagtgaagtcccaaatggaaaggaagtgtcctctcgaagtcagaactatcccaagaacgcaacgaagacaaagttgaaacagaaattcagcatgaaggcccagaatgggtttaataaaaaacgcaagaagaacgtgtttaaccccaagcgggtggtggaggattccgagtatgactcgggttcagacgtcgggtcttccttggatgaggattacagcagcggggaggaagtaatggaagatggatataagggcaagattttgcatttcctgcaggacgccagcatcggtgagctcactctgattccgcagtgcagccaaaaaaaggcccagaagatcaccgagcttcgcccattcaattcctgggaagctttatttacaaagatgtccaagaccaacggtctttcggaagacctgatctggcattgcaaaactctgatacaggagcgtgatgtggtgatccggctgatgaataagtgcgaagatatctccaataagctcacgaagcaggtgaccatgttaactggtaacgggggaggttggaacattgaacaaccatctattctgaatcagtccctcagtctcaaaccttaccagaaggttggcctcaattggctggcccttgtccataaacatggtcttaacggaatcctcgccgacgaaatggggctcggcaaaactattcaggcaatcgcattccttgcctatctatatcaagagggcaataatgggccacaccttattgtggttcccgcttctaccatcgataactggctacgggaggtcaatctttggtgccctacgctgaaagttctgtgctattatggttctcaggaagaacgaaagcagatcagattcaatatacactctcgatacgaggattacaatgtgatagtcacaacatataattgtgcaatctcttcaagtgatgacagaagcctttttcggcgactgaaactgaactacgctatctttgacgaaggccacatgcttaagaatatgggcagcatcaggtatcaacatctgatgactataaacgccaataataggctgttactgactggaacacctgtccagaacaatcttcttgagttgatgtctctcttaaacttcgtgatgccccacatgttcagttctagtacatctgagatcaggagaatgttttcctctaagacaaagtcagcagacgagcagagtatctacgaaaaagaacggattgcacatgctaagcagatcattaagcctttcatcctgaggagggtcaaggaagaggttctcaaacagctgccccctaaaaaagatcggattgagctttgcgcgatgagcgaaaagcaggaacaactgtatctgggcttattcaataggctgaaaaaatccattaataacttagaaaagaatactgagatgtgcaatgtaatgatgcagctgcgcaagatggccaatcatcctctgctccaccggcaatattatactgccgagaaactgaaagagatgtcccaactcatgctgaaggagcctacacactgcgaggccaacccggatttaatttttgaggacatggaggtgatgacagatttcgaattgcacgtgctttgcaaacaatacaggcacattaacaattttcagctcgatatggacttaatcctggactctggcaagttccgggtcctgggatgtatcttgtccgaactgaagcagaaaggcgaccgcgtagtgctgttttcgcaatttaccatgatgttggacattctcgaagtgctcctgaaacaccatcaacatcggtacttacgcttggacgggaaaactcagatcagtgagagaatacatttgattgacgagttcaatacagatatggacatcttcgtcttcctcctgtctactaaagccggaggactgggaataaacctgacttcagccaacgtcgtcatcctgcatgacatagactgcaacccatataacgataaacaggccgaggacagatgtcaccgcgtagggcaaacaaaagaggtgctcgtgatcaaactaatctctcaaggaaccatagaggaatccatgctgaaaataaatcagcagaagctgaagttggaacaggatatgacgaccgtggatgagggtgatgaggggagcatgcccgctgatatagccacgctgctgaagacttctatggggctctag

SEQ ID NO: 242993 - DNA, 3087 bp, Artificial Sequence
  Description of Artificial Sequence: Synthetic coding sequence
atgaacctcttcaaccttgacaggttcagattcgagaaaagaaacaagatcgaagaagccccagaagcaactccccaaccgtcccaaccaggccctagcagtcctatctccctcagcgccgaggaggaaaacgccgagggcgaagtatcacgagcgaatactcccgactcagacataacggagaaaacagaggactccagcgttccggagacaccggataacgagcgtaaggcctctatttcatatttcaagaatcagcgcggtatccagtacattgacttatctagtgacagcgaggatgtggtatctcccaactgttcaaataccgttcaggaaaaaactttcaacaaagacacggtgattatcgtctcagaaccatcagaggatgaggaatcacaggggttacccaccatggccaggcggaacgacgacatatcagagcttgaggacctctccgaacttgaggacctgaaagacgccaaactgcaaacgctcaaggagttattcccacagagatcagacaatgatttgctgaagctgatagaatctacatccaccatggatggggcaatcgcggcagccctgcttatgttcggcgatgcgggagggggtcctcgaaagcggaagttgtctagttcatcagagccctatgaggaggatgagtttaacgatgaccagagtattaagaaaacaaggctggatcatggtgaggaatcaaatgagtctgctgagtcctcatccaattgggagaaacaggaatccattgtactgaagctgcagaaagagttccccaactttgataaacaggagctgcgcgaagtgctcaaagaacacgaatggatgtacacagaggcgcttgaaagtctcaaggtattcgccgaggaccaggatatgcagtatgtctctcagagcgaggtaccaaacgggaaagaggtttctagccggtctcagaattacccaaagaatgctaccaagacaaagctaaagcagaagttctctatgaaggcccaaaacgggtttaataaaaaacggaaaaaaaacgttttcaatccgaagagagtggtcgaggacagcgagtacgactctggtagcgatgtaggctctagcctcgacgaggactacagcagcggcgaagaagtgatggaggacgggtataaaggtaaaatccttcacttcctgcaggatgctagcattggggagctcacattaatcccccaatgcagtcagaaaaaagctcagaaaattaccgaactgagaccgttcaattcatgggaggctctttttactaagatgtcaaagaccaatggcctgtcagaagatctcatttggcactgcaagaccctgattcaggagcgagacgtggtcatccgtctcatgaacaaatgcgaggacatatcaaacaaacttaccaagcaagtaaccatgctcacaggtaacggagggggatggaatatcgagcaaccatccatcctgaaccagtcgctttccttaaaaccttatcagaaggtgggcttaaactggctcgcgctggtgcacaagcatgggctgaatggcattctcgctgacgagatgggcctcggcaagaccattcaggccatcgcctttttagcctatctgtaccaggaagggaacaacgggccacatttaattgttgtgcccgcatcgacaatcgataattggctgcgggaggtgaatctatggtgcccaacattgaaggtcttgtgctactacggatctcaggaggaacggaaacagatacggttcaatatccattcacgctacgaggattacaacgtgattgtgaccacctacaactgcgccatctcctcatccgacgacagatctctattccgtagactgaaattgaattacgcaatcttcgacgagggccacatgctgaagaatatgggttcaatccggtatcagcacctgatgactatcaacgctaataatcgtcttttgctcactggcaccccagtgcagaataacctgttggaattgatgtccttgctgaacttcgtgatgccgcacatgttctcaagcagtacatccgaaattaggcgcatgttttcgtcaaagacgaaaagtgcagacgagcagagtatttacgagaaagagaggatcgctcacgcaaaacagattataaagccgtttatcctgcgccgtgtcaaggaggaggtgctcaagcagctgcccccaaaaaaagatcggatcgaattgtgtgccatgagcgagaagcaggaacaactctaccttgggttgtttaatcgcctgaagaaaagtatcaataacctcgtcactgagaagaacaccgagatgtgtaacgtgatgatgcaactgcgcaagatggcaaaccaccccttactgcacagacaatactacacggcggaaaaactgaaggagatgtcccaattgatgttaaaggagcccacacattgcgaggccaaccctgatctgatatttgaagatatggaggtgatgactgactttgaactccatgttctttgcaagcaataccggcacattaataactttcagctggacatggatctgatcctcgattcaggcaaatttagggtcctgggttgtatcctgagtgaactgaaacaaaaaggggatcgagtggtgttgttctcccagtttactatgatgttggacatcttggaggtgctactaaagcaccatcagcacagatacctccgcttggacggcaaaacccaaataagcgagaggatacacctgatcgatgaattcaataccgatatggacatctttgtattccttctgtctactaaggcaggcggacttggaatcaatcttacgagcgccaacgtggtcatcttacacgatatcgactgtaacccttacaacgataagcaggccgaggaccgatgccaccgggtgggtcaaactaaggaggtgctggtaatcaaattgatcagccagggaacgatcgaagaatccatgctgaaaatcaatcagcaaaaattgaaactcgagcaggacatgacaaccgtggatgagggtgatgagggctcaatgcctgcggacattgctactttgctgaaaacatcaatgggtctgtag

SEQ ID NO: 242994 - DNA, 3087 bp, Artificial Sequence
  Description of Artificial Sequence: Synthetic coding sequence
atgaatttgtttaatttggacagatttcggttcgaaaaacgaaacaagattgaagaggcaccagaagcgacaccacagcccagccaacctggaccctcctcaccgatcagcctaagcgctgaggaagagaacgctgagggggaggtgagtagagcaaataccccagacagcgatataacagagaagaccgaggattcctctgttcctgagaccccagataatgagagaaaggccagcattagttattttaagaaccagcggggaatacagtacattgatctgtccagtgacagcgaggacgtggtgtcaccaaattgttcaaatacagttcaggagaagacttttaacaaagatacagtcatcatcgtcagcgagccgagcgaggatgaagaaagccaggggctgccaacaatggcaagaaggaatgatgacatcagtgagctcgaggatttgtcagagttggaagacctgaaggacgccaagcttcagacacttaaagaacttttcccacaaagaagcgataacgacctcctcaagttgatcgagtctacatcaacaatggacggggctatcgccgcagccttactaatgttcggggatgctggcggaggccctcgaaagcgcaaactgagctctagctcagaaccgtatgaagaagatgagtttaatgacgatcaatcaatcaaaaagacccgtcttgaccacggagaagagtccaacgagtccgctgaaagctcaagcaactgggaaaagcaagaatccatagtgctgaagctccagaaagagtttcccaacttcgataagcaagagctacgagaggtactgaaagagcacgagtggatgtacaccgaagcccttgaaagccttaaagtcttcgcagaagaccaagacatgcagtacgtatcccagtcagaggtgcccaatggaaaagaggtgtcgtctaggtcccagaactatcccaagaacgctactaagaccaagctgaaacaaaaatttagtatgaaggcccagaatggttttaataaaaaacggaaaaaaaatgtcttcaaccccaagcgtgtggtcgaagattcggaatatgacagtgggagtgatgtaggaagcagtctggacgaggattacagcagcggggaagaggtgatggaagatggctacaaagggaagatcctgcatttccttcaggacgcgtctattggagagttgacccttatccctcagtgttctcagaagaaggctcagaagattaccgagttgcgtccatttaattcatgggaagcactgtttacaaaaatgtctaaaactaatgggttatcagaggacttgatatggcactgcaagaccttgatccaagaaagagacgttgtgattagactgatgaacaagtgtgaagacatttccaataaattgacgaagcaggtgaccatgttaactgggaatggcggagggtggaatatcgagcagccatcgatcctcaatcagagcctgagcctgaagccgtaccagaaggttgggctaaactggcttgctttggttcataagcacggacttaatggaattctcgctgacgagatggggctcgggaagaccatccaggcgatagccttcctcgcctatctatatcaggagggaaacaacggcccacacttgatcgtagtccccgctagtacgattgacaactggctccgtgaagtgaatttgtggtgtcctacattgaaggttctctgttattacggtagtcaggaggagaggaaacaaataagattcaacatccactctcggtacgaagattacaacgtgatcgtgaccacttataactgtgcgatctccagtagcgacgaccggagcctgtttagaagactcaaactcaattatgcaattttcgacgaaggtcacatgctgaaaaacatgggatccattcgctaccagcacctgatgaccataaacgctaacaatcggctcctgctgactggaacacccgtgcagaataacctcttggagcttatgagcctcctgaacttcgtgatgcctcatatgttcagcagttcaacatccgagatacgccgaatgttcagctctaaaaccaaatccgccgatgagcagtccatctatgaaaaagagagaattgctcacgccaaacagatcattaaaccatttattttgcggcgtgtgaaggaggaagttctgaagcagctgccgccaaagaaggataggatcgaactgtgtgccatgtctgaaaagcaggaacaattatacctgggcctctttaaccgcctgaagaaatccatcaataatctggtgactgagaaaaacacagaaatgtgtaacgtcatgatgcagctgagaaaaatggctaatcaccctctgcttcacaggcaatattataccgccgagaaattaaaggagatgtcgcagctcatgctgaaggaaccgactcactgtgaggcaaaccccgacttaatttttgaggatatggaagtgatgactgatttcgagctccatgtgctgtgcaagcagtataggcacataaacaacttccagctggacatggacctcattctggactccggcaagtttagagtgctgggttgtattctctccgagttaaagcagaagggtgacagagtggtgctttttagccagttcaccatgatgctcgatatcctcgaggttctacttaaacaccaccaacacagatatctgcggctcgatggcaaaacgcagatttccgagagaatccatctgattgatgaattcaatacggatatggacatattcgtgttcctgttgagtaccaaggcagggggattgggtattaacttgaccagtgccaacgtggtcatcctgcacgatatcgactgcaacccatacaacgacaagcaggccgaagatcgctgtcacagggtgggccagaccaaggaagtgttggtaatcaagctcatcagtcagggaaccatcgaggaatccatgctgaaaataaaccagcaaaagttgaagctcgaacaggatatgacaacggtggacgagggagatgaggggtcaatgcctgccgacattgccactttactcaagacctccatgggcttatag

SEQ ID NO: 242995 - DNA, 957 bp, Artificial Sequence
  Description of Artificial Sequence: Synthetic coding sequence
atgaacctgtttaacctagaccgctttcgatttgaaaagcggaacaagattgaggaagcaccagaggctacaccgcagccttctcagcctggaccctcttccccaatttccctgagtgcggaagaagaaaacgctgagggggaagtctctagagctaataccccagacagcgacattacagagaagactgaggacagctctgtgcctgaaactcctgacaatgagcgcaaggcctccatctcctacttcaagaatcagcgcggaatccagtacatagacttgtcctccgacagcgaagatgtggtctcacccaactgctccaacactgttcaggaaaagactttcaataaagacactgtcatcatcgtgtccgaaccttcagaggatgaggagtctcaaggtctgcctacgatggcacggaggaacgatgacataagcgaactagaagacctctccgaattggaggatctgaaagatgccaagcttcagactttaaaggagctcttccctcaaagatccgacaatgacctgctcaagctgatagagtccaccagcaccatggatggtgccattgctgccgctctgctcatgttcggagatgccggtgggggaccccgtaagaggaagctgtcatcatcctctgagccttacgaagaggacgagtttaacgatgaccagtctattaagaagacccgacttgatcatggcgaggaatccaacgagtctgccgagagttcttctaattgggagaaacaagagtcaatcgtactgaaactgcaaaaagaattcccaaatttcgacaaacaggaacttcgggaagttctaaaggagcatgaatggatgtacaccgaggctctcgagtccctgaaggtgtttgccgaggaccaggacatgcaatacgtcagccagtctgaggtgcccaatgggaagaagaaagcccagaagaagaaaaagtag

SEQ ID NO: 242996 - DNA, 732 bp, Artificial Sequence
  Description of Artificial Sequence: Synthetic coding sequence
atggctgccatagccgctagcgaggtcctcgtcgactcagccgaagagggctccttggccgcagcagccgagcttgcggctcagaagcgggagcagcggcttcgcaagttccgggaactacatctgatgcgcaatgaagcgcgtaagctgaatcaccaagaggtggttgaggaagacaagcgtctgaaactccccgctaactgggaggccaaaaaggcgagattggagtgggaactgaaggaggaggaaaagaaaaaggagtgcgcagctcgcggtgaagattacgaaaaggtgaagctgttagaaattagtgccgaagacgccgagagatgggagaggaaaaaaaagagaaaaaatccagacttggggttctccgattatgccgctgcacagttaaggcaatatcaccgcctgaccaagcagataaaacccgatatggaaacctatgagaggcttagggagaagcacggcgaagagttttttccaacatccaactctctgctccacggtactcatgttccttccaccgaggaaattgaccgcatggtaattgatcttgagaagcaaatcgagaagcgcgataagtattcccggagacggccttacaatgatgacgcagatatcgactatatcaacgaaaggaacgcaaaattcaacaagaaggctgagaggttctacggaaagtatactgctgaaatcaagcagaacttagaacggggaactgctgtctag

SEQ ID NO: 242997 - DNA, 606 bp, Artificial Sequence
  Description of Artificial Sequence: Synthetic coding sequence
atggccgctatcgctgcctccgaggtgcttgtggactccgctgaggaagggtctctggctgccgcagcggaactggctgctcaaaaaagggaacaaaggttacggaaattcagggagctgcaccttatgcgtgagtgcgccgctcgcggagaggactatgaaaaggttaaactgctggagatctcggctgaagatgcggagcgttgggaaaggaaaaaaaaaaggaagaatccagatctgggcttttcggattacgcggcagcacagttgagacaataccatagacttaccaagcaaatcaagcccgatatggagacgtatgaaaggctgcgtgagaagcatggggaagagttttttccgacctcaaacagtctcctccacggaacacatgtgccatccactgaggagattgatcgaatggttatcgacctcgagaagcagatcgaaaagcgagacaaatattctcggcgacggccttataatgacgacgctgatatagactatattaacgaacggaacgcgaagtttaacaaaaaagccgagaggttttacggcaagtatacagcggaaatcaaacaaaacctcgagcgcggtactgcagtgtag

SEQ ID NO: 242998 - DNA, 777 bp, Artificial Sequence
  Description of Artificial Sequence: Synthetic coding sequence
atggacggaatcatcgaacaaaaatccatgttggtccacagtaagatttccgacgcagggaaaagaaatggcctaatcaataccagaaatctgatggcagaaagccgtgacggcctcgtatcagtctacccagccccacagtaccaatcgcatcgtgtcggggcttcgaccgtcccagcctctctggactcctcacgttccgaacccatgcagcagttacttgatcctaacaccctccagcagagcgttgagagccgataccggcctaacatcattttatattcagaaggcgtgctgcgctcgtggggagatggggtggctgctgattgctgcgagacgacctttatagaggatcgtagcccgactaaagatagtctggaatatccagacggcaaatttatcgacctcagcgccgatgacattaagatccacacactgagctacgatgttgaggaggaggaagagttccaggagttagaatctgactattcttcagataccgagagcgaggacaacttcctcatgatgccgccacgcgatcatctcgggctgtcggtcttctccatgctgtgctgtttttggcctctggggattgcagctttttaccttagtcacgagaccaataaagcggtggccaagggtgatctgcatcaggcctcaacttcttccagacgcgctttattcctggctgtcctcagtattacaatcgggacaggggtttacgtgggtgtggccgtcgctttaatcgcgtatctttctaagaataaccatctgtag

SEQ ID NO: 242999 - DNA, 717 bp, Artificial Sequence
  Description of Artificial Sequence: Synthetic coding sequence
atggagtcactcagcgagctgcagaacccactcctgccacgatcacctgctcacctgcacggcccatacccctatccagaaacaccgccatcatggtcatgccaggaaaagctgtactcgtacctactcgggggagccggaccggcaggggcacatcagctgttggacccaggctctctacagctcgcagtggaggcatggtacaggcctagctgcctcctcggccgtgacaaggtgaaagagccaagagcgggaagctgcgagaccagcttcaccgaggatcgggaaccacaagaaggaccacctgagcaaccgactggtccaggccaggccgctgaaaatgtaactatccaaacagtaagttacggcgtgcaggaagagttgcgggatcaggaggacgaccaggaagaagaggagagcgacgctaccagtactgagtccgagtcagaggataatttccttacgttgcccccacgggaccatctgggtcttaccctcttctctatgctgtgctgcttctggcccctgggcatcgccgctttctatttctcacagggcaccagtaaggctatctctaagggcgattttaggttggcctcaaccacaagtcggagggcattgtttctggctaccctggctatcgccgttggcgctggcctttacgtggctgtagtcgtggcccttgctgcctacatgtctcagaatggccacggatag

SEQ ID NO: 243000 - DNA, 717 bp, Artificial Sequence
  Description of Artificial Sequence: Synthetic coding sequence
atggagtccctgtccgagttgcagaacccacttcttcccaggagtcctgctcaccttcacgggccttacccttacccagagacacctccatcatggtcctgccaggagaaattgtatagctatctgttaggcggtgcaggacctgcgggagcacaccaattactcgaccccggttctctgcagctcgccgtggaagcctggtacagaccctcgtgtctcctaggaagggataaggtcaaagagccacgagcagggagttgtgaaacctcctttacagaagaccgagagccccaggaggggccacccgaacagcctacaggccctgggcaggccgctgagaatgttacgattcagacagtgagctacggggtgcaggaagaactgcgcgatcaggaagacgatcaagaggaggaagagtctgacgcaacctccaccgagtccgagtccgaggataactttcttacccttcctccgcgtgaccacttaggcttgaccctgttttctatgttatgttgtttctggccattgggtatcgcagcattctatttttcccagggaacatccaaagccatctcaaaaggcgactttagactggcctctaccacgtctagacgcgctctcttccttgccactttggccatcgcggttggcgcaggcttgtatgtggcggtagtggtagcattagcggcttacatgtcacagaacggccacggttag

SEQ ID NO: 243001 - DNA, 243 bp, Artificial Sequence
  Description of Artificial Sequence: Synthetic coding sequence
atggagagcctgagcgagttgcagaacccactgctgccaaggtcccccgctcatctccacggtccatatccataccccgaaacgccaccatcatggtcatgccaggaaaaactctatagctatcttctggggggagctggcccagcgggtgcacatcaactgctggatcccggatctttgcaacttgccgtggaggcctggtaccgtccaagttgcctgttggggagggacaaagttaaatag

SEQ ID NO: 243002 - DNA, 2118 bp, Artificial Sequence
  Description of Artificial Sequence: Synthetic coding sequence
atgaactacttgagaagaaggctgtctgactctaacttcatggccaatctacctaacggctacatgactgacctgcagaggcctcagccccctcctcccccacccggtgcccactccccaggagcaacgcccggaccaggaacagccactgccgagcgttcgagcggtgtagctcctgccgctagccctgcagcccctagtcctggatcgtcaggtggcggtggattcttttcttctctctccaacgcagtgaaacagacaaccgcggctgctgctgcaaccttcagtgaacaagttgggggtgggagcgggggtgctgggagaggcggagcagcttcccgcgtactgcttgtgatcgatgagcctcataccgactgggcgaagtacttcaaggggaagaagatccacggggaaattgatatcaaggtggagcaggctgaattcagtgatttgaacctggtcgcacacgcaaatggtggtttttctgtggatatggaggtgcttcgaaatggcgttaaggtggtccggagcctgaagccggactttgtgctcatccggcaacacgctttcagcatggcgaggaacggggactaccgctccctggtcatcggactgcagtatgcaggaatcccttccgtgaatagtttgcactcagtttataacttttgcgacaagccatgggtgttcgcccagatggtcagactgcacaagaagctgggcaccgaagagttcccccttatcgaccaaaccttttacccaaatcataaagaaatgctatcatccacaacctaccccgtggtagtcaagatgggccacgctcactcgggtatgggcaaggtcaaagttgataaccagcacgatttccaagatatcgccagcgtcgtggctttgaccaagacatacgcgacagccgaaccctttattgacgcaaagtacgacgtgagagtccaaaagataggccaaaactataaagcctatatgaggacaagtgtgagtggcaattggaagactaacactggatctgccatgctggagcagatcgctatgagcgatcgatacaaattatgggttgatacgtgttccgagatctttgggggtctggacatttgtgccgtcgaagccctacatggaaaggatggacgagaccatatcatcgaagtggtggggtcctctatgccgctgattggggatcaccaagatgaggataagcagctcatagtagagctggtggttaacaagatggctcaggctctcccaagacagcgccagagggatgccagtcctggccgaggaagccatgggcagaccccaagcccgggagcactgccattgggccgtcagactagtcagcagcccgctggacccccagcccagcagcgacccccacctcaggggggaccaccccagcccggtccagggccacagcgtcaggggccacccttacagcagcggcctccgccacagggacagcagcatctgagcggcctagggccacccgcaggctccccgctgccacagaggctgccttctccaacctcagccccacagcaacctgctagccaggccgctccaccaacccaaggacagggacggcaatctaggccagtagctggcggtccgggagcccctcctgcagcccgaccacccgctagtccatcacctcagagacaggcaggccctcctcaggccacgcgacaaacctcagtaagtggtcctgctccccctaaggcctccggagctccaccagggggacagcaaaggcaaggccctcctcagaagcctcccggacccgctggtcccacaagacaggcctcccaggccggtccggtcccgcgtaccgggcctcccacgacccagcagccacggccaagcggaccaggcccagccggtagaccgaaaccccagttggcccaaaaaccctcgcaggatgtgcccccaccagccactgcagccgctggtggtccgccacatccgcagctgaacaagagccagtccttaacgaacgccttcaatcttccagaacctgcaccaccaaggccttccctgtcacaggatgaggtcaaagcagaaaccattcgttccctgcgaaagagcttcgcatcacttttcagcgattag

SEQ ID NO: 243003 - DNA, 2010 bp, Artificial Sequence
  Description of Artificial Sequence: Synthetic coding sequence
atgaactaccttcgacgccgattatctgacagtaattttatggccaacctacccaatggctacatgaccgatcttcagaggcctcaaccaccacccccacctcccggagcacattctccaggcgcaactcccggtcccggaaccgcaacggccgagaggagttccggcgtggcaccggctgcctcccccgctgcaccatcccccggttcctctggaggcggtgggttttttagctctctgagcaatgccgttaaacagactactgccgcagctgccgctacgttttccgagcaggttggcggagggtcagggggtgcgggaaggggcggtgcggcatctcgcgttcttctggttattgacgagccccacaccgattgggccaagtactttaagggcaagaagattcacggggagatagacatcaaggtggagcaggccgaattctctgatctgaatttggtggctcatgccaacggagggtttagtgtggacatggaagtcctacgcaatggggtgaaagtagttagatcactgaaaccagatttcgttttgattcggcagcatgctttttccatggcccgtaatggggattatcgcagcctggtaatcggactgcaatacgccggaataccgagcgtgaacagcctccattcagtttataatttctgcgacaagccttgggttttcgcccagatggtccggcttcacaagaaactgggcacggaggagttccccttaatcgaccagacattctatcctaaccacaaagagatgctgtccagcactacgtaccctgtggttgttaagatggggcacgcccacagcggaatgggaaaagttaaagtggacaaccagcacgattttcaggatatcgcctccgtggtggcccttacgaagacctacgcaacagcagagccttttatcgacgctaaatatgacgtgagagtgcagaagattggccagaattataaggcatatatgcggacgagtgtgagcggaaactggaaaacaaacaccggatccgcaatgctggagcaaattgccatgtctgatcgctataagctgtgggtggatacatgtagtgagatatttgggggattggatatatgtgccgtcgaggccttgcacggtaaagacggacgagatcacattattgaagtggttggaagcagtatgccgctcataggcgatcatcaggatgaggataaacagctgatagttgagctcgtagtgaacaaaatggcacaggctctccccagacagcgtcagagagatgcatcccctggaagaggctcacacggacaaacacccagtcctggcgctctgcccttggggaggcagacaagccagcagcccgctggacccccagctcagcagcgtccgccacctcaggggggacccccacagcctggacctggtcctcaacgccagggtccaccgttgcagcagcgacctcctcctcagggtcagcagcacctatccggcctgggtcccccagctgggtctccactgccacaacggctgcctagccctacatctgctccccagcaacccgctagccaggccgcaccccctactcaggggcaagggaggcagtcacgacccgttgctggagggccaggcgcaccaccagccgctaggccccctgcctctccctcgccccaacggcaggccggtcccccacaggccaccaggcagaccagcgtaagcggaccagccccacctaaggcgagcggagctcccccaggcggtcagcagagacagggtccacctcaaaagcccccaggtccagccggtcccacacggcaggcctctcaagccggacccgtgcccaggactggtcctcccactactcagcaaccgaggcccagcggccctgggcctgcgggaagacccaagcctcagttagctcaaaaaccatctcaggacgtcccccctcctgccacagctgcagctggaggacctccccaccctcagctgaaagcatcccctgcacaggcccagccttag

SEQ ID NO: 243004 - DNA, 1743 bp, Artificial Sequence
  Description of Artificial Sequence: Synthetic coding sequence
atgaactttttgcgcaggcgcttgtccgactcctcctttatggcaaatctccctaatgggtatatgactgatctgcagaggcccgacagcagcacttcgtccccagccagcccagctatggagcggaggcatcctcaacctctcgccgcatctttcagctctccaggcagcagtctgttcagtagcctgtcttctgccatgaaacaggcaccccaggcaacctcaggtttgatggagccccctgggccttcgacgccaatcgttcagaggccacggatcctgctcgtgatcgatgacgcccacaccgactggtcaaagtactttcatggaaagaaagtcaacggcgagatcgagatacgggtggagcaggctgagttcagcgagctgaacctggccgcatatgtaacaggcggttgcatggtcgacatgcaggtagtgcgcaatgggactaaagtcgtatctaggtcattcaagccagattttattctggtcaggcagcatgcttatagtatggctctcggtgaagattaccgttctttagtaatcgggctgcagtatggaggcttacctgctgtgaatagcttatactccgtgtataatttctgttcaaaaccatgggtgttcagccagctgatcaagatcttccactccctaggccctgaaaagttcccgctcgtggagcaaaccttttttcccaaccataaaccaatggttacggcccctcactttcctgtcgtcgtaaaactcggccatgctcatgctggcatggggaagatcaaagttgagaaccagctcgacttccaggatatcacatctgtggtggctatggccaaaacatatgcaactacagaggcattcatcgactctaagtacgacattagaatacagaagatcggaagtaactacaaagcgtatatgaggaccagcatctcaggcaactggaaggctaacactgggtcggcgatgctggaacaagttgccatgacagaacgttatagactctgggtggactcatgcagtgagatgttcggaggcctagacatttgtgcagtcaaggcagttcatagtaaggacggacgtgattatatcattgaagtgatggatagctcgatgcccctcatcggagagcatgttgaagaggatagacagctgatggccgacttagtggttagcaagatgtcacagcttcctatgcctggaggcactgcacccagcccattgcggccttgggccccacagattaaatctgcgaaaagccctggccaggcgcagctgggccctcagctcggtcagccccagcccagacccccaccccaaggaggacccaggcaggcccagtccccacagccccagcgctcagggagtcctagtcagcagcgtttatctccccagggccagcagcctctctccccacagagcggttctcctcagcagcagcggagccctggtagcccacaattatctcgggcaagtagtggctcatctccaaatcaggcctccaaacctggggctacactggcttctcagccaaggccacctgtgcagggacggagtacatcacagcagggcgaagaatccaagaagccagccccacctcacccgcacctgaataagtcacagtcactgactaattctctgagcacatctgacaccagccagagagggacaccgagtgaagatgaggcaaaggctgaaacaatccgcaacctacggaaaagctttgcgtctctgttttccgattag

SEQ ID NO: 243005 - DNA, 1743 bp, Artificial Sequence
  Description of Artificial Sequence: Synthetic coding sequence
atgaactttctccgcaggagactgtcagattcaagcttcatggccaacctacctaatggctacatgaccgatctgcagagacctgattccagtactagttcccccgcaagcccagctatggaaagacgacacccccagccgctagccgcatcattctcgagccctggaagttctctgttctcatcactctcgagcgccatgaaacaggcccctcaagccacctctggcctcatggagccacctggtcctagcacgccaatcgttcaaagaccacgcattcttctggtaattgatgacgcacatactgattggagtaagtatttccatggtaaaaaggtgaacggagaaattgaaatccgcgtggagcaggctgagttttcggagctgaaccttgcagcctatgtcaccggcggttgcatggtggacatgcaggtggtgagaaatggtactaaggtcgtcagcagaagttttaagccagactttatcctggtgcgccagcatgcttactccatggccttaggcgaagactaccgctcactcgtgattgggctccagtacggcggattacccgcagtcaatagcctgtacagcgtgtacaacttctgtagcaagccatgggtgttcagccagctgattaagattttccactcacttgggcctgagaagtttcctcttgtggaacaaactttttttcctaaccataagccaatggtgaccgccccacattttcccgtagtggttaaactgggtcacgcgcatgcgggaatggggaagatcaaggttgagaaccagctcgacttccaggacattacctcagtcgtagccatggcaaagacctatgccacaaccgaagcattcatcgactccaaatatgacatcagaatacagaagattggaagcaactataaggcatacatgagaacctctatttccgggaactggaaggcaaacactggcagcgccatgctagaacaggtggccatgactgagcggtataggctgtgggttgacagttgctctgagatgttcggaggtctggatatctgtgccgtcaaggctgtacatagcaaagatggcagggactatattatcgaggtgatggatagtagcatgcctctcattggggaacatgtggaagaagataggcagctcatggccgacctggtggtgtctaagatgagtcagctgcccatgcccggaggaacagccccttccccacttcgaccttgggccccacagatcaaatctgcgaagtctccagggcaggcccaattgggcccacagctaggtcagccccagcctcggccaccaccgcagggcggacctaggcaggcccagtccccacaaccgcagcgcagtggctcgccatctcagcagcgcctgtccccccagggccagcaaccgctgagcccccagtctggaagcccccagcagcaaaggagcccgggaagtccacagttgtcccgcgctagctctggaagttcacccaatcaagcttccaagccgggagctacgctcgcctcccagcctcgccctcctgtgcaaggaaggtcaacctcccaacagggcgaggagtccaagaagccagcccctcctcatcctcacttgaacaaaagccagagtctgactaattctctgagcacgtccgacaccagccagcgaggcactcccagcgaggacgaagccaaggcggagacaatccgcaacttacgcaaatccttcgcctccctgttttccgactag

SEQ ID NO: 243006 - DNA, 1335 bp, Artificial Sequence
  Description of Artificial Sequence: Synthetic coding sequence
atgaacttcctgcggcgaagattaagcgattccagcttcatggctaacctgccgaatgggtatatgaccgacttgcagcggccagactcatccacatcaagtcccgctagcccggctatggaacgtcgccacccacagccactcgctgctagttttagtagccccggttcttccctgttcagtagtttatccagcgcaatgaagcaggccccacaggctacgagcggccttatggaacctccagggccaagcactccaatcgtgcagagacctagaattctgctggtcattgatgacgcacataccgattggagtaaatacttccatggaaagaaggtaaacggcgagatcgaaattagggtcgagcaggcagaattttctgagttaaatttggctgcgtacgtcaccggcggatgcatggtagacatgcaagtcgttcgcaatgggactaaggttgttagcaggtcatttaagccagactttatccttgtgcggcagcatgcttactccatggcgctgggagaggattatagatcccttgtgatcgggttgcagtacgggggtctcccagcagtgaatagcctctattctgtttataatttttgtagcaagccgtgggtgtttagccagttgatcaagatatttcacagccttggtccagagaaatttcctctggtggagcagacattcttccctaatcataagcccatggtgacagcacctcatttcccagtggtggtgaagctcggacacgcgcatgcaggaatgggtaagatcaaggtcgagaatcagctggacttccaggatatcacgagcgtggtcgccatggccaagacgtacgcaactaccgaggcctttattgacagcaaatatgatatccgtattcagaaaatcggtagcaattataaagcctatatgcgtacttctatctccggcaattggaaagccaacactggctccgcgatgctcgaacaggtcgctatgactgaacgttaccgactgtgggtggactcatgctctgagatgtttggcggacttgatatctgcgctgtgaaagccgtgcactctaaagacggcagggattacatcatcgaggttatggatagttctatgcccctaatcggggaacatgtggaagaagacagacagctgatggccgacttggtggtgtctaagatgagccaactgcccatgcctggtggcacagcaccatcacccctgcgcccatgggcacctcaaatcaagtccgcaaaaagtccaggccaggcacaactgggcccacaattaggccagccacagccaaggcctccgccacaggtgtcttttagcccctag

SEQ ID NO: 243007 - DNA, 342 bp, Artificial Sequence
  Description of Artificial Sequence: Synthetic coding sequence
atgaattttctaagaaggcggctttctgattcctcatttatggccaacctccctaatggttacatgaccgacctacagagacccgactctagtacatcttcacccgcatctcccgcaatggagcgcaggcaccctcagcccctagcagcttcattctcgtccccaggtagtagtcttttcagttcgctatcctctgccatgaaacaagcccctcaggccacctctggactgatggagcctcccggaccttcaacccctattgtgcagcggccacgcatcctcctggtcattgacgacgcccacacagactggtctaagtacttccacggcaaaaaagtttag

SEQ ID NO: 243008 - DNA, 372 bp, Artificial Sequence
  Description of Artificial Sequence: Synthetic coding sequence
atgaacttcttaagacggcgacttagtgatagcagctttatggcgaacctccctaacggttatatgacagacctgcagaggcccgattcgtctacctcatcaccagcatctcctgccatggagagacgccaccctcagcctttggccgcaagcttctcgagccccggatcctctctcttcagttctctatctagcgctatgaaacaagctccgcaagccacttctggcttgatggagcctccgggtccatcaaccccaatagtccagagacctcggattcttctggtgattgacgatgctcacactgattggtcaaaatacttccacgggaagaaggtgaacggggagattgagatccgcgtagaacaatag

SEQ ID NO: 243009 - DNA, 561 bp, Artificial Sequence
  Description of Artificial Sequence: Synthetic coding sequence
atggactctagcatgccactcattggagaacatgtggaggaggacagacagttaatggcagacctcgtggtttctaagatgagccagctccctatgcctgggggaactgctccctccccccttagaccctgggcaccgcaaataaagagtgctaaaagtcctggacaggcccagcttggaccacagctgggacagccccaacccagaccgccaccacaggggggtccacgccaggcccagtcaccccagcagcaacggagccctggctcccctcagctgtccagggcatcatctggcagcagtccaaaccaggcctcaaaacccggagccaccctggcctcccagcctcggccacctgtacaagggcgaagcaccagccagcagggcgaagagtctaaaaagcctgctcctcctcatccccacctaaataagagccagagcctgaccaatagcctctctacatctgatacatcccaacgaggcacacccagcgaagatgaagctaaagccgagactattaggaatttgcggaagagttttgctagcctgtttagcgattag

SEQ ID NO: 243010 - DNA, 1212 bp, Artificial Sequence
  Description of Artificial Sequence: Synthetic coding sequence
atgtctcacaggaagttcagtgcaccacgccacggctcgctgggatttctgcctagaaaacggtcttcgcgccaccggggaaaagtgaagagcttccccaaagacgaccccagtaagcctgtgcaccttactgcatttcttggatacaaggctgggatgactcacattgtgcgcgaagtggaccggccagggagtaaggtcaacaagaaagaggtcgtggaggccgtgacaattgtggaaaccccaccgatggtggtggtgggaatagtgggctatgtcgaaactcctcgcggacttcgcacatttaagacggtattcgcggaacacattagcgacgaatgcaaaaggagattttataagaattggcacaaaagtaaaaaaaaagcctttactaaatactgtaaaaaatggcaggacgaggacggcaaaaagcagctggaaaaagatttctcctctatgaagaagtattgtcaggtgatccgcgtcatcgcccacacgcagatgcgcctgctgcctctaaggcagaagaaagcacacctcatggaaatccaggtgaacgggggaaccgtcgccgagaagcttgactgggcacgggagagacttgaacaacaggttcccgtcaatcaggtcttcggccaggacgagatgatcgacgtcatcggggtcacaaagggcaaaggctacaagggtgtgaccagcagatggcacaccaaaaaactgccaaggaaaactcatcgtgggctccgtaaagtggcctgcataggtgcctggcacccagccagggtcgcattttctgttgcaagggcaggacagaaggggtaccaccaccgcaccgagattaataaaaaaatctacaaaatcggccagggctatctgattaaggatggcaagctgattaaaaacaacgcctctactgattatgacctgagcgataaatcgatcaacccactggggggatttgtgcactacggggaggtgacaaacgatttcgtgatgttaaaaggctgtgtagtgggaactaagaagagagtgctcacccttaggaaatccctattggtgcagaccaagaggcgagctctggagaagatcgatctaaaattcattgacaccaccagtaaatttgggcacgggagattccagacaatggaagaaaagaaagcattcatgggtcctttgaagaaggatcggatcgccaaggaggaaggcgcatag

SEQ ID NO: 243011 - DNA, 576 bp, Artificial Sequence
  Description of Artificial Sequence: Synthetic coding sequence
atggagggcggagcgtacggcgcaggtaaagctgggggagcatttgatccctatacgctcgttagacaacctcacactattctccgcgttgtgagttggctttttagtattgtcgtgtttggctctatcgtgaatgagggatacttgaactccgccagtgagggcgaagagttctgtatttacaatcgaaatcctaacgcgtgctcctacggggtggcagttggggtactagcatttctcacgtgtcttctgtacctcgccctggatgtatattttccacagatttcctccgtgaaggatcgaaagaaagctgtgctgtctgatattggggtctctgccttctgggcctttctatggttcgtgggattttgttatctcgctaaccagtggcaagtttccaaacctaaggacaatccgctgaacgagggaaccgatgccgctcgggcagccattgcctttagcttcttttcaattttcacatggtctttgacagccgcactggcagtgcgaagatttaaggacctatcctttcaggaagagtatagcacactgttccctgcttccgcacagccttag

SEQ ID NO: 243012 - DNA, 702 bp, Artificial Sequence
  Description of Artificial Sequence: Synthetic coding sequence
atggagggcggagcatacggagccggaaaagctgggggagccttcgatccttacaccctggtaagacagccccataccatcttgagggtggtgtcttggcttttctcaatcgtagtattcggctctatagtcaacgagggttacctgaactctgcatccgaaggtgaggagttctgcatttacaaccgaaatcccaatgcttgctcatatggcgttgccgtaggcgtgctggcttttctgacctgcctcttgtacttagctctggacgtctactttccacagatcagcagcgttaaggataggaagaaggcagtcctgagcgatatcggcgtcagtgccttctgggccttcctgtggttcgtgggattttgttacctggccaaccaatggcaggtttccaagcccaaggataaccccctaaacgaaggtactgacgctgctagagcggctatcgcctttagcttttttagcattttcacttgggctggccaagccgtactcgcattccagcgttaccagataggcgctgattcagccttattcagccaggactatatggatccttcgcaggactccagcatgccatacgcaccatatgtcgaacccacaggcccagaccctgccggaatggggggaacctaccagcaacccgctaatacatttgatacagagccgcagggataccagtctcagggatactag

SEQ ID NO: 243013 - DNA, 579 bp, Artificial Sequence
  Description of Artificial Sequence: Synthetic coding sequence
atgctcacgcttgaatttggaatcctggagtttgacccgtcatggatcggttcctggacgcagcggtcttgggtctcctggaggtctcggcctggttgcgagctgtttagtattgtcgtattcggaagcattgtcaacgaagggtacctgaattccgcatcagagggggaagagttttgcatttacaaccgcaacccaaatgcatgcagttatggcgtggccgttggggtgctggcattcttgacctgtctactgtatctggccctggacgtgtactttcctcaaatctcttccgtgaaagataggaagaaggcagtgctatcagacattggggtaagcgcattttgggcgttcctgtggttcgtaggtttctgttacctggctaatcagtggcaagttagcaaacccaaagataacccgttaaacgagggaaccgacgcggcacgcgcagctattgcattctccttttttagtatctttacctggtccctgaccgcggcactcgccgtccgcagatttaaggacctgagctttcaggaagaatactccacactgtttcccgcttcagcccagccctag

SEQ ID NO: 243014 - DNA, 510 bp, Artificial Sequence
  Description of Artificial Sequence: Synthetic coding sequence
atggagggcggtgcttacggagccggtaaagccggaggagcttttgacccttacacactggttcgtcaacctcacacaattctccgcgtggtatcatggctgttttcgattgttgtattcggctccatcgtgaacgagggttatctgaacagcgctagcgaaggggaagagttttgcatttataaccggaaccctaatgcctgttcgtacggcgtggcagtgggcgtcctagctttcctgacctgtttactatatttggcccttgatgtctacttcccccagatatcttccgtcaaagaccggaaaaaagcagtgctgtccgatatcggggtgtctgccttctgggctttcctgtggttcgtaggcttttgctatctcgcaaaccagtggcaggtttccaagcctaaagataatcctctcaacgaggggacagacgccgctcgggcagcgatcgcattttcattcttctctatcttcacttggcgcagcggagccactagtcccccttag

SEQ ID NO: 243015 - DNA, 297 bp, Artificial Sequence
  Description of Artificial Sequence: Synthetic coding sequence
atggctagtggcgctggcggaagctgggggagaagcccccctcagtctgccgtacctacgccttgggttacgtttctgcaacccctgtcctgggccgtgccaccagcgcctccccagcccggtcgtgttaaggaagatctgctggaactgatgatgctgcagaacgcacagatgcaccagctgctgcttagcagactggttgccggagcactgcagcctaggcccgcttccccctgccctcaggagagttgtgcccctactccgacgcctcaatgccacagggactgcgggtgctag

SEQ ID NO: 243016 - DNA, 690 bp, Artificial Sequence
  Description of Artificial Sequence: Synthetic coding sequence
atggagggggctagttttggcgctgggagggccggagccgctctcgacccagtgtctttcgcgaggcgtcctcaaactcttcttagggttgcaagttgggttttttcaatcgcagtgttcggcccaatagtaaatgagggctatgtgaacactgacagcggtcctgagctgagatgtgtcttcaacggtaacgctggtgcctgtcggtttggagtcgcgctgggcctgggggcttttctcgcctgtgcagcttttctgctgctagacgtgcgctttcaacagatatctagcgtccgagaccgccgtcgcgctgtccttctcgacttaggcttcagtggcctctggagctttttgtggtttgtgggattttgctttctgacaaaccagtggcaaagaacagccccaggaccagcaaccacccaggcaggagacgctgcacgggcagctatcgccttctccttcttcagcatcttatcctgggtcgcccttaccgtcaaggccctacagcggtttcgcctcggaacggacatgagcttattcgccaccgagcaactctcaaccggggcaagccaggcctatcccggatatccggttggcagtggcgtggaggggaccgaaacctaccagtccccaccgtttacagaaacactggatacttcgcccaagggctaccaggtccccgcttactag

SEQ ID NO: 243017 - DNA, 438 bp, Artificial Sequence
  Description of Artificial Sequence: Synthetic coding sequence
atggagggtgcctccttcggtgcaggtcgcgcaggcgctgccttggatccggtcagcttcgcacggaggcctcaaactctgctccgggtcgcatcctgggtgttcagcattgctgtttttggaccgatcgtgaatgaaggttacgtgaatacagactctggcccagaactccggtgtgtcttcaatggcaacgccggtgcatgccggtttggcgtggcactcggattaggggctttcctggcatgcgctgcttttctgctgctcgatgtgcgttttcagcagtccggagggagggggaagaccccgccttctccgcaagactggggcagttggccactgtttccaagtcatgtgccagtgggctccgactgcttagtgagcgtgatggtggtgcgccctgtgcggtctcactcaccacttagcctgactggctgttag

SEQ ID NO: 243018 - DNA, 705 bp, Artificial Sequence
  Description of Artificial Sequence: Synthetic coding sequence
atgcacattcccaagtctcttcaagagctggctaacagtgaagccgtgcagtttctgcggagacccaaaacaattacaagggtcttcgaaggagtctttagtctgattgtgttttccagcttgcttaccgacggctaccagaacaagatggaatcacctcagctccattgcattctgaactcgaatagcgtggcatgcagttttgctgttggcgctgggtttttggctttcttgtcatgtctcgcgttcttggtgctggacactcaggagaccagaattgcgggtaccagatttaaaactgctttccagctcctggacttcatcctggctgtgctgtgggcagtcgtgtggttcatgggcttctgcttcctcgccaatcagtggcaacactcccctccgaaagaatttctgctgggctcatcaagcgcccaggccgcaattgcatttacctttttctccatcctagtctggatttttcaagcctatttagctttccaggatctacgcaatgacgcccctgtcccatacaaaagattcctcgacgagggaggcatggtcctgactaccttacccctcccttccgcaaattcaccagtgaatatgcctaccaccggcccaaattccttatcgtacgcaagttcagcactctccccatgcctgacagcgcctaaatccccacgcttggccatgatgccagacaactag

SEQ ID NO: 243019 - DNA, 4722 bp, Artificial Sequence
  Description of Artificial Sequence: Synthetic coding sequence
atggccttcagcaaaggtttcagaatctaccacaagctggatccacccccattcagcctcattgtggaaactaggcacaaggaagagtgtctaatgtttgaatccggggctgttgccgtgctttctagtgctgaaaaagaagccatcaaaggcacctattctaaagtcctggatgcttatgggttactgggcgtcctgcgcctgaacctgggtgacaccatgctacattatctcgttttagtgaccggatgtatgtccgtcggcaaaattcaggaaagcgaggttttccgggtgacaagcactgagtttatttctttgaggatcgactcatccgacgaggatcggatttccgaggttagaaaggtactcaactccggcaacttttatttcgcttggtcggcctcagggatttccctggaccttagtctaaacgcacacaggagtatgcaggaacagacaaccgacaacaggtttttttggaatcagtctctgcacctgcatttgaagcattatggagttaattgtgacgactggctccttagattgatgtgcggaggagtggagataaggacgatttacgccgctcacaagcaggcaaaagcttgcctgatttctcgcttgtcatgcgagagagccggtacacgatttaacgtgcgtggaactaacgacgacggccatgtggcaaactttgtggaaaccgaacaggtggtttatctggacgatagtgtcagctcttttatccaaatcagaggaagcgtccccctgttctgggaacaaccaggtctacaagtgggctcccacagggttcgcatgagccgcggtttcgaagctaacgcccctgcatttgataggcactttcggacattgaaaaatctgtacggaaagcagatcatagtaaacctcttggggtctaaggagggcgagcatatgctgtccaaagcattccagtctcacctcaaggcgagcgagcatgccgcagatatccagatggtgaatttcgactatcatcagatggttaagggagggaaggccgaaaaactgcactccgtgctaaagccccaggttcagaaattcctggactacgggttcttctactttaacgggagcgaggttcagcggtgtcagagtggcacagtgcggactaattgtttggattgtctggaccgaacaaactctgtgcaagcattcctgggccttgagatgctagctaaacagttggaggcactggggttggccgaaaagccacaattagtgaccagattccaggaagtgtttcgctcaatgtggtctgtgaacggtgattcaatctccaagatctacgcaggtacaggcgctcttgaggggaaggccaagttgaaagacggtgctcggtcagtcacgcgtactatacagaataatttttttgattcttccaagcaagaggccatcgacgtgttgcttctcgggaacaccctcaactccgacttggccgacaaggcaagggccctcctgaccaccggttctcttagggtaagtgagcagaccctgcagagcgcatcctccaaggtcttgaaaagtatgtgtgagaacttctataaatactcaaaacccaaaaagattcgtgtatgtgtgggaacatggaacgtgaatgggggaaagcaatttcgatccatcgcatttaagaaccaaaccttaactgactggcttctcgacgctccaaagttggccggtattcaagaatttcaggataagcgttctaagcctactgacatcttcgccatcggatttgaagagatggtggagctaaacgccggtaacattgtctcagcttcaactaccaaccagaagctctgggccgtggagcttcagaagacgatctcgagggataacaagtacgtcctactggctagtgagcaacttgtaggagtgtgcctattcgtgtttatcaggccgcagcatgctccatttattcgcgatgtggccgtggacacggtgaagacagggatggggggagctacagggaataagggcgctgtggccatccggatgttgtttcacacaacttctttatgtttcgtgtgttctcacttcgctgccggtcagagtcaggtgaaagaacggaatgaagacttcatcgagatcgcacggaaactgtccttccccatgggccgaatgctgttttcccacgactacgtcttttggtgcggagactttaactaccgcatcgacctgccaaatgaggaggtgaaagaacttatccgccaacaaaactgggattcgctcattgctggagatcagctcattaatcagaaaaatgccggacaggtctttaggggctttttggagggcaaagtcacattcgctcctacttataagtatgacctgttttctgacgattacgacacgtctgagaagtgtagaacacctgcctggacagatagagtcctctggagacgcagaaaatggccctttgataggtcagctgaagatcttgatctcctcaatgctagctttcaggatgaatcaaagattctgtatacgtggacaccaggcaccctgctccactatggcagggccgaactcaagacatccgaccatcgacctgtcgtggcgttgatagacatcgacatctttgaagtggaggctgaggaaaggcaaaatatctataaagaagttattgccgtgcagggacctcctgacggtaccgttctggtgagcattaagtcctcacttcccgagaacaacttctttgacgacgcactgatagacgagttgcttcagcagtttgcgagtttcggtgaggtgatcctaattcgattcgtcgaagacaaaatgtgggtgaccttcctggaggggtcttctgcactgaacgtactctcactcaacggtaaggaacttctaaataggaccattacaatagctttgaagtcaccagattggataaagaatctggaggaggaaatgtcccttgaaaagatcagtatcgctctcccttcaagcaccagcagtaccctgctgggcgaagacgccgaggtagctgcagactttgatatggaaggtgacgtggacgactactctgcagaagtcgaagagctcctgcctcagcacttgcaaccgagcagtagctcaggcctgggtacatctccaagtagctcccctcgcactagtccatgccaatcgcccactatttcagagggacccgtaccaagtctgccaatcaggcctagtcgtgcaccgagtaggacccccggaccgccaagtgcccagagcagtcccatcgacgcccagcctgccactcccctgccacagaaggatccggctcagccgttagaaccaaagcggcctccccctccgcgtcctgtcgccccaccaactcgccctgccccaccacagaggcccccacccccatcgggtgctcgttctcctgcccctactagaaaagagtttggcggaataggagctcctccaagccccggagtcgccagacgggagatggaggcaccaaagtcgcctggaacaactcggaaggacaacatcggacggtctcaacccagcccccaagcaggtctagccggtcctgggccagcaggctattctactgccaggcccacaatacctcctagggccggagtgatctctgctcctcagtcccacgccagggcatccgccggaaggttgacgcctgaatcgcagagcaaaactagcgagaccagcaagggctctacctttctgccagaacctttaaaaccacaggccgctttccctccacagtcatctttgcctccccctgcgcagaggctgcaggaaccactcgtgccggtcgccgctcctatgccacaaagtggcccacaacccaatctggaaacacccccacagccaccacctcggtcacgatcatcccatagcttgccctcggaagcttcctcccagcctcaggtcaaaactaacggcatctcggatggcaagcgcgaaagcccactgaaaatcgatcccttcgaggacctctcgtttaaccttctggccgtctccaaggcgcagctcagtgtgcaaaccagcccagtgcctactcccgatcccaaacggttaatccagttgccatccgccacccagtccaacgtgctctcctcagtgagttgcatgccaaccatgccacccattccagcccgttctcagtcccaggagaatatgagatcgtctcctaacccttttatcacaggtttaacccgaacgaatcccttctccgaccggaccgcggcaccgggaaatccattcagagcaaagagtgaggagagcgaggctacctcctggttcagtaaggaagagcccgtgactatcagtccgtttccaagcctgcaacctctgggccataacaagtctcgggcttcctcaagcttggacggtttcaaagacagttttgatctgcagggacagtctaccttaaaaatctccaacccaaagggctgggtgacgttcgaagaggaagaagacttcggcgtgaagggaaaatccaagtccgcatgctcagatctgctgggaaatcagccgtccagtttctccggctccaacctgactcttaacgacgactggaacaagggcacgaacgtgagcttttgcgtgctcccaagccgtcggcctcctccaccccctgtcccgctcttacctcccggtacctcacctcccgttgatccattcactaccctcgcctccaaagcgagccctactctcgacttcactgaacgctag

SEQ ID NO: 243020 - DNA, 3888 bp, Artificial Sequence
  Description of Artificial Sequence: Synthetic coding sequence
atggcgtttagtaaagggtttcgaatctatcacaagctggatccccctccattttcactgatcgttgaaacgaggcataaggaggaatgcctcatgttcgagagcggagccgtcgctgtcctgtcttctgcagagaaggaagctatcaaaggaacttactctaaagttctggatgcttacggactgcttggagtcttgagacttaacctaggggacacaatgctgcattacctggtactagtaacaggatgcatgagcgtggggaagatccaggagagcgaggtatttagggtcacatccacggaatttattagcctccgaattgattcaagcgacgaagaccggattagtgaggtaagaaaagtgttgaacagtgggaacttttactttgcttggtcggctagcggcatctcgttagacctgtcattaaacgctcaccgcagcatgcaagagcagaccacggacaacaggttcttctggaaccagtctttgcacttgcacttaaagcattacggagtgaattgtgacgattggttgcttcgcttgatgtgtggcggagtggagatccgtacaatttacgctgctcacaagcaagcaaaagcttgcctgatctctagactgtcctgcgaacgcgctgggacccggttcaacgtgcggggaaccaacgacgatgggcacgtggctaacttcgtggaaactgagcaggtggtctatttagacgatagtgtgtcttcattcatccaaatcagaggctcggtgccgctattctgggaacaacctggactacaagtcgggagtcaccgagtgcgaatgtccaggggctttgaggctaatgcaccagccttcgatcggcactttcgcacgctgaagaacctgtacggcaagcaaattattgtcaatctgctggggagtaaggaaggtgaacacatgttatccaaggctttccagtctcaccttaaagctagtgaacacgctgctgacatccagatggtcaactttgattaccaccaaatggtgaagggcggaaaagccgagaaattgcatagcgtactaaaaccacaggtgcaaaagtttctcgactatggcttcttttattttaacggatcagaggtgcagagatgccagtccggaactgtgcgaacgaactgtttggactgcctcgataggaccaacagcgtacaggccttcctaggcctggaaatgctggctaagcaactagaagccctgggtctggcagagaaacctcagctagtaacgcgctttcaggaagtgtttaggtctatgtggagcgtgaacggagattccatatctaagatctatgcagggacgggtgcgttagaaggaaaggccaagctgaaggacggcgcaaggtccgtgacccgcactattcagaataacttcttcgattcttctaaacaggaagcaatagacgttctgctgttggggaacactctcaatagcgacctggcggataaagcaagggcacttctgaccacgggctcactgcgagttagcgaacagacactccaaagcgctagctctaaggtgttaaagagcatgtgcgaaaacttctataagtacagcaagccaaaaaagatcagggtgtgtgtcgggacctggaatgtaaacggaggtaagcagtttcgctctatcgcattcaaaaaccagaccctaacagactggctgttggatgcgcctaagctcgccggtatacaggagttccaagataagcggagcaagcccaccgacatcttcgccattggatttgaggaaatggtcgagctgaacgccggaaacatagtatcagcttccaccacaaaccagaaactctgggcggtggagctacagaaaaccataagccgggataacaagtatgtcctattggcttcagagcagctggtcggggtatgcttgttcgtgtttatcagaccccagcacgccccttttatccgagatgtggccgtagataccgtgaaaacaggaatgggcggtgctacgggaaataagggagccgttgcaatccgcatgttattccacacaaccagtctgtgctttgtttgcagccatttcgccgctggacagagtcaggtcaaggagcggaacgaggactttattgagatcgccaggaagctgtccttccctatggggaggatgctgtttagccatgactatgtgttctggtgtggggacttcaattataggattgacttgccgaacgaagaggtgaaggagctgatcaggcagcagaactgggatagcttgatagccggtgaccagctcattaatcagaagaatgccggtcaggtcttccggggttttctagagggcaaggtcacgttcgcacctacgtacaagtacgacttattctccgacgattacgacaccagtgagaagtgccgaacacccgcatggacagacagggttctctggagaagacgcaagtggccttttgaccgcagcgcagaggatttagacctgcttaacgcttccttccaggacgagagtaaaatcctttatacctggactcccggaactctgctccattacggcagggcagagctgaaaacctcagaccaccggccagttgtcgcactcattgatatcgacatattcgaggttgaagctgaagaacgtcaaaatatctacaaagaggtgattgcagttcaaggaccaccagatggcacagtgctggtgtcaattaagtctagcctgcccgagaataactttttcgacgatgccctgattgacgagctgttgcagcaatttgcctcttttggcgaagtgatcctgattagatttgtggaggacaaaatgtgggtcacattcctcgaggggagtagtgccctgaacgttctgagcctgaacggtaaagagttactgaacaggaccatcaccatcgcgttgaaatcccctgactggattaaaaacctcgaggaagaaatgtccctggagaaaatctccatcgcactgccgagctccacgtcgtccaccctgctgggggaggacgccgaggtagccgctgatttcgatatggaaggcgatgtcgacgattactcagccgaggtggaagagctgctgccccaacatttacagccatcaagcagctccggcttaggaacctccccatcatcgagcccgaggacgtccccttgtcagtcccccacaatctcagaggggccagtgcctagtctgccaataagaccttctcgcgcaccgagccgtactccgggacctcctagcgcccagagtagccccattgacgctcagccggctacgccactgccacagaaggatcccgcacagcccttggagcccaagagaccaccaccaccacggcctgttgccccaccgactcggcctgctccgccacagaggcctccacctccaagtggagcccgaagccccgctcctacacgcaaggagttcggggcaccgaaatcaccaggcactactcggaaagacaacatcggtaggtcccaaccgtctcctcaggccggattagcagggcctggtccagcgggatacagcaccgccagacctaccattccaccaagagctggcgtgatcagcgctccacaaagtcatgcccgagcctccgcagggagacttacgcccgagtcccagtccaagacatccgagactagtaaaggtagtacatttctgcctgaacccctaaagccccaggccgcttttcctccccagagctccctgccgccaccagcacagcggttacaagagcctctcgtgccagtagcagcccctatgcctcagtccggccctcagcctaatctggagaccccaccacaacctccaccaaggtcaaggtcatctcatagcctcccaagtgaagcatcatcccagccgcagcaggagcaacccagtggatag

SEQ ID NO: 243021 - DNA, 4581 bp, Artificial Sequence
  Description of Artificial Sequence: Synthetic coding sequence
atggccttcagtaagggctttaggatctatcataagttagaccccccaccatttagcctgatagttgagaccaggcataaagaagagtgcctgatgtttgagtctggagcagtggcagtgctgtcctctgccgagaaggaagccataaagggtacttattccaaggtgttggatgcctatggactgttaggcgtgcttcgcctgaatcttggagacaccatgctgcactacttggtgctggtcacaggctgcatgtccgtgggcaaaatccaagaatctgaagtcttcagagtgacttccaccgaattcatttctctcaggatcgactccagcgacgaggatcgcatatctgaggtgcgaaaagtgcttaattctggaaacttttatttcgcctggagcgcatctgggattagcctggatctgagcctgaatgcccaccgatcaatgcaggaacaaactacagacaacagattcttctggaaccagtcactgcacttgcacctgaagcactatggtgtgaattgtgacgattggcttctaaggctgatgtgcggcggtgtggagatcagaactatttacgctgcacacaaacaggccaaggcctgtctaatctcgcgactgagttgcgagcgggctggcactcggttcaacgtgcgcggtactaacgatgacggccacgtagcaaacttcgtcgagacagagcaagttgtctacttggatgactccgtaagctcatttatccagatccggggatctgtaccattattttgggagcaacccggactgcaagtcgggagccaccgtgtcaggatgtctcgcggatttgaggctaacgctcccgcattcgataggcactttcggactttgaaaaatttgtatgggaaacaaatcatcgtgaacctgctggggtcaaaagaaggagagcacatgcttagcaaggcattccagagccatctgaaggctagcgaacacgccgctgacatccagatggtaaattttgactaccatcagatggtaaagggcggaaaagccgagaagcttcattctgtactgaagccccaagttcagaagttcctggactacggattcttttatttcaatgggtccgaggtgcaacgttgccagagtggtacggttagaactaactgtctcgactgtctggatcgcacaaactcagtgcaggcctttctcgggctggagatgcttgccaaacagcttgaggctctgggcctcgcggaaaagcctcagctggtaacccgattccaggaggtgtttagaagcatgtggtcggtcaatggagattcaatctctaaaatttacgctggcacaggggctctggaggggaaggccaaagccggtaagttaaaagacggcgctaggtctgtgactagaacaatccaaaataacttcttcgattcttctaagcaagaggccatcgacgttctgcttctagggaacaccctgaatagcgacctggctgataaagctagggcactcctcaccacgggatctctacgcgcatcaagtaaggttttgaaaagtatgtgcgaaaatttctacaaatacagcaagcccaaaaagattagagtatgcgtcggcacctggaatgtgaatggaggaaaacagtttcggtcaatagcctttaaaaaccagacgctaaccgactggttacttgacgcaccgaagctcgccggaattcaggagttccaggacaagcgaagtaaacccaccgacatatttgctattggatttgaggaaatggtcgaactcaatgcagggaacatcgtttcagcctctacaaccaaccagaaattgtgggccgtcgagctgcagaagaccatctcccgtgataacaagtacgttttactcgctagcgaacagctagtgggggtgtgcctgttcgtgtttatcagacctcagcatgctcctttcattagggatgtggcagtcgacactgtcaagacaggcatgggcggtgcgactggcaataaaggagccgtggcaattaggatgctttttcacacaacctctctgtgtttcgtttgctcccacttcgcagccggtcagtctcaggtgaaggaaaggaatgaagactttatagaaatcgcgcgtaaactctcatttccaatggggcgaatgttattctctcacgactacgtgttctggtgcggcgacttcaattaccgcatcgatcttcctaacgaagaggtgaaagagttgataagacaacagaattgggattccttgattgcaggggatcaacttatcaatcagaagaatgctggtcaggtctttagagggttccttgaaggcaaagttacgtttgccccaacctacaaatacgatttgttttctgacgactatgacacgagcgagaaatgccgcacccctgcctggactgaccgagtgctgtggcgacgtaggaagtggcctttcgacaggtccgccgaagacctggacctgttgaacgccagtttccaggacgagagtaagatactctatacgtggactccaggaactcttcttcattacgggcgagcagaattgaaaacatccgatcatcgtccagtggtcgccctcattgacatcgacattttcgaggtggaggctgaggaaaggcaaaatatctacaaggaagtgatcgccgtgcagggtcctcccgatggcactgtgctggtgagtatcaagtctagcctgcctgagaacaactttttcgatgatgcgttgatagacgaactcctgcagcagtttgcaagttttggtgaagtgatcctcattcgcttcgtagaggacaagatgtgggtgacatttctggagggctcctctgccctgaacgtcctttccttgaacgggaaggaactgctgaaccgcactatcaccatagccctcaagtctcctgactggatcaagaatctggaagaggagatgtctctcgagaagataagcatcgccctcccttcttctactagcagcaccctgttaggcgaggacgccgaggtggcagccgacttcgatatggagggagacgtagacgactactctgcggaagtggaggagttactccctcagcatctgcagccttccagctcctcagggctgggcacctcccctagcagttctcccagaacatctccctgtcagtcccccaccattagtgagggcccagtgccgtcactccctattagacccagccgcgcaccaagtagaacgcctggcccaccttcagcccagtccagtccaattgatgcccaaccagccactcccctgccccagaaggatcccgcacaacccctcgagccgaaaagaccacccccaccaaggcctgtggccccacctacacgtccagcccctccacagagacctccccctccaagcgggaggtctcagcccagcccccaggccggactggccggaccaggccctgccggatattcgacagccagaccaacaattccaccacgcgctggagtaatctctgccccacagtcacatgcacgtgcctccgccggtagactgacgcctgagtcacagagcaaaacttcagaaacatcgaaaggcagcacctttctgccggaacccctgaagcctcaggctgcttttcctccacagtcatcccttcccccacctgcccagagactgcaggaaccactggtgcctgtggcagcccctatgcctcagtccggccctcagccaaatctggagacacccccacagccccctccccgatccaggtcatctcattctctcccgtccgaagccagttcacagccgcaggtcaagactaacggtatatcagacggcaaacgggaaagcccactcaaaatcgaccccttcgaggacctgtcctttaacctgctcgccgtctccaaggcccaactgtccgtgcaaacatctcccgtcccaaccccggaccctaaacgactgattcaactcccctcagcgacccagtcgaatgtcctcagttcagtctcttgcatgcccaccatgcccccaattcctgccaggagccaatcccaagaaaacatgagaagctctccgaatcccttcatcactggactcactagaaccaatccgttctcagatagaacagccgctcccggtaacccgttccgtgctaagagcgaggagtctgaagctactagctggttctccaaggaagagcctgtgaccatctccccctttcccagtttacagcccttggggcacaacaagagcagagcatcttcctctctggatggcttcaaggattcctttgacctccagggtcagtcaactctgaaaatctctaatcccaaaggctgggttactttcgaggaagaggaagattttggcgtgaagggtaagtcgaagtcagcctgttcggatctcctcggcaaccaaccaagctccttctctggcagtaatctcactttaaacgatgactggaacaaaggcaccaatgtttctttctgtgtgcttccttctcgaaggccaccccctccccctgtcccactcctgccgcctggaacaagtcccccagttgaccccttcactacactggcttccaaagcatcccctacgctggatttcacggagcgatag

SEQ ID NO: 243022 - DNA, 4053 bp, Artificial Sequence
  Description of Artificial Sequence: Synthetic coding sequence
atgagaaagcggtgggcctgttggtcaggtagtgatgctccaggaggatgtggtggcggatgcgggcgtcgcagacgtcgcagtcgacgcaagcgcgcagccagcgaagagagaaggatggctttcagcaaaggatttcgcatctaccacaaactggatccccctcctttttcactcatcgtggaaacacggcataaagaagagtgtctcatgttcgagagcggtgccgtcgctgtgctctccagtgcggagaaggaagcaattaagggtacttattctaaggtgctcgacgcttacggattgcttggggtgctgcggctgaacctcggcgacacaatgctgcactacctggtcttggtgacagggtgcatgagcgtcgggaaaattcaagaatccgaggtgttccgggtgacatccacagagttcatcagcctgcgcatcgactcctcagacgaggatcgaatctctgaggtgaggaaagtcctcaacagtggaaatttctatttcgcttggtctgcctccgggatttcgctggatttgagtcttaacgcacatcggtcgatgcaggaacagaccaccgataatagatttttttggaatcagtcactgcacctccacctcaaacattacggcgtgaattgcgacgattggctcttaagactcatgtgtggaggagtagagatcaggacaatctatgccgctcataaacaagctaaggcctgtctgatttctagactgtcctgcgaaagagctggtacacggttcaatgtcagaggcaccaatgacgatgggcatgtagctaactttgtggagacagagcaggtggtctatttggacgactccgtgtcttccttcatccagattcgcggttccgtgccactcttctgggaacagccgggtctgcaggttggctcacaccgggtgagaatgagccgagggtttgaggcaaacgcccctgccttcgaccgccattttcgaaccttgaaaaacctatacgggaaacagatcattgtcaacctcctgggatcaaaagaaggggaacacatgttgagcaaggcattccagagccatttaaaggctagcgagcatgctgccgacattcagatggtgaactttgactatcaccagatggtcaagggagggaaagcagaaaaactacacagcgttctcaaaccacaagtgcagaagttcttggactacggcttcttctatttcaatggcagcgaggtccagcggtgccagtcaggaacagtgaggacaaattgccttgattgcttggaccggactaattctgtgcaggcttttctggggctagaaatgctggccaaacagctcgaagcactgggcctggcagagaaacctcagctcgtgacaaggtttcaggaagtctttcgctccatgtggtcagtgaatggagacagcatatccaagatatacgctggaacaggcgctttagagggaaaggctaaactgaaggacggagcccgttctgttactcggactatccagaataactttttcgatagcagtaagcaggaggcaatagatgtgctcctgctgggtaacaccctcaactctgatctggctgacaaagccagagccctcctgacaactggatctcttagggtgagtgaacaaaccctgcaaagcgcatcgtctaaggtactgaaatctatgtgtgagaacttttacaagtactccaaacccaagaagatccgtgtgtgtgtgggaacctggaacgtaaatggcggtaaacagtttcgctcaatcgcctttaagaatcagacgcttaccgattggctgctggatgcacccaagctggctgggatccaggaattccaggataagaggtccaaacccacagacatcttcgccatcgggtttgaggaaatggtggagctgaacgccggtaatatcgtgtctgcgtcaacaactaatcagaaattgtgggcggtggagttgcagaagacgatatccagagataataaatatgttttgctggcaagcgaacagctggtgggggtatgcctgttcgtgtttatcaggccccagcacgcccctttcatccgcgacgtcgctgtggatactgtcaaaacaggcatgggaggggcaaccggaaataaaggagctgtcgctattcgcatgctgtttcacactacttccctgtgcttcgtgtgcagccactttgcagccggtcagtcacaggtgaaggagaggaacgaggacttcatcgagattgcaagaaagctcagttttcccatgggcagaatgcttttctctcatgattatgttttctggtgcggggatttcaattaccgtattgacctgcctaacgaggaggttaaagaactgatacggcagcagaattgggattctctgatcgccggtgaccaactgatcaaccagaaaaatgcaggacaggtgttcagggggttcctggagggtaaggttaccttcgctccgacttacaaatatgacctcttttctgatgactacgacacatctgaaaaatgtcggacccctgcatggactgaccgcgtcctctggagacgcagaaagtggccctttgatcgcagcgccgaggatctggatcttctgaatgcttccttccaggacgagtcgaagattctgtatacatggacaccaggcacactcctgcactacggaagggccgaattgaagacaagcgatcaccggccagtggtcgccctaattgacatagacatattcgaagttgaggcagaagagcgccagaacatctacaaagaggtaattgccgtgcaagggccacctgacggaactgtattagtatccatcaagagctccttgcctgagaacaatttctttgatgacgctctgatcgacgaactgctccagcagttcgcctcatttggcgaagtaatattgattaggttcgtggaagacaagatgtgggtcaccttcctagaaggatctagtgccctaaacgttctcagcttgaatgggaaggaactgctgaacaggacaattaccatagccctgaaaagtccagattggataaagaacctcgaggaagagatgagtctggagaaaatttcaatcgcgctgccctcctcaaccagcagcaccctgctaggagaagacgcagaagttgctgctgacttcgacatggaaggggacgttgacgattactctgccgaggtggaggagctcttgcctcaacacctgcagccatcaagttcttccggcctcgggacaagcccgtcctcatctccccgtacatctccatgccagagccctactatttcagaaggacctgtgccgtctcttccaattcgaccatcgcgggcaccaagccgcactcccggtcctcccagtgcacaatcctcccccattgatgctcaacccgcaacccctctcccccagaaagaccctgcacagccactggaaccaaaaagacctcctccacctcgccctgtcgctccacccacgcgcccagcaccacctcaacgaccaccccctccatcaggagcacgcagccccgctcctacgcgcaaagaatttggaggaattggcgctcccccttctcccggtgtggccagacgtgaaatggaggcaccaaaaagccctggtacgactcggaaggacaacatcggaaggtcacagcccagcccacaagcaggactggccggaccgggaccggcaggatattcaaccgctcggcctaccattcccccacgggctggggtaatcagcgctcctcagtcccacgctagggcaagtgcaggacggttgacacctgaatctcagagcaaaacatcagagacctcaaaaggtagtacctttctgcccgagccactgaagccacaggctgccttcccacctcagtctagcctgccgccacccgcacagcgattacaggaacctctggtcccagtcgccgcaccaatgccacagtctgggcctcaaccaaatctggaaaccccccctcaacctccccctagaagccgctctagtcatagcctaccctcggaggcctccagccaaccgcagcaggagcagccaagcggctag

SEQ ID NO: 243023 - DNA, 4839 bp, Artificial Sequence
  Description of Artificial Sequence: Synthetic coding sequence
atgagaaagagatgggcttgttggagtggatcagacgctccaggaggctgtggaggaggctgcgggcgtcgcagacgacggagcaggcgcaagcgagccgcttccgaggaacgtcgaatggctttcagcaaaggctttcgcatctatcacaaactagacccaccccctttttcacttatcgttgagacacgtcacaaggaggaatgcctgatgttcgagtctggagcggtggctgtgctctcatctgctgaaaaagaagctataaaaggaacttacagcaaggtgctcgatgcctacgggctccttggagtcttgcggctaaatcttggggacactatgctgcactaccttgtactggtaactggctgcatgtcggtggggaagatccaggaaagcgaggtcttccgggtcacttccacagaattcatcagcctgcgtattgacagcagtgatgaggaccgtatctccgaggtgagaaaggtcttaaatagcgggaatttctacttcgcctggagcgcaagcggaatctctttggacctaagtttaaacgcgcatcggtcaatgcaggagcaaacaacagacaaccgattcttctggaaccagagcctgcacttgcacttgaagcattacggcgtcaactgcgacgattggttgctgcggcttatgtgcggcggagtggagatcagaaccatctacgccgctcacaagcaggccaaagcttgccttatttcccgcttgtcctgcgaacgggctggtaccagatttaatgttcggggaactaatgacgacggccacgtcgccaacttcgtagagacagaacaggtggtgtacctggacgactcagtgtcttctttcatacagatacgaggatcagtgcctctcttttgggaacagcctggactccaggtgggcagccatcgcgtcaggatgtcccggggtttcgaggccaacgctccagcatttgacaggcacttccgcaccctgaagaatctctatggaaaacagatcatagtgaatcttctgggcagcaaagagggggaacacatgctctctaaggccttccagagccaccttaaggcctccgaacacgctgcagatatccagatggtcaattttgattatcaccaaatggttaaggggggaaaggctgaaaagctgcactctgtgcttaaacctcaggtgcagaagtttttagattatggtttcttctattttaacggcagcgaagtgcagcgatgccagtctggaactgtgcgcacaaactgccttgactgtcttgacagaaccaactctgtccaagctttcctgggcctagagatgctggcaaaacagttggaggccctggggctagcagagaaacctcagcttgtaacccgatttcaggaagtgtttcgtagtatgtggagcgtgaatggggattctatctcaaagatttatgccggaaccggggcactggaaggtaaggctaaacttaaggacggcgcaaggtcagtgaccagaacaatccagaacaacttcttcgattcttctaagcaggaggcgatcgatgttctgctgttgggcaacaccctcaattccgacttagctgacaaagctagggctctattaaccacaggatcccttagggttagtgaacagacactgcaatcggcatcatcaaaggttctgaagtccatgtgtgaaaatttttataagtatagcaagcctaagaaaattagagtatgcgtcggcacctggaacgtgaatggtggtaagcagtttaggtcgatcgccttcaaaaaccagactttgactgactggcttctggacgcccctaaattggctgggatccaggaattccaggataagaggtctaaaccaaccgatatttttgccatcggcttcgaggaaatggttgagctcaacgcaggtaatatcgtgtccgcttctacaaccaaccagaaactttgggcagtggagctgcagaagacaatctctcgggataacaagtatgtcctgcttgcctctgagcagcttgtgggtgtgtgcctgttcgtgttcattagacctcagcacgccccttttatcagggacgtggctgtggataccgttaaaacgggaatgggaggtgctacaggcaataaaggcgctgtggccattagaatgctgttccacacaacctctctgtgtttcgtgtgctcccacttcgctgcaggacagtcccaggtgaaggagcgtaacgaagattttatagagattgcacgcaagctgagttttcctatggggagaatgctgttctcccatgactatgtgttttggtgtggagacttcaattaccgcatagatctgcctaatgaggaagtcaaggaattgatcaggcagcagaactgggatagtttaatcgcaggcgatcaactcatcaaccagaaaaatgcgggacaggtttttaggggatttttagaaggcaaagttacgttcgctcccacttataagtacgacctattctctgacgactacgacactagcgagaaatgcagaactccagcatggacggatagggtgctctggaggaggcgcaagtggcctttcgacaggtcggccgaagatctcgacttactgaatgcctctttccaggacgagagtaagattttgtacacttggacacctggtaccctgctgcactacggccgagccgagctgaagaccagcgaccatagacccgtcgtcgccctcatcgacatcgacatctttgaagtggaagcagaggagcgccagaacatctataaagaagtcatcgctgtgcagggccctccggacggaactgtgctcgttagcattaagagttcactacctgaaaataacttctttgatgatgcactgatcgatgagctacttcagcagttcgccagtttcggggaggtcattctgatacggtttgtagaggataaaatgtgggtcacattcctggaaggctcctccgcactcaacgttctctccctcaacggcaaggagctgctaaaccgtaccatcacaattgccttgaagtcgcctgactggatcaagaacctcgaggaggaaatgagcctggaaaagatcagcattgccctgcccagtagcacctcaagtacccttctgggggaggacgcggaagtggccgcagacttcgatatggagggcgatgtggatgactattcagcagaagtagaagagttgctgccgcaacatcttcagccctccagtagctctggcctcggaaccagcccaagcagcagtcccagaaccagcccctgccaaagccccacaatcagtgagggcccagttccatcattgccgatcaggccttctcgggcaccctcgaggactcctggacctccttccgcccagtcatcacctattgacgcacaacccgctacgcccttacctcagaaagaccccgctcagcctctggagcctaaaagaccacctcctcctaggcccgttgcgccacccactaggccagcaccaccccagcgaccaccaccccctagtggcgctcggtcaccagcccctacccgtaaggaattcggcggaattggcgctcccccaagtcctggcgtggcccgtcgcgaaatggaggcgcctaaaagcccagggaccacgcggaaagataatattggcagatcacagcccagcccccaggctgggctcgctggccctggccctgccggttatagtactgcaaggcccacaattccaccaagggcgggagtgataagcgctccacagtcacacgccagagcaagcgcagggcgtttgacaccagaaagccagagcaaaactagtgaaacttctaaaggttccacattcttgccagagccactgaagcctcaggctgcgttccctccacagtctagcttgccacctccagcacaacggctgcaggaacccctggtgcccgttgcagccccaatgccccagtcagggccacagcccaacttggaaaccccaccacagccaccacctcggtctcgaagtagccattccttgccctccgaagcttccagccagccgcaggttaagacgaatggaatctccgatggcaagcgggagagtcctctaaagatcgacccatttgaggacttgtcatttaacctgcttgctgtaagtaaggctcaacttagcgtgcagacaagtccagtaccaaccccagatcccaaacggcttatacagctgcctagcgcaacacaatccaacgtgctgtccagtgtttcctgtatgcccaccatgcctcccatccctgctcgttctcagagccaggaaaacatgaggtcatctcctaacccatttatcacaggcctgacccgcacaaaccccttttctgatagaactgctgcccctggcaatccatttcgagccaaaagtgaggaaagcgaggccacgtcttggttcagcaaggaagaaccagtcacgatcagtccttttccatccttacagcccctgggacataataagagtagggcctccagttctctggacggattcaaggactcctttgatctgcaaggccagagtaccctgaagatcagcaatcctaaagggtgggtgacttttgaagaagaggaggacttcggcgtgaaaggtaaatctaaatctgcctgttcagatttactcggtaaccagccttcttcttttagtggctctaacctcacactgaatgacgattggaataaaggtacgaatgtatcgttttgcgtgctgccatctaggaggccaccaccacctccagtgcccctgctgcccccaggaactagcccccctgtggacccttttactaccctggccagtaaggcgagtcccacccttgattttactgagcgctag

SEQ ID NO: 243024 - DNA, 4491 bp, Artificial Sequence
  Description of Artificial Sequence: Synthetic coding sequence
atggccttgtccaaagggctccggctcctcggacggcttggagccgagggagattgctcagtcttgttggaagccaggggaagggatgactgcctactgttcgaggcgggaactgttgcaaccctggcccctgaagaaaaagaagtgatcaagggtcagtacggcaaactcaccgatgcttacggttgcctgggggaacttagattgaaatctggtgggacctccctgagttttctggtgctagtaactggatgcacaagcgtgggccgaatcccagatgcagaaatatacaagatcactgctacagatttctaccctctgcaggaggaagccaaggaagaggaaagattgatcgcccttaagaagattttatcaagcggcgtcttttatttttcttggccaaacgacggctccaggtttgacctcaccgtaaggactcagaagcagggtgacgattctagtgagtggggtaatagtttcttttggaatcaactgctgcatgtacctttgcggcagcatcaggtcagctgctgtgactggctgctcaagattatttgcggagtcgttaccatccggacagtgtacgctagccacaaacaggctaaagcctgcctggtgtcaagggtgtcatgcgaaaggacgggaactaggtttcacacaagaggcgtgaatgacgatggacacgtttcaaacttcgtggaaactgaacagatgatatatatggatgatggagttagttcgtttgtgcagattagaggaagcgtcccccttttctgggaacagccagggcttcaggtcggttcgcaccatctccgactgcaccgaggactggaagcaaatgccccagcgtttgacagacatatggtgctcctcaaagagcagtatggtcagcaagtggttgtgaacctgctcggtagtcgcggtggtgaagaggtgctcaatcgagccttcaagaaactgttgtgggcctcctgtcatgccggtgatactcctatgattaactttgattttcaccagttcgccaagggaggcaagttggagaaattggagaccctgcttaggcctcagctgaagctgcactgggaggatttcgacgtgttcacaaaaggcgagaatgtctccccgagattccaaaaagggaccctgcgcatgaattgcctcgactgcctcgataggacaaacactgtccagtccttcatagctctcgaagtccttcacctgcagctcaagactctgggactctcctccaaaccaatcgtagatcgcttcgttgagagcttcaaggccatgtggtcgctaaatggacacagcctttccaaggtattcacaggctcgcgggctctagagggaaaagccaaggtgggcaagttaaaggatggtgcgaggagcatgtcacgcacaattcagagtaatttttttgacggcgtcaagcaggaagccatcaaattgttgctggtgggcgatgtctacggagaggaagtcgccgacaaaggcggtatgctgttggacagtacggcgctgttagtgaccccacggattttaaaagccatgaccgagaggcagagcgagttcaccaattttaaaaggatccgtatcgctatggggacctggaatgtgaatggaggcaaacagttcagatccaatgtgctgagaactgctgagctcacggactggctgctggatagtccccagctcagtggagccaccgattcgcaggatgattcgtcgcccgctgacattttcgccgtaggattcgaggaaatggtagagctgtctgctggcaatatcgttaacgcctccacaacaaataaaaaaatgtggggggaacaactccagaaggcaatctctcggtcccatcgctacattttgctgacatctgcgcaattagtgggcgtgtgcctgtatatattcgtccggccttatcatgtgccattcattcgagacgttgcgatcgacacagtaaagactgggatgggcggaaaagcaggcaataagggggctgtgggaatccgtttccaattccactcaaccagcttttgctttatctgcagtcacctgactgccggacagagtcaggtgaaggagaggaatgaagattacaaggaaatcactcagaagctttgtttccctatgggaagaaacgtgttctcgcatgactacgttttctggtgcggagattttaattacaggatcgacctcacatacgaagaagtcttctatttcgttaaaagacaagattggaagaagctgctcgaattcgaccaacttcagctgcagaagagctccggaaagatattcaaggactttcatgagggggcaatcaactttggaccaacgtataaatatgacgttgggtcggctgcatacgacacgagcgacaagtgtcggactccagcctggacagatagagtcctgtggtggaggaagaaacacccttttgataagactgcaggagagttaaatctgctggatagcgacctcgacgtcgacaccaaagtgaggcacacatggagccccggtgcgctgcagtactatggcagagccgagctacaggcttctgaccacagacctgtgttggctattgtagaggtcgaagtgcaggaggtggacgtgggggctcgtgagagggtttttcaggaagtatccagctttcagggcccactcgacgctacagttgtcgtgaacctgcagtcccctactctggaggagaagaatgagtttcccgaagacttaagaacagagcttatgcagaccttgggctcctatgggacaattgtccttgtccgcataaaccaggggcagatgttagtcacgtttgctgattcacacagtgccctgtcggtgctcgacgtggatgggatgaaggtgaaggggagagctgtcaaaattcgcccaaaaacaaaagactggctaaagggcttacgcgaagaaattataagaaagcgcgactcaatggctcccgtcagtcccacggccaactcctgcttgctggaggaaaactttgattttactagcctggattacgaatcagagggagacattcttgaagacgacgaggactacctggtggatgagttcaatcagcccggtgtatctgatagtgagttagggggagatgacttaagtgacgtgcctggtccaactgcactggcccctccttccaagagccccgcattgaccaaaaaaaagcagcatcctacttacaaggatgacgccgacctggtcgaattaaagagagagctggaggccgtcggcgagttccgacaccggtcccccagtcgcagtctgtccgtaccaaataggccacgccctccacagccacctcagaggcctccacctcccacaggcctcatggtcaaaaagtcggcctccgacgcaagtatatcatctggtacacacggccagtacagtattctacagacggccaggttactgcctggagcaccacaacagccccctaaggccaggactggcattagcaagccctataacgtgaagcagatcaagaccacaaacgcccaggaggccgaggccgctattcgatgccttttggaggccagagggggtgctagcgaggaagccctgagcgccgtggctcctcgggacttggaagcttcttctgagcctgagccaactcccggagcagccaagcctgagacccctcaggcaccccctctgctcccgcgtcggcctcctcctcgcgtgcccgcaattaaaaaaccgacactccggaggactggtaagccgctgtctcctgaggagcagttcgagcagcagactgtgcattttaccatagggccacctgagacctcagttgaggcaccaccggtagtgaccgcccctcgcgtcccgcctgtgccaaagcccagaacgtttcagccaggcaaagcggctgagagaccctcacaccgcaaacccgcatccgacgaggccccaccaggcgctggtgcctccgtgcctccgcctctcgaagccccacctctggttcccaaggttccccctaggcgcaagaagagtgccccagctgctttccacctgcaggttttacagagcaacagtcagctccttcagggattaacctataattcttcggatagtccgtcaggacatccccctgctgctggcactgtgtttcctcagggtgattttttaagtaccagcagtgctactagccccgacagcgacggcacaaaagccatgaagcccgaagccgctcccctcctcggcgactaccaggaccccttctggaatctgctgcaccatccaaaactgctcaataacacttggctgtctaagtcaagtgacccgttagatagtgggacacgctcacccaagcgcgatccaattgatccagtcagcgctggggcaagtgccgcaaaagcagagctgcccccagaccatgagcacaagactttggggcattgggtcacgattagcgaccaagaaaagcggaccgccttgcaagtgtttgatccattggctaagacctag

SEQ ID NO: 243025 - DNA, 1746 bp, Artificial Sequence
  Description of Artificial Sequence: Synthetic coding sequence
atgcagacactcggcagctacggcactattgttcttgtgagaattaatcaaggacaaatgttggttaccttcgcagacagccactctgctctctctgtcttggacgtagacggcatgaaggtgaagggacgcgctgtaaaaattagacccaagaccaaggattggttaaaaggcctaagggaggagattatccggaagcgtgattctatggccccagtctcccccactgctaactcctgtcttttggaagaaaatttcgacttcacatcccttgattacgaaagcgagggtgacattttggaggacgacgaagattaccttgtcgacgaattcaatcagcctggcgtgtccgactctgaactcgggggagacgatctgtcggatgtcccaggccctaccgctttggccccaccatctaaatcccccgcacttacaaagaaaaagcagcaccctacgtataaagatgacgccgacctcgtggagctgaaaagagagttggaggccgtgggggaatttcgccatagaagccccagccgctccctgtcggttcctaatcgaccacgaccgccacaacctccgcagcgccctccaccccctaccggccttatggtgaagaagagcgctagcgatgcttcgatttcctctggcacacacggccaatattcaatacttcagacggctcgcttgctcccaggggcacctcaacaaccccctaaggcccgaactggcatctcgaaaccttataatgttaagcaaattaaaaccacaaacgctcaggaggctgaggcagccattagatgcttactagaagcacgcggtggggctagcgaggaagcactatccgccgtcgctccaagggacctggaagcctccagtgagcccgaacctacgccgggagccgctaaaccagaaacacctcaggcgcctcccttattaccaagacggcctcctcctagagtaccagccataaagaaaccaacgcttagacggacaggtaaacctctgtcccctgaggaacagttcgagcagcaaacagttcattttaccattggacccccagagacaagcgtggaagcaccccctgtggtaacagccccaagggtgccccctgtgcccaagcccaggaccttccagcccggaaaagctgccgaacggcctagccacaggaagcccgctagtgatgaagctccgccaggtgcgggtgcgtccgtgccaccacctctagaagctccacccttggtccctaaagtgccacccaggcggaagaagtcagccccagccgcttttcacctccaagtgctgcagagcaatagccagctgcttcagggcctcacctataactcttccgactccccatcagggcatccgcctgctgctggaactgtgttcccccagggggattttctcagcaccagttccgctacctcgccggactctgacggtaccaaagccatgaaacccgaggccgcacccttgctcggagattaccaggatcctttttggaatttgctgcatcatcctaagctactgaataatacttggctgtccaaaagttctgatcctcttgactctggcacgcgatcccccaagcgggacccaatagatcccgtatcagccggagcctctgctgctaaggccgaattacccccagaccacgagcacaaaacgttaggccattgggtgacaattagcgaccaggaaaaacgcaccgcgctccaagtgttcgacccacttgccaaaacatag

SEQ ID NO: 243026 - DNA, 411 bp, Artificial Sequence
  Description of Artificial Sequence: Synthetic coding sequence
tgaggcagggacgattgtctccttttcgaggccggtacagtggccacgctggccccagaagagaaagaagtcatcaagggccagtacggtaagttaaccgacgcatacgggtgcttgggcgagctgcggctcaaaagtgggggaactagcctgagctttctcgttcttgtaacgggctgcacctccgtcggtagaatccctgatgccgaaatctataaaataaccgccacagatttttacccattgcaggaggaggccaaggaggaggagaggctgattgccctgaagaagatcctttcatcaggagttttctactttagctggcctaatgacggcagtagattcgacttgaccgtgcgcacccagaagcagggtgacgattcatctgaatgggggaattctttcttttag

SEQ ID NO: 243027 - DNA, 3867 bp, Artificial Sequence
  Description of Artificial Sequence: Synthetic coding sequence
atggccctgtctaaggggctgaggctgctcgggagactcggtgcagagggggattgttccgtgctcctggaagccagggggagagatgattgtttactctttgaggctggcacagttgcaaccctggctcctgaggagaaagaggtgattaaaggccaatacggcaaactgacagatgcctacggatgcctgggtgagttacgccttaaaagtgggggtacctccctttcatttcttgtgctggtcaccggatgcacctccgtgggacggatacctgacgctgaaatctataagatcactgccaccgacttctatccattgcaggaggaggccaaggaggaggagcggctcatcgccctaaagaagatactgtcaagcggggtgttctattttagttggccgaacgatgggtcccgttttgatttgacagtccgtactcagaagcagggagatgattcctcagaatggggcaatagcttcttttggaaccagttgctacacgtgccactaagacagcaccaggtctcctgttgcgactggctacttaaaatcatctgcggggtcgtcaccattagaaccgtctacgcctcccataagcaggccaaggcgtgcctggtctctagagtgagttgcgagcgtactgggacgcggttccacacccgcggagttaatgacgacgggcacgtctcaaattttgtggagaccgaacagatgatctacatggatgacggggttagcagcttcgtgcagattagaggaagtgtcccactgttctgggaacagcccggactgcaggtaggatctcatcacctccgccttcatcgcggattggaagcgaatgccccagcatttgacagacatatggtcctcctgaaggagcaatatggccagcaggtggtggtcaatctgttaggtagtaggggtggcgaggaggtccttaacagggccttcaaaaagttgctgtgggcatcctgtcacgccggagatacaccaatgatcaattttgacttccatcagttcgccaaaggcggaaaactggagaagcttgagacgttgctgaggcctcagttgaagttgcactgggaggattttgacgtgtttactaagggcgagaacgtgtctcctcgctttcaaaagggcacgctgaggatgaactgtctggactgccttgatcggacaaacaccgtgcagagcttcatcgccttagaagtgctgcacctgcagttaaagactcttgggcttagttcaaagcccatcgttgatcgcttcgtggaatcctttaaagctatgtggagcctgaacggccactcattgagcaaggtattcacagggagccgagcattagaggggaaagctaaggttggtaaattaaaggacggcgctcgctccatgtctcgaaccatccaatctaacttcttcgatggtgtgaagcaagaggctattaaactacttctggtcggcgatgtgtacggtgaggaggttgctgacaaaggcggtatgttattggattccactgccctcctcgttacacccagaatcctgaaagcgatgacagagagacagagtgagtttaccaacttcaagcggatacggattgccatgggcacctggaatgttaacggtggcaagcaatttcggtctaatgtgctcagaacagctgaactgaccgattggctccttgactccccccagctctccggtgcgacggacagccaggacgactcatctcccgctgacatcttcgctgtggggttcgaggagatggtcgagctgagtgctggcaatattgtcaatgcaagcaccaccaataagaagatgtggggggagcagctgcagaaagccattagccggtcccatcggtacatcctcctaacgtcagcacagctggttggcgtctgcctctacatattcgttcgaccgtatcatgtgccctttatacgtgatgtggcaatcgacacagttaaaacgggcatgggtggtaaggctgggaataagggagctgtggggatccgctttcagttccacagcacttccttctgttttatttgttcacatttaactgctgggcagtctcaggtcaaggaacgcaacgaagactacaaagagatcacccaaaaactgtgtttcccgatgggaagaaacgtcttctcccacgactacgtattttggtgcggcgacttcaactacagaatcgatctcacttacgaggaagttttttattttgtgaaacgtcaggattggaagaaactgctagaatttgaccaactccagctacagaagtcctccgggaaaattttcaaggattttcacgaaggggcaatcaactttgggccaacgtacaagtacgatgtaggcagtgcggcttatgatacatctgataagtgtcgaaccccagcttggaccgacagagtgctgtggtggcggaagaaacacccattcgacaaaaccgctggagagctgaaccttctggattctgacttggatgtggacaccaaggtcagacacacatggtctcccggagcactccagtactacggacgggcagagctgcaagcatcagaccataggcctgtgctggccattgtcgaggttgaggtccaggaggtggatgtgggtgcccgtgaacgcgtcttccaggaggttagtagtttccagggaccccttgacgcaacagtcgtggtcaacttgcagtcgcctaccttggaggagaaaaatgagttcccagaggacttgcgcacggaacttatgcagaccttaggtagctacggtacgatcgtacttgtccgcatcaatcagggccaaatgctggtcacttttgccgactcacattccgccctcagcgtcctggatgtagacggcatgaaggtcaagggaagggcggtaaagatcagacctaagaccaaggactggctgaaaggtctgcgagaggaaatcataagaaagcgtgactcaatggcacccgtgagtcctaccgcaaattcttgtttgctggaggaaaattttgattttacaagcttggactatgaatccgagggtgacatcttagaagacgatgaggattaccttgtagatgagttcaaccagcccggtgttagcgacagcgaacttgggggagatgacctgtcggatgttcctgggccaaccgccctcgcgcctccttccaaaagccctgcactgactaaaaagaagcaacaccccacctataaggatgatgcggacttggttgagcttaagagagaactggaggccgtgggcgagtttaggcatagatcacccagcagaagcctcagcgtgccgaatcgccctcgtccacctcagcctccacagagacccccaccacctactggacttatggtgaagaaaagcgcgtccgatgcctcaatatcctcgggtacacatggtcagtattccatcttgcagaccgccaggctattacctggcgctccacagcagcctcccaaggcccgtaccggcatctcaaagccctacaacgtaaaacagataaagaccacgaatgcccaagaggcagaagccgcaatccggtgtctgcttgaagccagaggaggagcttccgaggaggccctgagtgccgtagctccgcgagacttggaagcatcttctgagccagagcctacccccggagccgctaagcccgagacgcctcaggcaccacctttactgcctcgaaggccacccccaagggtgcccgcaatcaagaaaccaacactgcgtcgcacagggaaaattgtgttttgttcgcggtcgcaggcctcacagccttgcttgctactgcagaggcacgagtttgtgcggacagtcgccgcacagaggctagccagtgtcgatacgtctggttcgtccgtgtag

SEQ ID NO: 243028 - DNA, 4356 bp, Artificial Sequence
  Description of Artificial Sequence: Synthetic coding sequence
atggccctgagcaagggactcaggctgttggggaggctgggggctgagggcgattgcagcgtgttgctggaagcgaggggcagggatgactgcctgctgtttgaagccggtaccgtggcgactcttgcccctgaagagaaagaagtaataaaaggacagtacgggaaacttacagacgcgtatgggtgcctgggagaactgcgactcaagagtgggggaaccagtctctccttccttgtgctcgttactgggtgcacaagtgtcggacgcatccctgatgcggagatttataaaataaccgctaccgatttttatcctttgcaggaagaagccaaagaggaggaaagactgattgctctaaagaagattctctcttctggagtgttttatttctcctggcccaacgacggcagtcgcttcgacctgactgttagaacacagaagcaaggcgacgatagtagcgaatggggtaacagctttttctggaaccagctgctccacgtacctctaagacaacatcaagtgagctgctgtgattggctgctgaagattatctgtggcgttgtaacaattcgcactgtctacgcttcacataaacaggccaaagcctgtttggtgagccgcgtctcttgtgagcgaactggcacacggtttcacaccaggggcgtgaatgacgatggacacgtgtctaacttcgtggagaccgaacagatgatatatatggacgacggcgttagttcattcgttcagattagaggtagcgtgccgttgttctgggagcagcctggactgcaggtgggatcccatcatctgagattgcatagaggcctggaggccaacgctccagctttcgacagacacatggtgcttctaaaggagcagtatggacagcaagtggtagttaacctcctaggttctcgaggcggtgaagaagtgctcaatcgggcttttaagaagctgttgtgggcttcttgtcacgcgggtgacacccccatgattaactttgatttccatcaatttgctaaaggagggaagttggagaagcttgagactctcctccgaccgcagctgaagctccactgggaagatttcgacgtattcacgaaaggagagaatgtctctcctcgatttcaaaaagggactctcaggatgaactgtttggactgtctggacagaaccaacactgtccaaagcttcatcgcactggaagtgttacatttgcagctgaagaccctcggacttagctctaaaccaattgtcgatcgctttgtggagtcattcaaggcaatgtggtccctcaatgggcactccttgtcaaaagttttcaccgggtcaagagcactcgaagggaaagctaaagtcggcaagctcaaggacggggcaagatcaatgagtcggaccattcagagcaactttttcgatggcgtgaagcaggaagctatcaaattgctcctggtcggtgatgtctatggggaggaagtggccgataaaggtggaatgctgctggacagtactgctctgctcgtgacaccaagaattctcaaggcaatgaccgaaagacagtccgagtttaccaatttcaagagaattagaatcgccatgggaacctggaacgtgaacgggggaaagcagttccggtcaaacgttctgaggacagccgagttaacagactggttgctggactcgcctcagctctcaggcgctacagactcacaggatgacagttcccccgcagatattttcgcagttggttttgaggaaatggtcgagctgtctgcgggtaatatcgttaatgcttccacaaccaacaaaaagatgtggggcgaacagctgcagaaggcaatctcccgcagtcacagatatatcctcttaacgagtgcccagctggtgggtgtatgtctgtatatcttcgtccgcccttaccacgtcccgtttattcgggatgtcgccatagataccgtaaagactggcatggggggaaaggccggaaataaaggcgctgtcgggattaggttccagtttcactctactagcttttgcttcatttgtagccatctgactgccggacaatcacaggtgaaagaacgaaatgaggactacaaagaaatcacccagaaactgtgtttcccgatgggcagaaatgtattttcccatgactacgtattctggtgcggtgatttcaactacaggatcgatctgacctatgaggaagtcttttatttcgtgaagaggcaagactggaaaaagctcttagaatttgatcaactgcaactgcagaagtcatccggaaagatctttaaagacttccacgagggggcaatcaatttcggcccaacttataaatatgatgtgggctcagcagcttacgacacgtccgataagtgtagaactcctgcatggaccgacagggtactgtggtggagaaaaaaacacccatttgataagactgctggggagctaaatctgctagattctgacttggatgttgatacgaaggttcggcacacctggtcacccggtgcccttcaatattacggccgtgctgagttacaggcaagtgaccacaggcccgtcctggctatagtcgaagttgaagtccaggaggtggatgtaggggcacgggagcgtgtgttccaagaggtgtccagcttccagggccctttggacgccacggtggtagtgaatttacagagtcctacgctagaagaaaaaaatgagtttccagaagatcttcgtaccgagctgatgcagactctgggatcctacggtactatcgtcctcgtgaggattaatcagggacaaatgctcgttacctttgccgactcccattccgcgctgagtgtactggatgtggatgggatgaaggtcaaagggagggctgtcaagatacggccaaaaacaaaggactggctgaaagggctgagagaggaaattattaggaagcgggacagtatggcacctgttagccctaccgccaatagctgccttctggaggagaactttgattttacatctcttgattacgagagtgagggggacatcctcgaggatgatgaagactacctggtcgacgagttcaaccagccaggagtatccgattctgagctcggaggggacgatctctctgacgtgccgggacctactgcactggcaccgccatcaaagagtcccgcattaactaaaaaaaaacagcatcctacttacaaggcgggtctgatggtgaagaagagcgcttcagacgcttctatcagcagcggtacacatggacagtacagtatcctgcaaaccgctcggcttctccctggggctccacagcagccaccaaaagcgaggaccggtatcagcaagccctacaatgtaaagcaaatcaaaaccacgaacgctcaggaggccgaggccgctatacgatgcctcctggaagcgagggggggtgccagcgaggaggctctctcagcagtggcccctagggacctggaggcctcatctgaacctgaaccaacacccggtgctgcgaaaccagagacccctcaggctccacccctcttgccgagaagaccaccacccagagtgcctgccattaagaagccaacgctcaggcgtacaggtaagccactgtcgcctgaagagcaatttgagcaacagaccgtccacttcaccattggcccacctgagacatcagtcgaggcacccccagtggttacagctcctagggtgcccccagtgccaaagcccagaacattccagccaggaaaggcagcagagaggccaagtcaccgcaagcctgcgagcgacgaggctccaccaggagcgggtgcctctgtccccccaccactcgaagcacccccactggtgcccaaggtgccccctcggaggaagaaatcagcccctgccgctttccacctccaggtattacaatccaatagccaactcctccagggtctaacttacaattcctcagactctccttcaggtcacccgcctgctgctggcacggtcttcccacaaggtgattttctgagcacatcatctgctacctcacccgattcggatgggaccaaggcaatgaaacccgaagccgctcctctgttgggcgactaccaggacccattctggaatctgctgcaccaccctaaactgctgaacaatacctggctgtcaaagtccagcgatccactggacagcggtacccgcagccccaagcgagatcctattgatccagtctccgctggcgcatccgctgccaaggccgaactgcctcccgaccatgagcataagacactgggccattgggtcacaatctccgaccaggagaagaggactgctctccaggtgtttgatcctttagccaaaacttag

SEQ ID NO: 243029 - DNA, 279 bp, Artificial Sequence
  Description of Artificial Sequence: Synthetic coding sequence
atgtttctatatgcgagcggcccagctcctcccgcaggaacctgcagatggggcggtcagggtggaacttcactctctttcctggtcctcgtgacgggctgtacttccgtgggacgcatccccgacgcagaaatttacaagatcacggctacggacttctacccactgcaggaagaggctaaagaggaagaacgactgatcgcgctgaaaaaaatcctgtcgtccggcgtgttttacttctcttggccaaacgacggctccagatttgatttaacctag

SEQ ID NO: 243030 - DNA, 1551 bp, Artificial Sequence
  Description of Artificial Sequence: Synthetic coding sequence
atgtttctgtatgcgagcgggccagcccctcctgccggtacctgcagatggggaggacaaggagggacctcactgtcttttctcgtgctggtaaccggctgcacctccgtaggacgcatccctgacgcagagatctacaaaataactgccaccgatttctatcccctgcaggaagaggctaaggaggaggaacgtcttatcgcactcaagaagatactatcatccggagtcttctacttcagctggcccaacgacggcagtcgctttgacctcaccgtcaggacccagaaacagggcgatgactcaagcgagtgggggaactccttcttttggaaccagttactacacgtgcccttacggcagcatcaagtttcctgctgtgactggctgcttaaaataatttgtggagtggtgaccattcggaccgtctacgcctcccacaagcaggctaaagcctgcttagtatctagagtttcttgtgagagaaccggcaccagatttcacaccaggggcgttaacgacgatggacatgtgtccaacttcgtggagaccgagcagatgatctatatggacgatggtgtatcttcatttgtgcagattagaggcagtgtgcctctcttctgggagcaaccaggtcttcaggtagggagccaccaccttagattgcaccggggtctagaggcaaacgcgccagcctttgatagacacatggtgctgttgaaggagcagtacgggcaacaagtcgtcgttaacttactcggcagccggggtggagaagaagttctcaatagggccttcaagttcgctaagggtggaaagttggaaaagcttgaaactttactgagaccccagttaaagctgcactgggaagacttcgatgtcttcaccaaaggggaaaatgtatcaccacgcttccagaagggaactctgcgcatgaattgcctggactgcctggaccgtacaaatacagtccagtcatttattgcccttgaagtgctccacctgcagctcaagacgctgggacttagtagcaagcctatcgtcgatcggtttgtggagtcttttaaggccatgtggtccttgaatgggcactctctgtctaaggtgtttactgggtctagagccctggagggaaaggcaaaagtcggaaagctgaaagacggcgctaggtccatgtcacgtaccatccagagcaacttcttcgacggcgtgaagcaagaggcaatcaaactgttgctcgttggtgacgtctatggcgaggaggtcgctgataagggcggaatgctgctcgactcgaccgcccttctcgtgactccccgaattcttaaggcaatgaccgaaaggcagagcgaatttaccaacttcaaaaggatacgcatcgccatgggtacctggaatgtaaacgggggaaagcagttccgctcaaatgtccttagaacagcggagctaaccgactggttactcgactctccccagctgagtggagctacggatagccaaggagaggggagcgactttgggggagacaaaatccagctgcaccttacgtag

SEQ ID NO: 243031 - DNA, 438 bp, Artificial Sequence
  Description of Artificial Sequence: Synthetic coding sequence
atgaatggacgagtggactatctggtgacagaagaagagatcaacttgacccgcggtccaagtggattaggcttcaatatcgtagggggaaccgatcagcagtacgtgagtaatgattcaggcatctatgtgtcgcgcattaaagagaacggtgccgctgccctggacggacgtctgcaggaaggcgacaaaatcctttcagtgaacggacaggacctgaaaaacctgcttcaccaggatgcggtagacctgtttcggaatgctggctacgctgtgtccctgagggttcagcatcgcctccaggtacagaatggcccaataggccacaggggcgaaggggacccatctggaataccgatattcatggttctagtgcctgtcttcgccttgacaatggtcgctgcgtgggcttttatgaggtataggcagcagctgtag

SEQ ID NO: 243032 - DNA, 957 bp, Artificial Sequence
  Description of Artificial Sequence: Synthetic coding sequence
atggcgggacgctctctcacatccaaggcagaacccaccgccggtgcggtggatcgggcagagaaggccggaggacaggatacctcttcccagaagattgaggacctgatggagatggtacagaagctgcagaaagtcggtagcttagagcccagggtcgaagtactgattaaccgcatcaacgaagtgcagcaagcaaaaaagaaggccaacaaggacctcggggaggctaggactatatgcgaggcgcttcagaaggagttagactcactgcacggggaaaaggttcacctaaaggaaatcttatctaaaaaacaagagacactgaggatccttaggttgcactgtcaggagaaagaaagtgaagcccatagaaaacatacaatgctacaggagtgcaaagagagaatcagcgctctgaatttgcaaatcgaagaggagaagaacaaacaacgccagctgcgactggctttcgaggagcagctggaggatcttatggggcagcacaaggacttgtgggactttcacatgccggagaggctcgccaaggagatctgcgcactcgactcaagcaaggagcagctgctgaaggaagagaaattagttaaggccacgctcgaggatgtgaaacatcagctgtgtagcctatgcggagccgaaggccctagcacgctagatgaggggttatttttgagaagccaagaggccgctgccacggtgcaactgttccaagaggaacaccggaaagctgaagagctgctggcagcagctgcacagcgacatcaacagctgcagcagaaatgccaacagcagcagcagaaaagacaaagactgaaagaggagctggaaaagcacggtatgcaagtccctgcccaggctcagagcacccaggaggaggaagctggccctggagatgtggccccaagaccgggaagacccgtcacatggtggagctag

SEQ ID NO: 243033 - DNA, 1056 bp, Artificial Sequence
  Description of Artificial Sequence: Synthetic coding sequence
atggcgggaaggagtcttacgtccaaagccgaacctactgctggggcagtagacagggccgaaaaagcgggagggcaagacacatcatcccaaaagatagaagacctgatggagatggttcagaaactccagaaagtgggatctttagaaccgcgagttgaagtcctgatcaaccgcatcaatgaggttcagcaggccaaaaagaaggctaacaaagacttgggagaggccagaacaatttgtgaggccctgcagaaggaacttgattctttacacggtgaaaaagttcacctgaaggaaatccttagcaagaaacaggagacactccggatactgcggcttcactgtcaggagaaagagagtgaggcacacaggaagcacacaatgcttcaggaatgcaaagaaaggattagcgccctaaatcttcagatcgaggaagaaaaaaacaaacaacgtcaactgcgattggcttttgaagagcagctggaggaccttatgggccaacacaaagatctctgggatttccatatgcctgaacgtcttgcgaaagaaatatgcgctttggatagtagtaaggaacaactgctcaaggaagagaaactcgtgaaagctacactggaggatgtcaaacaccagctgtgttcactgtgtggtgccgagggcccttccaccttggacgaggggttgtttctccgcagtcaggaggctgcggctaccgttcaacttttccaggaggagcataggaaagctgaggaactgctggccgctgcagcccagagacaccaacaactccagcagaagtgtcaacagcagcagcagaagaggcagcgactgaaagaagagcttgaaaaacacggcatgcaagtgcctgcccaggcccagtctactcaggaagaggaggctggacctggagacgtggcaagcccgaagccccttaagggggagcgccctggcgctgcccaccaggccggacccgatgtcctgattggacaggaggatacattacacccagatctctctccgagaggattccaggagatcaaggaactcttttag

SEQ ID NO: 243034 - DNA, 849 bp, Artificial Sequence
  Description of Artificial Sequence: Synthetic coding sequence
atggagatggtacagaagctgcagaaggtggggagcttggaacccagggtcgaggtgcttataaacagaatcaatgaggtgcagcaggccaagaaaaaggcaaacaaggatttgggtgaagctaggactatatgcgaggcattgcagaaggagctagattcactgcacggggaaaaggtccacctcaaggaaatccttagcaaaaagcaggaaacactacggatcttacgtctgcattgccaggaaaaggagtccgaagctcatcgaaaacatactatgctccaagaatgtaaggaacgcattagtgctttgaacctccaaatcgaggaggaaaaaaacaaacagcggcaattgagactggccttcgaagagcagctggaggatcttatgggtcagcacaaggatctatgggattttcatatgcctgaacgcctggcgaaagagatctgtgcactggattcaagtaaagaacagctgctcaaggaagagaagcttgtgaaagctaccttggaagatgtaaaacaccaactgtgctctttatgcggcgcagaaggccctagtacactggacgagggcttatttctacgcagtcaggaagccgctgcgaccgttcaactgttccaggaagagcacaggaaggcagaagaattgctggcagctgcggcacaacgtcatcaacagttgcagcagaaatgtcagcagcagcagcaaaagcggcagcgcctcaaggaagagctggagaagcatgggatgcaggtgcctgcacaggcccagtctactcaggaggaagaagcaggccctggagatgtggccccacgcccaggccgtccagttacatggtggtcatag

SEQ ID NO: 243035 - DNA, 849 bp, Artificial Sequence
  Description of Artificial Sequence: Synthetic coding sequence
atggaaatggtgcagaagttgcagaaggtgggttctcttgaacccagagttgaggtcctgatcaacaggataaatgaggtgcagcaggctaagaaaaaagctaacaaagatcttggtgaagccagaactatctgtgaagccctccaaaaagagctggatagtctccatggagaaaaagtccacctgaaggagatcctgagcaagaagcaagagacactgcggatattgagattgcactgccaggaaaaggaatccgaggctcatcgcaagcacactatgctgcaggaatgcaaagagcgcattagcgcattgaacttgcagatcgaggaagagaagaacaagcagcggcagctgcgattggccttcgaggaacagcttgaggacctgatgggacagcacaaagacctatgggacttccacatgcctgagcggcttgccaaggagatttgcgccctggactcgtcgaaggaacagcttctcaaagaggaaaaattagtgaaagctacactggaagatgtgaagcatcaactatgctctctgtgtggcgcagaaggcccaagcaccctggacgaaggactcttcctccggtcgcaggaggcagccgcaaccgtgcaactgtttcaggaggagcaccgcaaggccgaggaactgctggccgcagcagctcaaaggcaccagcagctgcagcagaagtgtcagcaacagcaacaaaagagacaacgcctgaaagaggagctcgagaagcacggcatgcaggtgccggctcaggcccagtcaacacaggaagaggaagctggaccaggcgacgtagctcctcggcctgggcgaccagtgacatggtggtcatag

SEQ ID NO: 243036 - DNA, 657 bp, Artificial Sequence
  Description of Artificial Sequence: Synthetic coding sequence
atggagcggcagggtgtcgacgtgccacacgtaaaatgtaaggatcaggagccccagccactcggggagtcaaaggagcaccctcggtgggaggaaaattgtgaggaggaagcgggtggagggcctgcttccgcgagctgccagctgaccgttttggaagggaagtcaggcttgtattttagttctttggatagttcgatcgacatattgcagaaaagagcgcaggagcttatagagaacattaataagtctaggcagaaggatcacgctctgatgaccaactttcgaaactccctcaagactaaggtgagcgatctgacggagaaattagaggaaagaatataccagatctataatgatcacaataagatcatccaggagaagctccaggagtttactcaaaagatggccaaaatctctcaccttgagacagagctgaagcaggtgtgccactctgtcgagaccgtgtacaaggatctgtgtctgcagcccgagcagtccctccgcctgcgatgggggccagaccactcccggggaaaaagccctcctcgtccaggaaactcccagcccccagatgtattcgtctcctcggtcgccgagactacaagccaggccaccgccagcgaagtccaaactaaccgcgacggggagtgctag

SEQ ID NO: 243037 - DNA, 2931 bp, Artificial Sequence
  Description of Artificial Sequence: Synthetic coding sequence
atggaaaagcaaaaacctttcgccctttttgtaccaccgaggtcaagttctagccaggtgtcagcagtgaaacctcagactctcggaggcgattctaccttcttcaagagttttaacaagtgtactgaggacgattttgagttcccatttgcgaagacaaatctctccaagaatggggaaaacatcgactccgaccccgctcttcagaaggtgaatttcttaccagtgctggagcaggtcggaaattccgactgccactaccaggaaggactgaaagatagtgacctcgaaaactccgaaggattatcccgcgtgtacagcaaattgtacaaggaagctgagaaaatcaagaagtggaaggtgtcgacagaggccgaattaagacagaaagagagtaagctgcaggaaaatcgaaagattattgaggctcagagaaaagctatccaggaattgcagttcgggaatgaaaaagtttctctcaaacttgaagagggcattcaggagaacaaagatctaattaaggagaacaatgcaactcgccacctgtgtaacctgttgaaggagacgtgcgcccgtagtgcggagaaaaccaaaaaatatgagtatgaaagggaagagacccgccaggtttatatggaccttaataataatattgagaaaatgattacagctttcgaagagctaagagttcaggccgagaattccagacttgagatgcactttaagttaaaggaagactacgagaagatccagcatttggaacaagagtacaagaaagagatcaacgacaaagagaaacaggtgtctcttctcctgatccaaattacagaaaaagagaacaagatgaaggacctaacgtttcttctagaggagtcacgagacaaggtaaaccagcttgaagaaaagactaaactgcagagtgaaaacttgaaacagtcaattgagaagcagcaccatcttactaaagagttggaggacatcaaagtctccctgcagcgctctgtgagtactcagaaagcactcgaggaggatttgcagatagctacgaaaactatttgccagttgaccgaggagaaggagacacagatggaggaatccaataaggctcgcgctgcccattcctttgtggttactgagttcgagaccactgtctgcagcctggaagagctgctgcgcactgaacagcagcgcctcgaaaaaaacgaagatcagctcaaaatcctcactatggaactgcagaaaaaatcgtccgaactcgaagagatgactaagcttacaaacaataaggaggtcgaactagaggaacttaaaaaggtgctcggagagaaagaaacactgctatacgagaacaagcagttcgagaagatcgcggaagaacttaaaggaactgaacaggagctgatcggtctattgcaggccagagagaaggaagttcacgatctcgaaatacagctgactgcaattaccacgagcgagcaatactattccaaagaggtgaaagatctgaaaactgagctggaaaatgagaagctgaaaaacaccgaacttacgtcgcactgcaacaaacttagcctggagaacaaagaattaacacaggagacctccgatatgactctcgaactcaagaaccagcaggaggacatcaacaataacaaaaaacaagaagagagaatgcttaaacaaatcgagaacctgcaggagaccgaaactcagctacggaatgagctggagtacgttagagaagaactgaagcagaagcgggatgaggttaagtgtaaactggacaaatccgaggagaattgcaataacttacgtaagcaggtagagaataagaataagtacatagaggagcttcaacaggaaaacaaggcccttaaaaaaaagggaaccgcagagagtaagcagctaaatgtatacgaaatcaaagtcaacaagcttgagctggagctggagagcgccaaacagaagttcggggaaatcacagatacctatcagaaggaaattgaggacaagaaaattagtgaggagaacttgctggaagaagtggagaaagcaaaagtcatcgccgatgaagcggtcaaactccagaaagagattgataagagatgccagcacaagatcgccgaaatggtggcactgatggaaaagcataaacatcaatatgataaaatcatcgaagaacgagacagcgaactgggcctgtacaagagcaaagaacaggaacagtcatcactgagggccagccttgagatagaactgagcaaccttaaggcggaactcctctccgtgaagaaacagttagaaatcgaacgagaggaaaaagaaaagctgaagagagaggcaaaggaaaataccgcgacgctaaaagagaaaaaagacaagaagacacagacatttctactggaaacccccgagatttattggaaactggattcaaaggcagttccatctcaaactgtcagcagaaattttaccagtgtcgaccacgggataagtaaggataaacgggattatttgtggaccagcgccaaaaatacactctcaacaccgctgcctaaggcctatacagtcaaaaccccaacaaaacctaagctgcagcaaagagagaatctcaacatccctatagaagaaagtaagaagaagcggaaaatggctttcgaattcgacattaattctgattcttccgaaacaaccgatcttctgagcatggtctccgaagaggagaccttaaaaaccctgtaccgcaacaacaatccccctgcatctcacctgtgcgtgaagaccccgaaaaaagccccatctagcctcactactcctggctccaccctgaaatttggggctataaggaaaatgcgcgaagatagatgggccgtcatcgcgaaaatggacaggaagaagaagttgaaggaggcggagaaactgttcgtctag

SEQ ID NO: 243038 - DNA, 2931 bp, Artificial Sequence
  Description of Artificial Sequence: Synthetic coding sequence
atggaaaagcagaaaccattcgccctgtttgtgccacctagatcgagctcatcccaagtcagcgctgtcaagccccagacccttggcggtgacagtaccttttttaagtcttttaacaagtgcacagaggacgatttcgagtttccatttgcaaaaactaacctttctaaaaatggcgagaacattgattcagatcctgctctgcagaaagtaaacttccttccggtgctggaacaggtggggaacagcgattgtcactatcaggagggcctgaaagatagtgatctggaaaacagtgagggcctttctagagtgtactccaaactgtataaggaggccgagaagattaaaaaatggaaggtctccacagaggccgagctgcgacagaaggagtccaagctccaggagaaccggaagattattgaagctcaacgaaaggccatccaagaacttcagttcggcaacgagaaggtatcactcaagctggaagaggggatccaggaaaacaaggacctgatcaaggagaacaatgcaactaggcatttgtgtaatctgctgaaggaaacttgtgcccgtagcgccgagaaaactaagaaatacgagtacgagagagaggaaaccagacaggtttatatggacctgaacaacaacatcgagaagatgattaccgcctttgaggagctacgggtacaggcggagaatagcaggctcgagatgcacttcaaactgaaagaggactacgagaaaattcagcatctcgagcaggagtataaaaaagaaatcaacgacaaggaaaagcaggtgtcactcctcctcattcaaattactgagaaggagaacaagatgaaggatcttacatttctcctcgaagagtcaagggataaggtgaaccagctcgaagagaagaccaaactgcagtctgaaaatctgaagcaatctatcgaaaaacagcaccacctgaccaaggagctggaggatatcaaggttagcctccagcgatcggtgagtacccaaaaagcactggaggaggatctgcagatcgccaccaagactatatgtcagcttactgaagagaaggagactcaaatggaggaatccaacaaggccagagcggcacatagtttcgttgtgactgagtttgagactactgtgtgtagtctggaagagctgctgagaaccgagcaacagcgcctggaaaagaacgaggatcagctgaagatactgactatggagttgcagaagaagtctagcgagctggaggagatgacaaagctgacgaataataaggaggttgagttagaagaactgaagaaagttctaggagagaaggaaaccctgctgtacgaaaataaacaattcgaaaaaatcgcggaagaactaaagggaacagaacaggaactgatcggactgctgcaggcccgtgaaaaagaggtgcacgacctggagattcaactcactgccattacgacaagcgagcaatattactccaaagaagtgaaagatttgaagactgagctggaaaatgagaagctgaaaaacaccgaactaacttcgcactgcaacaaactctccctcgaaaataaagaactgacccaggagacaagtgatatgaccctagaactgaaaaatcaacaggaagacattaataataacaaaaagcaggaggagcgcatgcttaagcagatcgaaaacctgcaggaaaccgagactcagctgcgcaacgagctggagtatgtcagagaggagttgaaacagaagcgcgatgaggtcaagtgtaaactggataaaagcgaagagaattgtaataatctgcgtaagcaggtggaaaataaaaacaagtacatagaagagctccaacaagagaataaggctctcaagaagaaaggcactgccgagtcaaagcagctcaatgtttacgaaatcaaggttaataaattggaactggaactggaatctgctaaacagaagttcggcgagattacagacacctaccagaaagagatcgaggacaaaaagatttccgaagaaaacctacttgaagaagtcgaaaaagcaaaggtgatcgctgacgaggccgtaaaacttcagaaagagatcgataagcgatgccagcacaagatcgccgagatggtcgcattgatggagaagcacaaacaccagtacgacaaaattattgaagagcgcgattcagagttgggtctctacaagtctaaggagcaggaacaatcttccctgcgcgcatcccttgagatcgagttatctaacctgaaggctgagttactttccgtgaagaagcagctcgaaatcgaaagggaagagaaggaaaagctgaaaagagaagcaaaggaaaatacagctaccctcaaggagaagaaagataaaaagacccagacttttctgctcgagactcctgagatttactggaagctggatagcaaagcggtgccatcccagaccgtcagtagaaactttacttctgtcgatcatgggatttcgaaagataaacgcgattacctctggacaagcgccaagaacacgttgagtaccccgctgccgaaagcatacactgtgaaaactcccactaagcccaaacttcaacaacgggagaacttgaacattccgatcgaggagagtaaaaagaaaagaaaaatggcattcgagtttgacattaacagcgatagcagcgaaaccaccgacttactatccatggtgtcagaggaggagaccctaaagacactgtaccgcaacaataaccccccagcgtcccacctgtgtgtaaagacccccaagaaggccccttcttctttaacgacccccggatctacgctaaaatttggggctattcggaaaatgagagaggaccggtgggccgttattgctaagatggatcggaaaaaaaagctcaaggaggcagagaaacttttcgtttag

SEQ ID NO: 243039 - DNA, 2379 bp, Artificial Sequence
  Description of Artificial Sequence: Synthetic coding sequence
atggagaagcagaagccattcgctctctttgtgccgcctagatccagctcaagtcaggtcagtgctgtgaaacctcaaaccctcggtggcgatagcactttcttcaaatcctttaataagtgcactgaggacgattttgaattcccctttgctaagacaaatctcagcaagaacggcgagaatatcgactccgatccggctctgcagaaggtgaattttttaccggtgctcgaacaggtaggcaatagcgactgccactaccaggaaggactcaaggattccgatctggagaactccgagggcttgtctcgagtctacagcaaactgtacaaagaggcagaaaagataaaaaaatggaaggtgtcaaccgaagctgaattgcgacagaaagagagtaagttgcaagagaataggaaaatcatcgaggcacagcggaaagcaattcaagagctacaatttggtaacgaaaaggtgagtttaaaactcgaggaaggtatccaggagaataaagatttaattaaggaaaataacgccacaagacatctgtgcaatctacttaaggagacatgcgctaggtcagctgaaaagacgaaaaaatacgaatatgagagagaagagactagacaggtttacatggacctgaataacaatatcgagaagatgatcaccgccttcgaagaactgcgagtccaggctgagaattctcgactggagatgcatttcaaattgaaggaggattatgagaagatccagcacctcgaacaggagtacaagaaagaaataaacgataaagagaagcaggtgagcctcctgctcatccaaattaccgagaaggagaacaaaatgaaagatttgactttcctgctggaagagagccgcgacaaggtcaatcaattggaggagaaaacaaagctacaatccgaaaatttaaagcagtctatcgaaaaacagcaccacctcactaaagaactggaggacattaaagtgagcctacagcgaagcgttagcactcagaaagcgctcgaggaagacttgcagatagccacaaagacaatttgccagcttaccgaggaaaaggagacacagatggaggagtccaataaagctcgagccgctcactccttcgtggtgaccgagttcgaaaccaccgtttgttccctggaggagcttctgcgcactgagcagcaaaggttagagaagaatgaggatcagctgaagattttaaccatggaactgcaaaaaaaatctagcgaactggaggaaatgactaaattaacaaacaataaagaagtggaactcgaggaactcaagaaagtccttggggagaaagaaactctcctttacgagaataaacaattcgagaagatcgccgaggaattgaagggcaccgagcaggagctgattggccttctgcaagccagagaaaaggaagtgcacgatctggagattcagctaacagctattactacatcagagcagtactacagcaaagaagtgaaggaccttaaaaccgagctggagaacgaaaaactaaagaataccgagctaacatcacattgtaacaagctttctctggagaacaaggagctcacccaggaaacgagtgacatgactctcgaactcaagaaccagcaggaagatattaacaataataaaaaacaagaggagagaatgttaaaacagattgagaacctccaggagaccgaaactcagctgaggaatgagcttgagtacgtgagagaggaattgaaacaaaagagggatgaggtgaagtgcaagctggacaagagtgaagagaattgcaataatctgcgtaagcaggtagaaaacaagaacaaatacatcgaagaactacagcaggagaataaagcactgaagaagaagggcaccgccgaatccaaacagctcaatgtgtacgaaattaaagtgaacaagctcgaactggagctggaaagcgccaagcaaaaattcggagagattactgacacataccagaaggaaattgaggacaagaagatttctgaggaaaacctgctggaggaagtggagaaggccaaagtcatagccgacgaggcggtgaagcttcagaaagagatcgacaaacggtgccagcacaaaatcgcagagatggttgctctgatggagaaacacaaacaccagtatgataagatcattgaggaaagagactcagagttgggactgtataagtcaaaagagcaggaacagagctccctccgagcgtcccttgaaatagaactcagcaacttgaaggcagagctgctgagtgtgaaaaaacagctggaaatcgaaagagaggaaaaagaaaagctcaaaagggaggcaaaagaaaacacggcaacgctgaaagaaaaaaaatag

SEQ ID NO: 243040 - DNA, 2388 bp, Artificial Sequence
  Description of Artificial Sequence: Synthetic coding sequence
atggaaaaacagaagcccttcgccctgttcgttccccctaggagttcttccagccaggtttccgccgtgaagcctcaaactctggggggagatagcacattcttcaaaagcttcaataaatgtactgaggatgacttcgagtttccattcgccaaaaccaatctgtccaagaatggagaaaatatcgatagtgaccctgcgctccagaaggtgaactttcttccagtgttagaacaagtcggaaactccgactgccattatcaggagggtctgaaggactctgacctggaaaattccgaaggactaagccgcgtatatagtaagttgtataaagaggccgagaagataaagaagtggaaagtttcgacagaagctgaactgaggcaaaaagagtcaaaactgcaggaaaaccgtaaaattatcgaggcccaaagaaaagccattcaagagctacaattcgggaatgaaaaggtttcactcaagctggaggaaggaattcaggagaacaaagatttgattaaagagaacaatgcaacaagacatctgtgcaacctgttgaaagagacttgcgctaggagcgccgagaagactaaaaaatacgagtatgaaagagaagagacgcgacaggtgtacatggatctgaataataacattgagaagatgattacagcttttgaagagctcagagtccaggctgagaattctagactcgaaatgcacttcaagcttaaggaagactacgagaaaattcagcatctggagcaggaatacaaaaaagagatcaacgataaagagaagcaggttagcttattgctgattcagatcactgaaaaggagaacaaaatgaaagacctcactttcctccttgaagaatcaagagacaaggtcaatcagttagaggaaaaaactaagttgcaatctgagaatctcaagcagtcaatcgagaagcagcaccatctgaccaaagaattggaggacatcaaagtgtccctgcagcggtcagtttctacccaaaaagcgctagaggaagatctacagatcgctactaagacaatttgccagttaaccgaagagaaagagacccagatggaggaaagtaataaagccagggccgctcatagttttgtggtgacggaatttgaaactaccgtgtgctcactggaggagctccttcggaccgagcagcagagacttgagaagaacgaagatcagcttaaaatactcaccatggagctacagaaaaagtcatctgagctagaggaaatgacaaagctgaccaataacaaggaagtggaactggaggaactgaaaaaagtgttgggagagaaggaaacactgctttacgagaataagcaattcgaaaaaatcgccgaggagctaaagggtacagagcaggaactgattggactcttacaagcacgggaaaaagaggtgcacgatctggagatccagctcaccgcgatcacgacttctgagcagtattatagtaaggaggtcaaagacctcaaaaccgagctggaaaacgaaaagttaaagaacactgaacttaccagccactgtaacaagctgagcttagaaaacaaagagttgacacaggaaacaagcgacatgactttagaactgaagaatcagcaggaggacatcaacaataataagaaacaagaggagagaatgttgaaacagatcgaaaacttgcaagagaccgaaacacagctcaggaacgagcttgaatacgtacgggaagaactaaaacagaagagggatgaggttaaatgcaagctcgacaaaagcgaggagaattgtaacaacctgcggaagcaggtcgaaaataagaacaagtatatcgaggagctgcagcaagagaataaagcacttaagaagaaaggcacagctgagagcaaacaactaaatgtgtatgagattaaagtcaataaactggagctggagctggagtctgccaaacagaagttcggagagattacggacacttatcagaaggaaatcgaagataagaagatcagcgaagaaaacttgcttgaagaagtggaaaaagccaaggtaatcgcagatgaagccgtcaagctgcagaaggagatcgacaagcggtgccagcacaagatcgcagagatggtggcactgatggagaagcacaaacatcagtacgacaagattattgaagagagagattccgagttaggtctctacaagagtaaagaacaggagcagtctagtctgcgtgcaagccttgaaattgagttgagtaatctgaaggccgaactgctgtctgtcaagaagcagctggagatagaacgagaagagaaggagaagctgaaacgggaggccaaagaaaacactgctacactgaaggaaaagaaagataagaaatag

SEQ ID NO: 243041 - DNA, 4593 bp, Artificial Sequence
  Description of Artificial Sequence: Synthetic coding sequence
atgccgatccggccagatcttcagcaattggaaaagtgcatcgatgacgctttgcgtaaaaacgactttaaaccactaaaaacattattacagattgacatatgtgaagatgtgaagattaaatgctccaaacagttctttcacaaggtggataatcttatatgtcgggagctaaacaaggaagatattcataacgtctccgcgatcctggtaagtgtcgggcgatgcgggaagaatatctccgtccttgggcaggctgggctgctaacgatgattaagcagggactcatccagaagatggtggcttggttcgagaagagtaaggacattattcaaagccaaggtaattctaaggatgaggctgtgttgaatatgatagaggatctggtggatctactattagttatccatgatgtttctgatgaaggaaaaaagcaagtggttgaaagctttgtgccaaggatatgttctctggtgatcgattcccgcgtgaacatttgtatccagcaagagatcattaagaagatgaacgcaatgctggataagatgcctcaggacgcaaggaaaatactgagtaatcaagagatgttgatcctgatgtcctcgatgggtgagaggatcctcgacgctggcgactacgacctgcaagtcggtatcgttgaggccctgtgccggatgacaacagaaaaacaaaggcaggagctggcacaccaatggtttagcatggatttcatagctaaggctttcaagcggataaaagatagtgaattcgaaaccgactgtagaatattcctgaacttagtcaacggcatgttaggtgacaagagacgggtgtttaccttcccctgcctgagtgcgtttttggataagtacgagctgcagatcccgagtgacgaaaagctcgaggagttttggattgacttcaacctgggttctcagactctttcattttatatcgctggcgacaatgatgatcatcagtgggaggctgttaccgtgcctgaagaaaaagtgcagatatatagcatagaggtccgtgagtcgaaaaagttgctgactatcattctcaaaaatacagttaagatttccaaacgggaagggaaggagttactactatacttcgatgccagcttggaaattacgaatgtgacccagaagatcttcggcgcaaccaagcatcgagagtcaattaggaaacagggcatttcagtggcaaagacttccttgcacattctgtttgacgcctctggttcccagattttagttcccgaatctcagatatcacccgtgggggaggaacttgtaagcttgaaagagaaaagcaaaagccctaaggaatttgcaaagccatctaagtatattaaaaatagcgataaaggaaatcgcaacaattcccagttggaaaaaacaacaccctcaaagcggaaaatgagtgaagctagcatgatcgtgagcggcgctgaccgttacactatgcgttcaccagtgctctttagcaatacatctattcctccccgaaggagacgaataaaaccccctctgcagatgacatcaagcgccgaaaagccttccgtgtctcagacaagcgaaaatcgcgtggacaacgcggcttcgctgaaaagcaggtctagcgagggacggcaccgacgggacaacattgataaacatatcaagaccgcaaaatgcgtggaaaacacagagaataagaacgtcgaatttccaaatcaaaatttcagcgagctgcaagatgttatccctgactcccaagccgctgagaaacgggatcacactattctgcctggtgtgctggataacatttgcggaaataagatccacagcaaatgggcgtgttggacgcctgtaacgaatatagagctgtgtaacaaccagcgcgctagcacaagctcaggtgatactctaaatcaggacatcgttattaataagaagctgacaaaacagaagtcgtcttcctctatcagcgatcataattccgagggaacagggaaagtcaaatataaaaaggaacagacggaccatatcaagattgacaaggcggaagttgaggtctgtaagaagcacaatcagcagcagaaccaccctaagtactccggacagaagaacactgagaacgccaagcagtccgactggcctgttgaaagcgagaccacgttcaagtccgtactgttgaataagactatcgaggagtctctgatataccgcaagaagtatatactgagcaaagacgtgaacactgctacttgtgacaaaaatccctctgcaagcaagaacgtccaatcccataggaaagccgagaaagaattgacatcagagctgaacagctgggacagcaagcagaagaagatgcgagagaaatccaaaggcaaggaattcacaaatgtggccgagtcactgatctcacaaatcaacaaacggtacaaaactaaagacgacataaagagcacacgcaagctgaaggaatctctcataaattcaggttttagtaataaacccgtggtgcagctctccaaggagaaggttcagaagaagtcctaccggaagctgaaaacgacattcgtgaacgtcaccagtgaatgtcctgtgaacgacgtgtataactttaacctgaacggagccgacgatcccatcatcaaacttggaatccaagaattccaagcgacagctaaagaagcttgcgccgacaggagcatccgattggtcggcccacggaatcacgacgagctgaagagctcagtgaagactaaggataagaaaataattacaaaccatcagaagaaaaatctcttcagcgatacagaaaccgagtatcgatgtgacgattcaaagaccgacatttcctggctgagagaaccgaaaagcaagccccagttgattgactattctcgtaataagaatgttaaaaaccataagagcggcaagagccgatcttccttagaaaaagggcagcctagctccaagatgactccctcaaagaacatcaccaagaagatggacaagaccattcccgaaggtaggatcagactccccaggaaagccacaaaaacgaagaaaaactataaagacctctctaacagcgagagtgagtgtgagcaagaattcagccatagctttaaggaaaacatcccagtaaaggaagagaatattcactcgcgcatgaagaccgtgaaattgcccaagaaacagcagaaggtcttttgtgcggagacagagaaggaactttccaagcagtggaagaacagtagcctcttaaaagatgcgattagagacaattgccttgatctgtccccacgctctttgtccggatcaccatcctctatcgaggtaaccagatgtatcgaaaaaattacagagaaggatttcacacaagactacgattgtatcactaagtcaatatccccttatcccaaaactagtagcctggagagtttgaattccaatagcggagtcggaggaactattaaatcaccgaaaaataatgaaaagaactttctctgtgccagcgaatcatgcagtcctatccctagacctctgtttctccccagacatacacccaccaagtctaacacgattgttaacagaaaaaaaatatccagcctggtgctgacccaggagacacagaactccaacagctattccgacgtatccagctatagctcagaggagcgatttatggagatagagtccccacacattaatgaaaattacatccagagtaaaagggaggagtcccatctagcctcatcgttgtcaaagtccagcgagggccgtgagaaaacttggtttgatatgccgtgcgatgcaacgcatgtctccggcccaacgcagcaccttagccgaaaacgaatctatattgaggacaatttgtcaaattcaaacgaagtcgaaatggaagaaaaaggagagcggcgtgcaaatctgcttccaaaaaagttgtgcaagatcgaagacgccgatcatcacattcataagatgagcgagtcagtatcttccttaagcaccaatgacttctctataccttgggagacgtggcagaatgagtttgccggaatcgaaatgacatacgagacctacgagcgcctgaattcagagttcaagcgcaggaataacataaggcacaagatgctgtcttatttcacaacccagtcttggaaaaccgctcaacagcatttacggacaatgaaccaccagtcccaggacagccgaattaaaaagttggataagttccagttcattatcatcgaagaattggaaaatttcgagaaagattcgcagtccttaaaggacctggaaaaggagtttgtggatttctgggagaagattttccagaagtttagcgcttaccagaaatcggagcagcagagacttcacctcctgaagacgagtctggccaagtctgtgttctgcaacacagactctgaagagacagtcttcaccagtgagatgtgtctcatgaaagaggacatgaaagtgctgcaggaccgcctcctgaaagatatgcttgaggaggaattattgaacgtcagacgcgaacttatgtctgtatttatgagccacgagcgcaatgctaacgtgtag

SEQ ID NO: 243042 - DNA, 4593 bp, Artificial Sequence
  Description of Artificial Sequence: Synthetic coding sequence
atgcccattcgtcccgatctgcaacagttggagaagtgcatcgacgacgcattgcggaagaacgattttaaacctctgaaaacccttctgcagatcgacatttgcgaggatgtgaaaatcaagtgttctaaacagtttttccataaggtggataaccttatatgcagggaattgaacaaggaagacattcacaatgtctcagccatcctcgtaagtgtcgggagatgtgggaagaatatatctgtgctgggacaggcaggcctgctcactatgataaagcagggtctgatccagaaaatggttgcctggttcgagaaatcgaaggacattatccagtcccaagggaactcaaaggacgaagccgttctcaatatgattgaggatctcgtcgatcttcttctggtgattcacgacgtctctgatgaggggaaaaaacaagtggttgagagctttgtgccacggatttgttccctagtgattgattctcgagtcaacatatgcatccagcaggaaataatcaaaaagatgaacgcaatgctagacaagatgcctcaggatgccaggaaaatattgagcaaccaggaaatgcttatcctgatgtcctctatgggagagcggatcctggacgcaggcgactacgacctccaagttggaattgtggaggcgctgtgccgtatgacgacagagaagcagaggcaagaactggcacaccaatggttcagtatggacttcatagctaaggccttcaagcgcattaaggactcagagtttgagacagactgtagaatctttctaaacttggtcaacggcatgctgggagacaaaaggagagtctttacatttccatgtctttctgctttcctggataagtacgagctgcaaattccaagtgacgagaagctggaggaattctggatcgattttaatctgggctctcagacgctttccttttacatagccggagataatgacgaccatcaatgggaggcagtcacagtgcccgaagaaaaagtgcagatatatagcatcgaagttcgggaatcgaagaaacttcttacaattattctgaagaacaccgtgaaaatctccaagagggagggaaaggagcttctcctgtattttgacgcatcactggagatcactaacgtcacccagaaaatttttggggcaactaagcacagagagagcattcggaagcagggcatcagcgttgccaaaacgtccctgcacatcctcttcgacgcttccggttctcaaatccttgtgccggaatcacaaatttctccagtgggagaggagctggtgagcctgaaagagaagtccaaatcgcctaaggaatttgccaagcctagcaagtacatcaagaattccgacaaaggtaatagaaacaacagccagttggagaagacaacaccgtctaaaaggaagatgagtgaggcatccatgattgtctctggagcagaccgctacaccatgagatccccagtgttgtttagcaacacgtctatacccccacggaggagaagaattaaacccccactacagatgaccagtagcgccgaaaagcccagcgttagtcaaaccagcgagaaccgcgttgacaacgcagcttccttgaagtccaggagcagcgagggacggcaccgccgagacaatattgataagcacatcaagacagctaagtgtgtggaaaacactgagaataaaaatgtggagtttccaaaccagaactttagtgagcttcaggacgtcatccccgactcccaagccgctgagaagagagaccacactatcctgcccggtgtgttagacaacatttgcggaaataagatacattccaagtgggcctgttggaccccggtcacaaatattgagctgtgcaataatcagcgggcatcaaccagtagcggcgataccttgaatcaggatatagttattaataaaaaactgacaaagcagaagtccagctcaagtatctctgaccataacagcgagggaacaggcaaagttaagtacaagaaggaacagactgaccatatcaagattgacaaagcagaagtggaagtgtgcaagaagcacaatcagcagcaaaatcatcctaagtatagtggtcaaaaaaatacagagaatgcaaagcaatccgactggccagtggaatcggagacgacattcaaatctgtgctcctgaacaaaacaatcgaagagagtctcatctataggaaaaaatacatcctgagcaaggatgtgaacacggcaacttgtgataagaatccctcagcaagcaagaacgtgcaatcccaccgtaaggccgagaaggaattgacgtctgagcttaatagttgggatagtaagcagaagaagatgcgcgagaaaagcaagggaaaggagtttaccaatgtggccgagtcgctgatcagccagatcaataagaggtataagactaaggatgacatcaagtccacccggaaattaaaagaatcgctgattaatagcggcttttctaacaagcctgtggtccagttatctaaggagaaggtgcagaagaagtcttatcgcaaactcaagactacattcgtcaatgttacctccgagtgccccgtgaacgatgtttataactttaacttgaatggcgctgacgatcctattattaagctgggaattcaggaatttcaggctactgcgaaagaagcttgtgccgataggtctataagactggttgggccacgaaatcacgatgaactcaaatcatcagtcaaaactaaggacaagaagatcattacaaatcaccagaagaaaaacctgttctccgatactgaaactgaatataggtgtgacgacagtaagaccgacatctcctggctccgcgaaccaaaaagcaagcctcagctgattgactattcccggaataaaaatgtgaaaaatcataaaagcggcaagtccaggtcctccctggagaagggccagccaagctccaagatgactccctccaagaacataacgaagaagatggataaaactatcccggaaggcagaattcgtctccccagaaaggccaccaagaccaaaaagaactacaaggacctcagcaatagtgagtccgagtgcgagcaagaattttcacactcctttaaggaaaacatccccgttaaggaagaaaacattcattcccggatgaagacagttaagctccctaagaaacagcaaaaagtgttctgtgctgagactgagaaagagctgtctaaacaatggaaaaactctagtcttctcaaagacgcaattcgcgacaattgcttagatttaagccccaggagcttgagtggttcaccctcatctatcgaagtcactagatgtattgaaaagatcacagagaaggacttcactcaagactacgattgtattactaagagtatttcgccctaccctaagactagttcactggaatccctgaactcgaattccggcgtcggagggaccataaaatcgcccaagaataacgagaagaacttcctgtgtgcatcagaatcctgctcacctatcccgaggccactgttcctcccgagacatacccctacaaagagcaataccattgtcaacagaaagaagattagcagcttggttctgactcaggagacccagaacagcaacagctattcagatgtctcctcctattcttctgaggaacgcttcatggagatagaatcaccccacataaatgaaaactacattcagtctaagagggaagagagtcacttggcatcgagccttagcaagtcttccgaggggagggagaaaacatggttcgacatgccctgtgatgcaactcacgtgtcaggcccaacgcagcatctatcaagaaagagaatttatatcgaggataatctgtctaacagtaacgaagtagagatggaagaaaaaggagaaaggcgagctaacttactacctaagaaactgtgcaaaatcgaagacgcggaccaccacatccataaaatgtcagagtcagtgtctagtttatcaacaaatgacttcagtattccatgggaaacgtggcagaacgagttcgccggtatcgaaatgacgtacgagacttacgagcggctgaatagcgagttcaagagaagaaacaacattcgtcacaaaatgctcagttacttcacgacccagtcttggaagactgcccagcagcacctccgcacaatgaatcatcagtctcaggacagtcgcatcaaaaagctggacaaatttcagttcataatcatcgaagagctggagaatttcgaaaaggattcccagagtttaaaagacctggagaaggaattcgtggatttctgggagaagatctttcagaagttctctgcctaccaaaaaagcgagcagcaacggcttcatctgttgaagacatccctcgccaagtccgtcttctgcaatacggatagcgaggagactgtgtttacttctgaaatgtgcctgatgaaggaggatatgaaggtccttcaggataggctactgaaggacatgcttgaggaagaacttctgaatgtgaggcgcgagttaatgagcgtgttcatgagtcatgaaagaaacgcaaatgtgtag

SEQ ID NO: 243043 - DNA, 3072 bp, Artificial Sequence
  Description of Artificial Sequence: Synthetic coding sequence
atgccgatccggcctgatctacagcagttggaaaagtgtatagacgatgctctcaggaagaatgattttaagccccttaagacactgctccagatcgacatctgcgaggacgtcaagatcaagtgctctaagcagttctttcacaaagtggataacctaatttgccgcgaactcaacaaggaagacattcataatgtgtcggctatcctggtgtcagtggggcgatgcggaaaaaatatatcagtactcggccaggctggactgctgaccatgattaagcagggtctcatccaaaagatggttgcctggttcgaaaaatcaaaggacattattcagagccaagggaactcgaaggacgaagccgtactgaatatgattgaggaccttgtcgatttactgttggtgatccacgacgtaagcgatgagggcaagaagcaagtggtggagtcctttgtacccaggatttgcagcctcgtgattgacagtcgcgtcaatatctgcattcaacaggagataattaagaaaatgaatgccatgctggacaaaatgcctcaggatgccagaaaaatccttagcaatcaagaaatgctaatcttaatgagctctatgggcgagcggatcctcgacgccggagactacgacctacaagtggggatcgtagaagcattgtgtcgaatgacaaccgaaaaacagcgccaagaactggcccatcagtggttttccatggacttcatagcaaaagccttcaagagaatcaaggattccgagttcgagaccgactgtcgcatctttctgaatttggtgaacggaatgctcggagataaacgcagagtcttcacattcccgtgtctgtccgccttcttagacaaatatgaacttcagatcccctctgatgaaaaactggaggagttctggatcgacttcaacctcggctcacaaacgctgagcttctatattgctggcgacaacgacgaccatcagtgggaggctgtcaccgtccccgaggagaaagtccagatatattccatcgaagtgcgcgagtcaaaaaagctactgactattattctgaaaaacacagtgaagatcagtaaacgtgaagggaaggaactactgctgtattttgatgcctccttggaaattacaaacgtcacacagaaaatcttcggagccacgaagcaccgtgaaagcattaggaagcagggcatctcagtggcgaagacatctttgcatattttgttcgacgccagcgggtcacaaatcttggtgcccgaatctcagataagccctgtcggcgaagaacttgtgagcctgaaggaaaaatctaaaagcccgaaagagttcgctaaaccctccaagtacatcaagaactctgacaagggcaaccggaataactctcagctggagaagaccaccccctctaaacgcaaaatgtctgaagccagtatgatcgtctccggggcagatcgatatactatgcgatcgcccgttttgtttagtaacactagcatcccacctaggagacggcgaattaaacccccactgcagatgaccagttctgccgaaaaaccctccgtgagtcaaacctccgaaaatagagttgacaatgctgccagcttgaaaagtcggtctagcgaaggtaggcacaggcgcgacaacattgataagcacatcaaaacagccaagtgtgtagaaaataccgagaataaaaacgttgagtttccaaatcagaatttcagtgagttacaagatgtcatacccgactcacaggctgccgagaaaagggatcataccatccttcccggtgtgttggacaacatctgtgggaataagatacactcaaagtgggcttgctggacgcccgtcacgaacatcgaactgtgtaacaaccagcgggcaagtacaagcagcggggacacacttaatcaggacatcgtcatcaacaaaaagcttacgaaacagaagtctagtagcagtattagcgatcacaactctgaaggcacaggaaaggtgaagtataaaaaggagcagactgaccacatcaagattgataaggcagaggttgaagtctgtaaaaagcataatcaacagcagaaccaccctaagtacagcggacagaagaatacagagaacgccaagcagagcgactggcccgtggagtcagaaaccactttcaaaagtgtgctcctgaataagacaatcgaagagtctctcatctacagaaaaaagtacatactgagtaaggatgtgaatactgcaacatgtgataaaaatccaagcgcctccaaaaatgttcaatcgcaccggaaagccgaaaaggaattgacaagcgagctcaacagctgggatagtaaacagaaaaagatgcgagagaaaagcaaggggaaagagttcacaaacgtagctgagtcactgatatcccagataaacaagcggtataagactaaggacgatattaaatcgaccagaaagttgaaggagagcttgattaactcgggattctctaataaacctgtcgtgcagctgtcgaaagaaaaagtccagaagaagagttatagaaagcttaagaccacattcgttaacgtaacatccgaatgccctgttaacgatgtttataattttaacctgaatggcgctgatgatccgataataaagctgggtatccaggaattccaagcaacagccaaggaggcttgcgcagaccgcagcatacgtctggttgggcctcgcaaccatgacgagctgaagagcagcgtgaagaccaaggataagaagattatcaccaatcaccaaaagaagaacttgttttctgatactgaaacagagtacaggtgcgacgactcaaagacggacataagttggcttagggagcctaagtctaagccgcaattaatcgattattccagaaataagaatgtcaagaatcacaagagcggaaagtcgcggagctcactcgaaaagggacagcctagttccaagatgacaccgagcaagaacatcacaaaaaagatggacaagactatccccgagggacgcatcaggctgcctcgcaaggcgacgaagaccaaaaaatag

SEQ ID NO: 243044 - DNA, 711 bp, Artificial Sequence
  Description of Artificial Sequence: Synthetic coding sequence
atggtgtcctccggcaagaagtacagccggaaaagtggcaagccttctgtggaagatcaatttactcgcgcatacgacttcgagactgaggacaagaaggacctgtccggaagcgaggaggacgtgatcgagggcaagacagcagtgatagagaagcgccgtaaaaaaagaagctccgctggcgtcgtcgaggacatgggaggtgaagttcaaaacatgttggagggggtcggggtcgacattaacaaggccctgctggcaaaacgcaagcgactcgagatgtatacgaaggcctctctgaagacttctaatcagaagattgagcacgtgtggaagacccagcaggatcaacgccaaaagctgaaccaagagtattctcagcagtttctgacgttatttcaacagtgggaccttgacatgcaaaaagccgaggaacaggaggagaaaattctgaacatgtttagacaacagcagaagattctgcagcagagtaggatagtgcaatctcaacgacttaagactatcaagcagctttacgaacagtttatcaaatccatggaagaactggaaaaaaatcacgataacctgctgaccggtgcccaaaatgagttcaaaaaagaaatggcaatgctgcagaagaagatcatgatggaaacccagcagcaggaaatcgcctctgtgcggaagtccctccagagcatgctgttttag

SEQ ID NO: 243045 - DNA, 711 bp, Artificial Sequence
  Description of Artificial Sequence: Synthetic coding sequence
atggtgagctctggcaagaaatattcgcggaagagcggcaagcccagcgtggaagaccagttcaccagggcctatgatttcgaaaccgaagataaaaaagacctgtcaggtagcgaagaggacgttatagaaggaaaaactgcagttattgagaagaggcgaaaaaagcgatcctctgccggagtggtggaggacatgggtggggaggtacagaatatgctggaaggggtcggcgtcgatataaacaaagccctactggctaagagaaagcggctggaaatgtacactaaagcctctttaaaaacgagtaaccagaaaatcgaacatgtctggaaaactcaacaagatcagcgacagaagttaaaccaagaatattcccagcagttccttacgctgttccaacagtgggatctcgacatgcaaaaagctgaagaacaagaagaaaagatccttaatatgtttcgccaacagcagaagatcctgcaacaaagtagaattgtccagagccaacggttaaagacaattaagcagttatatgagcagttcatcaagtctatggaggagctcgagaagaaccatgataacttgctgacaggggcacagaacgagttcaaaaaagagatggctatgctgcagaagaagatcatgatggaaacccagcaacaggagatcgcttcagtccgaaagagtctccagtcaatgctcttttag

SEQ ID NO: 243046 - DNA, 711 bp, Artificial Sequence
  Description of Artificial Sequence: Synthetic coding sequence
atggtttcttcaggcaaaaagtactcccgcaaatctgggaagccttctgtcgaggaccaatttaccagggcctacgacttcgaaacagaggataagaaagaccttagtggaagcgaggaggatgttatcgagggcaagaccgccgttattgagaaacgtcggaagaaaaggagtagcgctggcgttgtcgaggatatgggtggagaggtccagaatatgcttgagggggttggggtggatatcaacaaagctctgttggcgaagcgcaaacgcttggagatgtatacaaaggcctccctgaaaacatctaaccaaaagatagaacatgtgtggaagactcagcaggatcagcgtcagaagcttaaccaagagtactcccagcagtttctgacacttttccagcagtgggatctagatatgcaaaaggcagaggagcaggaggaaaaaatcttgaatatgttcaggcagcagcagaagatcctccagcagagcaggatagtgcagagtcagagattaaaaaccattaaacaactctacgaacaatttatcaagagtatggaagagctcgagaagaatcatgataatctactgacgggggcacaaaacgagttcaagaaggaaatggccatgctacagaaaaaaattatgatggaaacacaacagcaggagatcgcctccgtgcgtaagtctctgcagagtatgttgttctag

SEQ ID NO: 243047 - DNA, 942 bp, Artificial Sequence
  Description of Artificial Sequence: Synthetic coding sequence
atgcttctcctagcagatatggatgtcgtgaatcaactcgtggccggtggccagttcagggtcgtaaaagaaccgctaggcttcgtgaaggtgttgcagtgggtgtttgccatcttcgcctttgccacctgtggatcctacagtggagagctccagttgagcgtggactgcgctaacaagaccgagtctgatctgtccatcgaggtggagttcgaatacccatttcgactgcaccaagtgtactttgacgctcccacctgccggggtgggaccacaaaagtgttcttagttggggactacagctcgtcagccgaatttttcgtgaccgttgctgtgtttgcgttcctgtattccatgggcgctcttgcaacctacatatttctgcagaacaaataccgggaaaacaataaaggaccgatgttggattttctagccactgccgtctttgcttttatgtggctggtgtcttcctcagcttgggctaaagggctttctgacgtgaagatggccacggatcctgaaaacatcataaaagaaatgcccgtgtgccgacaaacaggcaacacgtgtaaagaactaagagaccctgtgacaagtggtctcaacacgagtgttgtcttcggttttttgaatctggtcctatgggtcggcaacctatggttcgtctttaaagagacaggttgggcagctcccttcctaagagctccccctggggcacctgagaaacagccagccccaggtgacgcttacggggacgccggttatggtcaagggccaggtggctacgggcctcaggactcctacgggcctcagggaggctaccagcctgattacgggcaaccagctggatctggaggttcaggatatggcccacagggtgactacggccagcagggatacggcccacagggggcacctacgagcttctccaaccagatgtag

SEQ ID NO: 243048 - DNA, 942 bp, Artificial Sequence
  Description of Artificial Sequence: Synthetic coding sequence
atgcttttgctagccgatatggatgttgtgaaccagctggtcgccggaggacagtttcgagtggtgaaggagccactcgggtttgttaaggtgctgcaatgggtattcgccatctttgcttttgcaacatgtggctcatactctggggaattacaactcagcgttgattgtgctaacaaaacagagagcgacctatctattgaggtcgaattcgagtacccgttcagactgcaccaagtgtacttcgacgcccctacatgcagagggggtaccaccaaggtgttcctcgtaggggactacagctcgagcgcggagttctttgtgaccgtcgcagtcttcgctttcctttatagtatgggagcgctggctacttacatcttcctgcaaaacaagtatcgggagaacaacaaaggccctatgttagacttcctggctaccgcggtcttcgcattcatgtggctcgttagtagctcagcttgggccaaaggcttgtccgacgtcaaaatggcaactgatcctgagaacattattaaagagatgcccgtctgtagacagaccggcaacacttgtaaggaactgcgcgaccctgtgacctctggcctgaataccagtgtcgtgtttggattcctgaaccttgtgttgtgggtgggaaatctctggttcgtgttcaaagaaactggatgggctgcaccttttctgcgagcacctcctggggctcccgaaaaacagccggctcccggtgacgcctacggagatgccggatacgggcagggaccagggggatacggacctcaggactcctacggacctcagggcggttaccaacccgactacggccagccagcgggtagtgggggatctggatatggaccacagggagattacgggcagcagggttacggtccacagggtgctcccacctcgttctcgaatcaaatgtag

SEQ ID NO: 243049 - DNA, 588 bp, Artificial Sequence
  Description of Artificial Sequence: Synthetic coding sequence
atgggcgcattagctacatacatatttctgcaaaataaatacagggagaataacaagggcccaatgctggattttctcgcaactgccgtctttgcgtttatgtggctggtaagttcctcggcatgggctaagggtctctccgacgtgaagatggcaaccgatccagaaaacattattaaagagatgcccgtatgcaggcagacaggtaatacttgcaaggagctgagggaccctgtgacgtccggcctgaatacatcagtcgtctttggatttctgaacctggttctgtgggtcggcaatctttggttcgtgtttaaagaaactggatgggccgctccgtttctgcgcgctcccccaggggcacccgagaaacagcccgcacctggcgatgcatacggggatgccggatacggccagggtcctggtggttacggcccacaggatagttatggcccacagggcggatatcagccagattacggccagccagcaggatccggaggcagcggctatggcccacagggggattacgggcagcaggggtatggcccacagggtgccccaacatcttttagtaaccagatgtag

SEQ ID NO: 243050 - DNA, 2712 bp, Artificial Sequence
  Description of Artificial Sequence: Synthetic coding sequence
atggaaggctacagtgaagaggcaagcctgctgcggcacctcgagaaggtagcaagtgaggaagaggaggtgcctctggtggtgtacctgaaagagaatgccgctctccttactgccaacggcctccacttgtcccagaacagagaagcacagcagtccagcccagcccctccacctgcagaagtgcactcacctgcagccgatgtaaatcaaaacctggcatctccgtcagcgactctcaccaccccaacgtccaacagctcacataatcccccagcaaccgacgttaatcaaaaccctcccgcaaccgtagtgcctcaatcattgccactgagtagcatccaacagaacagctctgaagcgcagctgccatcaaatgggacagggccagcatctaaaccatccacactgtgtgccgacggccaaccccaagctccagcagaggaggtccgatgttctacactacttatcgacaaggtgagcacaccggcaaccaccacctctacattttcacgtgaggccaccctgatcccatccagccgaccgccagctagcgatttcatgtccagcagtctgctcatagatatccagcctaacacgttggtcgtctctgccgatcaggaaatgtccggacgagccgctgccaccactccaactaaggtgtattctgaagtgcacttcacgctggccaagcctccctccgtggttaacaggaccgcccgtccatttggtatccaggcgcctggaggaacgtcacagatggagaggtcccctatgctcgaacggagacactttggcgaaaaggcgccagcccctcaacctccatcattgcccgatcgtagcccaagaccccagcgccacatcatgagtcgatcacccatggtagaaagacgcatgatgggacagcgtagtcccgctagtgaaaggcggccactgggaaacttcacagccccacccacctacaccgaaaccctctccaccgcacccctcgcctcatgggtgaggtcaccaccctcgtactccgtgctctacccgtcaagtgatcccaaaagttcccatctgaaaggccaggccgtccccgcttcgaagaccggaatcctcgaggaaagcatggccaggcggggttcgagaaaaagcatgtttaccttcgtggagaaaccaaaggtcacacccaatcccgacctcctggatctggtccagaccgccgatgaaaagaggagacaaagggaccaaggggaagtcggagtggaggaagagccattcgctcttggagcagaggcctctaactttcagcaagagcctgcccctagagatcgagcctctccagccgctgccgaggaagttgtaccggaatgggcctcttgtctgaagagtcccaggattcaggccaagcctaaacctaagccaaatcagaatttgagtgaagcgagtggtaagggggctgagctctacgccagacggcagagccgtatggaaaagtatgtcatcgaatcatcatcgcacactccagagctcgctagatgcccttcaccgaccatgagtctgccatcgtcctggaagtaccctacgaatgcgccaggtgctttccgtgtagcatcaagaagtcccgctcgtacaccaccggctagcttataccatggctacctcccagaaaatggagtccttaggcctgagcccacaaagcagcccccataccagttgagacccagtctctttgtgctgagtccgattaaagagccagctaaggtctccccgagggcggcaagcccagcgaaaccatcctccctcgatcttgttcctaatctgcctaagggtgctctgcccccaagtccagcccttcctaggccatcacgctcctcaccagggttgtatacttcccccggacaggattcactccagccgaccgcagtgtccccaccttacggtggagatatctccccagtgagtccatcccgcgcttggagtcctagggccaaacaggccccacggccttccttcagcactaggaatgccggtattgaggcccaggacaggcgagaatctctgcccacatcacccccatggacaccaggcgcttctaggcctccctccagcctggacggctgggtttcacccggaccttgggaaccaggcagaggctctagcatgagtagcccacctcctttaccccctccccctcccatgagccctagttggtctgaacggtctgtatcacctttacggcctgagaccgaggcgcgacccccatcaagacagctgcaggccttgctcgcgagaaatataattaacgccgctagaagaaaatccgcctctccacggtctgcgggtgccgagaaccctcgaccgttcagtccccctcgcgctcctcctcccccacctccaccacctccccctcctcccagaatgcggagcccccagcccgctcgccctggcagcgctgctgtgcccggagcagcatttgccccaattcccaggtcaccactgcccgcagggcctagtagctgcacatcgcctagatcacctctgccggctccacccaggccctttctctaccgtcgatcgccaaccgattcagacgtgagcctggactcagaagattccggagctaaaagcccagggattctggggtacaacatttgtccccgagggtggaacggttcgctgaggcttaaaaggggtagcttgccagcggaagcctcttgcaccacttag

SEQ ID NO: 243051 - DNA, 2790 bp, Artificial Sequence
  Description of Artificial Sequence: Synthetic coding sequence
atgctgggaccacacctccctccaccgcctctcgcaccttctgaaggcagacccaccccctgcgcttttcagatccctgacggaagctatcggtgcttagccctggaggccgaagagagttccggagaggagggactgcaaggagaagttggaccaacggacctggaggaagacgagggcgtctctaggagtggcgacgattctgcttgtcgtgtgacacagggcacccctcagctgcccaaggccctggggatacagcccccaagctgttcccgagaggaacaaggcgctagccaacatgatgaccgagcgagccaggactgggatgttgtgaaggccggacagatgatgacagctagcccctcccccggaccagggccaagggtggctcagaaacccgcactgggacgatccacttctctcaccgagaaggacctgaaggaggctaaggcaagatcacagcagattgcagcacaactcaccactcctccctcctccaacagccgaggtgtgcagcttttcaaccgcaggagacagagagttaacgagttcacccttgaaagccacggtcaacgcggacagaagcccagccaggagagtctgcgggtcctcccttcaagcttgccaggacatgcccctgggctgagtctctcctccacaagtctgccggagccaggcccacctaggcatccatcgccccaatccccagatcgcggagtgcctggccactcaatggagggttatagtgaagaggccagtctgcttaggcacctggagaaggtcgcatcggaggaggaggaggtccccttggttgtatacttgaaagaaaatgcagccttgttgacggcgaatggacttcacctgagtcaaaatcgggaagcgcagcagtcgagcccggcaccgccaccagcagaagtgcattctcccgctgccgacgtgaatcaaaacttggccagcccgagcgccaccctgacaaccccaacgtctaactcttcccataaccctccagctaccgatgttaatcagaatccaccggctaccgtcgtgccgcagagtctacctttgtcctctatccaacagaactcctccgaggcacaactgccatcaaatggcaccgggccagcgtccaagccctcaaccctctgcgcagacggtcaaccacaggcccctgcggaagaggtacgttgttccacactcttaatcgataaagtctccactccagctacaaccaccagcaccttttcacgcgaggccacactaataccatcttcccgacctccagcctccgacttcatgtccagctctctacttattgacatccagcctaatactctggtcgtcagcgccgatcaggaaatgagcggcagggcagctgccacaacaccaaccaaggtgtattctgaagtgcactttacacttgccaaacccccatctgtggtaaaccggactgctcggccatttggcatccaggcaccaggaggaactagccagatggagaggtcacctatgctggagcgaagacactttggtgagaaggctcctgctccgcagcctccttcgcttccagacaggagccccaggccgcagagacatatcatgtctagatcacctatggttgaacgtcggatgatgggtcagcggagcccagcaagtgagcgacgcccactgggcaactttactgccccacccacttacactgagactttgtcaactgcccctctggcaagttgggtgaggagccctccctcctactctgtgctctatccgtcctccgatcctaagagctcacatctgaagggccaggctgtccctgcatctaagacgggaatcctggaagaaagcatggccagacgtggctcccgcaagtcaatgttcacttttgtggagaaacccaaggtaacacctaaccccgacctgctcgacctggtgcagaccgctgatgagaaacggagacagcgagaccagggagaagtgggagtcgaggaggaaccatttgctctcggtgctgaggctagtaacttccagcaggagcccgcaccgagggatagggccagtccagcagcagccgaagaggtggtgcccgagtgggccagctgcctgaagtctccacgaatccaggcgaagccaaagcccaagccgaatcaaaacttgtcagaagctagtgggaagggggctgagctgtatgccaggaggcagtcacggatggaaaagtatgtgatagagagctctagccataccccagaactagctcgatgcccttcacctacaatgagcttgccaagttcatggaagtacccaacaaatgcgccaggcgcattccgcgtggcatccagaagccccgcacgaaccccacctgcgagcttatatcacggctatctgcctgaaaatggggtccttagaccagagcctactaaacagcccccatatcagctgcgcccttccctgttcgtgctatctccaataaaagagccagccaaagtgtctccccgagctgcctcaccagcaaagccttcctcattagaccttgtgccaaatctcccaaagggagcactccctccaagtcctgcgctgcctcgaccgagcaggtcgtcgcctggtctctacacgtccccagggcaggactcccttcagcccacagccgtgagcccaccttatggaggcgacatctctcccgtgtccccctcacgggcatggtctcccagggccaagcaggcaccaagaccaagctttagcactagaaatgccggtattgaggcccaagtgtggaagccatcattctgctttaagtag

SEQ ID NO: 243052 - DNA, 2058 bp, Artificial Sequence
  Description of Artificial Sequence: Synthetic coding sequence
atggaagggtacagcgaggaggcatccctcctgagacatctggaaaaagtcgcctctgaggaggaggaggtgccactcgttgtttatctcaaggagaacgccgcactcttgaccgcaaacggattgcatctgagccaaaaccgcgaagcccagcagagttccccagctcctccaccagctgaggtgcactctcctgccgctgatgtgaatcagaatttagcctctccttccgctactctgactaccccaacaagcaactcctctcacaaccctccagctacagacgtaaaccagaatcctcccgcaacagtcgtcccccaaagcctgcctctcagctcaatccagcagaattccagtgaggcccagctgccctccaacggaaccggaccggcttctaagccctccactttatgtgccgatggccagccacaggcacccgcagaggaagtgcgctgttccaccctgctgatagacaaggtgagcacaccagctacgactacttcaactttcagtcgggaagctaccctaatcccatctagccgtcccccagcatctgactttatgtcttcaagtttgctaattgatatccagcccaatacgcttgtcgtgtccgctgaccaagaaatgtctggacgcgcagcagcaacaacaccgaccaaagtatacagcgaagtgcacttcactctggccaagcccccatctgtcgtgaaccggacagcccgtccctttggaatccaggcacctggaggcaccagccaaatggagaggtctcctatgctggaacggagacattttggtgaaaaagctcctgctccacaaccaccatcgctgccagaccgtagccctcggcctcagcgccatataatgtctcgatccccgatggttgaaaggcgcatgatgggccagcgaagccccgcaagcgagcgcaggcctctcgggaatttcacagcccctcccacctatactgaaacccttagcacggctcccttggcttcgtgggtgagaagccctccttcctactccgtattgtaccctagcagtgaccctaagtcaagtcatctgaaagggcaggcggtccccgcatctaaaacagggatcctggaggagagtatggctagacggggtagccgcaaatcaatgttcaccttcgtggagaagcccaaggtaactcccaatcccgacctcctagacctggtgcagacagccgatgagaaacgaagacagagagatcagggcgaggtcggtgtggaggaagagccattcgctctgggcgctgaggcatccaactttcagcaggagcctgctcctagagatcgagcctcacctgcagctgctgaggaggtggtgcctgaatgggcgagctgcttgaaaagtcccagaatccaagcaaaaccaaagcctaagccaaaccagaatttaagtgaggccagcgggaagggcgctgagctctatgcaagacgccagtccagaatggagaaatatgtgatagaaagcagcagccacacgccagagttggccagatgtccttcaccgacgatgtcccttccttcaagctggaaataccctactaatgctcccggagccttccgagtcgccagtagatctcccgcaaggacccccccagcctctctttatcacggatacctgcctgagaacggggtgctaaggccagagccgaccaaacagcctccttatcaacttcgaccttccctttttgtcctctctccaatcaaggaaccagctaaggttagtccacgcgcagcgtcacctgccaagccaagcagtctcgaccttgtccctaaccttccgaaaggcgctctccccccatcaccagccctgccgcgaccaagtaggagctcccctgggctttacacctccccgggacaagattctctccagcctaccgcagtgtcaccaccgtacgggggagacatcagtccagtatcacccagtcgggcttggagccctcgcgcaaaacaggctcccagaccatcattttcgactaggaatgcaggcatagaagcccaagtgtggaaaccttccttctgcttcaagtag

SEQ ID NO: 243053 - DNA, 2790 bp, Artificial Sequence
  Description of Artificial Sequence: Synthetic coding sequence
atgcttgggcctcacctccctcccccacctttggcaccaagcgaggggaggccaacaccatgtgcattccagattcccgatgggtcatacaggtgcctcgctctcgaggccgaggaatcatcaggcgaagagggtctccagggagaagtcgggcctaccgacttggaggaggatgaaggcgtctccagatcgggggacgacagcgcttgtcgggtcacgcagggcacgccccagttacctaaggcgctggggatacaacccccaagctgttcaagggaggagcagggagcgagccagcacgatgacagggcttcccaggactgggacgttgtgaaggccggacagatgatgaccgctagcccgtcaccgggacctggacctagggtggcccagaaacctgctttgggcagatccacctccctaacggagaaggacttaaaagaggccaaggcacggtcacaacaaattgctgcacagctaactactccaccaagtagcaatagcagaggggtccagctttttaaccggaggaggcagagggtgaacgagttcaccctcgagtctcacggacagcggggacagaagccctctcaggagtcattaagagtgcttccatcatctctgccgggacatgcaccaggcttgagcctatcctccacctcccttcccgagcccggtccaccgagacaccctagcccacagtccccagatagaggcgtccccggtcatagcatggagggatactcggaagaagccagcctattgcgccacctagagaaggtggcttccgaagaagaggaagtccctctcgtagtgtatctgaaggaaaacgccgcactcctcaccgcgaacggactgcatcttagccagaatagagaggcacagcagagcagcccagctccccctccggcagaggtgcattcaccggcagcagatgtgaatcagaacctggcctccccctctgccactcttacaactcctaccagcaattccagtcacaacccccctgcgactgacgtgaaccagaatccgccagctacagtcgttccacagagcttgccactgtcttccatccagcagaactcaagcgaggcccagctgccatccaacgggacaggccctgcctctaagccatccacgctctgtgcggacggtcaaccacaggcaccagcagaggaagtgcggtgttccactttgctgatagacaaagtaagcacccctgctactacaaccagcacatttagccgcgaagctacactgattccaagtagtagaccacctgccagtgatttcatgagctcatccctgctgatagacatccagccaaacactcttgtggtgtctgcagatcaggagatgtcgggacgggcagccgcaactactcccacgaaggtgtactccgaagttcacttcactctggccaagccgccttctgtggttaatagaactgcacgacccttcggaatccaagctccgggaggcacaagtcaaatggagcggtcccctatgttggaacgcaggcacttcggggaaaaagcacccgctcctcagccacccagtctgcccgatcggtcccccagaccccaaagacacattatgagcaggtcgcctatggtcgagcggaggatgatggggcagcgttcaccagctagcgaacgtagacccctgggaaattttacggcccctcctacatacaccgagaccctgtctaccgcaccactagcgtcatgggtgaggtctcccccatcttactccgtgctctacccttcctcagaccccaagagttcgcaccttaaaggccaggctgtgccagcctccaaaaccggcatactcgaggaaagcatggccagacggggatcccggaaaagtatgttcacttttgtagaaaagcccaaggtaaccccaaacccggacctcctcgatctggtccagacagccgatgaaaagagaaggcagagagaccaaggcgaagtcggagtggaggaggaacctttcgcgcttggagctgaggcttccaacttccagcaggaacccgcacccagggaccgagctagtccggctgcagcagaagaggtggtgcccgagtgggccagttgtcttaagagtcccagaatccaagcaaagccgaaaccaaaaccaaatcagaatctttctgaggcttcgggcaagggagccgagctgtatgccaggaggcagagtcggatggaaaagtatgtcatagagtcctcaagccatactccagaattggcaagatgtccttcccctactatgtcgctgccttctagttggaaatatcccaccaatgcccctggtgcgtttagagtggcaagccgaagccccgcaagaacgccgcctgcatcgctctaccacgggtacctgccagagaacggggtgctgagaccagaacctacgaaacagcccccatatcagctgaggccctccctgttcgtgctttctcccataaaggagcccgctaaagtgagtccgagagccgcatcaccagccaagccctcatctctggacttagttcccaacttaccgaagggggcactgcctccctcgcctgcgttgccacgtccaagtcggagctccccaggcctttacacgtcccctggacaagattcgctacaacccactgctgtctctcctccgtatggaggggacatctctccagtgtccccaagtcgcgcatggagccctagagcaaagcaggcaccacggccaagcttctcaacacggaatgcgggaattgaggcccaagtttggaaaccctctttttgctttaagtag

SEQ ID NO: 243054 - DNA, 636 bp, Artificial Sequence
  Description of Artificial Sequence: Synthetic coding sequence
atggataacttgagctctgaagaaatccagcaaagggcacaccaaatcaccgatgaatcactggagagcaccaggagaatccttggccttgcaatagagtctcaagacgccggtataaaaaccataaccatgctggatgagcaaaaggagcagcttaaccgcatcgaggagggacttgatcagatcaacaaagacatgcgtgaaaccgagaaaacattgacagagttgaacaagtgttgcggtctgtgtgtgtgtccatgtaatcggactaagaattttgaatcagggaaggcctacaagactacctggggagacggaggcgagaatagcccatgtaatgtggtttccaagcagcccggtcccgtcactaatggccagcttcagcagcccacaacaggcgctgcatcagggggatatattaaaaggattacaaacgacgccagagaggacgagatggaagaaaacctaacacaggttggaagcattttaggtaatctcaaagacatggctctgaatatcggcaacgaaatagatgctcagaacccacagatcaaacgtattacggataaagccgatacaaatcgcgaccggatcgacatcgccaacgctcgcgctaaaaaactcattgatagttag

SEQ ID NO: 243055 - DNA, 477 bp, Artificial Sequence
  Description of Artificial Sequence: Synthetic coding sequence
atggacaatttgtctagcgaggaaatacaacagcgtgcccaccaaatcaccgatgaatccctggagtccacccgccgtattctgggcctcgctatcgaaagccaggacgccggaatcaagaccattacaatgctggacgaacagaaagaacagttaaatcggatagaggagggacttgatcagataaacaaggacatgagggagactgagaaaactcttacagagctgaataagtgttgtggcctctgtgtttgcccctgtaattccattaccaacgatgcaagggaggacgagatggaagagaacctgactcaggtcggttccatattgggtaacttgaaagatatggcgctgaacatcggaaatgagatcgatgcccagaacccacaaattaaaagaattacggacaaggcggataccaatcgggataggattgacattgcaaacgcaagagctaaaaaactaatcgacagctag

SEQ ID NO: 243056 - DNA, 477 bp, Artificial Sequence
  Description of Artificial Sequence: Synthetic coding sequence
atggataatctgtcatctgaagagattcagcagcgcgctcatcaaattaccgacgaatccttggagagcacccgcaggatcctgggactggctattgaatcccaggacgctggtatcaaaacgatcaccatgcttgacgagcagaaagaacaactgaatcgcatcgaggaaggcctggatcagatcaataaggacatgcgtgaaactgaaaaaactctgacagagctgaacaaatgttgtgggctctgcgtctgcccatgcaattctataacgaacgacgccagggaggacgaaatggaagaaaatctgactcaagtgggaagcatactgggcaacttaaaagacatggcattgaacatcggaaacgaaatagatgctcaaaaccctcagataaagcgcatcaccgataaggctgatacaaatagagaccgaatcgatattgccaatgctcgtgcaaagaagctgatcgactcgtag

SEQ ID NO: 243057 - DNA, 621 bp, Artificial Sequence
  Description of Artificial Sequence: Synthetic coding sequence
atggccgaggacgccgatatgcggaacgagctggaagagatgcaaaggcgggcagatcagctggccgacgagtctttagagtccactcgcaggatgctccagcttgtagaggagtcaaaagatgcaggcatccgcaccctcgtgatgctggacgagcagggagagcagctcgaacgtatagaagaaggaatggatcagataaataaggacatgaaggaagccgagaaaaatctgactgacctcgggaaattctgtgggctctgtgtgtgcccatgcaataagttgaagtcttcagatgcctacaaaaaggcatggggcaataaccaagacggggtggttgcttcacaaccagctagagttgtggacgaacgagagcagatggcaatctcaggtggtttcattcggcgagttacgaacgacgctcgcgagaatgagatggatgaaaatctagaacaggtctcagggatcattgggaacttgagacacatggcccttgacatgggcaacgaaattgatactcagaatcgtcagatagaccggattatggagaaagccgattcaaataagaccagaatcgacgaggcaaatcagagggcaaccaaaatgctgggctccggatag

SEQ ID NO: 243058 - DNA, 621 bp, Artificial Sequence
  Description of Artificial Sequence: Synthetic coding sequence
atggccgaggatgcggacatgaggaatgagctggaagaaatgcagcgacgggcagaccagctggcagacgaaagtctggagagcacacgccgaatgctgcaattggtcgaggagagcaaagatgccggaattagaacactggtgatgctcgatgagcagggagagcagctagaccgcgtcgaggaagggatgaatcatattaatcaggatatgaaagaagccgagaaaaatctgaaagacctaggaaagtgttgtgggctgtttatctgcccctgtaataaactgaagtctagcgatgcctataagaaagcttggggtaacaaccaggacggggtggtagcatcacagcccgctagagttgtggacgagagggagcagatggccatttccgggggatttataagacgcgttacgaacgacgcccgtgagaacgagatggatgaaaacttagaacaagtatcaggcataattggaaatctcagacatatggctctagacatgggaaacgaaatcgacactcagaataggcagatcgaccgtattatggaaaaagccgattctaataaaacacggattgatgaggccaaccaacgcgctactaaaatgctgggcagtgggtag

SEQ ID NO: 243059 - DNA, 282 bp, Artificial Sequence
  Description of Artificial Sequence: Synthetic coding sequence
atggctgaggacgcggacatgaggaatgagcttgaagaaatgcagcgtagggcggaccagctagcagacgagagtctggaaagcacaaggcggatgctacagttggtggaggaaagcaaagatgcgggtattaggaccctcgtgatgcttgacgagcaaggagagcagctggagagaattgaggagggtatggatcagatcaataaagatatgaaggaggcagagaagaacctgacagacctaggtaagttctgcggactttgtgtgtgcccctgcaactag

SEQ ID NO: 243060 - DNA, 1500 bp, Artificial Sequence
  Description of Artificial Sequence: Synthetic coding sequence
atgaaacacagtctgaacgctcttttgatctttctcatcattacttcagcttggggcggaagtaagggacctcttgatcagctggagaagggcggtgagacagctcagagcgcggatccgcagtgggagcagctaaataacaagaacttgagcatgccactcttacccgctgatttccataaagaaaacaccgtgaccaacgactggatcccagaaggcgaggaggacgatgactacctcgatctggaaaaaatcttctccgaagatgatgactatatcgacattgtcgattctcttagtgtttcccccacggactcagacgtgtctgcagggaacatcctgcaactgttccatgggaaaagtagaatacaaagactcaacattctgaacgctaaattcgcctttaatttgtatagggttctaaaggatcaggttaacactttcgataatatctttatcgccccagtgggtatcagcactgccatggggatgattagtctcggcttgaaaggcgagacccacgagcaagtgcattccattttacacttcaaggatttcgtgaatgcatcatctaaatatgaaattaccactatacataatctcttcagaaagcttacccaccgccttttcaggcgaaactttggatataccctccgttcagtgaatgacctttacatccagaaacagttccccatcttacttgatttcaaaacgaaagtgcgggaatattattttgctgaggcccagatcgctgatttttccgaccccgctttcatttctaaaaccaataaccacatcatgaaactgacaaaaggactgatcaaggacgctttggagaacattgaccctgctacccagatgatgattctgaattgtatttacttcaagggatcgtgggtcaataaattcccagtcgagatgacccacaatcacaatttccggttgaacgagcgagaagtcgtgaaagtgtctatgatgcagacgaaagggaattttctcgccgctaatgaccaggagctggattgcgacattctgcaactggaatacgtcggcggaattagtatgctgattgtggtaccacacaagatgtcaggcatgaagaccctggaggctcagctcacccctagggtagtagaaagatggcagaagagcatgacaaaccgaacccgggaggtgctgctgcccaaattcaagctggagaagaactataacttagtggagtcccttaaattgatgggaatcaggatgctgttcgacaagaacggcaacatggctgggatttctgatcaacgtatcgccattgacctgtttaaacatcaaggcaccatcactgtaaatgaggaggggacccaagcaacaacagtcaccactgtgggttttatgccactgtctacacaagtcaggttcactgtggacaggcctttcctttttctgatttatgagcacagaacatcatgtctcctttttatgggccgagtcgctaacccttcccgaagctag

SEQ ID NO: 243061 - DNA, 1269 bp, Artificial Sequence
  Description of Artificial Sequence: Synthetic coding sequence
atggtgtccgaaagccatcacgaggccctggctgccccaccagttacaaccgttgctactgtgctcccgtccaatgcaacagaacctgcctcccccggagaaggtaaagaggacgctttttctaagctgaaagaaaagttcatgaatgaattgcataagatacctctcccaccttgggcactgatagcaatcgcgatcgtggccgtcctgctagtcctgacctgctgcttttgtatatgcaagaaatgcttatttaagaagaaaaataagaagaaggggaaagaaaaagggggaaagaacgcaattaatatgaaggatgtcaaggatctaggcaaaacaatgaaggaccaggctctgaaagacgacgacgccgaaacaggacttactgacggggaagaaaaagaagagccaaaggaggaggagaagctaggcaagctgcaatactctctggactacgactttcagaacaaccagctcctcgtaggcatcatccaagccgctgagcttccggctcttgacatgggaggcacttcagatccttacgtgaaggtatttctactgccagataaaaagaagaagttcgaaacgaaagtgcatcgtaaaaccctgaacccggtgtttaacgagcagttcacgtttaaggttccatattcggaactcggaggcaagactctggtgatggccgtgtatgacttcgaccgattctctaaacacgatattataggagagtttaaggttccgatgaacacagtggacttcgggcatgtgactgaggagtggagagacctccagagcgctgaaaaagaggaacaggagaagctgggtgatatttgcttttccctccgctatgtccctaccgcaggcaaactcacggtggtgatcctcgaggccaagaacttgaaaaagatggatgtggggggtctgtccgacccgtacgtgaagatacacttgatgcagaacgggaagcgactgaaaaaaaaaaagacaacaattaagaagaacactctgaacccatattacaacgagagtttcagctttgaagtaccatttgagcaaatccagaaggtgcaagtcgtggtcactgtccttgattatgataaaattggtaaaaatgacgctattggaaaggtgttcgtgggatataattctaccggagccgagctcaggcactggtcagatatgttagcaaacccacgacgtccgattgcccaatggcacacgttacaggtggaagaagaggtcgacgccatgctcgctgtgaagaaatag

SEQ ID NO: 243062 - DNA, 1269 bp, Artificial Sequence
  Description of Artificial Sequence: Synthetic coding sequence
atggtttcagagtcacaccacgaggccctcgccgctccacccgtgacaaccgtagctaccgttcttccgagcaatgcaacagaacctgccagcccaggagaaggcaaagaggatgcctttagtaagcttaaagagaagttcatgaacgaattgcacaaaatccccctcccaccgtgggctttaatcgcaatcgctatagtggctgtgctccttgtcctgacttgttgcttctgcatttgcaagaaatgcctgtttaagaagaagaataaaaagaaaggcaaagagaagggaggcaaaaacgccatcaatatgaaggacgtgaaggacttgggcaagaccatgaaggatcaagctctgaaagatgatgacgccgaaacagggctgaccgatggggaggagaaagaggaacctaaggaagaggagaagttgggaaaactgcagtattccctcgactacgattttcagaacaatcagctcctggtagggatcatccaggcagccgagttgcccgcattggacatgggtggcaccagtgacccttacgttaaagtgttcttactgccagataagaagaagaaattcgagacaaaagtccatcggaagacacttaaccccgttttcaacgagcagttcacttttaaggtgccctattctgaattggggggtaaaacactcgttatggccgtctacgactttgacaggttctctaagcatgacataattggcgagttcaaagtcccaatgaataccgtggacttcgggcacgtgacggaggaatggagagatctccagtccgccgagaaggaggagcaagagaagttaggggacatctgcttttccctccggtacgttccaactgccggtaagctaacagtggtgatactggaggccaaaaatctgaagaaaatggacgtcggaggtctgtctgacccctatgtcaagatccacctgatgcagaacggaaagcgccttaagaagaaaaagactacgatcaaaaagaatacactcaacccttactacaacgaatcctttagcttcgaagtaccattcgagcagattcagaaggtgcaagtagtggtgacggtcctggactatgacaagattggcaagaatgatgcgatcgggaaggtcttcgttggctataactccacaggggctgagctgaggcactggtccgatatgctggcgaacccaagacgtcctattgcacaatggcatactctccaggtcgaagaggaagtggatgccatgctggccgtaaagaagtag

SEQ ID NO: 243063 - DNA, 549 bp, Artificial Sequence
  Description of Artificial Sequence: Synthetic coding sequence
atggtgagcgagagccaccacgaggccttggctgcccctccagtgacaaccgttgccaccgttttgccatccaacgctactgagccagcgtcaccaggggaaggaaaggaagatgctttctccaaattgaaggagaagttcatgaatgagctccacaagattcctctccctccctgggcactaatagcaattgctatcgtggccgtgctccttgtgctcacatgttgtttctgcatttgtaagaaatgtttgtttaaaaaaaagaataagaaaaagggcaaagagaaaggcggaaagaacgctataaatatgaaggatgtaaaagatctggggaaaacgatgaaggatcaagcactgaaggacgacgatgctgagacaggcctaaccgatggtgaggagaaggaggagccaaaagaggaggagaagcttgggaaactgcagtattcccttgattacgacttccaaaacaaccagctgctggtgggtattatccaggctgcagaattacccgcactggatatgggagggactagcgatccatacgtttag

SEQ ID NO: 243064 - DNA, 177 bp, Artificial Sequence
  Description of Artificial Sequence: Synthetic coding sequence
atggtgtccgagtcacaccacgaagcactagcagcccctcccgttaccactgtggcaaccgttctgccctcgaacgccaccgaacccgctagccccggagaggggaaagaggacgcttttagcaaattgaaggaaaaattcatgaacgaattgcacaaaattcctctccctccctag

SEQ ID NO: 243065 - DNA, 219 bp, Artificial Sequence
  Description of Artificial Sequence: Synthetic coding sequence
atggtgtccgagtcccatcacgaagctctggccgcacccccagttacaaccgtggcaactgtgttaccatctaacgctaccgagccagctagtcccggtgaggggaaggaggatgccttcagcaagctcaaggagaagtttatgaacgaactgcataagatccctcttcctccttgggcccttatcgcgattgccatcgtggctgtgctcctggtatag

SEQ ID NO: 243066 - DNA, 222 bp, Artificial Sequence
  Description of Artificial Sequence: Synthetic coding sequence
atggtgtccgagagccaccatgaggccttggcagcgcctcccgtgactaccgtagcaactgtgctgccttctaacgctacagaaccagcttcccccggtgaggggaaagaggacgcattctctaaacttaaagaaaaattcatgaatgagcttcacaagatacctttacccccttgggctcttattgccatcgccatagttgctgtgttactagtgctgtag

SEQ ID NO: 243067 - DNA, 285 bp, Artificial Sequence
  Description of Artificial Sequence: Synthetic coding sequence
atggtcagtgaatcccaccacgaggccctcgcagctcctcctgtaactactgtggccacagtcttgcctagcaacgccaccgaaccagctagccccggagagggaaaggaagacgcgttttcaaagctgaaagagaagttcatgaacgaactgcacaagatccctcttcccccatgggcacttatagccatcgctatcgtggctgtgctcttggtgctcacctgctgcttctgtatttgcaagaaatgtctttttaagaaaaagaataagaaaaagggtaagtag

SEQ ID NO: 243068 - DNA, 1269 bp, Artificial Sequence
  Description of Artificial Sequence: Synthetic coding sequence
atggtatcagagtctcaccatgaggcgctggcagcccctccagtgacaactgttgctaccgtattaccaagcaacgctacagaacccgcttcccccggtgagggaaaggaggatgccttttccaagttgaaagagaaatttatgaatgagctacacaagatcccactgccaccctgggctttgatcgctatcgctatcgtggcagtgctgctcgttcttacctgttgtttttgcatttgcaaaaagtgcctgttcaaaaagaagaacaagaagaagggaaaggagaaaggagggaaaaacgctatcaatatgaaggacgttaaggatctcggcaagaccatgaaggatcaagcactaaaagacgacgatgctgagactgggctgaccgacggggaagagaaagaggagcccaaggaagaggagaaacttggcaagcttcagtattcactggactacgattttcaaaataatcagctgctggttggcatcattcaggccgcagaactcccagccctggacatgggaggcacaagcgacccttatgtaaaggtatttctcctgcctgacaagaagaagaaatttgaaaccaaagtgcatcgcaaaactcttaaccctgtgttcaatgaacagttcaccttcaaggtgccctacagcgaactcggaggcaagaccctggtcatggccgtgtacgatttcgaccgtttcagcaagcacgatataattggcgagttcaaggtccctatgaacacagtagattttggtcatgtgaccgaagaatggcgagacctccagtccgccgagaaggaggaacaggaaaagctgggggacatttgtttcagcctgcgctatgtccctaccgcgggtaaactgacagtcgtgattctggaagccaagaatctgaagaagatggacgttggcggtttgtcagacccttacgtgaaaatacacctgatgcagaatggcaaacgcttaaagaaaaagaagactactattaaaaagaataccctcaatccctactataacgaaagcttcagcttcgaagtgccatttgagcagatccagaaggttcaagtggtggtgaccgtgctcgactacgacaaaatcgggaagaatgacgccatcggcaaggtgtttgtaggttataatagcacaggggcagagctccggcactggagcgacatgctcgctaacccgcgaagacccatcgcccaatggcatactcttcaggtggaagaggaagtggacgcaatgctagctgttaaaaagtag

SEQ ID NO: 243069 - DNA, 1773 bp, Artificial Sequence
  Description of Artificial Sequence: Synthetic coding sequence
atgtccggtgactacgaggatgacctatgccgtcgcgctctcatactggttagtgatctgtgcgcaagggttcgcgacgcagatacaaacgacaggtgccaggagttcaatgacagaatccgaggttacccaagggggcctgatgctgacatctcagtttcgttgctaagcgttatcgtcaccttctgcggcattgtattgctcggcgtttccctgtttgtatcttggaagctttgttgggtgccctggcgcgataaggggggaagcgccgttggcggtggacctttacggaaagatcttgggccaggggtgggactcgccggactggttggaggagggggtcaccacctagcagccggactgggaggtcacccactgttggggggtccccaccatcacgcgcatgctgcccaccacccgccattcgcagagcttctggagcctggtagcttaggtggctcggacactcccgagccaagctatttggacatggatagttatcccgaagctgcagcggcagctgtggcagctggcgtgaagccctcccagacgagtccagagttgcccagtgaaggaggggcaggctccgggcttctcctcctgcctccttctggcggaggactcccttcggctcagagccaccagcaagtgacctcccttgctcccaccacccggtatcctgccctgcctaggccactgacacagcagacattgacttcgcagcccgatccgagcagcgaggagcgacccccagccctgcccttacccctgcccggtggagaggagaaagcaaagttaattggccagattaaacccgaactataccagggcaccggacccggagggcgtcgctccggcggaggtcccggatctggcgaggctgggaccggggctccctgtgggcgaatctcattcgcactgagatacctgtacggctccgaccagctcgtggttcggattctgcaggcacttgatcttcctgctaaagacagcaatggttttagtgacccttatgtgaagatctatttacttcccgaccgaaaaaagaagttccagaccaaggtgcacaggaaaaccctcaatcctgtgttcaatgaaactttccaattttccgtgccactcgctgaactggctcaacggaagctccatttttcggtgtacgatttcgataggttttctcgacacgacctaatcgggcaagtggtcttggacaacctcttggagctcgccgagcagccgcctgacaggcccttgtggcgggatatcgtcgaaggtggatccgagaaagctgacctgggcgaattgaacttcagcctgtgctatcttcccacagccggtcggctgaccgtaaccataatcaaggcatccaatcttaaagctatggatctcacaggattttcggacccttatgtaaaggcctcactgatctcagaaggcagaagactgaagaagagaaagacctcaatcaagaagaacacactcaatcctacatacaatgaagccctcgtctttgacgttgctcccgagtccgtcgagaatgtaggactatcaattgccgtggtagattatgactgtatcgggcacaatgaagtgattggggtgtgtagagtaggaccagacgcagcggacccgcacggacgggagcactgggctgagatgctggcaaatcctcgaaagcctgtagagcattggcatcagctcgtggaagaaaaaaccgttactagcttcacaaaggggtcaaaaggattatcagaaaaggagaactctgagtag

SEQ ID NO: 243070 - DNA, 1773 bp, Artificial Sequence
  Description of Artificial Sequence: Synthetic coding sequence
atgtctggtgactacgaagacgatctgtgcaggagggcactcattctggtctcggacctgtgcgcaagggtaagggatgcggacaccaatgaccgttgccaagaattcaacgatcggattcggggttaccctagggggccagacgccgatatctcggtgtcgctgctctctgttatcgtcaccttttgcgggattgttcttttgggtgtcagcctgtttgtctcctggaaattgtgttgggttccatggcgcgataaaggcggatccgccgtggggggagggccattacgcaaggacctcgggccaggggtaggattggcaggactggtagggggaggcggacatcaccttgccgctggacttggtggacatcctttgcttggaggcccacatcatcatgcccatgcagctcaccacccaccctttgcagaactcctggagcctggatccctgggcggtagtgacacgcctgagccatcttacctcgacatggatagttacccagaggccgctgctgccgcagttgcagccggtgtgaagccttcccagacaagccccgagctcccaagcgaggggggagctggaagcggcctcttgttgctgcccccatccggcggaggacttccgagtgcccagagtcaccagcaagtgacgtccctcgcaccaacaactcggtacccagcgcttccccgtccattaacccagcaaaccctgaccagccagccagacccttcttcggaggagagacctcccgcactgcccttgcccctgccagggggtgaagagaaagccaagttgatcggccagatcaagcctgagctgtatcagggaaccggaccagggggtaggcggtcaggtggaggacccggttcaggggaagcgggtaccggtgcaccttgcgggaggatctccttcgcactgcgttacttatatggttctgaccagctggtggttcgaatacttcaggccctggatctccccgcaaaagacagtaacggtttctcagacccatacgtgaaaatatacctgcttcccgacaggaagaaaaagttccaaacaaaagtgcaccgaaaaaccctgaaccctgtatttaacgagacctttcagttctctgttccgctagctgaactcgctcagagaaagctgcacttctctgtgtacgattttgacaggttctcaaggcacgatctcattggtcaagtggttctggacaatcttctggaactcgcggagcagccaccagacagaccgctgtggcgggatatcgttgagggaggctctgaaaaggccgacctaggagagttaaacttttccctgtgctatctgcctacagcgggacgccttaccgttactattatcaaggccagcaatctgaaggcaatggaccttaccggattttctgacccatatgtgaaggccagtttgatttccgaggggcgaagactcaaaaagcgcaaaacatcaatcaaaaaaaatactttgaatcccacatacaacgaagccttggtgtttgatgtagcccctgaaagtgtggagaacgtcggcctgtccattgccgtggtcgactatgactgcatcggccacaacgaagttatcggggtgtgcagagtgggcccagatgcagccgatccccacggacgcgagcactgggctgaaatgctagctaaccccagaaaacccgtggagcactggcaccaattagtcgaggagaaaactgtgacatctttcacgaaggggtctaagggcttgagtgagaaggaaaacagcgagtag

SEQ ID NO: 243071 - DNA, 1773 bp, Artificial Sequence
  Description of Artificial Sequence: Synthetic coding sequence
atgagcggtgattatgaggacgacctctgtagacgggctctgattcttgtctctgacctgtgcgctagagtccgggacgcagataccaatgataggtgccaggagttcaacgatcgcatccgcggttaccctcggggaccggatgccgatatcagcgtgagtctgctgtccgtaatagtcacattttgtgggattgtactgctcggggtctcactatttgtgagctggaagctctgttgggtaccatggcgcgacaaggggggatctgccgtcggcggaggacccctcagaaaagaccttgggcctggtgtgggactggcaggtttagtggggggaggagggcaccacctggccgctgggctgggcggacaccctctgctggggggaccgcaccaccatgcgcacgctgcgcatcatcccccttttgctgagctgctcgagccgggatcgctgggcggttccgatacgccggagcccagttacttggatatggacagctatccagaggccgctgcggctgccgtcgctgccggtgtcaaaccctcccagacaagccccgagttaccatctgagggtggcgctggtagtggcctgcttctgctacccccttctggtgggggacttccaagcgctcagtcccatcaacaagtgacttccttggccccaactactcgctatccagctctaccgaggccactcacccaacaaacccttactagtcagcctgatcccagctccgaagagcggcctccagctctccccctcccattacccggaggagaagagaaagccaagctcatcggccagattaaacccgaattataccaaggcaccgggccaggcggaagacgatccggcggtggcccagggtccggtgaggccggaactggagccccatgcggaagaatatcttttgcgctgcggtatctttacgggtctgatcagctagttgtccgcattctgcaggcactggacttgcctgcaaaggattccaacggctttagcgacccatacgtgaaaatatacctgctgcccgacaggaagaaaaaatttcagacgaaagtgcatcgtaaaaccctcaaccccgtgttcaacgagacctttcaatttagtgttcccttggctgagcttgctcaacggaagttgcatttctcagtctacgattttgatcgcttcagtcggcacgacctaattggtcaagtagtcctggacaatttgctggaactggccgaacagccacctgaccgccctctttggagagacatcgtggaaggcggaagcgagaaggcggatctgggcgaactgaactttagtctttgctatctgcccacagctgggaggttgaccgtcaccattatcaaagcctccaatctcaaagcaatggacttgaccggcttttctgacccatacgtcaaggccagcctcatatctgagggcagaaggctcaaaaaaaggaaaacttccatcaaaaaaaataccctgaatccaacatacaacgaggcacttgttttcgacgttgcacctgagtcagtagagaacgtgggcctctcaatagctgtggtcgattatgactgtatcggccataacgaagtgattggagtgtgccgcgtcggcccagacgcggctgatccacacgggagggagcactgggctgagatgctggcaaaccccaggaaacctgtggaacactggcaccagttggtggaagagaagacggtgacttcttttacaaaaggttccaagggcctctccgagaaggaaaacagcgaatag

SEQ ID NO: 243072 - DNA, 1773 bp, Artificial Sequence
  Description of Artificial Sequence: Synthetic coding sequence
atgagtggcgattatgaagacgacctttgtcgacgggcacttattcttgtgagtgatttgtgcgccagggtgagagacgctgataccaacgatagatgtcaggagttcaatgaccggatccgcggttaccccaggggcccagatgcagatatttccgtgagccttctaagcgtcatagttactttctgtgggatcgtgctcctgggggtgagcctgttcgtttcatggaagctctgttgggttccctggcgcgataaggggggtagcgcagtgggcggtggcccactgagaaaggatctggggcctggagttggcctcgcagggttggtcggtggtggagggcatcatctggccgcaggcctgggcggtcaccctctgcttggtgggccacatcaccacgcccacgcagctcatcaccctccctttgctgagcttcttgaaccaggttccctgggtggatctgatactccagagccttcttaccttgatatggattcttaccccgaggctgcagcggctgcagtcgctgcaggtgtgaagccatcccagacctctcctgaactgccaagtgagggaggggctgggtccggtttgctgctgcttcccccaagtggcggtggccttccatcagcacagagtcaccaacaggtcacctcactggctccaaccacacgttatcccgctttacccagaccactaacacagcagaccttaacttcccagcctgatccctcttccgaggagcggcctcctgccctcccattgcccctcccgggaggcgaggaaaaggctaagctgattggacagatcaagccggagctctaccagggcacaggtccgggaggcagacggtcagggggaggcccaggctctggcgaggctgggacgggtgcgccttgcggtcggatctcctttgcactcaggtatttgtacggctcagatcaacttgtggtgcggattttgcaagctcttgatttacccgctaaagacagtaatgggttttctgacccatatgtcaagatatatttgcttccagaccgcaaaaagaagtttcagaccaaggtgcatcgcaagacgctgaacccggtatttaatgaaacctttcagtttagtgtgccgctagcggagctcgctcagcgaaagttgcacttttccgtgtacgatttcgaccggttttcccgtcacgacctcatcggtcaggtggtcctcgataacctcctggagcttgccgagcagccacccgatagaccattgtggagggacatcgtggagggaggctccgaaaaggctgatttaggggaactcaatttttccctttgctatcttcccactgctggaaggctgacggttacaatcatcaaagctagcaatttgaaagccatggatctgaccggatttagcgacccatacgttaaggcaagcctcatcagtgagggaaggagactgaagaagaggaaaactagcattaagaaaaataccctcaatccaacatacaacgaggccctggtctttgatgtcgcacctgaatcagtggagaacgtgggtttgtcgatcgccgtagtcgattacgactgcatcggacacaacgaagtgatcggagtgtgtcgggtggggcctgatgccgctgaccctcacgggagggagcactgggccgaaatgcttgccaatccccgtaagcctgtcgagcactggcaccagctcgttgaggagaagaccgtaaccagcttcaccaaggggtctaagggcctcagcgagaaggagaactctgagtag

SEQ ID NO: 243073 - DNA, 1278 bp, Artificial Sequence
  Description of Artificial Sequence: Synthetic coding sequence
atggctcctattaccaccagtagagaagagttcgatgaaattcctacagtcgttggcatctttagcgccttcggattggtatttaccgtgagcctgtttgcctggatctgttgccaacgaaagagctctaagtcaaacaaaactcctccttataagttcgttcacgtcctgaaaggggtggacatctaccctgaaaatctgaactctaaaaaaaaattcggcgctgacgataaaaatgaagtgaaaaacaaaccggctgtcccgaaaaactccctgcaccttgatctagaaaagagggacctgaacggaaatttcccaaaaaccaacctgaagccaggatcgccttcagacctggaaaatgccacacccaagctttttctggaaggcgaaaaggagtccgtgtctcctgaatccctgaagagtagtacctcccttacctcagaggaaaagcaagaaaagctggggaccctgtttttcagtctggagtataatttcgagcgcaaagccttcgttgtcaacatcaaggaagccaggggtctgcccgcaatggacgagcagtctatgacatctgacccctatattaagatgaccatcctaccggagaagaagcacaaagtcaagactcgggtcctgaggaaaacactggatcccgcttttgacgagacctttactttctacggcataccatacactcagattcaggagctggcccttcactttacaattctatcctttgaccgcttcagccgtgatgatatcattggcgaggtcctgatccccctaagcggaattgagctgtctgagggaaaaatgttgatgaatcgcgagattattaaaaggaacgtccggaaaagtagcggtagaggtgaactgctgatatccttatgctatcagtcgaccaccaatactttaactgtggtcgtgctcaaagccaggcacctgcccaaaagtgatgttagcggtctctcagatccttacgtcaaagtcaatctttaccacgcgaagaagaggattagcaagaaaaaaacacacgtgaaaaagtgtacaccaaacgctgtgttcaatgaattgtttgtgttcgacatcccctgtgagggcctcgaagatataagcgttgagtttctggtactggactctgaaagaggtagcagaaatgaggtgatcggccaactggtgctcggagccgcagccgagggtacaggtggggagcactggaaggagatttgtgactatcctagaagacagattgccaaatggcacgtgctttgcgacgggtag

SEQ ID NO: 243074 - DNA, 693 bp, Artificial Sequence
  Description of Artificial Sequence: Synthetic coding sequence
atggatctcctttctgaaaagaagcacaaggtcaaaacacgtgttctgaggaagaccttggatcctgcctttgacgagacgtttaccttttacggaattccttacacccagatacaggagctggcgcttcatttcactattctttcttttgataggttctcccgagatgacatcatcggtgaagtgttgatcccgctgtccggcatcgagttaagcgaaggaaaaatgttaatgaacagggagataatcaagcggaacgtgcggaaaagcagcggtagaggagaactattgatcagtctgtgctaccagtcaactacaaataccctaacagtggttgtgctcaaagcacgccatctcccaaagagtgacgtctcaggcctgagcgatccttatgtgaaggtaaatctttaccacgccaaaaagcgcatttccaagaagaagacacatgtgaagaagtgtacgccaaacgctgtctttaacgaactgttcgtgtttgacattccgtgcgagggattggaggacatatctgtcgagttcctggtgctggattctgaaaggggttctaggaacgaggtgattggacagttggttctgggggctgccgctgaaggcaccggtggagaacactggaaagagatctgtgactacccccgacgacagatcgctaagtggcacgtcctctgcgatggatag

SEQ ID NO: 243075 - DNA, 1476 bp, Artificial Sequence
  Description of Artificial Sequence: Synthetic coding sequence
atgccaggcgctagggacgcgctgtgccatcaggcgctgcagctgcttgccgagttgtgcgctcgcggagcgttggaacacgacagctgccaggacttcatctaccatctgagagaccgggcaaggccaagactccgcgatcccgacatctctgtctccctacttaccttggtcgttacagcctgtggactggcattgtttggagtgagcctgtttgtgtcctggaaattatgttgggtgccctggagggaacgtgggctgccctccggcagcaaggataacaaccaagagccactgaattacatggatactgagacaaatgagcaagagaacagcgaggactttctggatcccccaactccctgtcccgatagtagcatgaagatttctcacacctcgcctgatatcccgcttagcacacagactgggatacaggagaactgcgcacacggcgtccgggttcagagacaggtgaccgagcccactagtagcgcacggcacaacagcatcagaagacagttaaatctgtccaaccctgactttaacatccagcagcttcagaagcaggaacaactgaccgggatcggacgcatcaaaccagagctttacaagcagcgttccctggataacgatgacggcagaagaagcaacagtaaggcttgcggtaagctgaactttatcttgaaatacgattgtgatctggaacagctcatagtgaaaattcacaaggctgtaaatcttccagccaaggacttctcaggtaccagtgacccttatgtgaaaatctacttactgcccgaccgcaagacaaaacaccaaaccaaggtgcatagaaagacactgaacccagtgttcgatgaagtcttcctcttccctgttccctataatgacttggaggcacgaaagcttcacttctctgtgtacgacttcgatcggttttcgaggcacgacctcatcggacaagtggtcgtcgaccatttccttgacctcgccgacttccccagggaatgtatcctttggaaggatattgagtacgtaacaaacgacaatgtcgatctgggcgagcttatgttttccctatgctatttgccaacggcaggcaggctgaccatcactataataaaggcacgaaatctgaaggctatggacattacaggagcttccgacccttacgtaaaggtgtccctgatgtgtgacggcagaagactgaaaaagaggaaaacctccaccaagagaaataccctcaaccccgtctataatgaggctatcgtgtttgatgtcccaccagagaatatagatcagatccatctaagtatcgccgtgatggactacgaccgcgtgggccacaacgaaattatcggcgtgtgtcaggtgggaaatgaggctgagcggcttggacgggatcattggagtgaaatgttgtcctatcccagaaaacctatcgcccactggcactccttggttgaaaagaggtag

SEQ ID NO: 243076 - DNA, 960 bp, Artificial Sequence
  Description of Artificial Sequence: Synthetic coding sequence
atgttggccaaggtggtcgaaggggatttagcttttaaagggggtcgggacatttctgtgagccttctgaccctggtagtgacagcttgtgggctggcgctgttcggggtctcactgttcgtgtcctggaaattatgttgggttccttggagagaacgcggtctccctagcggctcgaaagataataaccaggagccactgaattacatggatactgaaacaaacgagcaggagaacagcgaggatttcctagacccgccaaccccctgccccgattctagcatgaagatctcccacaccagccctgatatcccattgtcgacacagactgggatacaagagaactgcgcacatggggtacgggtgcagcgtcaggtaactgagccaacctctagcgcgaggcacaatagtatccggagacagctgaacctgtccaaccctgatttcaacatacagcagctacaaaagcaggaacagctgacggggatcgggagaataaaaccagagttatacaaacaacggagccttgataacgatgatggcaggaggagcaattccaaagcgtgtggcaagttgaacttcatcctaaagtacgactgtgacctcgagcaattaatcgtgaaaattcacaaggcagttaatttacccgctaaggatttttccggaacctcagatccatacgtgaaaatctacttactccctgacaggaagactaagcatcaaaccaaagtccaccggaaaaccttaaaccccgtctttgatgaagtgttccttttcccagtgccttataatgatctggaagccaggaaactgcattttagtgtttacgattttgacagattcagccgacacgacttgatcggtcaagtggttgtcgaccactttctcgatctcgcggatttcccgcgagagtgtattctgtggaaggacatcgagtacgttacaaatatcctgtcatag

SEQ ID NO: 243077 - DNA, 1161 bp, Artificial Sequence
  Description of Artificial Sequence: Synthetic coding sequence
atgtttccggagccgcctaccccaggtccaccctccccagacacccctccggactccagtagaatcagccacgggcctgtccccccatgggctctcgcaaccattgttctggtgagtgggctcttaattttttcctgttgtttctgcctctacagaaaatcctgcaggaggcgaacggggaaaaagagccaggcccaggctcaggtacacctccaagaggtgaaaggcctgggacagtcttacatcgacaaggtacaacccgaggttgaagagctggagcccgcaccgtcaggccctggccagcaggtggccgataagcacgagcttggacggctgcagtactccctggattatgattttcaatcaggccagttactggtagggatcctccaggcaatgggcctggccgcattggatctgggcggtagtagcgatccttatgtgcgcgtgtacctgctccccgacaagcgtaggcggtacgaaacgaaagtgcatagacaaacactgaacccacatttcggtgagacatttgccttcaaagtgccctacgtggaacttggcggaagggtacttgtcatggccgtgtatgatttcgaccggttctccaggaacgacgccatcggcgaagtcagagtacccatgtctagcgtggatttggggcgtcctgtgcaggcctggcgagagttgcaggctgcgccacgcgaagaacaggagaaattaggcgatatctgtttcagcttacgatacgtaccaaccgcaggcaagctaacagtaattgtgctggaagctaaaaacctgaagaaaatggatgtcggaggcctttccgacccctacgtcaaggtgcatctgcttcagggtgggaagaaggtgcgcaaaaagaagacaaccataaaaaaaaatactcttaatccatattacaacgaagcattttctttcgaagtcccgtgtgaccaagtgcagaaagtgcaggtcgagctcacagtactggattatgacaaactcggaaagaatgaggccatcgggagggtcgcggtcggagcggctgctgggggtgcagggttgaggcattgggcagacatgctagcaaatccgcgacggccaattgcgcagtggcattccctccgcccacctgaccgagtccggctgttgccagctccgtag

SEQ ID NO: 243078 - DNA, 1161 bp, Artificial Sequence
  Description of Artificial Sequence: Synthetic coding sequence
atgttcccggaaccacccacgcctgggccaccgtcacctgacaccccccctgatagctccaggatcagtcatggaccagtgcctccatgggcgctggcaacaatcgtactcgtgtctgggcttctcatcttttcatgctgcttctgcctgtataggaaatcctgcaggcggaggaccggcaaaaaatcacaggcgcaggcgcaagttcatttgcaggaggtgaaagggctgggtcagtcttatatcgataaagtgcagccagaggtggaagagcttgagccagcaccgagcggcccaggtcagcaggtggctgacaagcatgaactcggcagactgcaatacagtctcgactatgactttcagtctggccagctcttggtgggtattctccaggctatggggttagctgccctggatttgggcggtagcagcgatccctatgtcagagtgtatctcctccctgataaaagaagaaggtacgagacaaaagtgcaccggcagaccttaaatccacacttcggagaaaccttcgcttttaaggtcccctatgttgagttagggggtcgcgtactagttatggcagtttacgacttcgacaggttttcaaggaacgacgctattggcgaggtcagggtgcctatgtcaagtgtagacctcggcaggcctgtccaggcctggagagaattacaggccgcaccgagagaggagcaggagaagctgggagacatatgcttttctcttcggtacgtgccaacagcagggaagctcactgttatcgtccttgaggccaagaacctaaaaaagatggacgtgggcggtctctccgacccttacgtaaaggtgcacctgctacagggtggcaaaaaagtacgcaaaaagaaaacaacaatcaaaaaaaacactctgaacccctactataacgaagcattctccttcgaggtgccttgcgaccaagtgcagaaggttcaggtggaactcactgtccttgactatgacaaactcggaaagaacgaagccatcggcagggtggcagtaggcgctgccgctggcggagccggtctgcggcattgggctgacatgctggccaatccacggagacctatcgcgcagtggcacagtctgcggccacctgatcgggtacgcctgctaccagcaccctag

SEQ ID NO: 243079 - DNA, 1149 bp, Artificial Sequence
  Description of Artificial Sequence: Synthetic coding sequence
atgacacggggaggatgccctgtttccgcacgtttattcgcacaacgcccacatggctcatggtcttcactcctgtgtgttggcctaaaaggcagattgggatgggagtggggcacgcgcgtcctggaatgtctgtgtcggaaggactcgaggacccctccaccttgctcccgcagtccccagcctagggggctgcatcgccctacaagactgcctaccccagtggcttcagcaaccgcacaggttcaacccgaggtggaagagctggaacccgctccatccggccctggacagcaggtggccgataagcacgaattaggcagactccagtattccctcgactacgactttcagtcgggccaactcctggttgggatccttcaggccatgggcctggccgcactcgatcttgggggaagctctgacccctacgtgcgcgtgtatctgctccctgacaagcgacggagatacgagaccaaggttcaccgccagactctgaacccgcattttggggagaccttcgctttcaaagtcccatacgtggaactgggaggcagagtgttggtgatggctgtatatgatttcgaccggttttcaagaaatgatgccatcggagaggtgcgtgtgccaatgtctagtgtagatctggggagacccgtgcaggcctggcgtgagctacaggcagcacctcgcgaggaggagaagctcggcgacatttgttttagcttgcgctacgtacccaccgccggaaagcttaccgtcatcgtgttggaggcaaaaaatctaaagaagatggatgtggggggactatcggatccctatgtcaaggtacatttgctgcagggcggtaagaaggtccgtaagaagaaaactaccatcaaaaaaaacacactgaatccttactataatgaggccttctctttcgaggtcccttgcgatcaggtgcagaaagtgcaggtggagttaacggttctggactacgataagctggggaaaaatgaagccatcggcagggtcgccgtaggtgccgctgcagggggagccggtcttagacactgggcagatatgctggctaatccaaggaggcccatagcccagtggcactccttgagaccccctgacagggtcaggctgcttcctgccccttag

SEQ ID NO: 243080 - DNA, 1533 bp, Artificial Sequence
  Description of Artificial Sequence: Synthetic coding sequence
atgtcaggagtatggggcgcaggtggacctcgatgccaggaggctctagccgttttggccagtctttgccgtgcacggccacccccacttggactcgacgtggagacctgccgatccttcgaactccaaccacccgagagatccccgagcgccgctggtgccggtacatcggtctctctgttagcagtcgtagtaattgtctgtggggttgccctcgtcgcggtcttcttgttcctgttctggaagctttgttggatgccgtggcgtaataaagaggctagttctccaagttcagccaatccgccattagaagcgctacagagtcccagctttcgaggcaacatggccgataagctgaaggacccatcgactctgggattcctcgaagctgctgtgaaaatctctcacacctctccagacatccctgccgaggtccagatgtccgtgaaagaacacataatgaggcacacccgcctacaacgtcaaaccaccgagcctgcttcgtctactcgacacacctccttcaagcgccacttgcctagacagatgcacgtgtcctctgtggactacgggaacgaactaccccctgcagccgagcagcccacaagcattggccgaatcaagcctgagctatataagcagaagagcgtggatggagaagacgccaaaagcgaagccactaagtcatgtggtaagattaacttcagtctgagatacgattatgaaacggagacactgatcgtgcgtattcttaaggccttcgatttgccagcgaaggatttttgcgggagctcagatccttacgtcaaaatttacctgctgcccgatcgcaaatgcaaactccagacaagggtacaccgcaagaccttgaatccgacgtttgacgaaaacttccacttcccagtcccctacgaggagttagccgatcgtaagttacatctgagcgtatttgactttgatcgcttttcccgccatgacatgatcggcgaagtcattctcgacaacctgttcgaggcttccgacctgtcccgcgagacaagcatctggaaagatatccagtacgctacctcagagtctgtcgacctgggcgaaattatgttcagcctgtgttatttgcctacagctggacgcctcactctcactgtgatcaagtgccggaatctgaaagcaatggacattacagggtactctgacccctacgtgaaagtgtctctcttatgtgacgggcgacggcttaagaaaaaaaagacaactatcaaaaaaaatacgctgaaccctgtctacaatgaggccatcatttttgatatcccgcctgaaaacatggatcaggttagtttgttaatttctgttatggactacgaccgcgtgggccacaacgaaattattggggtctgccgcgtgggtataacagcggagggactaggcagagaccactggaatgagatgctggcctatccacgcaagcccatagcacattggcacagcctagtggaggtgaaaaagtcatttaaggagggtaacccaaggctatag

SEQ ID NO: 243081 - DNA, 1278 bp, Artificial Sequence
  Description of Artificial Sequence: Synthetic coding sequence
atgccctggcgcaacaaggaggcatccagcccaagcagtgcgaacccacctcttgaggcgctccaaagccccagcttccgcggaaacatggctgataaactgaaggacccctccaccctgggattcctcgaagcagcagtcaaaatatctcataccagccctgatattcccgctgaggtgcagatgtctgtgaaagagcatatcatgcgtcatactcgtctgcagcgacagacaacagaacccgcttcttctacgcggcacacgagcttcaagcgccatctccccaggcagatgcacgtatcgtccgtagattacggcaacgaactgcccccagccgctgagcagccaacaagcatcggacgtattaaaccggaactgtataaacaaaagtcagtcgacggggaggatgccaagagcgaagccactaaatcctgtggcaagatcaatttctcgctacgctacgactacgagaccgaaactctaatcgtgcgcatcctgaaggctttcgacctccccgcaaaggatttctgcggaagcagcgacccttacgtgaaaatctatctgctgcctgaccgtaaatgtaagctgcagactagagtccaccgtaagaccctgaatccgacctttgacgagaactttcactttccagtcccttatgaggagctggccgatcgaaagctccacttgtcagtgttcgacttcgaccgcttctctcgtcacgatatgataggtgaagtcattctggacaacctctttgaggcaagcgatctgtctagggaaacctcaatctggaaggacatccagtacgctacgtcagagagcgtcgaccttggggagatcatgttcagcctgtgctacctgcctaccgctggaagattgactcttactgtcatcaagtgtcgcaatttgaaagcaatggacattactggatattctgatccctatgttaaggtgtccttactctgcgacgggaggcgattgaaaaagaagaagaccactatcaagaagaacactctgaaccccgtgtataatgaggctatcatttttgacatcccgccagagaacatggaccaggtgtccctcctgatttctgttatggactatgacagagtgggccacaacgaaatcataggggtttgcagggtgggaattacagccgagggcctgggccgtgatcactggaatgagatgttagcctacccgcgtaagccaatagcccactggcactccttggtcgaagtaaagaaatcatttaaagaggggaaccctagactatag

SEQ ID NO: 243082 - DNA, 1278 bp, Artificial Sequence
  Description of Artificial Sequence: Synthetic coding sequence
atgccgtggcggaataaagaggccagctccccaagcagtgctaatccacctctggaagccttgcaaagcccaagcttccggggtaacatggctgataaactgaaggacccatctacactggggttcctggaggctgcagtaaagattagtcacacgtcccccgatattcccgctgaagtgcagatgagcgttaaagaacacattatgcggcacactaggttgcaacgccagaccaccgaacctgccagcagcactaggcacaccagcttcaaaagacacctgccgagacagatgcacgtcagttctgtggactacggaaatgaattaccccctgcggcagaacagccgactagtatcggcagaatcaagccggagctgtataaacaaaaaagcgtggacggagaagacgctaagagcgaggcaacgaagagttgcggaaaaatcaacttctccttgagatacgactacgagacggagactttgatcgtgagaatcttaaaagccttcgacttacccgcaaaggatttctgcggctcgagcgacccgtacgtaaagatctatctcctccccgaccggaaatgtaaactccagacacgggtgcataggaagaccttaaaccccactttcgacgagaactttcattttcctgttccctatgaagagctcgccgacagaaagctgcatctgagtgtgtttgatttcgaccgtttctctcgtcatgacatgatcggcgaggtgatactggataacttgttcgaagccagtgacctgtcaagagaaacaagtatctggaaggatatccagtatgccaccagtgaaagcgttgatctcggagaaattatgttcagcctgtgttatctccccaccgccggacggctcacgcttacagtaatcaaatgtagaaacctgaaggccatggatatcaccggctacagtgacccatatgtgaaggtatcactgctttgtgatggacgcaggttgaagaagaaaaagaccactattaaaaagaacacgctgaaccccgtttataacgaggctatcatcttcgatatcccacccgaaaacatggatcaagtcagcttgctcatctcggtcatggactacgaccgcgtcggccataacgaaatcatcggggtgtgtagggttggcatcacggccgaaggccttggtcgcgaccattggaatgagatgctcgcctatccacgtaaacccattgcccactggcacagcttagtggaggttaaaaagtctttcaaagaggggaacccacggttgtag

SEQ ID NO: 243083 - DNA, 1533 bp, Artificial Sequence
  Description of Artificial Sequence: Synthetic coding sequence
atgtctggggtgtggggggcaggagggccacggtgtcaggaggcactggccgtgctggcttccctctgccgcgctcggccaccacccctcgggttggacgtggagacatgtcgaagtttcgaactgcagccaccagagcgctccccgtctgctgcaggagctggaacctccgtaagtttgttggccgtggtcgtcattgtgtgcggcgtagccttggtcgccgtttttctgtttctgttttggaaactgtgttggatgccttggagaaataaggaggcttcgtcaccttctagtgccaaccccccactagaggccctgcagagcccctcctttcgcggaaacatggctgataaactgaaggatccttcgaccctaggctttctagaggcagctgtcaaaatctctcacactagtccggacattccagcagaagttcagatgtcagtcaaagaacatatcatgcgacatacgcggctgcagcgccagacaaccgagccagcgtcttctactcgccatacttctttcaaacgccatctcccacggcagatgcatgtctcctccgtcgactatggtaatgaattgcctccggctgcagagcagcctaccagcattggtcggatcaagcctgagctgtacaaacagaaatctgtagatggcgaggacgccaaaagcgaggctaccaaaagctgtggaaagataaatttcagtctgagatacgattatgagaccgaaacactaattgtgcggattctgaaagcattcgacttgcctgccaaggatttctgcggttcgagtgacccatacgttaaaatttacttgctaccagaccgcaagtgcaaactgcagacccgagtacacaggaagaccttgaaccccacatttgacgaaaacttccattttccagtcccttatgaggagcttgctgatcggaagctacatctctcagtgttcgacttcgaccgatttagtaggcatgacatgataggggaagtgatcttggataatctgttcgaagccagtgacctgagccgtgagacctccatttggaaagacatccagtatgccacttccgagtcagtggatctaggtgagatcatgttttccttgtgctatctgcctacggcaggtcgcttgacgctcactgtgattaagtgcagaaacttgaaagcaatggatatcaccggctacagcgatccatacgttaaagtttcactgctttgtgatggtagaagacttaaaaagaaaaagaccacaatcaagaagaacaccctgaacccagtctacaacgaggccattatctttgatatcccacctgaaaacatggatcaagtgtctctgctcatttcggtcatggactatgacagggtgggacataatgaaattattggggtgtgtagagtgggtatcaccgccgagggattggggagggaccactggaacgagatgttggcttacccgagaaagcctatcgcgcactggcactctctagttgaggtgaagaaaagttttaaagaaggcaatcccaggctgtag

SEQ ID NO: 243084 - DNA, 288 bp, Artificial Sequence
  Description of Artificial Sequence: Synthetic coding sequence
atgccatggcggaataaggaagcatcaagcccatctagtgccaatccacccctggaggcattacagtctcccagttttcgtggcaacatggcagataaactcaaagatccctccacattgggctttctcgaagcagcggttaaaattagtcacacatcaccagacatacccgctgaagttcagatgagtgtgaaagaacacatcatgaggcacacaaggctgcagagacagacaacagagcccgcatcatccaccaggcatacttcctttaaaagacacttgccatag

SEQ ID NO: 243085 - DNA, 261 bp, Artificial Sequence
  Description of Artificial Sequence: Synthetic coding sequence
atgccctggcggaataaagaggcctcaagcccctcaagtgcaaacccaccactggaggcactccagagtccttcattccgtggtaacatggccgacaaacttaaggaccccagcactctcgggttcctggaggcagcagtgaaaatttctcacacctccccagatatcccagccgaggtccagatgagtgtgaaggagcacattatgcgacacacccggctgcaacgacagacaacagagcctgccagcagtacgcgatag

SEQ ID NO: 243086 - DNA, 1212 bp, Artificial Sequence
  Description of Artificial Sequence: Synthetic coding sequence
atgtaccgcgaccctgaagctgcgtcaccaggagccccttcaagagacgtgctgcttgttagcgccatcatcactgtgagcctcagcgtcaccgtggtgttatgcggcctgtgccactggtgtcagcgcaagctcgggaagaggtacaagaatagcctagagacagtcgggacccctgacagtgggcgtgggaggtcagaaaagaaagccataaaactaccagccggaggcaaggccgtgaatacagctcctgtccctggccagacccctcacgatgagagcgacagacgaaccgagccacgctcctctgtgagtgacctcgtgaattccctcacgtccgaaatgttgatgctcagccctggttcagaagaagatgaggcacacgaaggttgctccagggagaacttaggtcgcattcagtttagcgttggttataacttccaggagagcaccctcacagtgaagatcatgaaggcccaggagctgcccgctaaggacttcagcggtaccagtgacccctttgtgaagatatatctgctcccagataagaagcacaagcttgaaaccaaagtgaagcggaagaatctgaatccccactggaacgagactttccttttcgaaggcttcccctacgagaaagtcgtgcagcggatcctctacctacaagtgctggactacgatcggttctctaggaacgacccaattggagaagtctctatcccactcaacaaagtggatctcacccagatgcagacgttctggaaagaccttaaaccatgctcagacgggagcggctctcgtggcgaacttctcctcagtctgtgctacaatccttcagcgaattccatcatcgtgaatatcatcaaggctagaaacttgaaggctatggatatcggcggtacaagtgacccctacgtaaaagtgtggttgatgtacaaggataaaagagtggagaagaagaaaactgtcaccatgaaacgcaatctgaatccaatttttaacgaatccttcgcatttgatattccaacggagaaattgagagagactacaattattatcactgttatggataaggacaagctgagtagaaacgatgtgatcggcaagatctatttgagctggaagtccgggcctggagaggtgaaacattggaaagacatgatagccagaccaagacaaccagtggcacagtggcaccaacttaaggcttag

SEQ ID NO: 243087 - DNA, 1266 bp, Artificial Sequence
  Description of Artificial Sequence: Synthetic coding sequence
atggcagttgacgtggcggagtaccacctgtcagtaatcaaatcaccccctggatgggaggtgggtgtatacgcagcaggggctctggccctccttggcatcgctgcagtgagtctatggaaattgtggactagtggatcttttccatccccttcaccatttccaaattatgactaccgctacctccagcagaagtatggcgagtcatgcgcggaggctcgggagaagcgggtcccagcctggaatgcccagagggcatcaacaaggggccctccatccagaaaggggtccctgtctattgaagataccttcgaatccatctctgaactgggaccactcgagctgatgggcagagagcttgacctggctccctacggaaccctgcgtaaaagccagtcagcggacagccttaattcaattagcagtgtgagcaacactttcgggcaagacttcacattgggccaggtagaggtctccatggagtacgatacggcctctcacacattgaacgtagccgtgatgcagggtaaagacctcctcgagagagaggaagcctccttcgaatcatgctttatgagggtttctctgttgccagatgagcagatagtcgggatctcacggattcagcgaaacgcctattctatcttctttgacgagaagtttagcattcctctggatcctacagctctggaggaaaaatctctgcggttctccgtgtttgggatcgatgaagatgagagaaatgtctccacaggtgtcgtcgaactgaagctctctgtcctggacctccccctccagcctttcagcggttggctatacctgcaggatcagaataaagccgctgacgccgtgggtgaaattctgctttccctaagctatttgccaactgctgaaagactgacagtcgtggtggtcaaagcaaaaaatctgatttggaccaatgataagactaccgccgacccatttgtcaaagtatatctgctccaggatggacgaaagatgtcgaagaaaaaaaccgcagtgaagagagacgatccaaacccagtattcaatgaggccatgatcttcagtgtgcctgccattgtgctgcaggatttgtcattgagagtgacagtagcagagtcctcttccgacggtcgcggagataacgtcggccacgttatcatcggaccgtctgcgtctggaatgggaacgactcactggaaccagatgctcgctacgctccgaagacctgtatcaatgtggcacgcagtgaggcggaattag

SEQ ID NO: 243088 - DNA, 1266 bp, Artificial Sequence
  Description of Artificial Sequence: Synthetic coding sequence
atggcagtcgacgtcgcggaatatcatctcagcgtgattaagagcccacctggatgggaggtcggggtgtacgccgctggggctcttgcactgctaggcatcgccgctgtgtcactctggaagctgtggactagtgggagcttcccgagtccctcaccatttcctaattatgattaccgatatctccagcagaaatacggcgaatcatgtgctgaggcccgtgagaagagggtacccgcatggaatgcgcagagagcttccacacgcggacccccaagccggaagggaagtttgagcattgaggatacgtttgagtcgatttctgaactcggccctctcgagctgatgggacgggagctagacctcgcaccctacggtacactgcggaaatcccaatcagccgacagtctcaactcaattagttctgtttccaataccttcgggcaggacttcacattgggtcaggtggaagtgagcatggaatatgacacagcatcacacactcttaatgtcgccgtcatgcagggcaaggacctcctcgaaagggaagaggcttccttcgaaagctgttttatgagggttagtcttctgcccgacgaacagatcgtcgggatctcacgaatccagcgaaatgcgtactccatcttttttgatgagaaattctcgattcccctagatcccacagctctggaggaaaagagcctcagatttagtgtatttgggatcgacgaggatgagcggaatgtaagtaccggcgttgtggagcttaagctgagcgtcctggacctgcccctgcagccatttagcggctggctgtacctacaggatcaaaacaaggccgcagatgctgtcggggagatattactgtcattgtcgtacctgcccaccgctgaaagactgaccgtggtggtcgtgaaagctaaaaatcttatctggaccaacgataaaacgaccgcagaccccttcgtcaaagtttacctgctgcaagacggcagaaagatgtccaagaagaagacagccgtgaaacgcgacgatcccaatccagtcttcaatgaggccatgattttttctgtgcctgccattgtgttacaggatctgtccctgcgagttacggttgctgagagctcctccgacgggagaggcgacaatgtgggccatgtgattataggacccagcgcgagtggcatgggtactactcactggaaccagatgctggcaactttacggagaccagtgtccatgtggcacgccgtcagaagaaactag

SEQ ID NO: 243089 - DNA, 1266 bp, Artificial Sequence
  Description of Artificial Sequence: Synthetic coding sequence
atggcggtcgacgtggccgaataccatctgtctgtgatcaagagccctcctggttgggaagttggtgtatatgcagcaggtgcactggccctgctggggattgcagcagtgtcactctggaagctgtggacttcaggatccttcccttctccgtcccccttcccaaactacgactatcgctatctgcagcagaagtatggtgagtcgtgtgccgaggcaagggagaaacgggtacccgcatggaatgcccagcgcgcatcaactagaggccctcctagcaggaaagggagtttgagcattgaggacacattcgaatccatctcagagttgggacccctagaattgatgggccgagaactggatctggccccatacgggacgctgcggaaaagccagagtgcggactcacttaactcgatatctagcgtgtccaacacattcgggcaggactttactttgggtcaggtggaagtttcaatggagtatgatacagccagtcacactctgaacgttgctgttatgcagggtaaggacctgctggagcgtgaagaagcctcatttgagagctgcttcatgcgggtctcactgctgcctgatgagcaaatagttgggattagcaggatccagcgcaatgcgtacagcatctttttcgatgagaaatttagtattcctctagaccctaccgcccttgaagagaagtcattgagattctccgtcttcggaatcgacgaggacgagcggaacgtgtctaccggggttgtggagttaaagttgtccgtgttagacttaccattgcaacctttctcaggatggctgtacttgcaggaccaaaacaaggctgccgatgcagtcggggaaatcttgctcagcctttcctacctacctacagccgaaagactgacggtggtggtcgtgaaagccaaaaatctaatttggactaacgataagactactgccgacccattcgtaaaagtgtaccttctacaggatggccgtaagatgtcaaaaaagaaaacagccgtgaaacgtgacgacccgaacccagtgttcaacgaagctatgatattttcggtacccgctatagttctgcaggatctctcactgagggtcacagtggctgagagctcaagtgatggtagaggggacaatgtcggccacgtcattatcggcccttccgctagtggtatggggaccacccactggaatcagatgctggctactctccgcagaccagtgagtatgtggcacgcagtgcgcagaaattag

SEQ ID NO: 243090 - DNA, 1281 bp, Artificial Sequence
  Description of Artificial Sequence: Synthetic coding sequence
atggtgctgagcgtcccggtgatagcgctcggcgctaccctgggaaccgcaacctccattctagccctgtgtggagtcacatgcctgtgccgtcacatgcaccctaaaaaaggtctgttgcccagggaccaggacccggatctcgagaaagccaagccctccctccttggttccgctcaacagttcaatgttaagaagtccacagagcccgtgcagccaagagcccttctaaagttccccgatatctatgggcctcggcctgccgtgacagccccagaggtcatcaattatgctgattattcccttaggtcaacagaggagccaacagcccctgcctccccgcagcccccaaatgatagccggctcaagcggcaagttactgaggagctgtttatcctcccccagaatggagtggtggaggacgtctgcgtcatggaaacttggaatcccgaaaaggccgctagctggaatcaggctccaaaactgcattattgcctggactacgattgtcagaaagcagagctttttgtgactcggctggaggccgtgacatccaatcacgacggcggatgtgactgttacgtgcaaggatcagttgctaaccgtactggaagcgtcgaggcacagactgccttgaagaagagacagctgcatactacatgggaagaaggtttggttttgcctctggcggaagaggagttgcctaccgccacgctgacactgaccctgagaacctgcgataggttctcccggcactccgttgctggcgagctgcgactaggtctcgatggaacaagcgtgccgctcggtgccgcacagtggggcgaacttaaaacatcggccaaggagccgtcagctggggctggggaggtgttactgtcaatttcttatctgccagcggcaaaccgattgctggttgtcctaatcaaggccaagaatctgcacagtaatcagagcaaagaactgttgggtaaggatgtatcggtgaaagtgactttaaaacaccaagccaggaagctgaagaagaaacagactaaaagagctaagcataaaattaacccagtgtggaacgagatgatcatgttcgaactgcccgacgacctgctgcaggcttcttcagtagagctcgaagttctggggcaggacgacagtggacaatcttgcgccttggggcactgttcactcgggctgcatacatccggatcagagcggtctcattgggaagagatgctgaagaatccgagaagacagatagcaatgtggcatcagttgcatttgtag

SEQ ID NO: 243091 - DNA, 1554 bp, Artificial Sequence
  Description of Artificial Sequence: Synthetic coding sequence
atgttactgttgtttctgtacattaataagaagttctgttttgagaacgtgggtgggtttcccgatttggggtctgagtacagtactaggaaaaattcgcaggacaagatctacaactcttatatggataaagacgagcacggctccagcagcgagagcgaggatgaggctctcggaaagtaccacgaggctctgagtaggactcataattcccgcctgccacttgctgattctagacaacgaaattacgcctgggaaacccggcaaaaatactctcccctatccgctgagtacgacggatactcctctgaagcttctatcgatgagggcaactgcatacagcggatgcgtagaacacctccattagatgagctgcagcctccaccatatcaggacgatagcggcagccctcacttgagctgcactccgagtgaaatcggagatagcaagtgtgagtttagtcactgtagtaattccccaaggtgctcctataataagtgcccttctgagggcagtacagggcatgaaatcgaaagttttcacaacaagggctacgaggaagacgtgccaagtgatagcacagctgtcctttccccggaagacatgagcgcacagggttcatccagccaactgccaaagccctttgacccagagcctgaggctaaatacggaacacttgatgtcacattcgactatgacagccaagagcagaaattgcttgtgacagtgaccgctgtgactgatatacctacatacaacaggaccgggggaaatagctggcaagtgcatttggtgttgctgccaatcaaaaagcaacgggctaagacttctattcagcgtgggccatgtccagtctttaccgagaccttcaaattcaatcacgtagagtccgaaatgatcggcaattacgcggtgcgatttcgactatacggggtacatcgcatgaaaaaagagaagatcgtgggcgaaaaaatcttttacttaaccaagctgaacttacaaggaaagatgtccttgcccgttattctcgagcccagctacaaccattcgggatgcgactcccagatgtcagtatcagaaatgagctgctctgagtcgacgagctcatgtcaatccttggaacatggtagcgtgcccgagatcctcattggtctcttatataacgccactactggtagactcagcgctgaggtgatcaaaggctctcacttcaaaaacctagcggctaaccggccaccaaatacttatgtgaaactgaccctcctcaatagcatgggacaagagatgtctaagtgcaaaacatctattcgacgcggacaaccaaacccagtgtataaagaaactttcgtgtttcaggtggctctatttcagctgagcgatgtaaccctaatcctgagtgtgtacaacaaaaggtccatgaaacgaaaagaaatgatagggtggatctcactcggacttaattctagcggtgaagaagaactcaatcactggacagagatgaaggaatccaagggccagcaggtgtgcaggtggcatgcactgttagaatcctag

SEQ ID NO: 243092 - DNA, 1725 bp, Artificial Sequence
  Description of Artificial Sequence: Synthetic coding sequence
atggccatcgaggggggtgaacgcacttgtggcgtccacgaactcatctgcatcagaaaagtgagcccagaagccgtggggttcctctccgctgttggagtcttcattatcttgatgcttctcctgttcctgtatatcaacaagaagttctgttttgagaacgtgggtgggttcccggatttggggtctgaatactctacccgaaagaactctcaagacaagatatacaattcctatatggataaggacgaacatgggagtagctccgaatccgaggacgaggcactcggcaaataccacgaagccctgtctcgaacgcataacagtaggctgcctctggcagatagtaggcaaagaaactacgcatgggagacacgacaaaagtactccccactgtccgcagagtacgacggttacagttccgaagcttcaattgacgaaggcaactgcattcaacggatgaggagaactccaccccttgacgagctccagccacctccttaccaagatgattcggggagcccacatctttcttgtactccctcagaaattggagacagcaagtgcgaatttagtcactgctcaaattcccccaggtgtagttacaacaagtgtccctctgagggctcaactgggcacgaaatagagtcatttcataacaaggggtacgaagaggacgtcccctcagattcaacagccgtgctgagcccggaggacatgagtgcccagggatcctccagccaattacctaaaccattcgatcccgaacccgaggccaaatacggaaccctcgatgtgacatttgactacgactcacaggaacaaaagctgctcgtgaccgtcaccgcagtgaccgacattccgacttacaatcggactggaggaaattcttggcaagttcacctggtgctactgcctatcaagaagcagagagccaaaacatcaatccagcggggtccatgtcctgtgtttactgagaccttcaagtttaaccacgtggaatctgagatgattggaaactacgctgtgagattccgcctttatggtgtccaccggatgaagaaagaaaaaattgtcggtgagaagatcttctacctgaccaaactgaatctgcagggaaaaatgtcgttaccagtgatcctagagccttcttataatcactctggctgcgatagtcaaatgtccgtgagtgaaatgtcttgcagcgagtccactagctcatgtcagtccttggaacacggttccgtccccgaaattctgattggcctactgtacaacgcgactacaggcaggctgtcagctgaagtaattaaaggatctcactttaaaaacttagcggcaaataggcctccaaatggcttattctgctgcctgaagcacctcatagggggtcaggtgtacatcattagagatacctacgttaaactaaccctcctgaactccatgggccaggaaatgtccaaatgcaagaccagcatccgtagaggccagcctaatcccgtttataaggagacttttgttttccaggttgcattattccaattgagcgacgtcactctgatcctgtccgtgtacaacaagcgttcgatgaagagaaaagagatgatcggttggatctcgctcggcctcaactcctctggcgaggaagagcttaaccactggactgaaatgaaggagtcaaagggtcagcaagtctgtcgctggcatgcgctcttagaatcatag

SEQ ID NO: 243093 - DNA, 1377 bp, Artificial Sequence
  Description of Artificial Sequence: Synthetic coding sequence
atggccatcgaaggtggcgagcggacctgtggcgtccatgaactcatctgcataagaaaggtgtcacccgaggcagtgggatttctctccgcagtgggtgtgttcattatcctgatgttactcctgttcctatacatcaacaagaagttttgcttcgagaacgtagggggtttcccagaccttggctccgagtattctacacgtaaaaactcccaggacaagatctacaacagttacatggataaggacgagcacggtagcagcagtgaatccgaggatgaggcccttggcaaatatcatgaagctctgagccgcacacataattctcgcctgcctctagccgactcgcggcagcggaactacgcctgggaaacccgacagaagtactcacccctgtctgcagagtacgacggttactcgagtgaagcaagcatcgatgaggggaattgtatacaacgcatgaggaggacaccccctctcgacgagctgcagcctcccccttaccaggatgattctggatctcctcacctcagttgcaccccttccgaaattggagattcaaaatgtgaattcagccattgctcaaacagtcccagatgctcatataataaatgtccctccgaggggagcaccgggcatgaaattgagagctttcataacaaaggctatgaggaggacgttccatcagactccacggccgtgttatcccctgaagacatgagcgcacaaggctctagctcacagttacctaaaccttttgatcccgagcccgaagctaagtatggcactctggatgtgacctttgattacgatagccaagagcagaagctacttgttaccgtcacagcagtgaccgacataccaacctacaaccgcacaggaggaaatagctggcaggtacacctggtgctactccccattaagaaacagcgggctaagactagtattcagagaggcccttgtcctgtctttaccgagacattcaaattcaaccacgtggaaagtgagatgatcggcaattatgcggtcagattcagactgtacggagttcacaggatgaagaaagagaagatcgtcggggagaagatattttatctcaccaaactgaacctgcaaggaaagatgtcactccccgtcattctggaaccctcttacaatcactctggctgcgactctcagatgtccgtgagtgaaatgtcttgcagcgagtccacgtcctcttgtcagagtctggaacatgggagcgtacccgaaatactgattgggctgctgtacaacgctaccacaggtcggctgtctgcagaagtgattaagggaagccactttaagaacctagcagccaatcgccctccaaaaatggactgtagtgtcgtatag

SEQ ID NO: 243094 - DNA, 1860 bp, Artificial Sequence
  Description of Artificial Sequence: Synthetic coding sequence
atggcctcggcatcttggcggttgaaggtcgagcgggagcccgtagaatacatgaacctgtccgtgctcgagaaaattggctacttttccgtggcccgactggaatactctggaacaatcttggcacattgcaatttcagactgctgggcagcaacgattcttccgcgtctgcatcccaggtcactggcaccacagtgtcaccagaagccgtcggtttcctctccgcagtgggggtgtttataattcttatgctgttgttgtttctgtacatcaataagaaattttgctttgaaaatgtcggaggatttcctgatctaggtagtgagtactccacccggaagaacagccaggacaagatatataatagctacatggacaaggacgagcatggatcttctagcgaatcggaggacgaggctctgggaaagtaccacgaggccttgtctcgcacgcacaacagtcgtctgccgctggctgattcccggcaacgcaattatgcgtgggagacacgacagaaatatagtcccctgagcgcagaatacgacggctattcctccgaagcctcgatcgatgaaggtaattgtatccagaggatgaggaggactccccctctggacgaattgcagccccctccataccaggacgattctgggtctcctcatctgtcttgtacccccagcgaaattggggattccaagtgcgaattctcgcattgtagcaacagccctagatgttcatataataagtgtccttccgagggtagtactgggcacgagatcgaatcctttcataataaaggctatgaggaagatgtgccttcagatagcacagcagtcctgtcaccggaggacatgagcgctcaggggagctcatcacagcttcctaaaccttttgacccagaacctgaggccaagtatggcacgctggatgtaacattcgactacgactctcaggagcagaaactcctggtcacggttacggctgtgacggatataccaacttataatagaacaggtgggaattcatggcaggtgcacctcgtactactgcccattaagaagcagcgcgctaaaacatcgatacagcggggaccctgccccgtgtttaccgagacctttaaattcaatcacgtcgagtccgagatgattgggaactatgctgtcagatttaggctctatggcgtgcacaggatgaaaaaggaaaaaatcgtcggtgagaagatcttttaccttaccaagcttaacctgcagggcaaaatgagtctcccagtgatcctcgagccatcctacaatcatagcgggtgtgatagtcaaatgtcggtgagtgaaatgagctgctctgaaagcactagttcctgtcaatccctggagcacggaagcgtgcctgagatcctgattgggctgctatataacgccacaacaggtcgactgtccgcagaggttataaagggtagccactttaagaaccttgcagctaacagaccaccaaatggcctgttctgctgcctgaaacacctgatcgggggacaagtatacataatcagggacacctacgtgaaactgaccctgcttaacagcatgggccaggagatgtccaaatgcaaaacaagcattcggcgaggccaacctaacccagtgtacaaggaaacttttgtattccaggttgccctgtttcaactaagcgatgttactctgatccttagtgtttacaataaacgttcaatgaaaaggaaggaaatgattggctggatttccctggggctcaattcttccggagaagaggagttgaaccactggactgagatgaaggagtcaaaagggcagcaggtctgcaggtggcatgctctgctggagagttag

SEQ ID NO: 243095 - DNA, 1668 bp, Artificial Sequence
  Description of Artificial Sequence: Synthetic coding sequence
atggccatcgaaggcggagagcggacctgcggcgtgcatgagctgatttgcattagaaaggtttccccagaggcggtcggatttctatccgcagtaggagtattcatcatattgatgctgttactgtttctctacattaataagaaattttgctttgagaacgtgggtggctttcctgacctgggcagcgaatatagcacgcggaagaactcacaggacaagatatacaattcttacatggataaggatgaacatggatcctctagtgagtccgaagacgaagccctggggaaataccacgaagctttgagcagaactcataactctcgtctgcccttagccgacagccgacagcgcaactacgcttgggagacgcggcagaaatatagccctctgtcagccgagtatgatggctattctagtgaggcgtctatcgatgaaggcaattgtattcaaaggatgcggaggacgccgccacttgatgaactgcagcctcctccgtaccaagacgacagtggctccccccacctatcatgtactcctagcgagatcggcgatagcaaatgtgaattcagccactgcagcaatagccctaggtgctcctacaacaagtgccccagtgaaggctccacagggcatgagattgaaagcttccacaacaaaggctatgaggaagatgtcccttctgattcaactgcagtgctgtcaccggaagatatgtcggcccagggatccagctcacagcttcctaaaccttttgaccctgaaccggaggccaaatacggcaccctcgatgtgacattcgattatgattcccaagagcagaaactgctggtgacggtcacagctgtcactgacatacctacatataatcggacagggggaaatagttggcaagttcacctcgtgctgttgccaattaaaaaacagagggccaagacttccatacaacgtggaccctgtcctgtgttcactgaaacattcaaattcaatcacgtcgagtcggaaatgatcggcaactatgcggtgaggtttcggttgtacggcgtgcaccgtatgaagaaagagaagatcgtcggtgagaaaatattttatctgacgaagctcaatctgcaagggaagatgtctctcccagtaatactggagccgagttacaatcacagtgggtgcgactcgcagatgtccgtctcagagatgtcctgctctgaaagcacctcgagttgtcagtcccttgagcacggatctgtgccagaaatcttaatcgggctgctatacaatgctactacaggacggctatctgcagaggtcattaaaggatcccacttcaagaatttggctgcaaataggccccctaacacctacgtaaagctaactctgcttaactccatgggccaggagatgtcaaaatgtaagacaagcatacgccgaggccaacccaatcccgtgtacaaggagacgttcgtgtttcaagtggccctgttccagctgtccgacgttacactcatactctcagtgtataataagagaagtatgaagcgcaaagagatgattggctggatttctctcgggttgaattccagcggcgaagaagaactgaaccactggactgagatgaaagagagcaaggggcagcaggtgtgcaggtggcacgctctgctcgagagctag

SEQ ID NO: 243096 - DNA, 1746 bp, Artificial Sequence
  Description of Artificial Sequence: Synthetic coding sequence
atggccatcgagggcggagagcgcacatgtggcgtgcacgaacttatctgtatccggaaggtaagcccagaggctgttggctttctgtccgccgtcggcgtattcatcatcctcatgttgctgctctttttgtatatcaacaaaaagttttgcttcgagaatgtggggggttttcccgatctgggctctgagtactccacacgtaagaactcccaagacaaaatatataatagttatatggataaagatgagcacgggtcctcctcagagagcgaggatgaagccctcggcaagtatcatgaagccctaagtagaacacacaactcacgcctgcccctggctgacagtcggcagagaaattacgcctgggaaacccggcagaagtatagcccattgtctgctgagtatgacggttacagctccgaggcttcaatcgatgagggaaattgcattcagcgtatgcgtcgcacccctcctctggatgagctccaacccccaccttatcaggatgactctggctcacctcacttgtcctgcactccatctgaaattggcgactcgaagtgcgaatttagccattgcagcaatagcccaaggtgcagctataacaagtgcccatcagaagggagcaccgggcatgaaatcgagagttttcataataaaggttacgaagaggatgtaccgagcgacagtaccgcagtactgtctccggaggacatgagtgcccaggggtctagctctcagctcccgaagccatttgacccagagccagaagcaaagtatggtacactggatgtgaccttcgattacgactcccaagagcagaaactcctggttacggtgacggccgttaccgacattcccacctacaaccggaccggaggcaactcctggcaggtgcacctcgtcttgctccccataaagaagcagcgggcaaagacaagcattcagcggggaccttgcccagtcttcacagagacctttaagttcaaccacgtcgagtctgaaatgatcggaaattatgccgttcgtttccgactgtatggcgttcatagaatgaagaaagaaaagatcgtcggggaaaagatcttctacctgacaaagctgaacctgcagggaaagatgagcctgcccgtgatcctggagccaagctataaccacagtggctgcgactcccagatgagtgtctcagagatgtcatgttccgaatctacgagctcttgtcagtcgttggaacatggctctgtgcctgaaatcttaatcggtctgctctataacgcaaccaccggtcggctttccgctgaagtgattaaaggatctcatttcaagaatctggctgccaaccgtcctcctacctttcaccctctcctgtccgatggcttgttctgctgccttaaacacttgattggaggccaggtgtacatcattcgcgacacttatgtcaaactgactctccttaacagcatgggtcaggagatgagtaagtgtaagaccagtattcgcaggggtcagcctaaccccgtctacaaagaaacatttgtatttcaggtggccctgtttcagctgtctgatgtcacacttatactaagcgtttacaataagcggagcatgaagcggaaggagatgattgggtggatcagtcttgggctgaattcatcaggggaggaggagctgaatcattggaccgagatgaaagaatcaaaaggccagcaggtgtgccggtggcacgccctccttgagtcatag

SEQ ID NO: 243097 - DNA, 1554 bp, Artificial Sequence
  Description of Artificial Sequence: Synthetic coding sequence
atgctcctcctgtttctttacataaacaagaagttctgctttgagaacgtgggcggtttcccggatctgggaagtgaatactccaccagaaagaactcacaggataaaatatacaatagctacatggataaggacgaacatggttctagctcagaatccgaagacgaggcattgggaaaatatcacgaggcactctcccgcacacataactcaagactccctctggccgactcccgccaaagaaactatgcgtgggaaacacgccagaaatatagtccactctcagcagaatacgatggctattcctcggaagcctccatagacgaggggaactgtattcagcgaatgcggaggactccccctctagacgaactgcagcctcctccataccaggacgacagtggctcaccacatttgtcatgcaccccctccgaaataggggacagcaagtgcgagttctcacactgtagcaattctccgcgatgctcatataacaagtgcccatctgaaggatccacaggacacgaaattgagagctttcacaacaagggctacgaagaggatgtcccaagcgacagcacagctgttctgtcccccgaagacatgagcgcccagggcagctcctctcagctgcctaaaccctttgatcccgaaccggaagcaaagtatggtacgttagatgtgaccttcgactacgacagccaggaacagaagcttctggtcaccgttaccgctgttaccgacattcctacatataataggaccgggggtaacagctggcaggtccacctggtcttactaccgataaagaaacagcgagccaaaacatcaattcagaggggaccatgccctgtcttcacggaaacatttaaatttaatcatgttgagtctgaaatgattggcaattacgccgtgagattccggttgtatggcgtgcatagaatgaagaaagaaaaaatcgtaggggagaagattttttatctgaccaaactcaacttacaaggcaagatgagcctgcctgtcatcctggaacccagttataatcacagcggatgtgactcacaaatgtccgttagtgagatgtcgtgtagcgagagtaccagttcttgtcagtcgctcgagcacggatccgtacctgagattcttatcggactgctctataacgcgaccaccggacggttgtccgcagaggtgattaaaggcagccattttaaaaacttggcggctaaccgccctcccaatacatatgtgaagctgactctcctgaactcgatgggacaggaaatgagtaaatgcaagacttccattcgacggggacagccaaaccccgtctacaaagagacattcgttttccaggtggcactgttccagctgtctgacgtcaccttgattctctccgtgtacaacaagagaagcatgaaaaggaaagagatgatcggctggatatcactaggcctgaacagttccggcgaggaagaactgaaccactggaccgagatgaaggagtccaaggggcagcaggtctgccgatggcatgccttgctggagtcatag

SEQ ID NO: 243098 - DNA, 1266 bp, Artificial Sequence
  Description of Artificial Sequence: Synthetic coding sequence
atggccgaacagcttgccctggtgattgggggtactatcggcggactcctactgctgctgctgatcggagccagctgctgcctgtggcgcaggttctgtgcgaccctgacttacgaggagcttcccggaactcctgccatggccactaccgcagcttcttccggtcagcgggacagaccatgccagcctcatgctcggacgcaactcagccggcctcccgctgttcctttcgtggttccacctactctgcagggcagagattgggtgcccttacatagcggggagtgggctgacgccccttgggacccctgcccagcttccgaattactccctcacacatccagcggcggactcggcgacgcctgcatggtgggcgcaatcaaccctgaactatacaagtttcctgaggacaaatctgagactgatttccctgatgggtgcctcggacgcctgtggttctccgtagaatacgagcaggaagcagagagactgctggttgggctgatcaaagcccagcacttacaggccccaagtgagacatgttccccactggtgaagctgtatctgctacccgatgaacgtcgatttctacagagtaagaccaaaagaaagacttctaacccacagttcgacgaacattttatctttcaggtgtcatccaagaccattacccaaagggtgctgaagttctcagtatatcacgtcgaccgccagaggaagcatcagctcctcggccaggtcctgtttccactgaaaaatgaaaccctggtgggagattgtcgacgcgtaatttggcgggacctcgaagcagaatcactggaacctccttcagaatttggagacctgcagttctgcttgtcttataatgattatctgagtcgcctcacagtcgtggtcctccgtgctaaagggcttcgtttgcaggaggatagaggtatcgtctcagtgttcgtcaaggtgagtcttatgaatcataacaagtttgttaagtgcaaaaaaacctccgcagtgctaggaagcatcaatccagtgtataacgagacgttctccttcaaggccgacgcaacagagcttgataccgccagcctcagtcttacagtcgtgcagaacatggagggagacaagtcacagcagctagggagagttgtcgtcggcccttacatgtatacacgcggtcgggaactggagcactgggacgaaatgttgtcaaagcccaaggagctggtgaagaggtggcacgcactttgccgaacgacggaaccctag

SEQ ID NO: 243099 - DNA, 1425 bp, Artificial Sequence
  Description of Artificial Sequence: Synthetic coding sequence
atgggagtagttctgtctccccaccctgctcctagcagacgcgaacctctagcccctctggctcccggtacccgacccggatggagtccagctgtctctggctccagtcgatccgcactgagacccagcactgcaggacctgggcctgggcctgggaccgggtggggtgggacagctgcgtccggacggtgggtccctgcgccagctgtacattgcgctgcgcctagagcagctgctggtcaccagcagcatcatgggccacctctatgttccccagatggcgctcccagaaggtttaagcgcagaccaggaagccctgctcccgcagcacagaccggggaaacctcgttaagagagcaaccccatgggggaccaccggctgtgccttttgtcgtgcccccaaccctccagggccgtgactgggtccccctccattcaggggaatgggctgatgctccttgggatccttgtccagcttcagaactgctccctcacacaagctcaggcggtttaggcgatgcttgtatggtcggtgctattaacccagagctctataagtttcctgaagataaaagtgagaccgattttccagacgggtgcttggggagactttggttctcagtggagtatgagcaggaggctgagaggctgcttgtgggactgatcaaggcgcagcatttgcaggccccaagcgagacatgctccccgctggtaaagctgtaccttctacccgatgaacggcgattcctccagagcaaaacaaagagaaagacatcaaacccacagttcgatgagcactttatcttccaggtgtcaagcaaaacgattacccagagagtgctaaaattctccgtgtatcacgtggaccgccagcgcaaacaccagctgctgggacaggtgttgttccctctgaagaatgagacgctcgtcggggactgcaggagggtgatctggcgggacctggaggccgaatcgctcgagcccccttctgaattcggcgacctgcagttttgtctgagctataacgattacttatcgcgcctgacagtggtcgtgctacgcgctaagggcctgcgcctacaggaggacagggggatagtgagcgtgtttgtaaaagtgtccctgatgaaccacaataaattcgtgaaatgcaaaaagacaagcgccgtgttgggttcaatcaatcctgtctataatgaaacctttagcttcaaagcggacgccacagagctggataccgctagtttgtcccttacagtcgtgcagaacatggagggggacaagagccagcagttgggacgcgtggtggtagggccatacatgtatacccggggtagagagctggagcactgggacgagatgttgtcaaagcctaaagagctggttaagaggtggcatgcgttatgcagaacaacagagccctag

SEQ ID NO: 243100 - DNA, 1173 bp, Artificial Sequence
  Description of Artificial Sequence: Synthetic coding sequence
atggctgagcagctagcacttgtgattggagggacaatcggtggtttgctgcttctactactcatcggtgccagttgttgtctatggcgccgattttgtgcaactcttacttacgaggagctgccgggaactcctgccatggcaaccacagctgcctccagcgggcagagagatcgtccatgtcaacctcatgcacgtactcagctctctagacctccagccgtgccctttgtggtccctccaacgctccagggcagggactgggtgcccctgcacagcggcgaatgggcggacgccccatgggatccctgtcccgcttcggagctgcttccccacacatcatcaggtggactgggcgacgcctgtatggtgggagcaattaatccagagctgtataagtttcccgaagacaaaagcgagacagactttccagatggctgtcttgggaggttatggttctccgtggaatacgagcaggaagcagaacgcttgcttgtgggtttaattaaagctcaacatttgcaggccccttcagagacctgctcacccctggttaagttatacctgctgccagacgagcgcaggttcctccagtccaaaacaaagcggaagacctcaaatccacagtttgatgagcacttcatcttccaagtatcttcaaaaaccattacgcagcgagtgttaaagttctctgtctaccacgtcgacagacaacgcaaacaccaactgctcgggcaggtcctctttcccctcaaaaacgagactctggtgggggattgcaggcgagtcatttggagggacttagaagccgagagcctcgagccaccctccgagtttggtgatctgcagttttgcctgtcgtacaatgattatttgagtagactgaccgtcgtagtgctgcgcgcaaagggtctgagattgcaagaagacagaggcatcgtgagcgtgtttgtgaaggtgtccctgatgaatcacaacaaattcgtcaagtgcaagaagacgtctgctgtgttggggtcaatcaatccagtttacaacgagaccttctcatttaaggcggacgccacagagctcgataccgctagccttagtctgactgtcgtgcaaaacatggaaggagacaaacaggcgactactgtcgagctcttcctcttccaccttaccagtgggtag

SEQ ID NO: 243101 - DNA, 543 bp, Artificial Sequence
  Description of Artificial Sequence: Synthetic coding sequence
gacgagcactttatctttcaggtgtcgagtaaaaccatcacccagagagtcctcaagttcagcgtatatcatgtggatagacagaggaaacatcagctgctggggcaggtcctcttccccctgaaaaatgaaacgcttgtaggggattgccgccgtgtgatttggcgcgacctcgaagccgaatctctcgagcctccatcagagttcggggacctgcagttttgcctgagctataatgattacctctcccggctgaccgtggtggtgctgagggcaaaaggtctgagactgcaagaggatcgcggaattgtctcagttttcgtgaaggtgtcactgatgaaccataataagttcgtcaagtgtaaaaaaacgagcgctgtgctcggtagcatcaatccggtgtataacgagaccttttccttcaaggctgacgcaaccgagttagacacagcgtcgttgagccttacagtggtgcaaaatatggaaggcgataagcaggctacaacagtagaactcttcctcttccatctgacctctgggtag

SEQ ID NO: 243102 - DNA, 783 bp, Artificial Sequence
  Description of Artificial Sequence: Synthetic coding sequence
atggttggcgcaataaatccagagttgtacaagtttcccgaggacaagagcgagacgtgttcccccttggttaagctttatcttctcccagatgaaagacggtttctgcagtcaaagaccaagcgtaagaccagcaatccccaattcgatgagcactttattttccaggtatccagcaagaccatcactcagcgagtgctcaaatttagcgtttatcacgtggaccggcagcggaagcatcaacttctcggccaggtcttattccctctgaagaacgaaaccctggtcggggattgcagaagagtgatctggcgggatctggaagcagaaagcctcgaacctcctagcgagtttggtgacctgcagttttgtctgtcatacaatgattatttgagcagactcacagttgtcgtactccgcgcaaaaggcctcaggctccaggaggacagaggaatagtcagtgtctttgtcaaagtgtccctcatgaatcataacaagtttgttaaatgcaaaaaaacgtccgctgttctcggaagcattaaccctgtgtataacgaaacgttcagtttcaaagccgatgccacagaacttgatacagcctccctgagcctgacagtggtgcagaatatggagggtgacaaatctcagcaactcgggcgagtcgttgttggcccatacatgtatacccgcggtagggagttagaacactgggatgagatgctgtcaaagccaaaagaacttgtaaaaaggtggcacgcactgtgtcggaccacagagccctag

SEQ ID NO: 243103 - DNA, 1047 bp, Artificial Sequence
  Description of Artificial Sequence: Synthetic coding sequence
atggctgaacagctagccttggtaataggagggacaattggtggactgctgctcctgttattaatcggggctagctgctgtctgtggcggaggttttgcgcaactctgacttacgaggagttgccgggaaccccggcaatggcaacaacagccgcttctagcggccaaagggatcggccatgtcagcctcacgccagaacccagctgagtcggccaccagcggttccctttgttgtcccacccacgcttcaaggcagggactgggtgccactacattctggagagtgggcagacgcaccatgggatccgtgtcctgcatccgaactgctgccccacacctccagtggcggattgggtgatgcctgcatggtcggagcgatcaacccagaactgtacaaattccccgaggataaatcggaaaccgacttccccgatgggtgtctgggtagactatggtttagtgttgagtacgagcaggaggcagaacgccttctcgttggcctgattaaagcccagcacctccaggctcccagcgagacttgttcccccctggtaaaactgtatctcctcccggatgagcggagatttcttcagagcaagaccaaacggaagactagtaacccacaattcgatgaacactttatattccaggtttcttcgaagaccatcacgcagcgcgttctgaagttctctgtgtatcacgttgatagacaacgcaagcaccaactgctgggacaggttctgtttcctcttaaaaacgaaactctcgtgggggactgccgtcgtgtcatctggcgggatttggaggcagaaagtctggagcctccatccgagtttggtgacctgcagttctgcctgagttacaacgattacttgtctcggctgacagtcgtagtcctgagagccaagggcctgaggctccaagaggaccgaggcattgtatccgtcttcgtgaaggtctctttgatgaatcataataaattcgcaaaatgtaagccaggcccagacctgggagaggaatcacgagggagtctcaacctaaagtag

SEQ ID NO: 243104 - DNA, 1173 bp, Artificial Sequence
  Description of Artificial Sequence: Synthetic coding sequence
atggccgagcaattggccctggtgatcgggggaactattggcggactcctgctgctgctgctgattggggcatcctgttgcctatggcggagattctgtgcaaccttgacttatgaggagcttcccggaaccccagccatggccacgacagctgcctcctccggccaacgggacaggccatgccagcctcatgccagaacccagcttagcagaccccctgccgttcccttcgtcgtgccacctaccttgcaagggagggactgggtgccattacatagcggcgaatgggcggatgccccatgggacccttgcccggcatcagaactgctcccacatacatcatctggaggcttgggcgatgcttgcatggtgggtgctatcaatcccgagctctataagtttccagaggacaagtccgagacagacttccctgatggatgcttgggtaggttatggttctccgtcgagtacgaacaagaagccgagcgcctccttgtgggactgattaaagcacaacacctccaagcaccaagcgaaacatgctcccccttggtgaagctctacctgctgcctgacgagcggagatttcttcagtcaaagacgaaacggaaaacatcaaatccccagtttgacgagcacttcatattccaagttagctctaagaccatcacccagagggtgctgaagtttagcgtctaccatgtggataggcaacgcaagcatcaattacttggccaggtgctttttcccctgaaaaacgagaccctcgtaggcgattgcagacgagtgatctggagggaccttgaagcagaaagtctggaaccgccaagcgagttcggggacttgcaattctgcctgtcttacaacgactacctgtcgcgcctgaccgtggtggtgctgcgcgcaaaaggcctacgtctacaagaagatcgtgggattgtgagcgtctttgtaaaagtatccctgatgaaccataacaaattcgtcaaatgcaaaaaaacttccgcagtgctggggagcatcaacccagtctacaatgaaacattctcattcaaagcggatgcaactgaactggacactgccagcctaagtttgacagttgtgcagaacatggagggcgataagcaggccacaactgtcgagctgttcctctttcatctgactagcggctag

SEQ ID NO: 243105 - DNA, 1152 bp, Artificial Sequence
  Description of Artificial Sequence: Synthetic coding sequence
atggtgttggccatggcatctcaggatgtccaaaatttcttccagccattcagttcatggatctctagggtttatgaagccctgcaacaggccggagacatgctgtctgcctctctggttaacatttctaagcaggacagtaaactaagcgacaagttagatcaggatcttgacaacattcagatacaggagacctatttcgaagacgaggagcaagataatgactggagccaggaagatgcaaactccctctttttggaagtagaccacttttcctgttgtaacagcgatctgcaagattctgcccagaacagctctccgagcctgtcccagcatgccaaggatagttgttctaccatgagccagtggcctaattgggcgtctgatgacagaaagctgccccacgtcctgtcatcgattgcggaggaggaacatcatttggagaaacagagatcagggctgcagcatggtttcgactcgcaattgcctggtaccttggagacagtcaacggaaaaaaacaggttaactctttcggcgatgatgaggaactttctactagtagtgattctgacgaggaggtgatcaagcaattcgagataagcgttagcagatcacaaagcttcagaagcgtaacaagcgagaagggaaaacaaaccggcttggaacaaaagcctaagtttagcagatcacttctgacccacggagaagacggtactgaagtctccgcttgtgaggacctggatggggctagccagagaagatatagtgagaacctgagttatggagaggatgaccacattccggcacactcccagtcaccgtgtgagcgcggtgatgcaaagcatcacggtacttcacatcaagagagctcagttgtgcagtctctgcggcgacaatccactgaggggtctcttgagatggaaacagcattcaacagccggggattcgaggattcgtacgccaccgacagctcctcaatgtggtccccggaggccaacctgaacctgaagcggaaggggtatttgttggacgtctattgcctctctagcccgctgctgttcacgacatcccttcatcgacgtaacaggacaggaccaatatgcagatgtcatcctgggtcacaatctcccagtcagtcggtggtgacgtag

SEQ ID NO: 243106 - DNA, 1938 bp, Artificial Sequence
  Description of Artificial Sequence: Synthetic coding sequence
atggtgctcgcaatggcgagtcaagacgtgcagaatttttttcagcctttcagctcatggatatctagagtgtacgaggcgctccaacaggctggagacatgttgtcagcttcattggttaacatctctaagcaggattccaagctctccgataaactggaccaggatttagacaacatccagattcaggagacatacttcgaagatgaggagcaggacaatgactggagccaggaggacgcaaactctctgttccttgaagtggaccacttctcctgctgtaatagtgacctccaggactcagcacagaacagttcaccaagcctgtctcaacatgctaaggacagttgtagtaccatgtcacaatggccaaattgggcctcagatgatcgcaaactccctcacgtgctgtcctctattgctgaggaggaacatcaccttgagaaacagcgatccggcctgcagcatggcttcgacagccagctgccaggtacactggagaccgtgaacgggaagaaacaagtgaattccttcggtgatgatgaggaattgtccacctctagcgatagtgatgaagaagtgatcaagcaattcgaaattagcgtgagtcgcagccagtcattcaggtccgttaccagcgaaaaagggaaacagacgggtctggagcaaaaacctaaattttcacggtctcttctgactcacggtgaagacggcaccgaagtgtctgcctgtgaggacttagacggcgcaagccagcgtcgttactctgaaaatctctcctatggagaggatgatcatatacccgctcatagccagagtccgtgtgagcgtggcgatgctaaacaccatggcacatcacaccaggaatcaagcgtcgtccagagcctccgtagacagtccacagagggatctctggaaatggagaccgcctttaactctcggggatttgaggacagctatgcgacagacagctcttccatgtggtcaccagaggagcaggatagaactaacctccaggttccttctggagtcagcgagcccatctctaagtgcggcgatctcgatgtgatcttcgaatatagagccgcatcccagaaactgacagtcacgatcgtgcgcgcacaggggttgccggataaagatagaagcggcgtcaacagttggcaggtgcatgtggtcctcctcccaggtaagaaacatcggggtcgaactaacatccagaggggtcccaaccccgtgttccgggaaaaagtaactttcgcgaagcttgaaccccgagacgtcgccgcatgcgcagtgaggtttcggctgtatgcggctagaaagatgacgcgcgaacgcatgatgggtgagaagctgttttatctgagccatctgcatccagagggagaaatgaaagttacactcgtgctggaaccacgtagtaatatctcttctggcggaagcccactgtccccctccgccgtctcccactccgattctacgagcagtacccaatctctctctcatggcggtgcaccggagcttctggtgggcctgagctacaacgccacgacggggcgactgtccgtggaaatgataaaaggctcacattttaggaacttggccgtcaacagagcaccagatacctacggcaagctgtttcttctgaacagtgtcgggcaggagatgagtagatgtaagaccagcataagacggggacagccaaatcccgtgtataaggagaccttcgtgttccaagtggcactatttcagctctccgatgtcactctgatgatttcggtatacaatagacggacaatgaaaaggaaagaaatgattggctggattgccctaggccaaaactcctctggggaggaggaacaggatcattgggaagagatgaaggagacaaagggtcaacagatctgtagatggcacacacttctggagagttag

SEQ ID NO: 243107 - DNA, 1653 bp, Artificial Sequence
  Description of Artificial Sequence: Synthetic coding sequence
atgccacagcggggtcaccccagtcaggagggcctgtgggcacttcccagcctccctatggcccacggacctaagccagagactgaaggtctgctggatctgagcttcctcactgaggaggaacaggaagctattgcgggtgtactgcagcgtgatgcgaggcttagacaattggaggaagggcgagtatccaaactccgcgctagcgtcgctgaccctggtcagctgaagatcctcactggcgactggttccaggaagccaggtctcagcggcaccacaatgctcatttcggtagcgatttggtgcgggctagcatgaggaggaagaaatccacgcggggtgaccaggctccgggtcacgatcgagaggccgaagccgcagtaaaagagaaagaagagggaccagagccccgtctgacaattgatgaggcacctcaggagcggctgcgagaaaccgaggctagcgacccggaagaagctagccaagctcaagaggaccccggtcagggggatcagcaggtttgcgctgaagaggccgaccccgagctggaacccgcaagcggaggggaacaggagccgagaccacagcaagctcagactaaggccgcatcccagattctggagaacggtgaagaagcgcctggcccagaccccagcttggaccgcatgctcagctcttcctcctccgtgtcctccctgaattcttccaccctatctggatcacagatgtctctctctggggatgccgaagccgtacaagtgcgcggatctgtacacttcgctcttcattacgagccaggagctgccgagttgcgggtgcacgtcattcagtgccaagggctggccgcagcccgacgtcgtagatccgacccatatgtgaagagctacctacttccggataagcaaagcaagagaaaaacagctgtgaagaaaaggaacctgaatccagtttttaacgaaacactgcggtattcagtgccccaggccgagctgcagggtcgggtgctgtccttgtccgtgtggcaccgagaatcgctaggcaggaacatcttcttgggggaagtggaagtgccactcgacacatgggactggggatcagagcccacttggctgccacttcagccaagagtgcctccgtcccccgacgacctcccatctcgcggactattggcgctctccctgaaatatgtgccggctggcagcgagggcgcaggtctcccgccaagcggggaactgcatttctgggtgaaggaagcacgcgacctgctgcccctccgtgccggatctctcgacacttacgtgcagtgttttgtcctgcccgatgactcccaggcaagcagacaacggacccgagtcgtaaggcgcagcctctctcctgtattcaaccatacgatggtctacgatggcttcggtccagctgacctaagacaagcatgcgctgaattgtcgttgtgggaccatggagccttggccaatagacaactcggaggtactcgccttagtctcggaacaggaagctcttacggcctgcaagtcccgtggatggacagcacaccagaggagaaacagctgtggcaggctctgttagagcagccttgtgaatgggttgatggactcctgccccttcggactaacctggcccctagaacttag

SEQ ID NO: 243108 - DNA, 231 bp, Artificial Sequence
  Description of Artificial Sequence: Synthetic coding sequence
atgcctcagaggggacatcctagtcaggaggggttatgggcccttccctccctccctatggctcacggacctaagcccgagactgaggggcttctcgacctctcctttctgaccgaagaagaacaagaggctatcgccggagtccttcagagggacgctcgcttaagacagcttgaggaggggcgagtgtccaagcttcgcgcaagcgttgccgacccaggtcaattgtag

SEQ ID NO: 243109 - DNA, 1065 bp, Artificial Sequence
  Description of Artificial Sequence: Synthetic coding sequence
atgcctcaacggggtcacccaagtcaggagggtctttgggctctgccgagcctccccatggcacacgggccaaagccagagactgagggactgctggatttgtcttttctcaccgaggaagagcaggaggcaattgcaggagtgctgcagcgggacgcacgccttaggcagttggaggagggtcgggtcagtaagttgcgtgctagtgttgcggatcctggccagctcaagattctgacgggcgactggtttcaggaggctagatctcagcggcaccataatgcccattttggatcagatttggtgagggctagcatgcgaagaaagaagtccacaaggggcgatcaggcccctgggcacgaccgggaggccgaagcggctgtgaaggagaaggaggaaggccctgaaccaaggcttactatcgatgaagccccacaggagagattacgggagacagaggggcctgatttcccaagcccctctgtcccactgaaagcaagtgatcctgaggaggccagccaggcccaggaagaccctggccagggagaccagcaggtgtgtgctgaggaagccgaccccgagctagagcctgcctctggcggagagcaggagccccgaccacagcaggcccaggtcgggggttctggaccatggctgctgagcacaagcggagccgattctggcagaggggctctcctgccaagggcagcatcccggccacggcctcgggcattaggcgcaggggtggggaaggaaggggctccccgtcatctcccgcctctccagaccaaggcagccagccagatcttggaaaatggcgaggaggccccagggccagacccatcccttgaccggatgctgtcctcttcatcctctgttagtagccttaatagcagcactctctcaggaagtcagatgtcactgagcggagacgccgaggcagtccaggtaagggggagcgttcacttcgctcttcattatgaacccggagcggctgaactgcgcgttcatgtgatccagtgccagggcctggctgcagccaggagacgcagatctgatccttag

SEQ ID NO: 243110 - DNA, 606 bp, Artificial Sequence
  Description of Artificial Sequence: Synthetic coding sequence
atgggcaccacagccctgctgggcggagtccggttgtccgagacaatccctgtgaagaggctggccagggggctcgccagagtgcgagacggagggtggggctccccacaggcaggggaaaaagccctgggtgggcctctgctcaccagtgggtcacacctgccaagctatgtgaagtcctacttgctgcctgataagcagtccaaaagaaaaaccgccgtgaaaaagcgcaacctgaatcctgtcttcaatgaaacattgagatattcagtccctcaggccgagcttcaaggacgcgtcctctcccttagcgtttggcaccgtgagagccttggcaggaacatatttctgggcgaggtggaagtgccgttggacacctgggactggggaagcgaacctacttggctgccactccaacctcgcgtacccccaagccctgacgatctcccttccaggggcctcctcgccctgtctcttaaatacgtgcctgcaggttcggagggagctgggctccccccttccggcgagttacacttctgggtcaaggaggcacgcgacctgctgcccttgcgcgcagggtcactggatacctatgtccaatggtag

SEQ ID NO: 243111 - DNA, 1083 bp, Artificial Sequence
  Description of Artificial Sequence: Synthetic coding sequence
atgccacagaggggccacccttcccaggaaggactgtgggccctgccatctctgcccatggctcacggcccaaagcctgaaaccgaaggcctgttagatctctctttcttaaccgaagaagagcaagaggctattgccggagtgctgcagagagacgccagactgagacagcttgaggaaggacgtgtgagtaagctgagggctagcgtagcagatcccggtcaactcaagatcctaactggagattggtttcaggaagccaggtcgcagcgacaccacaatgcccacttcggttccgatctggttcgggctagcatgcgccgtaaaaagagtaccagaggcgaccaggccccaggacatgacagagaggccgaggccgctgtgaaagaaaaggaagaggggccagagcctcggttaacgattgatgaagcccctcaagagcgactccgcgaaaccgaaggacccgattttccctcaccatcggtacctctgaaggccagtgatcctgaagaagcaagccaggctcaggaggatccgggacaaggggatcaacaggtttgcgctgaagaggcagaccctgaactcgaaccagccagtggaggtgagcaagaaccgcgaccgcagcaggctcaagttggcggatcaggcccatggttgctgagtacctccggggctgacagcggcaggggtgccttgctgcccagagccgcttcccggcctcgccctcgggctctgggcgctggcgtgggcaaggagggagcacctcgccatcttccacccctacagaccaaagcggcttctcagatactggaaaacggagaagaggcccctggaccggacccttcattagatcgcatgttgtcttccagcagttctgtgtcatcgctgaattccagcacggtcaggcgcgagggaggggaccctggtgggaggggcgttgatcccttccggtgcgtggcacccgcttgcccttccctcgccgctggcccaaccgccgcagctccccagcccgctacgtatgacccaggtctcaaacccccaagatgcccacgcccacgacgcgagccatgcgagcggccttag

SEQ ID NO: 243112 - DNA, 879 bp, Artificial Sequence
  Description of Artificial Sequence: Synthetic coding sequence
taaccacgcccacagcaggcacaggtcggtggttccgggccatggctgctctctacctccggagccgacagtggtcgcggagccctgctgccccgagctgcctccaggccgagacctagagcccttggcgctggcgtcggaaaagaaggcgcaccccgacatctgcctcctctccagaccaaggccgctagccaaatcctggaaaacggggaggaagccccaggcccagatccctcgctggaccggatgctgagctcttcatcttctgtttcaagcctgaactcctccaccctatccgggagtcagatgagcctgtcgggagacgctgaggccgttcaggtcagagggagtgtccactttgccctacattatgagccaggcgcagcagagctcagagtgcacgtcatccagtgtcaagggctggccgcagctcggaggagaaggtcagatccgtatgtcaaaagctacctgctgccagacaaacaaagcaagagaaagacagcggttaaaaagcggaatctgaatccagtctttaatgagacgctccgctatagcgtccctcaggcagaactccaaggtcgtgtgctctcactcagcgtctggcatcgggagtcgctcgggagaaacatctttcttggcgaagttgaggtcccgctggatacttgggattggggcagcgagcccacatggcttcccttgcagccacgggtcccccctagcccagatgatctgccgagccgaggattgctggccctgtctctgaagtacgtgccagctgggagcgagggagcaggcctgccaccaagcggcgagttacatttttgggttaaggaggccagggatctgctccctctgcgtgcgggttctttagatacatag

SEQ ID NO: 243113 - DNA, 1689 bp, Artificial Sequence
  Description of Artificial Sequence: Synthetic coding sequence
atgcctcagagggggcatccctcccaggaaggactgtgggccctgccttccctcccaatggcccatggccctaagccagagacagagggccttcttgacctgagctttctgacggaagaggaacaggaagccatcgctggagtgctgcaaagagacgcccgactgcgccagcttgaagagggcagggtgtctaaacttagagcaagcgtggccgacccgggtcaattgaaaatattaacgggtgattggtttcaggaagctcgctcccagagacatcataacgctcactttgggtctgatctagttcgagcaagcatgcgaagaaagaaatccaccaggggagaccaggctcccggacacgacagagaagctgaggccgcagtcaaagaaaaagaagaggggcctgagccgcgactcactatcgacgaagcaccccaggaaagactgagagagacagagggtccagactttccatcgccctcggttcccttaaaggcttcagatccagaagaggccagccaagcccaggaagacccagggcaaggggaccaacaagtgtgcgcagaggaggccgatcccgagttggagccggcatccggtggcgagcaagaacctagaccgcagcaggcgcagacaaaggcagctagccagatcttggaaaacggggaggaggcgccaggaccagacccctccctcgatcgcatgctgtcttcatctagctccgtatcgtcattgaactcctccactctgagcgggagccagatgagtctttcgggagacgctgaagcagtccaagtacggggaagcgtgcactttgcgctccattatgagccaggcgctgctgaactccgagtgcacgtcatacagtgccaagggctagctgccgctcgtaggcggaggtccgatccatacgtcaagtcttatctcctccctgataagcagagcaagcggaaaaccgctgttaagaaacggaaccttaaccccgtgtttaatgagaccctgcgatatagcgtcccccaggcagagctgcaggggcgagtgctgtctctttcagtatggcacagagaatcgctgggtaggaacatcttcttaggggaagtggaggtgcccctggacacgtgggactggggcagtgaacccacgtggctgcctctccagcctcgcgtgcccccaagtccagatgatctcccctcaaggggattgctggcactcagcctaaagtacgtgcctgccggttctgaaggggcagggttgcctcccagtggagagctgcacttttgggtaaaagaagccagggacctcctgcccttacgggcaggcagcttggacacgtatgtgcagtgcttcgtgctgcctgatgacagccaggcctcccgacagcgtactagggtagtacgcaggtcattgtctccagtctttaaccacactatggtttacgatgggtttggccctgccgatctcaggcaggcatgcgcagaactgtcactgtgggaccatggggcactggcgaatcggcaacttgggggaacccgactgagtttagggacaggctcaagctatggactgcaagtgccttggatggactcaacccctgaggagaaacagctctggcaggctctcctggagcaaccttgtgaatgggttgacggcctcctccctctccgtaccaatttggctcctcgaacctag

SEQ ID NO: 243114 - DNA, 2808 bp, Artificial Sequence
  Description of Artificial Sequence: Synthetic coding sequence
atgatcgaccttagttttctaactgaggaggaacaggaagctataatgaaggtgttgcagcgtgacgctgcccttaaacgggcagaggaagagagggtgcggcatctcccggaaaagatcaaggatgaccagcaactgaaaaacatgtccggccagtggttttacgaggccaaggccaagcgacaccgggacaagatccacggcgctgacatcatcagagcgtcgatgagaaaaaaacgcccacagatcgccgcagaacagtctaaagacagagaaaacggagccaaggagagctgggttaataatgttaacaaggacgcgttcctacctcctgagctagctggcgtggtggaggaaccagaagaagacgccgcaccggcatccccatcctcatcagtggtcaacccagcctcttctgtgatcgacatgtcccaggagaacaccagaaagcccaacgtttcaccagaaaagcagcggaagaatccatttaacagttctaagctcccggaggggcactcatctcaacagacgaaaaatgaacagtccaaaaatgggagaacgggcctgtttcagactagcaaggaagacgaattgtctgagtctaaggagaagagcacagtggctgacacttctatccagaaacttgaaaaatcgaaacaaaccttacctgggctgagcaacggcagccagatcaaggctcccatcccaaaggctcgcaaaatgatctacaagtccacagatctaaataaggatgataaccagtcattcccccgacagcgtaccgactccctcaaggccaggggcgcaccacgcggaatcctcaaacgaaattctagcagctcttcaaccgattcagagacactgaggtataatcataatttcgagcctaagagcaaaattgtgtccccaggcttgactatccatgagaggatttcagagaaggaacatagtctcgaagataacagtagtcctaattcgttagagcccttaaagcacgtgaggtttagcgccgttaaggacgagctcccacagagccctggcctgatccacgggagagaggttggagagttttcggttttggaatctgacagattgaaaaatggcatggaggacgccggagacaccgaggagttccagagcgaccccaaacccagccagtacagaaagccctctctgtttcaccagagcacctcaagtccgtacgtgtcaaagtcggaaacccatcagcctatgacctcaggaagcttccccatcaacgggctgcactcccatagcgaggtactcacagctcgccctcagagtatggagaactctcccactataaacgagccaaaagacaaatcctccgagctcacaaggttggaaagcgttctcccgcgatctccggctgacgaactctctcattgtgtcgagcccgagccatctcaggtacctggcggaagttctagggacagacagcagggttccgaagaagaaccttcaccagtgctcaagaccctggaaagatcggcagccagaaagatgccgagtaagtctcttgaggatatatcatcagactcaagcaaccaggcaaaagtcgacaaccagccagaagaactggtgagatccgccgaggacgtgagtactgtgcctacacagcccgacaatccttttagtcacccggataagttaaaacgaatgagtaaaagcgtcccagcattcctgcaggacgaaagcgacgacagggagaccgacacagccagcgaaagctcctaccagttgagtcggcacaagaagtctccctccagtttaaccaatctgtccagctcttcggggatgacttccctcagcagcgtctccgggtccgtgatgagcgtgtattccggcgattttggtaacctcgaggtcaagggcaatatccagttcgcaatcgaatacgtcgaatctctcaaggagttacatgtcttcgtcgcccagtgtaaggatcttgcagctgctgacgtgaagaagcagaggtccgatccttacgtaaaggcttacctgctgcctgacaagggcaaaatgggaaaaaagaagacactcgtagtaaagaaaacccttaaccctgtatacaatgaaattctgcgctataaaattgaaaagcaaatccttaagactcagaagctgaacctctccatctggcaccgcgataccttcaagcgcaattccttccttggggaggtggagctggatttagagacgtgggactgggacaataagcagaataagcaactaagatggtacccattaaagcgcaaaacggcccctgtggcgctggaagccgagaacaggggcgaaatgaaattggcactccagtacgttccagagcccgtgcctggaaaaaaactgcccactacaggcgaggttcatatctgggtgaaggagtgtttggacctccctcttctgagagggagccatttaaattctttcgtcaagtgcactatcctccccgacactagccgaaaaagcaggcagaaaaccagagctgtcgggaaaaccacaaacccaattttcaatcacacaatggtctacgacggctttcgccctgaggatctcatggaggcttgcgtggaactgaccgtctgggatcactacaagctaacaaaccagttcttgggcggtttacgcatagggttcggcacaggtaagtcatacggaaccgaagtggattggatggactctacctccgaggaggtcgccttgtgggagaagatggtgaactcaccaaatacatggatcgaggccacgttgcctctccggatgctgctcattgcaaagatctctaaatag

SEQ ID NO: 243115 - DNA, 3819 bp, Artificial Sequence
  Description of Artificial Sequence: Synthetic coding sequence
atggacgagccaaacgcagagcaagtgtacaatcctagccaattcgaaaatcttcgcaagttctgggatctcgaggccaatagcaattcgaaggacaacgacaagaacatcaccaccacttcacagaaaaactccgccccattcaacaggcaaaagcataaggagttttccgatattaagctcagtggcaagaatactcatgaggcagaggtgttgttgtctcccaaaaaagttatggccagggaagaaatggagaaacttaacagcaaagggatccttcaagtgctgcctgatgaaattaccttccccctgagtccacttagaaagtacacctaccagttacccggtaatgaaagctccaaggaaaatgtggagaaaaacacagagggcattgtgacacccgtttttaaagaagaaaaagactacagtgaacaggagattcaggagagtataataaaaaccaacgtcctgtctaaagattgcaaggacaccttcaacgactctcttcagaaactgctgagcgaaactagcactcccgctattcagccctcgggtggaaaggtgcatggcaagcaggtgttagaaccttctgtatccgaaaaccgtacctggccacaaaaaaccgatttcgcagacacagaggaggaggtgaaggggccagaaaagatcatcaacgagcatgtggataagaccgtcgtgcatcctaaagtcaaacggaacagtcttaccgcttcgctggacaaactgttgaaagaggccaccggaacttccccaagcccgctacaagccaaactcgcccctgtaatcactggaacaaattccaagctggaggaaggcaggttttttggaaaaggtatcgaacagtctcataatacctccgctgacaaacgggagatcctcgcacctttccctgtgagagacgaaactttcggcaacacggccctcctgaagaaagccgagtcaggagagtgtcagctgagtactcagaatctcatacaaatggctgccgaagactcccacccgttggacccgacctcccagctatcccggaaaggaagtttcggcgacgtggcgagccctccacaggacatgctcttcccacaggacgctcacctggtcccccaagctcgcgttcacccatcccagaccgagatctcagagaccgtcgaaaaagtcatcctccccccacgaccagtgctcaatgacgtaagtgctgcgctgcaaaaactgtgtggagaggtgtggttgagctatcccgcaggtcgggaagtggggcctggagaagtcaatccagagtttcccgaagctgtgcagcccgtttgcagtccacttaacccacccggagtcattagcccgtgggccactatggatacaattgttccggacaggaaggacttctacagcagcaatgttgtccccgacaagacacacgaggtcggatcttatctagccgctcagatgagcccaagcgaccagactctgtccagttttgcaagcatcgttgcccagtatggcaagggtctgccccaggaagtggaagagatcgtccgtgagacaatcgtacagccgaagagtgagttcttggaatttagcgccggactggagaaactgctgaaggaagagaccgagacgtttcccagcaagtatgaaagcgatacgggaaatctctctccatccaagctgatcggttcgaccgaggagcccaggcgggctacttccgaatgccaccccgaggagcttaaggaaaccgtggagaaagcggaagcgccattaatcacagaaagcgcctttgatgcgggatttgagaagcttctaaaagagatcactgaagcccctccctaccagcctcaggtgtcagttagagaagaaacacatgaaaaggagagctcccagtcagaacagacaaggtttctaggaacagttccccacttctatcgggcagcatctcagacttccgagatgaaggataaatctaatggtctggagagccaggtcaatcagtgcgataagatgttgggcggagacgccctggtgactgaccttctggttgatttctgcgggtcccgaagtggagtggaaattccccgtactccccagctgtatgtggcgcacgaaatcgggacaattaaaacggtgaccccaccagaagatcgtgattcagaatctggggtcgccggtggccagggaacactgcaggagcctggatttggagaggcttccgaagccatttccgtgtcgcgcaacagacagcccattccacttctcatgaacaaggagaattcgacgaagacctccaaagttgagcttactctggccagtccctacatgaagcaggagaaggaggaggagaaggagggcttcagcgaatccgatttctccgatgggaacacctcctccaacgccgagtcatggcgtaatccttcttcctccgaagaagaaccgagccctgtgctgaagacactcgagagatccgccgctcgtaaaatgccctccaagagcctggaagacataagctctgatagcagtaatcaggcaaaggtcgataatcaaccggaggaactcgtacgcagcgctgaagacgatgagaagccggaccagaaacctgtgactaacgagtgcgttcctcggatctcaaccgtgccaacccagcccgataacccttttagccatcccgacaagttgaaacgcatgtcgaaatccgtgcctgctttccttcaagacgagtcagacgaccgagagaccgacactgcatccgagtcctcgtaccagttgtccagacataagaagagccccagtagcttaacaaatctgtccagctcaagtgggatgacatctctgagcagcgttagtggatctgtgatgtctgtttactcaggcgacttcggaaacttggaagtcaaggggaacattcaatttgccatcgagtacgtggaatcattgaaagagcttcacgtgttcgtggcccaatgtaaagatctcgccgctgccgatgtcaaaaagcaacggagcgatccttacgtcaaagcatacttgctcccagacaagggaaaaatgggcaagaagaagactctggtcgtaaagaagacactaaaccccgtttacaatgagattctgcggtataagatcgaaaaacagatactgaagactcagaaattaaatctgagcatctggcatcgtgatacttttaaacgcaacagtttcctgggggaagtcgaattagatctggaaacgtgggactgggataataagcagaataaacagctgagatggtatcccctgaaacggaagacagcccctgtagctctggaagccgagaatcgcggtgagatgaagcttgctcttcaatacgttccggagccggtcccaggcaaaaaattgcccaccaccggagaagtccacatttgggtcaaagaatgcctggatctaccactgctgaggggcagtcacctcaactcattcgtgaagtgcactattctcccagacacaagccggaaatcgcgacagaaaacacgagcggtcgggaagacaacaaacccaatctttaaccacacaatggtctacgacggcttccgtcctgaggacctgatggaggcctgcgtggagcttacggtctgggaccactataagttgacaaaccaattcctgggtgggctgcggattgggttcggaacagggaaaagttacgggactgaagtagactggatggactctacttctgaggaagtggccctgtgggagaaaatggtcaattccccaaacacctggatcgaagcaaccctgccactcagaatgctgctgatagccaaaatctcaaagtag

SEQ ID NO: 243116 - DNA, 5342 bp, Artificial Sequence
  Description of Artificial Sequence: Synthetic coding sequence
atgatcaactcgagtctgtcaatgctcttttcatacttggagaagtacttttatgtcgctgacgagttgtcccattgcgtcgaaccagagccctcacaggtccccggaggttcctctcgggaccgacaacagggaaagccgcctccactgcctgccttgaaagccaaaacttcctcaaggtctgggccttatgcaactgagattaagaagagcacagacgatagcatttttaaagtccttgactggttcaataggtctagctactcagatgacaacaagtcgtttctccagcacccgagagggatcgagagcaaagagaaaaccgattcaaaaagtcaggtggccgtggatctcgttaccgacgataccacgctccgagaaaacgggtctaagactttgtcccctagtaaaattgaactcaagcccgtacgttccgatagccctttccaggccgaaggggatatgcttgtgtccgagtcctgtcaggacaacaacgtcaacatcaaatccaagtttatgaacctgagtcaaaaaggaactcccaaggaggggcctgggatcctccagccctttgaaagttacggtactcccagccaaggatccaagaacatggactacagccaagatagtaaaagccctggaaaagggaacggtgcctctccttcaaactctaactatagctactcggtcctgaaagagtctgatgccgagaatcaggtgccatgtaatactaataatattggcaatctcggcgaggaggagccaaagttccacgctcacgaggaaaataggggacattcggaggtcaattttgactctagcactgtagtgaaggaaccaggtttaaaggacaacatgaatgccgaacgtaagtctaaggtagggaatacatatatccttaaggcctccttggaaccagaaaatataaagtccacacctggcgtggcaaataacggcagcccctggaagaagcccgaggtgcagttccagcaagaagcaggagaggtgcctaaaaaccaggtccagcgggagaagtacaaacgggtgagcgaccgcatctccttctgggaaggcgaaaaagcaggtgcaaaaatcacccatgagaaacctacctcctcatgctcccaggagcagcctagtgccaaggcttatcagcctgtaaagaagtcccaaggcgtctcgagcatggattctctctccaccgaccaaagtgagtacaaccaggctatccctaagcgggtcgtactggacgaagatgatcaggcctcccaactgtccaattcctacagctccaacaaatctaaggaaacgaaaccgcagatcgccggtccatcacgttactacctatccgcagaacagtcagacaaggtctcgttgtttcaaaacaagaagaacgaaccgattaagaggagtcaggtggctgacagccttcccagcaggcgcaacattacccttccagctctgcaaccgcctagtaacgtaggtagtgaacggcacgcgccactcgaaaaggaccgcccactggtcagagagtctaatgccaatttcaaagttatgagcctgaaagaaagaatggatgaacctaatgccgagcaggtgtacaacccaagtcaatttgaaaaccttcgcaagttctgggatctggaagccaatagcaatagcaaggacaacgacaagaatataacgaccacgtcccagaagaactctgcccctttcaacaggcagaagcacaaggaattttccgatataaaactatccggtaagaacactcacgaagcagaggtgctgctgtcacctaaaaaagtcatggcaagagaagaaatggaaaaactgaacagtaaaggaatactgcaggtgttaccagacgagatcacctttcctctgagtcccctgagaaagtatacctatcaactgccagggaacgagagcagcaaagaaaacgttgaaaaaaacactgaggggatcgtgacgccagtgtttaaagaagagaaagactattcagagcaagagatccaggagtctattatcaaaacgaatgtgttgtcgaaggactgtaaggacacctttaacgattctctgcagaaactcttatctgaaacctctactcctgccattcagcccagcggtggaaaggtgcatgggaaacaggtgctggaaccctcagtgtccgagaataggacgtggccccagaagaccgacttcgcggacaccgaagaggaggtgaagggacccgaaaaaataatcaacgaacatgttgacaaaaccgtggtgcatcccaaagtcaagaggaattctctgaccgcttccctggataaattgcttaaggaagcgacgggaacttccccctccccactacaggctaaactcgctcccgtcatcaccggcaccaatagcaagcttgaagaaggaagattctttggcaaaggcattgagcagagtcataacacctcagcagacaagagggagatcttagcaccattccctgtaagagacgagacctttggaaacacagccctacttaagaaggcggaatctggcgagtgtcagctgtcgactcaaaacttgattcaaatggcagcggaagacagtcatcctttagatcccaccagccagttatcccggaaaggaagcttcggagacgtggcatctccgccacaagacatgctcttcccccaggatgctcacttggtccctcaagcgagagttcatccctctcaaactgaaatatctgagacagttgaaaaagtcattttgccccctcgacccgttctaaacgacgtgtcagcagccctgcagaagctctgcggagaggtttggcttagctatcctgcgggaagggaagtcgggcctggcgaggtcaatccagagtttcccgaggctgtccagcccgtgtgcagtccactcaatccacccggagtgatttccccatgggcaacgatggataccattgtgcccgatcggaaagacttctactcttctaacgttgtcccagataaaacgcacgaggttgggtcctatctcgccgcacagatgagccccagcgaccagacactgtcttccttcgcttcaatcgttgcacaatatggcaaaggactgcctcaagaagtggaagagatcgtccgtgaaactatcgtccagcctaaaagcgagttcctggaattctctgctggattggaaaaactgctgaaagaggagacagagacattcccttcaaaatacgaaagtgataccgggaatctgtctccctccaaattgattggcagcaccgaagagcccagacgagctacgagcgaatgccatccagaagagcttaaagagaccgtagaaaaagctgaggcgcctctgatcaccgaatcagcgtttgatgctgggtttgagaagctgctgaaagagattacagaagcacccccttaccagccccaggtaagtgtgcgtgaggaaactcatgaaaaggagagttcccagtccgagcaaacccggttcttgggaaccgtgccacacttctaccgggcagccagccagacctctgaaatgaaagataagtcgaatgggcttgagagtcaagtcaatcagtgcgataaaatgctcgggggtgatgcattggttacagaccttctagtcgatttctgtggtagtcgcagcggtgtggagatcccccgtactccgcaactgtatgtcgcacacgaaatcggcacaatcaagacggtcacaccccctgaagaccgcgactcagagagcggggttgccggtggacagggaactttacaggaacccggtttcggagaagcatctgaagccatctccgtgtctaggaaccgccagccgatacctttgctgatgaataaggaaaactcaacaaaaacgagcaaagtggaactgaccctcgcatcgccatatatgaagcaagagaaggaggaagagaaggaggggttcagtgagtccgatttcagtgacgggaacacatcttctaacgcagagtcctggcgtaatccatcctcatccgaagaggagccatcccctgtgctgaagacactggagagaagcgcagcccgaaaaatgccatcaaagtcactggaagacattagctccgactccagcaaccaggccaaagtggacaaccagcctgaggagctcgtgcgatcagctgaagatgtctccactgtgcccactcagcctgataatcctttttcgcatcccgacaagctcaagaggatgagcaagagtgtacccgcttttctacaagacgaatctgacgaccgggaaacagacacagcttcggaaagtagctatcagcttagtcgccataaaaagtctccctctagtcttaccaatctgtcaagctcctcgggaatgaccagcctgtcctcagtctctgggagcgtgatgagtgtgtactctggggattttggcaaccttgaggtcaagggaaacatccagttcgcgatcgagtatgtcgagagtttaaaggagctccacgttttcgtggcccagtgtaaagacctggcggcagccgacgtgaagaagcaacgaagcgatccatatgtgaaagcctaccttttgcctgacaaagggaagatgggaaagaaaaagaccctcgtggtgaagaagacactcaatccagtctacaacgagattctacggtacaagattgaaaaacagattttgaaaacccagaaactgaacctcagcatctggcatagagatacctttaagcggaatagctttctgggcgaggttgaactcgatctggagacatgggattgggacaataaacagaataagcagcttaggtggtacccactgaagcggaagactgccccagtcgccctggaagctgaaaatagaggggagatgaagcttgccctgcagtacgtgccagagccagtacctggaaaaaagctacctacaacgggcgaggtccacatctgggtgaaggagtgtctggatttgccgctgctgcgagggagtcacctgaactctttcgtcaagtgtaccattctgccagacacaagcaggaaatctaggcagaagactcgcgcagtagggaagaccaccaaccccatatttaatcataccatggtgtacgacggctttaggccggaagacctaatggaggcttgtgtggagctcaccgtttgggaccactataaactcactaaccagttcctgggcggactacgtatcggcttcggaactgggaagagttacgggactgaagtggactggatggactccacttctgaggaggtggccttatgggagaaaatggttaattctccgaatacctggatagaggcgactctcccactgcggatgcttttgatcgctaagataagtaagta

SEQ ID NO: 243117 - DNA, 1098 bp, Artificial Sequence
  Description of Artificial Sequence: Synthetic coding sequence
atgagcgacgacagggagacagataccgccagcgagagtagctaccagctatcccggcataagaagagcccatcgtcgctgaccaaccttagttcttcaagtgggatgacttcactttcgagcgtttcaggatccgtgatgtctgtgtatagtggcgactttggtaatctcgaagtcaaaggtaacatccagtttgccatagaatacgtggaatctctgaaagaactgcacgtgtttgtcgcccagtgcaaggatttggcagcggctgacgtaaaaaagcagcgctctgatccttatgtgaaggcatacctcctccccgacaagggcaaaatgggaaaaaaaaagacactcgtggtgaaaaagacactgaatcccgtatacaatgagatccttaggtacaaaatagaaaaacagatcttgaagactcaaaaactgaacctttctatctggcacagggataccttcaagcgcaattctttcctgggcgaggtggaactagatctggagacgtgggattgggacaataagcagaacaagcagctccgttggtaccccctgaagcggaaaactgctcctgttgctctcgaggccgagaataggggggaaatgaagttggcactgcaatacgtgcccgagccagttccaggcaagaaattgccaaccactggcgaagtccacatttgggtcaaggagtgcttagacttgcccctgctgcgcggttctcacttaaattctttcgtcaagtgtacaatcctgccagacacctcccggaaaagtcggcagaagacaagggctgttggcaagaccaccaaccctatttttaatcacactatggtctacgacgggtttcgccctgaggacctgatggaagcttgcgtggagctgactgtctgggatcactataagctgaccaatcaattcttagggggactgagaatcggctttggcaccggaaagtcctatgggactgaggtcgactggatggactccactagtgaggaagtagccctttgggagaagatggtcaatagcccaaacacgtggatcgaggccacccttcctctgaggatgctactgattgctaagatctccaagtag

SEQ ID NO: 243118 - DNA, 2733 bp, Artificial Sequence
  Description of Artificial Sequence: Synthetic coding sequence
atgatcgatctcagctttcttactgaggaagagcaggaagccatcatgaaagtgctgcagcgagatgctgctctgaaaagagccgaggaggagcgggtgcgccacctgcctgaaaaaattaaggatgaccagcagcttaaaaacatgtcggggcagtggttttatgaggctaaagcaaaacgacaccgcgacaaaattcacggagcggacataattagggcctctatgcgcaaaaaacgcccacagatagcggcagaacaatcaaaggatagagagaacggcgcaaaggagagctgggttaataacgtgaacaaggacgcatttctgccccctgaactggccggtgttgtcgaggaacctgaggaagatgctgcccctgctagtccgagctcctccgtagtaaatccagcaagttcagtcatcgatatgtcgcaggagaacactaggaaaccgaatgtctcgcctgagaagagaaaaaaccccttcaactcctccaagttaccagaagggcactcttcacaacagaccaaaaatgaacagtcaaaaaatggcaggacggggctatttcaaacatctaaggaagatgaattgagcgagagcaaagaaaagtcaaccgtagctgacacctctattcagaagctcgaaaagtccaaacaaacgcttccaggactgtctaacgggtctcagattaaggcgcctatcccgaaggctcgcaagatgatctacaagtcaacggacctcaacaaggacgataaccagtcatttccacggcaacgcacagattcgttgaaagccaggggcgctccaagaggaattctcaagcggaacagttcaagctcctcaacagactcagaaacacttcgctacaaccacaactttgagccgaaaagcaagatagtgagcccaggattaacaatccacgagagaatttccgagaaggaacacagcctggaagacaacagcagtcccaacagcctggagcccctaaagcatgtgagattctccgcggtcaaagatgagttaccccaaagcccgggactgattcacggtcgggaggtgggcgaatttagcgttctggagtccgaccggctcaagaatgggatggaggacgcaggcgatactgaagagtttcagagtgatcctaaaccctcccaatatcgcaaaccctccctctttcatcagtcaacttcttccccctatgtgagtaagtcagaaacccaccaaccgatgacctccggaagtttcccaatcaatggactgcactcgcactcagaggttttgacagccaggcctcaatctatggagaacagtccgacaataaacgaaccgaaggataagagttcagagcttacacgactggaatccgtgttgcccagatcaccggcagacgagctgagtcattgcgtagagccagagccttcccaagtgcctgggggttcaagcagggatcgacaacagggatctgaggaagaacctagtcctgtgctaaaaactttagaaagaagtgcggctagaaagatgccgagcaagagtctggaagatatttcttcagacagctcgaaccaggcaaaggtagataatcaacctgaggagctggtgagatcggccgaagatgatgaaaagccggaccagaaacctgtgaccaacgagtgcgtgccaaggatctctaccgtgcctacacagccggacaacccattttcccatcccgacaaactgaagcggatgagtaaatcagttcccgcattcctgcaggacgaagtcagtgggagcgtgatgtcagtttatagcggagatttcggcaatctggaggtgaaagggaacatacagttcgcaatcgagtacgtggagtccctgaaggagctgcatgtattcgtcgcacagtgcaaagatcttgccgctgctgatgtcaagaaacaaaggtcagacccatatgtgaaggcctacttgctccccgacaagggcaagatggggaagaagaagacactggtggtcaaaaaaacactgaatccagtgtacaatgagattctgaggtataagattgagaagcaaatccttaagacccaaaaactgaacctgtccatttggcatcgagataccttcaaacgaaactcattcctgggcgaggtggagttagacctggagacttgggactgggacaacaagcagaacaagcagctcaggtggtatcctttgaaacgaaaaaccgcccctgtggcactggaagcagaaaaccggggagagatgaagttggctctacagtacgtccctgagcctgtgccgggtaagaagttgccgaccacaggtgaagtccacatctgggttaaggagtgcctcgatctgccccttctccgcggttcacacttgaatagcttcgtcaaatgtaccatactgcccgatacgagccggaaatctagacagaagactcgcgctgtcgggaaaaccactaatcccatttttaatcatacaatggtatatgacgggttcagacctgaagatctcatggaggcatgcgtggagctcaccgtgtgggaccactacaaactaactaaccaattcctcggcggtctgagaatcggctttggtacaggaaagagttatggtactgaggtagattggatggacagcactagcgaggaagtggccctttgggaaaaaatggttaatagtcccaatacctggatagaagccaccctcccgcttcggatgctcctgattgctaagatctcaaaatag

SEQ ID NO: 243119 - DNA, 2733 bp, Artificial Sequence
  Description of Artificial Sequence: Synthetic coding sequence
atgatagacctatccttcttgacggaagaggagcaggaagccatcatgaaggtgcttcagagagatgctgcattaaagcgagccgaggaggaacgtgttcggcacctgcctgaaaaaataaaagatgaccagcagctaaaaaatatgagcggccagtggttctatgaagccaaagccaagcgccaccgggataaaatccatggtgctgatattattcgggctagcatgagaaagaagcgtccccagattgcagcagagcaatcgaaggatcgcgagaatggggctaaagagtcttgggtgaacaacgttaacaaagacgcgttcctgccgccagagctggcaggggtggtcgaggaacctgaagaagacgctgccccagcaagcccgtctagctccgtcgttaatccagccagttccgttatcgacatgtcccaggaaaataccagaaagcctaacgtttcaccagaaaaaagaaagaacccgtttaatagctccaaactgcctgagggacactcctctcagcaaactaaaaatgagcaaagcaaaaacggaagaactgggttgttccaaacaagcaaggaagacgaactgagcgaaagcaaagagaaatccactgtcgctgatacgagtatacagaaactcgagaagagcaaacaaacactacctgggctctcgaacggtagccagatcaaggcccctatacctaaggcgagaaaaatgatttataaatcaactgatcttaacaaggatgataatcagagtttccctagacagagaaccgattctctgaaggccaggggagcaccaaggggcatcctgaagcgtaacagctcatccagctctaccgatagtgagacactccgctataatcacaactttgaacccaagtctaaaatcgtgtcgcccggtcttactattcatgagagaatttcagagaaagagcacagtctggaggacaatagctctcctaacagcctggaaccactgaagcacgtccggttcagcgccgtgaaggatgaactgcctcagtcccctgggctgatccacggcagggaggtgggcgagtttagcgtgctagagagcgaccgcctgaagaatgggatggaagacgcaggggatactgaagagtttcagtcagaccccaagcctagccagtaccgcaaacctagcctgtttcaccagtctacttcgagcccttacgtgagcaagtctgagacccaccaacctatgacctccggctcgttcccaataaacggccttcacagccacagcgaggtcctgactgcgcgtcctcaatcaatggagaactcaccgactatcaatgagccgaaggataaatcttcggagctgacccgccttgaatcagttctgcccagatcccctgcagacgagttatcgcattgtgtcgagcccgaaccctctcaggtgcccggaggtagttcgcgggatagacagcagggttcggaggaagagccaagcccagttttgaaaaccctggaacgtagcgctgctcgcaagatgcctagcaagagcttggaggacataagctcggactcatctaaccaggcaaaagtggataaccagccggaggagttagtgcgcagcgccgaggatgacgagaagcctgaccagaagcccgtcacgaatgagtgcgtgcccagaatatcaactgtgcctacacagccagataatcccttcagccatcccgataagttgaaacggatgagtaaaagcgtccccgcttttttacaagacgaggtgtctggctcagtgatgagcgtttattccggtgacttcggtaacctagaggtgaagggcaatatacaatttgccattgaatacgtcgagagcctcaaggagctgcacgtgttcgttgcccagtgcaaggacttggctgccgcagacgtgaagaaacagagatcagacccttacgtgaaagcttacctgcttcctgacaaaggaaaaatgggaaagaaaaaaacactggtagtgaagaagacattgaacccagtgtataacgagatcctgcgctataaaatagaaaagcagatcctgaagacccaaaaactgaacctgtcaatttggcaccgggacacgtttaaacggaactccttcttaggcgaggttgaactggatctcgaaacctgggattgggataataaacagaacaagcaactccgatggtatccattgaagcgcaaaaccgcacctgtggccctggaggctgagaacagaggagagatgaagctcgcacttcagtacgttccagaacccgttcctggaaagaagctccccaccacaggagaggtgcacatctgggtgaaggagtgcttagatttgcctctgctgaggggcagtcacttaaactcctttgtgaagtgtacgatcctgccagacacaagccgcaagagccggcagaaaacacgggcagtggggaagactacaaaccctatcttcaaccacaccatggtatacgatggattcaggccagaagacctgatggaagcctgcgtggaattgacagtttgggatcactacaaattgacaaaccaattcctgggcggtctgcgcatcggctttgggactggaaagagctatgggaccgaggtggactggatggattccacgtctgaagaggttgccctctgggagaaaatggttaacagccccaatacttggatcgaagccactctacctctccgcatgttgctgatcgcaaaaatatccaaatag

SEQ ID NO: 243120 - DNA, 192 bp, Artificial Sequence
  Description of Artificial Sequence: Synthetic coding sequence
atgtcaaagtcagtgccagccttcctccaggacgaatccgacgacagggagaccgacacagctagtgaaagttcctatcagcttagtcggcataaaaagtccccctccagtctgacaaacctgtctagttcctcagggatgacttcactctcttccgtttccgggagtgttatgagcgtgtattcgggctag

SEQ ID NO: 243121 - DNA, 3771 bp, Artificial Sequence
  Description of Artificial Sequence: Synthetic coding sequence
atggatgaacccaatgccgagcaggtttacaacccctctcagttcgagaatctacgtaagttttgggatctagaggccaactctaactcaaaggacaatgacaagaatataaccaccacgagccagaagaattctgctccatttaatagacaaaagcataaggaattctcagatatcaaactgagcgggaaaaacacacacgaggcagaggtgcttttgtctcccaagaaggtgatggccagagaggagatggagaaactgaactctaagggaatccttcaggtgctcccagatgagattacctttcccctcagccccttacgcaagtacacctaccagctgcctgggaatgaatctagcaaggaaaatgtggagaaaaatacggagggaatagtcacacccgtgtttaaagaagaaaaggattacagtgaacaggaaatccaggagtctattattaaaactaatgttctctcgaaagattgcaaggatactttcaacgacagcttacagaagctgctgtcagagactagcacacctgccatacagccttcaggaggcaaagtccatgggaagcaggtgctcgaaccctccgtgagcgagaatagaacctggccccagaagacagacttcgctgataccgaggaagaggtaaaaggcccagagaaaatcatcaatgaacacgtggacaaaacagtagtacacccgaaggtgaaacgcaacagccttaccgcctcgctagacaagctgcttaaggaggccaccggaacttctccgtccccactccaggctaaactagcaccagttataaccgggaccaactccaagctggaagagggtagattttttggaaagggtatcgagcagtcccacaatacgagtgccgataagagagaaattctagcccctttccccgtcagggacgagacatttggaaataccgccctacttaaaaaggctgaatcgggtgaatgtcagctctctacccagaatttgatacagatggccgctgaagactcccaccccctggaccccactagccagttaagcaggaagggatcttttggggatgtggctagccccccacaggacatgctcttccctcaggacgcccatctggttcctcaagccagagttcacccttcccagactgagatctctgaaacagtggaaaaagttattcttccaccaagacccgtgctgaatgacgtttctgcagctcttcagaaactatgtggtgaagtgtggctgagctaccctgcagggcgtgaagtcggaccaggagaagttaacccagaatttccagaagccgtccagccagtgtgttccccacttaatccacccggtgtaataagcccttgggccaccatggacacaattgtccctgaccgtaaggacttttattcaagtaatgtcgtgcccgacaaaacccacgaggtgggaagctatttagctgctcagatgtccccctccgatcagacacttagttcattcgctagcattgttgcccagtacggtaaggggctgcctcaagaggttgaagaaatcgtccgagagacaattgttcagccaaagtccgaattcttagaattttctgcaggactggaaaaactgttaaaagaggaaacagagacatttccaagcaaatacgaaagtgataccggcaatttgagcccctctaagctgataggcagtacagaggaacccaggcgtgctacttctgagtgtcatccggaagagttgaaagaaacagtggagaaggctgaagccccactcatcacagagtcagcgtttgatgccggtttcgaaaaattacttaaggaaatcaccgaggctccaccttatcagccacaggtgtcagttcgtgaagagacacatgagaaggagagcagtcaatctgagcagaccagatttctagggaccgtcccacacttttaccgcgcagcctcccagacatcggaaatgaaagataagagcaatgggttggagtcccaggtgaaccagtgtgataaaatgcttggcggagatgcattggttactgatctgctggtggacttctgtggatcccggtctggggtggagattcctcggacccctcagctgtatgtggctcacgagataggcaccataaaaaccgtgacaccgcctgaggaccgagattcggaaagcggtgtggccggaggtcaaggaaccctgcaggagccgggatttggtgaagcctcagaagctatttctgtgagccgtaatcgccagccgattcccctacttatgaataaggagaatagtaccaaaacatccaaggtggagctgaccctggccagcccgtacatgaaacaagagaaagaggaggagaaagagggattttcagagtctgatttctccgacggaaatacctcctccaatgcggaatcctggcgtaacccatcttcttccgaagaagaaccctcgccagtcctgaaaacactggaaagatctgccgcacgtaagatgcccagcaaatcccttgaagacatcagcagcgatagttctaaccaggccaaagtcgacaatcagccggaggaacttgttagatccgctgaggatgtctccacagttcctactcaacctgataacccttttagccatcccgataaattgaaacggatgagcaagtcagtcccggcatttctgcaggacgaatccgacgaccgcgagactgacacagccagtgaaagtagctaccagctgtctcggcacaagaagagcccttcatcgctgacaaatttaagttcatcatccggcatgaccagcctgagctcagtgtcaggctcggtcatgtctgtgtacagcggcgattttggaaatctggaggttaagggcaatatacagtttgccatcgaatatgtggaaagcctgaaggagttacacgtctttgttgcccaatgcaaagacttggccgcagccgacgttaaaaaacagagaagtgatccctacgtgaaggcctacttgctccctgataaaggtaagatggggaagaagaaaacactcgtcgtgaagaaaacactgaacccagtgtataatgaaatattaagatataagatcgaaaaacagatattgaaaactcagaaactgaacctctctatctggcacagagatacgtttaaaaggaatagcttcctcggtgaggtggaattagatctggagacctgggattgggacaataaacagaacaaacagctgcgttggtaccccctgaaaaggaaaaccgctcccgtcgctctggaggccgagaatcgaggcgagatgaaactggctctacaatacgtccccgaacccgtccccggtaaaaaactccccaccaccggggaggtacacatctgggtcaaagaatgtcttgaccttcctttgttgcgagggagccacctcaacagttttgttaagtgtaccatcttacccgacactagccgaaagagtcgacagaagactagagcagtcggcaagacaactaatcctatcttcaatcacactatggtatatgatgggtttcggccagaggacttgatggaggcatgtgtcgaacttacagtctgggatcactacaagctcaccaaccagttcctcggaggactacggatcgggttcggcacggggaaatcttatggtaccgaagtcgactggatggactcaacaagcgaggaggtggccctgtgggaaaaaatggttaattcgccaaatacatggatcgaggctaccctccccctgcgtatgttgcttatagcgaaaataagcaaatag

SEQ ID NO: 243122 - DNA, 1131 bp, Artificial Sequence
  Description of Artificial Sequence: Synthetic coding sequence
atgtcaaagagtgtccccgcattcctgcaggacgaaagcgacgaccgggaaacagacactgcgtctgaatcttcgtaccagctttctaggcacaagaagagtccttcatcgttgaccaacctctccagcagctccggcatgacatcgctgtctagcgtttcgggttccgtgatgagtgtatattcaggcgacttcggcaacctcgaggttaaagggaatatacaattcgcgatcgagtatgtcgagagtttaaaggaactacacgtgttcgtggctcagtgtaaggaccttgctgccgcagatgtgaaaaagcagagatctgacccttatgtgaaggcctatttgctcccggataagggcaagatggggaaaaaaaagaccttagtcgtgaagaagacacttaatccggtgtataacgaaattctgagatacaagatcgagaaacagattctgaagacccaaaagctcaatctctcgatatggcatagagatactttcaagagaaactcattcctcggtgaggtggagcttgatctggaaacatgggattgggacaacaaacaaaacaagcaattgcgctggtacccgcttaagcggaaaaccgcgccagtggccttggaggccgagaatcgcggagaaatgaagctggctcttcagtatgtgcccgaacctgtccccggtaaaaaattaccgactactggcgaggtgcacatctgggtgaaagagtgtctggatctgccgttattaaggggctcccacctgaattcttttgttaagtgtacgatcctgcccgataccagtcgtaagagcagacagaaaaccagggctgtgggcaaaactaccaacccaatcttcaaccatacaatggtgtacgatggtttcagaccagaggatctgatggaggcctgcgttgagttaaccgtgtgggaccactataagttgaccaaccagttcctcgggggtctgaggatcggattcggcactggaaagtcgtatgggacagaggtggactggatggactcaactagtgaagaggtagcgctatgggaaaaaatggtgaacagtcccaatacttggatcgaggccacgctaccccttagaatgctgttgattgctaaaatttcaaaatag

SEQ ID NO: 243123 - DNA, 312 bp, Artificial Sequence
  Description of Artificial Sequence: Synthetic coding sequence
atgagcaagagcgtacccgcatttctccaagacgagtctgacgatcgcgaaacggataccgcctccgagagctcataccagctttctaggcacaagaagtcccccagcagcttgacgaatctgtcttcaagttccggtatgacatccctgtcctcggtttcaggtagcgttatgtccgtgtacagcggcgacttcggcaacctcgaggttaaggggaatatacaattcgctattgagtacgttgaaagcttgaaggaattgcacgtgttcgtggcccaatgtaaggatttagctgctgccgacgtcaaatag

SEQ ID NO: 243124 - DNA, 2709 bp, Artificial Sequence
  Description of Artificial Sequence: Synthetic coding sequence
atgtccgggcagtggttctacgaggcaaaggccaagaggcaccgggacaaaatccatggcgctgacataatcagggccagcatgagaaagaagcggccacaaatcgcagccgaacagtccaaagatagagaaaacggagcaaaggaatcttgggtcaataacgtgaacaaagacgctttcctaccacctgaactggcgggagttgtagaagagcctgaagaggatgccgctccagcctcgccttcgtcaagtgttgtgaatcccgcttcatcggtgattgatatgagccaggagaacacacggaagcctaacgtgtccccagagaagcgaaaaaatccgttcaacagctcaaagctacccgaaggccatagttctcaacaaactaagaatgaacagtcaaagaacggaagaacaggactcttccagacttccaaagaggatgaattgagcgaatctaaggagaagagcacagtggctgacacatccatccagaagctggagaaatcaaaacagaccctccccggactctccaatgggtcacagatcaaggcacccatccccaaggctcggaaaatgatttataagagcaccgatctgaacaaggatgacaatcaaagcttcccccgtcaacggacagacagccttaaagcacgcggagctcctcgcggtatcttaaagagaaactccagctccagctcaaccgactccgaaacactgaggtacaaccacaacttcgagccaaagtccaaaatcgtatcccccggactcaccatacacgagcggatctcagaaaaagagcattctcttgaagacaacagttcaccaaactccttggagcccctaaagcacgtccggttcagcgccgtaaaggatgagctgcctcagtcacccggtctcattcatggacgcgaggtgggcgaattttccgtgctagaaagtgacaggctgaagaacggaatggaggacgccggtgacacagaagaatttcagtctgacccgaaaccgtctcaataccgtaaaccaagtctgttccaccagagcacctcttccccctatgtgagtaagtcagagactcaccagcccatgacttccggttcatttccgatcaatggcctccattcgcacagcgaagtgctgactgctcgtcctcagtcgatggagaacagtccaactattaatgaacccaaggacaagagttccgaactcactagactggaatccgtcctgccacgtagccccgctgatgaactcagtcactgcgtcgaaccggagccatcccaggtgccaggcggatcctcccgcgaccgtcagcagggatcagaggaagagcctagtccggtgcttaagacattagagcgctccgctgcccgtaagatgccttcgaagtctctggaggatatcagcagcgacagctcaaatcaggccaaggtcgataatcagcccgaagaactggtgaggagtgctgaagatgacgaaaaacctgaccagaagcccgtgacaaatgagtgtgtgcctcgaataagtacagtccctacccagccggataatcccttcagccaccccgacaaactgaagcgaatgtcaaagagcgtgccagccttcttacaagacgaaagcgacgacagggagacagatacagcttcagagtcttcttatcaactttctcgacacaagaaatccccatcttcacttaccaacctgtcatcaagctccggtatgacatctctgtcgtcagtatccggctcagtgatgagtgtgtactccggggatttcgggaatctggaagtaaagggaaacatccagtttgccatcgaatatgtggagagtctcaaagagcttcacgtcttcgtcgcccaatgtaaggacctcgcagcagcagacgtgaaaaagcagaggtcagatccttacgtcaaggcttaccttctgcctgacaaagggaaaatgggtaagaaaaagacactcgtcgtcaagaaaacactgaacccagtttacaacgaaattctccgttataagatagaaaagcagatcctgaagacgcagaagttgaatctgtccatatggcatcgcgacacctttaaaagaaactctttccttggcgaggtcgagctcgacctcgaaacatgggactgggataataagcagaataagcaacttaggtggtatccattgaagcgaaagactgctccagtggccctggaggctgagaataggggggaaatgaagttggctctgcaatacgtaccagaacctgtgcccggaaagaaactgccgaccaccggagaagttcacatctgggtgaaagagtgtctcgacctgccgctgctgagaggaagccaccttaactccttcgtcaagtgtaccattttgcctgacacgtctcggaagagtcgtcagaaaacccgagctgtgggaaagaccaccaacccgatctttaatcacacgatggtttacgacggcttccgaccggaggatctgatggaggcttgtgtggagttaaccgtgtgggatcactacaaactgaccaatcagttcttgggcggactgaggatcgggttcggtaccgggaagtcgtatggaaccgaagtagactggatggactcaacttccgaggaagtcgccctctgggaaaagatggtcaatagtcccaacacttggatcgaggctacacttcctctccggatgctgcttatcgccaaaatcagcaagtag

SEQ ID NO: 243125 - DNA, 483 bp, Artificial Sequence
  Description of Artificial Sequence: Synthetic coding sequence
atgtctaaaagcgtacctgcattcctgcaggacgaggtgtccgggtccgttatgtcagtatactcaggggactttgggaacctcgaggtgaagggaaatattcagtttgccatcgagtatgtcgagtcattgaaggagctgcacgtcttcgtcgcgcaatgtaaggacttggccgctgccgacgtgaagaagcagcgcagcgacccatacgtgaaagcgtacctgttacctgataaaggcaaaatgggcaaaaagaagacactggtggtgaaaaagaccttgaatcccgtgtacaacgagatccttaggtacaaaattgagaaacagatcctgaaaactcaaaagttgaacctcagtatctggcatagggatacattcaagagaaatagtttcttaggtgaagtcgagctggacctggagacctgggactgggataacaagcaaaataagcagcttcgctggtaccccttaaaacgaaaatag

SEQ ID NO: 243126 - DNA, 2805 bp, Artificial Sequence
  Description of Artificial Sequence: Synthetic coding sequence
atgatcgatttgagttttcttacggaggaagaacaggaggccatcatgaaagtgctacagagggatgcagcgttgaagcgagcagaggaggagcgagtccggcacttgcccgaaaagataaaggacgatcagcaactgaaaaacatgtcagggcagtggttttatgaggcaaaggccaaaagacaccgggacaagattcatggcgctgacattatccgggctagtatgcgaaagaaacggcctcagatcgccgctgagcaatccaaggatcgggaaaacggtgcaaaggagtcttgggtgaacaatgttaataaggacgcttttctacccccagaacttgccggagttgtggaagagccggaggaagacgctgcacctgcttccccaagcagctcggtggtcaatcccgctagttccgtgattgacatgtcccaagaaaacacacggaagccaaacgtgtctcccgaaaagaggaagaacccttttaactcctcgaagctgcccgagggtcattcctctcaacagaccaagaatgaacaatctaaaaatggccgtacaggtctattccagacttctaaggaggacgagctatcggagtcaaaggaaaagtccaccgtggcagacacaagtatccagaagctggaaaagtctaaacagaccctcccaggcctctccaacggctcccagattaaggcccctatcccgaaggcccgtaaaatgatatacaaaagcacagacctaaacaaggacgacaaccagagttttccgcgtcaaagaacagactcgttgaaagccaggggtgcgcctcggggtatcctcaagagaaactcctcctctagctctacagactccgaaaccctgaggtacaatcacaatttcgaacccaaaagcaagattgtgagtccaggcctcaccatacatgaaagaatttcagagaaggagcactccctagaagataatagctccccaaactccttggagcccctgaagcatgtaagatttagcgcggttaaagacgaactgccccagtcgcctggcttaattcatggcagggaagtgggagagttctcagtgctggagagcgatagactgaagaacggcatggaggatgccggagatacggaggaatttcagtccgacccaaaaccatcccagtacagaaaaccatcactgttccaccaatctaccagcagcccttacgtgtctaaatcggaaacccatcagcctatgacaagtggatcattcccaattaacggcctacacagccattcagaagtgcttacagctaggcctcaatctatggagaacagcccaacaattaatgaacctaaggataagagcagtgagctgactagactcgaatccgtactaccgagatcccccgctgatgagctgtcacactgtgtggaacctgagccaagtcaagtgcctggcggtagctctagagacaggcagcaagggagtgaggaggagccttcgccagtgctcaagacactcgagaggtccgccgcacgtaagatgccgtctaagtcactggaggacatatccagtgacagttcaaaccaggcaaaagtggataatcagcccgaggaactggtgcggagcgccgaggacgtttcaacagtccctacccagcctgataatccattttcgcaccccgacaaactaaaacgaatgagcaagagtgtgcctgcgtttcttcaggacgagtcggatgatcgtgagactgacacagcgagcgagtcttcttatcaactctcccgccacaagaagtcaccttcctcactgactaatctgtcatcttcctctggcatgacctctctgtcgagcgtgtcgggttcagtgatgtctgtctacagcggcgatttcgggaatctagaggtcaagggaaatatccaatttgcgatcgagtatgtggagtctctgaaggagctgcatgtctttgtcgcacagtgcaaggatctcgctgccgctgacgttaagaagcaaagatccgatccctacgtcaaggcctatctgctgcctgacaaaggcaagatgggaaaaaaaaagactctggtggtgaaaaaaactttgaaccctgtgtacaatgagattctgcgctacaaaatcgagaaacagatactgaaaacccaaaagcttaatctgagcatatggcaccgtgataccttcaagaggaatagcttccttggcgaagtggagttagatttggaaacctgggattgggataataaacaaaataagcagctgaggtggtatccactcaagagaaagacagcccctgtagcgctggaggcagaaaatagaggggagatgaagctggcgctccagtacgtgcctgaacccgtgcctggcaagaagctcccaactacaggcgaggtgcatatctgggtcaaagaatgtctggacctccccctgctgcggggaagccacttaaattccttcgtgaagtgtactatattgccagatacgagcagaaagtctcgacagaaaacaagagcagttggtaagacgacaaatcctatcttcaaccacacaatggtttacgacgggtttcgcccagaagacctgatggaagcctgtgtagagctcaccgtttgggatcactataagcttacgaatcaattcctgggaggcttgcgaatagggttcgggactggcaaatcatacggcacagaagtggattggatggatagcacatccgaagaggttgccctttgggagaagatggtgaactctcccaatacatggatcgaggccacactcccacttcgcatgctcttgatagctaagatttcaaaatag

SEQ ID NO: 243127 - DNA, 468 bp, Artificial Sequence
  Description of Artificial Sequence: Synthetic coding sequence
atgtccaagagcgttcctgcatttctgcaggatgagagcgatgacagggaaaccgacaccgctagcgagagctcgtaccaactatcgaggcacaagaaaagcccgagtagtctaacaaacctgagttcaagcagcggtatgactagcctcagttccgtttctggctccgtaatgtccgtttactctggggactttggtaatcttgaggttaaaggaaacattcaattcgccattgagtacgttgagagtttgaaagagctccatgtgtttgtggctcaatgcaaagatctggctgctgctgatgtcaaaaagcagcgcagtgatccatacgtcaaggcatacctcctgcctgacaaaggcaaaatgggtaaaaagaagaccttggtcgtgaaaaaaacactaaatccagtttacaatgagatcctacggtataagatcgaaaaacagattctcaaaacgcagaaatag

SEQ ID NO: 243128 - DNA, 1131 bp, Artificial Sequence
  Description of Artificial Sequence: Synthetic coding sequence
atgagcaaatcggtcccagccttcctgcaggacgaatccgatgacagagagacagacacggcctctgaaagcagctatcagctgtcccggcataaaaaaagcccatcctccctgaccaacctctcttcctcatccggcatgacttctttatcatccgtttcaggtagtgtgatgtccgtctactccggcgatttcgggaatctggaggtgaaagggaatattcagtttgctatcgagtacgtagagtcactaaaggagttacacgtcttcgtcgcgcagtgtaaagatctagccgctgcggacgtgaagaaacaacgttcggatccatatgtaaaagcctatctgctgcccgacaagggcaagatgggcaaaaagaaaaccctggttgtcaagaaaacactcaaccccgtgtacaacgaaatactccggtataaaatcgaaaagcagatactcaagactcagaagcttaatctatcgatctggcaccgggataccttcaagcgaaatagctttctgggcgaggtggagctcgatttagagacctgggattgggacaacaagcagaacaagcagctcagatggtaccctctcaagcgaaaaacagcaccagtagcccttgaagcagaaaacagaggtgagatgaaactggctttacagtatgtcccggagccagtccctggtaaaaagctccctaccactggtgaggttcatatctgggttaaggagtgcctggacctgccacttctccggggtagtcacctgaacagctttgtaaaatgcactattctcccagacactagcagaaagtcccgccagaaaactagagcggttggaaagaccaccaatcctatcttcaatcacacaatggtttacgacggtttcagacctgaggatcttatggaggcttgtgtcgagctgacagtgtgggaccactacaagttaactaaccagtttttggggggattaagaattgggttcgggacaggcaagtcctacggcacggaggtagactggatggattccacatcagaagaagtggccctttgggaaaaaatggtgaattccccgaatacttggattgaggctaccctacccctgcgcatgcttttgattgccaagataagtaaatag

SEQ ID NO: 243129 - DNA, 1956 bp, Artificial Sequence
  Description of Artificial Sequence: Synthetic coding sequence
gaaactgttgagaaggctgaagcccctctgataaccgaaagcgctttcgatgctggattcgagaaattattgaaggagattactgaagccccaccttaccagccacaggtttccgtgagggaggaaacccatgagaaggaaagttcccagagcgagcagacccggttcctgggaaccgtgccacacttttacagggccgcatcacagacatcagaaatgaaagacaagtctaatggcctggagtcacaggtcaatcaatgcgacaaaatgctgggcggtgatgcccttgtgaccgacctacttgtggatttctgcggctcgaggtcaggtgtcgaaatccctcgaacgccacagctttatgtggcccatgagataggaacaatcaagacagtcactcctccagaagatcgagactctgagagcggggtggctggcggacagggcactctgcaggaaccgggatttggggaagcttcggaagcaatcagtgtatcacgaaatcgacagccaattcccctgctcatgaataaagaaaatagcaccaagacatccaaggtggaactgacactggcgagtccttatatgaaacaggaaaaggaagaagaaaaggaggggttttcagaatctgacttctcagacggaaatacttcatcgaacgccgaatcttggaggaatccctcaagttccgaagaggagccttcgcccgtgttaaaaacactggaacgatctgccgctcggaaaatgccttcaaagtcgctggaggacatcagttctgacagctcaaaccaggctaaggtcgataatcagcccgaagagttggttcgatccgcggaagacgacgaaaaacctgatcagaaacccgtgactaatgaatgtgtgcccaggatttcaaccgtaccaactcagcctgataatcctttttctcaccccgataagctgaagcgtatgagcaaatccgtgcctgcttttctgcaggatgaggtaagtggatctgttatgtctgtgtactcaggtgatttcgggaatcttgaagtgaaggggaacatccaattcgcaatcgagtacgtcgaatctctcaaagaactgcacgtcttcgtcgctcagtgcaaagacctggccgcagcggatgtcaagaaacagcggagcgacccatacgtcaaggcttaccttctcccagataagggcaaaatgggtaagaagaaaacactcgtcgtgaagaagactctaaatccggtgtacaacgagattctcagatacaaaatcgaaaagcaaatcctgaaaacacagaagcttaatcttagcatctggcacagagacactttcaaaagaaatagtttcctcggggaagtggaactcgatttagagacttgggactgggataataagcagaataagcagctgcgatggtaccccttgaaacgaaagactgcccctgttgccctagaggctgaaaatcgaggtgagatgaagctcgctctccagtacgtcccagaacctgtgccgggaaagaagttacccacaaccggggaggtgcacatctgggtgaaagagtgtctggaccttcccctcctgcgaggaagtcatttgaacagttttgtgaagtgcacaattctgcctgataccagcaggaagagccggcagaagactagggctgttggcaagactacaaacccaatcttcaatcatactatggtttatgacgggtttaggcccgaggatctaatggaagcctgcgttgagctgacagtctgggaccattacaaactcactaatcagttccttggcggacttcgcatcggatttggcacaggaaaatcttatggcactgaggttgattggatggactccactagtgaggaagtcgcattatgggagaagatggtgaattcacccaatacttggattgaagctacacttccactgagaatgctcctcattgcaaagatcagcaaatag

SEQ ID NO: 243130 - DNA, 213 bp, Artificial Sequence
  Description of Artificial Sequence: Synthetic coding sequence
atgagtaagagtgtgcctgcttttctgcaagacgagagcgacgacagagagacagacaccgcgtctgaatctagctaccagttaagccggcataaaaaaagtccatcgagcttgactaacctgagctcctcgtccggcatgactagcctgtcttcagtgtccggatcagtcatgtcagtgtatagtggggacttcgggaacctggaggtgtag

SEQ ID NO: 243131 - DNA, 1011 bp, Artificial Sequence
  Description of Artificial Sequence: Synthetic coding sequence
atgtccaagtctgtgcctgcttttttgcaggacgaagtgagtggctccgtgatgtctgtttactccggggactttggaaatctcgaggttaaaggaaatattcaatttgccatcgagtacgtcgagtccttaaaggagctgcatgtgtttgtcgcacagtgtaaggacctagctgctgcagatgtaaagaaacagcggtcagatccttatgtgaaagcttacttacttcctgacaagggaaagatgggtaagaaaaaaacactggttgtgaagaaaactctgaatcctgtatacaacgaaatcctgcgctataagatagagaagcagattttgaagacgcagaaactgaatctcagtatatggcatagagatacatttaagcgcaacagcttcctgggagaggtggaactggatctcgaaacctgggactgggacaataagcagaacaagcagcttcggtggtatcccctgaaaagaaagacagcccctgtggccctggaagctgagaacaggggggagatgaaattggcgctccaatatgtgccagaacccgtgcccggtaagaaactccccactacaggagaagtccacatatgggtcaaagagtgtctggacctgcccctcttaaggggctcccatctcaactccttcgtgaagtgcactattctcccagacacatctaggaaaagccgccaaaagacccgggcagtgggtaaaacaaccaaccccatttttaatcatactatggtctatgatgggttcagaccagaggatttgatggaagcatgtgttgaattaaccgtttgggaccactataaactgacgaatcagttcctgggcggtctcagaatcggcttcggcacgggcaagtcttacggcacagaggtcgactggatggactccaccagtgaggaagtggctctctgggaaaagatggtaaactccccaaatacctggattgaggccactctgccccttcggatgcttctcatcgccaaaattagtaagtag

SEQ ID NO: 243132 - DNA, 2016 bp, Artificial Sequence
  Description of Artificial Sequence: Synthetic coding sequence
atgtccgagctccttgacctgtccttcctgtcggaggaggaaaaggatctcattctgtccgtgttgcaaagagatgaagaagtgaggaaagccgatgagaagcgcatacgaagactaaagaacgaactgcttgagattaaacgtaaaggggctaaacgagggtcgcaacactattccgacagaacttgtgctaggtgtcaggagagtctaggaaggttgtctcccaaaaccaatacatgcaggggatgtaaccatctggtgtgtagagattgtcgaatccaggagagcaacgggacttggaggtgcaaagtttgcgctaaggagatcgagttaaagaaggccactggagattggttttacgaccaaaaagtcaaccggttcgcctaccggactggtagcgaaataattcgaatgagccttaggcataaaccagcagtgagtaagcgggaaaccgtcgggcagagtctgttgcaccagacccaaatgggagatatatggcctggcaggaaaatcatccaggaaagacagaaagagcccagtgttctgttcgaagttcccaagctaaagtcaggaaagagcgccctggaagctgagtcagagagcctagattcttttacggctgattctgacagtacatcccgtagggatagtctggacaaatctgggctgttcccagagtggaaaaagatgtcagcacctaagagccaggtagagaaagagacacaaccaggaggtcaaaacgttgtttttgtggacgaaggcgagatgatattcaaaaagaacacacgaaagattctcaggccttctgagtatactaaatctgtgatcgatctgcgaccagaagacgtggtacacgaatccgggagtttaggcgaccgttctaagagcgtgcccggattaaatgtggacatggaagaggaagaggaagaggaggacatcgaccatcttgtcaaattacaccggcaaaagcttgccaggagttccatgcaatccgggagcagcatgagtacaatcggttcaatgatgagcatctactcggaggcaggggattttgggaacatctttgtaacaggtcggatcgctttttcacttaagtatgagcagcaaactcagtcccttgtggttcatgtgaaggagtgccaccagctcgcctacgccgatgaggccaaaaaaaggagcaatccttacgtgaaaacttatctactccctgataagtcccggcaaggcaagcgaaagacttcaatcaagcgggataccatcaaccccctgtacgatgaaacactgagatacgaaatacctgagtctctccttgcccagcggacactgcagttctcggtttggcatcacggccgatttgggaggaacacctttctcggagaagcagaaatccagatggattcttggaaactggataagaagttagatcactgtctccctttacatggtaaaattagtgccgagtctcccacaggcttgccttcccacaagggagaacttgtggtgtctcttaagtacattcccgcatccaaaacgcccgtggggggtgaccgaaagaagtctaaagggggagaagggggagagctgcaggtgtggatcaaggaggcaaagaacctgactgccgctaaggccggaggcaccagcgacagcttcgtaaagggatacctccttccaatgcgcaataaagctagtaagcgcaaaacgcccgtgatgaaaaaaacattgaaccctcattataatcatacctttgtctacaatggcgttcgcctggaggacttgcagcacatgtgcctggaactgaccgtctgggaccgggagcccttggcgagcaatgactttctgggtggcgtacggctgggggtcgggacaggaatctccaacggggaggtggtcgactggatggattccactggagaggaagtgagcctgtggcagaaaatgcggcagtatcccggaagctgggccgaagggaccttacagctgcgaagtagcatggctaagcagaagctcgggctctag

SEQ ID NO: 243133 - DNA, 2016 bp, Artificial Sequence
  Description of Artificial Sequence: Synthetic coding sequence
atgagcgagctgctagacctgtcttttttgtcggaagaagagaaggatctcatcctttcagtcctgcagagagatgaagaggtgcgcaaggccgacgagaaaagaatccgacggcttaaaaatgagctgctggagattaaacgtaaaggggctaaaagaggcagtcagcactacagtgataggacgtgtgcacgatgtcaggagagccttgggagactgtccccaaaaaccaacacctgcaggggctgcaaccacctcgtgtgcagggattgccgcatccaggagagtaacggtacatggcgctgtaaggtctgcgcaaaggagatcgaactgaagaaggcgacgggtgactggttctatgatcagaaggtgaatcgctttgcttacagaactggtagtgagattattaggatgtctctcagacataagccagctgtcagtaagagggaaacggtgggtcaatctcttttgcatcagacacagatgggcgatatctggcctggacgcaagataattcaggagaggcaaaaggagccttctgtcctgtttgaagtcccgaaactgaaaagcggcaaatctgccctagaagccgaatcagaaagtcttgactccttcacggccgacagcgacagcacatccagaagggactctttggacaaatccggcctctttcccgaatggaaaaaaatgtccgcccctaagtcccaggtggagaaggaaacgcaacctggcggtcagaacgtggtgttcgtggacgagggggaaatgatcttcaaaaagaatactcgcaaaatcctgagacctagtgaatataccaagtccgtcatcgatcttcggccagaagacgtggtgcacgagagcgggtcgctgggcgatagatccaagagcgttcccggtcttaatgtagacatggaggaggaagaggaagaagaggatatcgatcacctggtgaagctgcaccgccagaagctggccaggagttccatgcagagcgggtcatccatgtccacgatcgggtcgatgatgagtatctactccgaagcaggtgacttcggcaatattttcgtcacgggcaggatcgctttttcattgaaatatgagcagcagacccaaagtctggttgtgcatgtaaaggaatgtcatcagctagcctacgccgatgaagccaagaagcggtctaacccatatgtgaaaacatacctgctccctgataagagccgccagggaaaaagaaaaacaagcattaagagggatacaatcaatccgctatacgacgaaaccctgcggtatgaaatccctgaatcactcctggcccagagaactcttcaattttcggtgtggcatcatgggaggttcggcagaaatactttcctgggggaggccgagattcaaatggattcgtggaagctggacaagaagttggaccactgcctgccactgcatggtaagatctcagccgagtcccctaccgggttaccctcccataaaggagaactggtcgtgtctttaaagtatatccctgcgagcaagacacccgtcggtggcgatcggaaaaagtccaaaggtggggaagggggagaattgcaggtgtggattaaggaagcaaagaacctgacggccgctaaggccggaggaacgagtgacagtttcgtcaaaggctatctgctgccaatgaggaacaaggcgtctaaaaggaaaacacctgtaatgaaaaagaccttaaaccctcattacaaccatacattcgtgtacaatggagttcgcctcgaagatctgcagcacatgtgcctggaattgacagtctgggatagagagcctctggcaagtaatgattttttggggggagttaggctgggggtgggcaccggaatttcaaatggggaagtcgtcgattggatggacagcacaggtgaggaggtgtctctgtggcagaaaatgcgacaatatcctggcagttgggccgaagggaccctgcagctgcggtcttccatggcaaaacaaaaattgggcttatag

SEQ ID NO: 243134 - DNA, 1050 bp, Artificial Sequence
  Description of Artificial Sequence: Synthetic coding sequence
atgtccgagctgctggaccttagcttcttgtccgaagaagaaaaagatctaatattgagtgtgctgcaacgggatgaggaggtgcgcaaggcagatgagaagaggattcggcgactgaaaaatgagttgttggaaattaagaggaagggagccaagcggggatctcagcactatagtgaccgcacttgtgccaggtgccaggagtctttaggtcggctgtccccaaaaacaaacacttgtcggggttgtaatcatttggtttgcagagattgccgtattcaagagtcaaatggaacttggcggtgcaaggtgtgcgctaaagagattgagctaaagaaagcaacgggagactggttctatgatcaaaaggtgaaccggtttgcttaccgaaccggtagcgaaatcattagaatgtcactgcgtcataaacctgccgtgagtaagcgggaaacggtcggacagtcgcttctccatcagacccagatgggcgacatatggccaggcagaaaaattatccaggaacggcagaaggaaccatcagtgttgtttgaagtcccaaagctgaagtccggaaaaagcgctctcgaagctgagagcgagtctctggattctttcactgcagactcagattccactagcagacgggattcccttgataaaagcgggctgttccctgagtggaagaaaatgtctgcacccaagtcacaagtcgagaaggaaacccagcctggcggacagaatgtggttttcgttgatgagggcgaaatgattttcaagaagaatacgaggaagattctccgccctagcgaatatactaaatctgtcattgatctgcggccagaagatgttgtgcatgaaagcggatctctgggcgaccggtctaagtccgttcccggactaaatgttgacatggaagaagaggaggaagaagaagacatagaccatctggtgaagctgcaccgtcaaaagctcgctaggagtagtatgcagagcggctcaagtatggtgtcctcaattagatccgtggtgacaggtatgttaggatactag

SEQ ID NO: 243135 - DNA, 2016 bp, Artificial Sequence
  Description of Artificial Sequence: Synthetic coding sequence
atgagtgagctcctcgacctgagtttcttgagtgaggaagagaaggacctcattctgtccgttctccagagagatgaggaagtgcgcaaggcagacgaaaagaggattcggagactcaaaaacgagctcctcgaaatcaagagaaaaggggcaaagcggggatcgcagcattatagcgatcggacctgcgccagatgccaggaaagccttgggagattgagtcccaaaaccaacacctgtcgaggctgcaatcacctggtgtgccgcgattgtcgcattcaggagtctaacgggacatggaggtgtaaagtgtgtgctaaggagatagagctgaaaaaggccactggagattggttttatgatcagaaagtgaataggtttgcttacaggacaggaagtgagattatacgtatgtctctgcgccacaagcctgcggtctccaagagagaaaccgtcgggcaaagcttattgcaccagacccagatgggagacatctggccgggaaggaagattatccaagagcggcaaaaagaaccatctgtgctgttcgaggtgccaaagttgaagagcggaaagtccgctcttgaagccgaatctgagtccctggactccttcaccgccgattctgactctactagtcggagggattctctggacaagtccggtcttttccctgaatggaaaaaaatgagtgctccaaagagtcaagtggagaaagagacacagcccggagggcagaatgtcgtgttcgtggatgaaggggagatgattttcaagaaaaacactcggaagattttgagacctagtgagtacactaaatctgtgattgatctgcgccctgaggatgtcgtgcacgagtcaggatctctcggagataggagcaagagcgtgccaggcctaaacgttgacatggaggaggaagaagaggaagaggatattgatcacctggtgaagcttcaccgccagaaactcgcacggtcctcaatgcagagcggctccagcatgtctacgatcggctccatgatgtcaatttacagcgaagcaggtgacttcggaaacattttcgttaccggccgaatcgctttttctctgaaatacgagcagcagacacaaagcctggtggttcacgtgaaggagtgtcaccagttggcctacgctgacgaggccaagaaacgctctaacccatacgtgaaaacctacttactgcctgacaagtcacgccagggtaagcgtaaaacatctattaaacgcgacactatcaacccactgtacgacgagacactaaggtacgagattccagaatccctgttggcccaacgcacgctacaattttcagtatggcatcatggacgcttcgggcgaaacacgttcctgggggaggccgagatccagatggactcctggaagctcgacaaaaaattggatcattgcttaccccttcacggaaaaatttctgccgagagcccaactgggctcccatcccacaagggtgagctagtggtttccctgaagtatattcctgcatcgaaaactcccgtggggggagaccgtaagaagagtaaagggggagagggaggggagctccaagtatggatcaaagaggccaagaatctcactgcagctaaggcgggaggaaccagtgacagcttcgtaaaggggtacctactgccaatgagaaacaaggcttccaagagaaaaactcccgtgatgaagaaaactctcaatccgcattataaccatacattcgtgtacaatggcgtcagactcgaagacctgcagcacatgtgtctggagctgacagtgtgggaccgtgagccacttgcaagtaatgattttctgggaggtgttaggctcggggtcggcacaggaatcagcaacggcgaagtggtggactggatggatagcaccggtgaggaagtgtctctctggcaaaagatgcgccaataccctggcagctgggccgagggtaccctgcagctgagaagcagcatggctaaacaaaaactgggattgtag

SEQ ID NO: 243136 - DNA, 2022 bp, Artificial Sequence
  Description of Artificial Sequence: Synthetic coding sequence
atgtccgagctcctggacctctccttcctgtccgaggaagagaaggatttgatcctgtctgtgctacaacgcgacgaagaggtgaggaaggccgacgagaagcgtatcaggaggcttaagaatgagctactggagattaagagaaaaggggctaaaagaggatctcagcactacagcgaccgcacctgtgccaggtgtcaggaatcactgggtcggttatccccaaaaaccaacacctgtcggggttgtaatcacctcgtatgcagggactgccgcatccaggagtcgaacgggacctggagatgtaaagtctgtgccaaagaaatcgaactaaaaaaagctaccggcgactggttctatgaccagaaagtgaacagattcgcctacaggacaggaagtgagatcatccggatgtcacttagacacaagcctgcagtaagcaaaagagagacggtgggccagtccttacttcaccagactcagatgggagatatctggccgggaaggaaaatcatacaggagcgccagaaggaaccatcgagtgtactgttcgaagtaccaaaacttaagagcggaaaatctgctcttgaagcagagtctgagtcattagactctttcaccgcagacagcgacagtacaagccggcgagactccctcgataagtcaggtctttttcccgagtggaaaaaaatgtccgcccctaaaagccaagtggaaaaagagacccagccaggcggtcagaatgtggtctttgttgacgaaggtgagatgattttcaaaaagaatacacgaaagattctgcgtccctccgaatatacaaagtcagtgatcgatctgaggccagaggacgtcgtgcacgaaagcggttcgctgggtgacaggagtaagagtgtgccgggtctgaacgtggacatggtggaggaggaagaggaggaagaggatatcgaccacttggttaagttacaccggcagaaactggcccgaagcagcatgcagtccggctcttccatgtccactataggcagtatgatgtccatctactccgaagccggagactttggcaacatattcgtcacaggccgtatagctttcagtctgaaatacgagcagcagacacagtccctggtggtgcacgttaaggaatgtcatcaactggcctacgcagacgaggccaagaaaagaagtaatccctacgtgaagacctatctgcttcccgacaaatcacgacagggaaagcgcaagacatctattaaaagagacacaatcaacccattgtatgacgaaactctcagatatgagatccctgaaagcctgctcgctcagcgcaccctacaattcagcgtgtggcaccacggcaggttcggtaggaatacgtttctcggtgaagccgagatacagatggacagctggaagcttgacaaaaagttggatcactgcctcccactccacggtaagattagcgccgagagtccgaccggactgccctcccacaagggcgagctcgtcgtgtcattaaagtacatccctgcctctaaaactcccgttggcggagacaggaagaagtccaagggcggagagggaggagagctgcaggtatggataaaagaagccaaaaacctgactgccgctaaggctgggggaaccagcgattccttcgtgaaaggatatctgcttccaatgcggaataaggcatcaaaacggaaaacaccagtgatgaaaaagacactcaacccccactataatcacacgtttgtgtacaacggagtgagactcgaggatttacagcacatgtgtctggaactgacagtgtgggaccgcgaaccgctggcttctaacgacttcctcgggggagtgcgcctcggggttgggacaggaatatcaaacggtgaagtggtggattggatggatagtaccggtgaggaggtctctttgtggcagaagatgcgacagtacccaggctcatgggccgagggtaccctgcaactgcggagctccatggccaaacagaaacttgggctgtag

SEQ ID NO: 243137 - DNA, 2016 bp, Artificial Sequence
  Description of Artificial Sequence: Synthetic coding sequence
atgtctgaactgctggacctgtcatttctcagtgaggaggagaaggacttaatcctgtcagtgctacagagagatgaggaagttcggaaagcagacgagaaacgcatccggaggcttaaaaacgagctgcttgagattaagaggaagggcgctaagcgcggttcccagcactattccgatcgaacttgtgctcgatgccaggaatctctcggtagattgtcccccaagaccaacacttgtaggggctgcaatcacttagtgtgtagagattgtaggatacaagagtccaacggcacctggcgctgcaaggtgtgtgccaaggagatcgaattgaagaaggctaccggtgattggttctacgaccagaaagtgaataggttcgcatacaggacgggttccgagataatcagaatgagcctgagacacaaacctgctgtcagtaaacgggaaactgtgggccagagtcttctccatcagactcagatgggagatatctggcccggaaggaagattatccaggagcgccaaaaagagccttccgtcttgttcgaagtgcctaagctgaagtccggaaaatctgcccttgaagctgagtctgaatccctagattcgttcaccgctgactccgattcaacctcccgcagagacagtctcgacaagtctggccttttcccagagtggaagaaaatgtctgctcccaagtctcaggtggagaaagaaactcagcctggcggtcaaaacgtcgtcttcgtagatgaaggggaaatgatttttaagaagaatactagaaaaatcctgcgccctagtgaatacacaaaaagtgtgatagacttgagaccagaggacgttgtccatgaaagtggctctctcggagaccggtccaaatccgtgcctgggctcaatgtcgatatggaagaggaagaagaagaggaggacattgaccacctagtgaaattgcaccgccagaagctagctcggtcctctatgcagtcagggtcctcaatgtctaccatcggatctatgatgtcaatctatagcgaggcgggtgactttgggaatatcttcgtgaccggtcggatcgcctttagcctgaagtacgagcaacagacccagagtttagtggtacatgtgaaagagtgtcaccagctcgcgtacgcagatgaggcaaagaagcggtccaacccttacgttaagacttacctgctgccggacaagtcccgtcaaggcaagagaaagacctcaattaaaagagacacaattaatcctctctacgatgaaaccctgaggtacgagataccagagtccctgctggcccaaagaactttacagttttcagtgtggcaccacgggaggtttggtcgcaatactttcctcggtgaggccgaaatccaaatggattcttggaaactagacaagaagctggaccactgtttgcccttacacggcaagatttccgctgaatctcccacagggctaccaagccataagggggaactggtagtgtcactgaagtacatcccagcttcaaaaacgcctgtcgggggagacagaaaaaagagcaaaggcggagagggtggcgaactgcaagtgtggatcaaggaggccaaaaatctgactgctgccaaagcaggcggtacaagcgacagttttgtaaaggggtacctactgccaatgcgaaataaagcctctaaacgaaagaccccagtaatgaaaaaaacacttaacccccactacaaccatacatttgtatataatggtgtccgtcttgaagacctgcagcacatgtgcctcgaactgaccgtctgggacagagaacccctggcatcaaacgacttcctgggcggagtgaggcttggagttggcaccggcatttccaacggcgaagttgtggactggatggatagcaccggcgaggaggtcagtctgtggcagaaaatgcggcaatatccaggatcctgggcagagggcacacttcagttgagaagtagcatggccaaacaaaagctaggcctttag

SEQ ID NO: 243138 - DNA, 933 bp, Artificial Sequence
  Description of Artificial Sequence: Synthetic coding sequence
atgaggagggctgctctgtggctgtggctctgcgcactggccttgtccttacagccagctctgccccagatcgtggctaccaatctgccacctgaagatcaggatggctccggggacgactcagacaatttttcagggtcaggcgctggcgctctgcaggacatcacgttatctcaacagactcccagcacctggaaggacacccaactgctgaccgctatcccgacctcacccgagccaacaggtctggaagctaccgctgcaagtacaagcacgctgcccgcaggcgaaggacccaaggagggcgaagcggtcgtgcttccagaggtggagcccggtcttacggctcgggaacaggaggccacacctcgtccccgtgagaccacccagcttcccactactcatttggcttccaccacaacagcaaccactgcgcaggagcccgcaactagccatccacacagagatatgcagcccggacatcatgaaacaagcacgcccgctggaccctcgcaagccgacttacacaccccacacacagaggatggaggcccttcagccactgagcgggctgccgaggatggcgcaagctcacagttgcccgctgcggaggggtcaggggagcaggacttcactttcgaaactagcggtgagaacacagccgtagtcgcagtggagcctgatcgcaggaaccagtctccggtggaccagggcgcaacgggcgctagccagggcctgctggacaggaaggaggttctcgggggagtgattgctggcggtctggtgggactgatcttcgcggtttgcctggttgggttcatgctgtaccgcatgaaaaagaaggatgagggtagttactccctcgaagagcctaagcaagcgaatgggggagcctatcagaagcccaccaagcaggaggaattctacgcctag

SEQ ID NO: 243139 - DNA, 933 bp, Artificial Sequence
  Description of Artificial Sequence: Synthetic coding sequence
atgaggcgcgctgccctgtggctgtggctctgtgcgcttgccctgagcttgcagccggctttaccacagattgtcgctaccaacctgccgcctgaggaccaggacggatccggcgacgattctgacaacttcagcggttcaggagccggagctctccaggatattacactctcacagcagacacctagcacatggaaagacacacagctcctgaccgcaatcccaacaagcccagagcccacgggcctggaagctaccgctgcttctacctccaccctcccagcaggagaagggccaaaagagggcgaggccgtagtactgccagaggtggagcccggtctcacagccagggagcaggaggcaacaccaaggcccagagaaacaacccaattgcctacaacgcatcttgcatccactactacggctacaactgcccaggagcccgctacatctcacccccatagagacatgcagcccggtcatcacgaaactagtacacctgccggaccttcacaagcagatctgcatacgccccatacggaagacggaggcccaagtgcaacggagagggccgctgaagatggcgcttctagtcaactgcccgctgctgagggttccggagagcaagattttacatttgagacctcaggcgaaaacactgcggtcgttgcagtcgaacctgatcggagaaatcagtcccccgttgatcagggagctaccggagcgtctcagggactactcgaccggaaagaggtgctgggcggagtaattgccggagggctggtgggccttatcttcgcagtgtgcttggtgggattcatgctctaccgtatgaagaaaaaagacgaaggttcctactctctcgaagagccaaaacaggctaatggcggtgcttaccaaaagcctactaagcaggaagagttttatgcatag

SEQ ID NO: 243140 - DNA, 606 bp, Artificial Sequence
  Description of Artificial Sequence: Synthetic coding sequence
atgagaagggcgtggatccttctaacgttgggcctagtagcatgtgtctccgccgagtcaagggcggaactgacgagcgataaagatatgtatctcgacaactcatccatagaggaagccagcggagtataccctattgacgatgatgactacgcatccgcttccggcagcggagcagatgaagatgtcgagtctcctgagttgacaacaagtagacccctgcctaaaatcctactgacctctgccgctcccaaggttgagactactaccctaaacattcagaataaaatcccagcccaaactaagtcacccgaggaaacggacaaagaaaaagtccatctcagtgactccgagaggaagatggacccagctgaggaggacactaatgtgtataccgagaaacacagtgattctctgttcaagcgtaccgaagtactagccgctgtgatcgctggcggagttattggttttctttttgccatcttcttgatcctgctcttggtgtatcggatgcgcaaaaaagacgaaggctcatatgacctaggggaaaggaagcctagcagcgccgcttatcagaaagcccctaccaaggaattctacgcgtag

SEQ ID NO: 243141 - DNA, 498 bp, Artificial Sequence
  Description of Artificial Sequence: Synthetic coding sequence
atgaggagggcgtggatcttgttgactttgggcctggtagcttgcgtttcagcagagtccgtgagggccgatgaagacgtcgagtctccagaactgactacaagccggccactgcccaagattcttttaacaagtgcagctcccaaggtggaaacaacaacgttgaacatccagaataagatccccgcacagactaagagtccagaagaaactgacaaggagaaggtccacttgagcgacagtgagaggaagatggacccggcagaagaagacaccaacgtgtacacagaaaaacactcagactccctttttaaacgaaccgaagtgttagccgcagtaattgcgggaggcgtcattgggttcctgtttgcaatctttctgatcctgttactggtgtatagaatgagaaagaaggacgaggggtcatacgacctgggagagcgtaaaccttcctccgctgcataccagaaagcccctacgaaggagttctacgcctag

SEQ ID NO: 243142 - DNA, 519 bp, Artificial Sequence
  Description of Artificial Sequence: Synthetic coding sequence
atgtatctggacaattcctccatcgaggaagctagcggggtgtatcccatcgacgacgacgattacgccagtgcatctgggagtggcgcagatgaggatgtggagtctcctgagttaaccacaagcaggcccctccccaagatactgctgacgtcggccgctcccaaggttgaaaccacaaccctgaacattcaaaacaagatccctgcccaaacgaagtccccagaggagacggacaaagagaaggtccacctgtccgacagcgaaaggaaaatggatccagccgaggaagacacaaacgtgtacacagagaagcattcagacagtctttttaagcgcactgaggtactcgcagccgtgattgcaggcggtgtgattggcttcctgttcgcaattttcctgatccttcttctggtgtaccgaatgagaaagaaagatgagggatcatacgatttaggggaaagaaagccatcctcagcggcatatcagaaggctccaaccaaggagttttatgcctag

SEQ ID NO: 243143 - DNA, 519 bp, Artificial Sequence
  Description of Artificial Sequence: Synthetic coding sequence
atgtatctggacaactctagtatcgaggaagcttcaggggtgtaccctattgatgatgacgattatgcctccgcctccggctcaggggcagacgaggacgttgagtcccccgagctgaccacgagtagacctcttccaaaaattctgctgacgtcagcagcccctaaggtcgagacaaccactctgaatatccaaaacaaaatccccgcacagactaaatctccagaggagaccgataaagagaaagtgcatctgagcgatagtgaacgaaaaatggacccagccgaggaggacactaatgtttatacagagaagcactccgactctctgttcaaacgtaccgaagtgctagcggcagtaattgccggtggcgtcattggattccttttcgcgatcttcttaatcttgcttctagtctatcgaatgcgcaagaaagacgagggctcctatgatcttggggagcgcaagccatcctctgcagcctaccagaaggctcccactaaggagttctacgcatag

SEQ ID NO: 243144 - DNA, 606 bp, Artificial Sequence
  Description of Artificial Sequence: Synthetic coding sequence
atgaggcgcgcatggatactgctgacactgggcctagtggcgtgcgtttctgccgagtcaagggccgagctgacaagtgacaaagatatgtatctggacaattccagtatagaggaagctagtggggtgtatccgattgatgatgatgactatgcctccgccagcggtagcggcgcagatgaggacgtagagagtccggagttgactacttcccgtccactacctaagattctactgacttccgcagccccaaaagtggagacgacgacgctgaatatacagaataaaattcccgctcagacgaagtctccagaggaaaccgataaggagaaagtccacctttccgactcagagcgcaaaatggaccccgctgaggaagatacaaatgtctatactgaaaaacattccgacagtctcttcaaaaggaccgaggtgctggccgctgtaattgccggaggggtgatcggatttctattcgccatcttcctcatcttactgctcgtgtacagaatgcggaaaaaggatgaagggtcttatgacttgggcgaacgcaaaccatctagtgccgcatatcagaaagctcccacaaaggagttttatgcttag

SEQ ID NO: 243145 - DNA, 576 bp, Artificial Sequence
  Description of Artificial Sequence: Synthetic coding sequence
atgagagtcgcctgtgtcagcgccgagtcacgcgctgaactgacctccgataaggatatgtatctggacaatagctccatcgaggaagcatctggtgtgtatcccattgacgacgatgactatgcatcagcaagcggtagtggcgctgatgaggacgttgaatcgccggaattaactacaagtaggcctctcccaaagattctcttgactagtgccgctcccaaagtggagacgaccactttaaacattcagaacaagatccctgcccagaccaaaagtcccgaagagaccgacaaagagaaggtgcacctgagcgactcagagagaaagatggatcccgcagaagaagacaccaacgtctatactgagaagcactccgacagcctattcaagagaaccgaggtgctggctgccgtcatcgcgggtggcgttatcggatttctgttcgccattttcttaatactgctgcttgtttataggatgagaaagaaggatgaaggaagctatgaccttggggagaggaagcccagctctgccgcatatcagaaagccccaactaaggaattttatgcctag

SEQ ID NO: 243146 - DNA, 1155 bp, Artificial Sequence
  Description of Artificial Sequence: Synthetic coding sequence
atggccatcgcatatttagggtccagctgccccagtcagccgcctagcagcctggccctctccctgtcacctacgcccagcgatttcgagcaagagagtgggattgagaccgctatgcgcttcagtccagacgtagccttagccgtgtcaaccactcctgccgtgctgccaacaacaaatatccaacctgtgggcacccccttcgaggagctccccagcgagcggcctacactggaacctgctactagccctctggtagtcaccgaggtgcctgaggaaccttcccagcgcgcaacaacagttagtaccaccatggccacaactgcagccacgtctactggtgaccccactgtcgccaccgtgccagctacagttgccactgctaccccaagtacaccagccgctccccctttcaccgcgacgacggcggtgatccgtacgaccggtgtacgacgcctgttgcccctacctcttaccacggtcgccacagcaagggccacgacacctgaagcgccttcaccaccaactacggccgcagtgttggataccgaagcccctacacctagacttgtctcaacagcaacctcaaggccccgagcactcccccgaccagcgaccacacaggagcccgacattccagagcgcagtaccctacctctgggcacaacagccccagggcctaccgaagtggctcaaactcctactccagagaccttcctaactacaatccgggacgaaccagaggtgccggtatcaggtggacccagtggagactttgagctgccagaggaggaaacaacccagcctgataccgccaacgaggttgtggctgtgggcggtgcagccgctaaagcctcttcccctcccggaaccctaccaaagggcgctcgcccaggtccgggactgctggacaacgctatagacagtggatcttctgcagcgcagctgccgcagaagtccatcttggagaggaaggaagtcctggtggcagtgatagtgggtggggtagtgggagcactcttcgccgcatttctggtaacactcctgatctacagaatgaaaaagaaggacgagggatcttatactctcgaagagccaaagcaggcatcggttacctaccagaagccggataaacaggaggaattttacgcctag

SEQ ID NO: 243147 - DNA, 1329 bp, Artificial Sequence
  Description of Artificial Sequence: Synthetic coding sequence
atgaagccaggcccaccccatagagcaggggcagcacatggtgccggagctggtgcaggcgctgccgcaggccctggagctagggggctgctgctccctccacttctgctgctgctcctggcaggaagggccgcaggggctcaacgatggcgttctgaaaattttgagcgacccgtggatctcgagggctctggtgatgatgattcatttcctgatgatgagctggacgatctgtattccggctctggctccgggtacttcgagcaggagtcggggatagaaaccgccatgagattctcgcccgacgtagcactggcagtgtccacgaccccggcagtgctgccgactactaacatccagcccgtgggcacaccgtttgaggagttgccaagtgaacggccaaccctagagcctgccacctcacctctggttgtgacagaggtccccgaggaaccttcacaacgcgcaacgaccgtaagcaccaccatggccaccaccgctgcaaccagcactggcgatcctaccgttgctactgttcccgcaacggtggctacagctactccttccactcccgcagctcctcctttcactgccaccaccgccgtgatacggaccaccggcgttcgacgtctgctccccctacccttaaccaccgtcgccacagcaagggccaccacaccagaagccccatccccccctactaccgccgctgtgttagatacagaggcccctactcctcggttagtcagcaccgccacctctaggccccgtgcactgcccagaccagctactacacaggagcccgacatccctgaacggagtaccttgccattgggaactaccgccccaggcccaaccgaggttgcgcagacccctacaccagagactttcctgaccactatccgggatgagcctgaggttcctgttagtggaggacctagcggagattttgagttgcccgaggaggaaacaacccagcctgacactgccaatgaggtggtagctgtgggaggggctgcagcgaaagcctctagtcctcccggtaccctcccaaagggggctcgtccaggccctggcctactagacaatgccattgactccggtagttccgctgctcaactgccccagaaatccattctggagagaaaggaggtcctagtggcggtgatcgtgggcggtgtcgtgggcgcactttttgccgcattcctcgtgacactcttgatttatcggatgaaaaagaaagacgagggctcttatacactcgaagaacccaagcaagctagcgtgacgtatcaaaaacccgacaaacaagaagaattctatgcctag

SEQ ID NO: 243148 - DNA, 597 bp, Artificial Sequence
  Description of Artificial Sequence: Synthetic coding sequence
atggcaccagcacgcctcttcgccctgctgctgttctttgtgggaggggtagctgagagcatcagggagactgaggttattgacccccaagacctgctggaggggcgttattttagcggggcactccccgatgacgaggacgtggtagggcctgggcaggagagcgacgacttcgagctgagcggttctggcgacttagatgacctcgaagatagcatgatcggacccgaagtcgtgcatccattggttccgctggataaccacatccccgagcgggctgggagcggctcccaggtgcctacagagccaaaaaagctcgaagagaacgaggtcatccccaaaaggataagccccgtagaggagagtgaggacgtcagcaacaaggtgagtatgtcgagcacagtgcaaggcagtaacatctttgagcggacagaagtacttgcagcactgatcgtagggggaatcgtagggattttgttcgctgtgtttcttattctgttattgatgtatcgcatgaagaagaaagacgagggctcttacgacctggggaaaaagcctatctacaagaaagccccaactaatgaattttacgcatag

SEQ ID NO: 243149 - DNA, 381 bp, Artificial Sequence
  Description of Artificial Sequence: Synthetic coding sequence
atgataggtcccgaagttgtgcatcctcttgtgcctcttgataatcacattccagaacgggcaggatccggttctcaggtccccactgaacctaaaaaactcgaggagaacgaggttatcccgaaaagaatttcacccgttgaggaatcggaggacgtctcgaataaggtttctatgtcttccaccgtacagggatcaaacatatttgaacgcaccgaagtacttgccgctctaatagtgggcggtattgtggggatcctcttcgctgtttttttgatccttctgctaatgtaccgaatgaaaaagaaggatgaggggtcttatgatcttgggaaaaagcccatatacaagaaagcaccaactaacgagttttacgcatag

SEQ ID NO: 243150 - DNA, 1851 bp, Artificial Sequence
  Description of Artificial Sequence: Synthetic coding sequence
atgttccggactgccgttatgatggccgctagtctcgcgctgacgggcgcagtggtcgctcacgcttactatcttaagcaccagttttacccaaccgtcgtttacttaaccaaaagttcccctagcatggcagtactgtatattcaggcttttgtgttggtgttcttactgggaaaggtcatgggtaaagtattctttggacagctgagagccgctgaaatggagcatctcttagaaaggagctggtatgctgtgaccgagacatgtctggcattcacagtgtttcgggatgacttcagtccaagatttgtggcactctttacactcctgctgttcctcaagtgttttcactggttagctgaggatagagtggattttatggaaagatcccctaatatcagctggttatttcactgcagaatagtatcgctgatgtttctgctcggcatcttggacttcctgtttgtgtcccatgcctatcatagtattctcacccgtggcgcttcagtacagttggtttttgggttcgagtacgcaatcttaatgaccatggttctgacaatttttatcaagtacgttttacactcggtggacctccagtctgagaacccttgggataacaaagctgtgtatatgctgtataccgagcttttcactggctttatcaaggtgctcctatatatggccttcatgaccattatgattaaggtgcacacattcccactctttgcaatccgccctatgtacttggcaatgagacagttcaagaaagcagttaccgacgccattatgtcacgcagagctatcagaaacatgaacactctgtatcccgatgcgacccccgaagagcttcaggcgatggataacgtgtgcatcatctgccgcgaggaaatggtaactggagctaaaaggctgccatgcaatcacatctttcatacttcttgcttacgaagttggttccagagacagcagacgtgtccaacctgtcgcatggatgttctgcgtgccagccttcctgcccagagccccccacctcccgagcctgcagatcaggggccaccccctgctccccacccacctccgctgctgcctcagccaccgaactttccacaggggctattgccaccattccccccaggtatgttcccactgtggccacctatgggacctttcccacccgtcccacccccaccttcttctggggaagcagtggccccaccatctaccagcgcagcactctctcgtccttccggagccgcaactacgacagctgctgggacgtcggccacagctgcatcagctaccgcatccggacctggcagcggcagtgccccagaagccggacccgctcctggcttcccttttccacctccttggatgggtatgcccctacctcccccttttgcttttccacccatgcctgtcccacccgctggtttcgcaggcttgacacctgaggagcttcgagccttagaaggtcatgagcgtcagcacttggaggcccgacttcaatctctcaggaatattcataccttgctcgatgctgccatgctccaaattaaccagtacctcactgtgcttgccagccttgggcctcccaggccggcaacctctgtaaactcgaccgaggaaacagcgacaaccgtcgtcgctgccgcatcatccacctccatcccctcgtctgaggccacaactccaaccccaggggcatcgcctccggcaccagaaatggagcggccacccgcacccgaatcagtgggtacggaggaaatgccagaagacggggagccggatgccgctgagctccggcgaaggcggttacagaaactggagtcccctgtggcgcattag

SEQ ID NO: 243151 - DNA, 1698 bp, Artificial Sequence
  Description of Artificial Sequence: Synthetic coding sequence
atgttccgcactgccgtaatgatggctgccagcctcgcactcacaggcgctgttgttgcccacgcctactatttaaagcaccaattctatccaaccgtcgtctacctgactaaaagctccccctctatggcagtgctttacatacaggcttttgttcttgtttttttactgggtaaggtcatgggaaaagttttctttggccaattgagagctgccgagatggaacacctcctggagcggtcatggtatgcagtcaccgaaacctgtcttgcctttacggtctttcgcgatgatttcagcccaaggttcgtggcgctgttcactctgctcctttttctaaagtgtttccattggctcgccgaggatcgggttgatttttacgctattttgatgacaatggtgttgaccatttttatcaagtatgttctccattcagtggatctccagagcgaaaacccctgggacaacaaagcagtgtatatgctctacacagagctcttcaccggcttcatcaaggtgctgttgtacatggccttcatgacaatcatgatcaaggttcataccttcccactgtttgcgattcgacccatgtatctcgctatgcgtcagttcaagaaggcagtgacagacgccattatgtccaggcgcgcaattagaaatatgaatacgttgtacccggacgctacacccgaggaactgcaggcaatggacaatgtctgcatcatctgccgggaagagatggtaacaggagcaaagagactcccctgcaaccacattttccatacatcatgtctacgatcctggtttcaacgccagcagacatgccccacctgcagaatggacgtcttaagggcctccttgcccgcacagagtcctcctccccctgagcctgctgatcagggcccaccccctgctccacatcccccaccactccttccccagccacccaattttccacagggtttgctccccccattcccaccaggtatgtttcctctgtggccacctatgggtcccttccctcccgtgccaccgccaccctcgagcggagaggccgtggctccccctagcacgtcagctgcactatccaggccttccggcgctgccaccactaccgcggcagggacatctgccacagccgcttcagccaccgctagcgggccaggctcaggcagtgctccagaagccggaccagcccctgggttccctttcccacctccttggatgggcatgccactgccccctccattcgcctttccacctatgcctgttcctcccgctggctttgctggccttacccctgaggagctccgtgctctggaaggccacgaacgccagcatctcgaggctcggttacagagcctgaggaatatccatacactattggacgctgccatgctgcagataaatcagtacttgaccgtcctggcatcgctgggcccaccccgaccagctacatccgtcaattccacagaagaaaccgctacaactgtcgttgccgcagccagttccacctccattccgtcgagtgaggctactacgcccaccccaggagcctcacctcccgctcccgaaatggagcgcccaccagcccctgaaagtgtaggtacggaagagatgcccgaagacggggagcctgacgcggctgaactcaggcggaggcgattgcagaagctggagtcaccagtggcacactag

SEQ ID NO: 243152 - DNA, 1854 bp, Artificial Sequence
  Description of Artificial Sequence: Synthetic coding sequence
atgtttcggacagccgtgatgatggctgcttccctagctctcacaggcgctgtagttgcccatgcgtattacctgaaacaccagttctaccctacagtcgtgtatctcaccaaatccagtccgtctatggctgtgctgtatatccaggctttcgtgctggtcttcctgctcggcaaggtgatggggaaagtttttttcggtcagctgagagccgctgagatggagcacctgctggaacggtcatggtatgcagttaccgaaacatgtctggccttcaccgtgtttcgggacgacttcagcccacgctttgtggccctgtttaccctgttattgttccttaaatgtttccactggctggctgaggatagggtcgatttcatggagcgtagccctaacatctcttggcttttccattgcaggattgtttctttgatgttcctgttagggatcctggattttctcttcgtttcgcacgcctatcacagcattcttactcgcggagcgagtgtgcaactagtgttcggatttgaatatgccattctcatgacaatggtccttactatttttatcaagtacgttttgcacagcgtggacctgcagagcgagaatccttgggacaataaggcagtgtatatgttgtacacagagttgtttaccgggtttatcaaagtcctgctatacatggcctttatgacaataatgatcaaggtgcacacctttcccttattcgctattcgacctatgtaccttgcaatgcgccagtttaagaaagctgtgacggatgcaattatgagtcggagggccatccggaacatgaacacactctatccagatgccactcctgaagaactgcaggccatggacaatgtctgcatcatttgccgcgaagaaatggtgactggagctaaacgactaccatgcaatcacatcttccacaccagctgcctgcgctcctggttccagcgccaacaaacctgtcctacatgcagaatggatgtcctccgcgcttcgctgcccgctcagtcgcctccccctcccgaacctgctgaccagggaccaccacccgcacctcacccaccacccttactgccccagcccccaaatttcccccaggggttactgccacctttcccgcctgggatgtttcccctctggccaccgatgggaccatttcccccagtgccccctccccctagttccggagaggccgttgctccacctagtacaagcgccgctgccctctcacgccctagtggagccgcaacgacgaccgctgctggtacatccgcgactgccgcatccgccaccgcatcaggtcccggaagcgggtccgccccagaagccggtcctgctcccggtttccctttccctcctccgtggatgggcatgccgctgccccctcccttcgcttttccccctatgcccgttcccccagccggatttgccggtttgactcccgaggaactgcgggcactggaggggcatgaaagacaacatctggaggccaggctccaatcactgcgtaatatccacaccctcctggatgctgcaatgttgcaaatcaaccagtatctgactgtgttagcgagcctgggacctcctagacctgcaacctccgtgaattctactgaagaaactgcgactactgtggtggcggctgccagctcgacatcgatcccctcttcagaggctacgacacctactcctggtgcctctccacctgcccctgaaatggaaagacctcccgctcctgagtctgttggaacagaggaaatgccagaggatggggagcctgacgccgcagagctacgtagacgacggttgcagaagctagagtcccctgtagcgcactag

SEQ ID NO: 243153 - DNA, 1890 bp, Artificial Sequence
  Description of Artificial Sequence: Synthetic coding sequence
atgtttagaaccgccgtcatgatggcagcgagcctcgcactgacaggcgctgttgtagcccatgcttactatttaaagcatcagttttatccaactgtagtgtacctaaccaagtcaagcccctccatggctgttctgtacattcaggcctttgttctcgtcttcctactcggcaaggtcatgggaaaggtgttttttgggcaactgcgtgctgcagaaatggagcacctgctcgagaggtcatggtatgccgttacagagacttgccttgcatttaccgtcttccgtgacgacttttcaccgagatttgtcgcgctgttcaccctgcttctatttttgaagtgctttcactggctggctgaggatagggtggattttatggagaggtctccaaacatttcctggttgttccactgtaggattgtctccctgatgttccttctgggtatcttggacttcctgtttgtatctcatgcctaccactccattcttaccaggggggcatctgtgcagttagtattcggatttgaatacgctatacttatgaccatggtgctgacgatttttataaaatacgtattacacagtgtggatctgcagtccgaaaatccttgggacaataaggccgtgtatatgctgtacaccgagctgtttactggctttattaaggtgctcctctatatggcgtttatgacaatcatgatcaaggtgcataccttccccctgttcgcgattagaccgatgtatctggccatgaggcagttcaaaaaggccgtcacagacgcaattatgagtaggagagcaatacggaacatgaatactctatacccagacgcaacccccgaagagctgcaggcaatggacaatgtttgtattatttgccgggaagagatggtgactggagcaaagcgactgccctgcaaccatatttttcacactagttgtttgaggtcttggttccagagacagcagacttgcccaacatgccgcatggacgtccttagagcctcgctgccggctcagtcccccccacctccagagcctgcagaccaaggcccacctcctgccccacacccacccccactcctgccccagccgccaaactttcctcaaggactgttgccaccctttccacctgggatgttcccactgtggcctcctatgggccctttccctccggtcccccctccccctagttccggggaagcagtcgcacctccatccacttctgccgcagcgttgagtcggccatctggtgccgctacgaccaccgccgcaggaacgtccgctactgccgcttcggctacagcctcgggacctgggtccggctccgctcccgaggccggtcctgcacctggcttccccttccccccaccctggatgggcatgcccttacctccgccttttgccttccctcctatgcccgtgcccccagcaggctttgccggattaacgccggaggagttacgggcactggagggtcatgagcggcagcacctggaggctcgactgcagagcctcagaaatattcacaccttacttgacgcagcaatgctacagattaaccagtatctcactgtgttagcatctcttggaccccctgggctgccgctgcagtccacaccacttaggcgcctgcccctccaactgcttctccttcctcctcccccagccagcttggcacaaaggcctcgcccacaaccccaggaacctccgcaccaacctttaaagtggaaagggctccaactgctgtctcagtgggcccagcggcgatgcctgcgcatggagagccccatgcagcaatcaagcgccggagccgcttgcagatcatggagccttctgctaccaactgacaccgccccagcacagccacagcctttattgttctag

SEQ ID NO: 243154 - DNA, 1851 bp, Artificial Sequence
  Description of Artificial Sequence: Synthetic coding sequence
atgttccgcaccgccgtgatgatggctgcttctcttgctcttaccggcgcagtggtcgcacacgcttattatctcaagcaccaattctatcctaccgttgtctacctcacaaagagttcaccatccatggctgtcctgtacatccaggcttttgtgttggtattcctcctgggaaaagttatgggaaaagtgtttttcggccaattgagggcggcagagatggagcatctgctggagcggagttggtatgccgttaccgaaacctgtttagcttttaccgtgttccgggatgatttcagccctaggtttgtggcattgtttacacttcttctctttcttaaatgctttcactggcttgcagaagaccgggtcgacttcatggagaggagccccaacattagctggttgttccactgcagaatagtgagcttaatgttccttttgggcattctcgactttctcttcgtgagccatgcttatcatagtatcctgaccaggggggctagtgtgcagttagttttcgggtttgagtatgccatcctcatgacaatggtgctaacaatcttcatcaagtacgtcctccacagtgttgatcttcagtctgaaaatccctgggataacaaggctgtctacatgctgtatactgaactgtttaccggtttcatcaaagtgcttctgtatatggcgtttatgaccattatgattaaagttcacaccttccctctgttcgctatccggcctatgtacttggcgatgcgccagttcaaaaaagctgtaacagatgccatcatgagccggagagcaatccggaacatgaatactctataccccgacgcaacacccgaagagcttcaggctatggataatgtttgtattatctgccgcgaggaaatggtgaccggggctaagagattaccatgcaaccacatcttccacacctcctgcctccgtagttggtttcagcgccaacagacctgccccacgtgtaggatggacgttctgagagcaagcctgcccgcacagtcaccgccacctcccgagccagcagaccagggtccaccccctgcaccacatcctcccccactgcttccccagccacccaactttccacagggactgttgcccccattccctcctggcatgttcccgctctggccgcctatggggccattcccacctgtaccacctccacccagcagcggggaagctgttgccccaccttccactagcgccgctctgtccaggccatcgggagccgctactaccactgcagcaggcaccagcgcaacagcggcttccgccactgcttctgggcctggctcaggcagtgcgccagaggctggccctgccccaggattcccatttcctcccccatggatgggaatgcctttgcccccaccctttgcattccctccgatgcctgtgccgcctgcagggttcgccggattgacccccgaggagctgagggccctggaaggacatgagaggcagcacttggaggccaggctgcagtccctgcgtaacatacacacattgctcgacgctgccatgctgcaaatcaatcagtatttgacagttctcgcatcgctcggccctcccagacccgctaccagcgtgaactcgacggaagaaactgctacaacggtagttgctgcggcttcgagcactagtatccctagcagcgaagccactacacccacgccgggagcaagtccacctgcacccgagatggaacggccaccagcccctgagagtgtgggcactgaagaaatgcccgaggatggcgaacctgatgccgctgagctgcgtcgccgaaggctgcagaagctcgaatcacctgtggctcattag

SEQ ID NO: 243155 - DNA, 1191 bp, Artificial Sequence
  Description of Artificial Sequence: Synthetic coding sequence
atgtcagtagcgttcgcgtccgccaggcccagaggcaagggcgaggtgacccaacagaccattcagaagatgctcgacgaaaatcaccacttgattcagtgcatactcgagtaccagagtaaaggaaaaactgccgaatgtactcagtatcaacagatcctacaccgcaacctggtgtatcttgcaacaatagctgatagtaatcagaatatgcagtccctcttaccagcacccccaacccagaacatgaatctgggcccaggggctctcacacagtctggctcttctcagggactgcactcacagggttcgctgagcgatgcaattagcaccggtttaccacctagcagtctgctgcagggtcaaattggcaatggccctagccacgtgtcaatgcagcagacagccccaaacacgctgccgacaaccagcatgtcaatttctggacccggttactcccacgccggaccagcgtctcagggagtgcctatgcagggacaggggaccattggtaactacgtgtcccgcacgaacattaatatgcagagcaacccggtcagcatgatgcaacagcaggcagcaacctcacattattccagcgcacaaggcggttcccaacattatcagggccagtccagtattgctatgatgggacagggctctcaagggtcttcaatgatgggccagcgacctatggccccatatcgcccttctcagcaagggagctctcagcagtatctgggtcaagaagaatactacggcgagcagtattctcattcacagggggcagctgagcctatgggacagcaatattacccggacggccatggggattacgcttaccagcagtcatcatacacggaacaatcctatgataggtcatttgaggagtctacacagcactattatgaaggcggaaacagccagtacagccagcagcaggctggctaccagcaaggagccgctcagcagcagacctacagccagcaacaatacccaagtcagcagagctaccccggtcagcaacagggatacggttccgctcagggggctccctctcagtatcccggttatcagcagggccagggtcaacagtacggcagttatcgcgctcctcagaccgcacccagcgcacagcagcagaggccttacgggtatgagcagggccagtacggcaattatcagcagtag

SEQ ID NO: 243156 - DNA, 1200 bp, Artificial Sequence
  Description of Artificial Sequence: Synthetic coding sequence
atgcagagcctctcaaccgaggctcgctatgtgccaagagtcccccagcatagggatcaaattagtcctagatctcctcagcatggtgggcagatctgccctagaagccccttacatcgtggtcagatctgccccaggagccctcctgcacgtcgatatcaacagatactgcaccgtaatctcgtctatttggctacgattgctgattccaaccagaacatgcagagcctgctgccagcccctccgacccagaatatgaacctgggccctggtgctctcactcaatccggttccagccagggactacacagtcaagggtcgctgtcggatgcaatcagtactgggcttcctccctcatccctgctacaaggccaaatcgggaatggcccttctcatgtgtccatgcaacagactgcacctaacaccctgcctacaacctccatgtccataagcgggccaggttatagccatgccggtccagcctcacagggggtccctatgcaggggcaaggaacgatcggaaattacgtcagcagaactaatattaacatgcagtctaatcccgtgagtatgatgcagcagcaggcagcaacctcacattattctagtgcccagggaggtagccaacactaccaggggcaaagcagtattgcaatgatgggccagggaagtcagggcagtagtatgatgggacagcgaccaatggcaccctaccgcccaagccaacagggcagcagccaacagtatctgggtcaggaggaatattatggcgagcaatattctcactcacagggtgctgccgagcctatgggccaacagtattaccctgacgggcacggggattacgcgtatcagcagtcctcttataccgaacaatcatatgatagaagttttgaagagagtacacagcactattacgagggaggcaattcgcagtatagccagcagcaggctggctatcaacagggtgcagcccagcagcaaacttacagccaacagcagtacccctcacagcagagttaccctggccagcagcagggatatggatcagcgcagggcgctccctcccagtatcctggctatcagcaagggcaggggcaacagtatggatcttaccgcgcaccccagactgccccttccgcacagcagcaacgcccttacggatatgaacaaggccagtacgggaactatcagcagtag

SEQ ID NO: 243157 - DNA, 1191 bp, Artificial Sequence
  Description of Artificial Sequence: Synthetic coding sequence
atgtctgtggcctttgcaagcgcacgcccacgtggcaaaggagaggtgacccagcaaaccatccaaaagatgcttgacgaaaatcatcatcttatccaatgtattctcgaataccagagtaaaggaaagactgcagaatgcacccagtatcagcagatccttcacagaaatctcgtctatctggctactatcgccgattctaatcagaacatgcagagcctcctgccagcccctccaacacagaacatgaatctcggccctggcgctcttacacagagcggcagttctcaggggttgcattcacagggctcactgtcagatgccatatccacagggctccccccttcaagcctgctacaggggcaaattggcaacggacccagccacgtgtctatgcagcaaacagcccctaatactttaccaaccacgtccatgagcatcagcggtccaggttattctcatgctggcccagcatcacagggcgtgccaatgcagggacagggaaccatagggaattacgtttcaagaactaacatcaatatgcagagcaatcccgtgtctatgatgcagcaacaggcagccactagtcattattcaagtgctcaaggtggatctcagcactatcagggacagagcagcattgcaatgatgggacagggctcacagggcagctccatgatgggacagagaccaatggctccctacaggccatcgcaacagggatcatcgcaacagtacttagggcaggaagagtattacggagagcaatatagccacagtcagggggctgcagaaccaatgggccagcagtactatcccgacggccatggagactacgcttaccagcagtcaagctacaccgaacagtcgtatgacagatcctttgaggagtcaacacagcactactatgaaggcggtaatagccagtattcccaacagcaagccggataccaacagggcgctgcacagcagcagacgtactctcagcagcagtacccaagccagcagagttacccaggccagcagcagggctacggatcggctcaaggcgcacctagtcagtaccctggttatcagcaaggccaagggcaacaatacggcagctaccgagcacctcagaccgcaccatccgcccagcagcagcgcccttacgggtacgagcaggggcaatacgggaattaccagcagtag

SEQ ID NO: 243158 - DNA, 387 bp, Artificial Sequence
  Description of Artificial Sequence: Synthetic coding sequence
atgcagtcactctccaccgaggcccgatacgtgccaagggtgccccagcaccgggatcagatttctcctagatcgcctcagcacggcggtcagatctgcccacggagtcctctccatcgaggacaaatctgcccccgtagtcccccagcacggcgttatcagcagatcctgcacagaaacttggtctatctcgctaccatcgccgacagcaaccagaatatgcagagtctgttaccagcaccaccaacacagaacatgaacctcggtccaggagccttgactcagagtggtagtagccagggactgcacagccaggggagcctgagtgacgcaatctctactgggcttccgccatcttcactcctacagggccagatcgggaactag

SEQ ID NO: 243159 - DNA, 234 bp, Artificial Sequence
  Description of Artificial Sequence: Synthetic coding sequence
atgtccgtagcctttgttcccgattggctgagggggaaggctgaagtgaaccaagagactatccagagactcctggaagaaaacgatcagctgatcaggtgtatagtagagtatcagaataagggccgtgggaatgaatgtgttcagtatcagcacgtcttgcaccgtaatcttatatacctagcaacgatcgccgatgcatcccctacatcaacttccaaagctatggaatag

SEQ ID NO: 243160 - DNA, 234 bp, Artificial Sequence
  Description of Artificial Sequence: Synthetic coding sequence
atgtcggttgccttcgtccccgactggcttagaggaaaagctgaggtcaaccaggaaacgatccaaagactcttagaggagaatgatcagctgattcggtgcatcgtagaataccagaacaaaggccgtggaaatgaatgtgtacagtaccagcatgtgctccacagaaacctgatctacctggcgaccattgccgatgcgagtcccacctcaacatccaaggctatggaatag

SEQ ID NO: 243161 - DNA, 1164 bp, Artificial Sequence
  Description of Artificial Sequence: Synthetic coding sequence
atgagcgtggcctttgccgcacccagacaacgaggcaagggtgagataacccctgcggctatccagaaaatgctcgatgacaataaccacctaattcagtgcattatggactcccagaataaaggcaaaacctcagaatgctcccagtaccaacagatgctgcacactaatctcgtatatttggctacaatcgccgattcaaaccaaaatatgcagagtctcttgccggcacctcccacccaaaatatgccaatgggtcccggtggcatgaatcagagtgggcctccccctccccctcgctcacataatatgccttcagacggcatggtgggcggtgggcctccggcaccccacatgcagaaccagatgaacggccagatgcctgggccaaatcacatgccgatgcagggaccgggaccaaaccagcttaatatgaccaattctagtatgaacatgccctcaagctcgcacggcagcatgggcggttacaatcactctgtgccaagtagccagtccatgcctgtgcagaatcagatgactatgtcacagggtcaacccatgggtaattacggtcctagaccgaatatgagcatgcaaccaaaccagggccctatgatgcaccagcagcctcctagccagcagtataacatgccacaagggggtggacagcactatcaggggcaacaacccccaatgggaatgatggggcaggtgaatcaaggaaaccatatgatgggccagcgacaaattcctccttaccggccaccccagcaggggcctccacaacagtactctggacaggaggattattacggcgaccaatactcacacggaggacagggaccaccggagggcatgaaccaacaatactatcccgatgggaattcccagtacggacaacagcaggacgcgtatcaggggccacctcctcagcaggggtatccaccacagcaacagcaatacccgggtcaacaaggttatcctggacagcaacagggatacggtccgtcgcaggggggacctggtccacagtaccccaattacccccagggccaaggacagcagtacgggggttacagacccactcagcctggaccccctcagcctccacagcagcggccatacggctatgatcaggggcaatacggcaactatcagcaatag

SEQ ID NO: 243162 - DNA, 1257 bp, Artificial Sequence
  Description of Artificial Sequence: Synthetic coding sequence
atgagcgtcgcatttgcagcaccacgccagagaggaaagggcgaaatcacccccgctgcaatccagaagatgcttgacgataacaatcatcttatccagtgcatcatggacagtcaaaacaaggggaagacgagcgagtgttcccagtatcagcagatgctacacacgaatctggtctacttggcaactatcgcagatagcaaccaaaatatgcaaagcttgttgccagcgcctccgacgcaaaatatgccaatgggccctggcggaatgaatcagagcgggcctccacccccacccagatcacataatatgccttctgatggaatggttggcggtggtccgccagctcctcatatgcagaaccagatgaacggtcagatgcctggccctaaccatatgcccatgcagggtcccggacccaaccagttgaacatgacaaactccagcatgaatatgccttcatcgagccatggatccatgggcggatataatcactccgtcccatcaagtcagagtatgcctgtccaaaatcagatgactatgtcccaggggcagcccatgggaaactatggacctcgccctaacatgtcaatgcagccgaatcagggccctatgatgcatcagcagccacctagtcagcagtataacatgccgcagggaggtggacagcactaccagggacagcagcccccaatgggtatgatgggccaggtcaatcaggggaaccatatgatggggcagcgccagattcctccctatagaccaccacagcagggtcccccacaacaatacagtggtcaggaggactactacggagaccaatactcccacgggggacaagggcctccagagggcatgaaccagcaatattacccagatggccacaatgattacggataccagcagccctcataccctgagcagggctatgataggccttacgaagatagcagccaacactattacgagggcggtaactcccagtatggccaacagcaagatgcgtaccaggggccacctcctcagcaaggatatccacctcagcagcagcagtaccctgggcaacaggggtaccccggacaacagcaaggatatggaccaagccagggaggtccaggccctcaatacccaaattaccctcagggtcaggggcaacaatacggtggctaccgaccaactcagcccggaccgcctcagcccccacagcagcgaccttacgggtacgatcagggacagtatggcaattaccagcagtag

SEQ ID NO: 243163 - DNA, 1266 bp, Artificial Sequence
  Description of Artificial Sequence: Synthetic coding sequence
ggaggaaacatgagcgtggctttcgcagcaccacggcagcgcggaaaaggagaaattacaccagcagccatccagaagatgcttgacgacaataaccatttaattcagtgcatcatggacagtcaaaacaaaggcaagaccagcgaatgcagccagtatcagcaaatgctgcacaccaatttggtttacctcgcgactattgccgactccaatcagaatatgcagtccttgctacccgctcccccaacccagaacatgcccatgggacccggtgggatgaaccagtcagggccacccccaccaccacggtcgcataacatgcctagtgacgggatggtcggtggcggaccccctgccccacacatgcagaaccagatgaacggacagatgcctggccctaatcacatgccaatgcagggcccaggcccaaatcagcttaacatgacaaactcgtccatgaatatgccctccagcagccatgggtcgatgggaggctataaccattctgtaccaagctcacagtctatgcctgtgcagaatcagatgactatgtctcagggtcagccgatgggaaactacggccctcggcctaatatgtctatgcagccgaaccaagggccaatgatgcatcagcagcctccctcacagcagtataatatgccgcagggcggaggccaacactatcaggggcaacaaccacccatgggaatgatgggacaggtaaatcagggcaatcacatgatgggacagaggcagatacctccttatcgcccaccccaacagggtccgccacagcaatactcagggcaggaagattactacggtgaccaatactcccacgggggacagggccctccagagggaatgaatcagcagtactatccggacgggcacaacgactacgggtatcagcagcccagctatcccgaacaaggctatgaccgaccctacgaagattcttcgcagcattattacgagggagggaattcacagtacgggcagcagcaagacgcttaccaagggcctcctcctcagcagggctaccctccgcaacagcagcagtatccagggcagcaggggtatcccggacaacaacaaggatacggccctagccaggggggacccggtcctcagtacccaaattatcctcagggtcaaggtcagcagtacggtgggtacaggccgacccagcccggaccaccacaacctcctcagcagaggccttacggatacgatcaggggcagtacgggaattaccaacagtag

SEQ ID NO: 243164 - DNA, 399 bp, Artificial Sequence
  Description of Artificial Sequence: Synthetic coding sequence
atgaaccagcagtactaccccgatggtcataacgactatgggtatcagcaaccctcctatccagagcagggttacgatcgcccttacgaagattcatcccagcactattacgagggcggaaactctcagtacggccagcagcaagatgcctatcagggtcccccaccacagcagggttatcctcctcagcaacagcaataccccggtcaacagggctaccccggacagcaacagggatatgggccatctcagggcggtccagggccacagtaccccaattacccccaaggtcaggggcaacaatatggaggttatcggcctacccagccgggaccccctcagcccccacagcagaggccttatggctacgaccaaaattcacggtggaccgtgtgctag

SEQ ID NO: 243165 - DNA, 1011 bp, Artificial Sequence
  Description of Artificial Sequence: Synthetic coding sequence
atgcccatggggccaggaggtatgaaccagtctggcccacctccaccacctcggtcccataacatgccttccgacggtatggtgggcggtggacctccagcgccacacatgcagaatcagatgaacgggcaaatgccaggccctaatcatatgccaatgcaaggcccaggtccaaaccagctgaacatgaccaacagctctatgaatatgccctcctcttctcatggctcaatgggcggatacaatcactcagtgcccagcagtcagtcgatgcccgtgcagaaccagatgaccatgtctcagggacagcccatggggaactatggtcctcgccctaacatgtctatgcagccaaatcaggggccaatgatgcatcagcaaccaccaagccaacagtataatatgcctcagggcggagggcagcactaccagggccaacaacccccaatgggaatgatgggccaagtgaatcagggaaatcatatgatgggccagagacagattcctccttacaggcctccacagcaggggcctccacagcagtacagcggacaggaagattattatggggatcagtattcacacggcggacagggtcctccagagggcatgaatcagcagtattaccccgacggacacaatgactatggatatcagcagcccagctatcctgagcaggggtatgaccgcccatacgaggattcctcacagcattactacgaaggtgggaacagccagtacggccagcagcaggacgcttatcagggccctccacctcagcagggatacccccctcagcagcagcagtatcctgggcaacaaggatatccgggtcagcagcagggctatggacctagccagggtggcccaggaccccagtacccgaactatccgcaagggcagggacagcagtacgggggatatcgtccaactcaaccaggaccaccacagccccctcagcagagaccatacggatatgaccagggccagtatggcaattatcagcagtag

SEQ ID NO: 243166 - DNA, 1188 bp, Artificial Sequence
  Description of Artificial Sequence: Synthetic coding sequence
atgctggacgataacaatcacctaattcaatgtatcatggactcacagaacaagggtaaaacctccgagtgcagtcagtatcagcagatgctccacacaaatcttgtgtacctggctaccatagctgattcaaaccaaaacatgcagagtctgctccccgctcccccaactcagaacatgccaatggggcctgggggtatgaatcaaagcggtccaccaccacctcctaggagccataatatgccttctgacgggatggtcggcggaggccctccagctccgcatatgcagaatcagatgaacggtcagatgcccggacccaatcacatgcctatgcagggcccaggcccaaaccagctgaatatgactaacagttccatgaacatgccatcctcatcacatggcagcatgggtggctataatcattctgtccctagctcccagtcaatgccagtgcaaaaccagatgacgatgtctcagggccagcctatgggcaattatgggccaaggcccaacatgtcaatgcaaccaaatcagggaccaatgatgcaccagcagcccccatctcaacagtacaatatgccgcaaggcggaggccagcactaccaggggcagcagccgcctatgggtatgatgggccaggtgaaccaggggaatcacatgatggggcaaagacagattccaccttatcgcccaccgcagcaaggcccaccacagcagtatagcgggcaggaggattactatggcgatcaatattctcacggcggacagggcccacccgagggaatgaaccagcaatactatccagatggacacaatgactacgggtatcagcagccatcctatcctgaacagggatatgatcggccttacgaggacagttctcagcattactatgagggcggaaactctcaatacggccaacaacaggatgcttaccagggaccccctcctcagcaggggtacccaccacaacaacagcagtacccaggtcagcaggggtatccagggcagcagcagggttacggtccctcacagggcggtccgggtccccagtatcccaattatcctcagggacaaggccagcaatatggcggataccgcccaacacagcccggacctccccaaccaccgcaacaaaggccctatggatatgatcaggggcaatatgggaactaccaacaatag

SEQ ID NO: 243167 - DNA, 1008 bp, Artificial Sequence
  Description of Artificial Sequence: Synthetic coding sequence
atgctgcatacaaacctcgtgtatctagcaacaatcgctgactccaaccagaacatgcagagcctgctccccgctccacccactcagaacatgcccatggggcctggaggcatgaatcagagcggaccgccaccgcctcccagatcccacaacatgccaagtgacgggatggtgggcggaggaccccctgcccctcatatgcagaaccagatgaacggtcaaatgccaggccctaatcacatgccaatgcagggtcccggacccaaccaattgaacatgaccaattcaagcatgaacatgccatcctcctctcacggctctatgggaggctataatcacagcgtgcctagttctcagtctatgcccgtgcagaaccagatgactatgtcccagggtcagccaatgggcaactacggtccccgtcccaatatgtctatgcagcctaaccagggcccaatgatgcaccagcaaccgccaagccagcagtacaacatgccacagggaggaggacagcattatcagggccaacagccacccatgggcatgatgggacaggtgaaccaggggaaccatatgatggggcagcggcagatccctccctacaggcctcctcagcaaggtcctccccagcagtattccgggcaggaggattattacggcgatcaatattcacatgggggtcagggccctccagaaggcatgaatcaacagtattaccccgatggaaattctcagtacgggcagcagcaagatgcgtatcaggggcctccaccccagcaaggatatccccctcagcagcagcaatatcctggacaacagggataccccggacagcaacagggctacggtccctcccagggaggtccgggtcctcagtaccccaactatccccagggtcagggacagcagtatggaggataccgccctacgcagccaggaccacctcagcccccacagcaacgcccatacggctacgaccaagggcaatatggcaattaccagcagtag

SEQ ID NO: 243168 - DNA, 1008 bp, Artificial Sequence
  Description of Artificial Sequence: Synthetic coding sequence
atgttgcacaccaatctggtgtacctggctaccatcgccgattccaaccagaacatgcagagcttgttgcctgcccctcccacccagaacatgcccatgggcccaggaggaatgaatcagtcgggaccacctccgcctccgaggtcccacaacatgccctcggatggcatggtcgggggaggccctcccgcacctcacatgcagaatcagatgaatgggcagatgcctggacccaatcatatgcccatgcagggtccaggccctaatcaactcaacatgacgaattcttctatgaatatgccctcctcatctcatgggtccatgggaggctacaatcatagcgttccttcctcccagtcaatgccagtccaaaatcaaatgaccatgagtcaaggtcagcccatgggcaactatggaccacgccctaacatgagcatgcaaccaaatcaaggcccaatgatgcatcaacagcccccaagccagcaatacaacatgccccagggagggggacagcactaccagggacaacagcctcccatggggatgatgggccaggtcaatcaaggcaaccacatgatggggcagagacagatacctccatatcgcccaccacagcaaggccctccccagcagtattctggacaggaagactattacggtgatcaatactcccacggcggtcaggggccaccagaggggatgaaccaacagtactatccagacggtaattcccagtatggccaacagcaggatgcctaccagggcccaccaccacagcagggataccctccacagcagcagcagtatcctggacagcaaggatacccgggtcaacagcagggctacgggccaagccaggggggacctggaccacagtacccgaactatccccagggacaggggcagcagtacgggggttacaggccaacccagccgggaccaccccagccgccacagcagcggccatatggctacgaccaggggcagtatggaaactatcagcaatag

SEQ ID NO: 243169 - DNA, 567 bp, Artificial Sequence
  Description of Artificial Sequence: Synthetic coding sequence
atgaatggcgatgacaccttcgctaagaggcccagggatgacgcaaaagctagcgagaagcgatcgaaagccttcgacgacatcgccacatactttagcaagaaggagtggaaaaaaatgaagtactccgagaagattagttacgtatacatgaagaggaattacaaagctatgactaaattgggatttaaagtgaccttgccgcctttcatgtgtaacaagcaggccaccgatttccagggaaatgacttcgataacgaccacaacaggcggatccaagtggagcatccccagatgacgtttgggaggcttcaccgaattatccctaagatcatgccgaagaaacccgctgaggatgaaaacgactctaagggcgtctccgaagcctccgggccacagaatgacgggaaacagctgcaccccccaggaaaagctaacatatccgagaaaattaacaaaaggagtggcccaaaaagagggaaacatgcttggactcaccgcctgcgagaacgcaagcagttggttatatacgaagagatctccgaccccgaggaagacgacgagtag

SEQ ID NO: 243170 - DNA, 672 bp, Artificial Sequence
  Description of Artificial Sequence: Synthetic coding sequence
atgaacggagacgacgccttcgctaggcgtcccactgtcggtgctcaaatacccgaaaagattcagaaagccttcgacgacattgcgaagtatttctccaaggaggagtgggagaagatgaaggcaagcgaaaaaattttctacgtctacatgaaaaggaagtacgaggccatgacaaagcttgggtttaaggccacccttccgcctttcatgtgtaacaaacgggctgaggactttcaaggcaatgacctggataatgatcctaacagagggaatcaggtggagcgaccccagatgactttcggtcgactccagggaattagccctaaaattatgccaaaaaagcctgcagaggagggaaacgatagcgaagaggttcctgaggcctccggcccacaaaatgatggcaaggagctctgccccccaggtaagcccacaacttccgaaaaaatccacgaaagatctggcaacagggaggcccaagaaaaggaagagcgacggggtactgcccatagatggtcctctcagaatacgcacaacatcggaaggttttcactttcaaccagcatgggcgctgttcacggcacacctaagacaatcactcacaaccgagaccccaagggtggaaatatgcctggtccgacagactgtgtgcgcgaaaattcctggtag

SEQ ID NO: 243171 - DNA, 567 bp, Artificial Sequence
  Description of Artificial Sequence: Synthetic coding sequence
atgaatggcgacgatgcctttgctcgccgtcccacagtcggcgctcagattccagagaaaatccaaaaggctttcgacgatattgctaaatacttctctaaggaagaatgggagaagatgaaggcatccgagaaaatcttctacgtttacatgaagaggaaatacgaagcgatgacaaaattaggatttaaggccaccctccctccctttatgtgcaacaagagggctgaagattttcagggaaacgaccttgataatgatcccaacagagggaaccaggttgagagaccccagatgacattcggccgactgcaagggatcagtcccaaaataatgcccaagaagccagcggaagagggtaatgacagtgaggaagtgccagaggcttctggtccccagaacgatggcaaggaactttgccctccaggcaaacccacaacgagtgagaagattcatgagcgctctgggccaaagagaggagagcacgcctggactcatcgactacgggaaagaaagcagttggtgatctatgaagagatctccgacccggaggaggatgatgaatag

SEQ ID NO: 243172 - DNA, 567 bp, Artificial Sequence
  Description of Artificial Sequence: Synthetic coding sequence
atgaacggggatgacacgtttgcccgtcgccctactgttggagcacagattccggagaaaattcaaaaggcctttgatgacatagcgaagtacttctccaaagaggagtgggagaaaatgaaggtgagcgagaagatcgtgtacgtttacatgaaacgcaaatatgaagctatgactaagcttggctttaaggctatactcccttccttcatgagaaacaaaagagtgactgattttcaggggaacgacttcgacaacgatcctaataggggaaaccaggtgcagagaccgcagatgaccttcggtcgactgcagggcatcttccccaagataatgcctaaaaagccagcagaagaggggaacgtgtctaaagaggtgcctgaggcctcaggtccgcagaatgacggcaagcagttgtgtccccctggcaaaccaaccaccagcgagaaaatcaatatgatcagcggaccgaagcggggagagcatgcttggacgcaccggttaagggagaggaaacagctcgttatttacgaagaaatatccgacccggaagaggacgacgaatag

SEQ ID NO: 243173 - DNA, 513 bp, Artificial Sequence
  Description of Artificial Sequence: Synthetic coding sequence
atgaatggcgacgacacattcgctaggcgaccaaccgttggggcacaaatcccagagaagatacagaaggcctttgatgatattgctaagtacttcagtaaggaagaatgggaaaagatgaaggtctctgaaaagatagtgtacgtctacatgaaacgcaaatatgaggccatgacgaagctgggattcaaggctatccttccttctttcatgaggaataaacgcgtgacagacttccaaggtaatgatttcgataatgaccctaatagaggtaatcaggtccagagaccgcaaatgactttcgggcgtttacagggaatcttcccgaagatcatgcctaagaaacctgccgaggaaggtaatgttagtaaggaggtgccagaggccagcggccctcagaatgacggtaagcagttatgtcccccaggtaaacccaccacttctgaaaagattaacatgatctccggtgttctccagaggtattgtagattcggctcccgacctctgcagtag

SEQ ID NO: 243174 - DNA, 303 bp, Artificial Sequence
  Description of Artificial Sequence: Synthetic coding sequence
atgtacagtctgtcagtgcaacgccctcaaatgacttttggtaggctgcagggcatttttccaaagatcatgcctaagaaacccgctgaagagggcaatgtaagcaaagaggttccagaggcctcaggccctcagaatgacggtaaacagctgtgtccccctggtaaacccacaaccagcgagaagatcaacatgatatccggcccaaagcgaggtgagcatgcttggacacaccgcctgagggaaagaaaacagctagtaatttacgaggagatttccgaccctgaggaggatgacgaatag

SEQ ID NO: 243175 - DNA, 462 bp, Artificial Sequence
  Description of Artificial Sequence: Synthetic coding sequence
atgaacggcgatgatgccttcgcaaggcgccctagagatgatgcccagattagcgaaaaactgagaaaggcttttgatgatatcgcaaaatacttcagcaaaaaagagtgggaaaagatgaagtcatccgagaagatagtctacgtctatatgaagctcaactatgaggtaatgaccaagctgggctttaaggtaaccttgcctcctttcatgcgcagcaaacgggctgccgattttcatggaaacgatttcgggaacgatcggaatcacaggaaccaagtagagaggccccagatgacgttcgggtcgctgcagagaatctttccgaaagatccaaagggtggtaacatgccgggtccaactgattgtgtgcgcgagagctcttggtggttcatgaaaagatctgccacgctcaggaaaatgacctcaaattctcctaggggctacgatacatgcccctag

SEQ ID NO: 243176 - DNA, 567 bp, Artificial Sequence
  Description of Artificial Sequence: Synthetic coding sequence
atgaatggcgacgacgctttcgctcgccgtccgagagacgacgcccagatttccgaaaagctacgaaaggcttttgatgacatagctaagtacttttcaaagaaggaatgggagaagatgaaaagttctgaaaaaatcgtctacgtctatatgaaactgaactatgaggttatgactaaacttggctttaaagtgactctgcctccttttatgagatccaagcgggctgcagacttccacggaaatgatttcggtaacgatcggaaccacaggaaccaggttgagcgacctcagatgaccttcgggtctctccaacgaatcttcccgaagatcatgcctaagaagcccgcagaggaggagaacggactgaaagaggttccagaagcttctggcccacagaacgacggcaaacaactgtgtcccccaggaaacccgtcaaccctggagaaaattaataaaacgagcgggccaaagcgcggtaaacacgcctggactcaccggttgcgcgagcgcaagcagttagtggtgtatgaggaaatcagcgatcctgaggaggacgatgagtag

SEQ ID NO: 243177 - DNA, 1992 bp, Artificial Sequence
  Description of Artificial Sequence: Synthetic coding sequence
atggggcctctgcgtgaatctaagaaagagcacagggtgcagcatcacgacaaggaaatttcgaggtcccggattccacggctcattctccggccacacatgcctcagcagcagcataaggtctcccccgcatctgaatcacccttcagtgaagaggaatccagagaattcaatccatcatcttccggcaggagcgccaggactgtgtcttccaactcattctgcagtgacgacacaggatgtccatctagccagtccgtatcgcccgtgaagacaccatccgacgcaggtaatagcccaataggtttttgccccggttctgatgaaggttttaccagaaaaaagtgcaccatcgggatggtgggcgaaggatccatccaaagttccaggtacaaaaaggaatcaaagtctgggctcgttaagccgggatctgaggctgactttagcagcagttccagcacgggaagcatttcggctcccgaagtgcatatgtcaacagctggcagtaaacggagctcctccagcaggaatcggggaccgcatggcaggtctaacggcgcaagttcccacaaaccaggctcaagcccctcaagcccacgcgagaaagacctcctctctatgctgtgccgcaaccagctgtccccggttaatattcacccaagctacgcaccctcctccccatcttcctcaaactctggaagttacaagggctcagactgctcacctatcatgcggagatcgggtagatacatgtcttgtggcgagaatcacggagtgcgaccccctaacccagagcaatacttgacccccctccagcagaaggaggtgactgtgcgtcatctcaaaaccaagttgaaggagtcagagcgccgtctgcacgagagagagtctgaaatagttgagctgaaatcccaacttgctcgaatgcgggaggactggatcgaggaggagtgccatcgggtggaggcccagctggccctgaaggaggccagaaaggaaattaaacagctgaaacaggtgattgaaaccatgcgatctagcctcgccgacaaggacaagggaatccaaaaatattttgtggacatcaacattcagaacaagaaattggaaagcctacttcagagtatggaaatggctcattctggttccctgagggacgaattgtgcctcgacttcccttgcgacagccccgagaaaagtctgactttaaatcccccattagatactatggctgacggactcagcttggaggagcaggtaacgggagagggagctgatagagagttgcttgtcggcgactctattgcgaacagcacagacctctttgatgagattgtgactgcaacaacaacggaaagcggagacctggagctggtccatagcacccccggagcaaacgttctggaactgctgccgattgtgatgggtcaggaggaaggcagcgtggttgtggaacgagcagtgcagacagatgtagtcccgtactcgccagcaataagtgaacttatccaatcagtactacaaaagttacaggatccgtgccctagtagtcttgcatctcctgacgagtcagagcccgattctatggaaagctttcccgagtcactgtctgctctcgtcgtcgacctgacacctcgcaaccccaatagcgccatcctgttatcaccagtggagactccctacgccaacgtcgatgcggaagtccacgctaatcggctgatgagggagttggacttcgcggcatgtgtggaggaacgcctggacggagtgattccccttgccagaggcggtgtagtgcggcaatattggtccagcagctttctcgtggacctgcttgccgtggccgcacctgtggtgcccaccgtgctgtgggccttctctacgcagcggggaggtacagaccctgtatataacataggagctttgttaagaggatgctgcgtggtggccctccatagtcttcgccgtacagccttccgaatcaaaacctag

SEQ ID NO: 243178 - DNA, 1983 bp, Artificial Sequence
  Description of Artificial Sequence: Synthetic coding sequence
atgtcaaatttcgagaaagagcatcgggtgcagcatcacgacaaggaaatcagcagatcacgaattcctcgcctgatccttcggccacatatgcctcagcaacagcataaggtctctccagcgagcgagtcacccttctccgaggaggagagccgcgaatttaatcccagcagctcagggagatccgcacgtacggtgtcatccaatagcttttgctctgacgatacaggctgcccaagtagccagagcgtatctcccgtcaagaccccgtcagatgccggaaatagccctattggcttttgtcctggttccgatgagggttttacgagaaagaagtgcaccatcggaatggtgggagagggatctatccagagttcgagatacaaaaaggaaagtaagtcgggcctggtcaagcccggtagcgaagcggattttagctcctccagcagcacaggaagtatctcagcccctgaggtgcatatgtcgactgcaggttcaaagcggtcatcctccagcaggaataggggccctcacggcagatcgaatggcgcttcctctcacaagccgggtagcagcccttcctcccctcgcgagaaggatcttctcagcatgctctgccgcaatcaattgtcgccggtgaatatccaccctagttatgcgccatcctcacccagttcttccaactcgggaagctataaaggctccgattgctcccccattatgagacgctccggacggtatatgtcatgcggggaaaaccatggcgtacgacctcctaatccagagcaatatctgacccccctccagcagaaggaagtgacagttagacacttgaagactaagcttaaagagtccgaaagaagactgcacgaacgggagtcggaaatagtcgagctgaaaagccagttagcgcgaatgcgagaggactggatcgaggaagaatgccatcgagtggaggctcagctcgccctgaaggaggcaagaaaagagatcaagcaattaaagcaggtcatcgaaacaatgcgtagttctctcgcggataaagataagggaatacaaaagtactttgtggacattaacatccaaaacaaaaaactggagtccctcctgcaaagtatggagatggctcactcagggagcttacgggacgagctgtgtctggattttccgtgcgacagcccggagaaatcactgacgctaaatccccctctggacacaatggcggacggtctctcactcgaggagcaggtcaccggcgagggcgctgacagagaattattagtaggagattcgatagctaacagtaccgacttgttcgatgaaatcgtgactgccacaacgactgagtcaggggacctggagttggtacattcaactccaggcgctaatgtgttggaactgttgcctatagtcatggggcaggaagagggaagtgtggtggttgaaagggctgttcagactgatgtagtgccatacagtcctgcaatatcagaactgatccagtctgtgctgcagaaactgcaggatccttgcccgagtagtctggcttccccagatgaaagcgagccggattctatggagagctttccggagtctctgtccgctctggtggttgatttgactccacggaatcccaatagtgccatcttattgagccccgtggaaaccccttatgccaacgtggacgcagaagtacacgccaacagacttatgcgtgaactggactttgcggcttgcgtggaagaaagactcgatggagtgattccactcgccagagggggtgtcgtgaggcaatactggagctcttcatttctcgtagacctgttggctgtggcggctcccgtggtgcccactgtcctgtgggctttctcgacccagcgaggaggtacggacccggtgtataatattggtgcccttctacggggatgctgcgtggtggccctacacagcctgcgccgaactgcctttcggatcaagacgtag

SEQ ID NO: 243179 - DNA, 1635 bp, Artificial Sequence
  Description of Artificial Sequence: Synthetic coding sequence
atggtaggcgagggaagcatacagtcgtcccggtacaaaaaggaatcaaagtcagggctggtcaaacccggaagcgaagctgacttctcaagctcatctagtaccggctccatcagcgcacctgaggtgcacatgtctactgccggatctaaacggtcctcctcttcacgcaatcgcggacctcacggtcgctccaatggcgcttctagtcacaagcctggtagctcaccatcctcccccagagagaaagacctgcttagcatgctgtgcagaaaccagctgtctccagtgaacatccatccctcctacgccccttcatcaccgagctcttccaactctggatcatacaaggggtccgactgttcccctataatgcggagaagcggcagatacatgagctgtggggaaaaccatggcgttaggcctccaaaccctgaacaatatctaaccccactgcagcagaaagaggtcacagttcgccacctaaagactaagcttaaggagagtgagagaaggcttcacgagagagagtccgagatcgtggaactgaagtctcaattggcacgcatgcgcgaggattggattgaggaggaatgtcacagagtggaagctcagctggcactgaaggaagctcgcaaagagatcaagcaattgaagcaagtcatcgagacaatgagatcctctctggccgacaaagataagggcattcagaagtactttgtggatattaacatacagaacaaaaagctggaatccttactacaatctatggaaatggcacattctgggtctctgagggatgagctttgtctagacttcccttgtgatagccctgagaagtccctgacgctgaacccccctttagacactatggcagacggtctcagtctcgaagagcaagttacaggcgaaggcgcagacagagagcttctcgtcggagattccatcgccaacagtaccgatctctttgatgagatagtaacagcaacaactactgaaagtggggacctcgagctggtgcattcaacaccaggggcaaatgtgcttgagctgttaccaatcgtaatgggacaggaggaggggtctgtggtcgtcgagagagctgtgcagactgacgtcgtaccatactctccggcaatctcagaactcatccagagtgtgctgcagaaactgcaggatccctgccctagcagcctcgcctcaccagacgaatctgagccagacagcatggagtcattcccggagagcctgagcgccctggtcgtggacctgacgcccagaaaccctaattccgccatcttgttgtcgccagttgagaccccttatgctaacgtggacgctgaggtgcatgctaacagactgatgcgagagctcgattttgccgcatgcgtggaagagagactggacggggtgatccctctggctaggggtggtgtcgtccgtcaatactggtcctcatctttcctggtggacctcctcgccgtggcagcccctgtggtgccgactgtcctgtgggcattctctacacaacggggtggtaccgaccccgtgtataacatcggcgcactgctcaggggttgttgcgtagtcgccctccacagccttcgacgcacggcctttcgcataaaaacctag

SEQ ID NO: 243180 - DNA, 1992 bp, Artificial Sequence
  Description of Artificial Sequence: Synthetic coding sequence
atgggccctttacgagagagtaaaaaggaacaccgcgtacaacaccatgataaggagataagccgcagtaggattcctcgcttaatactccgtccacacatgcctcagcagcagcacaaggtgagtcctgcttccgaaagcccgttcagcgaagaggagtctagagaattcaacccgagttcttctggccgttcagctcgcaccgtctcgtctaactctttctgttctgacgacaccggttgcccgtcctcacagtcagtgagcccggttaagacaccaagcgacgccggtaactcaccaataggattttgcccgggtagcgacgaaggcttcactcgaaaaaagtgtaccattggtatggtcggagagggctcaatccagtcctctagatacaaaaaggaaagcaaatccggactggtcaagcctggtagtgaggcagactttagctcttctagttcaacggggtctatcagtgctccagaagtccacatgagtacagccggaagcaagcgttcatcaagcagccgcaatcggggaccacacgggagatcgaacggcgcaagctctcacaaaccagggtcaagccccagctctccgagggagaaagatctgctgtccatgctctgccgcaatcagctcagtcccgtcaacatccaccctagctatgccccttcgtccccgtcctccagcaatagtggctcctataagggtagtgactgcagcccaattatgagaagatccggcaggtacatgagttgcggcgaaaaccacggtgttagacctcccaaccctgaacaataccttacccccctgcagcaaaaggaagtgactgtgcggcacctcaagacaaaactgaaggagtcggaacgcagactccacgagcgggaatcagaaatcgtagagctgaagagccagctcgcaagaatgcgagaggattggatagaggaagagtgccatagggtggaagctcaattagcactcaaggaggcaagaaaagaaataaagcagctgaagcaggtaatcgagacaatgagatccagccttgccgataaggataagggaatccagaagtacttcgtggacatcaacattcagaacaagaaacttgagtccctcctgcagagcatggaaatggcccattcagggagcctcagggacgagctatgcctggactttccatgcgactcacctgagaaatcactcacgttgaacccacctttagataccatggcagacgggctcagcttggaggaacaagtgaccggtgagggcgctgatcgcgagctgctcgtgggggactccattgccaactccaccgacctctttgacgagatcgtgactgccaccaccactgagtctggcgacctggaattggtgcactcaacccctggagccaacgtgttggagctccttcccatcgttatggggcaagaagaagggagcgtggttgtcgagcgcgcagtgcagactgacgtggtgccatactcacccgcaattagcgaacttatccagagtgttctgcagaaactgcaggatccctgccctagtagtctggcatctcctgacgaatccgaaccggactcaatggagtcctttcctgagagccttagcgctctggtcgtggaccttacaccacgcaaccctaacagcgcaatccttttgtctcccgtcgagacaccatacgcaaacgttgacgcggaagttcacgcgaatcgtctgatgcgagagctggacttcgctgcgtgtgtggaggagagactggatggcgtgatacctctcgccagagggggagtggtgcgtcagtactggagttcaagctttctggtggacctgctggccgtcgcagctccagttgtgccaactgtgctttgggcgtttagcacacaaagaggcggaactgatcccgtgtataacatcggtgctctgctgagagggtgttgtgtggtagctctccattctctgagacggactgccttcaggatcaagacttag

SEQ ID NO: 243181 - DNA, 1989 bp, Artificial Sequence
  Description of Artificial Sequence: Synthetic coding sequence
atggggcctctgcgcgagagcaaagagcaccgggtgcaacatcatgacaaggaaatcagccggtcccgcatcccacggttgatcctccggccacacatgcctcaacaacagcacaaagtcagtccggcatccgagtctccctttagcgaggaggaatcacgagaatttaatccctcttcatccggacgcagcgctcggactgtgtcctctaattctttctgttcagatgacactggttgtcccagttcccagagcgtttcccccgttaagacgccaagtgatgcgggaaactcacccataggattctgtcccggttctgatgaaggcttcacccgaaagaagtgcactatcggtatggtgggggaggggtccattcaaagcagccgatataagaaagagagcaagagtggtctcgttaagcctggctctgaggccgacttctccagttcttcgagcactggaagcatcagtgcacccgaagtgcatatgagcactgctggcagtaagcgttcctcaagttcacgaaatcgcggtccccacggcagatctaatggagcctcttctcacaagcccggttcctcaccatcatccccacgcgaaaaggatttattgtccatgctttgtcggaatcagctctctcctgtcaatatacaccccagctatgccccaagtagtccatcctccagcaattctggctcctacaagggatcagattgctctccgataatgaggagaagcgggagatatatgagctgcggggagaaccatggagtcagaccgccaaacccagaacaatacctcaccccacttcagcagaaggaggtgaccgtcagacatttgaaaactaaactcaaggaatcggagcgacgactgcacgagcgggaatccgaaattgtagagctcaagtcacagctcgctcgtatgcgtgaagattggattgaggaggagtgccatcgcgtcgaagcccagctggcacttaaggaagccaggaaggaaatcaagcaattaaaacaagtgatagaaactatgagatcttcactcgcggacaaagataagggtatccagaagtattttgtggacatcaatatccagaataagaaattggagtctctgttgcagagcatggaaatggcccattcaggtagtcttcgcgacgaattgtgcttagacttcccctgcgactctcccgaaaagtccctgactctcaaccctcccttagataccatggcagatggtctgtctctagaggaacaggtcactggagagggtgctgatcgggagctgctcgtgggagattccattgccaactccactgatctctttgacgagatagtaaccgcaacgaccaccgagtccggcgacttggagttggtacactctacacccggagcgaatgtcctggagcttctacctatcgtaatgggccaggaagagggctctgtggtagtcgaaagagccgttcagactgacgtagtgccctattccccagccatctctgagctcatccagtccgttttgcaaaagctgcaggatccatgtccaagctcccttgcaagcccggatgagagcgagccagattcgatggagtcctttccagaaagtttaagtgccctcgttgttgacctaactccaagaaatcctaactccgctatccttctgtctccggtggaaactccttatgcaaacgttgatgcagaggtgcacgcaaaccggctgatgcgcgaattggactttgcagcttgtgtcgaagagcggctggacggagttattcctctcgcccgtggaggcgttgtgaggcagtactggtcatcatccttccttgtggatctcctggcagtcgctgctcctgtggtgcctacagtgctctgggccttctccacgcagagagggggaacagaccccgtctacaacatcggtgcactgctccgcggatgctgcgtggtagctctgcattccctcaggcgaacagcctttaggataaagacgtag

SEQ ID NO: 243182 - DNA, 1992 bp, Artificial Sequence
  Description of Artificial Sequence: Synthetic coding sequence
atgggaccactccgcgagagcaagaaagagcatcgggtgcagcatcacgacaaggagatttcccggagccggattccacgcctgattctccgtccacatatgcctcagcagcagcacaaagtcagccctgcctcagagagccccttttcagaggaagagagtagagaatttaacccttcatcatcagggagatccgcccgaaccgtgagctcaaacagcttttgttctgatgataccggatgcccaagttcccagtcagtgagtccagtaaagacaccctctgacgctggcaactctccaattggcttctgccccggttcagacgaagggtttacacggaagaaatgtacgatcgggatggtcggagaaggtagcattcagagttctcggtataagaaagagtcgaagtccggactggtcaagccaggctcagaagccgacttttcgagttcaagctccaccgggtctatttccgcccctgaggtgcacatgtccaccgctggtagcaaacggagcagcagcagtcgcaatcgtggcccacatggtagatccaatggagcctcctcacataaacctggctctagcccctctagtcccagggagaaggacctgcttagtatgttgtgtaggaatcagctgagtcccgtcaatatccatccctcttatgccccaagctccccctcctcttctaactccggttcgtacaaaggctccgactgctctccgattatgcgacgtagcggtagatatatgtcttgcggggagaaccatggcgttagaccacctaatccggaacagtatcttacgcccttacagcagaaggaggtgacagtgcgacacctgaagacaaaattgaaagaatccgagagacgcttacacgagagagagtcagagatagtggagctgaaaagtcagctggcacgaatgagagaggattggatcgaggaagagtgtcaccgggttgaggcacagctggcactaaaggaggccagaaaggaaatcaagcagcttaagcaggttatcgagacaatgcggagtagtctagctgacaaagataaagggatccagaaatactttgttgacatcaacattcagaacaaaaagctggaatcactccttcagtcgatggaaatggcccactcaggttctcttcgggacgaactctgtctggactttccatgcgatagtccagagaaatcattaaccctgaaccctccacttgacactatggctgatggactcagcctcgaggaacaggtgacaggggaaggggctgaccgggagctgttagtcggcgatagtattgccaacagtacagatcttttcgatgaaatcgtgaccgcaaccacaacagagtcaggcgacctggagctcgtgcactcaactcccggagccaacgtcctagaactgcttcccatagtaatggggcaggaagagggctccgtggttgtggaacgcgcagtccagacagacgtagtcccctacagccccgcaataagcgagctcatccagtctgtgctgcagaaactgcaagatccgtgtccctcctctctagccagccccgatgagagcgagcctgattctatggagtccttccctgagagcctgagcgctctggttgttgatctgacacctcgcaaccctaactcagccatacttctgtcccccgttgaaactccgtatgccaacgtggacgcagaggtacacgctaaccgattaatgagggagctggactttgccgcatgcgtcgaggaaaggctggatggggttatcccgctcgccaggggcggagtggtccggcagtattggtctagctcatttctcgttgatcttcttgcagttgctgccccagttgtccccactgttctatgggctttctcgacacaacgcggtggaacagaccccgtctacaacattggcgctctgctccggggttgctgcgtcgttgcgttgcattcattgcgcagaacagccttccgtataaaaacatag

SEQ ID NO: 243183 - DNA, 1992 bp, Artificial Sequence
  Description of Artificial Sequence: Synthetic coding sequence
atgggaccactccgggagagcaagaaggagcatcgagtacagcaccacgacaaggaaatcagcaggagcagaatcccaagactgattctaagaccccatatgccgcagcagcagcacaaggtgagccctgcaagcgagtcccccttctcagaagaagaaagtagagagttcaacccaagcagcagcggcaggtctgcacgcacagtgagcagcaattccttctgtagtgatgacaccggctgccccagtagccagtcagtcagcccggtcaaaacgccatccgatgccggaaacagcccaatcgggttctgcccgggttctgatgagggcttcacccgaaaaaaatgcactataggcatggtaggtgaagggagtattcagtctagcagatataaaaaagagtcaaaaagcggcttggtaaagcccggttctgaagcagattttagttcttcctcatcaaccggtagtatctctgccccagaggtgcatatgagtacagcaggctcaaagagatcgagttcctcccggaatcggggtcctcatggacggtctaacggtgctagctcccataagccgggatccagcccttcctccccaagagaaaaggacctcttgagcatgctgtgtcggaaccagctctcacccgtcaacatccatcctagctacgccccttcttcgccatcttcctctaattcgggaagttataagggtagcgattgttcacctattatgaggcggtctggacggtacatgtcctgtggcgaaaaccatggcgtccgccctcccaatccggaacagtatttgacccccttgcagcagaaagaggtgacggtcagacacctgaagactaaactaaaagagtctgaaaggcgtcttcatgaaagagagagtgaaatcgtggaactcaagagccagctagcgaggatgagagaggactggattgaagaggaatgtcacagggtcgaagctcaattagcccttaaggaggcacggaaggagatcaaacagcttaagcaggtgattgagacaatgcggagctcactagctgacaaagacaaggggattcagaagtactttgtggatataaatatccagaacaaaaaactggagtctctgctgcagtcaatggaaatggcccattctggcagcttacgcgacgagttgtgcctggactttccctgcgacagccccgagaagtccctcaccctcaatcctcctctggacactatggccgacggactgagcctcgaggagcaggtgaccggcgaaggcgctgaccgcgagctgctcgtcggtgatagtattgccaatagcactgacctatttgatgagatcgtgacagccaccacaaccgaaagtggcgacttggagttggtgcacagcactccgggagccaatgtgctggaactgctgccaatagttatgggacaagaggaggggagtgtcgttgtagagagggcagtgcagacagatgtcgtaccctacagtccagccatctcagaactcatacaaagcgtgctacaaaagctacaagatccctgcccctccagcttggcctcccctgatgagtcggagccagacagcatggagagttttccggaaagcctttctgcgctggtggttgacctcacacccagaaacccaaacagcgccatcctgctgtccccagttgagacaccatatgccaatgtggacgctgaggtacacgccaatcggttaatgagagagctcgactttgccgcatgcgttgaggaacgcctggatggggtcattcctctggcgcgagggggtgtggtgcgccagtattggtcaagcagttttctggtagacctgctggccgtagccgctcctgtagtacctactgtgctgtgggccttcagtacacagaggggtggtacagacccggtatacaacatcggcgcactgctgaggggctgctgtgtggtggctctgcacagccttcggcgaacagctttccgaatcaaaacttag

SEQ ID NO: 243184 - DNA, 1992 bp, Artificial Sequence
  Description of Artificial Sequence: Synthetic coding sequence
atggggccactgagggaaagcaaaaaagaacaccgtgtacaacatcacgataaagaaatctcccgctcccgcatacctagactgattttgcgccctcacatgccacagcaacaacataaggtctcccccgcatcagagtcccccttttcagaggaggagtcccgggagtttaatccgagctcatccggcaggtctgcccgtactgtgtccagtaactcattctgctccgatgataccggctgccctagctctcagtccgtgagccctgtgaaaacaccaagcgatgcgggaaacagtcctattgggttttgccctggttccgacgaggggttcacccggaagaaatgcaccatcggcatggtgggcgaaggatctatacagagctcccgttacaagaaagagagcaagtctggactggtcaaaccagggtccgaggctgattttagttccagcagcagtaccggctctatttccgcccctgaggtccatatgtcaaccgcgggtagcaagagatcatcctcctctcgcaaccgaggcccacacgggcgatctaacggcgcttcctcacataaaccagggagttcacccagctcccctcgagagaaggacctactgtctatgctgtgtcgcaaccagctgagccctgtgaacatccacccatcgtatgcccctagctccccttcgtcttccaactccggatcgtataaggggagtgactgtagccccatcatgcgcagatccgggaggtacatgagctgcggcgaaaaccacggagtgcgtccccctaacccagaacagtacctcacaccgttacaacaaaaagaagtgaccgttcggcacctgaaaactaaactcaaagagtcagagcgcaggttgcatgagcgggagagtgagatagttgagttgaagtctcagttggcgaggatgcgcgaagactggatcgaagaggaatgtcaccgggtcgaagcacagctggccctaaaggaagcgaggaaggagataaagcagctgaagcaggttatagaaactatgcgatcaagtcttgccgacaaggataagggcatccaaaagtatttcgtggacataaatatccaaaataagaagctggaaagcctcctgcagtctatggaaatggcccactccggctctctcagagacgagttatgcctggacttcccttgcgatagtccagagaaatccctgactctaaacccccctctggacaccatggccgatgggctctctttggaagagcaggtcactggcgagggagcggatcgcgagcttctcgtgggtgatagtattgcaaattcgactgatctgttcgatgaaatcgtgactgcaacaaccaccgaatccggagatttggagctagtgcactcgaccccgggtgccaacgttctggagttactgcccattgttatgggacaggaagaaggttccgtagtcgtggagagggcagtgcaaactgacgtggttccctacagtcctgccatttcagagttgatccagagcgtgttacagaagctgcaggatccctgcccttcatctctggctagtcctgacgagagtgaacctgattctatggagtcatttccggagtcgctgagcgcactcgtagtcgatctgaccccacgcaatcccaacagtgccatcctactttctcctgtggaaacgccatatgccaatgtggacgccgaagtgcatgctaatcggcttatgagggaactagactttgccgcatgcgtggaggaaagactggacggcgtgatccctttggccaggggtggcgttgttcgccagtactggagctctagcttcctagtagaccttctagctgttgctgcccctgtggttccaacggttctctgggctttcagcacccagcgaggtggcactgatcctgtgtataatatcggtgctctgttgaggggctgttgtgtagtggccttacatagtctccgcaggaccgcctttagaatcaagacctag

SEQ ID NO: 243185 - DNA, 1989 bp, Artificial Sequence
  Description of Artificial Sequence: Synthetic coding sequence
atggggcctctgagggagagtaaagaacatagagtccaacaccacgataaagaaatctcacggtcacgaataccccgactcattttaagaccccatatgccacaacaacaacacaaggtgtccccagctagcgagagtccgtttagtgaagaggagtcccgggagttcaatccttccagcagtggtaggagtgctagaacggtgtcatccaacagtttctgttctgacgacacagggtgccccagtagccagtctgttagtccggtcaaaacacctagcgacgctggcaatagtccgataggtttctgcccgggttcagatgaaggctttaccagaaagaaatgcacaatcggcatggtgggcgaggggagcatccaatcgtcgcgatacaaaaaggagagcaaatctggcctggtgaagccaggctccgaggctgacttctcatcgtcttcaagcacagggtccattagcgctccagaagttcatatgtccacggccggaagtaaaagatccagtagctcaaggaaccggggtccacatggtcgcagcaatggtgcctcatctcataaaccagggagcagtccgtccagccccagagaaaaggacctgctgagtatgctgtgtagaaatcagcttagtccagtgaacatccatccaagttacgccccttcctctccttcttcctccaatagcggctcatacaaagggagtgattgttctcccatcatgcgtcggtctggcaggtatatgagttgcggggaaaaccatggggtgaggcctccaaatcctgaacagtacctgaccccactgcagcagaaggaggttacagtccgacatctgaaaaccaaactcaaagagagcgagcggaggcttcatgagcgcgagagtgagatcgtggaactgaaatcccagcttgcgagaatgcgagaagattggattgaggaggaatgtcatcgcgtcgaagctcagctggctttaaaagaggctcgtaaagagatcaagcaactgaaacaagtcatagagacaatgcgcagctccctagctgacaaagataaaggaattcagaaatactttgtcgacataaatatccagaataagaaactggaaagtctactgcaatcgatggaaatggcacactcaggcagtttaagagatgagctctgcctggacttcccctgtgacagccctgaaaagagccttaccttgaatccccctttagacaccatggctgacgggctctcactggaagaacaggtaactggcgaaggggcagatagagaactcctggttggagactccatcgccaattccacggacctctttgatgagatcgtgacggccaccaccacagagagcggtgaccttgagctggtacattcgacgcccggtgccaatgtgcttgagctgctccccattgtgatggggcaagaagaagggtctgtggtggtggaacgtgctgtgcagactgatgtggtgccatacagccctgccatttctgagttgatacagtctgtgctgcagaagctgcaggacccctgtccgtccagtctggcttctcctgacgaaagtgagccggactccatggagagcttccctgagtctctttccgcacttgtggtggaccttacacccagaaacccaaacagtgctatattgttgtcccccgttgagactccttatgccaatgtggatgcggaagtgcacgctaatcggcttatgagggagctagacttcgccgcatgcgtcgaggagaggctggatggtgtgatccccctcgcgagaggaggagtggttagacagtattggagtagttctttcctcgtggatctcctggcggtggcagctcccgtggtgcctacggtcctctgggctttctccactcaaagaggaggcactgatcccgtgtataatataggtgccttgctccgcggttgctgcgtggttgccctgcatagtcttcgtcgcacagcctttcgcatcaaaacctag

SEQ ID NO: 243186 - DNA, 414 bp, Artificial Sequence
  Description of Artificial Sequence: Synthetic coding sequence
atgggccctctgagggagagcaagaaagaacacagagtccagcaccacgataaagagatttcgaggtccagaatcccccgactgattcttcgtccccacatgccacagcaacagcacaaggtttctccagccagcgaatccccattcagtgaggaagaatctagagaattcaatccctcctcctctggacggtccgcaaggacagtgagcagtaattcattctgttctgacgatactggatgccccagcagccagtccgttagcccagtcaagacgccatccgatgctgggaactcccctatcggtttctgtcctgggtcagacgagggcttcaccaggaagaaatgcacgattggaatggtgggcgaaggtagcatccaaagctcaagatacaagaaagagagtaaaagctag

SEQ ID NO: 243187 - DNA, 231 bp, Artificial Sequence
  Description of Artificial Sequence: Synthetic coding sequence
atgggccctctccgggaaagcaaaaaagagcaccgagtacagcaccacgataaagaaatatccaggtctcgaattcctcggcttatacttcggccacacatgccccagcagcagcacaaggttagccccgctagcgaaagccctttctccgaagaagaatcacgcgaattcaaccccagcagctccggacggtcagcacgcacagtcagttcgaacagtttctgtagctag

SEQ ID NO: 243188 - DNA, 222 bp, Artificial Sequence
  Description of Artificial Sequence: Synthetic coding sequence
atgggcccacttcgggagagtaagaaggaacacagggtacagcatcacgataaggaaatttcccggtcccgcatcccccgactgatcctccgccctcacatgccacaacaacaacacaaagtaagtcctgctagcgagagtccgtttagtgaagaggaatctcgggagttcaatccatcctctagcggaagaagtgccaggactgtttcgtcgaactcttag

SEQ ID NO: 243189 - DNA, 378 bp, Artificial Sequence
  Description of Artificial Sequence: Synthetic coding sequence
atggtcggagaaggttcaatacaaagttctcgctacaagaaggaatctaaatcaggattggtgaaaccaggctctgaggctgatttctcatcatccagctccaccggctccattagtgccccagaggtgcatatgtcgacagccggtagcaagaggagctctagctctagaaataggggacctcacggtcgatccaatggagccagttcccacaagccgggatcctcaccttctagccccagggaaaaggacctgctcagcatgctgtgtagaaatcagttgagccctgtgaatatccatccatcatatgcaccttcctctccatcatcctccaattcaggctcctataagggatctgactgttcaccaattatgtag

SEQ ID NO: 243190 - DNA, 1635 bp, Artificial Sequence
  Description of Artificial Sequence: Synthetic coding sequence
atggttggagagggctccattcagagtagcagatacaagaaggaaagcaagtccggcctagtgaagcccggtagcgaagccgatttctcctcgtcctccagtactggatcgattagcgctcctgaggtgcatatgtccactgccggatcaaagcggtcatcttcttctagaaaccgaggacctcacggaagatcaaacggagctagctctcacaagccaggctcttcccccagctcaccaagggaaaaagatttattatcaatgctatgccggaatcagctcagtcctgtgaacatccatccgagctatgcaccttcatccccttctagttccaactcaggcagctacaagggatctgattgttccccaattatgagaagaagtggtcgctatatgtcctgtggtgaaaaccacggggttcgccctcccaaccccgagcaatacctcactccactgcagcagaaggaggtgaccgtgagacatctgaagacgaagttaaaagaaagtgaacgtcggctgcatgaacgggagtcagaaattgtcgaactcaagtcccagctggcaagaatgagagaagattggattgaggaggagtgccatagagtggaggcacagctggctctgaaggaggctcgcaaggagatcaaacagctaaagcaggtcatcgagaccatgcgcagttcgcttgctgataaggacaaaggaattcagaaatatttcgttgacattaacattcagaataaaaagctagagagcctattgcaaagcatggagatggcacattctgggtctctgagggacgagctctgcctggattttccctgcgattccccagagaaaagcttgaccctgaatccaccattggataccatggccgacgggctctccttagaagaacaagttaccggggagggtgcagatagggagctgttagtgggggactctatagccaattcgaccgacctgtttgatgagatcgtcaccgcaaccaccacagaaagcggagatttggagttagtgcacagtactccgggagccaatgtgctggaactactgccaattgttatggggcaagaggaggggtccgttgtcgtggaacgggcagtccagaccgatgtggtgccatatagtccagccatttctgaattaatccagtcagtcctacaaaagcttcaggatccgtgtccgagtagtctggcgagtcccgacgaatcagagcccgatagcatggaatcgttccccgagagtctctcagccctggttgtggatttgactcctcgcaatcctaactctgcaatactgttgtcacccgtcgaaaccccgtatgctaatgtcgatgcagaagtacacgcaaatcgtctgatgcgggagctggactttgccgcttgcgtcgaggagaggctggatggcgttatccccctggcaagaggcggagttgttcgccagtactggtcgtcgtctttccttgtcgaccttttagctgtggctgcgcctgtggtaccaaccgtgctgtgggccttttctacacagcgcggaggaaccgatcccgtctacaatatcggcgctctgctgcggggttgctgcgtggtagccctgcattcgctccggagaaccgcctttaggatcaagacctag

SEQ ID NO: 243191 - DNA, 243 bp, Artificial Sequence
  Description of Artificial Sequence: Synthetic coding sequence
atggtgggcgagggaagcatccagtcaagccggtacaaaaaagagtccaaaagcggactcgtcaaaccgggtagtgaagcagacttcagcagcagctcgtcgactgggagcatctccgcaccggaggtgcacatgtctaccgcagggtccaaaaggtcttcatcctcccggaatagaggaccacatggcagaagcaatggcgcttcatcccacaagcctgggagttcaccttcatctccttag

SEQ ID NO: 243192 - DNA, 1989 bp, Artificial Sequence
  Description of Artificial Sequence: Synthetic coding sequence
atgggtcctttgcgggagtctaaagaacatcgagtgcagcatcatgataaagagatatcgcgctcccgaattcctaggctcattctgcgcccacacatgccacagcaacagcacaaggtctctccagccagcgagagccccttttccgaagaagaatcccgagagtttaatccttcaagtagcggacgtagtgctaggacagtctcaagcaactccttttgttctgatgacacagggtgccccagttcccagagcgtgtccccagtcaagacgcctagtgatgcaggcaattcgcctatcggattttgccccggatcagatgaaggcttcacccggaaaaagtgcacaatcgggatggtaggagaagggagtattcaaagctcccgttacaagaaggagagtaagtctgggctcgtgaagccgggttctgaggccgatttttccagcagtagcagcactggcagcatctccgcaccggaggttcatatgagcacggcaggtagcaaacgcagttctagcagtcggaaccggggtcctcatggaaggtcaaacggagccagctctcacaaaccgggatcttcacctagcagccccagggaaaaggatctactcagcatgctctgccggaaccagctttcaccagtaaacatccatccatcctatgccccaagttcgccctccagctctaactccggtagctacaaggggtcagattgctccccgattatgagacggtccggcaggtatatgagttgtggggagaaccatggcgtgcggccacccaaccctgaacagtatttgacgcctctacaacagaaagaggtgactgttcggcacctgaagacgaagttaaaagagagcgagcggaggttgcacgagcgcgagagcgagattgtcgagctgaaatcccagctcgcccgtatgagggaggactggatcgaggaggaatgccatcgcgtggaggctcagctggccttgaaggaggcgaggaaggagattaagcagctcaagcaggttattgagaccatgcgctcctcactggctgacaaagacaaaggcatacagaaatattttgtggatattaacattcagaacaaaaaattggagtcactgttgcagtctatggaaatggcccactctggcagtcttcgcgatgagctatgtctggattttccctgcgactccccagaaaagagcctgacacttaatcctcccctggacaccatggcggatggactgtcactggaggagcaggtgaccggcgaaggcgctgacagagaacttcttgtgggagatagtatcgccaatagtaccgatttgtttgatgagatcgtgactgccacgacgactgaatccggcgatctggaactggtccatagtactccgggagctaacgttttggagctcctgcctatcgtgatgggccaggaggaaggctccgttgtagtcgagcgcgcagtacagaccgacgtagtgccctactcgcccgctattagcgagttaattcagtcagtccttcagaaattacaggacccttgtcccagttccctggctagccccgacgaaagcgagcctgattcaatggaatcattcccagagtccctgtcggcacttgtagttgatctgacaccgaggaaccccaattccgcaattcttctctccccggtggaaacaccgtatgctaacgtggatgctgaggtccatgcaaaccgattgatgagggaactggacttcgcggcttgcgtagaggagcgtttagacggagtgataccactcgctaggggaggtgtggttaggcaatattggagtagcagtttccttgtcgatctgctcgccgtggccgcaccagtggtgcccacagttttgtgggcttttagtactcagcggggaggcaccgatccggtgtacaatatcggcgctctgctgaggggctgttgcgtcgtggcactccacagcctccggaggaccgcctttaggatcaagacctag

SEQ ID NO: 243193 - DNA, 288 bp, Artificial Sequence
  Description of Artificial Sequence: Synthetic coding sequence
atggggcctttacgagagagtaagaaggagcatcgggtgcagcatcacgacaaagagatctcaaggtctaggatcccccgattaatcttacgccctcacatgccacaacagcagcataaagtgtctccagcttccgagtctcccttctccgaggaagagtccagagaattcaatccttccagttcgggtcgtagcgctcgcactgtgagctccaactctttctgcagcgacgataccggctgtccatcctcccagagcgtgtctcctgttaagactcccagcgactag

SEQ ID NO: 243194 - DNA, 615 bp, Artificial Sequence
  Description of Artificial Sequence: Synthetic coding sequence
atgggcccactccgagaatccaaggagcatcgtgtccagcaccatgataaggagatatcacgcagcaggatcccacgcctcatcttgcggccacatatgccccagcagcagcacaaggtttcacctgccagtgagtcgccttttagcgaagaagaatcgcgtgagttcaacccatcatccagcggccgatctgcgagaacagtctcctcaaattcgttttgcagtgacgacactggatgtccttctagccagtctgtttcacctgtaaaaacccctagtgatgcgggtaacagccccattggcttctgtcctggctcagatgagggatttactcgcaagaaatgcacaattggcatggtcggtgaaggctcaatccagtcctctaggtacaaaaaggagtccaaatccgggctcgtaaagcctggctccgaagccgatttctcatcctcctcctccacggggtcaatctcagcccctgaagtacatatgagcacagctggcagcaaaagatcctcatcatctcgcaacagagggcctcatggccgttcgaatggagccagcagccacaagcccggatcaagcccctccagtcctagggagaaagacctactctag

SEQ ID NO: 243195 - DNA, 108 bp, Artificial Sequence
  Description of Artificial Sequence: Synthetic coding sequence
atggtcggggagggatcgatccagtcaagtcgctataaaaaggagtcgaagtccggactggtcaaacccggttccgaagcagacttctcctccagctcgtctacttag

SEQ ID NO: 243196 - DNA, 105 bp, Artificial Sequence
  Description of Artificial Sequence: Synthetic coding sequence
atggtgggagaaggctccatccaaagcagccggtacaaaaaggagtccaagtcgggcttggttaaaccaggttctgaagccgatttttcatcttcctccagttag

SEQ ID NO: 243197 - DNA, 243 bp, Artificial Sequence
  Description of Artificial Sequence: Synthetic coding sequence
atggtcggggaaggttccattcagtcatccaggtataagaaagagagtaagtctggcctcgtaaagcccggtagtgaagccgacttcagttctagttcttcgacaggctctatcagcgccccagaggtccatatgtccacagccggaagcaaaaggtctagctcatcaagaaatagagggccacatggacgatcaaatggcgcttccagtcataagccaggatccagcccatcttctccttag

SEQ ID NO: 243198 - DNA, 1788 bp, Artificial Sequence
  Description of Artificial Sequence: Synthetic coding sequence
atgggccctttttgggcaaggaaggatgacaccgggtgtcctagtagtcagtctgtgtcccctgtgaagactccaagcgatgctggcaactctccaatcgggttttgtccagggagcgatgaggggttcactcggaaaaaatgtactataggcatggttggtgaaggctctatacaatcaagccggtacaaaaaggaatcaaagtcaggtcttgtgaagcctggttccgaggcggacttttcaagctctagttctaccggaagtatatcagccccagaggttcacatgtccaccgccggtagcaagaggagctcttccagtcgtaataggggacctcatggaaggagtaacggggcttcttcacacaaacctgggtctagcccttcctcaccacgcgaaaaagatctgctatctatgctctgtaggaatcagctaagccccgtgaacatccacccttcctacgcaccctcaagcccatctagctctaatagtggctcatacaaaggttccgattgttcaccgattatgcggcgtagcgggagatacatgtcatgtggagaaaatcatggtgtcaggccacctaatcctgaacagtacctgacgcctttgcagcaaaaagaggtgacagtacgtcacctcaagactaagctgaaagaaagcgaaaggcgcttgcatgagagggaatctgagatcgttgaactgaagtcccagctggccagaatgcgcgaggactggattgaggaggaatgtcatagagtggaagcccagcttgccctgaaggaagctaggaaggagatcaaacagttgaaacaggtcattgaaaccatgaggtctagtctggccgataaagataagggcattcagaagtacttcgtagatatcaacatccaaaataaaaagctcgagagcctgctccaatctatggagatggcccatagcggcagtttgcgcgacgagctttgtctcgattttccgtgcgacagtcctgagaaaagtttaacactgaacccacctctcgacaccatggctgacggactatcattggaagaacaggtgacaggcgaaggcgcagatcgcgagctgttggtgggcgactcaatcgcaaactcgacagatctttttgacgaaattgtcaccgctactaccacagagtcgggcgacctcgaactggtccactccacgccaggcgctaatgtgttggagttgctgcccatcgttatgggccaagaggagggaagcgttgttgtcgagcgagccgtgcagacggatgtggtgccttactcaccagctatatccgagctgatccagagtgttctccagaagctgcaagacccttgcccctcaagtctagcatctccagacgaatcggagcctgattcaatggagagttttcccgaaagcctgtcagcattagttgtggacttaacccccagaaatcctaactctgccatcctcttgagccccgtggaaacaccatatgccaatgtggacgcggaggttcacgctaacaggcttatgcgcgagctagattttgctgcctgcgtggaagagagactcgatggggtcataccacttgcgagagggggagtggtgaggcagtactggagcagttccttcctggtggacctactggccgttgccgctcctgtggtacccacagttttgtgggcattctcgactcaacgcggagggacagaccccgtctataacatcggcgctcttcttaggggctgttgcgtagtcgcgctgcacagcctgagacgcacggcattccggataaaaacttag

SEQ ID NO: 243199 - DNA, 1635 bp, Artificial Sequence
  Description of Artificial Sequence: Synthetic coding sequence
atggtgggtgaaggctctattcagagctctaggtacaagaaagaatccaaaagcggattggttaaacccggaagtgaggctgattttagttcctcttccagcacggggtcgatcagtgccccagaggtgcatatgtcgactgctgggagcaagcggagtagttccagcaggaatcgtggcccacacggccgttccaacggggcatcatcccacaagccaggatcatctccatcttcacccagggagaaagatctgctatcaatgctgtgcagaaaccagctgtcacctgttaatattcacccatcttacgcaccctcttcacccagcagcagcaattccggcagctacaaggggagcgattgctcacctatcatgcgcagatcaggcagatatatgtcctgcggagagaaccacggtgttagacctcccaacccggaacagtacttaacccctttgcagcaaaaagaggtcaccgttaggcatctgaaaacaaaactgaaagagtccgagaggaggctccacgagagggaatctgagatcgtggaactgaagtcccagctggcacgcatgcgcgaggactggatcgaggaggagtgtcatagagtcgaggctcagctcgcactcaaagaagcaagaaaagagattaagcagttgaagcaagtaatagagacgatgcgcagttcactagctgacaaagacaaggggatccagaagtacttcgtcgacataaacattcagaataaaaagctggagtccctgctccagtctatggaaatggcccactcaggcagtctgagagacgagctatgccttgattttccttgtgatagtccggagaagagcctgacgttgaacccgccactcgacacaatggccgatggactctccttggaagagcaggtgacgggcgagggtgctgatcgcgaattacttgtcggtgacagcatagcaaatagtacagatctttttgatgagatcgttacagcaacgaccaccgaaagcggcgatctggagctggtccactctacccccggagctaacgtcctggagctcctgccaattgtgatgggccaggaggaaggctccgtagtagtcgagcgggctgttcagactgacgtagtgccatattctcctgcaatttcggaactgatccagtctgttctccagaagcttcaagacccctgcccatcaagcctcgccagccccgacgagagtgagcctgatagtatggagagcttccccgagtctctatcagctcttgtggtggacctgaccccacgtaatccaaattcagccattcttttgagtcccgtcgagactccatatgccaacgtcgacgctgaagttcatgcaaaccggcttatgcgggagctagattttgccgcttgcgtggaggaacggctggatggggtgatcccattggcacgtggcggtgtcgtaaggcagtattggagcagctctttccttgtggacctcctggctgtcgccgctcccgtcgtccccaccgtcttgtgggccttcagcacgcagaggggaggtactgacccggtatataatatcggcgctctgttaagaggatgctgtgtcgtcgcgctccactccctccgacgaacagccttccggataaaaacatag

SEQ ID NO: 243200 - DNA, 1992 bp, Artificial Sequence
  Description of Artificial Sequence: Synthetic coding sequence
atgggcccattgcgtgaatccaaaaaagagcaccgtgtgcagcaccacgacaaggagatcagtcggagtcgaatcccaaggcttattctaaggccccatatgcctcagcagcagcacaaggtcagtccagccagcgaatcgccattttccgaagaagagagtcgcgaattcaaccccagctcttctggaagatctgcccgaacagtgtcttctaattctttttgttcggacgataccggctgcccttcttcgcagagcgtgtcccccgtgaagacaccttctgacgctggcaattctcctataggcttctgcccgggatcagatgagggtttcaccaggaaaaagtgcaccattggtatggtaggtgaaggctcgattcaatcttcacgatacaaaaaggaaagcaagtctggccttgtcaagccaggcagtgaggctgacttttcttcatcctcgtctaccgggtctatttcagcgccagaagtccatatgtccaccgccggatccaaaagaagtagctcctcacggaacagaggaccccatggtcgtagtaatggcgcttctagccacaaacccggttcaagtccttcttctccgcgagaaaaggacctgcttagtatgttatgccgcaaccagctttccccagttaatattcacccatcttatgctccatccagtccatcctcttcaaactctggctcatacaaagggagcgattgttcccccatcatgcgtcgaagcggcaggtatatgtcttgcggcgaaaatcacggagtccgaccaccgaaccctgaacagtacttaactccattacagcagaaggaagtaacggtcaggcatcttaagaccaaactgaaagagagcgagagacggcttcatgagagggaatccgagatcgtagagctgaagtcacagctggccaggatgcgagaagactggatcgaagaggagtgccatcgagtggaagcccagctagccctgaaggaggcacggaaagagataaaacagcttaaacaggtaatcgagacaatgaggtcgtctttggctgataaggacaaaggcattcaaaagtacttcgtagatatcaacatccagaacaaaaagctcgagtccttactgcaatccatggaaatggctcattccgggtcgctccgagatgaactctgtctggacttcccatgtgactctcctgagaagagtctgaccctcaacccacctctggacactatggcagacgggttgtccctggaagagcaagtgaccggcgaaggcgcagaccgggagctcctggttggagactctatagctaattctaccgacctgttcgatgaaatagtaactgccaccaccaccgagtccggtgacctcgaattggtgcacagtacacccggagctaatgtgctggaactactgcccatcgtgatgggccaggaggaggggagcgtggtggtggagagagccgtgcagactgacgttgtcccctactctcccgctatatccgaattaattcagtcggtgctccaaaagttgcaggatccatgtccctcctcgctcgcatctccagatgaatcagagcccgactccatggagtcctttcctgagtcgctatccgccttagtggttgatttgacgcctcggaaccctaactccgcgatcctgctctcgcctgtggaaacaccttatgctaatgtcgatgccgaagtacacgctaaccgcctgatgcgggagctggactttgccgcatgcgtggaggaacgcctcgacggcgttattcctctggccagagggggagttgtccgccagtactggtcctcgtcattcctcgtggacctcctcgcagttgccgctccagtcgtgcctaccgtcttatgggccttcagtacccagcggggaggcaccgatcctgtttataatataggcgcactactccggggatgttgtgtcgttgccctgcattcactgaggaggacagcattccgtataaagacatag

SEQ ID NO: 243201 - DNA, 489 bp, Artificial Sequence
  Description of Artificial Sequence: Synthetic coding sequence
atggggccattgagggaaagtaaagaacacagagtacagcaccatgataaggagatttcgaggtcccgcatccctcggctgatccttcggccacacatgccacagcagcagcacaaggtctctccagctagtgaaagcccattcagtgaggaagagtccagggagttcaatccatcaagcagcggcaggagtgccagaacagtgtccagcaactcattctgttctgacgataccggatgtcctagcagccaaagcgtttcccccgtgaagactccatccgacgcgggaaatagtcccatcggattctgcccaggatctgacgagggcttcacccgcaagaagtgtacaatcggaatggttggtgagggcagcattcagtcgagccggtacaagaaggagtctaaatctggcctggtcaagcccggatctgaagccgacttcagctcctctagctctactggctctattagcgcaccggaagtccactag

SEQ ID NO: 243202 - DNA, 1989 bp, Artificial Sequence
  Description of Artificial Sequence: Synthetic coding sequence
atggggcctttgcgtgagtccaaagaacaccgggtgcagcatcatgataaggagatatcccggtcaaggatccccagactgatcctcagaccccacatgccccagcagcagcacaaggtgagcccagcctcagaaagtcctttctcggaagaagaaagccgcgagttcaacccaagctcatccggcaggtcagccaggacagtgtcatccaattcgttttgctcagatgacactggttgtcccagctctcaaagcgtgtctcctgtgaagactccaagcgatgctggaaattctcccatagggttttgcccagggagtgacgaagggttcacgagaaagaaatgcaccattggtatggttggggagggctctattcagtccagccggtataagaaggaaagcaagtccggattggtgaaacccggatccgaggccgatttctcatcctcaagtagtactggcagtatcagcgctcccgaagttcatatgagcacagccggtagtaaacgcagctccagctccaggaacagagggccacatggtagatccaatggagcatctagccacaagcccggaagcagtccgtcaagcccccgtgaaaaagacctgctgagtatgttgtgtcgaaatcagctatcaccagtgaatattcaccccagttacgcaccaagcagtcccagcagttctaattccggcagctacaagggctctgattgcagccctattatgaggaggagcgggcgatatatgtcttgcggagagaaccacggcgtgaggccgcctaaccccgaacagtatctgacgccactccagcaaaaagaggttacagtgcgccaccttaagaccaaactgaaggaaagcgagaggcggctgcatgagcgagagagcgagattgtggagctgaagagccagctggccagaatgcgtgaggactggattgaggaagaatgtcacagggtggaggcccaattggccctgaaggaagctcgaaaggagattaagcagctcaagcaggtgatcgaaactatgcggtctagcctagcggacaaagataaaggaatccaaaaatacttcgtggatatcaatatacagaacaagaaactcgagtctctactgcagtctatggagatggctcactccggtagcctgcgtgacgagctctgtcttgacttcccgtgtgacagtcccgagaagagcctgacactcaaccctccactggacacgatggctgatgggctctctttggaggagcaggtaacgggcgaaggtgcagatagagaattgctcgtgggagactctatcgcaaatagtaccgatttgtttgacgaaatcgtgacagctacaaccaccgagagcggcgacctggagctcgtgcactccaccccgggtgccaacgtcctcgaactgctccctatcgttatgggtcaggaggaagggagtgtggtcgtggaacgcgcagtccagactgatgtggtgccatactcccccgcaattagcgaactgatacagagcgtcctgcagaagctgcaagacccgtgtccaagtagccttgcatctccagacgaaagcgaaccggactctatggaatccttccccgaaagcttatcggctcttgtagttgaccttacacctagaaacccaaacagcgccattcttttgagccccgtggaaacaccctacgctaatgtcgacgctgaggtgcacgccaatcgactaatgagagagttggactttgctgcgtgcgtagaggagcggctcgacggagttatccctctggcccgaggaggcgtcgttaggcagtactggtcctcatcgtttctggtcgacctcctggccgtcgccgcaccagtagttccaacagtcctttgggcgttttctacacaaagggggggtacggacccagtctacaatatcggcgctctcctgaggggctgttgtgtcgtcgccttacacagcctgcgcaggacagcgttccgcattaagacttag

SEQ ID NO: 243203 - DNA, 315 bp, Artificial Sequence
  Description of Artificial Sequence: Synthetic coding sequence
atgggcccactgcgggagtctaaggagcacagagtgcagcaccatgataaggaaattagtcggagcagaattccacgccttattctcagaccccatatgccccagcagcagcataaagtctcgcccgcaagcgaaagccctttctctgaggaggagtctagagaatttaacccatccagctcagggagatctgcgagaacagtttcttcaaactccttttgttccgatgacactgggtgtccctcctcccagtccgttagccctgtaaaaacccctagtgacgccggaaactcccccatcggcttctgtccctag

SEQ ID NO: 243204 - DNA, 456 bp, Artificial Sequence
  Description of Artificial Sequence: Synthetic coding sequence
atgggacccctgagagagagtaagaaagaacatagagtgcagcatcacgacaaggagatctctcgctcaaggattcctagactcattctgcgaccccatatgccccagcagcaacataaggtgtctccagcaagcgagagtccctttagcgaggaggaatcccgtgagttcaatccatccagttcagggaggtccgccagaactgtttcttcaaactcattctgttctgacgacacgggttgcccctcttcccagagcgtcagccctgtgaagacacctagcgatgccggaaattccccaataggcttctgtcccggtagtgatgaaggattcaccagaaagaaatgtactatcggcatggtaggggagggttccatccaatcaagtaggtataaaaaggaaagcaagtctgggttggtgaagcctgggtcagaggcagatttctctagctcttag

SEQ ID NO: 243205 - DNA, 231 bp, Artificial Sequence
  Description of Artificial Sequence: Synthetic coding sequence
atggggccattgcgcgaatccaagaaagaacatcgcgtgcagcatcatgataaggagatttcccgcagtcggatacctagactgattttaagaccacacatgccacaacagcagcacaaggttagtcccgctagcgaatcaccattttctgaggaggagagccgagaattcaacccctctagctctgggaggagtgctcgaactgtgagttccaatagtttttgtagctag

SEQ ID NO: 243206 - DNA, 1617 bp, Artificial Sequence
  Description of Artificial Sequence: Synthetic coding sequence
atgcccggaagcggcccatctgagcgcatgacttggccgggacccgcattgagcgcaggccctcctacacgccctctgagcagcgccccaggtatcccccctattccccctctcacacgcacccacagtctgatggctatgtcactgccaggtagtcggcgaacctctgcgggttctagaagacggactagccctccagtgtcagtaagggatgcctacggcacctcctcactttcgagctcttctaacagcggttcgtataaaggaagcgatagctcccccacgcccagaagaagcatgaaatacactctttgttcagataaccacgggatcaaacccccaacccccgaacagtacctgacccccttgcaacagaaggaagtctgtattaggcacctgaaagctcgcctgaaggacacacaagacagactccaggatcgggatacagaaattgatgacttgaaaactcagcttagccgcatgcaagaggactggatagaggaggagtgccaccgcgtggaggcccagctggccctgaaggaagccagaaaggaaattaaacagctcaaacaggtgatcgacacagtgaagaacaacttgatcgacaaggacaaaggcttacagaaatattttgttgacattaatatacagaataagaagctggagactctgttgcattccatggaagtcgcgcagaatggtatggccaaggaggacgggacaggagagtccgctggcggaagtccagccaggtccctaacacggagctccacatacactaaactgagcgacccggctgtgtgcggcgatagacagccaggggaccccagttccggcagtgccgaagacggcgcagatagcggcttcgccgctgccgatgacaccctgagccggaccgacgctctggaggcgtcatcactcctttcgagcggagtggactgcggtaccgaagaaacatccctgcactcttcctttgggcttggcccacgttttcctgcatccaatacttatgaaaagctactgtgcggcatggaagctggtgtgcaggcctcgtgcatgcaggagagggctattcagaccgacttcgttcagtaccagcctgatctagacacaatactcgaaaaagtgacccaagcacaagtgtgcggaacagacccagaatccggggaccggtgccccgagctggatgcccatccttcaggcccaagggatcctaattctgcagtggtggtgacagttggcgacgagctcgaagcgccagagccaatcacacggggaccaacgccccagagacctggcgctaaccccaacccaggtcagagtgtgagtgtcgtttgtccgatggaagaggaagaggaagccgcagtggcggaaaaggaaccaaaatcatactggtctcggcactacatcgtagacttactggctgtggtagtgccagccgtcccaactgtggcctggctatgtaggagccagcggcgtcagggacaacctatatacaatatatccagcctgctacggggttgttgtactgtggccttacattccattaggcgaatttcgtgtcgcagcctgagccagccttcacccagccctgccggaggaggttctcagttatag

SEQ ID NO: 243207 - DNA, 1485 bp, Artificial Sequence
  Description of Artificial Sequence: Synthetic coding sequence
atggccatgagcctacccggttcccggaggactagcgctggttctcggcgaaggacatccccacctgtgagcgtgcgagacgcctacggcacctcttctctcagcagttcttctaactcaggttcttacaaaggaagtgacagtagtccaactcccaggcgatccatgaagtatactctgtgttctgataaccatggtatcaaaccaccgactccagagcagtacctgacccctctgcaacaaaaggaggtctgtatcagacatctgaaggcaaggcttaaagatacccaggaccggctgcaagaccgagacactgaaattgatgatttgaaaacccagttgtcacgtatgcaggaagattggatcgaggaggagtgtcacagagtcgaagcccaactggctcttaaagaggccagaaaggagattaaacagctcaagcaggtcatcgatacggtgaaaaacaacctgatcgacaaggacaaaggcttacaaaagtacttcgttgacatcaacattcagaataagaagttggaaacgctattacactcaatggaggtggctcaaaacggcatggccaaggaggatgggacaggcgagagcgccggtggatctcccgctcggtctttaacccggtcttccacttataccaaattgtcagacccggctgtctgtggcgaccgacagccgggagatccttcttctggcagcgccgaagacggtgctgacagtgggtttgcagctgcggacgacactttgtctagaactgacgcgcttgaggcgagtagccttttaagcagcggagtggactgtggtaccgaggaaacgagtttacatagcagctttggattgggcccacgatttcctgccagtaacacctacgaaaaacttctatgtggcatggaagctggagtgcaagccagctgcatgcaggaacgggcaattcaaacggacttcgtccagtaccagccagacctggacacaatcctggaaaaggtcactcaggcacaagtctgcggaaccgatccagagagcggggacagatgcccagaactggacgctcatccatctgggcctagggaccctaacagcgctgtggtggtgacggtgggagacgagctcgaggcgcctgaacccattaccagaggacccacacctcagagacccggagccaacccaaacccaggacagtcggtgtccgtggtgtgtcccatggaggaagaagaagaggcagcagtggcggagaaagagcccaagtcttattggtcacgacactacatcgtcgatctgctcgctgtggtagtgcccgcagtccctaccgtcgcatggttgtgtcgatctcagagacgacaaggccagccaatttataatatcagttctctactgaggggctgttgcacggtagcgttacactctatccggcgtattagctgccggtccttgagccagccaagcccctcacccgctggaggcggaagtcaactatag

SEQ ID NO: 243208 - DNA, 864 bp, Artificial Sequence
  Description of Artificial Sequence: Synthetic coding sequence
atgaaggataggttggcagagctgctggatctttcaaaacaatatgatcagcagttccctgacggagatgacgagtttgatagccctcacgaggatatcgtctttgaaacagatcatattttggagtccctgtaccgcgacatccgtgatatacaagatgaaaatcagctgctggtggcggatgtgaagcggttggggaaacagaacgcacgcttcctcacctcgatgcggaggctgtctagcatcaaacgggacacaaactccatcgcgaaagcgattaaagcaagaggtgaagtgatccattgcaaactgcgggctatgaaagagttgagtgaggccgctgaagctcagcacgggccacattccgctgtcgcccgtatcagtagagcccagtacaatgcccttaccttaacattccagagagcaatgcacgactacaaccaggcagagatgaagcaacgggacaactgtaagattaggatccagagacaattggaaatcatgggtaaggaggtctcaggagaccaaattgaggacatgtttgagcaaggaaagtgggatgtttttagcgaaaatctgctggcggatgtgaaaggtgcaagggctgctctcaatgagatagaatctaggcaccgagagctgcttcggcttgagtcacggattagagacgtgcacgagctttttcttcaaatggccgtcctcgtcgagaaacaggcggacaccctcaacgtgatcgagttaaatgtgcaaaaaacagttgactataccgggcaggccaaggctcaggtacggaaagccgttcagtatgaggagaaaaatccttgcaggaccctctgttgcttttgctgcccttgtctaaaatag

SEQ ID NO: 243209 - DNA, 615 bp, Artificial Sequence
  Description of Artificial Sequence: Synthetic coding sequence
atggctcttgtttcaggtattagcctcgatccagaggcagccattggagtcaccaagaggcctccgccaaagtgggtagacggcgtcgacgagattcaatacgatgttggcaggatcaaacagaagatgaaggaattagcctctctccacgacaaacacctgaaccgccctacgctggacgatagctctgaggaagagcacgcgatcgaaatcaccacacaggagatcacacagctattccacaggtgtcagcgcgcagttcaagccctgccctctcgggctcgagcgtgttcagaacaggagggcaggcttctaggcaatgtcgtagcgagcctggctcaggccctgcaggagctgagcacatcgtttagacatgcacagtctggatacctcaagcggatgaagaatcgggaggagcgatcgcagcatttcttcgatacaagcgtgccactaatggatgacggggatgacaatacactgtatcatagaggattcaccgaagatcagctggtactagtggaacaaaatactttaatggtcgaagagagagagcgggagatacggcagattgtgcagtcgattagtgatcttaacgaaatctttcgggatctctag

SEQ ID NO: 243210 - DNA, 927 bp, Artificial Sequence
  Description of Artificial Sequence: Synthetic coding sequence
atggccacgagaagacttacagatgcctttctactgttaaggaataatagtatccaaaacagacagcttcttgcagaacaggagttggacgagttggctgacgacaggatggctctcgtgtccggcattagccttgaccccgaggcagcgatcggagtgactaaacggcctcctccgaaatgggttgatggagtggacgagatccagtatgatgtggggaggatcaaacagaaaatgaaggagctggcttccctgcatgacaaacatcttaaccgccctaccctagatgactcctccgaagaagaacacgcgattgagatcaccacccaagagattacacagctattccaccgctgccagcgggcagtgcaggcactgccctctagggctcgtgcttgcagtgaacaggaaggccgactgctgggaaacgtcgtggctagtctagctcaagccttacaggaattatccacgtcttttcggcatgcgcaaagcggctacctaaaaaggatgaagaaccgggaggagcggagccagcatttcttcgatacctctgttcccttgatggacgacggtgacgacaatacgttgtaccaccgaggcttcactgaggatcagctggtgctggttgagcagaataccctgatggttgaggaacgagaaagagaaattaggcagattgtccaatcaatcagcgacttgaatgaaatattccgagacctgggcgcaatgatcgtggaacaaggaactgtgttggaccgtattgactataatgtggaacagtcgtgtattaagactgaggatggattaaaacagttgcacaaagctgaacaataccagaaaaagaaccggaagatgctcgtaattttaattctgtttgtgatcataatcgtcctgattgtcgtgctggtcggagttaaatctcggtag

SEQ ID NO: 243211 - DNA, 966 bp, Artificial Sequence
  Description of Artificial Sequence: Synthetic coding sequence
atggcaaccaggcgcctcactgatgcatttctgttgctgcggaataacagcatccagaacaggcagctgcttgccgagcaggtgtcttctcatattacttcctcccccttacactctcgttcaatagctgctttagccgatgaccgcatggcactcgtttccggcatctccctggacccagaggctgccattggcgttaccaagcgtccaccccctaaatgggtggacggcgtcgacgaaatccaatacgacgtcggcaggatcaagcaaaaaatgaaggaactggcatcgctacatgacaagcatctcaatagaccgaccctggacgactctagcgaggaggaacatgctatagagatcacaacacaggaaatcacccagcttttccatagatgccaaagagctgtacaggctcttccctcaagggcacgcgcatgcagcgagcaggaagggaggctacttgggaatgtagtggcttcacttgcacaggcactgcaggagctgtctacctcttttcggcatgcccagtccggctatctgaagagaatgaagaatcgcgaagaaagatcgcagcacttctttgataccagtgtgcctctaatggatgacggtgatgataacactctctaccatcgcggattcacagaagaccagctcgtcttggtggagcagaacacactgatggtcgaagaacgagagagggaaataagacagatagtacagagcatcagtgatttgaacgagatctttagagatctgggtgccatgattgttgaacagggtactgtgctggacaggatagattacaacgttgaacaaagttgtattaagactgaggatggattaaagcagctgcataaggcagaacagtatcaaaagaagaatcggaagatgcttgttattctgatcctgtttgtgatcatcattgtgttgattgtcgtgttagttggcgtcaagagccgctag

SEQ ID NO: 243212 - DNA, 756 bp, Artificial Sequence
  Description of Artificial Sequence: Synthetic coding sequence
atggcgctagtgtcaggtatttctctagaccccgaagccgcaatcggtgtcactaagcgaccgcctcccaagtgggtggacggagtggacgaaatacagtacgatgtcggcaggattaagcagaagatgaaagaattggcctctttgcacgataaacacttgaatcgtcctacactggatgactcttccgaagaggagcacgccattgagataacgacacaggagatcacccagctctttcacagatgtcagcgggctgtccaggcactaccaagccgtgctagagcttgtagcgagcaagaggggcgattgctggggaacgtcgtcgcttctctagcccaggccttgcaggagttatcaacatccttcagacatgctcagtcaggttaccttaagcgcatgaaaaaccgcgaggagcgcagtcagcacttctttgatacttctgtgcctctgatggacgacggtgacgacaataccctgtatcataggggcttcacggaagaccagttggtccttgtggaacagaatacgttgatggtggaagagagggaaagagagattcggcagatagtgcagtcaatcagcgatctcaacgagatattccgcgacctgggagccatgatcgtggagcaggggacagtgctggacaggatcgattataatgtcgagcagtcttgtattaagaccgaagacgggctcaagcaacttcacaaggctgagcagtaccaaaagaaaaataggaagatgttggtctag

SEQ ID NO: 243213 - DNA, 927 bp, Artificial Sequence
  Description of Artificial Sequence: Synthetic coding sequence
atggcaacacggcgacttacagacgcattcctgctcttgcgcaataactccattcaaaaccggcaactgctcgcggagcaacagctcagcaagctggccgatgatcgaatggccctggtcagcgggatctccttggatcctgaagcggctataggtgttacaaagcgcccaccgccaaaatgggtcgatggagtagatgagattcagtacgatgtcggacgcatcaagcagaaaatgaaggagcttgcctcccttcacgataagcatcttaaccgcccaacgcttgatgattctagcgaagaggaacatgctattgagattaccactcaggaaataactcagttgttccaccgatgccagcgagcggttcaagccctgccttcgcgagctcgcgcttgtagtgagcaggaggggagattgctcggaaatgtcgtcgcatcgctcgcacaggctctgcaggagttgagtacttcgtttcggcacgcgcagtccggatatcttaagcgcatgaagaatagagaagagagaagccaacatttttttgacacaagcgtgcctcttatggacgatggagatgacaatacactgtaccatcggggttttaccgaggatcaactggtcctggtggaacagaatactctcatggtggaggagcgggagagggagatccgccagattgttcagagtattagcgatctgaatgagattttcagagatctcggcgctatgattgtagagcaggggacagtgctggatcgcattgactacaacgttgagcagagctgcataaagactgaggacggtctgaagcagcttcacaaagctgaacagtaccaaaagaagaaccgaaaaatgctggtaattttgatactcttcgtgatcatcattgtcctgatcgttgtgttagtaggcgtgaagtcacgttag

SEQ ID NO: 243214 - DNA, 978 bp, Artificial Sequence
  Description of Artificial Sequence: Synthetic coding sequence
atggccaccaggaggcttacagacgccttcctgcttctcaggaacaattccatccagaaccgacagctgcttgccgagcaggtcagctctcatatcacgtcctctcctctgcactcccggtcaatcgcagcggcactagacgagttagccgacgaccggatggcccttgtgtccggtatcagcctggatcctgaagccgctatcggggtcacaaagcggcctcctcccaagtgggtggacggcgtggacgaaatccaatatgatgtaggccgtattaagcaaaagatgaaggaattggcctcactgcatgacaagcatctgaacaggccaaccctggacgatagctctgaggaagagcacgccatcgagattactacgcaggagatcacgcagctgtttcacaggtgtcaacgagccgtccaggctcttccatccagggcacgggcttgcagtgagcaggagggacgcctcctcggaaatgtggtggcctcattggcacaggcactgcaggagctctccacctcttttaggcatgcccagagcggctacctgaaacgaatgaaaaatcgggaagaaaggtctcagcattttttcgacacttctgtgcccctgatggatgacggagacgataataccctgtaccaccgaggctttacggaagatcagttggtactcgtcgaacagaacacactgatggtcgaggaaagagaacgagagatccggcagatcgtgcagagcatctccgatctcaacgagatattccgggacctgggtgccatgatcgtggaacaggggacagtattggatagaatcgattacaatgtcgagcagagttgtataaagaccgaggacggcctgaagcagctgcacaaggctgaacagtatcaaaaaaaaaatagaaagatgcttgtaatattaattctcttcgttattattatcgtcctaatcgtcgtgctggtaggggtaaagagtaggtag

SEQ ID NO: 243215 - DNA, 915 bp, Artificial Sequence
  Description of Artificial Sequence: Synthetic coding sequence
atggctactcgccgactcaccgatgcctttcttcttctgaggaacaattcaattcagaacaggcagttgctggccgagcagcttgcggacgaccgcatggctctggtaagtgggatcagtctagaccccgaagcagcgattggggtgacaaaaagaccccctcccaagtgggtggatggtgtggacgaaattcaatatgatgttgggagaatcaaacagaagatgaaagaactggcatcccttcatgacaaacatttgaatagaccaaccctggatgactcctcggaggaggaacacgccatcgagattacaacccaggaaattacccaactgtttcaccgatgccagcgtgcagttcaggcccttccatcacgagcccgagcatgttctgaacaagagggtcggcttctgggcaatgtggtggcaagtttggctcaagcattgcaggaactgagcacctcatttcggcacgctcagagcggatacctgaaaagaatgaaaaatcgcgaggagagatcgcagcacttcttcgatacttccgtgccactcatggacgacggagacgacaacacactgtatcaccgagggttcacagaagaccaactcgtcttggtcgagcaaaacaccctcatggtggaagagagggaacgcgagataagacagattgtgcagtctattagcgacctgaatgagatcttccgggatttgggcgctatgattgtggagcaggggaccgtccttgatcgaatcgattataacgtggagcagagctgcatcaagactgaggacggcctgaaacagttacacaaggccgaacagtaccagaagaaaaacagaaaaatgctggtaatcctgattttgttcgtgattattatcgtactgattgttgtcctggtcggcgtgaagtccaggtag

SEQ ID NO: 243216 - DNA, 819 bp, Artificial Sequence
  Description of Artificial Sequence: Synthetic coding sequence
atggccctcgtgtccggcatctcattagaccctgaagcagctataggcgtgacaaaacgccctccaccgaaatgggtggacggggtcgacgagatacagtacgacgtcgggaggatcaagcagaagatgaaggagctggccagcttgcacgacaagcatctcaaccgtcctacactggacgatagttcagaagaggagcacgcgattgagatcacaacccaggaaatcacacagctcttccatagatgtcaacgcgcagttcaggctttaccatcaagggcacgggcatgcagtgaacaggaggggagactcctcggaaacgtggtcgcaagcctggcacaggccctccaggagttgtctacctccttccgccatgctcagtccggctatttgaaacgcatgaaaaatagagaagagcgatcccagcacttctttgacacatctgtcccattgatggacgatggcgatgacaacacactgtaccatcgaggctttacagaggatcagttagtgctcgtggaacagaatacccttatggtggaagaaagagaacgcgagatcaggcaaattgtgcagagcatatctgacctgaacgagatcttcagagatttaggcgcaatgatagtggaacaggggacagtgctggatcggattgattacaacgtggaacagtcttgcattaagacagaggacgggctcaaacaactgcacaaggcggagcagtaccaaaagaagaaccggaagatgctggttattctgattctgttcgtgataatcatagtcctgatagttgtgctcgttggcgtgaaaagcagatag

SEQ ID NO: 243217 - DNA, 978 bp, Artificial Sequence
  Description of Artificial Sequence: Synthetic coding sequence
atggccacacgacgcctgacagacgcatttctgctccttcggaacaattccatccagaatcgccagctcctggcggagcaggtgtctagtcatataacatcgagcccattacactcacggtccattgccgcagagctggacgagctggctgatgaccgtatggccctcgtcagtggtataagccttgacccagaggccgcaatcggggttactaagcgtccaccgcctaaatgggtagacggcgtggacgagatccagtatgacgtgggtagaatcaaacaaaagatgaaggagttagcctctcttcacgataaacacctaaacaggcccacactagatgactcttcagaagaagaacacgccatagaaatcaccacccaggagattactcagttgttccatcggtgtcagcgtgccgtgcaggcattaccgtcacgggcaagagcgtgctctgaacaagaaggcaggttattgggtaatgttgtcgccagtttagcccaggcgttgcaggaactcagcaccagcttcaggcatgcacagtccggctacctaaaacggatgaagaatagggaggaacggtcccagcattttttcgacaccagtgtccctctgatggacgacggagatgataacacactctaccatcgcggattcacagaagatcagttggtgctggtagagcagaataccctgatggtggaggagcgggaacgggaaattcggcaaatcgtgcagtccatctctgaccttaatgaaatcttccgcgacctcggggcaatgattgtggagcagggcacagtgttggatagaatcgattataatgtcgaacagtcctgtataaagacagaagatggcttgaagcagctgcacaaagccgagcaatatcagaaaaagaaccgtaagatgctggtgattttgatcttgttcgtaattattattgttctgatcgttgtcctggtcggggttaagagtagatag

SEQ ID NO: 243218 - DNA, 366 bp, Artificial Sequence
  Description of Artificial Sequence: Synthetic coding sequence
atggcactcgttagtgggattagcctggatccagaagcagcgattggtgtcaccaagagaccccctcccaagtgggtggatggagtggatgagattcagtacgacgttggacgcattaagcagaagatgaaggagctggctagccttcatgacaagcacctcaacaggcctactctggacgactccagcgaagaggaacacgccattgagattacaacacaggagatcactcagctgttccacagatgccagcgtgcagtgcaggccctgccgtcacgtgcaagagcatgttccgaacaggagggcaggctgttgggcaacgtcgtggcatcgttagcacaggcgctgcaggaactgtccacctag

SEQ ID NO: 243219 - DNA, 420 bp, Artificial Sequence
  Description of Artificial Sequence: Synthetic coding sequence
atgaaaaaccgcgaagagagatctcagcattttttcgacaccagcgtcccccttatggacgacggcgatgacaacactctgtatcatcgcggttttactgaggaccaactggtcctcgtcgaacagaatacccttatggtggaggaacgggaacgggagatcagacagatcgtgcagtcaatcagtgacttgaacgagatattcagagatttaggagcaatgatcgtggaacagggcacagtgctggacagaattgattataacgtcgaacagagctgtatcaagacagaggatggcctcaaacaactacataaagccgagcagtatcaaaaaaagaaccggaagatgctggtgatcctgattctgttcgttataatcatcgtcttgatcgtcgtactggtcggtgtcaagtcacggtag

SEQ ID NO: 243220 - DNA, 660 bp, Artificial Sequence
  Description of Artificial Sequence: Synthetic coding sequence
ggcatcagcctggaccctgaagcggcaattggcgtcacgaagcgacccccacccaagtgggtggacggcgttgatgaaatccaatacgacgtgggaagaatcaagcaaaaaatgaaagagcttgctagccttcatgacaagcacctgaacagaccaaccctggacgattccagcgaagaggaacatgccatcgagatcactacccaggagataactcagctgttccaccgctgtcagagggctgtgcaggccctcccgtcacgtgctagagcatgtagtgaacaggagggacgtcttctaggcaatgttgtggccagcctggcccaggcccttcaggaactgagcacgagtttccgacatgcacaatccggctatttaaagaggatgaaaaacagagaggagcgatcccaacattttttcgatacctctgtgccattgatggacgacggggacgataacacactgtatcatagagggacagtcctagataggatagactacaatgtggaacagagctgtatcaagacggaggatggactcaaacaactgcataaagcagagcaatatcaaaagaaaaatcggaaaatgctggttattttaatcctattcgtgataataattgtactcatcgtagtcctcgtgggcgtcaagagccggtag

SEQ ID NO: 243221 - DNA, 369 bp, Artificial Sequence
  Description of Artificial Sequence: Synthetic coding sequence
atggccctggtcagcggcatctccctggatcctgaggcggcaattggagtcacaaaacgaccgcctcccaaatgggtggatggggtggatgaaattcagtacgacgtgggcagaattaaacaaaaaatgaaagagttagcaagtctccatgataagcacttgaacagaccgacactggacgatagttccgaagaggaacatgccatcgaaatcactacacaagaaatcacacaactatttcataggtgtcagcgcgctgtgcaggctctacctagccgggcaagagcttgctctgagcaggaaggacgtctcctcgggaacgttgtggcctcgctcgcacaggcattacaggagttaagcacatcttag

SEQ ID NO: 243222 - DNA, 609 bp, Artificial Sequence
  Description of Artificial Sequence: Synthetic coding sequence
atggccactcgcaggctgaccgacgctttcctgctgctccggaataacagcatccaaaacaggcagctgctggcggagcaggaactggacgagctagccgacgaccggatggctttggtctcaggcatttctctcgatccagaggccgctattggagtaacgaaacgtcctcccccaaaatgggtggatggcgttgatgagattcaatacgacgtaggtagaatcaagcaaaaaatgaaggagctggctagtttgcacgataaacacctcaatcgacctacactggacgactcaagcgaggaggagcatgctattgaaatcacaactcaagaaatcacccagctgttccacagatgccaacgggctgtccaggcgctgccatccagagccagggcctgttctgaacaggagggtcggcttttaggtaacgtggtcgcttccctcgcacaggcccttcaggaactttctacatcctttcgccatgcccagtcaggctatctcaagcggatgaagaaccgtgaagaaaggagccaacattttttcgatacctccgtaccgttgatggatgatggtgacgataataccttgtatcaccgtcggacatcctag

SEQ ID NO: 243223 - DNA, 909 bp, Artificial Sequence
  Description of Artificial Sequence: Synthetic coding sequence
atgagcgaagatgaggaaaaagtgaagctgcgcagattggaaccagctatacagaaattcatcaaaatcgtaattcccaccgacctggaacgcctgagaaagcaccagatcaacatcgagaagtaccagcgatgtagaatttgggataaactgcatgaggaacacatcaatgccggacgtacggtgcagcagcttaggagcaatatccgagagattgaaaaactatgcctcaaggtgagaaaggacgacctcgtgttgctcaagaggatgattgatccagttaaagaggaagcatcagctgccaccgctgaatttctccaactccacctagaaagcgtagaggagttgaagaaacagttcaatgatgaggagactctgctgcagccacccctgacccggtctatgacagttggtggcgcatttcataccaccgaagccgaggcctcaagccagagcctcacccagatatatgccctccccgagatcccccaagatcagaacgctgccgaatcatgggagacgctcgaggcggatctcatcgaattgtcacaactcgtgacagactttagcctgcttgtcaactcccagcaggagaagatagatagcatcgctgaccacgtcaactccgccgcagtgaatgtggaagaaggaacaaaaaacctaggtaaggccgcaaagtacaagcttgccgcacttccagtggccggagcgctcatcggaggcatggtgggagggcctatcgggctgctggccggatttaaggtagccggtatagctgccgctctgggaggcggagtccttggatttaccgggggaaagttgatacagcgaaagaagcagaagatgatggaaaaactgacgtcatcgtgtccagatttgccgagccagaccgataagaagtgcagctag

SEQ ID NO: 243224 - DNA, 909 bp, Artificial Sequence
  Description of Artificial Sequence: Synthetic coding sequence
atgtctgaggacgaggagaaggttaagcttagaaggcttgagcccgcaattcagaagtttatcaagatcgtcattcctacagacctggaacggctaagaaagcatcagattaacattgaaaagtatcagaggtgccgcatctgggataagcttcacgaggaacacattaatgcagggaggaccgtgcagcagctccgcagcaacatccgcgagatcgaaaagctttgtttgaaagtgaggaaagatgatctcgtgctcctcaagcgtatgatcgaccctgttaaggaggaagcgtccgccgctactgctgaatttcttcagctgcaccttgagtcggttgaggagctgaagaagcagtttaacgacgaggagacgctgctgcagcctcctctaaccaggtctatgactgtgggcggtgcgttccacacaacagaggccgaagcgagctctcagagcttaacgcagatttacgctttgcccgaaattcctcaagaccagaatgcggctgagagttgggagaccttagaagctgacctaatcgaattatcacagctggtgaccgacttcagtctgttggtcaattcacagcaggaaaaaattgattcaatagcggaccatgtcaactccgcagccgtcaatgtggaagaaggtacgaagaatcttgggaaggccgcaaaatataagctcgccgctttaccagtggctggcgctcttattggcggaatggtcggaggaccaatcggacttctggccggatttaaggtcgctggaatagcagctgctctgggagggggtgtgctgggttttactgggggtaagctgatccaacgcaaaaagcagaaaatgatggagaagcttacttcaagttgcccagacctcccctcccagacagacaagaagtgctcttag

SEQ ID NO: 243225 - DNA, 126 bp, Artificial Sequence
  Description of Artificial Sequence: Synthetic coding sequence
atgagcgaagacgaagagaaggtgaaattgagaagattggaaccagctatccagaaattcattaaaatcgtgatcccgactgacctggagaggctgagaaaacaccagatcaatattgagaagtag

SEQ ID NO: 243226 - DNA, 126 bp, Artificial Sequence
  Description of Artificial Sequence: Synthetic coding sequence
atgtcagaagacgaagagaaagtcaaactgcggagactggaaccagccattcagaagttcatcaagatcgtgataccaacagacttggagcgcctgcgaaaacatcagatcaatattgaaaaatag

SEQ ID NO: 243227 - DNA, 909 bp, Artificial Sequence
  Description of Artificial Sequence: Synthetic coding sequence
atgtccgaggatgaggagaaagtcaaacttcgccgactcgaacctgctattcagaaatttataaagatagttatacccaccgatttagagcgtctgaggaagcaccaaattaacatagagaagtatcaaaggtgtagaatctgggacaagctgcacgaagaacacatcaatgctggtcgaaccgtgcagcaactacggtctaatatcagggagatcgaaaaactgtgtctgaaagtcaggaaggatgatctcgtgctgctaaaacgaatgattgatcctgtcaaggaagaagcctccgcggcaaccgccgaatttttgcagttacatctcgagtcggtcgaggagctgaaaaagcagttcaacgacgaagaaacacttttacagcctcccctcactcgcagcatgactgtgggtggagcattccacacgaccgaggctgaggctagctctcagagcttaactcagatatatgctctgcctgaaatcccccaggaccagaatgccgctgagagctgggagaccttggaggctgatctgatcgagttatctcagctggtgactgacttctcactccttgtgaattcccagcaggaaaagatagacagcattgcagatcacgttaactctgccgcagtgaatgttgaagagggcaccaagaatctcgggaaagcagcaaaatacaaacttgccgcactccctgttgcaggggcactaattgggggaatggtaggcggacctatcgggctcctggctggatttaaagtagcagggattgctgctgccctgggaggcggagtgctggggttcaccggcggaaagttgatacagcgtaagaagcagaagatgatggagaaactcacaagctcatgccctgacttgccttcccaaactgataagaagtgctcctag

SEQ ID NO: 243228 - DNA, 636 bp, Artificial Sequence
  Description of Artificial Sequence: Synthetic coding sequence
atgcgcctcttcttatggaatgcagttctcaccctcttcgtcaccagtctcataggagcgctcataccagaacctgaggtgaagattgaagtccttcagaaacccttcatttgccaccggaaaactaagggtggtgacctgatgctggttcactacgagggctacttggagaaggacggcagcctgttccatagtacacacaaacacaacaacggccagcccatctggtttactctcggcatactcgaggcactcaaaggctgggatcaggggcttaagggcatgtgcgtgggcgaaaaacgcaaactgattattccgccagctctgggctacggaaaagaaggaaaaggcaaaatccctcccgagagtacattaattttcaacatagatcttcttgaaattaggaatggacccaggagtcatgaaagcttccaggagatggacctgaatgacgactggaaactgagcaaagatgaagtgaaagcttacctcaagaaagagtttgagaagcatggagctgtagttaacgagagccaccatgacgctcttgtggaggacatctttgacaaagaagacgaagataaggacggcttcattagtgctagagaatttacctacaaacatgacgagctctag

SEQ ID NO: 243229 - DNA, 783 bp, Artificial Sequence
  Description of Artificial Sequence: Synthetic coding sequence
atgaaagacagaactcaagagttgaggactgctaaggattcagatgacgacgacgacgttgctgtaaccgtcgatagggaccggtttatggatgaattctttgagcaggtcgaggaaatcaggggtttcattgacaagattgctgagaacgtggaagaagttaaaagaaaacactcagccatcctggccagtcccaaccccgacgagaaaactaaggaggagctggaagaactcatgtcggacatcaaaaagactgccaataaagtgcgttctaagctgaaatctatcgagcagagcatagaacaggaggaaggactcaatcgcagcagtgccgatctgaggattagaaagactcagcattctactctgagcaggaagttcgtagaggtgatgtccgaatataacgctacacaatccgactatcgcgagcggtgtaaaggaaggatccagcgccaactcgaaatcacaggtaggacgaccacaagtgaggaactagaggacatgttggagagcggcaatccagccattttcgctagcggcattatcatggactcatccattagcaagcaagccctgtctgaaattgaaacaaggcatagcgaaattataaaacttgagaatagtattcgggagctacatgatatgttcatggacatggccatgctggtcgagtctcagcctcaaggggcattcttgaagtcctgtccagagcctcagccaaacccggaggagggtgccctttggtccagcggggctcccggaccggctggccgtgacgactag

SEQ ID NO: 243230 - DNA, 516 bp, Artificial Sequence
  Description of Artificial Sequence: Synthetic coding sequence
atgaaagatagaacacaagagttacgcaccgcgaaggattccgacgacgacgatgacgtggctgtcaccgtcgaccgggaccgctttatggacgagtttttcgagcaggtggaagtgatgagtgagtacaacgcgacgcagagcgactatcgggagagatgcaagggacgtattcagaggcagttggagatcacaggccgtaccaccacatcagaggagcttgaggacatgctcgagtctggcaatcccgctatctttgcctcaggaataattatggatagctctatctctaaacaagctttgtccgagattgagactcggcactctgaaattataaaactggagattgaatataatgtcgagcacgctgttgactatgtggagcgagctgtgtctgacacaaaaaaagccgtgaagtatcaatctaaggctagacggaagaaaatcatgatcattatttgctgcgtgatcctgggcattgtcattgcgagtacagttggaggtatcttcgcctag

SEQ ID NO: 243231 - DNA, 756 bp, Artificial Sequence
  Description of Artificial Sequence: Synthetic coding sequence
atgaaagaccggactcaggagcttaggacagccaaggatagtgatgatgatgatgacgtggccgtcaccgttgatagggacagatttatggatgagttctttgagcaggtcgaagagatcaggggctttatcgataaaattgctgagaatgtggaggaggtaaagcgaaaacattctgccattctggcctcgcccaacccagacgaaaaaactaaggaggagttggaggagctaatgtccgacatcaagaagacagcaaataaggtgcgctccaagctgaagtccatagagcagtccatagagcaggaagaaggcctgaaccgatcttccgccgacctaaggattcgaaaaacgcagcactcaaccctcagcaggaaatttgtggaggtcatgtcggagtacaatgccacccagtccgactatagggagcgatgtaagggaagaatccagaggcagctggaaatcacaggtaggaccaccacttccgaagagttggaggatatgctcgagagcggcaatccagcgatttttgcttcgggcatcatcatggatagctctatcagcaagcaagccctaagcgagatcgaaaccaggcacagtgagataattaaactggagaatagcatccgcgagctgcatgatatgttcatggacatggctatgctggtggagagtcagactatgtggaggggaccctgtcttacgccaaggagaccctctagtacacgagctaggcgcgctgggagaaaaagttag

SEQ ID NO: 243232 - DNA, 1053 bp, Artificial Sequence
  Description of Artificial Sequence: Synthetic coding sequence
atgtttatcaaaggccgagctcctagagcgccaccacgagagcggagaagagccaccagaggaggattgcgccaagtggtggctcccccaagagccttaggctccacctcaaggcctcatttcagaagagccagcgtgtgtcgcaggaggtgtcgtaagagtgggggactgctcgccgctagtcgcaaaatggccgctgccgctgtgaatggggctgccggtttttcgtcttccggacccgctgccacttcaggtgcagtgctgcaggctgctacgggcatgtacgaacagctgaaaggcgaatggaatcgcaaatctcctaacctatccaaatgtggagaagaacttgggagactgaaactggtcctgcttgagcttaattttttaccaacaactggaaccaagctgacgaaacagcagttgattctagctagagacatactcgaaatcggggctcagtggtctatcctacgtaaagacatccctagcttcgaaagatacatggcccagctgaagtgctattatttcgactataaggaacagctacccgaaagcgcctacatgcaccagctgcttggactcaatctgctttttttgctgagtcagaatagagtggccgaatttcacacggagctggagaggttgcccgctaaggatatccagacaaatgtgtatatcaaacaccccgttagcttggaacaataccttatggaaggcagttacaacaaggttttcctggctaaaggcaatatcccagctgaatcttacacgttcttcattgacatactcttagacaccatccgagacgagatagcaggctgtatcgaaaaggcttatgagaagattttgtttactgaagctacccgcattttgtttttcaacactcctaaaaagatgacggattacgccaagaagcgtggatgggtgctcggacccaataattattattcattcgcctcacagcagcagaaacccgaagacaccacaattccatccacagagttagccaagcaggtgattgagtatgccaggcagcttgagatgatagtgtag

SEQ ID NO: 243233 - DNA, 864 bp, Artificial Sequence
  Description of Artificial Sequence: Synthetic coding sequence
atgcgcgatagactcccagatctgactgcctgtcgaaaaaatgatgatggcgatacagtcgtagtggtagagaaagaccattttatggacgacttctttcaccaggtggaggagattcggaactccattgacaagattacccagtacgtcgaagaagtgaagaagaaccattccattattctatctgctccgaaccccgaaggcaagattaaagaagaactcgaggacctcaacaaagagataaagaagacagccaacaagatccgggcaaaactcaaagccattgagcagtcctttgaccaggatgagagcgggaaccgaacctcagttgatttgagaatcagacggacacagcactccgtcctgagtcgtaaatttgtcgaagccatggcagaatataatgaggcacaaacactctttcgcgagcgtagcaagggcaggatacagcggcaacttgaaattaccggaaggacaacaacggatgacgagctggaggagatgcttgagtccggaaagccaagcatctttacaagcgacatcatctctgatagtcagatcacaaggcaggctctaaatgagatagaaagcagacacaaggacatcatgaaactggaaacaagtattcgcgaactacacgaaatgtttatggacatggcaatgttcgttgaaacacagggagaaatgatcaacaacatagagcggaacgtaatgaacgccactgattacgtggaacatgcgaaagaggagacgaaaaaagccataaagtatcagtctaaggcaagacggaagttaatgttcatcattatctgtgtgattgtgctcctggttatcttgggaatcatcctggctaccaccctgtcctag

SEQ ID NO: 243234 - DNA, 867 bp, Artificial Sequence
  Description of Artificial Sequence: Synthetic coding sequence
atgcgcgatagactcccagacctgacagcctgccggaagaacgacgatggcgatactgttgtagtggtggagaaggaccatttcatggatgactttttccaccaggtggaggagatacgtaattctatcgacaagataacccagtacgtagaggaggtgaaaaaaaatcactctattatcctgagcgctccgaaccctgagggaaaaatcaaggaggaacttgaagacctgaacaaggaaattaagaaaaccgctaataagatcagagccaaattaaaagccattgagcaaagcttcgatcaggatgaaagcggaaaccgaacgagtgtggacctgcggatccgtagaacgcagcactctgttctcagccgcaagttcgtggaggccatggcagagtataacgaagcccaaacattgttccgcgagagatctaaagggcgtatccagcgccagttggagattaccggtagaaccactactgatgacgagttggaggagatgctggaatctggaaaaccttctatttttacgagcgacatcatctcagattcccagataactagacaggctttgaatgaaatcgaatctcgtcacaaggatattatgaaactagagacgtcaattcgcgaactccacgagatgttcatggacatggccatgtttgtggagacccagggggaaatgattaataacatcgagcgcaacgtgatgaatgccactgactatgttgagcacgccaaagaggagaccaagaaagctattaaatatcagagtaaagcacgtcggaagaagtggatcataatcgcggtgtcggtcgtgctggtggcaatcatcgccctgattatcggtctgtccgtcggaaaatag

SEQ ID NO: 243235 - DNA, 777 bp, Artificial Sequence
  Description of Artificial Sequence: Synthetic coding sequence
atggatgaattcttctccgaaatagaggagacgcggttgaacattgataagatcagcgagcacgtcgaggaggctaagaaactttactccatcatactttccgcacctattccggagccaaagaccaaggatgaccttgagcagctgaccaccgaaattaaaaagcgcgcaaataatgtcagaaacaaactgaaatctatggagaagcacatagaggaggatgaggtccgcagctccgctgaccttcgtatcaggaagagccagcactctgtgctgtcgcggaagttcgtggaggttatgaccaaatataacgaagcacaggtcgattttagagagcggtctaaagggaggattcagcggcaacttgaaatcaccggtaaaaaaactacagatgaggaactcgaagaaatgcttgagagcgggaaccccgcaatatttacctccggaatcatcgattcccagatctccaagcaggccctaagcgaaatcgaaggacgtcacaaagacatcgtcagattggagtcatccatcaaggaactgcatgacatgttcatggatattgctatgctggtagagaaccaaggcgaaatgctggacaacattgaattaaacgtgatgcacactgtcgatcatgtggagaaggcccgagacgaaacaaaaaaggcagtcaagtatcaatcacaggcgaggaaaaagttgataatcattatagtgctcgttgtcgtgttgctcgggatcctggcactgatcatcggactgtcagtgggactgaactag

SEQ ID NO: 243236 - DNA, 870 bp, Artificial Sequence
  Description of Artificial Sequence: Synthetic coding sequence
atgaaagaccggttagagcagttaaaagcgaagcagctgacacaggacgacgacaccgatgccgtggagattgcaattgataatactgcctttatggatgagttcttctcggaaatcgaagaaacaagattgaatatcgataagatctctgagcacgtggaggaggctaaaaagttatactccattattctatctgctcccatccctgagcccaaaaccaaagatgatctagagcagttgacaacagagattaagaagcgagccaataatgtgcgcaacaagctcaagagcatggagaagcacatagaggaagacgaggtgcgaagcagcgcagatttgagaattcgcaagtcacaacattcagttctctccaggaagttcgtagaggtgatgacgaagtataacgaggcccaagtggacttccgtgagcgctctaagggaagaattcagcgacagctggagattaccggcaagaagaccacggacgaggaactcgaggagatgctggagagtggcaatcccgctattttcacgagcgggatcatcgattctcaaatctctaaacaggcactgtctgaaattgaggggaggcacaaggatatcgtgcgcctcgaaagctcaatcaaggagttgcatgatatgttcatggacattgcgatgctcgtggagaaccagggtgaaatgctcgataacatcgaactcaatgtgatgcataccgtcgaccacgttgagaaggctagggatgagacaaaaaaggctgtgaaataccagtcccaagccaggaaaaagctgattatcataatcgtgctggtggtggtgttattgggcatactggcactgatcatcggactgtcagtaggactaaactag

SEQ ID NO: 243237 - DNA, 543 bp, Artificial Sequence
  Description of Artificial Sequence: Synthetic coding sequence
atggagaaacacatagaagaagatgaggtgaggtcttccgctgacttacgaatacgaaaatcacagcatagcgtactaagccgcaagttcgtggaggtgatgactaagtacaatgaagcccaagtagacttccgcgagaggagtaaaggccgtattcaaagacaactagaaatcaccgggaagaagacaactgatgaggagctggaagagatgctggaaagcggcaacccggctatctttacgagcggcatcatcgactctcagatttccaagcaggctctctctgagatcgagggccgacacaaggacattgtgcgcctggaatctagcatcaaggagttgcacgacatgtttatggatatagcaatgttagtcgagaatcaggggtcaatgatagaccggattgagaataacatggatcagtccgtcgggtttgtggaaagagcagtggcggataccaaaaaagcggtgaaataccagagcgaagcacggagaaaactgatcagtttacagacaggggtcgccactctggtcttcagatag

SEQ ID NO: 243238 - DNA, 834 bp, Artificial Sequence
  Description of Artificial Sequence: Synthetic coding sequence
atgaaagacagactcgaacagttgaaggcgaaacagctcacacaagatgatgatacagatgcagtggagatcgctatcgacaatacggccttcatggacgaattcttttctgaaatagaagagactcgcctgaatattgataagatctcagagcacgtcgaggaggctaaaaagctctatagcatcattttaagcgcccctattcctgagcctaagaccaaagacgacttagaacagcttacaacagagattaaaaaacgtgccaacaacgtgcggaacaaattgaaaagtatggaaaagcatattgaggaggatgaagtgcgtagtagtgcagacctgcgaatccggaaaagccagcactctgtcttgagccgaaagtttgtagaggtgatgacgaagtacaacgaagcacaagtcgactttcgtgagaggtcaaagggcaggatccagcgccagctggagattaccggcaagaaaacgacagatgaagaattggaagagatgctggaaagcggaaatcccgctatttttacctccggcattatcgattctcagatttcaaagcaggcattgtctgaaatcgagggcaggcacaaagatatcgtgcgattggaatccagtataaaggagctgcatgacatgttcatggatatcgcgatgctggtggagaatcagggcgagatgctggacaacatcgagctcaacgttatgcataccgtggatcacgtcgagaaggctcgagatgagacgaaaaaggccgtcaaatatcaatcccaagcccgtaagaaactgatatcactgcagactggagtcgccaccctcgtgttccgttag

SEQ ID NO: 243239 - DNA, 231 bp, Artificial Sequence
  Description of Artificial Sequence: Synthetic coding sequence
atgtttatggacatagcaatgctggtagaaaaccagggggagatgctggataacatcgagctgaacgtgatgcatacggtggatcacgtcgagaaggccagagacgaaaccaaaaaagccgttaagtaccagagtcaagccagaaagaagcttatcatcatcattgtgttggttgttgtcctcctgggcattctggctctgatcataggcctgagcgttggtcttaattag

SEQ ID NO: 243240 - DNA, 759 bp, Artificial Sequence
  Description of Artificial Sequence: Synthetic coding sequence
atgaaggataggcttgagcagttaaaggccaaacagttaacgcaggatgacgacacagacgctgttgagattgctatcgataatacagctttcatggatgagtttttttccgagattgaagaaaccagactgaatatcgacaaaatttcagaacatgtggaggaggccaagaagttgtacagcattatcttgtccgccccaatccctgagccaaaaactaaagatgatttagagcagctcaccactgaaatcaaaaagagggcgaacaatgtgcgaaataaactgaaatcgatggagaaacacattgaggaagatgaagtgcgctcatctgcggacctgcgcatcagaaagtcacaacatagcgtgctttcaagaaagttcgtggaggtcatgactaaatataacgaggcccaagtcgattttcgagagcggtcgaaaggacgaatccaacgccaactagagattacggggaaaaagaccacagacgaagagctagaggagatgctcgagtccgggaatcccgcaatctttacgtccgggatcatcgactcacaaatctctaagcaggcgctgtctgaaatcgagggccgtcacaaagatatcgtgcggctcgagagttccatcaaggagctgcacgatatgtttatggatatcgctatgttagtcgagaaccagaagttgatcataatcatcgtcctggtagttgtgctgctgggtatcctggcccttattattggcctgagcgtcggactgaactag

SEQ ID NO: 243241 - DNA, 894 bp, Artificial Sequence
  Description of Artificial Sequence: Synthetic coding sequence
atgcgtgacaggacacatgagctccggcagggcgatgacagctctgatgaagaagacaaagagcgcgtcgctctggtggtccaccccggaacggccaggctggggagtccagacgaggaatttttccataaggtgcggacgatccgacagaccatcgttaaactcggaaataaggtccaagaactggaaaaacagcaggttaccatccttgccacacccttgccagaggagagcatgaagcaggagctgcaaaacctgagagacgaaatcaagcaactgggacgcgagatccgactgcaactaaaagccatcgagcctcagaaggaggaagccgatgaaaactataatagcgtgaacactcgaatgcggaagacacagcacggagtcctatcccagcaattcgtcgaactgattaacaagtgcaatagcatgcagtcagaatatagagagaagaacgtggaaagaattcgtagacagcttaaaatcactaacgctggaatggtgtccgatgaggaactggaacaaatgctggatagcggccagagtgaagtgttcgtcagtaatattctaaaggatactcaagtgaccaggcaggccctcaatgaaatatccgcccgacactcggagatccagcagctggagcggagcataagggaactgcacgacatttttactttcttagcaaccgaagttgaaatgcagggcgagatgattaaccgcatcgagaagaatatactgagttcagcagactatgttgaacggggacaggagcacgtgaaaacagcactggaaaaccagaagaaagctaggaagaagaaagtgcttatcgcgatctgcgtctcgatcacagtggttctgttagccgtgattattggagtcactgtcgttgggtag

SEQ ID NO: 243242 - DNA, 888 bp, Artificial Sequence
  Description of Artificial Sequence: Synthetic coding sequence
atgggcatgaccgccaggaccaagaggaccaggagcggcagccgctggtggtgtacgagggccagacacggctggggagccagaacgcgctctagctcaaccagcccccttggacatcctcctcaggtgaggaccatccgacagactatagttaaactcggcaacaaagttcaagagctcgaaaaacagcaagttaccattctggccacacctctgcccgaggaaagcatgaaacaagagctacagaacctccgcgacgaaatcaagcagcttggccgagagatacgccttcaattgaaagctatcgagccacagaaagaagaggcggatgaaaattacaatagcgtcaatacgagaatgaggaaaactcaacatggagtgttaagtcagcaattcgtcgaactgatcaacaagtgcaattctatgcagagcgagtaccgagagaagaatgtggaaaggatccggcgacagcttaaaataacaaacgcgggtatggttagtgatgaggagctggagcagatgctagatagcggccagtcagaagtgttcgtttctaacatcctgaaagacacccaggtaacgagacaggccctgaatgagatttcagccagacactccgaaattcagcagttagaacgctctatccgggagctgcatgatatttttaccttcttagcgactgaagtggagatgcagggcgagatgatcaacaggatcgagaaaaacatactcagcagcgcagactacgtggagcgaggacaggaacacgtgaagactgccctagaaaatcaaaagaaagcacgaaagaaaaaagtcctcatcgcaatatgtgttagcatcacagtagtgctcctagcagttatcataggggttacagtcgtgggatag

SEQ ID NO: 243243 - DNA, 1068 bp, Artificial Sequence
  Description of Artificial Sequence: Synthetic coding sequence
atgattcctcgaaaacggtatggaagtaagaatactgatcagggggtctatcttggtctatcaaaaactcaggtgttgtcacccgcaactgccggttcttcttcctcagacattgccccactgccccctcctgtcaccctggtgccccctccccctgacaccatgtcctgccgtgaccgcactcaggaatttctctctgcatgcaagagcctacaaacacgccagaacggaatacagaccaacaagccagccctgagggccgtacggcaacggtctgagttcaccctgatggccaagaggatcggaaaggatctgagcaatacatttgccaaactggagaaactaacaattcttgcaaagcgtaagtcactcttcgatgacaaggctgtcgaaatcgaggaacttacttatataatcaaacaagacattaacagtcttaataaacagattgcacagctgcaggactttgtgagagcaaaagggagccagagcggcagacacctccagacccattcaaataccatagtggtgagcctacaatcaaaactcgcgtcaatgtcgaacgatttcaagtccgtgttggaagtgcgcaccgaaaaccttaagcaacagcgttcaaggcgggaacagttctcgcgcgctcctgtgtcagctctacccctcgcccctaatcatttaggcggtggcgctgtggttctgggagccgaatcccacgctagtaaggatgtcgcaatcgacatgatggatagccgcacaagccaacagctgcagctcatcgacgaacaagactcttacatacaaagtcgcgctgacacaatgcaaaacatcgagtctaccatagtggagctcggatcaatctttcagcagctcgctcacatggtgaaggagcaagaggaaactatccaaaggatcgacgagaatgtcctaggcgctcagcttgacgtcgaagcagcacatagtgaaatcctgaagtatttccagtccgtgacctctaaccgttggttgatggtgaagatattccttatcctgatcgtcttcttcataatttttgtcgtctttctggcctag

SEQ ID NO: 243244 - DNA, 966 bp, Artificial Sequence
  Description of Artificial Sequence: Synthetic coding sequence
atgatccccaggaaaagatatgggagtaagaacacagatcagggagtgtaccttggtctaagtaagactcaggtgctgagccctgccacagctgggagctcttccagtgacatagctccgctcccaccacctgtaacacttgtaccgcctccaccggatacgatgtcatgccgagatcgaacccaagaatttttgtccgcgtgtaagagcctccagactaggcaaaacggcatccaaacaaataagccagcgcttcgggctgtgcgtcaacgaagtgaatttaccctaatggctaaaaggattggcaaggacctgagtaacacttttgccaagcttgaaaagctcacaattctcgctaagcggaaatcactattcgacgacaaagctgttgagatcgaggaactgacctacattattaaacaggatattaactccctcaataaacagatcgctcagctgcaggacttcgtgcgcgctaaaggctcccagtctggcagacacctacagacacactctaatactatagtggtttccctgcagtctaagttggctagtatgtccaacgactttaaaagtgtgctggaagtccggacggagaatctgaaacagcagcgcagcaggcgcgagcagttctccagagcacctgtgagcgcacttcctcttgctcctaaccatctgggaggtggggcagtggtgcttggagcagagagccacgcaagtaaagatgtggctattgatatgatggactccagaacatcccagcagcttcagttaattgacgaacaggattcatatattcagtcccgggctgatacgatgcaaaatatcgaatccaccattgtggagctggggtctatattccagcagctcgcgcatatggttaaagagcaagaggagactatccagtccgtgctcttatttcccctccttcctgctctgtcaccagggagcacccgaacatgttag

SEQ ID NO: 243245 - DNA, 906 bp, Artificial Sequence
  Description of Artificial Sequence: Synthetic coding sequence
atgtcctgtagggaccggacacaggagttcctttccgcttgcaagtctctccaaactcggcaaaacggcatccagactaacaaaccggcattaagagctgtgcggcagcgatcagaattcacacttatggctaaaagaatcggcaaggatctgagcaatacctttgcgaagctggagaagctgactatcctcgccaagcgtaagtcactctttgatgacaaagcggtagagattgaagagctgacatatataattaaacaggatattaattccctgaataagcagattgcgcaactgcaggattttgtgcgtgctaaaggtagtcagtcggggagacacctgcagactcacagcaacacaattgtggtgtccttacaaagcaagctggctagcatgtccaacgatttcaagtccgtgttagaagtgagaacggaaaatctgaagcagcagcgctcacggagagaacagttttctagagctccagtgtctgccttacctttggcaccgaatcatctcggcggaggcgctgtagtactcggggcagaatctcatgcgagtaaagacgtggccatcgatatgatggattcacggacttcgcagcagcttcagcttattgatgagcaggacagctacatccagagccgggcagacacaatgcagaacatcgagtcaacgattgtagaactagggagcatctttcagcagctagcacacatggtgaaagagcaagaagagactatccaacggatcgacgaaaacgttctgggcgctcagctcgatgttgaagcagctcatagcgagattttgaagtatttccagtccgtcacctccaacaggtggctcatggtcaaaatttttctgatattgatagtgttctttataattttcgtagtctttctggcgtag

SEQ ID NO: 243246 - DNA, 780 bp, Artificial Sequence
  Description of Artificial Sequence: Synthetic coding sequence
atggctaagcggatcggaaaagatctgagcaatacatttgctaagttggaaaaacttacaatcctggccaaacgcaaatccctgttcgatgataaggctgtcgagatagaggaactgacttacataattaagcaggacatcaactcactgaacaagcagattgctcaactccaggattttgtgcgcgctaagggctcacaaagtggtaggcatttgcagacacactcaaacacaattgttgtgtcccttcagtcaaaattagccagtatgtccaatgacttcaaaagtgttctggaggtacggaccgaaaacctaaaacagcagcggagcagacgagaacagttttctcgggctcccgtttccgccctccctcttgcccctaaccacctgggaggtggggctgtggtactcggcgctgagtctcacgcttccaaggacgtcgccatcgatatgatggactcccggacaagccaacaattacaactgattgatgaacaagattcgtacattcagagccgagctgacacgatgcagaatatagagagcacaatagtcgagctgggatcaatttttcagcaactcgcacacatggtaaaagaacaggaagagacgatacagcgtatagacgagaacgtgctcggggctcagcttgacgttgaagcagcccattctgagattttgaaatactttcagtctgtgacgtccaatagatggttgatggtcaagattttcctcatcctgatagtgttttttataatattcgtggtctttctggcctag

SEQ ID NO: 243247 - DNA, 720 bp, Artificial Sequence
  Description of Artificial Sequence: Synthetic coding sequence
atgtcctacacacctggcgttgggggtgatcccgctcagctggctcagcgaatcagcagcaatatccaaaagattacccagtgtagcgtggagatacagagaacccttaatcagctgggaaccccccaggactctccagaattgagacaacaattgcagcaaaagcaacagtacaccaaccagcttgccaaggagaccgataaatacattaaagagttcggaagccttccaaccacaccgtcagagcagaggcaaaggaaaatacagaaagaccgattggtggccgagtttaccacctccctcacaaacttccagaaggtccagcgccaggcagcggagagagaaaaggagtttgtagcacgggtccgagcctctagtagagtgtctggatctttccccgaagatagcagtaaagaaagaaatcttgtctcttgggaatcacaaacccaacctcaagtgcaagttcaagatgaggagataaccgaggacgacctgcgactgatccatgaaagggagtccagtattcggcaacttgaagcggacattatggatatcaacgaaatcttcaaggatttgggaatgatgatacacgagcagggggacgtgattgactccatcgaggcaaacgtggaaaacgcagaggtgcacgtgcaacaggcaaaccaacagttgagccgggcagcggactaccagaaaaaagacagttgtatgctgatgtag

SEQ ID NO: 243248 - DNA, 786 bp, Artificial Sequence
  Description of Artificial Sequence: Synthetic coding sequence
atgtcatatacccccggagttggcggtgacccggctcagctcgcgcagcggatcagtagcaacatccagaagattacccagtgttctgttgaaatccagcgtactctcaatcagttagggaccccccaagactcacccgaactccgtcagcagttgcagcaaaaacagcaatacacgaatcagctcgcgaaggagacagataagtacatcaaggagtttgggagcctcccaactacaccctccgagcagagacaacgtaagatccagaaagaccgcttagtggccgaattcaccaccagtcttacgaattttcagaaagtgcagcggcaggccgcagagcgcgaaaaagagtttgtggcaagagtgcgggcttccagcagggtgtctggaagttttccagaggactcctctaaggagcggaacctggtgtcttgggagtctcaaacccagccacaggtgcaagtacaggatgaggagatcaccgaagatgacctgcgcttgatccacgaaagagaatcctccattcggcagttggaagcagatataatggacattaacgagattttcaaggacctcggaatgatgatccacgaacagggcgacgtgatcgatagcatcgaggcaaacgttgagaacgcagaagtccacgtgcaacaggccaaccagcagctgagcagagccgctgactatcagcggaagtctcgcaagactctgtgcataattatcctcatccttgtgatcggggtggctattatctctctgatcatctgggggttaaatcattag

SEQ ID NO: 243249 - DNA, 786 bp, Artificial Sequence
  Description of Artificial Sequence: Synthetic coding sequence
atgagttacacccccggagttggcggagacccggcacagcttgctcagagaatatcatcaaacattcaaaaaatcactcagtgctcagttgagatccaacggaccctgaaccagttggggacaccccaagattccccagagttacgccaacagcttcagcagaaacagcagtatacaaaccagttagccaaagagaccgataaatacatcaaagagttcgggtcattgcccactactccctcggaacagcgtcagaggaagattcagaaggatcgcctggtggcagagttcacgaccagtctcaccaacttccagaaagtgcagcgccaggccgctgagagggagaaagaattcgtggcgagggtgcgggctagtagcagagtgagcgggagtttccccgaggacagttcaaaggagaggaacttggtatcctgggagtcacaaactcagcctcaagtccaggttcaggatgaagaaattacagaagacgatttacgcctcatccacgagagggagtctagtatacgtcagttggaagcagacatcatggacatcaatgaaatatttaaggacctcggaatgatgattcatgaacagggtgacgtaatcgactccattgaagcgaacgtcgaaaacgccgaggtgcatgttcaacaggcaaaccaacagctgtctagggcagcggactatcagagaaagtctcggaaaacactgtgcatcatcatactgattcttgtgattggtgttgctatcatctccctcattatctggggcctgaatcattag

SEQ ID NO: 243250 - DNA, 711 bp, Artificial Sequence
  Description of Artificial Sequence: Synthetic coding sequence
atggcgcctgatccctggttcagtacgtatgactctacatgtcagatcgctcaggaaatcgctgagaaaatacagcagcgcaaccagtatgagcggaagggggaaaaggccccaaagctaactgtgacaatccgagcactgctgcagaatctcaaagaaaaaatcgcactgttgaaagaccttctgctgcgtgccgtgagtacccatcagatcacacagttggaaggggaccgccgacagaatctgctggacgacctggttactcgcgaacggctcctgctggcctctttcaagaatgagggagcagaacctgacctgatcaggtcctcactgatgtcggaagaagcaaagagaggcgctcccaacccttggctctttgaagagcccgaagagacgcgcggactgggcttcgatgagattcggcagcaacagcagaaaattatacaggaacaggacgccggactggacgcattaagcagcataatatccagacagaagcaaatggggcaggagataggcaatgagttggacgagcagaatgaaattatcgatgacctggccaacctcgtggagaacacagatgagaagttgcgaaacgagactcggagagtgaacatggtggacagaaagagtgcttcttgcggaatgatcatggtcatcttgttactcctggtggcaattgtcgtcgtcgccgtctggcccacaaactag

SEQ ID NO: 243251 - DNA, 1785 bp, Artificial Sequence
  Description of Artificial Sequence: Synthetic coding sequence
atggctcccatcggattgaaggccgtggtcggagaaaagatcatgcacgacgtcatcaagaaagtgaagaagaaaggagaatggaaggtgctggtggtggaccagctttcgatgcggatgttatcctcttgttgcaagatgacggacattatgaccgagggaattaccattgtcgaggacattaataaacgcagagagcctcttccctcccttgaagctgtctatctgattactccttccgaaaagtccgttcattctctgatttctgactttaaggaccctccaactgctaagtatcgggcagcacacgtgttctttacagacagttgccctgatgctctcttcaatgaattagtgaaaagccgagccgcaaaggtgattaaaacccttaccgaaattaatattgccttcttgccatatgagtcccaggtatacagcctggattccgctgacagctttcagtccttttactctccacacaaagcccaaatgaaaaaccctatcctggagcgcctggcggaacaaattgcaacactttgcgccacccttaaggaatatcctgcggttcgctaccgcggagagtataaagataacgccttgctcgctcagctgatacaagacaagttggatgcctataaagccgacgatcccacgatgggcgagggacctgataaagctaggtctcagctgctcattctcgacaggggcttcgaccccagtagtcctgtcttgcacgagctcacatttcaggccatgtcttacgatctgctgcctatcgagaatgatgtctacaagtacgagacatccgggattggcgaggccagagtgaaggaagtgctcctggatgaagacgatgacctttggattgctttgcggcataagcatattgctgaagtctctcaggaggtaacacgtagccttaaagatttttctagctctaagcggatgaacacaggagagaagaccaccatgcgggatctctctcagatgttaaagaagatgccccagtatcaaaaagagctgtcaaagtactccactcatttgcacctggcagaagactgtatgaagcactaccagggaacagtggacaaattgtgccgcgtagaacaggacctggcaatgggtacggatgcagaaggagagaagataaaagatccaatgagagctatcgtacctatacttttggatgcgaatgtgtccacatacgataaaatcagaatcattctcctctatattttcctcaaaaacgggatcactgaggaaaacctgaacaagttgatccagcacgcgcagatccctcctgaggactcagagataatcactaacatggcccatcttggggtacccatagtaactgattctacacttagacgcagatctaaaccagagagaaaagagcgcatttcagagcagacctatcagttgtcccgctggactcctataattaaagatatcatggaagatactatcgaagataagcttgatacaaaacattatccctacattagtactcgctctagcgcgagtttttcaactactgctgtctccgcacgctatgggcattggcataaaaacaaggcgccaggagagtataggagcgggcctcgactgatcattttcattctcggaggagtctccttaaatgaaatgagatgcgcctatgaggtcacccaagccaacggcaaatgggaggtgctaataggatcaactcatattcttaccccccaaaaactgttggacacactaaaaaagctcaataaaacagatgaagaaataagctcttag

SEQ ID NO: 243252 - DNA, 1674 bp, Artificial Sequence
  Description of Artificial Sequence: Synthetic coding sequence
atgaccgatattatgactgaaggcattactattgtggaagacatcaacaagcgaagagaacctctccccagtttggaggccgtgtatctcatcaccccctccgaaaagtcagtccactcacttataagtgattttaaggatccgcctacagctaagtatagagcagctcatgtttttttcaccgactcatgtcctgatgccttatttaatgaactggtgaaaagccgagccgcaaaggtcatcaagacacttacagagattaacatagcgttcctcccttatgaatcacaggtctattccctagattctgcagattcattccaatccttttattcaccacataaggctcagatgaagaaccccattctcgagcgtctggccgaacagatcgctaccctatgtgctactctgaaggaatatcctgccgtgagatatcgtggagagtacaaagacaatgcactcctggcccaactgatccaggataaattggacgcatataaagccgatgatcccacaatgggggagggtcccgacaaagccagatcacagctactgattctcgatcgcggtttcgacccaagctcaccagtcctgcatgaattaacgtttcaggcaatgtcttacgatctgctccctatcgagaacgacgtgtacaagtacgagacaagcggcatcggggaagcaagagtgaaggaggtactacttgatgaggatgatgatctgtggattgctctgcggcacaaacacattgctgaggtgagtcaggaggtgaccagatccctcaaagacttcagttcctcgaagagaatgaacaccggcgaaaagaccacaatgcgagacctcagccaaatgctgaaaaagatgccacagtatcagaaagagctctccaagtattcaacacatcttcacctcgcggaggactgtatgaagcattaccaggggaccgtcgataaactgtgtagggtggagcaggacctggctatgggaacggatgcggagggagagaagatcaaagatccaatgcgggcaatcgtgccaatactgctggacgcaaatgtgagcacgtacgacaagataagaattatcctgttgtatatcttcttaaaaaatgggattacagaagagaatctgaataagcttatacaacatgcacagatcccacctgaagactccgagattattaccaacatggcccacctgggagtgccaatcgtgacagattcaaccttgaggaggcggagcaagcccgagagaaaggaacggatctcggaacagacctatcaactttccagatggactcccatcatcaaagatattatggaagacaccatagaggacaagttagataccaagcattacccttatatcagcacacggtcttccgcaagcttttcaacaactgccgtgtccgccaggtatggacattggcacaaaaacaaggcccctggcgaatatcgaagtggccctcggctgatcattttcatcctgggtggcgtgtctctgaacgagatgcgatgcgcctatgaggtgactcaggcaaacgggaaatgggaggtgctaatcggatctacacacatccttacccccacgaaattcttgatggatctgcgccatcccgatttccgggaaagctcccgggtgtctttcgaggatcaggccccaacaatggaatag

SEQ ID NO: 243253 - DNA, 1308 bp, Artificial Sequence
  Description of Artificial Sequence: Synthetic coding sequence
atggccccaataggcctgaaggccgtggttggcgagaagatcatgcatgatgtgataaaaaaagtgaaaaagaaaggcgagtggaaggtccttgtggtggatcagctgtcgatgaggatgctgagctcctgttgtaagatgaccgatatcatgacagaaggcccagacaaggccaggtcacagttgctcattctcgacagggggtttgacccctcaagtcctgtgctacacgagttgacattccaagctatgagctacgacttactcccaattgaaaacgacgtctataaatatgagacttctggaataggtgaagccagagtgaaagaggtacttctggatgaggatgacgacttgtggattgcgttgcgccataagcacattgctgaagtttcccaggaagtgacccggtcactgaaggatttctcaagctctaaacgaatgaacaccggagaaaagacaacaatgagagatttaagtcagatgttaaagaagatgccgcagtaccaaaaggagctctcaaagtactccactcacctacacttagcagaagactgcatgaaacactatcagggcactgtggacaaactctgtagagtcgagcaagacttagcaatgggtaccgatgccgaaggtgagaagattaaggacccaatgagggcaattgttcccatcttgttagatgcaaacgtcagtacatacgacaaaattaggataatcctgttgtatatcttccttaagaacgggataaccgaagagaacttgaacaaactgattcagcacgcgcaaatccctcccgaagattctgagatcatcacaaatatggcacacctcggggttcctatcgtgaccgattctacactgaggcggcgtagcaagccagagaggaaagagcggatctccgagcagacataccaactttcccgatggacacccatcattaaagacattatggaagatactatagaagacaagctcgacactaagcattatccgtacattagtacacggtcttcggccagcttttcaacaacagctgtgagcgcgagatacggacactggcacaagaataaggcaccgggagaatataggtccgggcctagactaatcatttttattctgggcggtgtgagtctgaatgagatgcggtgcgcttacgaggtgacccaagcgaacggcaagtgggaagtgctgataggatctacacacattcttacgcccactaaatttctgatggatctgagacatccagactttagagagtcgtcccgggtgagttttgaggatcaagctccgaccatggaatag

SEQ ID NO: 243254 - DNA, 1812 bp, Artificial Sequence
  Description of Artificial Sequence: Synthetic coding sequence
atggctcccattggcttgaaagcagtggtgggggagaagatcatgcacgatgtgatcaaaaaagtcaagaaaaagggagaatggaaggtactcgtggtcgatcaattgagtatgaggatgttgagtagctgttgcaaaatgaccgacataatgacagagggtattaccatcgttgaggatatcaataagcggagagagccgctccccagcttggaggctgtctatttaataactccaagcgagaaatcagtacatagtttgatatctgatttcaaagaccctccaacagctaagtaccgggcagcccacgtgttcttcacagattcatgccctgatgcgctcttcaacgagcttgtgaagtcccgtgccgctaaggtaataaaaaccctgaccgaaatcaatatcgctttcctgccgtatgaatctcaggtctacagtcttgattccgctgattctttccagagcttttattccccacacaaagcccagatgaaaaatcccatcctggaaaggctggccgagcaaatcgccacactctgtgccacccttaaagagtaccccgctgtgcgctataggggagagtataaggataacgctctgctggcgcagcttattcaggacaaactcgacgcatacaaggcagacgaccctacgatgggggaaggtcctgataaagccaggtcccaactgctgatattagatcggggttttgacccatcttcgcccgtgctccacgagctcaccttccaagctatgagctacgatttgctccccatcgaaaacgacgtgtataaatacgaaaccagtggcatcggtgaagccagagtgaaggaggtcctgctcgatgaggatgatgacctgtggatcgcgctgcggcataagcacatcgccgaggtgagtcaagaggtgacgagaagccttaaggacttctcatcctctaaaaggatgaacaccggagagaagacgaccatgagagatttgagccagatgctgaaaaaaatgccccagtaccaaaaagaactgagcaaatattcaacgcatctgcaccttgctgaagattgcatgaaacattaccagggaaccgtcgacaagctttgtcgcgttgagcaggatctggctatgggaaccgatgcagaaggtgagaagattaaggacccgatgcgagccatcgtacccatcctcctggacgctaacgtttcaacttacgataagatccggatcatattgctgtatatcttcctaaaaaacgggatcacggaagagaacctgaataaattaatccagcatgcgcagataccgccagaggactcagagataatcactaacatggcgcatctcggagtaccgatcgttaccgattcgaccctccgtaggcgaagcaaacctgaacgtaaggagagaatctccgagcagacgtaccagctgtcacgttggacccctatcataaaagacattatggaagacaccatcgaagacaagctggatacaaaacactacccatatatttcaacgcgtagctctgcttccttttcaacaacggcggtttcggctcggtacggtcattggcacaaaaataaggccccaggtgagtaccgtagcggtccgagactcattatctttatcttgggcggtgtgagcctgaacgaaatgaggtgcgcatatgaagtaactcaggccaatggtaaatgggaggtgctcatcggaagtacccatattctgaccccgaccaagttcctcatggatctccgccaccccgatttcagggagtccagtagagtttcatttgaagaccaagctcccacgatggagtag

SEQ ID NO: 243255 - DNA, 1389 bp, Artificial Sequence
  Description of Artificial Sequence: Synthetic coding sequence
atggcacccacaatccagacccaggcccaaagggaggatggacaccgctctggcgtagtgtgcagagttaagtactgcaactcactgccagacatcccattcgatccgaaattcattacgtacccgttcgaccagaaccggtttgtgcagtacaaggcgactagtctagaaaaacagcataagcacgacctccttaccgaacccgatctgggtgtaacaatcgacctgatcaacccagacacttacagaattgacccgaacgtgttactggatccggcagatgagaagttgctcgaagaagagatccaggcccctacctcgtcaaaaagaagccagcagcatgcgaaagtggttccttggatgcgaaagactgagtacatatctacagaattcaaccgctacggaatctcgaacgagaaaccagaggtgaaaatcggtgtgagtgtgaaacagcaatttacagaagaggagatatacaaagatcgcgactcacaaattaccgctatagagaagaccttcgaagatgcacaaaagagcatgtggatcaatccttgcgcacaggtgatcttcgacagcgatcccgctcccaaagacaccagcggtgcagccgctctggaaatgatgagtcaagcaatgatccgcggaatgatggacgaggaaggcaatcaatttgtggcctactttctccccgtcgaggagacacttaagaagcggaaacgggatcaagaggaggagatggactatgcacccgatgacgtctacgactataaaatcgctcgggaatacaattggaacgtaaagaacaaggcctctaaaggctacgaggagaactacttcttcattttccgtgagggtgacggcgtgtactataatgaacttgaaactcgcgtccgcctctctaagcgtcgggctaaggctggggtccagtcaggaacgaacgccctgttggtggttaaacacagagacatgaacgagaaggagttggaggcccaagaagccagaaaagcccaacttgagaaccatgagccagaggaagaagaggaagaggagatggagacagaagaaaaagaagccggtggaagcgtgatgctcattctgagaactatgccaactctgatgatgaggaccgaagatcgacccaaggtcgctgttacaatgatccagactgcggctgctatgggggtagcaagtggggctggcgcaacagcagccgctccggtgcccagccccgtggccgcatcgactcgacccaggagaatggctgtgaagctgcaactgctcataccggtcaagctgatcgtgaccgtaaccgagagccagggcatccagggctggttcagacatcattactgcgaacaacagtctacgttcctggtggtgtgcctttag

SEQ ID NO: 243256 - DNA, 1197 bp, Artificial Sequence
  Description of Artificial Sequence: Synthetic coding sequence
atgtgcattcgcgtgcatgtctcaatgtgtatgtgcatgtgtgttcacgtgtgcgtccacctctgtatgcatgtctgtgccgtctgtatgtgtgtgtatgtgtgcgtgtgcgtccacgttcacgtgtgcgcatctgtgtgtgcctttgtctgcatgtgcgtatgcgtatgtgtttgcggtagtgtgtgcgcctttgtgtcagtacacgtatgcatgagggtgtacgtgtgcgtgtgtatttgtgttcacttgtacgtttgcgtgtgtgtctgtctctgtgcttgtgtatatgcttgcgtttgcatgtgtctgagactgtgtgtgcggctctgtgtttccgtgtgtgcgtgcgtttacgcctgcatctgcatgtgcatctgcgtgcatgtgtccatgtatgtatgcgcgagcgtgtgtgcctgcgtgtgcgtgtgtgtttgcgtctgtgtatgcatgcgggtatgtgcccaccagtgtctgcacgtatgtatctgtgtctatgtgtgtgcacgcatctgcgtgtgcgcctgtgtgtatgtctgtgtttgtatttccgtctgcgcatgcgtatacgtctgcgtgcatctgtgcgtgtgtgcctgtgtgcatgcatgtgtttgtgtgtgcgcatgcgtacatctgtgcgtgtgcgcgtgtgcgcacgtgggagccacccttgtgtgcatatgtacatacacttgtccacgtccatccatgttcgcacatggcggtcgctggggtgtagctgggcgtcccagacagccgatgagcctaggagttcaggctcaggcacagcgagtgattcatctgccccagtctgtccaagccctgataaaggactttcaagggacacctaccttcacctacaaagccgctcatatttttttcaccgacacatgccccgagccactgttctccgaattagggcgttctaggttagcgaaggtggtcaagacacttaaagaaatccacctcgcctttctcccgtatgaggcgcaggtgcgacccggactcatccttggtcgcggatgggggtttgttacaaaatgccccttgtttccccagaagcaaacactgagactcggggctgtggcacatacctgtaacccctccgccgttggcggacaaggacgcaggattacgtgggggcaggaatttgaaacttctctgggaaccgaacaggacccagtgagctag

SEQ ID NO: 243257 - DNA, 1773 bp, Artificial Sequence
  Description of Artificial Sequence: Synthetic coding sequence
atggccccttctgggctgaaggcagtagtgggtgagaagatcctctccggcgtcattagaagtgttaaaaaggatggggagtggaaggtgcttattatggatcatccctcaatgcggattctgagctcttgctgcaagatgagcgacatactggcagaggggatcacaatcgtagaggatattaacaaacggagagagccgatcccatctttagaggcaatctacctcctgtcccccactgaaaaggcattaataaaggactttcagggcacccccaccttcacatacaaagcagctcatattttcttcaccgacacatgccccgagccgcttttctctgagctcgggcgatcaagactggcgaaggtggtgaaaacactgaaagagatacatctggccttcctgccgtatgaggcacaggtgttctctcttgacgctccacacagtacatataacctgtattgtccctttcgagcagaggagagaacaagacagctagaagtcctcgcacaacagatcgccaccctttgcgctacactccaggagtacccagccattcgttatcggaagggaccagaagatactgcccagctggcacatgcagtgcttgccaaacttaatgcattcaaagccgacactccatcgctcggcgagggacctgagaagacccggtcccagcttttgatcatggaccgcgctgctgacccggtgtccccactgcttcacgaacttacttttcaggcaatggcgtacgatttgctagatatcgagcaggacacgtatcggtacgaaaccaccggcctgtctgaggcccgtgaaaaggctgtgctacttgacgaagacgacgatctgtgggtggagctccgccatatgcatatcgccgatgtgtccaagaaggtaaccgagctgctgcggacattctgcgaatctaaaagacttactacagacaaagcgaatatcaaggacctgtctcagattctcaagaaaatgccacaataccaaaaggagctgaacaagtactccacacaccttcacctggcagatgattgcatgaaacattttaagggatccgttgaaaaactgtgcagtgtggaacaggacctcgctatggggagtgacgccgagggcgagaagatcaaggacagtatgaagctgatagtgcctgtgctgctagacgctgctgtgcccgcatatgataaaataagagtcttgcttctgtatatcttgctcaggaatggagtaagcgaagagaacctggctaagcttattcagcacgcgaacgtgcaggcccacagcagtctgatcagaaatctcgagcaactgggcggaaccgtcactaatccagggggttctggtacgagttcgcggctcgaacccagagaaagaatggaacccacgtaccagctgtcccgatggacgccagtcattaaagacgtcatggaggatgcagtggaggaccgccttgaccggaatctgtggcccttcgtgtccgaccctgccccaactgcctcgagtcaggctgccgtgagcgccagattcgggcactggcacaagaataaagcaggcatagaagctcgggcagggcctaggctaattgtctatgtgatgggaggagttgccatgagcgaaatgagagcggcatacgaggtgacacgggctacagaggggaaatgggaggtattgatcggatcctcacacattctaactcccactcggtttttggacgatttaaaggctctggacaagaaattagaggatatcgctctcccctag

SEQ ID NO: 243258 - DNA, 1815 bp, Artificial Sequence
  Description of Artificial Sequence: Synthetic coding sequence
atggccccttccggcctcaaagccgttgtgggggagaaaattctgagtggggtgattcgcagtgtcaaaaaggacggagagtggaaggtactcatcatggatcacccatcgatgagaatccttagctcctgttgtaagatgtcagatatactcgctgaaggtatcactatcgtggaggatatcaataagagacgcgaaccaatcccttccctggaggccatttacctgctttctcctactgagaaggctcaagcacaacgggttatccatctcccacaaagcgtgcaagccctgattaaggattttcagggcacacccacattcacatataaagccgctcatatcttctttacggacacctgccctgaaccattgttttccgaactggggcgtagtagacttgctaaagtggtgaagaccctaaaagagatccacctggcctttctgccatacgaagctcaggtcttttctctggacgcaccacacagcacatataatctctattgccccttccgagctgaggaaaggacacgtcagcttgaagttcttgcccaacaaatcgcaacgctctgtgcaacactgcaggaatatcctgctattagatataggaaggggcctgaggacaccgcccagttagctcacgctgtgctggccaagttgaacgcgttcaaggctgatactccatcccttggagagggcccagagaagactaggtcgcagcttttgattatggaccgggcagccgaccctgtcagccccctcctgcacgagttgacatttcaggctatggcatacgatcttctggatatcgaacaggatacctatcggtacgagacaaccgggctgtctgaggcgagggaaaaagccgtattgctcgatgaggatgatgatctgtgggtggagctccgacatatgcatatcgctgatgtgagcaaaaaagtgaccgagcttctgaggaccttctgtgagtctaagcgattgacaactgataaggcgaacatcaaggatctatcccagattctaaaaaaaatgcctcagtatcagaaagagctgaacaagtatagcacccacctgcatctggcggatgactgcatgaaacacttcaagggaagcgttgaaaagctatgcagcgttgagcaggacttagccatgggaagtgatgctgaaggggagaagattaaggatagcatgaagcttattgtacctgttctgcttgacgcggctgtgcccgcatacgataaaatccgcgtactgctgctgtacatactgctgcgcaatggcgtttcagaggaaaatttggccaagctgatacagcacgctaatgttcaggcacattcgtctctgatccggaaccttgaacagctggggggaactgtgaccaaccctgggggtagcgggaccagctcacgcctggaacctcgcgaaaggatggaacccacctaccaattgagccggtggacaccagtgattaaagacgtcatggaagacgctgtggaggatcggctagatagaaacctatggcctttcgtaagcgaccctgctcccaccgctagtagtcaggccgcagtgtcagctagattcggccactggcataagaataaggctggcatagaagctcgcgcagggcctaggcttatcgtgtacgtcatgggcggtgttgcaatgtccgagatgagagccgcttatgaggtgacacgggctacggaaggcaaatgggaagtcctgattgggagtagtcatatactgacacctactcgcttcctggatgacctgaaggcactggacaagaaacttgaggacatcgcattaccctag

SEQ ID NO: 243259 - DNA, 1740 bp, Artificial Sequence
  Description of Artificial Sequence: Synthetic coding sequence
atggccccatccggcctgaaggctgtggttggggagaagattctctcaggggttataaggtcagtgaaaaaagatggcgagtggaaggtcctaattatggaccacccgtcaatgagaatcttaagctcttgctgcaagatgagcgacatcctagctgaagggattacaatagtggaagacatcaataagcggagagagccaatcccgtccttggaagcaatatacttactttcacccaccgaaaaatcagttcaggccttgatcaaagacttccagggcacccctacctttacctacaaagcagcccacattttctttactgacacttgtcctgagcctttatttagcgagctggggaggtctcgattggccaaggtggtcaagactctgaaagaaatccatctcgcgtttcttccctatgaggctcaggtgtttagccttgatgcaccccacagcacttataacctgtactgtcctttccgcgctgaggagagaacgcgccagctggaagtactcgcccaacagattgcgaccctctgcgccacactacaggaatacccggcaatccggtaccgcaagggtccagaggatacagctcagctggctcatgccgttctcgctaaactgaacgcctttaaggctgacacacctagcctgggagaggggccagagaaaactcgctcacaactcttgataatggatagggctgctgaccccgtctcgccactcctgcatgaactgacctttcaggctatggcgtacgatttgctggatatagagcaggatacttaccggtatgagactacggggctgtccgaagccagagaaaaagctgtgctcctggacgaggatgacgatctgtgggtggagctcagacacatgcatatagctgatgtctcaaagaaggttaccgagcttctgcggaccttttgtgagagtaagagattaactacagacaaggccaatatcaaggatctgtcccagatattgaaaaaaatgcctcaataccagaaagagttgaacaagtatagtactcacctacatctggctgacgattgcatgaaacactttaaaggaagtgtcgaaaaactttgttcagtggaacaggacctagctatgggaagtgatgccgagggcgagaaaattaaggactcaatgaagctaatcgtcccggtgctcttagacgccgctgtgcccgcatatgataagataagggtgctgttgttatatatcttgctccgaaacggagtgtctgaggagaatctcgctaagctcatccaacacgctaacgtccaggcgcacagctctctgataagaaatcttgaacagcttgggggtacagtaactaatcctggcggtagtggtacctccagtcggctggagcccagggaacgcatggaacctacttatcagctgagccgctggacccccgtgataaaagacgtgatggaagatgcagtggaagatcgcttagaccgcaatctgtggccatttgtatctgacccagctccgacagccagctcgcaggcagccgtgagcgccagattcggccactggcacaaaaataaagctggaatagaggcgagggccggtcctagactgatcgtctatgtgatgggcggtgttgcaatgtccgaaatgcgggcagcttacgaggttactcgggctacagagggatcaggcaggtgtagcctcgcaccccacacgtcatctccaagacccgctagctggatgacttag

SEQ ID NO: 243260 - DNA, 2421 bp, Artificial Sequence
  Description of Artificial Sequence: Synthetic coding sequence
atgcatgggaagtccaccgctgttctggagatggactacagcatcgtggacttcctgacactgtgcgaaaccccatatcccaacgactttcaggagccatatgccgtagttgtgttactggagaaggacctagttctgatcgacctcgcccagaatggatatccaatcttcgagaatccttatcctttatcaatccatgaatcccccgtgacctgttgcgagtatttcgctgattgcccggtggatctgattcccgcactctatagcgtgggggctcggcagaagcgccagggctacagcaagaaagagtggccgattaacggcggtaactggggcctgggcgcacaatcataccccgagatcataataactgggcatgccgacggctcggtcaagttctgggacgcgagcgccatcacgcttcaggtgttatataagcttaaaacttccaaagtttttgagaaaagccgcaacaaggacgacaggccaaatacagacattgtggatgaggatccctatgccattcagatcatctcatggtgccctgagtctcggatgctctgcatagcgggagtgtcagcccatgtgatcatttatagattttctaaacaagaggtgataaccgaagtgatccctatgctcgaagtgcgcctcctttacgaaataaacgatgttgagacacccgagggcgaacagccaccacctttaccgactcctgtgggtggctctaatccacaacctatcccgcctcagagccatcctagcacttctagctcgagcagtgatggactcagagacaatgtaccatgccttaaagtgaagaacagtcctttaaaacagagcccaggttaccagacagagttggtgatacagctcgtctgggtcggcggagaacctccccagcagatcaccagcctggcggtgaatagctcttatgggctcgtggtgttcgggaactgcaacggaattgccatggttgactacctgcagaaggccgtgctgttaaacctgggtactattgagctgtacggttctaatgacccttaccgcagagaacccagatctcccagaaagagccgccagccctccggtgcaggcctatgtgatattagtgaggggactgtcgtgcccgaagatagatgcaagtcccccacttccgggtcatcatctccacataactcagatgatgaacagaaaatgaataatttcattgagaaagctaagatgtcccgcaagcttagtctgcctacagacctgaaacctgacctcgatgtgaaagataactctttttctcgctcccgttcatcaagcgtcactagcattgacaaggagagtcgagaggccatcagtgcccttcacttttgtgaaacattcacccgtaaaactgacagctccccatctccgtgtttgtgggttggtacgacattgggaacagtgctggtgatcgcattgaacctaccacccggtggggagcagcgcctcctccaacctgttattgtatccccctctgggactatccttcggctcaaaggtgccatcctaaggatggcgttcctcgacaccacaggatgccttattccacctgcttacgaaccgtggagagaacacaatgttccagaagagaaagatgagaaagagaagctgaagaagagacgtccggtcagcgtgagcccgtcatcttcacaagagatttccgagaaccagtacgctgtgatctgctctgagaagcaggcgaaggtgatatctcttccgacccagaactgcgcttacaagcaaaatattacagaaacctcatttgttctacgcggagatatcgtggccctcagcaatagcatctgtctcgcgtgcttctgcgccaacggacacatcatgacttttagtctgcctagcctcagacccttgctcgacgtgtattatctccccctcaccaatatgcgcatcgcgcgtaccttttgtttcactaacaacgggcaggcgctttatctggtcagtcctactgaaattcagagacttacctactcacaggaaacatgcgagaacttgcaggagatgctgggcgaattattcactcctgtggagacacccgaagcacccaatcgcggtttcttcaagggattgtttgggggaggtgctcagtcccttgatcgcgaagagttgttcggtgaatccagctccggtaaggccagtaggagcttggcccaacatatccctggcccagggggaatagagggtgtgaagggtgcagccagtggggtagtgggcgaacttgccagggcgagactggcattagatgaaaggggacagaaactgggagaccttgaagaaagaacggcggctatgctatcttcggcagagagcttcagcaaacacgctcacgagattatgttgaaatacaaggacaagaaatggtaccaattctag

SEQ ID NO: 243261 - DNA, 3456 bp, Artificial Sequence
  Description of Artificial Sequence: Synthetic coding sequence
atgaggaagtttaacatccgcaaggttttagacggtttgacagctggttctagcagcgccagccagcagcagcagcagcaacaccctcccggaaacagagagccagagatacaggagacactccagtcagagcatttccagctgtgtaagacagtgcggcatgggtttccttaccaaccttccgcactcgcctttgaccctgtacagaagattttggccgtgggcacacagacaggtgctctgagacttttcggacgccctggcgtggagtgctactgccaacacgatagtggcgcagccgtgattcaactgcagtttcttatcaacgagggggcactggtgagcgcactggccgacgacacactgcatctgtggaacctgcgacaaaagcggccagctattctccattcgctgaaattctgtcgggaacgcgttaccttttgtcacttgcccttccaaagcaagtggctgtatgttgggaccgaaaggggcaatatacatattgtcaacgtggaatccttcacattgtcgggctatgtcattatgtggaacaaggctatagagctcagctctaagagtcatccaggcccagtggttcatatctcagataaccccatggatgaaggcaagctgctgattggcttcgaatcaggaaccgtcgttctctgggacctgaaatcaaagaaagccgattaccggtacacttatgatgaagcgattcactcggtcgcatggcatcatgaaggcaagcagtttatttgctcccactcggatgggaccctgaccatctggaacgtacggtctccggctaagccagtgcagacgatcactccccacgggaaacaactgaaggacgggaagaaacctgaaccttgtaaaccaatcctaaaagtcgagttcaaaaccacaagatccggcgagccatttatcattttgagcggtggtctcagctacgacactgtggggaggagaccctgtctcacggtgatgcacgggaaaagcacagccgtactcgagatggactactctatcgtcgatttcctcactctctgcgagactccgtaccctaatgacttccaggaaccctacgcggttgtcgtgctcctggagaaggatctcgtgctgatcgatctcgcccagaatggatatccaatctttgaaaatccttatcctttgagcatccatgagagtccagtgacatgctgcgagtacttcgcagactgcccggtggatctcattcccgctctttacagtgtgggcgcacgccagaagcggcaggggtattctaaaaaagagtggccaattaacggaggaaactggggcttaggcgctcagtcataccccgagattatcattacgggacatgctgacgggagcgttaagttttgggacgcttccgccatcactttacaagtcctctataaactcaaaactagcaaggtgttcgaaaagtccaggaacaaagacgatagaccaaacaccgatatcgttgacgaggatccctacgctatccaaatcatttcttggtgcccggaaagccggatgctgtgtatcgccggagtgagtgcccacgtgatcatctaccgattctccaaacaagaggtgatcaccgaagtcatccccatgctcgaggtgcggctgctctacgagattaacgacgtggagacccctgagggcgagcaaccacccccactgcctacccctgttggcggatccaacccacagcccataccacctcagtctcacccctccaccagcagttcatcaagcgacggactgagagacaacgttccctgcctcaaggtgaagaacagtcctctgaaacagtctcccggttaccagacagagctggtgattcagctcgtttgggtaggtggggaaccacctcagcagataacttccctggccgtcaattctagttatgggctggtcgtcttcggcaattgcaatggcatagccatggtagactatctccagaaggctgtgctgctgaatttgggcacaatcgaactctacggatccaatgatccgtaccgcagggagccgaggtctccgcgtaaatctcgacagccttctggcgcagggctctgtgatatttcagaaggaactgtggtccctgaagatcgctgtaaatcccctacgtcaggatctagttccccccacaacagcgatgacgagcagaaaatgaacaactttatcgagaaggtaaaaacaaagagccgcaaattctctaagatggtcgctaacgatatagcaaaaatgtcacgtaagttgtccttgcctactgacctcaagcctgaccttgatgtgaaggataacagtttctctagatctcgctcctcctcagtaacctcaatagacaaggagtctcgggaggccattagcgcactgcacttttgcgagactttcaccaggaaaactgacagttccccctccccatgtctgtgggtggggacaaccctgggcaccgttcttgttatcgccttgaacttgccccctggcggtgagcagcgcttgctgcagccggtgatcgtgtcaccaagtggtacaatcctgagactcaaaggggcaatattgcgtatggctttcctcgatactacagggtgcctgatccctcctgcctatgaaccgtggagagagcacaatgtaccagaagagaaagatgaaaaggagaaactgaaaaaaagacgccctgtttctgtgtccccaagcagctcgcaggaaatttctgagaaccaatatgctgtcatttgtagcgagaagcaagcgaaggtaatctccctgcccacccagaattgtgcctataaacagaacatcaccgaaacatcttttgttctgcggggagacatagtggccttatccaactccatctgcctggcctgcttctgtgccaatggccacattatgactttctcgctgccctcactaagaccgcttcttgatgtctactatctgcccctaacaaacatgagaatagctagaaccttttgcttcaccaataacgggcaggccttatacctggtctcccctacagagatccagaggctcacctattctcaggagacatgtgaaaatctacaagagatgctgggggagctgttcacacctgtagaaacccccgaggctcccaacagggggtttttcaagggtctcttcgggggaggcgctcaaagcttagatcgcgaggagctgtttggcgaatccagctccggaaaagcgtcacggtctcttgctcaacatatcccaggccctggcggaatcgaaggcgttaagggcgctgctagtggagtggtgggcgagctagcaagggcccgtctggcgttagacgagaggggccagaagctgggagacctggaggagcgcaccgcagctatgctctcttccgctgagtcgttttcaaagcacgcacacgaaatcatgctgaagtacaaagataagaagtggtatcagttttag

SEQ ID NO: 243262 - DNA, 525 bp, Artificial Sequence
  Description of Artificial Sequence: Synthetic coding sequence
taaaaggccgtgttgttgaatctgggtaccattgagctgtacgggtccaatgatccgtataggagagaaccgaggtctcccaggaagtctagacagcctagtggggctgggttatgcgacattagtgaggggaccgtggtgccagaggatcgatgcaaatccccaacatccgggtcttcttcaccccataattctgatgacgagcagaaaatgaataacttcatagagaaagccaagatgtcccgcaagctaagtcttcctaccgatttgaagcctgacctggatgttaaggataacagcttttctcgctctcgatcgagttccgttacatctatcgacaaagagtctcgggaagcaatctctgccctgcatttctgcgagacatttacccgcaagacagacagcagcccaagcccatgcctgtgggtcggaaccactctggggacagttttagttattgccttaaatttgcctcctgggggtgagcagcgtctcttgcagcccgttatcgtgagtccatcgtag

SEQ ID NO: 243263 - DNA, 840 bp, Artificial Sequence
  Description of Artificial Sequence: Synthetic coding sequence
atggtggattaccttcagaaggccgtcctgctgaatcttggtaccatcgaactatacgggtcaaacgacccataccggcgtgagcctaggtccccccgaaagtcacgccagccatctggaggggtgctaatcgtgacctcttgtatgtgcgggctctccagcctgtatagcgagtcaatgaagaaactgagaagtagctttctcacgggcctctgtgacatctccgaaggcacagtggtaccagaggatcgatgtaaatcccctacttcagccaaaatgtctcgaaagctgtcgctccctactgatttgaagccggatctcgacgtaaaggacaatagtttcagccgtagcaggtctagctctgtgacgtccattgacaaggagtcacgggaggcaatcagtgctctgcatttttgcgaaacctttactagaaagactgactccagcccctccccatgcctatgggtgggaacgacactcggaacggttttggtgattgctctgaacctccctcctgggggagaacaacgactccttcaacccgtcatcgtcagtccaagcggtacaatcctgagactcaagggggctatccttcggatggctttcctggataccactggctgtctaattccccctgcatacgaaccttggcgagaacacaatgtgcctgaggaaaaagacgagaaggagaagttgaagaagagaagacctgtttctgtatctcccagttcctctcaagagatttctgaaaaccaatacgccgtgatttgctcagagaagcaggcgaaggtgatttccttgccgactcagaattgcgcgtacaagcagaacatcacatag

SEQ ID NO: 243264 - DNA, 3297 bp, Artificial Sequence
  Description of Artificial Sequence: Synthetic coding sequence
atgcggaaattcaatatccgaaaggtacttgatggactgaccgccggatcaagcagcgcctcccagcagcagcagcagcagcaccccccaggcaacagggaaccagagatacaagaaaccctgcagagcgaacatttccagctgtgtaagactgtcaggcacggctttccttatcagccgagcgccctggctttcgatcctgttcaaaagatattggcagtcggcacgcagacaggggcactgcgcctatttggacgacctggcgtcgaatgttactgtcagcacgattctggggctgcggtgattcaactgcaattcctaattaacgaaggagcactggtctctgctctggccgacgacactcttcatctgtggaacttgcgccagaaacggcctgcaatcctgcactctctcaagttctgtcgggaaagggttactttttgccacctcccatttcagagcaagtggctgtatgtggggactgaaagggggaatattcatatcgtgaacgtcgaatcctttacacttagcggctacgtaatcatgtggaacaaagctatagagctatcctcaaaaagtcatccaggcccagtggtccacattagtgacaaccctatggacgaggggaaacttctgattgggtttgaatctgggacagtggtgttgtgggatttgaaaagcaagaaggctgactaccgttatacttatgacgaagctatccacagtgtcgcttggcaccacgaagggaagcagttcatctgttcccacagcgacggcactctgaccatctggaacgtgcgcagcccggcaaagccagttcaaaccatcaccccacacgggaaacagctaaaggatggcaaaaaacctgaaccatgtaagcctatcctcaaagtcgagttcaaaacaacacggtcaggcgaacctttcatcatcttgagtggagggctttcctacgacacggtgggtcgcagaccatgtctaacagtcatgcacggtaagagcaccgccgtgctcgagatggattacagcattgtcgatttccttacactctgcgagaccccttaccccaatgacttccaagaaccttatgccgtcgttgtactcctagagaaggacctcgtgctgatcgatctggcgcagaatggatacccaatattcgagaacccctacccactctccatccatgagagcccggtcacatgttgcgagtactttgcagactgtccggtggatttgatcccagccctgtattctgtgggggcaaggcagaaacgtcagggatactcgaagaaagaatggccaattaatggagggaactggggactcggcgctcagtcatacccggaaattatcattaccggacacgcggatggcagcgtgaagttctgggatgccagcgcgattaccctacaagtgctttataagctgaaaaccagtaaagtcttcgagaaatcgagaaacaaagacgatcgacctaatacagatattgtggatgaggatccctacgcaatccagattatctcctggtgtcctgagtctcgcatgctctgcattgctggggttagcgcgcacgtgatcatttacagattcagtaaacaggaagttatcaccgaagtgatcccgatgctggaggtgcggttgctctatgagattaacgacgtcgagacccctgaaggggaacagccccctccgcttcccactccagttggcggaagcaacccgcagccaatccctccccagtctcatccgtccacatcttcaagcagctcagacggcctgagggacaacgtgccgtgcctaaaggtgaagaacagccccctgaaacagtctccagggtatcagacagaactcgtgatccaacttgtatgggttgggggagaaccccctcagcagatcactagtctggctgtaaactcctcgtatggtttggtggtttttgggaactgcaatgggattgccatggtagattatctccagaaagcagttcttctaaacctgggcaccatcgagctgtatggctccaacgatccctaccgcagggagcctaggtcaccacgcaaatcaaggcagccctccggcgcagggctgtgcgacatttccgagggaaccgtagtaccagaggatagatgtaaaagccccacctctgatgtgaaggataatagtttttctagatcgcgctctagctccgtcactagcattgacaaggaatcacgtgaggcaatctcagcgttgcacttctgcgagacctttacacggaagactgatagctctcctagtccatgcctgtgggtaggaacaactttggggacggtgctcgtgattgcacttaacctcccacccggaggggagcagagactcctgcaacctgtgattgtgagcccttctggaacaattctgcgcttgaaaggtgctatcctcagaatggcatttctcgacactactggctgcctcatcccccctgcgtatgagccctggagagagcacaacgtgccggaggagaaagatgaaaaagaaaaactgaaaaagcgccgacccgtgagtgtaagccccagctctagccaggaaataagtgagaaccagtatgcagtgatctgttcagaaaaacaagccaaagtgatcagtctgcccacccagaattgtgcttataagcagaacattactgagactagttttgtgctgcgcggtgatatcgttgcattgtccaacagtatatgtctggcttgtttctgcgctaacggtcacattatgacattctcgttgccctccttgcggcctcttctggacgtgtattatctaccactgacaaacatgcgtatcgcccgtaccttctgttttacaaacaacggacaagccctgtacctggtctcccccacagagatccagaggttgacatatagccaggagacctgtgagaatctgcaggaaatgctcggcgagctgtttacccctgtggagacacccgaggctcccaaccgtgggtttttcaaagggctgttcgggggtggagcacagtcattggatagggaggaactgtttggggagtcgtctagtggcaaggcctcccgatctcttgcacagcacattcccggaccaggtggaatagaaggggtaaaaggtgcggcttctggcgtcgtgggagagttggccagagccaggctcgccctagatgaacgtggacagaaactgggcgatttggaggaaagaacagccgctatgctatccagtgccgagagtttcagtaagcacgcccatgagatcatgctcaagtacaaggacaaaaagtggtaccaattctag

SEQ ID NO: 243265 - DNA, 3348 bp, Artificial Sequence
  Description of Artificial Sequence: Synthetic coding sequence
atgagaaaattcaacattaggaaagttcttgatggcctgacggccggttcttcttctgcctcccaacagcagcagcagcagcatccccctggcaatcgggagcctgagatccaagagacactgcagtctgaacacttccagctctgcaagacagtgcgtcacggcttcccttaccagccgagtgctttagccttcgacccagtgcagaagattttggccgtaggaacacaaaccggagccctcaggctgttcggtcgtccaggcgttgagtgctactgtcaacacgactctggggctgccgtaatacagctgcagtttctaataaatgaaggggctctggtctctgccttagccgatgacacccttcatttgtggaacctgcgtcaaaaaagacctgcgatactgcattcgctcaaattctgtagagagcgtgtcaccttttgccacttgccttttcagagcaagtggctttatgttgggactgaacgtggcaacatccacatcgtcaacgtcgagagcttcacgctgagcgggtatgtaattatgtggaacaaggccattgagctgtccagcaagtcccaccccggtcctgttgtgcatatctctgataatcctatggacgaaggcaaacttctcattggtttcgaaagcggcactgtggtgctgtgggacctgaagtctaaaaaagcggactaccgctatacttacgacgaggctattcacagcgttgcttggcatcacgagggcaaacagttcatctgcagtcatagcgacgggacgttgaccatttggaacgtgcggtctccagccaagcccgtgcagaccattaccccccacggcaaacaactcaaagacggcaaaaaaccagaaccttgtaaacctatactgaaggtggagtttaagaccactaggtcgggagaaccgtttatcattctgtcaggcggattgtcttatgataccgtggggaggcgtccttgcttgacggtgatgcatggcaagtcgacagctgttctcgagatggattattccattgttgactttctcacactgtgcgagaccccttacccaaatgattttcaagaaccatacgccgtggtcgtgctcctggagaaagatctggtgctgatcgaccttgcgcagaacggttacccaatctttgaaaacccttaccctctcagcatacacgaaagcccggtgacctgctgtgagtactttgccgattgccctgtggatctgattccagcactgtactctgtcggagctcgacagaagagacagggatattcaaaaaaggagtggccaatcaatggaggtaattgggggctgggtgctcagtcatatcccgaaataattatcaccggtcatgccgatggatcagtaaaattctgggacgcttctgcaataaccctccaggtgctgtacaaactgaagacttctaaggtgtttgagaaaagtagaaacaaggacgataggcccaataccgacatcgtggatgaggatccatacgccattcagattatctcatggtgtcctgagtcacggatgctgtgcattgccggagtttcagctcacgtcatcatttaccgattctcaaagcaggaggtgattaccgaagtgatacccatgctagaagtgaggctcctgtatgaaatcaatgatgtcgagacacctgagggcgagcagcctcctccactccctacgccagtggggggttcaaaccctcagccaattccacctcaaagtcacccgagtaccagctcatcctcatccgacggtctgagagataacgtgccttgcctgaaggtcaaaaatagccctctcaagcaaagccctggatatcagacagagttggtgatccagctggtgtgggtaggaggggagccacctcagcaaattacctccctcgctgtgaactcttcatacggattggtggtttttggcaactgtaacggcattgccatggttgattacctgcaaaaggctgtgctccttaatctgggcaccatcgagttgtacggtagcaacgatccctacaggagagagcctaggtccccccgtaaatccagacagccctccggcgcaggcctctgtgacatttcagaaggaaccgttgtgccagaagaccggtgcaaaagccctacaagcgccaagatgtcccgcaagctctccttgcccacggatctgaaaccggatttagatgtgaaagacaactcattctcaagatctcggtcatcttccgtaacaagtatcgacaaggaatcccgggaagctatttccgcactgcatttctgtgagacgtttacccgaaaaaccgactcttcaccatcaccatgcctgtgggtgggcaccacattgggtacagtcctggtgatcgctctgaaccttccccctggcggagaacagagattgttgcaaccggtgatagttagtccatctggcactatactgcgtctgaagggtgccatattgcggatggctttcctggacaccacgggctgtctgatccccccagcgtacgaaccatggagggagcacaacgtccccgaagagaaagatgaaaaggagaagctgaagaagcgtcggccagtctctgtgagtccctcctcttcacaggagatctctgagaatcagtacgctgtgatatgctccgagaaacaggccaaagtgatctccctcccaacgcagaattgcgcatacaaacagaatatcacagaaaccagcttcgtgctgcgtggggatatcgttgcattatccaattccatctgtcttgcctgtttctgtgcgaacggccatatcatgacttttagcttaccatctctccggccactcctcgatgtgtattacttgcccctgacaaacatgaggatcgctcggaccttttgctttacaaacaacggacaggctctgtacctagtgagtcctactgagatacagcgcttgacctattcgcaggaaacctgcgagaacttacaagagatgctgggggagctctttacacctgtcgagacccccgaagccccaaatcggggtttttttaaggggctctttgggggtggggctcaaagcctggatagggaagaattgttcggagagtccagctcaggcaaggcaagtcggtccctcgcacaacatataccgggacctggcggaattgaaggtgtcaaaggtgccgcaagtggggtggttggtgagctcgctcgggcaaggctggccttagacgaacgcggacagaagctgggtgatctcgaagagagaactgctgctatgctgtccagtgctgaatccttctcaaaacacgcacatgaaatcatgctaaaatacaaggacaaaaagtggtaccaattctag

SEQ ID NO: 243266 - DNA, 795 bp, Artificial Sequence
  Description of Artificial Sequence: Synthetic coding sequence
attgagctgtacgggagcaacgatccatacagaagagagccccgttccccgaggaagagccgtcaaccatctggtggcgttctaatcgtcacttcttgtatgtgcgggctgtcgtcactgtatagcgagagtatgaagaagctcaggtcctcgttcttgactggtctctgcgacatcagtgagggcaccgtggttcccgaggatcgttgtaagagtccaacctccgctaaaatgtccaggaaactgtcccttcctacagatcttaagccagatttagacgtgaaggataattcattctccaggtcccgctcttcgagcgtcacaagcatagacaaggagagtagagaggcaatttctgctttgcacttttgcgaaacttttacccgcaagacggattcctctccatcaccgtgcctatgggttggaactacccttggcaccgtgcttgtgatcgcactcaacctccctccgggtggggagcagcggctcctgcaaccagtcatcgtctctccatccggaacgattctgagacttaagggtgccattcttcggatggcattcctggatacgacgggctgcttaattccccctgcctatgagccttggcgcgagcataatgtgcccgaggaaaaagacgagaaagaaaagctcaaaaaacgccgacccgtcagtgtctctccctctagtagtcaagagatttcggagaaccagtacgccgtgatatgtagcgagaaacaggccaaggtgatttcacttcccacgcagaattgcgcctacaagcagaatattacttag

SEQ ID NO: 243267 - DNA, 927 bp, Artificial Sequence
  Description of Artificial Sequence: Synthetic coding sequence
atgcggaagtttaatatcagaaaggttctcgacggcctcacagccggtagctccagtgctagccagcaacaacaacagcagcacccaccaggaaatcgagaaccagagattcaggagacactgcagtccgaacacttccagctatgcaagactgtcagacacgggttcccttatcagccctccgcccttgctttcgatccggtgcagaaaatcttagccgtgggcacacagacaggcgctctgaggttgtttggtcgccctggggtagaatgctactgccaacacgactctggagcggctgttattcaactgcagttcctgatcaacgaaggagccctagtgtcagcattggctgatgacactttgcatctgtggaatctccggcaaaagagacctgccattctgcactcactcaagttctgcagagaacgtgtgacattctgccatttgccctttcagagtaagtggttgtatgtgggtaccgaaaggggcaatattcatattgtgaatgtcgagtcctttaccctcagtggctacgttatcatgtggaacaaggcaatcgaactctccagtaaaagccatcctggtcccgtggtacatatctccgacaatcccatggatgagggcaaattattgatcggattcgagagcggaacagtcgtgctctgggacttgaaaagtaagaaagccgactacagatatacgtacgacgaagccatacacagtgtcgcttggcatcatgagggcaaacagttcatatgctctcactctgacggaacactgacaatttggaatgtccgttcacccgctaaacccgtgcagacgattacacctcacgggaagcagctcaaggatgggaagaaaccagaaccatgtaagccgattctgaaggtcgaattcaaaacgaccaggagtggcgtctgctag

SEQ ID NO: 243268 - DNA, 3561 bp, Artificial Sequence
  Description of Artificial Sequence: Synthetic coding sequence
atgaaaaaatttaatttccgaaaagtgcttgacggcctcacagcaagttctcctgggagcggttcttcctcaggcagtaatagcgggggaggcgcaggctccggctccgttcaccctgctggcaccgccggagtcctccgggaagagatacaggagacactcacgtccgagtatttccagatctgtaaaaccgtgcgtcacggattccctcaccaacctaccgctctcgctttcgatccggttcagaaaattcttgccattggcactcgcactggagctatacggattttaggcaggcctggcgtggattgctattgtcagcatgagtccggagcagcggttctgcagttgcagtttctgattaacgagggggcattagtcagcgcctcatccgacgacaccctccatctctggaatctgcggcagaagcgtcccgctatcctacattccctaaagttcaaccgagagagaattacttactgtcatcttccattccagtcaaagtggctgtacgttgggactgaacggggtaacactcacattgtcaacatcgaaagctttattctgtctggttacgtcattatgtggaacaaagccatcgagctcagcactaagactcacccaggccctgtggttcacctgtccgattctccgagggatgaaggcaaactgctgatcggctacgagaacgggacggtcgtgttttgggatctgaaatctaaaagggccgagttgcgggtgtattatgacgaggctattcattcaatagactggcaccatgagggtaaacagttcatgtgtagtcacagcgatggttcactcacactctggaacctcaaatcaccctctaggccgtttcagacaaccatacctcacggtaagtctcagcgggaggggagaaaatctgagtcttgtaaacctatcttaaaggtggagtacaagacttgcaaaaattctgagcctttcatcatcttctctggcggactctcctatgacaaagcttgtagacgcccatccctcaccatcatgcatggcaaggcaatcacagttttagagatggatcaccccatcgtggaattccttaccctgtgtgaaaccccatatcctaacgagtttcaggagccctacgccgtcgtagtcttgcttgagaaagatctgatcgtggtagacctcacgcagagcaatttccccattttcgaaaatccgtatccgatggatatccacgagtcccctgtgacctgtacggcatattttgccgattgcccaccggatcttattctagtcttgtactccatcggggtcaagcataagaagcaggggtacagcaataaggaatggccaatcagtggaggtgcctggaatctgggggctcagacttaccccgaaattattattactggccatgccgatggctccataaagttttgggacgccagcgccataactctgcagatgctgtataagctaaagacctccaaagtcttcgagaagcagaaggtgggggagggcaagcagacctgtgagatagtggaagaagacccattcgccatccagatgatctactggtgtccagagtctaggattttctgcgtaagcggagtttctgcttacgttatcatctacaaattttctcggcacgaaatcactacagagattgtgtcactggaagtgaggcttcagtacgatgtcgaggacatcattaccccggagccagaaacatcccctccattccccgatctctcagctcagttaccttcctctcgtagtttgagcggaagcacaaataccgttgcctcagaaggcgtgacaaaagactctatcccatgcttaaatgtgaagacaagacctgtgcgcatgccccctggctaccaggcagagctcgtgatccaactcgtgtgggtagatggagagccccctcagcagattacctctcttgccgttagttctgcctatggcatcgtcgcctttggtaactgcaatggcctggctgtcgtagattttattcagaaaaccgttctgctcagtatgggtaccattgatctgtataggtcgagcgacctctatcaacggcagccaagatctccacggaaaaacaagcagttcattgctgacaacttctgtatgagaggcctcagtaatttctaccctgaccttaccaagcgcatacggacctcctatcagtccctgactgaactgaatgacagtcccgttcccctggaacttgaaaggtgtaagtccccgaccagcgatcatgtgaacgggcactgtacatcccctaccagccaaagctgctcatcaggaaagcgtctgagcagtgccgacgtgagcaaagtaaatcgctggggcccagggaggccaccattccgtaaggcacaaagcgctgcctgcatggagatctctctccccgtgaccacagaggagaatcgcgagaattcctacaatcggtctcggtcgtcatctatctcttctattgacaaggacagcaaggaggccatcaccgccttgtactttatggatagttttgctcggaagaatgactctaccatttcaccatgtctcttcgtgggcacatctctgggaatggttttgattataagccttaatctcccactcgctgatgagcaacgctttaccgaaccagtcatggtgctaccctctggtacttttctcagtctcaagggggctgtcctaaccttctcctgcatggaccgtatgggcggtcttatgcaacctccttatgaggtatggagagaccccaacaatatcgatgagaacgagaagagttggcggaggaaagtggtaatgaacagctctagtgcctctcaggagatcggcgaccaccagtacaccatcatctgtagcgagaaacaggcaaaagtgttctccctaccttcccagacctgcctgtatgttcacaacataacagagacaagctttatcttgcaagccaacgtcgtcgtcatgtgctccagtgcgtgcttagcctgcttctgcgcaaacggacacattatgatcatgtctctcccttccctccgacctatgttggatgtgaattacctccctctgacagacatgcgcattgctcgaaccttctgtttcaccaatgaggggcaggctctttacctggtaagcccgaccgaaattcagcgactgacgtactcccaggagatgtgtgacaatttacaggatatgttaggagacctcttcacgcccatcgagacacccgaggcccagaataggggattccttaaaggcctcttcggcggaagcggccagacctttgatcgtgaagaactgtttggagaggccagcgccggtaaggccagcagatctctggctcaacatattcccggtccaggttcaatcgaagggatgaagggcgctgccggaggtgtcatgggagagttgacccgagcgcgaatcgcccttgacgaacgcggacagcgtctgggggaacttgaggagaagactgcgggtatgatgacttctgcggaggccttttctaaacatgcccacgagttaatgctgaaatataaagacaaaaagtggtaccaattctag

SEQ ID NO: 243269 - DNA, 384 bp, Artificial Sequence
  Description of Artificial Sequence: Synthetic coding sequence
atgaaaaaatttaacttccgcaaggttctggacgggctgaccgcgtcgtctcctgggtcaggaagctcctctggctctaattcaggaggaggggctggcagtggatctgtgcacccagctgggaccgcaggggtgctgagggaggaaattcaggagacccttacatcagaatacttccaaatttgcaaaacagtgaggcacggatttccacaccaacctaccgcactggcgttcgatcccgtccagaaaatactagccatcggaactcggacgggagcaataagaattcttggcagacctggcgttgattgttactgtcagcacgagtcaggggcagctgtactccagcttcagttcttaatcaatgagggcgctttggtgtag

SEQ ID NO: 243270 - DNA, 633 bp, Artificial Sequence
  Description of Artificial Sequence: Synthetic coding sequence
atgtcagctaagagcgcgatcagcaaagagatattcgccccactagatgagcggatgctgggcgcagtacaggtcaagcgtcgtaccaagaaaaaaattccgtttctggctactggcggacaaggtgagtaccttacctatatttgtctctccgtgaccaataaaaagccaacacaggcctccatcacaaaagtgaagcagtttgagggttctacctcttttgtcagacgatcccagtggatgctcgagcagctgcggcaggtgaatggcatagatcccaacggcgatagtgccgagtttgatcttctgttcgagaatgcctttgaccagtgggtggcaagtaccgcttcagagaagtgcacattttttcaaatcctccatcacacttgtcagcgatacctgactgacagaaaacctgagttcataaattgtcaaagcaagatcatgggcggtaacagcattctacattcagctgccgacagtgtgaccagtgcagtccagaaggcatcacaggctttgaatgaacgtggagagcgcttgggtcgcgcagaggaaaagacagaggacttaaagaactccgctcagcagtttgccgagacagcccacaagctggccatgaagcacaagtgttag

SEQ ID NO: 243271 - DNA, 633 bp, Artificial Sequence
  Description of Artificial Sequence: Synthetic coding sequence
atgtccgccaagagtgcaataagtaaggaaattttcgcccctctggacgagcgcatgcttggcgctgtgcaggtgaagcgacgcacaaaaaagaaaattccctttctcgccaccggaggtcaaggcgaatacttgacctatatctgcctgtccgtgaccaacaagaagcccacccaggcctctataacaaaagtgaagcaattcgagggaagtacaagctttgtgcggagatcacaatggatgctggaacagctgcggcaggtaaatggcatagacccgaacggggatagcgccgagtttgacctcctgttcgagaacgcattcgaccagtgggtcgcgagtacagcttctgagaagtgcacttttttccagatcctccatcacacatgtcagcggtacctgaccgataggaaaccagagtttatcaattgtcaaagcaagattatgggcggaaatagtatattacattctgccgcagatagcgtgaccagcgctgtgcagaaagcctcccaggctctcaacgaaagaggcgagcgcctgggcagagctgaggaaaaaactgaggacctcaagaacagtgcgcagcaattcgccgagacagcacataaggtgacgttccgagggaggaagtag

SEQ ID NO: 243272 - DNA, 633 bp, Artificial Sequence
  Description of Artificial Sequence: Synthetic coding sequence
atgagcgccaagagtgctattagtaaagagatattcgccccacttgacgaacgaatgctgggggcagtacaagtgaaacgtcggacgaagaaaaagatccccttcttagccacaggcggtcaaggcgagtatctgacttatatttgcctcagcgtgactaacaaaaaacccacacaggcttcaataaccaaagtgaagcagtttgagggctcaacctccttcgtgagacgctctcaatggatgctggagcaactgcgacaggtgaacggtatcgatccaaacggagactccgccgagtttgatctgctctttgaaaacgcctttgaccagtgggtcgcgagcaccgccagcgagaaatgcacgttctttcagatattgcaccatacgtgccagagatacctcacagatcggaagcccgagttcattaactgccagagcaaaataatgggcggaaattccattctgcattccgctgctgattcagtcacttccgcggtgcagaaagcttcacaggccctcaacgaaaggggcgagcgccttggacgagcagaagaaaagaccgaggacctgaagaactctgctcaacagttcgctgagactgctcacaagctcgcaatgaagcacaagtgctag

SEQ ID NO: 243273 - DNA, 633 bp, Artificial Sequence
  Description of Artificial Sequence: Synthetic coding sequence
atgagtgccaagagcgcgatttcaaaggagatattcgcgccactggatgaacgcatgctgggcgcagtgcaggttaagcggaggactaaaaagaagattccattcttggcaaccggcggacagggggaatatctcacatacatctgcctgtccgtcaccaacaaaaaaccaacacaagctagtattaccaaggtcaagcaattcgaaggcagcactagttttgtcagacggtcccaatggatgttagagcagctccggcaagtcaacggaattgatccgaacggggatagtgcagagttcgaccttctgttcgaaaacgcttttgatcaatgggtggctagcactgcgtccgaaaagtgtacgtttttccagattctgcatcatacttgccagcggtacctcactgatcggaagcccgagtttattaactgccaaagtaagatcatgggcggaaattcaattctacactcagccgctgactctgtgacttccgccgtccaaaaggcatcacaagccctaaacgagcgcggagagcgtctgggacgggcagaggagaaaaccgaggatcttaagaactctgcacagcagtttgcggagacagcccataagcttgcaatgaagcataaatgctag

SEQ ID NO: 243274 - DNA, 633 bp, Artificial Sequence
  Description of Artificial Sequence: Synthetic coding sequence
atgtctgcaaaatccgccatctcaaaggagatcttcgcccctctcgacgagcggatgctaggggcagtacaagtgaaacggagaaccaagaagaagattccattccttgcaacgggaggacagggagaatacttgacatatatttgcctctcagtgaccaataagaaacctacacaggcgtcaattaccaaggtgaaacagttcgaggggtcaacaagctttgtccggcgttcacaatggatgctagagcagctaagacaggtcaacggaatagaccctaatggagattcagctgaatttgacctgttatttgaaaatgcttttgaccagtgggttgcatcgaccgcgagtgagaaatgtaccttctttcagatattgcatcacacatgtcagcgctatttaacagatagaaagccggagttcatcaactgtcagtctaagatcatgggtggcaattccatccttcactccgcagctgattctgttacctccgccgttcagaaggcttcccaggctctgaatgagcggggtgagagactgggccgagctgaggaaaaaactgaggacctgaaaaattctgctcaacaatttgcagagacagctcataagctggctatgaaacataagtgttag

SEQ ID NO: 243275 - DNA, 327 bp, Artificial Sequence
  Description of Artificial Sequence: Synthetic coding sequence
atgtccgcttgctttctggacacgcgtcgtgcggcatttctccagtgcgaccttcccagtagctacaggatattaacattaccagaatctgggcattgcggaagcgccgagccagtcagcgacgctcccgctctcctgctctcaggtaactccattctgcacagtgccgctgactcagttactagcgccgtgcagaaggcctctcaggccctgaacgagagaggagagcggctggggagggctgaggagaaaacagaagacttgaagaactctgctcaacagtttgctgagacagcgcacaaattagctatgaaacataaatgctag

SEQ ID NO: 243276 - DNA, 633 bp, Artificial Sequence
  Description of Artificial Sequence: Synthetic coding sequence
atgtctgcaaagtccgccatctctaaggaaatttttgcaccactcgatgagagaatgctgggtgctgtacaggtaaaacggaggactaaaaaaaaaatcccgtttcttgctacagggggtcagggagagtaccttacctatatttgtctcagcgtcactaataagaagcctacccaagcaagcatcaccaaggtgaaacagtttgagggcagtacgtcctttgtgcggagatctcaatggatgctggagcagctccgacaggtgaacgggattgaccccaatggggatagtgcagagttcgacctgttatttgagaatgcctttgaccaatgggtcgcatcaacagccagcgagaaatgcacattcttccagatactgcaccacacttgccaaagatacctaacagacaggaaaccagaatttatcaattgccagagtaagataatgggcggaaactcaatcctgcacagtgccgctgatagtgtaacctccgctgtccagaaggcctcgcaagctctcaatgagcgaggggaacgcctgggcagggcggaggagaagactgaggacctgaaaaacagcgcccaacagtttgcagagaccgcgcataaactggcaatgaagcacaaatgttag

SEQ ID NO: 243277 - DNA, 633 bp, Artificial Sequence
  Description of Artificial Sequence: Synthetic coding sequence
atgagcgccaaatctgccatctctaaggagattttcgctccactagatgagagaatgctcggcgctgtgcaggtgaagcgacggaccaagaaaaagattccattcctcgccaccggaggacaaggtgagtatctaacctatatttgtctctccgtgactaacaagaagccaacacaggcttcaattactaaggtcaagcagtttgaggggtccacgtctttcgttagaaggagccaatggatgctggaacagctgcgccaagtgaacgggatcgacccgaatggtgactccgctgagtttgacctgttattcgagaatgcgttcgaccagtgggtggctagcactgcctccgagaaatgtacattcttccaaatcctccaccacacgtgccagcgctaccttactgatcggaagccggagttcatcaactgtcaaagcaagatcatgggcggaaactccatcctgcattcagctgcagacagcgtgaccagtgccgtgcagaaggcatcccaagccctgaacgagcggggagagagactcggcagagccgaggagaagacggaagacctgaagaattccgcccagcaattcgcagaaaccgctcataaactggcaatgaagcataaatgttag

SEQ ID NO: 243278 - DNA, 1617 bp, Artificial Sequence
  Description of Artificial Sequence: Synthetic coding sequence
atggctgttgcagccgcagccgctgccgctgggcctgccggtgccggaggcggtcgggcacagaggagtggtctgttggaggtcctggtcagggacagatggcacaaggtgctggtcaatctgtccgaggatgcattggtgctctcctccgaagagggtgctgcggcatacaatggaatcgggactgcaactaatggctccttctgccgtggagctggcgcaggccatcccggagcaggaggcgcacagcccccagacagccccgcaggcgtgaggaccgcattcaccgatctgcctgaacaggttccggagtctatctcaaatcagaaacgaggcgtgaaagtcctaaaacaggagttaggaggccttggtatcagcatcaaaggtggaaaagaaaacaagatgcccatattaattagtaagatatttaagggcctcgccgctgaccagacccaagctctttacgttggagatgctattctgtcggtgaatggcgcagacctgcgtgatgccactcacgatgaggctgtgcaggctttgaagcgcgcaggaaaggaggtcctcttggaggtcaaatacatgcgcgaagccactccctatgtgaaaaaaggcagccccgtttccgaaatcggctgggagacaccaccacctgaatctccccgactgggtggaagtacctcggacccaccctcctctcaaagcttttcctttcacagggacagaaaatcaattccacttaagatgtgttatgtgacccgttccatggctctggcagaccccgaaaatagacagcttgagatccattctcctgacgccaagcacaccgtcatcctcaggtctaaggactctgcgaccgcgcaggcctggttctccgccatacattccaacgtaaacgatctgctcacgagggtgattgcagaggttcgcgagcagctgggaaaaaccggcatcgcgggttctcgggagataagacacctcggttggctggccgaaaaagtgcctggggaaagcaaaaagcagtggaagcccgctctcgtcgtgctgaccgagaaggatctgcttatatacgactccatgcctaggaggaaggaggcttggttctctcctgtacacacgtacccacttctggctactcgcttggtgcattccgggcctggcaagggaagtccccaagctggcgtggatctaagtttcgctacccgaaccggtacccgacagggcattgagacgcatcttttcagagctgagaccagcagagacctatcgcactggactcgctctattgtgcaggggtgtcataacagcgctgaattgatcgccgaaatttcaaccgcctgcacttataaaaaccaggaatgcagattaactatccactacgaaaatggtttctctatcaccactgagccccaggagggcgctttccctaagacgatcatccaatccccatatgagaagcttaagatgagctccgatgatggtattcgcatgctgtatctcgatttcggcggaaaggatggagagattcaattggatctgcattcgtgccccaagcccatcgtttttataatccacagtttcctctccgctaagatcactcggctggggctcgtggcatag

SEQ ID NO: 243279 - DNA, 1617 bp, Artificial Sequence
  Description of Artificial Sequence: Synthetic coding sequence
atggctgtggctgccgcagcagctgccgcaggtccggcaggggctggcggtggcagagcccagcgttccgggctcctagaagtcttagttcgtgataggtggcacaaagtcctggtgaatctctccgaggatgcactcgtgctttcgtctgaggaaggagccgctgcttacaacgggattggcaccgcaacaaatggtagtttctgcagaggcgctggcgctgggcaccctggggcagggggtgctcaaccacccgacagccccgcaggggtccgaaccgccttcacggacctgcccgagcaggtgcctgaatcaatcagcaatcagaagcgaggcgtgaaagtcttgaagcaggagctgggcggtctggggatctccatcaaggggggaaaagagaataaaatgccaattctgatttcaaaaattttcaaggggcttgccgcagaccaaactcaagccctgtatgttggcgatgccattctgtcggtcaacggcgcagacctgagagacgcaacacacgatgaggcagtgcaggctctgaaacgagcaggcaaagaagtcctgctggaggtgaaatatatgagagaggcaactccctatgttaagaaagggagccccgtgtcagaaataggatgggagacccctccccctgaatcccctaggctcggaggttcaacatctgaccccccaagctcccaatcgttctctttccatcgcgatcgcaaatcaattccgctcaagatgtgctatgttaccaggtcaatggcattggccgatccggagaacaggcaactggagatccactcgcctgacgcaaagcatacggtgattctgaggtctaaggatagcgcgacagcacaagcatggttctctgcaatccacagtaacgtgaatgacctgttgaccagagtgattgctgaggtccgggagcagttggggaagacgggcatcgccggtagccgggaaatcaggcatctcggatggctggccgagaaagtccccggtgaatcgaagaaacagtggaaaccggctctagttgtcttgaccgagaaggacttgctaatttatgatagcatgcctaggcgtaaggaagcatggttctctcctgtgcatacataccctcttctcgccaccagattagtgcacagtggcccaggaaaaggatctcctcaggctggggtagatttaagtttcgcaacaaggactggcacaaggcaaggcatcgaaactcatctgtttcgtgccgaaacttccagagacttgagccattggaccagatctatcgtgcagggttgtcataacagcgccgaactcatcgctgaaatctccactgcatgcacgtataaaaaccaggaatgccgcctgaccatccactacgaaaatggcttctccatcaccacagaacctcaggagggggcatttcctaaaaccatcatacagtcaccttatgaaaaattaaagatgagcagcgacgatggaatcaggatgctgtacctggactttggtgggaaggatggagagatacagcttgacctccactcgtgtcctaagcccatagtgtttattattcactcctttctgagtgccaagattactcgactgggactggtggcgtag

SEQ ID NO: 243280 - DNA, 87 bp, Artificial Sequence
  Description of Artificial Sequence: Synthetic coding sequence
atggctgttgctgctgcagcggcagctgcgggaccggcaggagcgggaggcggacgcgctcagagaagcggactcctggaagtgtag

SEQ ID NO: 243281 - DNA, 1623 bp, Artificial Sequence
  Description of Artificial Sequence: Synthetic coding sequence
atgcgggtggccgctgccacagcggctgctggggcaggtccagccatggctgtgtggactcgggctactaaggccggattagtggagctcttattgcgtgaacgctgggttcgagtcgttgccgagttgagcggtgaatccctgagcttaaccggagatgccgctgcagcagagcttgagccagccctcggaccagccgcagcagctttcaacggccttccaaatggcggaggggctggtgatagcttgccgggttctccctctcgcggattgggcccaccatcgccaccggcacccccaagaggcccagctggcgaggcgggagccagtccgcctgtgcgacgcgtgcgggtcgtcaaacaagaagccggtggcctgggcatcagcattaaagggggaagagagaatcgcatgccaatactcatcagtaaaatttttcctgggttggcagcggaccagtctcgcgctctgagactaggtgacgcgattctcagcgtcaatggtacagacctacgccaggccactcacgatcaagcggtacaggcactgaagcgcgcaggcaaagaggttctcctggaggtcaaattcatcagggaggtcaccccttacattaagaagcccagcctggttagcgaccttccttgggaaggggctgccccacagtcgccatcctttagcggcagcgaagattctggatctcctaaacaccagaattcgaccaaggacaggaaaatcatccctctgaagatgtgcttcgcggctcggaatctgagtatgccggatctggaaaacaggctcattgagcttcactctccagattctcgtaatactctcatactgaggtgcaaggatactgccactgcccactcatggttcgtcgctatccataccaacatcatggccctcctgccacaggtattggctgagctgaatgccatgctgggggcaacttccacagccggtggatctaaagaggttaagcatattgcctggctcgccgaacaggcaaagctggatgggggaaggcagcaatggaggccagtcttaatggccgttacagaaaaagacctgttactctacgattgcatgccctggaccagggacgcatgggcgtcaccctgccatagttatccgctagtggcgacacgcctggtgcatagtggatccggctgtaggtccccgagccttgggagcgacctcaccttcgcaacacgcactggctcacgtcagggcatagagatgcacctctttagggtagagacacatcgagacctgagttcatggactaggatactcgtgcaggggtgtcacgctgccgctgaactaataaaagaggtatcattaggatgcatgttaaacggccaggaagtgcgccttaccatccactacgagaatggattcaccatttcaagagagaacgggggtagctcttctatcctgtacaggtacccttttgagcgcctcaaaatgtccgctgacgatgggattcgcaatctctatctagatttcggcggacccgagggtgaactaactatggatctccactcttgcccgaaacctatcgtgtttgttctgcacaccttcctaagtgctaaggtgacaagaatgggccttcttgtctag

SEQ ID NO: 243282 - DNA, 1443 bp, Artificial Sequence
  Description of Artificial Sequence: Synthetic coding sequence
atggactttcgcacagcatgcgaagagacgaagaccggtatctgtcttctgcaggatggcaatcaggaaccatttaaggtgaggctgcatctggccaaggacattttaatgattcaggagcaggatgtgatttgcgtttccggagaacctttctactcgggggagaggaccgtcacaatccgtagacagaccgtgggagggttcggattatccataaagggcggagccgagcataatatccctgtggtggtatcaaaaatcagtaaggaacagcgcgctgaattatctgggctcctgttcatcggggacgcaatcttgcagatcaatggcattaacgtccggaagtgccggcatgaggaggttgtacaggtccttcggaacgcaggagaggaagtgaccctgactgtgagcttccttaagcgcgcacccgctttcttaaaactgcccctcaatgaggactgcgcttgtgctccgtctgaccaaagctcaggaacatcatcccccctctgcgattccggactgcatctgaattaccatccaaataacaccgacactttaagctgctcaagctggcccacgagccctgggttgagatgggagaagcggtggtgtgatctgcgcctgattcctctcttacactcacggtttagtcagtacgtaccagggacagacttgtcgcgccagaatgcatttcaggttatcgcggtggatggagtttgtacagggattattcagtgtctgagtgctgaggactgcgtcgactggctacaggcaatcgctacaaatatcagcaatctgacaaaacataacatcaaaaagattaacaggaactttccagtgaaccaacagatcgtttacatgggatggtgtgaagctcgcgagcaagatcccctccaggatagagtgtattcacccaccttcctcgccctgagaggcagctgtctctacaaatttctcgcgccaccagtgaccacctgggactggacacgagctgaaaagacattcagcgtgtatgagattatgtgcaaaattcttaaggacagcgacctgcttgacagacgtaaacagtgcttcacagtacagtcagaaagtggcgaagacctgtatttttcggtggagcttgaatcagaccttgcccagtgggaacgggcttttcaaactgcaaccttcctggaagttgagaggatacagtgcaaaacgtacgcatgcgttttggaatcccatctcatggggctgaccattgacttttccactggtttcatctgcttcgatgctgcaaccaaggagctcgagttttctaacttattcgccgtcctgcactgcatccacagcttctttgcggcaaaggtagcttgtcttgatcctcttttcctgggcaaccaggcaactgcctctactgctgcatccagtgccacgacttctaaagccaagtatacaacgtag

SEQ ID NO: 243283 - DNA, 1443 bp, Artificial Sequence
  Description of Artificial Sequence: Synthetic coding sequence
atggacttccggacagcatgcgaggagaccaaaaccggtatctgcctgctccaggatggcaaccaagagccattcaaagtgcgccttcacctagccaaagatattctcatgatccaggaacaagatgtcatctgtgtgtcaggggaacccttctatagcggagagcgcacagtgaccataaggcgtcaaacagtcggtgggtttggactctccattaaagggggagccgaacataacatcccggtagtggtcagcaagatttcgaaagagcagcgggctgagctctcgggactgctcttcatcggcgacgccatcctgcagatcaatggcatcaatgtccggaagtgtaggcacgaggaggtggtgcaggtgctccggaacgcaggcgaagaagtcaccctgacggtttcctttctcaagcgggctcctgcctttctcaaactgcccttgaatgaggattgtgcttgtgctccctcagaccagagcagcggaacaagttctccgctctgtgatagtggactgcacttgaactatcaccccaataatacagacactttgtcctgttcatcttggcctacttccccaggcttaaggtgggaaaagcgatggtgcgatctccgcctgatacccctgcttcatagccgattctctcagtatgtccccggaaccgacctgtcgaggcagaatgcattccaggtcatcgccgtcgacggcgtctgcacgggaatcatacagtgtctcagtgctgaagattgtgtcgactggttacaggccatcgctaccaacattagcaacctcacaaagcataacattaagaaaatcaacaggaacttcccagtgaatcagcagatcgtatatatggggtggtgtgaagcacgggagcaggatcccctgcaggatcgcgtgtacagccctacgttcctagctctccggggatcgtgcctttacaagttcctcgcccctcctgtaacaacatgggattggacacgcgcagaaaagactttctctgtttacgaaattatgtgtaaaatcctcaaagacagcgatttgctggacagacggaagcagtgttttacagtccagtcagagagtggcgaggatctatatttttccgtggaactggaatcagatctcgcccagtgggaacgggcattccaaactgccacctttctggaggtcgagcgaattcaatgtaaaacatacgcatgcgtgctcgaaagccacttgatgggtcttaccatcgatttttctactggatttatctgttttgacgctgccaccaaggagctcgagttcagtaacctgtttgctgtgcttcactgcatccacagtttctttgcggctaaagtggcttgtctggatccattattcctgggcaatcaagccaccgcttctacagccgcttcttctgctacgacttcaaaagcaaaatacactacctag

SEQ ID NO: 243284 - DNA, 1554 bp, Artificial Sequence
  Description of Artificial Sequence: Synthetic coding sequence
atggattttagaacagcttgtgaggagacaaagactggcatatgtttgctgcaggacgggaaccaagagcctttcaaagttaggctccacttggccaaggatatcttgatgatacaggagcaggacgtgatttgtgtgtcaggtgagccgttttatagtggagagcgcacagtgacaattcgacggcagaccgttggtggctttgggttgtcaatcaaaggcggagcggagcataacatacctgtagtagtctctaaaatctccaaggagcaaagagctgaactttcgggcctactctttattggcgacgccattctgcagatcaatggcatcaacgtgaggaagtgccgacacgaagaagtcgtacaagtcctacgaaacgcaggagaggaagtgaccctgacggtctctttcttaaaacgcgctcctgctttcctcaagctaccactaaacgaagattgcgcatgtgctcccagcgaccagtcttctgggacatcatctcccttgtgcgatagtggtttgcacctgaattaccatccaaacaatacggacacactctcgtgctctagctggcccacatcacctggcctgcgatgggaaaaacggtggtgtgacttgcggctaatccccctgctacattcacgattcagccagtatgtccccggtactgacttgagtcgccagaacgcctttcaggtcatcgcggttgacggcgtgtgcacaggcatcattcagtgtctctcggcagaagactgcgtcgactggctgcaagctatcgccacaaacatcagtaatctgaccaaacacaatattaagaagattaatagaaactttccagtgaaccagcagatagtgtatatggggtggtgtgaggccagggaacaggaccccctccaagaccgggtgtactctccaacattcttggctctgcgcggttcctgcctctacaagtttctcgcgccacccgtgaccacctgggactggactagagccgagaaaacctttagtgtatacgaaattatgtgtaagatactgaaagactctgacctgttggataggaggaagcaatgtttcactgtacagtcggaaagcggggaagacctctatttctccgtcgaattggagtctgacctggcccagtgggagcgtgccttccagaccgcgaccttcctggaagttgagagaattcagtgtaagacctacgcttgtgtcctggaaagccacctgatgggcctcaccatcgatttttctacaggcttcatctgcttcgacgcagccacaaaagctgtgctttggcgatataagttctcccaacttaagggctcaagcgatgatgggaaatcaaaaatcaagttccttttccagaatcccgataccaagcaaattgaagccaaagaactagaattttccaacctcttcgcagtgttgcactgcattcacagctttttcgccgcaaaagtggcctgcctggacccactcttcctgggcaaccaggcaacggcgagcaccgcagcaagctcagccacgacatccaaggccaagtacacgacttag

SEQ ID NO: 243285 - DNA, 1554 bp, Artificial Sequence
  Description of Artificial Sequence: Synthetic coding sequence
atggactttcggaccgcctgcgaagagactaaaacaggaatctgtctcctgcaggacggaaatcaagaaccattcaaagtcagactgcacttggccaaggatatcttaatgatccaggagcaggacgtgatctgtgtgtcaggggagcccttctactccggtgaacgaacagtgactattagacggcaaaccgtgggtggcttcggcctgtcgattaaggggggagccgagcacaacatacccgtcgtggtgagcaagattagtaaggagcaacgggcagagctgagcggtttactttttataggagatgccatcctgcagatcaacggcataaacgtacggaaatgccgccacgaggaagtcgtccaggtcctgcgtaatgctggggaagaggttactttaacagtgagcttcctgaaaagagcgccagcctttctgaaactgccactgaatgaggactgcgcgtgtgcaccttccgatcagagttcgggcactagttccccgctctgtgattcaggcctgcacttgaattaccaccccaacaatactgatacactgagctgttcaagctggccaacatcgcccggtctgagatgggagaagagatggtgcgatctcaggctgatcccattgctgcactcgagattctctcaatatgtgccaggtaccgacttaagtagacagaatgccttccaggtgatcgccgtcgacggtgtttgtaccggcattattcagtgtctgtcagctgaagattgcgttgattggctgcaggccatagcaacaaatataagtaatctcaccaagcacaatatcaagaaaattaaccgcaatttccccgtgaaccaacagatcgtgtatatgggctggtgcgaggcaagggagcaagatccactgcaggaccgagtgtactcccccacattccttgccctgcgcggatcttgtttgtacaagttcttggcccctcctgtgacgacatgggattggacaagggcggagaagacatttagcgtttatgagatcatgtgtaagattctcaaagattccgatttgctggataggagaaagcagtgtttcaccgttcagtccgagagcggcgaggacctgtacttcagcgtagaactggaaagcgaccttgctcagtgggagcgagcattccagacagccacttttcttgaggtggagcgaattcagtgtaagacttatgcgtgcgtgcttgaatctcaccttatgggtttaactattgacttctccacaggtttcatttgctttgacgccgctactaaggcagtgctgtggagatacaagttttcccagcttaaagggtcttccgatgacggaaagtccaaaataaaatttctctttcagaatcccgatacaaagcagattgaagcaaaggagctcgagttttccaatttgttcgctgtgctgcactgcattcacagctttttcgccgcaaaggtggcatgtctggatcccctttttctcggaaatcaggcaaccgcaagcactgccgcttcaagcgcaactaccagcaaagcaaagtataccacatag

SEQ ID NO: 243286 - DNA, 279 bp, Artificial Sequence
  Description of Artificial Sequence: Synthetic coding sequence
atggattttcggacagcttgcgaggagacaaaaaccggcatttgcctgctgcaggatggcaatcaggagccatttaaggtcaggctgcacctggccaaggatatcttaatgattcaggaacaggatgtgatctgcgtaagcggagaacccttctactcaggagaacgaaccgtgacgattaggcggcagacagtaggtggctttgggctgtctattaaaggtggggcagagcacaacatccccgtggtcgtcagtaagatctccaaggaacagaggtag

SEQ ID NO: 243287 - DNA, 423 bp, Artificial Sequence
  Description of Artificial Sequence: Synthetic coding sequence
atggatgtctttatgaaagggctctccaaggcaaaagaaggggtcgtggctgccgctgagaaaaccaagcagggggtggcagaggccgctgggaagaccaaagaaggcgtcctatatgtcggttctaagacaaaagaaggggtggtccatggcgtggctactgtagccgaaaagacaaaggagcaggttaccaacgtgggaggcgctgtggtgaccggcgtcacggccgtcgctcagaagaccgtcgaaggtgctggatcgattgccgcagccactggcttcgttaagaaggaccagctgggtaagaatgaggaaggggctcctcaagaagggattcttgaggatatgcccgtagatcccgacaacgaagcctacgaaatgccgtctgaggagggctatcaggactacgagccagaagcctag

SEQ ID NO: 243288 - DNA, 339 bp, Artificial Sequence
  Description of Artificial Sequence: Synthetic coding sequence
atggatgtttttatgaagggactgtctaaagcaaaggagggtgtagttgctgcagcagagaaaaccaagcagggcgtggctgaggcagctggaaagacgaaggaaggggttttatacgtcggttcaaaaacaaaagagggtgtcgtccacggagttgcaaccgttgcagagaaaacaaaggagcaggtgactaacgtgggaggggctgtggtgactggtgtgaccgcagttgctcagaagacagtggagggagcagggagtatagccgctgccacaggtttcgttaaaaaagatcaacttggaaaagagggttatcaggactatgaacccgaagcatag

SEQ ID NO: 243289 - DNA, 423 bp, Artificial Sequence
  Description of Artificial Sequence: Synthetic coding sequence
atggatgtgttcatgaaaggcctcagcaaggctaaggagggcgtggtggctgccgctgagaagacaaaacagggagtcgctgaggcagccggaaagaccaaagagggcgtgctctacgtcggctccaaaactaaggagggagtggtacatggtgtagcaacagtggccgagaagaccaaggaacaagtgaccaacgtcggcggtgccgttgttaccggtgtgaccgcagttgctcagaaaaccgtcgagggcgcaggcagcattgcagctgccactggctttgtcaagaaggaccagctggggaagaatgaggagggagctccccaagaaggtattctcgaagacatgcccgtggaccccgacaacgaggcttatgaaatgcccagcgaggagggatatcaagactacgaacctgaggcttag

SEQ ID NO: 243290 - DNA, 381 bp, Artificial Sequence
  Description of Artificial Sequence: Synthetic coding sequence
atggacgtgttcatgaagggtctgtctaaggccaaagaaggggttgttgcagctgctgaaaaaaccaaacagggtgtcgcagaggcggcaggaaagacaaaagaaggcgtgctgtatgtggtcgcggagaagaccaaggaacaagtgacaaacgtcggcggagccgtcgtgacgggcgtgactgctgtggctcagaaaaccgtggagggcgcaggttccattgctgctgcgacgggcttcgtaaaaaaggaccaattaggcaaaaacgaagaaggtgctcctcaggaaggaattctggaagatatgccagttgaccccgataacgaggcctatgaaatgccatcagaggagggttaccaggattacgaacctgaagcttag

SEQ ID NO: 243291 - DNA, 423 bp, Artificial Sequence
  Description of Artificial Sequence: Synthetic coding sequence
atggacgtatttatgaagggcctctcgaaggccaaagagggcgtagtggccgcagctgaaaaaacaaagcagggcgtggccgaagctgcgggaaagaccaaggagggcgtcttgtatgtggggtctaaaacgaaagagggagtggtgcacggagtggcaaccgtagccgagaaaaccaaggagcaggtgacaaacgtgggcggtgctgtagtgactggggtgactgcggtagcgcagaagaccgtggagggcgcaggcagtatcgccgctgctacaggatttgtcaagaaagatcaacttgggaaaaacgaggaaggagcacctcaggaaggcatcttggaagatatgccggtggaccccgacaatgaggcatatgaaatgccttcagaggaagggtatcaggactatgagcccgaggcctag

SEQ ID NO: 243292 - DNA, 339 bp, Artificial Sequence
  Description of Artificial Sequence: Synthetic coding sequence
atggacgtgtttatgaaaggattgtccaaggccaaagaaggtgtggttgccgctgccgagaagactaaacaaggcgtggccgaggcagccggtaagacaaaggagggggttctgtacgttggttctaaaacgaaggaaggggtcgtgcacggagtcgccactgtagcagagaagaccaaagagcaggtaaccaacgtgggtggggcagtggtaactggtgtcacggctgtggcacagaaaactgtggagggggcaggctccatcgcagccgcaaccggattcgtgaaaaaggaccagctgggaaaggaaggctaccaggactacgaacccgaagcctag

SEQ ID NO: 243293 - DNA, 348 bp, Artificial Sequence
  Description of Artificial Sequence: Synthetic coding sequence
atggacgtcttcatgaagggattaagcaaagccaaagagggcgttgtggcagctgccgagaagacaaaacagggcgtcgcggaggctgctggcaaaacaaaggagggggtgttatatgtgggttccaaaacaaaggagggggtggtgcatggtgtggccaccgtcgcagaaaagactaaggaacaggtgaccaatgtcgggggagccgttgtaactggggttactgcagtggcgcagaagactgtagagggagccggaagtatcgctgctgcgactggatttgtcaagaaagatcagttggggaaggtgtggttgtgtacattctgcgttacgtttattagctggtag

SEQ ID NO: 243294 - DNA, 381 bp, Artificial Sequence
  Description of Artificial Sequence: Synthetic coding sequence
atggacgtgtttatgaaggggttgagcaaggccaaagagggggtcgttgcagccgcagagaagaccaaacagggagtggcagaagctgctgggaagaccaaggagggggtcctgtacgtggtagctgaaaaaactaaggagcaggttaccaacgtgggtggagcggtagtaacaggagtaacagccgtagcccagaagacagtcgaaggcgctggaagcattgccgcagccactggcttcgtgaagaaagaccagctgggtaaaaatgaggagggcgctccccaggagggtattctggaggacatgcctgtggaccccgacaatgaggcgtatgagatgccttcagaagaaggctaccaagattacgaaccagaggcatag

SEQ ID NO: 243295 - DNA, 423 bp, Artificial Sequence
  Description of Artificial Sequence: Synthetic coding sequence
atggatgtgttcatgaagggcctgtccaaggctaaggaaggggtcgtggccgctgctgagaagactaaacaaggtgtcgctgaggccgctggaaagaccaaagagggcgtgctgtacgtagggtctaaaacaaaggagggagtagtgcacggcgtggccaccgtggccgaaaaaaccaaggagcaggtgaccaacgtgggcggagccgtggtgaccggagtcacagcagtggcacagaaaacagtggagggcgcaggatcaatagccgctgcaacaggatttgttaagaaagaccagttaggcaaaaacgaggagggcgcaccccaggaggggatacttgaggatatgccagttgacccagacaacgaggcatacgaaatgcccagcgaggagggatatcaggattacgagcccgaggcatag

SEQ ID NO: 243296 - DNA, 204 bp, Artificial Sequence
  Description of Artificial Sequence: Synthetic coding sequence
atggatgttttcatgaagggcctgagtaaagctaaggagggagttgtagcagcagcggaaaagaccaagcagggggtggcagaggcagcgggaaagacaaaggagggggttctgtacgtaggcagtaaaacgaaggagggagtcgtccacggggtggccactgtcgctgaaaagaccaaggagcaggtgacaaacgtcggctag

SEQ ID NO: 243297 - DNA, 423 bp, Artificial Sequence
  Description of Artificial Sequence: Synthetic coding sequence
atggacgttttcatgaaaggactgtctaaagctaaagagggcgttgtagctgctgctgaaaaaacaaagcagggcgttgccgaggccgctggtaagactaaagaaggggtactgtacgtgggctcaaagactaaagagggtgtggtgcacggcgtcgccacagtggctgagaagaccaaagaacaagtgaccaacgtgggaggcgcagtggtaactggcgtgacggcggttgcccaaaaaaccgtagaaggagctggtagcattgctgcagcaacagggttcgtcaaaaaagatcagctagggaagaatgaggaaggagcaccccaagaggggattcttgaggatatgcccgttgatcctgataacgaagcctatgaaatgccttctgaagaggggtatcaagactacgaacccgaagcttag

SEQ ID NO: 243298 - DNA, 2760 bp, Artificial Sequence
  Description of Artificial Sequence: Synthetic coding sequence
atggaggctccagagtaccttgacctcgacgagatcgacttttcagacgacatatcatattcggtgacttctctcaaaaccatcccagagctgtgtaggcggtgtgacacacagaacgaggaccgttccgtgtcctcctcttcgtggaactgcggtatttctacccttatcacgaacacacagaagccaactggcattgcggacgtctattctaaatttagaccggttaagcgagtgagcccactcaagcaccagccggagaccctggagaacaacgagtccgacgaccaaaaaaatcaaaaggttgttgagtaccagaagggtggggagtccgatctgggtccccagccccaggagctcggacccggagacggggtcggcggtccaccaggtaaatcctcggaacccagtaccagcctgggggagttggaacactacgacctggacatggacgaaattcttgacgtcccatatattaaaagttcgcagcaactagcctcattcacgaaggtgaccagcgagaagagaatcctcggactgtgtacaaccattaatggtttgtcagggaaggcctgtagcactggatcctctgaatcttctagtagtaacatggcgcctttctgcgtgctatcccctgtaaaatcgccacacctccggaaggcatctgccgtgattcatgaccagcacaagctgtccaccgaggaaacagaaatatcccccccattagtgaaatgtggaagtgcctatgagcccgagaatcagagtaaagatttcttaaacaaaaccttcagcgacccacacggcaggaaggtagaaaagacaactccagattgtcagcttcgagccttccacctccagagtagtgccgcagaaagcaagcctgaggaacaagtgtccggactcaaccgcacaagctcgcagggacccgaggagcgtagtgaatatcttaagaaggtgaagagtattctgaatatcgtgaaagaaggccagatatcattgctcccccaccttgctgctgataacctggacaagatccacgatgaaaatggaaacaatttgctgcacattgctgcctcccagggccacgctgaatgtctgcagcacctcacaagtctaatgggcgaagattgcctgaatgaacgcaatactgagaaactaacccctgcaggcttggccattaaaaacgggcagctggaatgtgtgcgttggatggtgtcagagaccgaagccatcgccgagctttcctgctccaaagactttccgtcgttgatccactatgctggatgctatgggcaggagaaaattctgctatggctcctccagttcatgcaggagcagggcataagtctggacgaagtcgatcaagatggcaacagtgctgtccacgtggctagtcagcacggttacctgggttgcattcaaaccctggtggaatacggagccaacgtgacaatgcagaatcacgctggtgagaaaccctctcagagtgccgaacggcagggccacacgctgtgttccagatatctggtcgtggtggagacttgtatgtccttggcttctcaggtcgtgaagttgaccaaacagttgaaggaacagacagtcgagcgagtcacactccaaaatcagctccaacagtttctggaggcccagaaatcagagggcaagagtttgccaagctcaccctctagcccaagttcgccagcttccagaaaaagccagtggaagagtccagatgccgacgatgatagcgttgccaaaagtaaaccaggcgtgcaagaagggattcaggttttaggaagcctgtccgcctcctcccgagcgagacctaaagccaaagacgaagattcagataagatcctgcgccaactgctgggtaaagaaatctcagagaatgtgtgcacccaggagaagctctcattggagttccaggatgctcaggcctcaagcagaaacagcaaaaaaataccactagagaagcgggagctcaaactggcaagacttcggcaactgatgcaacggtccctgagcgagagcgacacggattcaaataactcggaggaccccaaaactacccctgtgagaaaggctgaccgcccacgaccgcagcccatagtggagtctgtcgaaagtatggacagtgccgaatcattgcatttaatgatcaaaaaacacaccttagcctccggagggagacggtttccattttcgataaaagcctctaagtctctggacggacacagtccttcccctacttctgaaagctccgaaccagacctggagtctcagtatcccggatctggatccattccacccaatcagccatccggagacccacagcagccgtcccctgactccaccgccgcacagaaggtcgccaccagccctaagtccgctctgaaatcaccttcaagcaagcgtcgtacctcacagaatttaaagctccgagtcacctttgaagaacctgtggtccagatggagcagccctcactcgagcttaatggagagaaagataaggacaaggggaggacgctgcagcggacttccacctctaacgagtccggagaccaacttaagagaccttttggggcttttcgaagcatcatggaaaccctgagcggcaaccagaataataataacaattaccaagccgcaaatcagttaaagacatctactcttccgctgacatcccttggccgtaaaacagacgcaaagggcaaccctgcctctagcgcttcaaagggaaagaacaaagcagcctag

SEQ ID NO: 243299 - DNA, 3051 bp, Artificial Sequence
  Description of Artificial Sequence: Synthetic coding sequence
atggaagccccagagtatctggacctggatgagatcgacttctctgatgatatttccgataaccgcagccaagggaacagacttcagaaacttggtctcgaggatacggaccgcgaggacgctatgggttttggctcacaccgagcaaagttgactgtagtcgccgctctcggagcttgccattgtcctgaaaatgaatacagcgtaacatcgctgaaaacaatcccggagctatgtaggcgatgcgatacccagaacgaagatcgctccgtctcaagttcttcatggaattgcggcatttccaccctcatcaccaatacacaaaaacccactggcattgctgacgtgtatagcaagtttcggccagtgaagcgtgtgtcccctctcaagcaccaacccgaaaccttggagaataacgaatctgatgaccagaagaatcagaaagtggtggagtatcaaaaagggggtgagtcggatctgggaccccagccacaggaactcggccctggggacggggtcggtggacctcctggcaagtctagcgaaccaagcacctcgcttggcgagcttgaacactacgacctggacatggatgaaatcctcgatgtgccctacatcaagtcttcacagcagctagcttcctttaccaaggttacaagtgagaagaggattttaggcctttgtaccactatcaacggtctttcaggtaaggcctgttctaccggatcgtctgagtcaagcagttccaacatggctcccttctgtgtgctgtccccagttaagtctccacaccttcggaaggcaagcgctgttattcatgatcagcataagttgagtactgaggaaactgagatttctcctccactggtcaaatgcggcagtgcctatgagcctgaaaaccaatctaaagactttctaaataaaacgtttagtgatccccatgggagaaaggtggagaagaccactccagactgccagctgagagctttccatttacagtcctccgctgccgagagcaaacccgaagagcaggtatctggcctgaataggacaagcagccaagggccagaggagagaagcgagtaccttaaaaaagttaaaagcatcctgaacatcgtcaaggagggtcagatctctttactcccacacctggccgcagacaacctggacaagattcacgatgagaatgggaataatttactgcacatcgccgctagtcaggggcacgcagagtgtctgcagcacctaacaagcctgatgggagaggattgcctcaatgagcgtaacacagagaaactgactcccgctggacttgccatcaagaatggacagctggaatgcgttaggtggatggtctccgaaactgaagcaatcgccgaactctcctgcagtaaggacttcccaagccttatccactacgcagggtgttatggccaggagaaaattttattgtggctgttacagttcatgcaggaacaaggtatctctctcgatgaagttgaccaggacggaaactctgccgtccacgttgcatcacagcatggatacttaggatgtattcagaccttagtcgagtacggggcaaacgtcaccatgcagaatcacgctggagaaaagccttctcaatctgctgagaggcagggacacactctctgttcccgctacctggtggtggtcgaaacctgtatgtccctggcaagtcaggttgtcaaactgaccaagcagctcaaggagcagaccgtggagagggtgactctccagaatcagctccagcaatttctggaggcacagaaatccgagggtaagtctcttcctagttctccctcaagtccttcatcaccagcctctagaaagtcccagtggaaatcccccgatgcagatgacgattctgtggcgaagagtaaaccgggagtacaagagggaatccaggttctcggtagtctgagtgccagctcaagagccaggcctaaggcgaaagatgaggacagtgataaaatcctacgtcagctgctcggcaaggagatttcggaaaatgtctgcacccaagagaagctttccctggaattccaggacgctcaggcctccagccgaaactccaaaaagattccactcgagaagcgcgagctgaagctcgcaaggctgcgtcagctcatgcagcggtctctgtccgagagtgacactgattctaataatagtgaagaccccaagactactccagttagaaaggctgatcggccacgtccgcagcctattgtggagtctgttgagtccatggacagcgccgaatccttgcacctgatgattaagaagcacactcttgccagcgggggtcggcgtttccctttctcaataaaggcctcaaaatctctcgatggccactccccaagccccacgagcgaatccagtgaaccagatctcgaaagccagtatccagggtcaggcagcattccccctaaccagccaagcggagaccctcagcagccgagcccagacagcaccgccgctcaaaaggttgctacatcacccaagtcagcgttgaagtcccccagctcaaagcggaggacgagccaaaacctaaaactgagggtcacattcgaagaacccgtagtgcagatggagcaaccctctctggaactgaatggggaaaaagataaggacaagggacggactctgcaaaggacctcaacaagtaatgagtcgggcgatcagctgaagcgtccattcggggcatttcgcagcatcatggaaaccctgtctgggaaccagaacaataacaacaattatcaagctgctaaccagctcaagacatcgactctgccactgacttcactaggacgcaagactgacgccaaagggaacccagcttccagcgcttcaaagggcaaaaacaaggctgaaatgtacagctcatgcattaacctgtcatctaacatgctgattgaagaacatctctgtaacgacacacgacacaacgatatcaatcgcaagatgaaaaaatcatatagcatcaagcacatcgcagaacctgaatctaaggaactgtttctttag

SEQ ID NO: 243300 - DNA, 2580 bp, Artificial Sequence
  Description of Artificial Sequence: Synthetic coding sequence
atggaggccccagaataccttgatctcgatgagatagattttagcgacgatatctcctattcagtgacttctctcaagacaatccccgagctgtgtcggaggtgtgacactcagaatgaagaccggagtgtctcgtcttctagctggaactgtggcatcagcacactgatcactaatacccaaaagcccactggtatcgctgatgtgtattccaagtttcgcccagttaagcgagtttcccccctgaaacaccagccagaaacattagagaataatgagtccgatgatcagaaaaatcagaaagtggttgagtatcagaagggtggcgagtctgatctggggccacagccgcaggagctgggcccaggcgatggagtggggggaccacctgggaagagctccgagccaagtactagcctgggcgaactggagcattacgatcttgacatggacgaaattctggatgtgccatacataaagtccagccagcagttggcctcttttactaaggtgactagtgaaaagcgaattctcgggctttgtacaaccattaacggcttgagcgggaaggcctgtagtactggctccagcgaatcatcatccagtaacatggcgcctttttgcgtgttgtcgccagttaagagccctcacctgagaaaggcctctgccgtgatccacgaccagcacaagctgtccaccgaagaaacagaaatttcccccccactcgttaaatgtgggtctgcttatgaacccgagaaccaatctaaggactttcttaacaagacttttagcgatccacatgggagaaaggtcgagaaaacaacccccgactgtcagcttcgcgcttttcatctgcagtctagtgcagcggaatccaagcccgaggagcaggtctcgggattaaaccgcacgtcctcacagggcccagaagagagatctgaatacctgaaaaaagtgaagagtatcctcaatattgttaaggaagggcagataagtttgttgaacgggcaattggagtgcgtgagatggatggtgagtgaaacagaagccattgctgaactctcatgctcaaaagactttcctagccttatccattacgccggatgttacggacaggagaaaatacttctatggctgctccagttcatgcaggagcagggcatctccctggacgaagtggaccaggacggtaatagcgcggtccatgtggcctctcagcatggctacttaggttgtatccagaccttagtggagtacggggctaacgtgactatgcagaatcacgctggagagaagccttcccagtcagccgagagacagggccacactctatgttcccgatatcttgtagtagtcgaaacttgtatgtcactagcatctcaggtggttaagctaactaaacagttaaaagagcagacggtcgagcgggtgactttacagaaccagctgcaacagtttcttgaggctcagaagagcgaagggaaatccctgccctctagcccttcctctccatcttctccggcttcccgcaaatcgcagtggaagagtccagatgcagacgacgactcggtggctaaatctaaaccaggggtccaggaagggatccaggtgctcggaagcctaagcgccagttcccgagccagaccgaaagccaaggacgaagactcagataaaatactgcgtcagctgttgggaaaggaaatctccgagaatgtgtgtacacaggagaagctgagtctggaatttcaggacgcgcaagcctctagtagaaactccaagaaaatacctctcgaaaagagagagctgaagctggctcgcctcagacagctaatgcagcgaagtttaagtgagtcagatactgactccaacaactcagaggatcccaagaccacaccagtccggaaggcggacagaccgaggcctcagcctatcgtggaatcagtggaaagcatggattctgcggagtctcttcatctgatgataaaaaagcacacactggcctctgggggacgcaggtttccattttccatcaaggccagtaagtcacttgatggtcattccccctctcctacatccgagagttccgagccggatcttgaatctcagtacccaggatccggcagcataccccctaaccaacccagcggggatcctcaacaaccgtcaccagattctactgccgctcagaaggtggccacaagccctaagagcgccctgaaatcaccaagttctaagcggaggacatcacagaatctcaagctacgagtaacattcgaggaacctgtggttcagatggagcaaccttcgctggagttaaacggggagaaggacaaggacaaaggaagaactctgcagagaacctccacgtcgaacgagagtggtgaccagctaaaacgtcccttcggggctttcagatccattatggagacactgtctgggaaccagaacaacaataataattaccaggcagcgaatcaattgaagaccagcactctgcctttaactagcctgggtcgtaaaacagacgctaaaggcaatccggcatcctcagcgtcaaagggcaaaaacaaggctgcttag

SEQ ID NO: 243301 - DNA, 1812 bp, Artificial Sequence
  Description of Artificial Sequence: Synthetic coding sequence
atgacttatctgattcagagccatcacagcaggcgttctcagaactgtgccgaggatgttatcaggaaaacaaagaccgatcagaatggtcagctggagtgcgtgaggtggatggtctcagaaacagaggcaatcgcagagttgtcatgctccaaggattttcctagtctcattcattatgcgggatgctatggccaagagaagatcctcctatggcttctacaattcatgcaggagcagggtatatcattggacgaagtggaccaagatggtaacagtgcagtgcacgtggctagccagcacggctacctcggctgcatccagacgctggtggagtacggcgcaaatgtcacaatgcagaatcacgccggagagaaacctagtcagtcagctgaaaggcagggccacacgctgtgttcaagatatctggtagtggttgaaacctgtatgtcactggcttcacaagtggtaaagctcaccaagcaactgaaggaacagactgtcgagcgggtgaccttgcagaaccagctacagcagtttttggaggctcagaagagcgagggcaagagtctgccaagctccccatcctctccatcaagtccagcgagtagaaaatcccagtggaagagtcctgacgccgatgacgattctgtggccaagtcgaagcccggtgtacaggaagggatccaggttttggggtctttgtctgcctcgagcagggctaggcccaaagcaaaggacgaggatagcgacaaaattctccgccagcttctgggcaaggagattagcgagaatgtttgtactcaggaaaagttgagtctggagttccaagacgcccaagccagctcccgaaactcaaagaaaataccacttgagaaacgggagctaaaattggccaggctccgacagctcatgcagcgcagcttgagcgagtctgacacagacagcaataacagtgaggaccccaaaaccactcctgtgagaaaagcggatcgcccaagaccccagcctatagtggagagcgtcgaatctatggactccgctgaatcattgcatcttatgatcaaaaagcatactctagccagcggtggccgtagatttcccttctccatcaaagccagcaaatcactggacggccattcaccttcccccacctcagagtcctccgagcctgatctggaatcacaatacccaggtagcggctcgattcccccaaaccaaccttctggcgacccgcagcagcccagcccagactctaccgccgctcagaaagtcgctacatctccaaagtctgcactgaagtctcctagttcaaagcgccgaacatcacaaaatttaaagctcagggtgaccttcgaggagcctgtcgtgcagatggagcagccttccctggaattaaacggcgagaaggacaaagacaagggaaggacactgcagcgcacttccacttcaaacgagtccggtgaccagttgaaacgtcctttcggcgcttttcgatccataatggaaacactgtccgggaatcaaaacaataataacaattaccaggcagccaaccagttaaagacttcaactctccccctgacttcactgggcaggaaaacagatgctaagggtaatccagcctcctccgcttcaaaggggaagaacaaagccgagatgtattcgtcctgtattaaccttagcagcaatatgctcatagaggagcatctatgtaatgatactcggcacaatgatatcaatagaaagatgaaaaaaagctacagtatcaaacatatagccgaacccgaatctaaagagttgttcctgtag

SEQ ID NO: 243302 - DNA, 1566 bp, Artificial Sequence
  Description of Artificial Sequence: Synthetic coding sequence
atgaagctgactctggtgatgacgtatctgatccaatcccaccattctagacgttctcaaaactgcgcagaggacgtgatcaggaagactaaaaccgaccaggaaaagatcttgctttggctgctgcagttcatgcaggagcagggcatcagtcttgacgaggtggatcaggatggcaattccgccgtccacgtagctagtcagcacgggtatttgggttgcattcaaactctcgtagagtatggagccaatgtgacaatgcagaaccatgccggagaaaaaccttcccagtctgcagaaagacaaggccatacactttgtagtagatatcttgtggtggtggagacctgtatgagcctggcgagccaggttgtcaaactcactaaacagctgaaggagcagacagttgaacgcgttaccctccagaaccagctccagcagttcctagaggctcagaagagcgaaggcaagagcttaccctccagtccttcctcaccgtcttcccccgcaagcaggaagagccagtggaaatcaccggacgccgacgacgactcagtcgcaaagtccaagcccggagtgcaggaagggatccaggtgctcgggagtctcagcgcctcttctcgtgctaggcccaaagccaaagacgaagattctgataaaattttaaggcagctgctcggcaaagaaatctccgaaaatgtatgcacacaggaaaaactcagcctggagttccaggacgcccaggctagtagtaggaatagtaagaaaatccctctggagaaaagggaactgaaattggctaggctccgccagttgatgcagcggtcactgagcgagagtgatactgactcaaataactccgaagatccaaagactacacctgttcgaaaggcggatcgtccaaggcctcagcctattgtggagtcggttgaaagcatggactcagccgagagcttgcatctgatgatcaaaaagcatactcttgcctctgggggacgcagatttcccttttccatcaaggccagcaagtcactcgacggtcattcccccagtccgacatcagagtcttcagaacctgacttagaatctcagtacccaggtagcggcagcattcctccaaaccagccatctggggacccccagcagccaagtccggacagcacagcagctcagaaggtggccacctcacctaaaagcgcgcttaagtcccccagtagcaagcgaagaacctcccaaaacttgaagcttagagtcacatttgaggaacccgtcgtccaaatggagcagcccagtctagaacttaacggggaaaaggataaggacaaaggacggaccctgcagcgcacatctactagcaatgagagcggggatcagctgaagaggcctttcggcgcattccggagtataatggagactctgagcggcaatcaaaataacaacaataattaccaggccgcaaaccagctcaagactagcacattacccctgacttcactgggcaggaagactgatgcgaagggaaatcccgcatcttcagcctcaaaggggaagaataaggctgcctag

SEQ ID NO: 243303 - DNA, 1146 bp, Artificial Sequence
  Description of Artificial Sequence: Synthetic coding sequence
atgaaattgacgttggtcatgacttatctgattcaatctcatcacagtagaaggagtcagaattgcgcagaggacgtgatccggaaaacgaaaaccgatcagaatggacagctggaatgtgtcagatggatggtttcagagacagaagcgattgcagagctctcctgctccaaggactttccttcgttaatacactatgcagggtgttacggccaagagaaaatcttgctctggctgttgcagttcatgcaagagcagggcatcagcctggatgaggttgatcaggacggtaactccgccgtgcacgtggcaagtcagcacggctatctgggatgtatacagactctggtggaatatggagccaacgtgacgatgcagaatcatgccggagagaaaccaagtcagagtgccgaaagacaggggcacacgctgtgtagccggtacctggtcgtcgtagagacttgtatgtctttagcaagccaggtcgtcaaacttactaaacagctcaaggaacagactgttgagagagttacgctccagaaccagcttcagcagtttctcgaagctcagaagagtgagggcaagtcactaccctcatctccctcctctccaagctcccccgcatcacggaagagtcagtggaaatcgcctgatgctgatgatgattccgttgccaaatccaaacccggtgttcaagagggaatccaggtgctaggctctctctcagcctcatccagggctagacccaaagccaaggatgaggactccgataaaatcctccggcagctgttggggaaggaaataagcgagaatgtttgtacgcaagagaaattgtctctcgaatttcaagacgcccaggcttcctcacgtaattctaaaaaaatccccctagaaaaacgggagcttaaacttgcaaggctgcgccagttaatgcagcggtctctgagcgagagtgacaccgactcaaataacagcgaagaccccaagaccacaccggtgcgcaaggcagatcgaccccgaccgcagccgatagttgagagcgttgagagcatggactctgcagggtttttatccgcttcccggcctcccaatccatggatggccaccgcacatctgccacctcagcgcgctgccaatcaaacctag

SEQ ID NO: 243304 - DNA, 1767 bp, Artificial Sequence
  Description of Artificial Sequence: Synthetic coding sequence
atggaagctcccgagtacctcgacttggatgagatcgacttcagcgatgatatctccgacaataggagccagggaaacaggctgcaaaaacttgggcttgaagatacagatcgagaggacgcgatggggttcggctcacaccgggcaaaattgaccgtcgtagctgctctcggtgcttgtcactgccctgagaacgagtatagcgttacaagcctgaagactattcccgagctgtgccgccgttgcgatacccaaaatgaggatcgttctgtctctagttctagctggaattgtggcatctcaaccttaatcactaatacgcagaagcccaccgggattgcagatgtgtattcaaaatttagaccggtgaaacgagtgtccccactgaagcaccaacccgagacattagagaacaacgagagcgacgaccagaagaatcagaaggtggttgagtaccaaaaaggcggtgaatctgatctcggtcctcagccccaagagcttggacccggagatggcgtcggcggaccaccaggcaaaagcagtgaaccatccacatctcttggggagctggagcactatgatctggatatggatgagattctggacgtcccatatattaaatcatcacagcaacttgcctccttcactaaggtgacatcagagaaacggattttgggcttgtgtacgaccataaatgggctgtctgggaaagcatgtagtacaggctcaagcgaaagctcttcctctaacatggcacctttttgcgtgctaagccccgtcaagtctccgcatctacggaaggccagcgccgtgatccacgatcagcataagttgagcaccgaagaaaccgaaataagcccaccactggtaaaatgtgggtcagcctatgagccagaaaatcagtcaaaagatttcctcaacaaaaccttttccgatccgcacggtagaaaggtggagaagacaaccccggattgccagctccgcgctttccacctgcagagctccgcagcagaaagcaagccagaagagcaggtaagcggccttaacaggacctccagccaggggccagaggagcgatcagagtacttaaagaaggtgaagtctatcctgaatattgtcaaagagggccagatctccctcctccctcacctcgccgctgataatttggataaaatccacgatgagaacggaaacaatcttttgcatatcgctgcttcccaggggcacgcagagtgccttcagcatctgacatctctcatgggggaagattgtctaaacgaaagaaacactgagaagctgacccctgccggactggctatcaaaaacggacagctggagtgcgtgcgttggatggtgtctgagaccgaggccatagcggagctgtcgtgttctaaggacttccccagcctcattcattatgcaggatgctacggtcaggaaaaaatcttactgtggctgttgcaatttatgcaggagcagggtatcagcctggacgaagttgaccaggatggcaactccgccgtgcatgttgcttctcagcacggttatctgggatgcattcagaccagactgaaaattcaagggacgtggaacgggagcgagacgtgtctgttcacacaccatttttcaagttatccacctatcagcagtggcctgcagtgccagggccaagagggcgtcttgttcattccagaccaggtgggtgctgctacaaataagcaggtcctctttcagaatcagctccccgaaaccaaatcatcctattag

SEQ ID NO: 243305 - DNA, 267 bp, Artificial Sequence
  Description of Artificial Sequence: Synthetic coding sequence
atggaagcaccagaataccttgacctggatgaaatcgatttcagcgatgatatttcctacagcgtcacaagcctgaagaccattcccgaattatgtcgccgatgtgatacacagaacgaagatcgatccgccactccatcttgtagacagtctcgacagaacagccggcgaaaatggaagcagagcatcacgtattgtggcgtaacggggacccgcagagtttctactgccccacacttcttcgacggaaggagactgccccaatag

SEQ ID NO: 243306 - DNA, 297 bp, Artificial Sequence
  Description of Artificial Sequence: Synthetic coding sequence
atggaggccccagaatacctggatcttgacgaaattgatttctccgacgacatttcctattcggttacaagcctcaaaaccattcccgaactgtgtcgccgatgtgatactcagaacgaagatcggtctgtgagttctagttcttggaattgcggtatttccaccctgatcacaaacacccaaaagcccacagggatcgcagatgtgtacagcaagttccgcccagtgaaacgcgtatctccactcaagcatcagccagagacactggagaacaatgagagtgatgatcagaagtag

SEQ ID NO: 243307 - DNA, 45 bp, Artificial Sequence
  Description of Artificial Sequence: Synthetic coding sequence
atggaagctccggagtacctagatctggatgaaatcgatttctag

SEQ ID NO: 243308 - DNA, 408 bp, Artificial Sequence
  Description of Artificial Sequence: Synthetic coding sequence
atggaggcacccgagtacctggaccttgacgagattgactttagcgatgatatcagctactctgtgaccagcttgaagacgataccagagctgtgccggcgatgcgacacgcagaatgaggacagaagtgtctcttcaagttcgtggaattgcggcatttcgacgctcatcaccaatacacagaagccaaccggtatcgcagacgtgtacagcaagtttagaccagttaagcgggtatcaccacttaaacaccagccagagaccctagagaacaacgagagcgatgaccagaaaaatcagaaagtggtggagtaccagaaaggaggcgagagcgacctcgggcctcagccgcaggaactgggcccaggtgacggggtgggcggaccgccagggaaaagtagcgagtag

SEQ ID NO: 243309 - DNA, 1434 bp, Artificial Sequence
  Description of Artificial Sequence: Synthetic coding sequence
atgcaggagcagggtatctccttagatgaggttgaccaggatggtaattctgccgtccatgttgccagccagcatggctaccttggatgcatacagacgttagtggaatatggagctaatgtgactatgcaaaaccacgccggagagaagccatcacaaagtgcagaacggcagggccatactctgtgtagccggtacctggtcgttgttgagacctgcatgagtctggcctcccaggttgttaaattaaccaaacagctcaaagagcaaaccgtggagcgggtcactctgcagaaccagttacagcaattcttggaggctcagaagtcggagggtaagagcttgccctccagcccgtccagccccagttcccctgcatctcgtaaaagtcagtggaaatcccctgatgcagacgatgattccgtggcaaaatcaaaacccggtgtccaggagggcattcaggtcttgggcagcctgagcgcctcatctcgcgctaggcccaaagcaaaagatgaagacagtgacaagatattaaggcagttactcggcaaggagatttccgagaatgtgtgcacacaagagaaactttcactggagttccaagatgcacaggctagtagcagaaacagtaagaagatcccactggaaaaacgagagctaaaattagcacgcctaaggcagctcatgcagaggtccctcagcgaatccgatactgatagcaataactcagaggaccccaaaacgacaccagtgagaaaggccgaccggccacggcctcagcctatagtcgaatccgtggaatcaatggattccgccgagtctttgcatttgatgatcaaaaaacacacgcttgcctcaggaggccgacgctttcccttctcaataaaggcttctaaaagtctcgatggacatagcccttctcctacctccgagtccagcgaaccagatttggagagccagtacccaggtagcggcagcataccccctaaccagccaagtggcgacccgcagcagccctctcctgactcaacagccgctcaaaaagtcgccacgtctccaaagtccgcattgaagtctcccagctcaaagaggaggactagccagaatctcaagctgagggttacctttgaagaacctgtcgtgcagatggaacagcctagcttagagctgaacggagagaaggataaagacaagggtaggaccttacagcggacaagcacctccaacgagagcggggaccagctgaagcgaccttttggagcctttcggagcataatggagacgctctccgggaaccagaacaacaataataattatcaggccgcaaatcagcttaagacttctaccctgcctctgacttcactgggcagaaagacggacgcaaagggcaatccagctagctccgcttccaaggggaagaataaggctgcttag

SEQ ID NO: 243310 - DNA, 405 bp, Artificial Sequence
  Description of Artificial Sequence: Synthetic coding sequence
atggacgttttcatgaagggcttatccatggcaaaggagggtgttgtggctgccgcagagaagaccaagcagggtgtcacagaggctgcagaaaagactaaagagggggtgctttatgtcgggagtaagacccgggagggagtggtacaaggggtggcctccgtcgccgaaaagacaaaggaacaggccagccatctcggcggtgccgtgttctcaggcgcaggcaacatcgccgctgccacaggacttgtcaagagagaagaatttcccaccgacctcaagcctgaggaggtcgcccaagaggccgcagaagagcccttgattgaacccttgatggaacctgagggcgaatcctatgaagatccacctcaggaggaataccaggagtatgagcccgaggcctag

SEQ ID NO: 243311 - DNA, 405 bp, Artificial Sequence
  Description of Artificial Sequence: Synthetic coding sequence
atggacgtgttcatgaaaggattgagcatggccaaggagggtgtcgtcgcggcagctgaaaaaaccaagcagggcgtgacggaggccgctgagaaaaccaaagagggcgtattgtatgttgggtccaagacaagagagggagtcgtgcagggcgtggcaagcgtcgcggaaaagaccaaggaacaggccagccacctcggcggagccgtctttagcggagcaggtaatatcgctgccgcaactggtctcgttaaaagggaagaattccctacggacttgaaacctgaggaggtggcacaagaagccgctgaagaacctttgattgaacccttaatggaacccgaaggggagagttatgaagatcctcctcaggaggagtatcaggagtatgagcccgaggcctag

SEQ ID NO: 243312 - DNA, 405 bp, Artificial Sequence
  Description of Artificial Sequence: Synthetic coding sequence
atggacgtcttcatgaaaggcctgtcaatggcaaaagaaggggttgtcgccgcagccgaaaaaaccaaacagggagtaaccgaagctgcggagaagactaaagaaggggttctgtacgtcggcagtaagacccgcgagggcgtggtccagggagtcgcatccgtcgccgagaagacaaaggagcaggcgtctcatcttggcggagcagttttcagcggcgcaggaaatatcgccgcagctactggcctggtgaagagggaagagtttcctacagacctgaagcccgaagaggtggctcaagaggcggctgaggagcctttaatagagccattgatggaaccagagggcgaatcctatgaggacccgcctcaggaggagtaccaggaatatgagcccgaagcttag

SEQ ID NO: 243313 - DNA, 405 bp, Artificial Sequence
  Description of Artificial Sequence: Synthetic coding sequence
atggatgtttttatgaagggcctgagcatggctaaggagggggttgtagcagccgctgagaaaaccaagcagggcgtcaccgaggcagctgagaagacaaaggagggcgtcctgtacgtgggctccaagaccagagagggcgtggtgcagggagtcgcgtccgtcgccgagaaaacaaaagagcaggccagccatctgggcggtgccgtgttttccggagcaggaaatatcgccgctgccacgggacttgtaaagagggaggagttcccaactgatttaaaacccgaagaggtggcccaggaagctgccgaagagccacttatcgaacctttgatggagcccgagggcgagtcttatgaagatcctccacaggaggagtatcaagaatatgaacctgaagcctag

SEQ ID NO: 243314 - DNA, 381 bp, Artificial Sequence
  Description of Artificial Sequence: Synthetic coding sequence
atggacgtgttcaagaagggcttcagtatcgcaaaagagggggtcgtgggagctgtagagaagacaaagcaaggcgtgacggaagcagcggaaaagaccaaggagggggtgatgtatgtaggggctaaaaccaaggaaaatgtcgtgcagtctgtgaccagtggactaccatggggttgggggtggggtggcggtcagccggtgtctagccacagtgggagggaggatcagggagcaggtcaaagaagagagagaggctgtggcgagcagcgtcagcactgtgggcaccaagatcggggtggcggaggtgagcacagaggacatctgaggggaggtgctcagggagggcttgaagctatctgtccacctaccggaggctag

SEQ ID NO: 243315 - DNA, 384 bp, Artificial Sequence
  Description of Artificial Sequence: Synthetic coding sequence
atggacgtctttaaaaagggcttcagcatcgccaaagaaggggtggttggagccgtggagaagactaagcagggggtcacagaagccgcagagaaaactaaagagggagtgatgtatgtaggtgccaagacaaaggagaacgtggtacagtcagtaacatccgtggccgagaagacaaaagaacaagccaacgccgtgtccgaagccgtcgtgagctctgtgaacaccgtggcgacaaagaccgtcgaagaggccgaaaacattgccgtgacctctggagtagtcagaaaggaagacctgcgcccaagcgcaccccagcaggaaggggaagcatctaaggaaaaagaggaggtggcagaagaggcacaaagtggaggagactag

SEQ ID NO: 243316 - DNA, 471 bp, Artificial Sequence
  Description of Artificial Sequence: Synthetic coding sequence
atggccggtcagttcagaagctatgtttgggacccactgctaatattgtcccagatcgtcctgatgcagaccgtatattatggatcactggggctgtggcttgccctggtcgatggcctcgttcgctcctctccatcacttgatcagatgttcgatgcagagatcctaggcttcagcacaccccctgggaggctttccatgatgtccttcatactgaacgctcttacgtgcgctctggggctcctctactttatacgtcgcggaaaacagtgtctcgactttaccgttactgtgcatttctttcacctcttaggctgttggttctatagcagtagatttccatccgcacttacatggtggctcgtgcaggcagtctgcattgcactaatggccgttatcggagagtacctgtgcatgcgaaccgaactaaaagagatccccttaaacagtgccccaaagtcgaatgtgtag

SEQ ID NO: 243317 - DNA, 471 bp, Artificial Sequence
  Description of Artificial Sequence: Synthetic coding sequence
atggcgggacaattcaggagctacgtgtgggaccctctgctcattctgagtcagattgtgctgatgcagaccgtgtactacggttccctgggtctttggctggcgctcgtagacggattggttcgaagttcacccagtctcgatcagatgtttgatgcggagatcctaggattttctacgccccctggcaggctcagcatgatgtcttttatcctgaatgccctaacctgtgctctcggcctgctgtattttattcggcgtggtaaacaatgcctggactttaccgttaccgtgcacttcttccacctgctggggtgctggttttattccagtagatttccttcggccttaacctggtggctggtgcaagccgtgtgtatcgccttgatggccgttattggcgagtatctttgtatgcgaaccgaacttaaggagattcctctcaattccgctcctaagtcgaatgtgtag

SEQ ID NO: 243318 - DNA, 357 bp, Artificial Sequence
  Description of Artificial Sequence: Synthetic coding sequence
atggcagggcagttccggagttacgtatgggacccattgttgatactctcccagatcgtgctcatgcagacagtgtattacggcagtctgggtttgtggctcgccctagttgacggcttggtccgatcctcaccatccctagaccagatgttcgacgccgagatattgggatttagcacaccaccaggacgactgtctatgatgtcttttatcttgaatgctctgacatgcgcactcggtttgttgtactttattaggagggggaaacaatgtctcgattttaccgtgacagtgcacttctttcatctccttgggtgttggttttattccagcagattcccatctgctttgacctag

SEQ ID NO: 243319 - DNA, 231 bp, Artificial Sequence
  Description of Artificial Sequence: Synthetic coding sequence
atggccggacagttcagaagctacgtctgggacccactcttgatattgtcccagatagtactcatgcagaccgtgtattacggctccttggggctgtggctggcgctggtggatgggttggtacgcagtagtccttcgctcgatcagatgtttgacgctgagatacttgggtttagtacccctcctgggaggctgagtatgatgagtttcatccttaatgccctgacatag

SEQ ID NO: 243320 - DNA, 1134 bp, Artificial Sequence
  Description of Artificial Sequence: Synthetic coding sequence
atgtctagtccagggacagagtcagccggaaaaagcttgcagtaccgtgtggaccatcttctgtctgcggtggaaaacgagctccaagccggatctgagaaaggcgaccccacagagcgagaattacgggtcgggctagaggagtccgaactgtggctacggtttaaagagctgacaaatgaaatgatagtgactaagaatggaaggcgaatgttccccgtcctgaaagtgaatgtctctggacttgatcctaacgccatgtattcttttctcttggactttgtggcagctgacaatcacaggtggaagtacgttaacggagagtgggtaccaggcggtaaacctgaaccgcaggcaccatcctgcgtgtacatccacccagatagccctaatttcggcgctcactggatgaaagcccctgtctcattcagcaaggtgaaattaacaaataaactcaatggtggtggacaaattatgctcaactcccttcacaagtacgaaccaaggattcacatcgtgcgagttggcggaccccagaggatgattactagccattgctttcccgaaacacagtttatagcagttaccgcatatcaaaatgaggaaataactgccctcaagatcaaatacaatccattcgccaaagctttcctggacgcaaaagaacgctctgaccacaaagagatgatggaggagcccggagactcccagcaacccggatacagtcagtcttactccgataatagcccagcctgcctaagtatgctccagtcccatgacaactggtctagtctcgggatgcctgcacacccgagtatgctgccagtttctcataacgccagccctccaacatcctcatcccaataccccagtctgtggagcgtctccaacggagctgtgacacccggatcacaggcagcggcagtttcaaacgggttaggggcacagtttttccgcggatctcccgctcactatacgcctttaacccatcccgtctctgctcctagctcttcaggttctcccttatacgagggagccgcagccgctacagacatagtggattcgcagtacgatgcagctgctcagggtagactcatcgcctcttggacccctgtgtccccaccttccatgtag

SEQ ID NO: 243321 - DNA, 735 bp, Artificial Sequence
  Description of Artificial Sequence: Synthetic coding sequence
atgcgatggtgcctcctcctcatttgggcgcagggactaagacaggcccctctcgcatcagggatgatgacagggacaattgagaccaccggtaatatttcagccgaaaaaggtgggagcatcattttacagtgccacctttccagcacaaccgcacaagttacgcaggtgaactgggaacagcaggaccaactgttggcaatttgcaatgccgatctgggctggcacatcagtccatcatttaaggaccgcgtggcgcctggacctggcctcgggttgacgctacagagccttacagttaacgacactggggaatatttctgcatctatcacacttaccctgatggcacatacaccgggcgtatcttccttgaggtgcttgagtccagcgtcgccgagcatggcgctagatttcagattcctctattgggagcgatggctgctactctcgttgttatctgtacagcggttattgtggtcgtggctttgactcgcaaaaagaaggccttgaggatccactctgttgaaggggatctgaggaggaagagcgccggtcaggaggaatggtccccctctgccccttcccccccagggagctgtgtgcaagctgaagcggcaccagccggtctgtgtggtgaacagcgaggggaagattgtgccgagctgcatgattatttcaacgtgttgtcttaccgatctctcggtaattgcagcttcttcactgaaaccgggtag

SEQ ID NO: 243322 - DNA, 936 bp, Artificial Sequence
  Description of Artificial Sequence: Synthetic coding sequence
atggcattcctggtcgcacacccgatgcagtttgtgtatcttctgaccactctgtgcgtgttcaatatggtgttcgcaaagctaggcttttcagagacagttttctcacaaagactttcattcactgtcctgagtgccgtcggatacttccagtggcagaagcgccctcacctgctgcctgtcgggccactgggcaggtctatgcggtggtgtctcttgctgatttgggcccagggattgagacaggccccactagcctcggggatgatgactgggacgatagaaaccaccgggaacataagcgctgagaaaggaggatcaataatactacagtgtcacctgagctccaccacggcacaggtgacgcaggtgaactgggaacaacaggaccagttactggccatttgtaacgccgatctgggctggcacattagcccctctttcaaggatcgggtggcgcctggcccaggcctgggtctgaccctgcagagcctgaccgtgaacgacactggagaatacttttgtatatatcacacataccctgacgggacttacaccggcaggatttttctggaagtgctcgagtccagcgtagcggaacatggtgctaggtttcagattcccctcttgggggctatggctgccacactcgtggtgatctgtaccgccgttatcgtggtagtggcgttgaccagaaagaagaaagcgctgaggattcattctgtcgagggggaccttcggagaaaatcggctggccaggaagagtggagccctagtgcccctagcccacctggcagttgtgttcaagctgaagcagcaccagcgggactgtgcggggagcagagaggcgaagactgtgctgaactccacgactactttaacgtcctgtcttaccgtagtttaggcaactgttcattctttacagagacgggatag

SEQ ID NO: 243323 - DNA, 735 bp, Artificial Sequence
  Description of Artificial Sequence: Synthetic coding sequence
atgaggtggtgcctcctgcttatctgggcgcaaggactccgccaagcaccactggccagtgggatgatgacgggcaccatagaaacgactggcaacatctccgccgaaaaaggtggctccattatactgcagtgtcacctgagctctacaactgcacaagtgactcaggttaattgggaacagcaggaccagctactggcaatttgtaatgccgatcttggatggcatataagcccctcattcaaggatagggtcgcacccggaccaggtctcggcctcacacttcagagcctgacagtcaatgacactggagagtacttttgtatttatcacacttaccccgacggcacctatactggcaggatctttttagaggtattggagtcctctgtggccgaacatggggcacgatttcagatccccttgctcggtgcaatggcagccacgctggtggtgatctgtaccgcagtgatcgtggtggtggccctgactcggaagaagaaggccctgcgcatccacagcgtagagggggatctgcggcgaaaaagtgctggccaggaggaatggagcccaagtgctccttcacctcctgggtcttgtgttcaggcagaagctgctccagcagggttgtgcggagagcagaggggtgaagattgtgccgagctgcacgactactttaatgtgctgtcgtatcggtctctcgggaattgtagtttcttcacagagacggggtag

SEQ ID NO: 243324 - DNA, 561 bp, Artificial Sequence
  Description of Artificial Sequence: Synthetic coding sequence
atgtcgggaatctccgggtgcccattttttctgtggggtcttcttgcactgcttggtctggcgttagtgataagcctgatattcaacatttcacactatgttgaaaaacagcgccaagacaaaatgtactcctactccagtgaccacacccgggtggacgagtattacattgaagacacaccaatttacggcaatctggacgacatgatcagtgagcccatggacgagaactgttatgaacaaatgaaagcccgtcccgaaaagagtgtgaacaaaatgcaagaagccacgccttccgcccaggccacgaacgaaactcagatgtgttatgcaagtctcgaccactcagtgaaagggaagcggaggaagcccaggaaacagaacacacatttctccgacaaagatggagatgaacagttacatgctatcgatgccagcgtatccaaaactactctggtcgactccttctccccggagtcccaggccgtggaggaaaacatccacgacgaccccatacgactcttcggactgattagagcaaaaagggaacctattaactag

SEQ ID NO: 243325 - DNA, 1308 bp, Artificial Sequence
  Description of Artificial Sequence: Synthetic coding sequence
atgtcgagccccggaacagagagcgcaggaaagtccttacaataccgggtggaccacctcttatctgccgtggagaacgaactccaggccggttccgaaaagggtgacccaaccgagagggagctacgtgtgggactcgaggaaagtgaattgtggcttcgcttcaaagagcttactaatgagatgatcgtgactaagaatgggaggagaatgtttcctgttctgaaggtcaatgttagcggcttggaccctaatgccatgtacagcttcctgctggattttgttgctgccgataatcatcgatggaaatatgtgaatggagaatgggtgcccggtgggaagccggagcctcaagctccaagctgcgtttacattcaccctgactccccaaacttcggggctcattggatgaaggcccctgtcagctttagcaaagtcaaactgactaacaagctgaacggtgggggtcaaataatgctgaacagtctgcataaatatgaaccgcgtatacatatcgtgagagtcggcggacctcagcgaatgatcacgtcacattgcttcccagagacccagtttatcgcagtgacagcctatcagaatgaggagattaccgcactgaaaatcaagtacaatccttttgccaaggccttcttggatgcgaaagaaagatctgatcataaggagatgatggaagagcctggtgatagccaacagcccggatacagtcagtggggctggctgctccccggtacatccactctgtgccccccagccaatccacatccacagtttgggggagctctctctctgccatccacacacagctgcgatcgctaccctactctcaggtcacacagatcctctccttatccttccccttatgctcatcgcaataattcgcctacatacagcgacaattctcctgcgtgtctaagtatgctgcagagccacgataactggtcaagtctgggtatgcccgctcatccgagcatgttaccggtgagtcataatgcaagcccccctacgagcagtagccagtaccccagcttgtggtcagtgagtaatggcgctgtgacacctggttcacaagccgctgctgtctctaacggcctaggtgctcagttctttcgaggatcaccggcacactacacccccttgacccatcccgtatctgcgccaagttcctcagggagccctctgtacgagggcgcagctgccgctaccgacattgtcgattctcagtatgacgctgccgctcaggggaggcttatcgctagctggaccccggtgtctccaccatcgatgtag

SEQ ID NO: 243326 - DNA, 732 bp, Artificial Sequence
  Description of Artificial Sequence: Synthetic coding sequence
atgagttcgccaggaacggaatccgccggaaagagtctgcaatatagagtggaccacctcctgagtgccgttgagaacgagctgcaggcgggttctgagaaaggagatccaaccgagagagaactgcgtgttggacttgaagagtctgagctatggctgcggtttaaagaactgactaatgagatgattgtcaccaagaacgggagacgaatgtttcccgttttaaaggtgaatgtgagtggcctggaccccaacgcaatgtattcctttctcctggatttcgtggccgcagacaaccaccgatggaagtatgtcaatggcgagtgggtgcccggtggaaagcccgagccacaggccccttcatgtgtatatattcatccggatagccctaatttcggcgcacattggatgaaggccccagttagtttctccaaggtgaaactgacaaacaaactcaatgggggtggccagatcatgctgaacagcctgcataaatatgagcccaggatccacatcgtgcgggtgggaggcccacaaagaatgatcacatctcactgcttcccagagacacagttcattgcggttaccgcctatcagaatgaagagattaccgccctcaagattaaatataacccgtttgctaaggctttcttggatgccaaagaaagatctgaccacaaggagatgatggaggagcccggtgattcccagcaacctggctatagccaatag

SEQ ID NO: 243327 - DNA, 366 bp, Artificial Sequence
  Description of Artificial Sequence: Synthetic coding sequence
atgaggataatgctgctgttcaccgccatcctggctttcagtctcgcccaatctttcggcgctgtctgtaaggagccccaggaagaggtagtcccaggagggggaagatcgaagcgggaccccgatctgtatcaacttctgcaacggctcttcaagtcccactcaagtttggagggcctactgaaggccttgtctcaggcctcaaccgatcccaaggaatcaacctctcccgagaaaagagatatgcacgactttttcgtgggcctgatggggaagaggtctgtacagccggatagcccaactgacgtaaaccaggaaaatgttccctcctttggcattctcaaatacccaccccgagccgagtag

SEQ ID NO: 243328 - DNA, 366 bp, Artificial Sequence
  Description of Artificial Sequence: Synthetic coding sequence
atgcggattatgttgttgtttaccgccattctggccttctctttggcccagagctttggcgcagtctgcaaagagccccaggaggaggtggtgccgggtggcggtagatccaagagggatccagacttgtatcagctcctccagcggctgttcaaaagtcatagcagccttgaggggctgttaaaagcactcagccaggcctctaccgatcctaaggaaagtacttctccagagaaaagagatatgcatgatttttttgtgggtcttatgggtaaacgtagtgtccagccggacagccccacagatgttaaccaggagaacgttccatcattcggcattctgaagtatccacctagggcagagtag

SEQ ID NO: 243329 - DNA, 312 bp, Artificial Sequence
  Description of Artificial Sequence: Synthetic coding sequence
atgcgtatcatgctgctatttacggccattctcgcattcagccttgcccagtctttcggtgccgtgtgcaaagagccccaagaggaggttgtgcctgggggtggaagatctaaaagagatcccgatttataccagctcctacagaggctattcaagtctcattccagccttgagggcttattaaaagcactgtctcaggcaagtacggatcctaaggaaagcaccagtccagagaagcacagtccaactgatgtcaaccaggagaacgtcccttcttttggaatactgaagtatccacccagagccgaatag

SEQ ID NO: 243330 - DNA, 366 bp, Artificial Sequence
  Description of Artificial Sequence: Synthetic coding sequence
atgcggataatgcttttattcaccgccattctcgcctttagcttggcccagtcctttggggcagtgtgcaaggagccccaggaagaagtcgtccctgggggtgggagatccaaacgggatcccgatctttaccagttgcttcagaggctgttcaaatcccacagcagcctggaaggactgctgaaagcactaagtcaggcatccactgaccctaaagaatccactagtccggaaaagcgcgacatgcacgatttcttcgtcggtttaatgggtaagcgctcagtgcagcctgattccccaactgatgttaaccaggaaaatgtcccctcttttggcatattgaagtatcctccaagagccgaatag

SEQ ID NO: 243331 - DNA, 1224 bp, Artificial Sequence
  Description of Artificial Sequence: Synthetic coding sequence
atggacaacgtgctgcctgtcgatagtgacttgtctcccaacatctccacaaacactagtgagcccaaccagtttgttcaaccagcatggcagattgtcctgtgggcggctgcctatactgtaattgtcgtgacgagtgttgttggcaacgtggtggtgatgtggataatcctagcccacaagaggatgcggactgttaccaattatttcctggtgaacctagcgtttgcagaggccagcatggcagccttcaacacagtggtgaactttacttacgccgttcataacgaatggtattatggtttattttattgtaagtttcacaacttcttccccatagccgctgtatttgcctcgatctactccatgaccgccgtggcattcgacaggtacatggccattatccatccgctccagccgagactgagtgcgaccgctacaaaggtggttatttgtgtgatctgggttctcgcactgctgctggccttccctcaaggctactatagcaccacagagacaatgccaagtagagtcgtctgtatgatcgagtggcctgagcatccaaacaaaatctatgagaaagtttaccatatttgtgtgaccgttttgatctattttctgccgttactggtcataggatacgcttacacagtcgttggtatcaccctatgggctagtgagatcccaggcgatagctcagaccggtaccacgaacaggtcagtgcgaagcgaaaagttgtcaaaatgatgatagtggtagtgtgcaccttcgccatctgttggttgccctttcacatattctttttgctgccttacatcaatcccgatctgtatcttaaaaaattcattcagcaggtctaccttgcaattatgtggctcgccatgagttcaaccatgtataatcccatcatctattgctgccttaacgatcggttccggctcggattcaagcatgcctttaggtgttgtcctttcatatccgccggtgattatgagggacttgaaatgaaatccacgcgttacttgcaaactcagggatctgtttacaaagtgtcccggctcgagacaaccatatcaacagtagttggcgcacacgaggaggagcccgaagacggaccgaaagcaactccgtctagtttggatctcacttccaattgctccagcaggagtgactcaaagacaatgacagaatcttttagtttcagcagcaatgtgcttagttag

SEQ ID NO: 243332 - DNA, 936 bp, Artificial Sequence
  Description of Artificial Sequence: Synthetic coding sequence
atggacaacgtacttccggtggatagcgatttatcccccaatatctcgaccaatactagcgaacccaatcagttcgtccagccagcgtggcagatagtgctctgggcagccgcttacaccgtgattgtggttacatcagtggttgggaacgtggtagtcatgtggattattctcgctcacaaaaggatgcgcaccgtaaccaactattttttggtgaaccttgcttttgccgaggcgagcatggcggctttcaacacagttgtgaatttcacctacgcagtccataacgaatggtattacgggctgttttattgtaagttccacaactttttccctatcgctgctgtattcgctagtatctacagcatgacggcggttgcctttgatagatatatggccataattcatccactgcagcctagactttcggccaccgcaacaaaagttgttatttgtgtgatatgggttctagccctgctgttagccttcccgcagggctactattctactactgagacgatgccttcaagggtggtgtgcatgatagagtggccagagcatcctaataagatatatgaaaaagtctaccacatatgcgttacggtgttgatttacttcctgcccctgctggtgatcggctatgcttataccgtggtggggattacactctgggcctcggaaatcccaggcgacagtagtgatcggtatcacgaacaagtgtctgccaaaaggaaggtcgttaagatgatgatcgtggtggtatgcactttcgccatctgctggctgccattccacattttctttctgctcccctatatcaaccctgatttgtacctgaaaaagttcatccagcaggtctacctggccattatgtggctggccatgtcaagtaccatgtacaaccctatcatctattgctgtctgaatgaccgttag

SEQ ID NO: 243333 - DNA, 1197 bp, Artificial Sequence
  Description of Artificial Sequence: Synthetic coding sequence
atgggaacctgtgacatcgttactgaagcaaatatttcttccggtcccgagagtaatacgacaggaatcaccgcattctccatgccttcctggcagctggcgctctgggccacagcctacctggctctggtactggtggcagtgaccggcaatgccatcgtcatttggatcatccttgcccatcgaagaatgcgtacagtgacaaactacttcatcgtcaacctcgcacttgccgatctatgcatggctgcctttaacgctgccttcaactttgtgtatgcctcacacaatatatggtacttcggcagggcgttttgctatttccagaacctgttccctattaccgcgatgttcgtgtcaatttacagcatgaccgccatcgctgcggacaggtacatggctattgtccacccatttcagccaaggttaagcgctccgagcaccaaagcagtaatcgccggtatctggttagtagccttggccttagcgagccctcagtgcttttatagcaccgtcactatggaccaaggggcaactaaatgcgttgttgcatggcctgaagactctggcggaaagacactacttctgtatcaccttgtggtcattgcactgatctatttcttgcccctagctgtcatgtttgttgcgtattcagtgattgggttaactctgtggcgacgcgcagtccctggacatcaggcacatggcgctaacctcaggcacctccaagcaatgaaaaagttcgtcaagaccatggtgttggtggtgctgaccttcgccatctgttggctaccctatcacctatattttattctgggtagcttccaggaggatatatactgtcacaaattcattcagcaggtgtacttggctcttttctggctggccatgtcgagcacgatgtacaatccgattatttactgttgtctgaaccaccggtttcgaagtggattccggctggctttcaggtgctgcccttgggtgaccccaaccaaagaggataaactcgaactgactcctaccaccagcctctccacacgtgtaaaccggtgtcacacaaaggagacactatttatggcaggggatacagctccaagcgaagcaacatcgggagaagccggaaggccacaggatggctctggtttatggttcgggtatgggttactggcacccaccaaaacgcatgtcgaaatttag

SEQ ID NO: 243334 - DNA, 561 bp, Artificial Sequence
  Description of Artificial Sequence: Synthetic coding sequence
atgtttgtggcttatagtgtcatagggctgacactgtggaggcgggctgtcccaggacaccaggcccacggagccaatctccggcacttgcaagctatgaagaaatttgtgaaaacaatggtgctggtggttcttaccttcgctatctgttggctcccctaccacttgtattttatcttgggctcttttcaggaagacatctactgtcataagtttatccaacaggtgtacttagccctgttctggctcgccatgtcttccaccatgtacaaccccatcatctactgttgccttaaccatcggttcaggagcgggtttaggctggcttttcggtgttgtccatgggtgacccctactaaagaggacaaattggagctgactccaacaacctccctgtcaactagagtgaaccggtgccatactaaagagaccctctttatggctggcgatacagccccaagtgaagccacatcaggagaagccggtcgcccacaggacggatctgggctatggttcgggtacggtctactggcaccaactaaaacgcacgtggaaatctag

SEQ ID NO: 243335 - DNA, 1398 bp, Artificial Sequence
  Description of Artificial Sequence: Synthetic coding sequence
atggccaccctaccggctgccgagacatggatagatggaggcggaggcgtgggagctgatgcggtgaacctgaccgcctccctggccgcaggcgcagctactggagccgtcgaaactggatggcttcagctgctcgaccaggctgggaatctctcctccagccctagcgcccttggacttcccgtggcctccccagctccgtctcagccctgggccaacttgacgaatcagtttgtccaaccatcttggaggatcgcactgtggagccttgcatacggcgttgtcgtcgccgtcgcagttctggggaacctcatagtgatctggattattctggcccacaagcgcatgcggaccgtgactaattacttcctggtcaacctcgcgttctctgacgcaagtatggccgcatttaacacgctcgtcaattttatatacgccctccacagcgaatggtacttcggggcaaactactgtagatttcaaaacttttttcctatcacagctgtgttcgcaagcatctattccatgaccgccattgccgttgaccggtatatggcgattatcgatcccttaaagccccgactttccgccacggctacaaagatcgtgattgggtccatttggatcctcgcctttctgctagcgttccctcaatgtttgtattccaaaaccaaggtcatgccagggagaactctgtgttttgtccagtggccggaaggcccaaaacagcattttacctaccatatcattgtcattattctggtttactgttttcctctcttaatcatgggtataacttatacgatagtgggcattactctatgggggggtgagattcccggagatacatgtgacaaatatcatgagcaacttaaggctaagcgaaaggtggttaaaatgatgattatagtggtgatgaccttcgcaatttgttggctcccttaccacatctactttatcctcaccgccatctaccagcagcttaataggtggaagtacattcagcaggtttacctcgcatccttctggctcgcaatgtctagcactatgtataaccccataatatactgctgcttgaacaaacggtttcgtgccggtttcaagcgggctttcagatggtgcccattcatcaaggtttcatcatatgacgaattagagctcaagacaacccgcttccaccccaatagacagtcatccatgtataccgtgacccggatggaaagtatgaccgtggtcttcgacccaaatgatgcagacaccacccggtctagcaggaagaagcgcgctaccccaagggatccttcgttcaacggctgctcacggagaaactctaaatctgcctctgctaccagtagtttcattagtagcccatataccagcgtggacgagtactcttag

SEQ ID NO: 243336 - DNA, 5682 bp, Artificial Sequence
  Description of Artificial Sequence: Synthetic coding sequence
atgggaccgggttgtgaccttcttttacgcaccgccgctactattaccgccgcagccatcatgtctgatacagatagcgatgaagacagcgccggaggcggacccttctccctcgccggatttctgttcggaaatatcaatggggctggccagttagagggcgaatctgttctcgatgatgagtgcaaaaaacacctggcaggactgggtgccctcggactcggatctcttatcaccgagctaaccgctaacgaagaacttacaggaacagatggagcactcgtgaatgacgaaggatgggtgagaagtacggaagatgccgtggactactcagatataaacgaggtcgccgaggatgaaagtagaagatatcagcagacaatgggatccttacaaccattgtgccacagcgattacgatgaggacgattatgacgcagattgcgaagatattgattgcaagctgatgcctcctccacctcccccaccaggtccgatgaagaaggacaaggaccaagattcaatcacgggcgtgagtgaaaacggtgaaggaatcattcttccaagcataatcgcaccaagctctctggcttccgagaaagttgacttcagcagctcctcagacagcgagtcagaaatgggcccacaggaagctacccaagccgaatccgaggacggaaagttgaccctgcccctggctggtattatgcagcatgatgccactaagcttctaccgtccgtgacggagttattccccgagtttagacctggtaaagtgctgcgtttcctgagactgtttggccctggcaagaatgtgccgtctgtctggaggagcgcgaggaggaaaaggaagaaaaagcatagagaacttattcaggaggaacagatccaggaggttgagtgctcagtggaaagcgaagtgtcccagaaatctctttggaactatgattacgcacccccacccccaccagagcaatgcctgtctgacgatgagatcacgatgatggccccagtggaatctaagttctcgcagtcaacaggtgacatagataaggtaaccgacactaagccgagagttgccgagtggagatacggtccagcgcgtctgtggtatgacatgctcggcgtccccgaggatggcagcggtttcgattacggattcaaattgaggaagactgagcacgaacccgtgattaagagccgtatgatcgaagagtttcggaaattagaagagaacaatggaacagacttgctggcagatgagaacttcttgatggtcactcagcttcactgggaagatgacattatctgggacggtgaagatgtgaagcacaaaggcaccaagccccaaagagctagcctggccggatggctgccgtcttctatgacgaggaatgccatggcctataatgtgcagcaaggctttgctgcgacgctcgacgacgacaagccatggtattccattttccctattgacaatgaggatttagtgtacggcaggtgggaggacaacattatatgggacgcccaggctatgccccgattgctagaaccacccgtgctcacactggaccctaacgatgaaaatctcatactggagatccccgacgagaaggaagaagcaacttccaattctcctagcaaagagtcaaagaaagaaagcagccttaagaaatcacgcatactactgggcaaaaccggggtgattaaggaggaacctcaacaaaacatgtcccagcccgaagtgaaagatccttggaacctcagcaacgacgagtactactaccccaaacagcagggcctgcggggaaccttcggaggaaacatcatacagcactcaattcctgctgtcgagcttcggcagccatttttcccaacccacatgggcccaattaagctgaggcagtttcaccgccctccactaaaaaaatactctttcggcgctctctcacagccgggtccacactctgtgcaacccctgctgaaacacataaagaaaaaagccaagatgcgtgagcaggagcgacaagccagcggcggaggcgagatgtttttcatgagaacccctcaagacttaaccggcaaggacggggatctgatactggctgagtactctgaggagaacggcccactgatgatgcaggtcgggatggccaccaaaattaaaaattactataaaagaaagcctggcaaggaccccggagccccagattgcaaatatggcgaaacggtgtactgtcacacttctcctttcttgggatccctgcaccccggtcagttgctgcaagcctttgagaacaacctgttcagggcccctatttacttgcacaagatgcctgagaccgatttcctgattataaggactcgacaagggtactacattcgagagctggtggacatcttcgtagtggggcagcagtgccccctttttgaggtgcccggacctaactcaaagagagctaatacccatatcagggacttcctgcaggttttcatatacaggctgttttggaaatcgaaggatcgccctagacggatacgcatggaagacatcaagaaggcgttccccagtcactctgaatcttccattagaaaacgccttaaactgtgcgctgacttcaaacgcactgggatggatagcaactggtgggtattgaagagtgactttcgattgccgactgaagaggaaattcgggcaatggttagccctgaacagtgctgcgcctattacagcatgattgccgcagagcagcggctcaaagacgctgggtacggggagaagtcattctttgctccggaggaggagaacgaagaagacttccaaatgaaaattgatgacgaggtgagaacagccccatggaacactaccagggcgtttattgcagctatgaaaggcaagtgcctcctggaagtgacaggcgttgcagatcctactggatgcggcgagggatttagttacgttaaaatccccaacaagccgactcaacagaaggatgacaaagagccccagcctgtcaagaagaccgttactggcacagatgccgacctgcgcaggctgagtctgaagaatgccaaacagctgctgcgtaagttcggcgtgcccgaggaagaaatcaagaagctgtctaggtgggaggtgatcgatgtggtgagaaccatgtcaaccgagcaggctcgttccggggagggccctatgagcaagttcgcacgaggctcacgcttctccgtcgccgaacatcaggagagatacaaagaggagtgtcagcggatcttcgatctccaaaataaggtgctgtcctccaccgaagtgctctcaactgacacagactcgagctctgcagaagatagtgacttcgaagagatgggcaaaaatatagagaacatgttgcagaacaagaaaaccagctcccagctgtctcgggaacgtgaagaacaggagcgtaaggagcttcagaggatgctgcttgctgctggatctgcagcctcaggaaataaccatcgggacgacgacacagcttccgttaccagcctgaactcctccgccacaggaagatgcctgaagatctaccgcacttttagggacgaggaaggcaaagaatacgtcagatgcgagaccgttagaaagccagctgtgatcgacgcatacgtgcggatccggactactaaggatgaggagtttatccgaaagtttgcgctgttcgatgaacagcatagagaagagatgcgtaaggagagacgcagaattcaggaacagttgcggagacttaagaggaatcaagaaaaagaaaagctgaaaggcccaccagaaaaaaaacccaaaaaaatgaaggaacgccctgacttgaagttaaaatgtggcgcatgcggagcaatcggacacatgcgaacgaacaagttttgtcctctctattaccagacaaatgctccaccgtcaaatcccgtcgccatgacagaagaacaggaggaagagctggagaagacagttatccacaacgacaacgaagagcttattaaggtggaaggaaccaaaattgtactcgggaaacagcttatcgagagtgctgacgaggtgaggcgtaagtccctagtcctcaaattcccgaagcagcagttgccccctaagaaaaaacggagagtggggaccactgtgcactgtgactacctcaatagacctcacaagagcattcatcggaggcgaaccgaccctatggtcactctgtcctcaatattggaaagtattataaatgacatgcgggatctgcccaacacataccccttccatacgcccgtcaacgccaaggttgtgaaggactattacaagattatcaccaggccaatggacctccaaaccttgcgcgagaacgtccgcaagaggctgtacccgtcacgggaagaatttcgcgagcatctcgagctcattgttaagaattcagccacctataatggacccaaacatagcttaacccagattagtcagtccatgctggacctgtgtgacgagaagctaaaggagaaagaggacaaacttgctagactggagaaggcaattaacccactcttagatgacgatgaccaggttgcttttagttttatacttgacaatatagtcacccagaaaatgatggctgtgccggatagctggcctttccaccaccccgtcaacaagaaatttgtgcctgattactataaagtcatagtgaatcctatggatctcgagactatcagaaaaaatatttcaaaacacaaatatcagtctcgtgagagcttcctggacgacgtgaacctgatcttggccaatagcgtgaagtataacgggcctgagagtcagtatacgaagacagctcaggagatcgttaatgtatgctaccagacgctgacggagtacgatgagcatctaacccagctcgagaaagatatttgtaccgccaaggaagctgccctggaagaggctgaactcgaaagtctggaccccatgaccccgggaccatacaccccccagccaccagacttatacgacacaaacacttcgctgagcatgtctcgggatgccagtgtttttcaggacgaatccaatatgagtgtgttggacatcccgagcgccactcccgaaaaacaggtcacccaagagggtgaagacggagatggcgacctcgccgacgaggaggaaggaaccgtgcagcagccccaggcatctgtgctgtatgaagacctactcatgtcagaaggagaggacgatgaagaggatgccggatccgacgaggagggcgataaccccttcagcgcaattcagctcagtgagagcggatccgattctgacgtcggttctgggggtatccggccaaaacaacctaggatgttgcaggagaacaccaggatggatatggagaacgaggagtctatgatgtcatacgaaggagacggcggtgaggcaagtcacggattggaggattctaatatcagctacggctcatacgaagagcccgatccaaaaagcaatacacaggataccagcttctcctcaatcggaggatatgaggtctccgaagaggaggaggacgaggaagaagaagagcagcggtccggacctagcgttttaagccaggtgcatctctccgaagacgaggaagactcagaggacttccactcaatcgccggagattcggatctggactcagatgagtac

SEQ ID NO: 243337 - DNA, 5618 bp, Artificial Sequence
  Description of Artificial Sequence: Synthetic coding sequence
atgggacctggatgtgatctgctgctgaggaccgccgctacaatcactgccgcagccatcatgtctgataccgattctgatgaggactctgcaggcggtggtccgttctccttagcagggtttcttttcgggaatattaacggcgcaggacagcttgaaggggagtccgtgctggacgatgagtgcaagaagcatctcgctgggctgggcgctttaggcctcggaagtctgataacagaattaacagccaatgaagagctgacagggacagacggtgcactcgtgaacgacgaagggtgggtacgttccacagaagatgctgtggattacagtgatatcaacgaggttgcagaggacgagagtaggagataccagcagacaatgggctccctgcagcccttatgtcattctgattatgatgaggacgactatgacgcagattgcgaagatatcgactgtaagcttatgccacctccccctcctccccctggaccaatgaagaaggacaaagatcaagacagcatcaccggggagaaggtggactttagtagctcttctgatagtgaaagcgagatgggcccacaagaggctacacaggctgagagtgaggacggaaagctgaccctccctctggccggaataatgcagcatgatgccaccaaattgttgcccagtgtgacagagctgttccccgagttccgcccaggtaaggtgctgcgcttcctgagactgttcgggcctggtaaaaacgtaccctcagtctggcggagcgcacgcaggaagagaaagaagaaacacagggagctgatacaggaagagcagatacaggaggtggagtgttccgttgagtccgaagtgagtcagaagtccttgtggaactatgactacgcaccccctccacctcctgagcagtgcctttcagatgacgaaatcacgatgatggcccctgtggaatctaagttctctcagagtacaggcgacattgacaaggtgacagataccaagccccgtgttgccgagtggcgatatgggcctgcaaggctgtggtacgatatgctgggcgtgcctgaggacgggagcggtttcgattatggctttaagcttagaaagacagagcacgagcccgttataaagagtaggatgatagaggagtttaggaaactcgaggaaaataacggcaccgacttgctcgcagacgaaaacttcttaatggttacacagctgcactgggaggatgacataatatgggatggggaagatgttaagcacaagggtacaaagccgcagcgcgcttcactggcaggatggctgccttcatctatgacacgaaatgctatggcctacaatgtacagcagggtttcgccgctaccctggacgatgataagccttggtatagcatattccctattgataacgaggacctggtttacggcagatgggaagataacatcatctgggacgctcaggccatgccgaggttgttggaaccccctgttctgacattggatcctaatgacgagaatctgatcttagagattcccgacgagaaagaggaagcaacaagcaattcaccttctaaggagtccaaaaaggagagctcactcaaaaagagccggattttattaggaaagacaggcgtgattaaagaggagccccagcagaacatgagccaaccggaggtcaaagatccttggaatttgtctaatgatgagtactattaccctaagcaacaaggtttgaggggaactttcggcggaaatataatccaacactcgattcctgcggtggagctgcgacaacctttctttcctacacacatggggcctattaaactgaggcaattccatcgcccaccacttaagaaatatagcttcggcgcactatcccagccgggaccacactctgtacagcctctgctgaaacatattaaaaagaaagctaagatgcgcgaacaggaacgccaggcctcaggaggaggagagatgttctttatgagaactcctcaagacctcacagggaaggatggagatctcatccttgctgaatactccgaagagaatggaccactgatgatgcaggtcggtatggctactaaaataaaaaattattacaagcggaagccagggaaggatcctggcgcacccgattgcaaatacggtgagacggtgtactgccacacctccccattcctcggctcactgcacccaggacagctgctgcaggctttcgagaacaacctgtttagggcccctatatatctgcataaaatgcctgagacagatttcctaatcatacggacacgccaagggtactacattcgggagctcgtggacatattcgtagttggccagcagtgcccactatttgaagtgcccggacctaacagcaaaagagctaatactcacatcagagattttctacaggttttcatctacaggcttttctggaagtctaaagacaggcctcggagaattcggatggaagacatcaagaaggcattcccatctcacagcgaaagctcaatcagaaagagactgaaactctgcgccgattttaagaggaccgggatggattccaactggtgggtgctgaagagtgatttccgcctgcccacggaggaggaaatccgtgcaatggtatccccagaacaatgctgtgcgtactacagcatgattgcagccgaacagagactcaaagacgcgggttatggcgagaaaagttttttcgctccagaggaagagaatgaggaggactttcagatgaagattgacgacgaagtccgaaccgcgccttggaataccacacgcgctttcattgccgctatgaagggtaagtgtctgctagaagttacaggggttgccgaccctacaggatgcggagaaggattcagctatgtaaagatacctaataagcctacccagcagaaggatgataaagagccacaaccagtgaagaagactgtgacaggaacagacgcggacctaaggaggctatctttgaagaacgcgaagcagctcctccgcaagtttggcgtgcccgaagaggagattaagaagttgtctaggtgggaggtcatcgatgtggtgaggactatgtccactgaacaggccaggtctggcgagggccctatgagcaagtttgccagggggtccaggttctcagtggcagaacaccaggaacggtataaagaggagtgccaaagaatatttgatctgcagaacaaggtcttaagttctacagaggtcttgagtacagatacagactctagctccgcagaagattctgacttcgaagaaatgggcaaaaacatcgaaaatatgctccagaacaagaagaccagcagccaactctctcgcgagcgcgaggagcaagaacggaaggagctgcaaaggatgttgctggcggcaggcagcgctgcctccggaaataaccacagggatgacgacactgcaagcgtgacgtcactgaattcttcagcaacagggaggtgtctgaagatctacagaacattccgagacgaggagggcaaggaatatgtaaggtgcgagactgtgcgtaagcctgcggtgattgacgcgtacgtgagaattagaaccacaaaggacgaggagtttattagaaaattcgcactcttcgacgaacaacacagggaggaaatgcgcaaagaacgtcgccgaatccaagagcagctgcggagactgaagcggaaccaggagaaagagaaattgaagggcccaccagagaagaagcccaagaagatgaaggagcgacctgatcttaagctgaaatgtggcgcttgcggcgctattggccacatgcgaactaacaaattctgtccgctgtattatcaaaccaatgctcctcctagcaaccccgtcgccatgactgaagaacaagaggaggaattggaaaaaaccgtgatccacaatgataacgaggaactcatcaaggtggagggaaccaagatcgtcctaggcaagcagctaatagaatcggcagatgaagtgcggaggaaatctttggtgctgaagttccccaagcagcagttgccacctaagaagaaacgacgagtcggcaccaccgtccactgcgactaccttaatcgccctcataaatcaattcacaggaggcgaacagaccccatggtcactctctcttctatcttggagagtattatcaacgacatgcgcgacctgcctaacacatatcccttccacacacctgtgaacgcaaaagttgttaaggactattataaaatcatcactagacctatggacctgcagacactgcgggaaaatgtcaggaaacgactgtacccctcccgcgaagagtttcgcgaacatttggaactgatcgtcaagaactccgccacatacaacggaccaaagcacagcctgacccagatttctcagtccatgttagatttatgcgacgagaaattaaaagagaaagaggataagctggctagactggagaaggctataaatccacttctcgacgatgatgatcaggtggcgttttcctttattctggacaacatagtaacccaaaagatgatggccgtacctgactcgtggcccttccaccaccccgttaataagaagtttgtgcccgattattataaggttattgtgaacccgatggacctggaaacaatccggaagaatatctctaaacataaatatcagtcgagagagtcgtttctcgacgacgtgaacctgattctagctaacagcgtgaagtataacggcccagagtcccagtacaccaagactgctcaagagattgtgaacgtgtgctatcagaccctgaccgagtatgatgagcacctgacccagctggagaaggatatctgcaccgccaaggaagctgccctggaagaagccgagctggagtccctggatccaatgacgccgggtccctatactccacagcctccggatctgtatgatactaacactagcctgtctatgagtcgggatgcttccgtgtttcaagatgaaagtaacatgagtgttctggatattccttcagccacccctgagaaacaggtgactcaagaaggcgaagatggtgacggagacctggctgatgaagaggagggtacagtgcagcagccccaggctagtgtcctgtatgaggacctactaatgtctgagggcgaagacgatgaggaggatgccggatctgatgaagagggggataacccttttagcgccatccagttgtccgagtctggatcggacagtgacgttggaagcgggggaattcggcctaagcaaccccgaatgctccaagagaacactagaatggacatggaaaacgaggagtcgatgatgtcgtacgagggagacggcggagaggctagccatggccttgaggattcaaatattagctacggttcttatgaagaacctgatcccaaatctaacacccaggatacttcattctcctctatcggtgggtacgaggtgtctgaagaagaggaggacgaggaagaagaggaacagcgctcaggtcccagcgttcttagccaggttcacctgagtgaggacgaagaggactctgaagatttccattctatcgctggtgactcagacctggattccgatgagta

SEQ ID NO: 243338 - DNA, 1632 bp, Artificial Sequence
  Description of Artificial Sequence: Synthetic coding sequence
atgaccgaagaacaggaggaggagctggagaagaccgtgatccataatgataatgaggagttgattaaggtggaaggaacaaaaattgtcctgggcaaacaactgattgagtctgcggatgaggtgaggaggaaaagcctggtgctgaagtttcctaagcaacaactccctccgaaaaaaaagcgacgagtcgggaccaccgtccactgtgattacctgaacagacctcacaaatccattcaccggcgtcggaccgatcctatggtaaccttgtccagcatccttgaatccataataaatgacatgagggatttgcccaatacttaccccttccatacccccgtgaacgccaaagtggtgaaagattactacaagatcattacccggcctatggatctccaaaccctcagagaaaatgtccgcaaaagactgtatcctagtagggaggagttccgagaacacctcgaactgatagtaaaaaactccgctacttataatggccctaaacactcattgacacagataagccagagcatgctggatctttgtgatgagaagttaaaggagaaggaggataaactcgccaggttagaaaaagccatcaatcccctattggacgatgatgaccaagtggccttttcgttcatcttggacaatattgttacccagaaaatgatggccgtgcctgacagctggcccttccatcaccctgtgaacaaaaaatttgtccccgattattacaaggtgattgtgaaccctatggacttagagactatcaggaagaatatctctaagcacaaataccagagccgagaatcatttttggatgacgtcaacttaatattagctaatagcgtaaaatataatggtccagagtctcaatatacaaaaacggcccaagagatagtgaacgtgtgctatcagactctaacagaatatgatgagcaccttacacagctggagaaagacatctgcaccgctaaggaggcagcattagaagaggcagaactggaatccttagaccctatgactccaggaccatataccccccaagccaaacctccagacctgtatgataccaacacgtccttgtccatgtctcgcgacgcctccgtcttccaggacgagagtaatatgtcggtactcgacatcccgtccgccactcccgagaagcaggtcacgcaaatgaggcagggcagaggtcgcctgggagaggaagactccgatgtggacatcgaaggttatgatgatgaggaagaagacgggaaacctaagacgccagcacctgaaggagaagacggggacggagatctcgcagatgaagaggaaggtaccgttcagcagccgcaggccagcgtgctgtatgaggacttgctgatgagtgagggagaggatgacgaagaggatgcaggatccgatgaggagggcgataaccccttctctgctatacagctcagtgaaagcggatccgatagtgacgtgggtagcgggggtatcagaccaaagcagccacgcatgctccaggagaataccaggatggatatggaaaatgaagagtctatgatgtcatacgaaggcgacggcggagaagctagccacggattagaagattcaaacattagccatcaatag

SEQ ID NO: 243339 - DNA, 5687 bp, Artificial Sequence
  Description of Artificial Sequence: Synthetic coding sequence
atgggaccaggatgcgatttgctgttacgcactgctgcaacaattacagctgctgccattatgtccgacaccgacagtgacgaggactctgctggcggtggaccgttctctctcgctggctttctctttggtaacattaatggcgctggccagctggaaggagagagcgttcttgacgatgaatgtaaaaaacacttagctggcctcggcgcactgggcctgggctctcttattactgaacttacggcgaacgaggaattaactggcacagacggtgccctggtgaatgatgagggctgggtgcggagcaccgaggacgccgtggactactccgacatcaatgaggttgcagaagacgagtccaggcgctaccagcaaacaatgggatctttgcagccgctgtgccattccgattatgatgaggacgattatgatgcagactgtgaggacatcgactgcaagctgatgccgccacccccacctccacccggaccgatgaaaaaggacaaagaccaagattctattactggagtatcagaaaacggggaaggcattattctcccgtctattatcgccccaagttctttagcatccgagaaagtcgactttagctcaagttctgatagcgagtcggagatgggaccgcaggaagccactcaggcagaatctgaggacgggaagttgaccctgcctctggcgggaatcatgcagcacgacgcgactaaattacttcccagcgtcactgagttgttccctgagttccgacccggtaaagtcctccggtttctccgattgttcgggcctgggaaaaacgtgccctcagtttggcgctcagcccgacgtaaaagaaagaagaagcatcgcgagctgatccaggaggaacagatccaggaagtcgaatgttctgttgagtccgaggtctctcaaaagtctttgtggaattacgactatgcaccccctcctccacctgagcagtgtcttagcgacgacgagataaccatgatggcccctgtggaaagtaagttttcgcaatctaccggtgatatcgataaggtgaccgacaccaagccccgtgtagccgagtggagatatgggcctgcaaggctgtggtatgatatgctgggtgtgcctgaagatgggtctggatttgactacggtttcaagctgaggaaaacagagcatgaaccagtcatcaaatccaggatgatcgaggagttccgaaaactggaagagaacaatggcaccgacctactagctgacgaaaactttctgatggtcactcaactgcactgggaggatgacatcatatgggatggcgaagacgtaaaacacaaaggcacaaagccccagagggcctccttggcaggttggctccctagttccatgacccgcaacgctatggcttacaacgtccagcagggtttcgctgctacactcgatgacgataagccctggtactcaattttcccgatagataacgaagacctggtatatgggaggtgggaagataatataatctgggacgcccaagccatgcctaggctcctggagcccccagtgctgacgcttgaccccaacgacgaaaacctgattctcgaaatacctgatgagaaggaagaggcgacctctaatagcccctctaaagagtcaaagaaggaatctagtctgaagaaatctcggatcctgctgggtaaaactggcgtcattaaagaggagcctcagcagaatatgtcacagcccgaggtaaaggatccatggaacctgtccaacgacgaatactactacccaaaacaacaggggctgaggggaactttcggaggcaacattattcagcactcaatcccagcagttgagctgagacagcccttctttccaactcacatgggccctatcaaactcagacagttccatcggcctccccttaaaaaatactcttttggagctctctcgcagcccggacctcactctgttcagcccctgctgaaacatatcaaaaagaaggctaaaatgagggaacaggagaggcaggcttcaggcggaggagagatgttttttatgcggacaccgcaggacctgaccgggaaggacggagaccttattctggctgagtattccgaggaaaatggtcccctcatgatgcaagtggggatggccaccaaaattaagaattactacaaaagaaaacccggtaaggatcctggagcccctgactgcaaatatggggaaacggtgtattgtcataccagcccgttcctcggcagtcttcaccccggtcagctgctccaggctttcgaaaacaatcttttccgcgcacctatatatttgcataaaatgccagagaccgatttcttgataatccggacgcgccaaggctattatattcgggaactcgtcgatattttcgttgtgggacagcaatgcccgttattcgaagtccctggccctaattccaaacgagcgaatactcatatccgcgattttcttcaggtttttatttaccgactgttctggaagtcaaaggacagaccgcgacggatcaggatggaggatattaagaaagcatttccatctcactcagagtctagcatccggaaaaggttaaagctgtgcgcggacttcaagagaactggcatggattccaactggtgggttctgaagtccgactttcggctcccgacagaagaagaaattcgggcaatggtgtcacctgagcagtgttgcgcctactattcaatgattgctgccgagcaaagactgaaggacgccggatatggcgaaaagagtttcttcgcccctgaggaagaaaatgaagaagatttccagatgaagattgatgacgaggtccgaactgcaccctggaacacaacccgggcatttatagccgctatgaaaggtaaatgcctgctggaagttacaggagtggccgaccctacaggttgtggcgagggatttagttatgttaagatccctaacaagccaacacagcaaaaggatgataaggagccccagccagtgaagaaaactgtgactggcacggatgccgacctgaggcgactgagcctcaagaatgccaaacagctgctcaggaaatttggggtcccggaggaagaaatcaagaagctgtcccggtgggaggtgattgatgtcgtgaggacgatgtcaacagaacaggcacggagcggcgaaggacctatgagcaaatttgccagaggcagcagattctccgtggctgaacatcaagaacggtacaaggaagagtgtcagagaatatttgacctccagaacaaggtgctgtcgagcaccgaggtattgtctaccgacaccgactcctctagtgccgaggattccgattttgaagagatgggaaagaacattgagaacatgcttcaaaacaagaagacaagcagtcagctttctcgcgagcgcgaggagcaggagcgaaaggagcttcagcgtatgctgcttgcagctggatccgccgcttccggaaacaatcacagagacgacgatacagctagcgtgacttccctgaattctagcgccactggacggtgcctgaagatttacaggacatttagggacgaggagggcaaggagtatgttcgctgtgagactgttaggaaaccagccgttatcgatgcttacgtccgcattcggaccacgaaggatgaagaattcatccgcaaatttgctctattcgacgagcaacatcgcgaggaaatgcgcaaagaaaggagaagaatacaggaacaattgcgacggttaaaacgcaatcaggagaaagaaaaactcaaaggtccaccggagaagaagcccaagaagatgaaggaacgcccagacctgaagctcaaatgtggcgcttgtggagcaattggacacatgaggaccaacaagttttgtccactgtactaccagactaatgcccctcctagtaaccccgtggccatgacagaagaacaggaggaagagctggagaagacagtgattcataatgacaacgaggagctgatcaaggttgaagggaccaagattgtgcttggcaagcagctgattgagtccgcggacgaggtgcgtcgtaaaagccttgtgcttaaatttccaaagcagcaacttccaccaaagaagaaacgaagagtgggtaccacggtacactgcgattacttaaacaggccccataaatccatccaccggagaaggaccgaccccatggtgacacttagctccatcctagaaagcataatcaacgacatgagagatctgcccaacacttacccgttccacaccccagttaacgctaaagtcgtaaaagattattacaaaattataacgaggccaatggatctgcagaccctgcgcgagaatgtgaggaaacgtctctatccatccagagaggaattcagagagcatctagaactgatcgttaagaattccgcaacttacaatggcccaaagcacagcctgacacagatatcccagtccatgctggatctatgcgatgaaaaactaaaagaaaaggaggataagttagcccgtcttgagaaggccatcaacccgctgctggacgatgatgatcaagtagcattcagttttattctcgacaacatcgtgactcagaaaatgatggcagtcccagatagttggcccttccaccaccctgtgaacaaaaaatttgtgccagattattacaaggtcattgtgaatcctatggatctagaaaccattcgcaagaacataagcaagcataagtaccagagcagggagagttttctggacgatgttaacttaattcttgccaattccgtgaagtacaacggccctgagtcccagtataccaagaccgcccaggaaatagttaacgtctgttaccaaacactgacagagtacgacgaacacctgactcagcttgagaaagacatttgtacagctaaggaagcagccctggaggaggcggagctggagagtctggacccaatgacacccggaccctatactccccaggcaaagccacccgacctgtatgatactaacacctccctttcaatgagcagagacgcttcagtctttcaggatgagtctaacatgtctgtcctggacattccctctgcgacccccgagaaacaggtgactcaggagggggaagatggagacggcgacctggccgatgaggaggaagggaccgtgcaacaaccacaagccagtgtgctgtacgaggatctgcttatgtccgaaggtgaggacgatgaagaagacgccggtagtgatgaagagggtgataatccattttctgccattcagctgagcgagtctgggtcagatagcgacgtcgggagtggcggaataagaccgaaacagcctcgcatgctgcaagagaacaccaggatggatatggaaaatgaggagtccatgatgagctatgaaggagacggcggagaagcatctcacggactggaggacagcaacatttcatacgggagctatgaggaacctgaccccaagagtaatacacaggacacatcattctccagtatcgggggatatgaggtgtctgaggaagaggaggatgaggaggaggaggagcagcgatctggaccttccgtattgtctcaggtacacctgagtgaagatgaggaggactcagaagattttcactccattgccggagacagcgaccttgattcagatgaata

SEQ ID NO: 243340 - DNA, 5720 bp, Artificial Sequence
  Description of Artificial Sequence: Synthetic coding sequence
atgggacctggttgtgatctcctgcttcgcaccgctgcaactattactgccgcagcgattatgtctgatacagacagcgatgaagattctgcgggaggcggtccctttagcctcgctgggtttttgtttgggaatatcaacggggctgggcagctggagggcgagagtgttttagatgacgaatgcaaaaagcatctggcaggtcttggggctttgggcttaggaagcctgattaccgaactgacggctaacgaggaactcacggggaccgacggtgctctggttaacgacgaagggtgggtgcggtcaaccgaagacgcagtagactatagtgacatcaacgaagtggccgaggacgagtccaggcgctaccagcagactatgggctcgttacagcctttatgtcacagtgactatgacgaggacgactatgatgccgattgcgaggatatcgactgcaagctcatgccacctcctccacctccacctggtcctatgaagaaggataaggatcaagactcgataaccggggaaaaagtggatttctcgtctagctctgactccgaatctgaaatgggtccacaggaggctacacaggccgaaagcgaggacggaaagctcacactccctcttgccggaataatgcaacacgatgccaccaaactgctcccttctgtaacagagctcttccctgagtttcggccaggcaaagtccttaggttcttgcggctgtttggaccaggcaagaatgtgcccagcgtgtggcgttcagccagacgaaagaggaagaaaaaacacagagagctgattcaagaggagcagatccaggaggtggagtgctccgtcgagagcgaagtgtcacagaagtccctttggaattacgactatgctccgcctccccctccggaacagtgtttgagtgatgacgaaatcacaatgatggctccggtggagtccaagttcagtcagtcaacaggagacattgacaaagtaacagacaccaagcctagggtggccgaatggagatacgggcctgccaggctatggtacgacatgctgggtgttcccgaggacggctccgggttcgattatggctttaagctgcgaaagacagagcacgaaccggtcattaaatcccgtatgattgaagaatttcgcaaattagaagaaaacaacggtaccgatctactagcagacgagaatttcctcatggtaacacaattgcactgggaggatgatatcatatgggatggagaggacgtgaaacacaagggaaccaagccccagagggcgtccctcgctggctggctcccctcaagcatgacccgcaacgctatggcctataatgtccagcagggattcgctgctaccctggatgacgataagccctggtacagcattttccctatagataacgaagacctggtgtacgggcgatgggaggataacattatctgggacgcccaggcaatgccacgcttacttgagccaccagtgctcacactcgatccaaacgacgagaacttgatcctcgagatcccagacgaaaaggaagaagcaacatctaactctccgtccaaagagtcaaagaaagaatcatctttgaaaaaatccaggattctcctcggaaagacaggggtaattaaggaggaacctcagcagaatatgtcacaaccagaagtcaaagacccttggaatttaagcaacgacgaatactattatcccaaacagcagggattaagaggaacattcgggggaaatataatccagcatagcattcctgcagtggagctcaggcagcctttttttcccacccacatggggcctataaagctacgtcagttccaccggcctccgctgaagaaatattcttttggcgcactctcacagccgggtccccactccgtgcagcccctgttaaagcatatcaagaagaaggccaagatgagggagcaagagcgtcaggcttctggaggtggtgagatgtttttcatgcggacccctcaggacctgacaggcaaagatggcgatttaatccttgccgagtacagtgaggagaatggaccactgatgatgcaggtgggtatggccactaagattaagaactactataagcggaaaccgggtaaagaccctggagccccagactgcaagtacggggagaccgtgtactgtcatacatcaccgtttctgggatccctgcaccctggacagcttctccaagcctttgaaaataaccttttccgagcccctatctacttgcacaagatgcccgagaccgacttcctgataataaggacaagacaaggatattatatacgggagctggtggacatattcgtcgttggccagcagtgtccactgttcgaggtccccggacccaactccaagagagctaacacacacatacgagatttcctgcaggtttttatataccgcctgttttggaaaagcaaagacagacccagaagaataaggatggaggatatcaagaaggcgttcccttcccactcggagagtagcattaggaaaaggcttaaactgtgcgctgacttcaaacggactggtatggattcaaactggtgggttctcaaatcagactttcgcctgcctaccgaggaagagatcagggctatggtgtcgcctgagcagtgctgtgcttactacagcatgatcgccgcagaacagaggttgaaggacgctggttatggcgaaaaatctttctttgcacctgaagaggagaacgaggaggactttcagatgaaaatagacgatgaggtcaggacagcgccttggaacacgacacgagccttcatcgctgccatgaaaggcaaatgcctgctggaagtaactggggtagccgatcccaccggctgtggtgaaggtttctcttacgtaaagattcctaataaaccgactcaacaaaaagatgacaaggagccacagcccgtgaagaaaactgttaccgggaccgacgcagatttacgcaggttgtccctgaagaacgctaagcagctgctgcgtaaattcggtgtgcccgaggaagagattaaaaagttgtctcgctgggaagtcatcgatgttgttagaactatgagcactgagcaggcacgttcaggggaaggtcccatgtccaaattcgcccgaggcagcaggttctccgttgcagaacatcaggagaggtataaggaggagtgccaaagaatcttcgatctgcagaataaagtgctgtcctctacggaggtgttgtctactgacaccgactcgtcctctgctgaggatagcgacttcgaagagatgggcaagaacatagagaacatgctacaaaacaagaaaacctcatcacagctatccagggagcgcgaggagcaggagagaaaagagcttcaacgcatgcttctagcagcgggatccgctgcctccggcaataaccaccgtgacgatgacaccgctagtgtgacctcactgaacagctctgcaaccgggagatgccttaaaatctatcggaccttcagggatgaggaagggaaagagtacgttaggtgcgaaaccgtcaggaaacccgctgttattgatgcctacgtccggatcaggaccaccaaagatgaggagttcatccgcaagtttgccctgtttgacgaacagcatagggaggagatgcgcaaggagcgcagacgcatccaggagcagctaaggcggttgaagcgcaaccaggagaaggagaagcttaaaggaccccctgagaaaaaacccaagaaaatgaaggagcgcccagatttgaaacttaaatgtggggcttgtggcgctatcggacacatgagaactaacaaattctgcccactgtactaccaaaccaatgcaccaccctccaacccggtggccatgaccgaggaacaggaagaggagctggagaagactgtaattcataacgacaatgaagaacttattaaggtggaggggacaaaaatagtgttgggcaaacagcttatcgaatccgctgatgaggtgaggaggaaatcacttgtgctgaaatttccaaagcagcagctgccacccaagaagaagcgcagagtggggactacggtccattgcgactacttgaaccgaccacataagtcaatccatcgcaggagaactgatcctatggttaccctgtcatcgatcttagaatcaattataaacgatatgagagaccttcccaatacatatcctttccacacccctgtaaacgcgaaggtcgttaaggattattataaaatcattacccgcccaatggatctgcagactctgcgggagaacgtgcggaagcggttgtatccctcaagagaagaatttagggagcatctcgaactgatcgtgaaaaactcggccacgtataatggtcctaagcattctcttactcagatttcacaaagcatgctcgacctgtgtgatgaaaagcttaaggagaaggaagacaaactcgctcgcctcgagaaggctattaacccgctattggacgatgacgaccaggtcgcctttagctttattctcgataatatagttacacaaaaaatgatggcagtgccggacagctggccattccatcaccccgtgaacaagaagtttgttccagactactacaaggtgatcgtgaaccctatggatctcgagaccattcgtaaaaatatcagtaagcataagtatcaaagtagagagagcttcttagatgacgtaaacttgatcttggccaacagtgtaaaatacaatggacccgagtcccagtacacaaaaaccgctcaggaaatagtcaacgtgtgttatcagaccctgactgagtacgacgagcacctgacgcagctggagaaggacatatgcaccgcaaaggaggctgcactggaggaggcagagcttgaatctcttgaccccatgacccccggaccctacactccacagccacctgatctgtacgacaccaatacctcgctgtcaatgagtcgcgatgcatccgtgttccaggatgaaagcaatatgtccgtgctcgatatcccatcagccaccccagaaaaacaggtgactcagatgcggcaaggccgaggtagactgggagaagaagacagcgacgtggacatcgagggctatgacgacgaggaagaggacgggaaaccaaaaactccggctcctgaaggggaggacggtgacggggatctcgctgatgaggaggaggggacagttcaacaaccccaagcctcagtcctctacgaggatcttctgatgagcgaaggagaagacgatgaggaagacgcaggttcggacgaagagggggacaaccctttcagcgcaatacagctgtcagaaagcggaagtgatagcgacgtgggaagcggaggcatccgccctaaacaaccacgtatgctgcaggagaacacaagaatggatatggagaacgaagaaagcatgatgtcatatgaaggggacggaggagaagcctcccacggtctggaggacagtaacatttcctatggatcctacgaagagccggacccgaaaagcaacactcaagatacaagtttttcaagcatcggaggatacgaggttagcgaggaggaagaggatgaagaggaggaggaacagagatccggcccttccgtgctgagtcaggtgcacctgtccgaagatgaagaggacagtgaggactttcactccattgccggagatagtgaccttgattccgacgaata

SEQ ID NO: 243341 - DNA, 897 bp, Artificial Sequence
  Description of Artificial Sequence: Synthetic coding sequence
atgactgaggagcaggaggaagaactggaaaaaacggtgattcacaacgacaatgaggagctcataaaagtggaaggcacaaagatcgttctgggcaagcagctgattgaatctgccgacgaagtccgcagaaagtcactggtgttgaaattcccaaagcagcaactgcctcctaagaagaaaaggcgtgtcggcactacagttcactgtgactatcttaatcggccacacaagtctatccaccggagaaggaccgatcctatggttaccctaagctccattctcgaatccatcataaatgatatgcgggaccttccaaacacttacccctttcacacacccgtgaatgcaaaagtggttaaggattactacaagattattacgagaccaatggacctccaaactctgagagagaatgtcagaaaaaggttgtatcccagccgggaagaattcagggagcatctggaattaatcgttaagaatagtgcgacttacaacggtcctaagcattctcttacacagatcagccagagtatgctcgacctctgtgacgagaagcttaaagagaaggaagataaattagcgaggctggagaaggccatcaacccactgttagatgacgatgatcaggtagcatttagtttcattctggacaacatcgttacgcaaaaaatgatggccgttccggattcctggccattccatcacccagtcaataagaaattcgtgcctgactactacaaggtgatagtgaaccctatggatctggagacgatccgtaagaacatcagtaaacacaagtatcaatctagggagtcctttctggatgatgtcaacctcatcctcgccaacagtgtcaaatacaacggatatatgtgtaccacatgccgcttttag

SEQ ID NO: 243342 - DNA, 657 bp, Artificial Sequence
  Description of Artificial Sequence: Synthetic coding sequence
atgagctgcagcggatccggcgctgatccagaggccgctcctgcctctgctgcatccgcaccaggcccagcgccaccagtgtccgccccagcagccctgccgagctcgaccgctgcagaaaataaggcttcccccgcaggaactgctggtggacctggtgccggtgccgcagccggaggtacagggccacttgccgcacgcgctggtgaacccgctgaaaggcggggagctgcccctgtgtccgccggtggagccgcaccgccagagggtgccatcagcaatggagtgtacgtcctgccttctgccgctaacggggacgtgaagccagtggtttccagtacccccctggtcgacttcttaatgcaactcgaagattacacacccacgatcccagatgcagtcactggatactacctgaatcgggctggcttcgaggcaagcgatcccaggatcatccgcctcatcagtctcgccgcacaaaagttcatctcagacatagccaacgatgccctccagcactgcaaaatgaagggcaccgccagtggctcttcaagatcgaagtcgaaggaccgtaagtataccctcactatggaagacctaactccagctctttccgagtatgggataaacgtgaagaaacctcattacttcacgtag

SEQ ID NO: 243343 - DNA, 636 bp, Artificial Sequence
  Description of Artificial Sequence: Synthetic coding sequence
atggacgatgcccacgagtccccaagcgataaaggcggagaaactggagagagcgacgaaacagcggctgtgcccggtgaccctggagctacagacaccgatggcattcctgaggagacagatggggacgcagatgtcgatctgaaggaggctgcagcggaagagggcgagctcgaatcccaggatgtatccgatcttacaacagttgagcgcgaagattcatcactcctcaacccagctgcaaaaaaactgaagatcgatactaaggaaaagaaagagaagaagcagaaggtggacgaggacgaaatccagaagatgcagattctggtcagttctttttctgaggaacaactcaaccggtacgagatgtaccggaggtcagcattccccaaggccgcaattaagcgcctgattcagagcatcaccgggactagtgtgagccagaatgtggtgatagctatgagcggcatttctaaagtttttgtcggtgaagtggtggaagaagccctcgacgtgtgtgagaaatggggtgagatgcccccactgcagccgaagcacatgcgtgaggcagtaagacggttgaagtccaagggccagatcccaaattcgaaacataagaagatcattttcttctag

SEQ ID NO: 243344 - DNA, 465 bp, Artificial Sequence
  Description of Artificial Sequence: Synthetic coding sequence
atggatgacgctcacgagtctccttccgacaaaggcggtgagacaggtgagagtgacgagactgctgccgtgcccggagatccaggagcaactgataccgatggtatacctgaagagacagatggtgacgccgacgtagatctaaaggaggcagccgctgaggagggtgaactggaaagccaggatgtgagcgatttgaccacagtggagagggaggactcgtccctactaaaccctgcagccaagaagctgaagatagataccaaagagaaaaaggagaaaaaacaaaaggtggatgaagatgagatccaaaaaatgcagatcttagtttcaagcttttctgaggagcagctgaatcgctatgagatgtaccggcgttctgcttttcctaaagcagccatcaagaggcactggatgtgcgttcggagcggcgaaaagtgccatcactacaatccaaacatttag

SEQ ID NO: 243345 - DNA, 486 bp, Artificial Sequence
  Description of Artificial Sequence: Synthetic coding sequence
atgaaccagtttggtccatcagcactgataaacttaagtaactttagctcaatcaaaccggagccagcttcgacaccgccacaagggagcatggctaacagcaccgcagttgtcaagattcctggaaccccgggagctgggggaagattgtctccagagaataaccaagtattgaccaagaaaaagttgcaggacctggttcgggaggtcgaccctaacgagcagctggatgaagatgtggaagagatgctcttgcagatcgctgatgactttatcgaatccgtggtcacggccgcttgtcagctcgcacgccataggaagtcttcaactctggaagtcaaggatgttcagctgcatctcgaacggcaatggaacatgtggatccccggattcggaagcgaagaaatccgaccctataagaaggcctgtactacggaagcgcacaaacagagaatggcactcatccgcaagaccactaaaaaatag

SEQ ID NO: 243346 - DNA, 486 bp, Artificial Sequence
  Description of Artificial Sequence: Synthetic coding sequence
atgaatcagtttggtcccagcgccctcatcaatctgagcaatttttcgagcatcaagcccgagcctgcaagtactcctccacaaggtagtatggctaacagtaccgccgtcgttaaaatccctggcacaccgggtgccggagggcgactgtcacccgagaataaccaggtgctgacaaaaaaaaagctgcaggacttggtgagagaagtagatccaaatgaacagctggacgaggatgtggaagaaatgcttctgcagattgcagacgacttcattgaaagcgtggtcaccgcggcttgccaactggctagacaccggaaatctagcacccttgaagtgaaggatgtccaattgcaccttgaacgtcaatggaatatgtggattccaggctttggttctgaagaaatacgtccgtacaagaaagcgtgtactaccgaggctcataagcagagaatggccctcattaggaagactacgaaaaaatag

SEQ ID NO: 243347 - DNA, 1779 bp, Artificial Sequence
  Description of Artificial Sequence: Synthetic coding sequence
atgtccgacagcggctcctatggtcagagtggaggtgaacagcaatcctactcaacctatggaaaccccggaagccaagggtatggacaagcctcacaatcatactctggatacggtcaaacgactgactcctcctatggccaaaactacagtgggtactctagttatggccagtctcaatccggatactcgcagagctacggtgggtacgagaaccagaaacagagctcttatagccagcagccttacaacaaccagggccagcagcaaaacatggaaagttccggaagccagggcggtcgggcaccctcatatgatcagcctgactacggtcaacaggattcatacgaccagcagtcaggttatgaccagcaccagggcagctacgacgagcagagcaattatgatcagcaacacgactcttatagtcagaatcaacaaagttaccattcgcagagagaaaactacagccatcatactcaggacgacaggcgggacgttagccggtacggagaagataacagaggttacgggggatcccaaggcggaggtaggggaaggggtggttacgataaggacgggaggggacctatgaccgggtcatcggggggtgatcggggtgggtttaaaaactttggaggacatagagactacggccctaggactgatgctgactccgaaagtgacaatagtgataataacacaatctttgtgcaagggcttggtgaaggcgtctccacagatcaggtgggggaatttttcaagcagattggtatcatcaagaccaacaagaaaactggaaaacctatgataaacctctacaccgacaaggacacaggtaagcctaaaggagaagcaacggtgagttttgacgatccgccttccgctaaggcagccatagactggttcgacgggaaggaattccacgggaacattataaaagtttcttttgccacccgcaggcctgagtttatgcgaggcggaggtagcggcggagggaggaggggacggggaggttatcgcggaagagggggattccagggacgcggtggagaccccaaatctggagactgggtctgccctaatccgtcttgtgggaacatgaattttgctcgcagaaatagctgcaaccagtgcaatgagcctcggccagaagacagtcggcctagcggaggggattttcgcggtcgtggctacgggggagaacgcggatacaggggtcgtggcggtagaggcggtgatagaggcggttacggaggggaccgtagcgggggaggttacggtggcgaccgcagcagcggagggggttattctggcgatcgctctggtggtgggtacggtggcgatcgctcaggaggcggatatggtggagatcggggagggggttatggcggagatagggggggtggctatgggggtgatagaggaggcggatacggtggcgacaggggcggatatggcggtgatcgtggcggaggttacggtggagaccggggagggtacggaggcgaccgtggagggtacggcggtgaccgagggggttacggaggagaccggggagggtatggaggcgataggtccagaggcggttacggtggtgaccggggagggggttctggttacggcggagataggtccggcggatacgggggtgataggtcaggtgggggttatggcggtgacagagggggaggctacgggggtgacagggggggatatggagggaagatgggaggcaggaatgattacagaaatgaccaacgaaaccgtccttactag

SEQ ID NO: 243348 - DNA, 1779 bp, Artificial Sequence
  Description of Artificial Sequence: Synthetic coding sequence
atgagtgactcaggatcctatggccagagcgggggtgagcagcagtcatactccacctacggtaatcctggttcccagggatacgggcaggccagtcagagttatagcggatatggacaaacgacagattcttcttatggccaaaattactccgggtacagctcatacggccagtcacagtctggatactcccagagttacgggggatatgaaaatcagaaacagagttcatatagtcaacagccatacaacaatcagggacagcagcagaatatggagtcttctggatcgcagggaggacgagctccatcttacgatcaaccagactatgggcagcaagattcttacgatcagcaaagtgggtacgaccaacaccagggttcctacgacgagcagtcaaattatgaccagcaacatgacagctactctcagaaccaacagagttatcattctcagagagagaattactcgcatcatacccaagacgaccgccgagacgtgtctagatacggcgaagacaaccgcggttacgggggaagtcagggcggaggtagaggaaggggcggttatgataaggacggtagggggccaatgaccgggtcctctggcggagacagaggtggctttaagaacttcgggggacaccgtgattacggccctagaacagacgctgatagtgaatcggataacagtgacaacaacacaatattcgtgcaaggcttgggtgaaggtgtgtctaccgatcaagttggggaattttttaagcagattgggatcatcaagacgaacaaaaagacaggcaaacccatgatcaacctgtacacagacaaagacaccggaaagcctaagggcgaagcaacggtgtccttcgacgacccccctagcgcaaaagctgccatcgattggttcgacggaaaggaattccacggcaacatcatcaaggtgtcttttgccacccggagaccagagtttatgcgcggagggggttctggaggcggacggcgtggcaggggcggataccgcggaagaggcggttttcagggacgcggtggtgacccgaaatcaggcgactgggtttgtccaaatccttcctgcggcaacatgaactttgcaagaagaaattcctgcaaccaatgtaacgaaccaaggccagaggattccaggcctagcggcggagatttcaggggccgtggctacggcggtgaacgaggctatcgaggccgagggggtcggggtggcgaccgaggagggtatggcggagacagatctggaggaggctacgggggagaccgatcaagcggcggaggctacagtggggaccgcagcggcggaggctacgggggtgaccgttctggcggtggttatggaggtgaccgcggaggcggatacggcggtgaccgaggaggcggttatggtggcgacaggggagggggatatgggggtgatcggggagggtacggcggagaccgcggtgggggttacgggggtgacagaggcggttacggaggcgatcgcggtgggtatggcggtgatcgcggtggatacggaggtgacaggggcggatatgggggagacagaagccggggaggctacggaggcgataggggtggaggcagcggctatggtggggataggtctggcggatatggaggcgatagatccgggggagggtatggaggggataggggcggtggatacgggggtgatcgaggagggtacggaggcaaaatggggggacgtaacgactatcgtaatgaccagcgaaaccgtccttattag

SEQ ID NO: 243349 - DNA, 1188 bp, Artificial Sequence
  Description of Artificial Sequence: Synthetic coding sequence
atgacaggcagttcaggcggagaccgcggtggatttaagaatttcgggggacaccgggattatgggcctcgaacagacgccgatagtgagtccgataactctgataacaatacaatttttgtccagggccttggcgagggcgtttccacagatcaagtgggcgaattctttaagcaaattggtataattaagaccaacaagaaaacaggcaagcctatgatcaacctatacacagacaaagacactggaaaaccaaagggtgaggccacggtgtcattcgacgaccctccctccgccaaggcagctatcgactggttcgacgggaaggagtttcacggaaacatcatcaaggtcagctttgcaacgcggcgacctgaattcatgcggggtggagggtccggtggtggtcgcagaggtagggggggttacaggggcaggggcggattccagggccgaggtggagaccctaaaagcggcgactgggtgtgtccgaatccatcttgtgggaacatgaattttgctagaagaaattcgtgtaaccagtgcaacgaaccaaggcctgaagattccaggccgtcaggcggtgatttcagaggcaggggctacggaggagaacgagggtacaggggcagaggcggacgaggtggcgaccgagggggttatggtggggatagatctggcggaggctatggcggtgaccgctcttcgggcggtggttactccggagatcgcagcggcggtggatacgggggagatcgcagcggtggaggatatggaggggaccgtgggggaggttatggaggggaccggggtgggggatacggaggcgaccggggtggcggatacgggggtgaccgagggggatacggaggagatcggggtgggggttatggaggcgatcgcggtggttatggaggcgataggggtggttatgggggagatagaggagggtacgggggagaccgtggcggatacgggggagatcgcagtcggggaggttatgggggagacagaggtggtgggtctggttacggcggagataggagcgggggatacggtggggatagatccggcggaggatatgggggagaccgtggcggtggatacgggggtgaccggggaggttatggtggcaaaatgggaggcagaaatgactatcggaatgatcaaagaaaccgaccctactag

SEQ ID NO: 243350 - DNA, 2790 bp, Artificial Sequence
  Description of Artificial Sequence: Synthetic coding sequence
atgtgcgaaagctacagccgtagcctcctgagggtgagcgttgcacaaatttgccaggccctcgggtgggattcagtccaactctccgcctgccacctgttaacagacgtactgcaacgctacttacagcaattgggccgtggatgtcaccgctatagcgagctctacggtagaaccgatcctatcctggacgacgtgggcgaggcattccaattgatgggcgtatccctgcacgaattggaagattatattcacaacatcgaacctgtgacctttccgcaccagatcccaagttttcccgtctccaaaaacaatgttcttcagtttccacaacctggcagcaaggatgctgaggaaagaaaagagtacatcccggactacctgcccccaatcgtctccagccaggaagaggaagaggaggagcaggtccctaccgatggaggaactagcgcggaagccatgcaggtcccacttgaggaagacgacgagctggaggaggaagaaatcattaacgatgaaaattttctagggaagcgtccgcttgactcccccgaggcagaggagctcccagccatgaagcgccctagactcctgagcactaagggcgatactctggatgttgtgctgttagaggcaagggaacctttatcttccatcaacacacagaaaattcctcccatgctgtcacctgtgcacgtgcaggatagcactgatctggctccgccaagccccgagccccctatgttggctccggtggctaaatcacagatgccaacggccaaacctctagagaccaaaagcttcacccctaagaccaaaacgaagactagtagtcctggccaaaaaacaaaaagcccaaagacagcccagagccccgctatggtcggctccccgattaggtccccaaagaccgtttcaaaagaaaagaagtccccagggaggtcaaaatctccgaagtccccgaagtctccaaaggtgaccacacacattcctcagaccccagtgcggcctgagacgcctaatagaacgcctagcgcaacgctctctgagaaaatatcgaaggaaaccattcaggtgaagcagattcagaccccgccagacgccggtaaactgaactccgagaaccagccgaagaaggcagtggttgctgacaagaccattgaagcgtccatagacgctgtgatagctagagcttgcgctgagagagagcctgacccttttgagttcagctccgggtcagagtctgaaggggatatcttcacatccccaaagcggatatcaggtcctgaatgtactactcctaaggccagtacatctgccaacaacttcacaaagagcggaagtaccccactccctctttcaggaggaacctcgtctagcgataattcttggaccatggatgcctctatcgatgaagtcgtgcgcaaagcgaagctcggcacgcctagtaatatgcctcctaatttcccctacattagctcacctagcgtgagcccaccaactccggaacccctgcacaaggtgtatgaagaaaaaacaaaacttccctcttccgttgaggttaaaaagaagctcaagaaggaactgaagacaaagatgaagaaaaaggagaaacagagagatcgggaacgcgaaaaagacaagaataaagacaaatccaaggaaaaggataaggtgaaagagaaggaaaaggataaagagactggacgggagacaaaatatccttggaaggaattcctgaaagaggaggaggccgacccctacaaattcaagatcaaggagtttgaagacgtggacccaaaagtgaaactcaaggacggtctggtccggaaagagaaggagaagcacaaggataaaaaaaaggatcgcgagaaaggcaagaaggacaaagacaagagagagaaagagaaggtgaaagataagggcagagaagacaaaatgaaagcaccagcacctcctcttgttcttccaccgaaagagcttgccttaccgcttttcagccctgcaaccgccagcagggtcccagctatgctgccatccttgttacctgtgctgcctgagaagctgttcgaggagaaagaaaaggtcaaggaaaaggaaaaaaagaaggacaagaaggagaaaaagaaaaaaaaggagaaggagaaggaaaagaaggaaaaggagcgtgaaaaagaaaagcgggaaagggaaaagagagagaaggagaaggagaaacacaagcatgagaaaattaaagtcgagccggtggccctcgcaccaagccctgtgattcctcgcctcacgctgagggttggggctgggcaggacaagatcgtcatctcaaaagttgtgcccgctcccgaggccaaacctgctcctagccaaaaccggcctaagacccctccccctgcacctgcccctgcccctggacctatgttggtcagtcctgcacccgtacctctgcctctgctggcccaagccgcagcgggaccagcactgttgccgtctccgggtccagcagctagcggggctagcgctaaggcaccagttaggtcggtggtgaccgaaacggtgagcacctacgtgatccgggacgaatggggaaatcagatatggatctgtcctgggtgcaacaaacccgatgacggttcccccatgatcggttgcgatgattgcgacgactggtaccattggccttgtgtgggaatcatgaccgccccacccgaggaaatgcagtggttttgcccgaaatgcgcaaacaagaaaaaggacaaaaagcataagaaaaggaagcaccgggcacattag

SEQ ID NO: 243351 - DNA, 852 bp, Artificial Sequence
  Description of Artificial Sequence: Synthetic coding sequence
atgtgcgaatcctatagccgaagcctgcttcgcgtatcagtggcccagatctgtcaggcactgggctgggactctgtacagttatccgcatgccatctgctgactgacgtgcttcaacggtacctacagcagcttggcagagggtgtcataggtactcagaactttatggaagaaccgaccccatattggacgatgttggagaagctttccaactcatgggtgtctctctgcacgagctggaagattatatacacaatattgagccagtcaccttcccccaccagataccaagctttccggtctccaaaaataatgtgttacagttcccccagcctggatccaaagatgccgaagagcggaaagaatacattccggactacttgcccccaatcgttagcagtcaagaggaggaggaggaagaacaggtgcccacagatggaggaacatcagccgaggcaatgcaggtgccactggaggaagacgacgagttggaagaagaagagattatcaatgacgaaaacttcctgggtaaaaggccacttgattcgcccgaggccgaagaactcccagccatgaagagacctcggcttctctctaccaagggtgatacacttgacgtggtgctgctcgaagcgagagaacccttatcctctattaacacccagaaaatccccccaatgctatccccagtgcatgttcaggactccaccgatctagcgccaccatcaccagagcctcccatgctcgcgccagtggctaaatcacaaatgccaaccgctaaaccactcgagacgaaaagttttaccccgaaaactaagaccaaaaaaaaaaaaaaaaagaagaagtcctag

SEQ ID NO: 243352 - DNA, 3258 bp, Artificial Sequence
  Description of Artificial Sequence: Synthetic coding sequence
atggccgcaggttccgatctgctggatgaagtcttcttcaattctgaggtcgacgagaaagtagtgtcagatttggtgggatctctcgaatcgcagctcgcggcatcagccgctcaccaccaccatttagcgcctcgcacccccgaggtgagggctgctgcagctggggcactcgggaaccacgttgtctcaggcagtcccgcaggggctgccggtgccggaccagccgcacccgctgagggggctccaggggcagccccagagcctccaccagctggtcgagctcggcctggagggggaggaccccagcgccctggacccccatcgcccaggagacctctcgtcccagccggtcccgctcctcctgccgcaaagcttcggcctccccctgagggctcggcaggatcctgcgcgcctgtccccgctgctgctgccgttgcggctggaccagaacccgcacccgcaggaccagcaaaacctgcagggccagcagctttggctgccagagccggtccagggccagggcctggccctggacctggcccaggccctggtcctggtaaacctgccggacctggtgctgctcagacacttaacggatcagcggctttgctgaatagccaccacgctgcagctcctgccgtctccctggtgaacaacgggcctgcagcccttctgcccctccctaagccggcagccccaggaactgttattcagacaccaccctttgttggagcggctgcccctcccgcacccgcagctccatcaccacctgccgctcctgccccagccgctcccgctgcggcacctccgcctccgccaccagctcccgctaccttagctcggcctcctggccaccccgctggtccccctaccgccgcaccggcagtaccgccacccgcagcggcacagaatggtggttcggcgggagccgctcctgcccctgcccctgccgctggtggacccgctggcgttagcggccagcccggtcctggtgctgctgcagccgcacctgccccaggcgttaaagctgagtcgccgaagagggtggtacaagccgcaccaccagccgcacagacactagcagccagcggcccagcttcaaccgccgcatccatggtgatcggccctactatgcaaggcgctttgcccagcccagccgcagtccccccaccagcccctggcacgcctaccgggctcccaaaaggtgccgcaggtgccgtgacacaaagcctttcacgtactcctactgctaccacttctggtattagggctacactgacccctaccgtcttagcccctagactacctcagccgccacaaaaccccaccaacattcagaactttcaacttccaccgggaatggtccttgtgaggtctgaaaacggacagctcctcatgatacctcaacaggcccttgcccaaatgcaggcacaggcgcatgctcagccacagaccacgatggcaccaagaccggctacccctactagcgctcctccagtacagatatctacggtgcaagccccagggacaccaataatagccagacaagtaactcccaccacaatcattaagcaggtgtctcaggcccagactacggtccagccttcagccacattgcagaggtctccaggcgtgcaaccccaactcgtgctcgggggagcagcccagactgcaagcttggggaccgcaaccgctgtccaaactggtacaccccagagaacggtacctggcgctaccacgaccagttcggccgcaaccgaaaccatggagaacgtgaaaaagtgcaagaacttcctttccacgttgataaaactggctagcagtggcaagcagagtactgagaccgcggctaatgtcaaggagcttgttcagaacctgctggacggtaagattgaagctgaggatttcacttctagactctaccgagaattgaactcatctccccagccgtatctcgtgccctttctgaagcgatccttgccagccctcagacaattgacccccgacagtgcggcatttattcagcaatctcagcagcaacccccacccccaacgtcccaggcaacgaccgccttaactgccgtcgtgctgtcttcatcagtgcagcgcacagctggaaaaaccgcagcaactgtaactagtgctcttcagccaccggtcctgagcctcacccagcctacccaggttggagtgggcaagcagggccagcccactcccttggtcattcagcagccccctaaacctggggctcttatccgacccccacaggtcaccttaactcaaacacccatggtcgcccttaggcagccccacaacaggattatgctaaccaccccgcagcagattcagctgaatccgctccagccggttccggtggttaagcctgcagtacttcccggaactaaagcattgagtgcagtttcggctcaggcagcagccgcacagaaaaataaactcaaggagcctggcggaggctcctttagagatgacgacgacatcaatgacgtggcgagtatggcaggggtgaacctgagcgaggagagcgcaaggatcttggcaaccaactctgaactggtcggcacacttactcggagttgcaaggacgagacctttctattgcaagccccactgcagagaaggattctggagatcggtaaaaaacatggtattacagaactacaccccgacgtcgtctcctacgtatcccatgcaactcagcagcggctacagaacctggtggaaaagatctctgagacagctcagcagaagaatttcagttacaaggatgacgataggtacgagcaggccagcgatgtgagagcacaactgaaattctttgaacagcttgaccagatcgagaaacaaaggaaggacgaacaggagcgggagattctgatgcgagccgctaaaagcagaagtagacaggaagatcccgagcagctgcgtttaaaacagaaggctaaagaaatgcagcagcaggaactggctcaaatgcggcagagagatgccaacttgactgcattggccgcaatagggccaaggaagaaacggaaggtggactgtccaggacctggctccggggcagagggctctgggcctggatccgttgtgccaggctcttccggtgtgggcacacccagacagttcacacgccagcgaattacccgcgtcaacctgcgagatttaatcttctgtctggagaacgagcgagagactagtcatagcttgcttctctataaagcctttttaaaatag

SEQ ID NO: 243353 - DNA, 2850 bp, Artificial Sequence
  Description of Artificial Sequence: Synthetic coding sequence
ggacggggactcctccaacagcgcggaggccgagaatcggggccagcaccacctgccgctaagctgagaccacctccagagggatctgcagggagctgcgcccctgtgccagccgcagccgcagtagcagcaggcccagaaccagcccctgctggccctgctaagcccgcaggacccgctgcactggctgccagggcgggacctggccctgggcctggacccggacccggtccaggtcccggaccaggtaagccagctggccctggcgctgcacagacacttaacgggagcgccgctctgctgaactctcaccacgctgctgcgccagctgtgtccctggtgaacaacggccctgccgctttactacctttgccaaagcctgcggctcctgctgctgccccaccaccaccccctcccgcacctgccacgcttgcgagacccccaggccatccggctggcccacctacagctgcacctgccgtgcccccacccgctgctgcccagaacggcggatccgccggtgccgctcccgctcccgctcctgctgccggtgggccagccggagtgtcaggacagcctgggccaggcgcagccgctgctgctcccgcaccaggcgtgaaagctgagtccccgaaacgtgtggtgcaagccgctcccccagcggctcagacactggcagcctcagggcctgcatccacagctgcctcaatggtgattgggcctaccatgcagggcgctttaccgtccccagccgcagttcctccccctgccccaggcacgccaacaggactgcccaagggagctgccggagccgtgacccagtcgctctcccggaccccaaccgccaccactagcggcattcgagccactctgactcctacagtgctcgcacccagactgccccaaccacctcagaatcctaccaacattcagaacttccaactcccccctggaatggtgctagtgcgaagtgaaaatggccagcttctgatgattcctcagcaggcccttgcacagatgcaggcccaggctcatgcacaaccacaaaccactatggcccctaggccagccactcctaccagcgcgccacccgtacagatttcaaccgtgcaggctcccggtactcctatcattgccagacaggtgactcccacaactattatcaaacaggttagccaagcccagaccacagtacagccatctgccacgcttcagaggagccccggtgtgcaaccacagctggtgctgggcggagcagcacaaacagcctctttgggaaccgccaccgccgtgcagacaggcacgccccagagaaccgttcccggagctacaacaacctcttccgcagcgacagagacaatggaaaacgtcaaaaaatgcaaaaattttcttagcacacttattaaactggcttccagcggcaagcagtccacagagactgcggcaaatgtgaaggagttggtgcagaacctgctggatggcaagatcgaagcagaagatttcacgtcccgcctgtacagggaactgaactcctctccacagccctatctcgtcccatttctcaaacgcagtctgccggctcttaggcaactgactccagacagcgctgcgtttattcagcaatcccagcaacaaccccctccccctacaagtcaagctacgactgccctgactgctgtggtgctctcttcttctgtgcagcggaccgctggcaagaccgccgctaccgtgacctcagccctgcagccccctgtcctaagcctaacccaacctacacaggtgggcgttgggaagcagggccagcccacccctcttgttattcagcagcccccaaaacctggcgcattaattcgtcccccacaagtcaccctgactcagacaccaatggtcgctttgaggcagccgcacaatcggattatgcttacaacccctcagcaaatccagctgaatccccttcagcccgttcccgtagttaagcccgctgtgttgcccggaaccaaggccctttctgccgtgagcgcccaagcggcagccgcacagaagaacaaactgaaagagccaggcggagggtcatttagagacgacgacgacatcaacgacgtcgcatctatggcgggtgtcaacctgtcagaggaaagcgcccgtattctggctacaaacagtgaacttgtcggcaccctgacccgtagctgcaaagatgagacgttcctcctacaagctcctctgcagcgaaggatcctggagattgggaagaaacacggcatcacggaactgcatcctgatgtggtttcatacgtgagtcacgcgacacagcagcggctgcagaatctcgtcgagaagatttccgagacagcccagcagaaaaacttcagttacaaggatgacgacagatacgagcaggcatcagacgtgagagctcagctcaaatttttcgaacagctggaccaaatcgaaaaacagcgaaaggatgagcaagagagggaaatccttatgagggccgctaagagtaggtccagacaagaagatcccgagcagctcaggcttaagcaaaaggccaaggaaatgcagcagcaggagctcgcccagatgaggcagcgcgacgctaatctgacagccctggcagccatcggccctagaaaaaaaagaaaggtggattgccctgggcctgggtccggcgcagagggatctgggcctggaagcgtggtgcccggaagctccggggtcggaactccgcgacagtttacaagacagagaattacaagggtgaacctgagggatctgatcttctgtctggagaacgagcgagagacatcacattccttactgctttacaaagcgtttttaaaatag

SEQ ID NO: 243354 - DNA, 2589 bp, Artificial Sequence
  Description of Artificial Sequence: Synthetic coding sequence
atgccagcaggactgactgaacccgctggagcagcacccccagccgctgtgagcgccagtggtactgtgacgatggcacccgctggagccctgcccgttagagtggaatcgaccccagtggctttaggcgcagtgactaaggcgccagtatccgtttgtgtggaacctactgcgtcacagccactgaggtctcctgtggggaccctcgtcaccaaagttgccccagtaagtgccccacctaaggtgtcatcaggcccaaggctgccagcccctcaaattgttgccgtgaaggcccctaataccacaacgatacaatttccagccaatctgcagctccctcctggtacagtgctcatcaaatcaaacagtggtccactgatgctagtctctccccagcagaccgtgacacgagcggagaccaccagcaatatcaccagccgcccagctgtgccagccaacccacaaactgtgaagatttgcactgtccccaacagctcgtcacagctgattaaaaaagtggccgtgacgccggtcaagaaattggcacagatcggaacaactgttgtgactaccgtgcccaagccctctagtgtgcagtccgttgcagtaccaacaagcgttgtcacggtgacacctggcaagccccttaacactgttaccaccttaaagccttcttccctgggcgcttcttcgacaccctccaatgagccaaatctgaaggcggaaaacagtgcagctgtgcagattaatctgtcccccactatgttggaaaacgtgaaaaagtgcaaaaattttctggctatgcttattaagctcgcttgcagcggatcacagtcacccgagatgggccagaacgtcaagaagctcgtcgagcagcttctcgatgccaagatcgaagccgaggaatttacgaggaaactctacgtggaactcaagtccagcccccagccccatctggttccattcctgaagaagagtgtcgttgctctgaggcagttactcccaaattctcagtcctttattcagcagtgcgttcagcagacctcttccgatatggtgatcgcgacatgcacgaccaccgtcactacaagcccggtagtgaccactactgtgtcctccagccagagcgaaaagtcaatcattgtctccggtgctacagcaccaaggactgtatcagtgcaaaccctgaatcctctcgctgggcctgtgggtgcgaaggccggagtggtgacccttcattccgttgggcctacagctgcaactgggggaacgaccgctggcacagggctgctccagacctcaaaaccactagttactagcgtcgctaataccgtgacaacagtgtccctccagccagaaaaacccgttgtgtctggcacagccgtcactctgtcactgcccgctgtgactttcggggagacatccggagccgcaatctgcttgccatcagtgaagcctgtcgtgagcagcgccggaacgacctcagacaagcctgtcattggtacacccgtccaaattaagctggcccagcccggacctgtgctctctcaacctgccggaatcccccaggccgtacaagtgaaacagcttgtggtgcagcagccttcaggagggaacgaaaaacaggtgactacaatcagtcactctagcaccctgaccatccagaagtgcggccagaaaacaatgcccgtcaatactataataccaaccagccaattccctccagccagtatcttgaaacagatcacacttcctggcaacaagattctgagtctccaagcgtctccgacccagaaaaatcgcatcaaggagaatgtgacttcctgctttcgcgatgaggacgacataaacgatgtcacatcgatggcgggtgtgaatctgaatgaagagaacgcttgcattctggctacaaatagcgagttggtgggcactctaatccagagctgtaaggatgagccctttttgttcataggagcactgcagaaaagaatactcgatattggcaagaagcacgacatcactgaacttaattcggatgcggttaatctgatctctcaggccacgcaggagcggctaagaggcttactcgaaaaactcaccgctattgctcaacataggatgactacttataaagcctcagagaactacattctgtgttccgacacacggtctcagctgaagttcctggaaaaactggaccagttagagaaacagagaaaagacctggaggaacgggaaatgttgttgaaggcggctaagtcccggtcaaataaggaggatccagagcagctcaggctgaagcaaaaggccaaagaacttcagcaattggaactcgcccaaatacagcacagggatgccaacctcaccgccctcgcagcaataggaccgaggaagaagcgaccacttgagtccggcatcgaaggcttgaaggataatcttttggctagcggtacgagctctctcactgcaaccaagcaactgcaccggcctcggattactagaatatgcctgagggacctgatcttctgcatggaacaggaacgagagatgaagtactcccgagctctgtacctggccctgttgaaatag

SEQ ID NO: 243355 - DNA, 1857 bp, Artificial Sequence
  Description of Artificial Sequence: Synthetic coding sequence
atgccagcgggactgacagaaccagctggagctgccccacctgcagctgtgagtgcatcaggtaccgtgacaatggcaccggcaggcgcactccctgtcagggtcgagagtactcctgtggctctcggagcagtgacaaaggctcccgtatccgtctgcgtggagccaaccgcgtcccagcctcttcgttccccagtcggcacactggttacgaaggtcgcacccgtgtctgccccacctaaggttagttcgggtccacgcttacccgcaccccagattgtggcagtaaaagcccctaacaccacaacaatccagttccccgctaatctgcaacttcctcctggcactgtactgatcaagagcaatagtggtccacttatgttggtgtctccacagcagaccgttacacgggctgagacaacttccaacatcaccagtcgtccagccgtccctgccaaccctcagacagtgaagatctgtactgtccccaatagtagcagccagttgatcaaaaaagtggccgtaacccccgtgaagaagctcgctcagattgggaccactgtggtgactaccgtgccgaaaccttcatctgtgcagagcgtcgccgtacccactagcgttgttacagtcacaccgggtaaacctctcaataccgttaccacccttaagccgtcttctctaggagcctccagcactcctagtaatgaacccaatcttaaggcagagaattcagccgctgtccaaattaatctcagtccaacaatgttagagaatgtaaaaaaatgcaaaaattttttagccatgttgatcaagctggcctgttccggaagccagtccccggagatgggccaaaatgtcaaaaaactggtcgaacagcttttagatgcgaagatcgaagccgaggagttcacacggaaactatacgtggaactgaagtcgtcaccacagcctcacctggtgccctttctgaagaaatccgtcgtggccctccgtcagctcctgcccaatagtcagtcctttattcagcagtgtgttcagcagacatctagtgacatggtgatcgccacctgcacaaccacagtaacaactagcccagttgtcactacgaccgtgagtagttcccagtccgaaaaatcaatcattgtatccggagccactgccccaagaaccgtcagcgtgcaaaccctgaacccactggcaggtcctgtgggcgcaaaggccggtgtcgtgaccttacactccgtcgggccaacagctgccactggcggtacgactgctggtacgggactccttcagacatccaaacctctggtgactagtgtcgccaatacagtaactacagtcagcctgcagcctgagaagccggtcgtttccggcactgcagtgacactgtccctgccagcggtgacatttggcgagacttccggggcagctatatgcctgcctagcgtgaaaccagtggtctctagtgccggtaccacctctgacaaacccgtcattggaacaccagtgcagattaagctggctcagcccggtcccgtgctctcacaaccagctggtattcctcaggccgttcaggttaaacagctcgttgtgcagcagccctcgggaggcaacgagaagcaggtgacgaccattagccattctagcacactaactatccagaaatgcgggcagaagaccatgcctgttaatacaatcatacccaccagtcagttcccccctgccagcatccttaagcagatcacgctgccaggcaacaagatactatctcttcaggcctccccaacccaaaagaacagaattaaggagaacgtgacttcgtgttttaggtccacctttatctgcgtttactag

SEQ ID NO: 243356 - DNA, 2598 bp, Artificial Sequence
  Description of Artificial Sequence: Synthetic coding sequence
atgcctgctggtttgaccgaaccagcgggagctgccccacccgcagcagtgtctgctagcggcacagtgacaatggcccctgctggcgctctgccagtgcgcgtggagtctacacctgttgcactgggagccgttacaaaagcacccgtttcagtgtgtgtggagcctaccgctagccaacctctgcgtagtccagtcgggaccctagtgaccaaagtcgccccagtctcagcccctcccaaagtgtcctctggacctagacttcccgctcctcagattgtcgcggtcaaggccccaaataccaccacaatccagtttccagcaaaccttcagttacctcccggaaccgtcctgattaagtcaaattccggtcctctgatgctcgtgagcccccagcagactgtcacccgagccgagacgacctctaacataacttctcgtcctgccgttccagccaatcctcagaccgtcaaaatatgcacagtccctaatagctccagtcagcttatcaaaaaagtggccgtgactcccgtcaagaagctcgcccagatcgggaccaccgtggtgacaacagtgccaaaaccatcgagtgtccagagcgtcgctgtgcctacaagcgtggtgaccgtgacccctgggaagccacttaacactgtgacgacccttaaaccgtcctccctgggtgctagctcaacccccagcaacgaacctaacctaaaggctgagaactcagccgctgtgcagattaatctgagccccaccatgctggaaaacgttaaaaagtgcaaaaactttctcgccatgttgattaagttagcctgctccggctcccagagcccagaaatgggccaaaacgtaaagaagctggttgagcagctgctggacgcaaagattgaagccgaagaatttacccggaagctatacgtcgaactgaagagtagtcctcagcctcacctggtccccttcctgaagaagagtgtcgtggctttgcgccagttgctgccaaacagtcagagttttattcagcagtgcgtccagcagacgagctctgacatggtcatcgcaacgtgtacaacaacggtcactacctcacctgtggtcacaactacagtgagttcgagccaatctgaaaagtctattattgtgtcaggggcaactgcgcctaggaccgtgtctgtgcaaacgctgaacccattggcaggacccgtcggagccaaggcgggagttgttactctgcactcagttggtcccacggcagcaaccgggggaaccacggctggcaccggattactgcagaccagcaagcccctggtaactagtgtcgcgaacaccgtaacgacagtgtcgctgcagccagagaagccagtcgtgagtggtactgccgtcacactatccctgcctgccgtcacattcggcgagacttctggggctgcaatttgcctcccatccgtgaaaccagtggtgttctgctgggatcacatcaagccggttatagggacaccggtgcagatcaaattggctcagcccggaccagtcttgtcacagcctgcgggtatcccacaagctgttcaggtgaagcagttattctccctgttccaagttgtgcagcagccctccgggggtaatgagaaacaggtgaccacgatctcccacagtagtaccctcacaattcagaaatgcgggcagaagacgatgcccgtgaatactatcatcccaaccagtcagttccctccagccagcatcttgaagcagatcaccctgcccggaaacaagattctgagtctccaggccagcccaacccagaagaacaggatcaaagagaatgttacttcatgtttcagagatgaggacgacattaacgacgtaacctccatggccggagtgaatttgaatgaggaaaacgcatgtatcctcgcaaccaactccgaactcgtagggacgctcatccaatcatgcaaagacgagccctttttgttcatcggtgcccttcaaaagagaattctagatattggaaaaaagcacgatatcacagagctgaattctgatgccgtcaatttaatatcgcaagctactcaagaacgtctgcgaggcctcttggaaaaattgacagcaatcgcgcagcaccgaatgaccacttataaagcctccgagaattacatcttgtgttcagatacccgatctcagttgaaattccttgagaagctagatcagctggaaaaacagaggaaagatctggaagaacgtgagatgctgctgaaggcggcaaagtctcgctcaaataaagaagatcccgagcagcttaggctgaaacagaaggcgaaggagctgcaacaactcgagctggcccagatccaacaccgtgacgcaaatttaacagccctggctgccattgggccacggaaaaaaagacctttagaaagtggcatcgaagggctgaaagataacctgcttgctagcggaacatctagcctgactgccacaaaacagctgcacagaccgagaattactaggatctgtctcagggatttgatcttctgtatggagcaggagagagagatgaagtactcccgtgcactgtaccttgctttgctgaaatag

SEQ ID NO: 243357 - DNA, 2238 bp, Artificial Sequence
  Description of Artificial Sequence: Synthetic coding sequence
atggctgctctggccgaagaacagactgaggtcgcggtgaaactcgagcccgaaggccctccaaccctgttacccccacaagctggagatggagccggagaaggcagcggcggtacgacaaataacggccctaacgggggtggcggtaacgtcgctgcgagctcttccaccggcggagacggcggtacacctaaacccacagtggctgtgtcggctgccgctccggcaggagccgctcccgtgccagccgcagctccagacgcgggtgccccacatgatcgacagacactcctagctgtcctccagttcctgaggcagtctaagctacgcgaagccgaggaagctttaagaagagaggccggactgctcgaagaagctgttgctggaagtggcgcacccggagaagtggatagcgcgggagccgaggtgaccagtgctctgcttagccgggttaccgcaagcgctccaggccctgcagcacccgatccccctggaaccggagcatctggcgcaaccgtggtcagtggctctgcctccgggccagccgctcctggcaaagtcggatctgttgctgtagaggaccagcctgatgtgtcagccgtgttaagtgcttacaatcagcaaggagacccgacaatgtacgaggagtactattccggactgaagcactttatcgagtgctccctggactgccaccgggctgaattgagtcaactcttttatcctttgtttgtgcacatgtaccttgaactggtctacaaccaacatgagaatgaggccaagtctttcttcgaaaagttccatggtgaccaggagtgctattatcaggacgacctcagggtgctgtcttctttaacaaaaaaggaacatatgaagggcaacgagacgatgttggacttccgcacaagcaaatttgtccttcggatcagccgcgattcttatcagctccttaaaagacatttacaggaaaagcagaataaccaaatttggaatattgtgcaagagcatctgtatatagatatatttgacggcatgccaaggtccaagcagcagattgacgcaatggttggatctctagccggagaagccaaaagagaagccaacaagagtaaagtgttcttcggcctcctgaaggaacctgaaattgaagtgccccttgatgacgaggacgaagagggggagaatgaagagggcaagcctaaaaaaaagaagccaaagaaggatagcattggttccaaaagtaaaaaacaggaccccaacgcaccccctcagaatcggattccgttgccggagctcaaagatagcgacaaactggacaagattatgaatatgaaagaaactaccaaaagggtgcgcctcgggccagactgccttcctagcatctgtttctatacttttttaaatgcttaccaagggctgaccgccgtcgacgtcaccgatgatagcagtctgatcgctggaggttttgctgactccaccgtgcgggtctggagcgtcaccccgaagaagttgcgcagcgtgaagcaggcgtctgacctcagtctcattgacaaagagtcagacgacgtcctcgaaagaatcatggacgagaagaccgcatctgagctgaagatcctttacggacactccggccctgtttacggggcaagcttttctcccgatcggttgtgggctactgaccactatcaaccgctccgaattttcgccggacacctcgcggatgttaactgcaccaggtttcaccccaattctaattacgtcgccactggaagcgcagataggacagtccgcttgtgggatgtgctaaatgggaactgtgtcagaatattcactggccacaaggggccaatccactccctcacatttagtccaaacggaagattcctcgcgacaggggctactgacggacgggtcttgttatgggatattgggcacgggctgatggtgggagaactaaaaggccataccgacaccgtgtgtagtctgcggttctctcgcgatggagaaatactggcatctgggtccatggacaacacagttaggctgtgggacgctattaaggcttttgaagatctggagaccgatgatttcacaacagctacaggccatatcaacctccccgaaaatagccaggagcttctgctgggcacatacatgacaaagagtaccccagttgtgcacttacatttcacccgacgtaacttagtgctggctgccggagcatattcccctcagtag

SEQ ID NO: 243358 - DNA, 2403 bp, Artificial Sequence
  Description of Artificial Sequence: Synthetic coding sequence
atggccgcactggctgaagaacagactgaagtggcagtcaaacttgaacctgaaggacccccaacactgcttcccccacaggcaggggatggggcaggagaaggaagcggaggcacaaccaacaacggccctaacggagggggaggcaatgtagcagccagctcctccaccggaggagacgggggtacacctaagcccacggtcgctgttagtgccgctgctcccgctggcgcagctccagtgcccgcagcggctcccgacgcaggcgctcctcacgatagacaaactttactcgctgtgctgcagttcctcaggcaaagcaagttgcgcgaagccgaagaggccctaaggagagaggcgggtctgcttgaggaagccgtcgctggctctggggcacccggagaggtggattcggctggcgctgaggtgacatctgccctgctgagccgagtcaccgcttcagcacctgggccagcggctccagatccacccggaaccggagcaagcggagcgactgttgtcagcggaagcgccagtggccctgctgcaccaggcaaagtcgggagcgtggctgtagaagaccaacccgacgtgtcagcagtgctttctgcatataatcagcagggagacccaacaatgtacgaggagtactattctggcttaaagcacttcattgaatgctcgcttgactgccaccgggctgagctgtcacaactattttacccgctcttcgttcacatgtacctcgaactagtctataatcagcatgaaaacgaggcgaaaagctttttcgaaaagtttcacggggatcaggaatgctactaccaggacgacctccgtgtgctgtccagtttaacgaaaaaagaacacatgaaggggaatgagaccatgttggattttcgtaccagcaagtttgttctcaggatctctcgagacagctaccagctgctgaaacgacatcttcaagaaaagcaaaataatcaaatttggaacatcgtccaggagcacctgtatatcgatatcttcgatggcatgcccagatctaaacagcaaatcgacgccatggtcggcagcctcgctggggaagccaagcgagaagctaacaaatccaaagtcttttttggactgcttaaggagcccgaaattgaagttccccttgacgacgaagatgaggaaggcgagaatgaagaagggaaaccaaaaaaaaagaaacccaaaaaagattctataggtagcaagagcaaaaagcaggaccctaacgccccaccacagaaccgcattccccttcccgagctcaaggactccgataagctggacaagatcatgaatatgaaagagaccacaaaacgagtgcggctaggaccagattgtctgcctagcatttgcttctatactttcttaaatgcctatcagggactgactgccgtcgatgtgacagatgactcatcccttattgcaggaggtttcgctgacagcactgtcagagtatggtccgtgacaccaaagaaactccgtagtgttaagcaggcgtccgatctgagtctgatcgacaaggaatcggatgacgtgctggaacggataatggatgaaaaaacagcgtcagagctgaaaatcctgtatgggcatagcggcccagtgtatggtgccagtttctctccggaccgcaattatcttctgagctcttctgaagatggtaccgtgcggttatggtctttacagacttttacgtgcctggttggatacaaggggcacaattaccctgtttgggatacccagtttagcccatatggctattactttgtgtcgggtggccacgatagagtcgctaggctgtgggccaccgaccactatcagcctctgcgcatattcgccggtcacttggccgacgtcaattgcactaggtttcatcccaactcgaattatgtcgccacaggttctgccgatcgaactgtgcgcctttgggacgtgctgaatggaaattgcgtgcgaatctttaccggccataaaggtccaattcactctttaactttctcacctaatggacgcttccttgccacaggagctaccgacgggagggtgctcctctgggatataggccacggtctgatggtaggcgaactgaaagggcacaccgacacggtgtgtagcctccggtttagcagggacggggaaatcctagcctccgggtccatggataacaccgttagactgtgggatgctatcaaggcattcgaagatcttgagaccgacgattttacaaccgcaacaggtcacataaatcttccggagaattcccaggagctgctgctcggtacctacatgactaagtccacccctgtggtgcacttgcatttcacaaggcggaacctcgtcctggccgctggggcttatagccctcagtag

SEQ ID NO: 243359 - DNA, 2034 bp, Artificial Sequence
  Description of Artificial Sequence: Synthetic coding sequence
atggccgaggagaagaagcttaagttgtcaaatactgtcctgcccagcgagagcatgaaggtggttgcggaatccatgggcattgcacaaatccaggaagagacgtgccaattgttgacagacgaagtgtcctatcggattaaagaaatagcacaggatgctctgaagttcatgcacatgggtaagagacagaagctcactacttccgacattgattatgccctgaaactgaaaaacgtcgagcccctttacggattccatgcacaagaattcattccatttaggttcgctagtggcggtggacgagagttgtatttttacgaagagaaagaggtggatttgagcgatatcatcaacacccccctgcctagagtgccactggacgtgtgtctgaaggctcactggctgtcaattgaggggtgtcagcctgccattcccgaaaatccaccaccggcacctaaagagcagcagaaggccgaagccactgagcccctgaaatcggccaaacctggccaggaggaagacggccctctgaaaggcaaagggcagggcgctaccaccgcagacgggaaaggcaaggagaagaaggcgcctcctctgcttgaaggagctcctcttaggctcaagcctcgcagtattcatgaactgagcgtcgagcagcagctctattacaaggagattaccgaagcctgtgtgggctcctgtgaagccaagagagcggaagccctgcagagcattgccacagatccgggactataccagatgctaccaagattctctactttcatctctgagggcgttcgggtgaacgttgtccagaacaaccttgcactgctaatctacctcatgcgtatggtgaaagcattgatggacaacccgactctttacctcgaaaaatacgtccacgaactaatccctgctgtgatgacatgcattgtatctcggcagctgtgccttagacccgacgtcgataaccattgggcattgagagacttcgcagccagactggtcgcgcagatctgtaaacacttttccaccactacaaataacatacaaagccggatcactaagacatttactaaatcatgggtcgacgagaagaccccttggacaacaaggtatggttcaattgcgggactggctgagctgggtcatgacgtgatcaagacacttatcctgcctcggctccagcaggaaggagaacgcattcgcagtgttctcgatgggccagtgctctccaatattgatcgcattggagctgatcatgtacagagcctgcttttgaagcactgtgcaccagtgttggccaaactgcggcctccccctgataaccaagatgcctacagagcagaatttgggtctctaggtcctctcctttgttcacaggtcgtcaaggccagggctcaagctgcgctccaagcccaacaggtgaaccggactactttaactatcactcagcctcggcctacactgaccctcagccaggccccacaaccaggtccccgtacgccaggactgctgaaagtaccaggcagcatcgctcttccagtccagaccttggtgtccgccagagctgccgctcccccacagcccagcccaccaccaacaaaattcatcgtgatgtcatcctcaagcagtgccccttccactcaacaagtgctgagtctttctacatccgcccctggatcaggtagcaccactacgtcaccagtgacgactacagtccccagcgtccagcctatcgttaaattagtcagtacagctactactgctcccccatcgacagctcctagtggtccgggaagtgtgcagaagtacattgtagtgtcgcttccacccactggtgagggcaaagggggtcctacgagtcaccccagtcctgtcccgcctcctgctagctccccctctcctctgagcgggagtgctctgtgcggcggaaagcaagaagctggagatagccctcctcccgcacctgggaccccaaaagcaaacggtagccagcctaattccggaagcccgcagccagccccatag

SEQ ID NO: 243360 - DNA, 231 bp, Artificial Sequence
  Description of Artificial Sequence: Synthetic coding sequence
atggccgaggagaagaaactgaagttaagtaacaccgtgcttccaagcgaaagcatgaaagttgtggccgagagcatggggattgcacagatacaggaggaaacttgccaattgttgacagatgaagtaagctacagaatcaaagagattgcccaggacgctttgaaattcatgcacatggggaagcggcagaagctgacgacctccgacatagactatgccctgaagtag

SEQ ID NO: 243361 - DNA, 1806 bp, Artificial Sequence
  Description of Artificial Sequence: Synthetic coding sequence
atgcacatgggaaagagacagaagcttacgacctctgatattgactacgccctgaagttgaagaatgtagagcctttgtacggcttccatgcccaggagtttatcccgtttcggtttgcatcaggtgggggtagggaactgtacttttacgaagagaaggaagttgacctatctgacatcattaacacaccactgcccagggttcccttggacgtgtgtctgaaggcccctaaggagcagcagaaagcagaagccacggagccattaaaaagtgctaagcccggtcaggaagaggatggcccacttaagggaaaagggcagggcgcaacgacagcagacggtaagggaaaagagaaaaaggctcctccactgctggaaggagcacccctgaggcttaagccacggtctattcacgagctttctgtggagcagcaactttactacaaagagatcactgaggcctgtgttggatcctgcgaggccaagcgggctgaggccttgcagtcaatcgccacagacccaggtctttaccaaatgttgccaaggttttctacgttcatcagtgaaggagtacgcgtgaacgtcgtgcaaaataatctggcgttgctgatttatcttatgcgcatggtcaaagcactgatggacaatcccacactttacttagagaagtatgttcacgagctgattccagccgtcatgacctgcattgtgtcacggcagctttgcctcaggcctgatgtggacaatcactgggctttaagagattttgccgcacggctggttgcccagatctgcaagcatttctccaccactaccaacaatattcagtccagaataacaaagactttcacaaaaagttgggtggacgaaaagaccccgtggaccacaagatacggaagtatcgccggtctagcagaactgggacatgatgtgatcaagaccctgatccttcctcgattgcaacaagaaggcgagcgaatcaggagtgtgctggacggaccagtgctgtccaatattgaccggataggtgctgatcacgtgcagagcctcctgctgaaacattgtgcacctgtgcttgctaaactcaggcccccacctgataaccaggatgcgtatcgggctgaattcggttccctaggcccactactctgttcccaggtcgtgaaagctcgcgcacaggcagcgctccaagcccaacaagtcaatcgaaccactctgaccatcacacagcctcgccctactcttaccctaagccaggccccacagcctggccctcgaacccccggtcttctaaaagtcccagggtcaatcgctcttccagtgcagaccctggtatctgcacgtgcagccgctccccctcaaccttctcctccgccaacaaagtttatcgtgatgtcttccagctcttctgccccttcaacccagcaggttctgtctttgagcacctcggcacccggatcagggagtacaaccacatcacccgtgacaaccaccgtgccttccgtccaacctattgttaagttggtaagcactgcgacaactgcccctccttcgacagcccctagcggccctggctctgttcagaagtacattgtggtaagcctgcctcccaccggtgaggggaaggggggacccacttcccacccatcacctgtgccacctccagcgagtagcccctcacctcttagcggttctgctttatgtggaggtaagcaggaggcgggagatagtccacctcctgctccaggcaccccaaaggctaatggcagtcagcccaacagcgggagcccacagcccgcaccctag

SEQ ID NO: 243362 - DNA, 45 bp, Artificial Sequence
  Description of Artificial Sequence: Synthetic coding sequence
atggctgaggaaaagaagcttaagctctccaatacggtcttgtag

SEQ ID NO: 243363 - DNA, 2145 bp, Artificial Sequence
  Description of Artificial Sequence: Synthetic coding sequence
atgaccaaacgcagactccagacaataacagcctgtctgcaactacgagagggatcgccaagcttacatcgaggacttcatccatccagggaggagaagcgcgatagcaggatggccgaagaaaagaagctgaagctgtcaaacacggtgttgccatccgagtcaatgaaggtagtggcagaatctatggggattgctcagatccaggaggaaacgtgtcagcttttgaccgacgaagttagctatcgtataaaagaaatagcccaggacgcattaaaatttatgcacatgggcaagcgccagaaactcacgacatcagatatcgattacgctttaaaactgaaaaacgtcgagccactctatggtttccacgcccaagaatttatcccattccgtttcgcttctggtgggggtagagagctatacttctatgaggagaaagaggtggaccttagcgacataatcaacacccctctgcccagagtgccactggacgtgtgcctgaaggcccattggctctctatcgagggctgtcagcccgcaatacctgagaatcctccacccgcacctaaggaacagcagaaggccgaagctaccgagcccctcaaatccgccaagcccggacaggaggaggacggaccactgaagggcaagggacagggagctacaactgcagatggaaaggggaaggaaaagaaggctcctcctctgttggagggcgcacctttgcgactcaaacctcggtctattcatgagttgtccgtggagcaacagctctactacaaggagattactgaggcgtgtgtgggttcctgcgaggccaagagggccgaggctctccagtcaattgcaacggatcctggtctgtaccagatgcttcccagattctccacctttatctccgaaggagtgcgggtgaacgtcgttcagaacaatctcgctttgctgatctatttaatgagaatggttaaggcgctcatggacaacccaacactgtacctggagaagtatgtgcacgaactgatacctgccgtgatgacatgtattgtgagcaggcagctctgtctccggcctgacgttgacaaccattgggccctgcgcgactttgccgcacgcctcgtcgctcagatatgtaaacatttctcaacaacaaccaataatatccaaagtagaatcacaaagactttcactaaatcatgggtcgatgagaagacaccctggaccacgagatatgggagtatcgccggactggccgagctaggccacgatgtaattaagacactcatcctgccgaggctgcagcaggagggggaacgtattaggtccgtgctggatggccctgtgctctcaaatatagacagaatcggtgccgaccacgtacagagcttactcttgaagcattgcgcacctgtgctcgcaaaactcaggcccccaccggacaaccaagatgcttatcgtgccgagttcggaagcctcggaccactgctgtgctcgcaggttgtaaaagccagggcccaggccgctctacaggcacaacaagtgaatcggaccacactgacaattacacagccacgacctactcttaccttatctcaggccccacagcccggaccccgaactcccggactgctcaaggttcctggatctattgcccttcccgtgcagacgcttgtgtcggcacgggctgcggcaccccctcaacccagcccacccccaactaaattcattgtgatgtctagctcgtcctccgccccttccacacagcaggtgctgagcctaagcactagcgccccagggtctggctcgactacaaccagcccggttacaacgactgtacctagtgtgcagcccattgttaaacttgtttctacagctacaactgcccctccatccacggcaccctctggcccaggctccgtccagaaatatattgttgtctcccttccgcctacaggagagggaaagggagggccaacgtcccatccgtctcccgtcccaccccctgcaagtagtccgtctcccctaagtgggtccgcattgtgtgggggtaaacaggaagcaggagactcaccacctcccgcacctggcaccccaaaggctaatggcagtcagccaaactccggctcccctcagccagcgccttag

SEQ ID NO: 243364 - DNA, 702 bp, Artificial Sequence
  Description of Artificial Sequence: Synthetic coding sequence
atggccgaagagaagaagctaaaactgagtaacaccgtactgccttctgagagtatgaaagttgtcgcagaaagcatgggtattgctcagattcaggaagagacctgccagctgcttaccgacgaggtttcatacaggataaaggagatcgcgcaggacgccctgaaattcatgcatatgggcaagcgccagaagcttactacctccgacatcgattatgcgctcaagctgaagaacgttgagcccctgtatggtttccacgctcaagagttcattcctttcaggttcgccagtgggggtggacgcgagctgtacttctatgaggaaaaagaggttgacttgtccgatatcattaatacacctcttccacgcgtcccactggatgtgtgcctgaaggctcctaaagaacagcagaaggccgaggccactgagccactcaagagcgcaaaaccaggccaggaggaggacggcccactgaagggcaagggacagggtgccaccacagccgacggaaaaggaaaagagaagaaggcaccccctctgctggagggagcaccgctccgactgaagccacggtccattcatgagctttctgttgaacaacaactgtattataaagaaatcaccgaggcgtgtgtgggatcatgtgaggccaagagagcagaggctcttcaaagtatcgccacagatcccggtttatag

SEQ ID NO: 243365 - DNA, 405 bp, Artificial Sequence
  Description of Artificial Sequence: Synthetic coding sequence
atggccgaggaaaaaaaacttaagctatcaaacacagtactgccttctgaaagcatgaaagtcgtggccgaatcaatgggtattgcgcagatccaagaagaaacctgccagcttctgactgatgaggtcagttatagaatcaaggagatagcccaggacgccctgaaatttatgcatatgggaaagcgccagaaactgaccacttcagacattgactacgcgcttaagctgaaaaatgtcgagcctctgtacgggtttcatgctcaggagttcatacctttccgctttgccagcggcggagggagagaattgtatttctatgaagaaaaggaggtagacctctcggatattattaatactccgctgccccgagtacctctggacgtgtgcctaaaggcgcattag

SEQ ID NO: 243366 - DNA, 345 bp, Artificial Sequence
  Description of Artificial Sequence: Synthetic coding sequence
atggcagaagagaagaagctcaaattgtccaataccgtcttgccaagcgagtctatgaaggtcgtagctgaatctatgggaatagcccagattcaagaagaaacttgccagctcctgacggatgaagtgagttacaggattaaagagattgcgcaagacgccttgaaattcatgcatatgggcaaaaggcagaagctaactacatccgacatagactacgcactcaaactcaaaaatgtcgagcccctgtacggtttccacgcgcaggaattcatccccttcagatttgctagcggcggtgggagagagctgtacttctacgaggagaaagaggtggatctctag

SEQ ID NO: 243367 - DNA, 2034 bp, Artificial Sequence
  Description of Artificial Sequence: Synthetic coding sequence
atggccgaagagaagaaactgaagctctcaaacacagtgctcccatcggagagcatgaaggtagtggcggagagcatgggcattgctcagatccaagaggagacctgtcaattgctcactgacgaggttagctacaggattaaggagatcgcccaagacgcactgaagttcatgcacatgggtaaaagacagaaactcactacctccgatattgactatgcattgaagttgaaaaacgtcgagcccttgtacgggtttcatgcgcaagaatttatcccgttccgattcgcttcgggagggggtagagagctttatttttacgaggagaaggaggtggatttgtcggacataatcaataccccattgccgagggtacctctagatgtatgcttaaaagctcattggttgtccatagaaggctgtcagcctgctattccagagaacccccctcccgctcccaaggagcagcagaaggcggaagcaaccgagcccttaaaatcagccaaacccggacaagaagaggatggccctcttaaaggtaaaggtcaaggcgcaaccactgccgacggcaagggcaaagagaaaaaagcacccccactgctcgagggcgcacccttaagactaaaaccaagaagtatacacgagttgagcgtggagcaacagttgtactataaggaaatcactgaggcttgtgtagggtcctgcgaagccaaacgcgctgaggcattgcagagtatagctacggaccccggactctaccagatgctgcccagattttctacctttattagtgaaggggtgagggtgaatgttgttcagaacaaccttgctctgctgatttatttaatgcgcatggtcaaagccttaatggacaatcctaccttatacctggagaagtacgttcacgagttgataccagcagtaatgacatgcattgtttcccgccaactctgtcttagacctgacgtcgacaatcattgggctttgcgagatttcgccgctcggctcgttgcacaaatatgtaagcatttttcgaccacaacaaacaatatccaatcacggatcaccaagactttcactaagtcgtgggtggacgaaaagaccccatggacaacccgatacggctccatcgccggtcttgcagagctcggccacgacgtcatcaagactttaattcttcccagactgcagcaagaaggcgaaaggattagaagtgtacttgacggaccagttctgtctaacatcgataggattggagcagaccatgtccagagtctccttctcaaacactgtgctcccgttctggcaaagttaagacccccacccgataaccaagatgcatacagggctgagttcggatctctcggcccactgctctgcagccaagtggttaaagcacgcgctcaggcagccctgcaggcccagcaggttaataggacaacactgactataacccagccacgaccaaccctgactctgagtcaagccccacaacctggacccaggaccccgggtcttctgaaagtgccgggttccattgcactgcccgtacagactctggttagtgctcgggctgccgcacccccacagccctccccccctcctacgaaattcatcgtgatgtcttcgagcagcagtgcccctagcactcaacaggtgctgagtcttagtacttccgctcctggctccggctctactaccacttcccccgtcaccacaaccgtgccctccgtgcagccaatcgtgaaactggtcagtacggccaccaccgccccaccatccactgcaccgagcggacccggatcagttcagaaatatattgtggtgtctctcccacccacaggcgaagggaagggaggcccaacgagccacccttcaccagtgcctcctcccgcttccagtcccagccccctgagcggatctgctctctgtggaggaaagcaggaagcgggagacagcccacctccggctcccggtactcccaaagcaaatggaagtcagcctaactcgggatcgccccagcccgctccctag

SEQ ID NO: 243368 - DNA, 2034 bp, Artificial Sequence
  Description of Artificial Sequence: Synthetic coding sequence
atggctgaagaaaaaaaacttaaactgtctaacactgtactgccatcagagtccatgaaggtcgttgccgagagcatgggtattgcgcagattcaggaagaaacttgccagttactaacagatgaagtctcatataggatcaaagagatcgcacaggatgctctcaaattcatgcacatgggtaagagacagaagctgacaacgtctgatattgattacgcccttaagttgaaaaacgtagagcccctttacggcttccatgcacaggagtttataccattcaggttcgcatccggaggcggaagagagttgtacttctatgaggaaaaggaggtggatctaagcgatatcattaacaccccccttccacgagtgccactagatgtgtgtttaaaagcacactggctgagcatcgagggttgtcagcctgccatcccagagaatccccctcccgcacccaaggaacaacagaaggccgaggccacggaacccttgaagtctgccaagcctggacaagaagaggacggcccactgaaagggaaagggcaaggagcaacaaccgcagacgggaaaggaaaggaaaaaaaggcaccacctctcctggagggcgcaccactccgcctcaagccaaggagcattcacgagctgtcagtggagcagcagctgtactacaaagaaataacagaggcttgtgtcggatcctgtgaggctaaacgggcagaagctctccaaagtattgcaaccgaccccggactgtaccagatgctaccacgcttctctacattcataagcgagggagtgcgcgtgaatgtggttcaaaacaacttggcattactcatctacctgatgcgcatggtaaaagccctgatggataacccaactctttatttagagaaatacgtgcacgagcttattccggctgtgatgacctgtatcgtgagccgtcagctatgcctgcgcccagacgttgacaatcattgggccctgagagatttcgcagccagactcgtggcccagatctgcaagcacttttccacgacaacgaacaacatccagtcacggattaccaagacttttacaaagtcctgggtggatgaaaagaccccatggaccactcgatacggatcaatcgcgggattagcagagctggggcatgatgtcattaaaaccctgattctcccccgactacagcaagaaggagagaggatccgctctgtccttgacgggcctgttttgagtaatattgacagaatcggtgccgatcacgtgcagtctctgctgcttaaacattgcgcaccggtactcgcaaaactccgccctcccccagataaccaggacgcatatagggccgagttcggctccttgggccctctgctctgctcccaggtggtcaaagctagggcacaggctgctctgcaggctcagcaggtgaaccgaactactttaacaataacccagcctaggcccaccctaacgttatctcaggcgcctcagcctggtcccagaaccccgggacttctgaaggtacccggatctatcgccctgcctgtccagaccttagtgagcgccagagccgctgcccctcctcaaccttcccccccacctactaaattcattgtgatgagtagctccagttcagccccaagtacccaacaagtccttagcttatctactagtgccccaggatccgggagcacaaccactagccctgttaccaccacagtaccaagtgttcagcccattgtgaaactggtgagcaccgctacaaccgccccaccatccacagcccctagcgggcctgggagcgtgcagaaatatatcgtcgtgtctctccctcctacaggtgaaggcaagggcggaccgacatcacatccaagtcctgtgccaccacccgcttcttctcctagccccctgtctggaagcgccctctgtggaggcaagcaagaagcaggtgactcacccccaccagctccaggcacgccaaaggctaacggcagccagccgaacagtggttctccacaaccagccccatag

SEQ ID NO: 243369 - DNA, 30 bp, Artificial Sequence
  Description of Artificial Sequence: Synthetic coding sequence
atggccgaggaaaaaaaactgaagctctag

SEQ ID NO: 243370 - DNA, 2205 bp, Artificial Sequence
  Description of Artificial Sequence: Synthetic coding sequence
atggacattcgccatagcgagtttttaccctgtctgcactgccctccctttgtggggcctttgcccgtgtcccacgtctcgttttcaagtgcctgccccgtgcccctaccgggttctccttctctacataggggactacacccctctcgggaagagaaacgagacagtcggatggcagaagagaagaagctcaaattgagtaacaccgtactaccctctgaatctatgaaagtggttgcagagagcatgggcattgcccagatccaagaggaaacctgccagctgctgactgatgaagttagctatagaattaaggagatcgcacaggatgcactgaaattcatgcacatgggaaagagacagaaactgaccacctcagatatagactatgccttgaaacttaagaacgtagaacctttgtatggtttccacgcccaggaattcattcccttcaggtttgcgagtggagggggtcgtgaactgtatttttacgaagagaaagaagtcgaccttagtgacattatcaacaccccccttcctagagtccccctggacgtttgtctgaaggcacattggttaagcatcgaaggttgtcagcctgcaatcccagaaaacccacctccagcgcctaaggagcaacagaaggcagaagccacggaaccactcaaatccgccaaacctgggcaagaggaggacggtccattgaaaggaaaggggcaaggcgcaacaaccgcggacgggaaaggtaaagagaagaaggctccacccctgctcgaaggcgcacccttgagactgaagcctcgctccatacatgaattaagtgtcgaacagcagctctactacaaagaaatcaccgaggcgtgtgtggggtcttgtgaagctaaaagggccgaggccttgcagtcgattgcgactgatcccggactataccagatgcttccacgtttctcaacctttatctcagagggagtgagggttaatgtggtgcagaacaacctcgctctcctgatctatctgatgagaatggtgaaagccctgatggacaaccccaccctgtacttagagaagtatgtgcatgagcttataccggcagtaatgacctgcatcgtttcccgtcaactctgccttaggcctgatgtggataatcattgggcactgcgggattttgctgccaggctcgtcgctcagatttgtaaacattttagcacaacaaccaacaacatccaatctagaataacgaagacctttaccaaaagctgggtcgacgagaaaacaccctggactacacggtatggatccatcgcaggattagccgagcttggccatgatgtgattaaaaccttaattctcccgaggctccagcaagagggggaaagaatccgtagtgtacttgacggacccgtcttatccaacatagatcgcattggtgctgaccatgttcagtcattactgctcaaacactgcgcgcctgttctcgctaagctccgtccccctcccgacaatcaggatgcctatagggccgaattcgggtccttaggtcctttactgtgcagtcaggtggtcaaggcccgtgcccaagccgctctccaagcccaacaggtaaataggacaaccctaacaatcacacagccgagacccacactgaccttatcgcaggctccacaacctggcccacggacaccagggctgctcaaagtcccgggatctatagcactcccagtacaaactcttgtttccgcgcgagctgccgcacctccacagccatcaccccctcctactaagtttatcgtgatgtcatcctcgtcaagcgcaccctcaacacagcaggttctttcactgtctacctctgcccctgggagcgggtccacaactacctcccccgtaacaactacagttccctcggtacaacccatcgtgaagctcgtatctacggcgaccacagcccctccctcaacagccccaagtgggcctggtagcgtacaaaagtacattgtggtcagcttaccccctacaggcgaaggcaagggtggccctacctcacacccctcacccgtcccccctccagccagctccccgtccccgttatctggttccgcattgtgtggtgggaagcaggaggctggggattcccctccgcctgcccctggaacccctaaggctaatggcagtcagcctaactctggcagtccccaaccagccccttag

SEQ ID NO: 243371 - DNA, 768 bp, Artificial Sequence
  Description of Artificial Sequence: Synthetic coding sequence
atggcagaagagaagaagcttaagctgtccaacactgtgttaccaagcgaaagcatgaaagtcgtggcggaaagtatgggtatcgctcaaatacaggaagagacctgccaactcctaaccgatgaggtttcctacaggattaaggagatcgcacaggatgctctgaaatttatgcatatgggtaaacggcaaaaacttacaacttctgatattgattacgcgttgaagctgaagaatgtcgaacctttgtacggcttccatgcacaagagtttataccattcaggttcgcctccggcggtggaagagaactctatttctacgaggagaaagaggtggacctgtccgacattatcaatacccccttgccacgtgtgcccctggatgtgtgtctgaaggctcattggctgagcattgagggatgccaaccagctattcccgagaatccccctcccgcacccaaagagcagcagaaggcagaggccacagaaccactcaaaagtgcgaaacccggacaggaggaggatggccctttaaagggaaaagggcagggcgctacgacagccgatgggaaaggaaaggaaaagaaagccccaccattgctggagggagcacctctccgcctgaaacctcgcagcattcacgagcttagcgtggagcagcaactatattataaagagatcaccgaggcctgtgtggggtcgtgcgaagcaaagagagctgaggccctccaaagtatcgctactgatccaggactctatcagatgtag

SEQ ID NO: 243372 - DNA, 1050 bp, Artificial Sequence
  Description of Artificial Sequence: Synthetic coding sequence
atgtcaaaatcaaaggacgatgcaccccacgaactggagtctcagttcatcctccgcctccctccagagtacgcctccacagttcggagagccgtgcagtcaggacatgtcaatttgaaagacagactgaccatcgaacttcaccctgatggccgacacggcatcgtccgagtggatagggttccgttggccagtaagcttgtggatctgccctgtgtgatggagagtctgaaaactatagacaagaaaactttctataaaacagctgacatttgccaaatgttagtttctactgtggacggggacctctatccacccgtggaggagcccgtggcatctacggatcctaaagccagtaagaagaaggacaaggataaagagaaaaagtttatctggaatcatggcattaccctgcctcttaagaatgtgaggaagcgccgattcaggaagaccgccaaaaagaaatacatcgaatcccccgatgttgaaaaggaggtcaaacggctgctctccacagacgcagaggctgtgtccacccggtgggaaatcatcgctgaagatgaaactaaggaagcagagaaccagggtctggacatttcttcccccggaatgtctggtcaccgccaaggacatgactccttggaacacgacgaactgcgcgaaattttcaatgatcttagtagttcttctgaggacgaagatgaaacgcagcaccaggacgaagaagatattaatataatagacactgaggaggacctggaacgccagctgcaggacaagctgaacgaaagcgacgagcagcaccaggagaacgaggggacaaaccagctggtgatggggatccagaaacagatcgataacatgaaagggaaattgcaagagactcaggacagggctaaacgtcaggaagatctgattatgaaagtcgagaacttagccctgaagaaccgattccaggccgtcctggatgagcttaagcagaaggaggatcgggaaaaagagcagctgagtagtctgcaggaggagctcgagagcctattggagaagtag

SEQ ID NO: 243373 - DNA, 909 bp, Artificial Sequence
  Description of Artificial Sequence: Synthetic coding sequence
atgtccgagagccaagatgaggtgcctgacgaagtggagaaccaatttatactaaggcttccccttgagcacgcctgcaccgtgaggaacctagcgaggtcccagagcgtcaagatgaaggataaattgaaaattgatcttctcccagatggccgacacgccgtagtggaggtcgaggatgtcccattggctgccaaattggtagatttgccatgcgtgatagagagcctgcgcacactcgacaaaaaaaccttttacaaaaccgccgatatcagccagatgttagtgtgcacagctgatggtgacattcacctgtcacccgaggaacccgctgctagcaccgaccctaatatcgtgcggaaaaaagagcgtgggagagaagaaaaatgcgtgtggaaacacggaattactccaccgcttaagaacgttcgcaagaagcgctttaggaagacccagaagaaggtgccagatgtgaaagagatggagaaatccagctttacagagtacatcgaaagtcccgacgtggaaaacgaagtaaaaagactgctccggtctgatgccgaagccgtttcaacacgatgggaggttattgcggaggatgggaccaaagaaatcgagagtcaaggcagtatccctggcttccttatctcgagcggcatgagctctcataagcaaggacatacctcatcagttatggaaatccagaaacaaatcgagaagaaggagaagaaattgcataagatacaaaacaaggcgcagcggcagaaggacctgattatgaaggtggagaatctcactcttaaaaaccacttccagtctgtcctggaacagttggagttacaggaaaagcagaagaatgagaaattgatctcccttcaggaacagctgcagagatttctgaaaaaatag

SEQ ID NO: 243374 - DNA, 1131 bp, Artificial Sequence
  Description of Artificial Sequence: Synthetic coding sequence
atgtctgagtctcaagacgaggtccccgatgaagtagagaatcagtttattctgcgtctccctctggagcatgcttgcacagtccgcaacttggcgcgatctcagagcgtgaagatgaaggacaaacttaagatcgatctactcccggacggaagacatgccgtcgttgaagtggaagatgtgcccctggccgctaaactagtagatctcccctgtgttattgaaagcttgcgcactctcgataaaaaaacattctataaaaccgctgacatctcccaaatgctggtctgcaccgctgacggagatattcacttgagccctgaagaaccagcagcaagtacagaccctaacatcgttcgcaaaaaggagagagggagggaggaaaaatgtgtgtggaagcatgggatcacaccgccactgaagaatgttaggaagaagcgttttagaaaaacccaaaagaaggttcctgacgtgaaggagatggagaagagcagctttaccgagtatattgagtctccagacgtggagaatgaggtaaaacgcttattgaggagcgatgctgaagccgtctctactaggtgggaggtgattgctgaagacggaaccaaggaaatcgaatcacagggatcaatccccggattcctgatctcctcggggatgtccagccataagcagggccacacatcatctgaatacgacatgctgagagagatgtttagcgattcaaggtcaaacaacgacgatgatgaggacgaggatgacgaggacgaggatgaagacgaagacgaggacgaggacgaagataaggaggaggaggaggaagactgcagcgaggagtacctggaacgacagctgcaggccgaattcatcgaaagcgggcagtatagggccaacgaaggcacgtctagcatagttatggaaattcagaagcagattgaaaagaaagagaaaaaactgcacaagatccagaacaaagcccagcgacagaaggacttgatcatgaaggtcgagaacctgacgttaaagaaccacttccagtctgtactcgagcaactggaattacaggagaaacagaagaatgagaagctgattagcctgcaggaacagctgcagcggttcctcaaaaaatag

SEQ ID NO: 243375 - DNA, 909 bp, Artificial Sequence
  Description of Artificial Sequence: Synthetic coding sequence
atgagtgagtcccaagacgaggtacctgatgaggtcgagaaccaattcattttgcggctgcctttagagcacgcgtgcacagtacgcaacttggcgcgatcccaatcagtgaaaatgaaggacaaactgaaaattgatctgctgcctgatggacgtcacgcagtcgttgaagtcgaggacgtgcctttagccgctaagctggtggatctgccttgtgtgatagagtccttgaggaccctcgataagaagacattttacaagaccgcggatatcagtcagatgctcgtgtgcacggccgatggcgacatccacctgagccccgaggaacctgcggctagcaccgaccctaatattgttagaaaaaaggagcgcggacgggaggaaaagtgtgtgtggaagcacggcattacccctccattgaaaaacgtgagaaagaaacggttccgtaagacgcagaagaaggtgccagacgtcaaagaaatggagaaaagcagctttacagaatacatcgaatccccagacgtcgaaaacgaagtcaagaggctgctcagatcagatgccgaagctgtcagtacaagatgggaagtcatcgccgaggacggcactaaagaaatagagtctcagggaagcatccccggttttttgatttcatctggaatgagctcacacaagcaggggcacacgtcttccgtcatggaaatccagaagcagattgaaaagaaggaaaagaaactccataagattcagaacaaggcccagcggcagaaggacctaattatgaaagtggaaaatctcacacttaaaaatcactttcagtctgtcctggagcagctcgaactgcaagagaaacagaaaaacgaaaagctgatttcacttcaggagcagctgcagaggtttctgaagaaatag

SEQ ID NO: 243376 - DNA, 1389 bp, Artificial Sequence
  Description of Artificial Sequence: Synthetic coding sequence
atggaatgtcccgagggacagctgcccatttcaagcgaaaatgattctacacccactgtaagtacttccgaggtgacaagtcaacaggagcctcagattcttgtggaccgtggcagcgaaaccacatatgagtccagtgcagacatcgctggagatgagggtacccagatccccgctgatgaggacactcagacagacgctgacagctcagcccaagcagccgctcaggccccagagaactttcaggagggcaaggacatgtcagaaagccaggatgaagtcccagacgaagtcgagaatcaatttatcctcagactgcccctcgagcatgcctgcactgtgagaaacctcgcacgctctcagagcgtgaaaatgaaagataagctgaagattgatctcttgcctgacggcaggcacgccgtagtagaagtggaggacgtcccgttggcagctaagttagtcgacctgccttgcgtaatcgagtccttaagaacactggacaagaagactttttataagacagctgatattagccaaatgttagtgtgtacagcggacggcgatattcatctgagtccagaggaacccgctgcctccaccgatccgaatatcgtgcgtaagaaagagagggggcgagaagagaagtgcgtctggaaacacggcattaccccacctctgaagaacgtgaggaaaaagcgctttagaaagactcagaagaaggtccccgatgtaaaagagatggagaagagtagtttcactgagtacattgagagtcctgatgttgagaatgaagtgaagcggctactcaggagcgacgctgaggccgtaagtacacgctgggaggtgatcgccgaggacggcaccaaagagatcgagagccaggggtccataccaggttttctaattagctcaggcatgagctcccacaaacaggggcacacctcatctgagtacgatatgctgcgtgaaatgttctcagattctcgtagtaataacgatgacgacgaagacgaggatgacgaggatgaagacgaggacgaagatgaggacgaggatgaagataaagaagaggaagaagaagattgttctgaagagtacttggagcgccagctgcaggccgaattcatcgaatcggggcagtaccgtgccaacgagggaacatcgtcaattgttatggaaatacagaagcagatcgaaaagaaagaaaaaaaactgcataagatccagaacaaagcccagagacaaaaagacctgattatgaaggtcgagaacctcacattgaagaaccatttccagtcagtgctcgagcagctggagttgcaggagaaacagaagaatgagaagttgatatctctccaggaacagctccagagatttttaaaaaagtag

SEQ ID NO: 243377 - DNA, 1548 bp, Artificial Sequence
  Description of Artificial Sequence: Synthetic coding sequence
atggggaactgggtggtgaaccactggttctccgttctgttcctcgtcgtgtggctgggattaaacgtgttcctgtttgtcgacgcatttcttaagtatgaaaaagccgacaagtattattacacacgcaagatattgggctcgacgttggcctgtgcacgggcttcagccctgtgcctgaacttcaactccaccctgatcctgttgccagtgtgccgcaacctgctgagcttcctccgtggcacttgttcattttgcagtaggacactgcggaaacaactggaccacaacttaacatttcacaagctcgtcgcatatatgatctgtctccatacggctattcacatcatagcccatttgttcaactttgattgctacagccgaagcagacaggccacagacgggtccctggcgtccatcctgtccagcctgtctcacgacgagaagaagggtggttcgtggctgaacccaattcaaagcaggaatacaacagtcgaatatgtgacatttaccagcatcgctgggcttacaggagttattatgactatcgcccttattctcatggtgacttccgccacagagttcattagaagatcctattttgaggtcttctggtatacacatcatctgttcatcttttacattctggggctcggtattcatgggatcggcggtatcgtccgcggacagaccgaggagtctatgaatgaatcccaccctcggaaatgcgctgaatcatttgaaatgtgggatgatagagattcccattgtcgtaggcctaaattcgagggacacccacccgagagttggaaatggattctcgcaccagtgattctgtatatctgcgaacggatcctgcggttctatcgtagccaacagaaagttgtgattaccaaagttgtgatgcacccttccaaggtgctcgaactgcaaatgaacaagagaggattctcgatggaagtgggacaatatatttttgtgaactgtcccagtatatcactgcttgaatggcatccattcactttaacctctgcccctgaggaggacttcttcagcatccatattcgcgctgctggcgattggactgagaatctgatccgggctttcgaacagcagtatagccccattccaaggatcgaggttgatggcccttttggcacggctagtgaggacgttttccagtatgaagtggccgtgctcgtgggggctggcatcggcgtgactccctttgctagtatcctcaagtccatttggtacaagtttcaatgcgccgaccataatctcaagacgaagaaggtcggacacgccgctctgaacttcgacaaggctacagatattgttactggcctgaagcagaaaaccagtttcggcagaccaatgtgggataatgagttctccacgatcgcaacatcacacccgaagtctgtggtgggcgtgttcctgtgtgggccaagaaccctggctaagagcctgcggaagtgttgtcatcggtactcttccctcgaccccaggaaggtacagttttactttaacaaggagaatttttag

SEQ ID NO: 243378 - DNA, 795 bp, Artificial Sequence
  Description of Artificial Sequence: Synthetic coding sequence
atggaatctggcaaaaccgccagcccaaagtctatgccaaaagacgcgcagatgatggcccagatccttaaagacatgggaataaccgaatatgagccccgagtcattaaccagatgctcgagtttgcctttcggtatgtgactactatactggacgatgcaaagatctacagctcccatgctaaaaaggcaactgttgatgccgacgacgtgagactggcaatccagtgtcgtgcagatcaatcgttcacctcccccccacctcgggactttctactggatatcgccaggcagaggaaccagactcccctgccactgatcaagccttacagcggccctcgtctgcccccagatcggtactgtttaactgccccaaactatcgcttgaagtctctgcagaagaaagccagcacgtctgcgggaagaataaccgtacctaggctaagtgttggcagtgttacttctcgcccatccaccccgactctaggcacgccaacaccgcagacgatgagtgtgtccaccaaagtcggtacccccatgtccctgacggggcagcgattcaccgttcagatgcctacaagccaaagccccgcagtgaaagccagcatacctgccacctctgccgtccagaacgtgcttatcaacccctccttaattggaagcaaaaatatcttgataacgaccaacatgatgtccagccaaaacacagctaacgagtcctcgaatgcattaaaacgcaaaagggaagacgacgacgacgatgacgatgatgatgatgactatgacaacctgtag

SEQ ID NO: 243379 - DNA, 510 bp, Artificial Sequence
  Description of Artificial Sequence: Synthetic coding sequence
atgtgccacagaaagcctgggacacctggtgtgggtaagaccacactcggcaaagaactggcctctaaatctgggttgaagtacatcaacgtgggtgacctcgcacgggaagagcaactgtacgacggctacgatgaggagtacgactgtcctatcctagacgaggatagagtagtggacgagctggacaaccagatgagagagggaggcgtgatcgtggactatcacggctgtgatttctttcctgaacgatggtttcacattgtctttgtcctgcgaaccgacacgaacgtactttacgaacgcttggagactcggggttacaatgaaaagaaactgaccgataatatccagtgtgagatattccaggtgctttatgaagaggctactgcaagttacaaagaggagatagtgcaccagctgccttccaacaagccagaagaactggagaataacgtggatcagatactgaagtggattgagcagtggataaaggaccacaattcctag

SEQ ID NO: 243380 - DNA, 519 bp, Artificial Sequence
  Description of Artificial Sequence: Synthetic coding sequence
atgctgttgcctaacattctgcttaccggtaccccgggagtcggtaagacaacactgggaaaggagctcgcgtctaagtccggactgaaatatatcaacgtgggagaccttgccagggaggagcagttgtatgatgggtatgatgaggagtacgattgccccattctcgatgaggatcgagtcgtggatgagctggacaatcagatgcgtgaaggcggagtgattgttgattatcacggctgtgacttttttccggaacgatggtttcacattgtctttgtcctgaggacagacaccaatgtgttatatgaacgactcgaaaccagaggatacaatgagaagaaactgacagataacatccaatgtgaaattttccaggttttgtacgaagaagctaccgctagctataaagaggaaatcgtacatcagctgccaagcaataaaccagaggaactggaaaataatgttgatcagatcttgaagtggatcgagcagtggatcaaggatcataacagctag

SEQ ID NO: 243381 - DNA, 597 bp, Artificial Sequence
  Description of Artificial Sequence: Synthetic coding sequence
atggaaagcggcaagacagcctcacccaagtccatgccgaaagatgcccaaatgatggcccaaatcctgaaagatatgggcattacagaatatgagcccagggtaattaaccaaatgctcgagtttgctttccgttacgtgactactatcttagatgacgcgaaaatctactcctctcatgctaagaaagccactgtagatgctgatgacgtgcgtcttgcgattcagtgccgtgccgaccagtccttcaccagccctccgcctcgtgactttctccttgatatagcacgtcagagaaatcaaaccccactcccactgatcaaaccttattccggacccagactgccacccgatcgttactgccttaccgcacccaactaccggctaaagtctctacagaagaaagcctccacttccgccggacgcataaccgtgcctcggctttctgtcggatcggtgactagcaggccaagcacacctaccctcggaactcctacacctcaaacgatgagcgtgtctaccaaggtgggcactcccatgagcctcacaggccagcggttcacagtgcagatgccaaccagccagtccccggcatag

SEQ ID NO: 243382 - DNA, 411 bp, Artificial Sequence
  Description of Artificial Sequence: Synthetic coding sequence
atggaatcagggaaaacagcttcccccaagtctatgccaaaggacgctcagatgatggctcagattttgaaggacatggggattaccgagtatgaaccccgtgtaatcaatcagatgctggagttcgcattcaggtatgtcaccactatacttgacgatgccaaaatttacagctcccacgctaagaaggctaccgtggatgcagacgacgtgagactggccattcagtgccgagcagatcaatccttcaccagcccacccccacgtgacttcttactagatattgccagacaacgtaatcaaaccccactaccacttatcaaaccttattcgggccctaggctgcctcccgaccgatattgcctcacagccccaaactatcgcttaaagtcattgcagaagaaagcttag

SEQ ID NO: 243383 - DNA, 795 bp, Artificial Sequence
  Description of Artificial Sequence: Synthetic coding sequence
atggagtctgggaaaacagccagtcccaaatcgatgcctaaagatgcccagatgatggcacagattcttaaagacatgggcataacagagtatgagccacgggtgatcaaccaaatgttagaatttgcctttcgttacgtgaccacaattctggatgacgctaagatatatagctctcacgcgaaaaaggctaccgtggatgctgacgacgtgcggctggctattcagtgccgggctgaccagtcattcacaagcccccctccccgagacttcctcctcgatattgccaggcagcgcaatcagacaccactgcccctcattaagccatactctggaccgcgtctccccccagaccggtattgccttaccgcgcctaactaccggctcaaatcattgcagaagaaggccagcacctcagcaggacgtatcaccgtgcctcggttaagtgttggatccgtcaccagccgtccatcaacacctacactgggaactcctacaccgcagactatgtcagtaagcacaaaagtcggaacacccatgtctctgacaggccagcggtttacggtgcagatgcccacatcacagtcccccgctgtgaaggcctccatccccgcaacatctgctgtgcagaatgtgctcatcaatccctccctaataggatcgaagaacatactgattactactaatatgatgagttcccaaaacactgcaaacgaaagctcaaacgccttgaaaaggaaacgggaagacgacgatgatgacgatgacgacgacgatgattacgacaacttgtag

SEQ ID NO: 243384 - DNA, 309 bp, Artificial Sequence
  Description of Artificial Sequence: Synthetic coding sequence
atggagagcggcaaaactgcgtcgcccaagtctatgcccaaagacgcacagatgatggcacagattctcaaagatatgggtatcacagagtacgaacccagggtgattaaccagatgctggagttcgctttcaggtacgtgacgacgattctggatgacgccaagatttatagttcccacgctaagaaagccaccgtagatgccgacgatgtcaggctggccattcagtgccgggctgatcaatcctttacttccccaccccctcgtgacttcctcttggatatagccaggcagaggaatcagacgtag

SEQ ID NO: 243385 - DNA, 501 bp, Artificial Sequence
  Description of Artificial Sequence: Synthetic coding sequence
atggagagtggaaaaactgcctccccaaagtcaatgccgaaggatgctcagatgatggcccaaatcctgaaggatatgggaatcacagagtacgaacctagggtcatcaaccagatgttggaatttgctttcaggtatgtgacaaccattctagatgatgccaagatatattcttcgcacgctaagaaggctactgtcgacgcggatgacgtgaggctcgctatccagtgccgggcagatcagagtttcacgtcgcctccccctagggactttctcctggatattgccaggcagcgaaaccaaactccactgccactgattaagccgtacagtggcccacgcttgccgcctgatcgatattgtctcaccgctccaaattacagactcaagtccctgcagaaaaaagcaagtacatctgccggtcgtattaccgttcctcgcttgtcagtgggctctgtgaccagcaggccgtctacgcccacactgggtacacctacttag

SEQ ID NO: 243386 - DNA, 384 bp, Artificial Sequence
  Description of Artificial Sequence: Synthetic coding sequence
atggagtcagggaagacagcttcccctaaatccatgccaaaagatgcccaaatgatggcccagatactcaaggacatgggaatcactgagtacgagccacgcgtcataaatcagatgttagagttcgcttttaggtacgtgaccacaattctagatgacgccaaaatctattccagccatgcaaaaaaggccaccgtggatgctgacgatgtgcgtctggcgattcagtgtagagccgatcagtcgtttacttccccacctcccagggatttcctactcgacatcgcccgtcagcgaaatcaaacgcctttaccactgatcaaaccctacagtggcccacgactgcctcccgaccggtactgcctcacagctcctaattattag

SEQ ID NO: 243387 - DNA, 756 bp, Artificial Sequence
  Description of Artificial Sequence: Synthetic coding sequence
atggaaagcggaaagatggcccctcccaaaaacgcacctcgcgacgccttggttatggcccagattctgaaggacatgggaattacagagtacgaaccaagggtgattaatcagatgctggaatttgcctttcggtacgtgactacgatcctagacgacgcaaagatatatagctcccatgccaagaagcccaatgtggatgccgacgacgtgaggttggctatccagtgtagggctgaccaatccttcacctctcccccaccacgtgactttctgctggacattgcccgtcagaagaatcagacccctctccccttaatcaaaccgtacgcagggcctcgtctgcctccagacaggtattgtttgactgcccctaactaccgactaaaatctctgatcaagaaagggcctaaccagggacgattggtgccgaggctttccgttggcgcagtgagcagcaagcctacaacgccaacaatcgccaccccccagaccgtctccgtgccaaacaaggtggctacccctatgtccgtgacctcacagcggtttacagtacagatacctcctagccagtccactcctgttaaacccgtccctgcaacaacagccgtgcagaatgtgttgatcaatccttccatgatcggtcccaaaaacatcctcattacaacaaacatggtaagctcccagaacacggctaacgaagcaaaccccctgaagcgtaaacatgaggacgatgacgacaatgatataatgtag

SEQ ID NO: 243388 - DNA, 879 bp, Artificial Sequence
  Description of Artificial Sequence: Synthetic coding sequence
atgccgctgcacgtgaaatggccgtttccagcagttcctcccctgacgtggaccctggcatcctcagtagtcatgggccttgttggcacatacagctgtttctggacaaagtacatgaatcatctaacagtccacaatcgtgaggtactttacgagctgatcgagaagaggggcccagccacacccttaataacagtatcgaaccaccagagttgcatggatgacccgcatctgtggggaatcttaaagctgcgtcatatttggaatttgaaactgatgcgctggacccccgcagccgctgacatatgttttaccaaagaactacatagccatttcttctcactcggaaaatgtgtacctgtgtgtcgaggcgctgaattttttcaggccgaaaacgagggcaagggtgtgcttgatactggcagacacatgcccggagctgggaaaagacgtgagaagggggacggcgtctatcaaaaggggatggacttcattctggaaaagctgaatcatggcgattgggtgcacatcttccccgaggggaaagtgaacatgtcttcagaattcctgagattcaagtggggtatcggcaggttaattgccgagtgccacctgaatcctatcatactgcccctttggcacgttgggatgaacgacgttttgccaaactcaccgccatacttccccaggttcggacagaaaattactgttctaatcggaaagcctttctctgccctgcctgtactggaacgattgagagcggaaaataagtcagctgtagagatgcgcaaggctttgaccgatttcatccaggaggagtttcaacatttgaaaactcaggccgaacagcttcataatcacctgcagccgggaagatag

SEQ ID NO: 243389 - DNA, 789 bp, Artificial Sequence
  Description of Artificial Sequence: Synthetic coding sequence
atgccgctgcacgtgaagtggcccttcccagctgtgcccccactcacatggactctggcctcttcagttgttatgggcctcgtcggcacatactcctgtttctggaccaagtacatgaatcacctcaccgtccataacagggaagtgctatatgaactgatagagaaacggggtccagccactcctcttatcaccgtgtcaaatcaccagtcttgcatggatgatcctcacttgtggggaattcttaaactaagacatatctggaacttgaaactaatgcgatggacaccggctgccgcagacatctgtttcacgaaggaactgcacagtcacttcttctcactgggtaagtgtgttcccgtatgccggggtgatggtgtgtaccagaaggggatggacttcattctggaaaagctcaaccacggtgattgggtgcacatatttcccgaaggaaaagtgaatatgtcaagcgagtttctcagattcaaatggggcatcggcagactcattgccgagtgccacttgaatccgataatccttccgttatggcacgtcggcatgaatgacgtcttgcctaatagtccaccttacttcccccgtttcggacaaaaaatcaccgttctcataggaaaaccattcagcgcactacctgtgttagaaagacttcgtgccgaaaataagtccgctgtagagatgagaaaagctctgacggactttattcaggaagagtttcagcacctgaagacacaggcagagcagctgcacaatcacctccaacccggaaggtag

SEQ ID NO: 243390 - DNA, 837 bp, Artificial Sequence
  Description of Artificial Sequence: Synthetic coding sequence
atgccattgcacgtaaaatggccatttcctgcagtcccccctctgacttggacccttgcctcctcggtcgtgatgggcctggttgggacttattcttgtttctggaccaaatacatgaaccacctgacagtgcataatcgggaggtgctttacgaactcatcgagaagaggggtccagcgacacctcttataactgtcagtaaccaccaatcctgcatggatgacccacatctctggggaattctgaagcttcgccacatttggaatttaaagttaatgagatggacgcccgcagccgctgatatctgcttcaccaaggaactccactctcactttttctctctcggaaagtgtgttcccgtgtgccgcggtgctgaatttttccaagctgaaaatgaagggaaaggcgttctggatacagggagacacatgccgggtgccggaaagcgaagagagaagggagatggcgtttaccagaagggcatggactttatcctggaaaagcttaaccacggcgactgggtccacatttttccggaaggaataggaaggctcattgcggaatgccatctgaaccctatcatactgcccctttggcacgtcggcatgaatgacgtactccctaatagtccaccctatttcccccgattcgggcagaaaattacagtgctaataggaaaaccatttagcgccttgcccgtgctggaacgcctgagggctgagaataagtctgccgttgagatgcggaaggccctcactgacttcatccaagaggaatttcagcatcttaagacccaagccgaacagctgcataatcatttgcagccagggaggtag

SEQ ID NO: 243391 - DNA, 747 bp, Artificial Sequence
  Description of Artificial Sequence: Synthetic coding sequence
atgcccctgcacgtgaaatggccttttcccgcagttcctccacttacatggactttggcgtcctccgtcgtgatggggttagtgggaacctactcctgtttctggaccaaatacatgaatcatctcaccgtccacaaccgggaagtgctctacgaacttatcgagaagaggggacccgctaccccgctgatcacagtatcgaatcatcagagctgcatggacgatccacacctatgggggatccttaaactgcgtcacatctggaaccttaaactgatgagatggaccccagcagctgcagatatatgctttacgaaagaactgcactcgcattttttctctctcgggaaatgtgtccccgtttgccgcggagatggagtctatcagaagggcatggactttatccttgaaaaactgaatcacggggactgggtacatatctttcccgagggaatcgggaggctaatcgcagagtgtcatcttaacccgatcattctgcccttatggcacgtcggcatgaatgatgttctgccgaattcaccgccttattttcctaggttcggtcaaaagattaccgtgttgatcggaaagccattctcagcacttcccgtcctcgagcggctccgggcagagaacaagagtgcagtggagatgaggaaagcgttgacagactttatacaggaagagttccagcacttgaaaacacaggcagagcaactgcacaaccacttgcaacccggaagatag

SEQ ID NO: 243392 - DNA, 798 bp, Artificial Sequence
  Description of Artificial Sequence: Synthetic coding sequence
atgcccctgcacgtcaagtggccttttcctgccgtccccccactgacatggaccctggcttcgtcagttgtcatggggctcgtcggcacctactcttgcttttggacgaagtacatgaaccaccttacggtacataacagagaagtgctctacgaactgatagagaagagaggcccagccacgccactgattaccgtatccaaccatcagtcttgcatggacgatccacacttgtggggcatcctgaagttaagacacatctggaatctgaaacttatgcgctggacaccggctgctgccgatatctgtttcaccaaagagctccactcacattttttttcactcggcaagtgtgttccagtctgtagaggagctgaatttttccaagctgagaatgaaggaaagggcgttctggacacagggcgacatatgcctggagcaggcaagcgacgggagaagggcaaagtgaacatgagtagtgagtttctcaggttcaagtgggggatcggtcgactaatagcagagtgtcatctgaatccaataattttaccactctggcatgttggcatgaatgatgtcctaccaaattccccaccttatttcccgagatttggacagaaaatcaccgtccttattggcaagccattttctgctctccccgtcctggaacggctccgagccgagaacaagtccgccgtggaaatgcgcaaggctctaactgacttcatccaggaggaatttcaacatttaaaaacacaagctgagcaactgcacaaccacttacagccgggtcgttag

SEQ ID NO: 243393 - DNA, 7629 bp, Artificial Sequence
  Description of Artificial Sequence: Synthetic coding sequence
atggtggctctcagtcttaaaatctgtgtgaggcactgcaatgtggtgaagacaatgcagtttgaaccatctactgccgtgtacgacgcatgccgcgttataagggaacgcgtacctgaagctcagaccgggcaagcatcagactatggcctgttcctgagcgacgaagaccccaggaagggaatctggctggaggctggccgtacattagactactatatgctccggaacggagatattttggaatataagaagaaacagcggcctcagaaaattcgaatgctcgacggctccgtgaagaccgttatggtcgacgacagcaagactgtgggcgagttgttggtgaccatctgtagccggattgggataaccaattacgaagagtatagtctcatccaggagacaatagaggaaaaaaaagaggagggcaccggtaccctgaagaaggatcggacccttctgagggatgaacgcaaaatggagaagttaaaagctaagcttcatacagatgatgacttaaattggcttgaccacagccgaaccttccgcgagcagggagtggatgaaaacgaaacattattactgagacggaaattcttttattctgaccaaaatgtagatagcagggatcccgtgcagttaaatcttctgtacgtccaggcacgggacgatatcctgaatgggtctcaccccgtgtctttcgagaaggcctgcgagttcggcggatttcaagcacagattcagttcggtccacatgttgaacacaagcacaagccaggattcctggacctgaaagaatttctgcctaaggagtatatcaaacagcgtggggctgaaaagagaattttccaggagcataaaaattgtggagaaatgtctgaaatcgaagcaaaggtcaagtacgttaaactggctaggtcccttagaacatatggcgtctcgtttttcctggtgaaagaaaaaatgaagggtaagaataagctggttcctcgcctcctgggaatcaccaaggatagcgtcatgagagtcgacgagaagactaaagaagtcctgcaggagtggccgctcactaccgtgaagcgttgggcggctagtccaaagtcgtttactcttgatttcggcgaatatcaagagtcttactactcagttcagactacagagggggagcagatatcgcaactcatcgctggctacatagacattattttaaagaagaagcagtcaaaagatagattcggactggagggcgacgaggagagcacaatgctcgaagaaagtgtctcgcctaaaaagtccaccatacttcagcagcagttcaacagaacagggaaggccgaacacggttccgtggccctacctgccgtgatgaggtccggctcctccggacccgaaacatttaatgtgggtagtatgccttctccacagcagcaggtcatggtgggccaaatgcatcgcggtcatatgccgcctctcactagcgcccagcaggccctcatgggtaccattaacacctccatgcacgctgttcagcaagcccaagacgacctgtccgaacttgatagtctcccaccccttggccaggatatggcttccagggtctgggtccagaataaggtggatgagagcaaacatgaaattcattcacaggttgatgctatcaccgccggaacagcatcggtcgtgaatctgaccgctggcgacccagctgatacggattacaccgcagttgggtgtgccatcacaacgatttccagtaatctgacagagatgagcaaaggtgttaagctactggctgccctaatggatgatgaagtcggttcaggggaagatttacttcgcgcagcgaggacccttgctggtgccgtaagcgacttgctgaaagccgttcaacccacctcaggagagcctcgccagaccgtgctgactgccgctgggagcataggccaggcctctggcgatctgctccgacagattggcgaaaatgagactgacgaacggttccaggacgttctgatgtcgctcgccaaggctgtcgctaacgccgctgcaatgctcgtgctgaaggcaaagaatgtcgcccaggtagccgaagacactgtgctgcagaaccgggtgatagcggctgcaacgcagtgtgccctgtcgacctcacagctggtcgcgtgtgcaaaggtagtgagcccaaccataagcagccccgtttgtcaggagcagctcatcgaggctggaaagctcgtggatcgcagtgtggagaactgcgtgagggcttgccaggccgcaaccacagatagcgaactactcaagcaagtgtccgccgctgcgtccgttgtgagccaggccctacacgacctcctccaacatgttcgacagtttgccagtcggggagaacccattggacgatacgaccaggctaccgataccatcatgtgcgtcaccgaaagtatcttcagctccatgggagatgccggtgaaatggttcgccaagctcgagtgctggcacaggccactagtgatctggtgaatgccatgaggtctgacgccgaagcagagatcgatatggagaactccaaaaaattgctcgccgcagccaagctgctggccgattcgacagcgcgtatggtggaggctgccaagggcgcagcagccaacccagagaatgaggatcagcagcaacgtctgagagaggccgcagaaggtcttagagtggccacgaacgcagcagcccagaatgccataaagaaaaagatcgtaaatcgtcttgaagttgcagcgaagcaggctgcggcagccgcaacccagacgattgctgcttcccagaacgcagctgtctccaataaaaaccctgcggcacagcagcagttggtccagagttgtaaggctgttgctgatcacattccccagctcgttcagggcgttcggggttctcaagcacaggcagaggacctcagtgcccagctggccctaatcatttccagccagaatttcctgcaaccgggttcaaaaatggtgagttctgccaaagccgctgtgcctacagtttccgaccaggctgccgcaatgcaactctcacagtgcgccaagaacctggctacatctttggccgagttacgcactgcatcccagaaggcacacgaggcttgtggacctatggaaattgatagtgcactcaacacggtgcagaccctaaaaaatgagctccaggacgccaaaatggccgcagtggagagccaattgaagcccctgcctggagagacattagaaaagtgtgcccaggacctcggcagtacaagtaaggccgtcggttcaagcatggcccagctactgacttgtgccgctcaaggcaacgagcactacactggcgtggcggcacgtgaaacagcgcaggccctcaagactcttgcgcaggccgcacgcggagttgctgctagtaccaccgatccagctgctgcccatgccatgctcgacagcgcccgtgacgtgatggaagggtcggcaatgctaatccaggaagccaagcaggctctgatcgcacctggagatgccgaacggcagcagcgcctggcccaggtggccaaggccgtgtctcactcactgaataattgtgtgaattgcctgcccggacaaaaggatgtagatgttgctctgaaaagcattggtgagtcttcaaagaagttgctagtcgactctctccccccttcaaccaagccatttcaggaggctcaatccgagttaaatcaggccgctgccgacctgaatcagagcgcaggcgaggtggtgcacgccaccagagggcagagcggagagctggcagccgcatccggcaagttctctgatgactttgacgagtttcttgatgcgggaatagagatggcaggccaggctcaaacaaaagaagaccaaatccaggtcatcggaaatctgaaaaatatatccatggcatccagcaaactgctccttgccgcaaagtccctctcagtggacccaggggcacccaacgcaaaaaacttgttggctgctgccgcacgtgctgtaacggagtctattaatcaactaatcacactctgcacccaacaggcaccagggcagaaagagtgcgacaatgctttgagggaattggagacggtcaaaggaatgttggacaaccccaatgaaccagtgtccgacctttcatacttcgactgtattgagagcgtgatggagaactcaaaggtacttggcgagagtatggccggaataagccagaatgccaagactggagatcttcccgcattcggcgaatgcgtcggcattgcttcaaaggcgctgtgcgggctgactgaggcggctgcacaggctgcatacttagttggcattagcgatccaaattcccaggccggtcaccagggcctggttgacccaatccagtttgctcgggctaatcaggcaatacaaatggcctgtcagaatctggtcgatcccggtagctcaccgagtcaggtcttgtctgccgctaccatcgtggctaaacatacatccgccttgtgcaatgcttgcagaattgcttccagtaagaccgccaatcctgtggctaagcgacacttcgtccaatcagccaaagaggtagccaattcaactgccaacctggtaaaaaccattaaagcgctggatggcgacttttccgaagacaatcggaacaagtgtcggatcgccaccgccccactcatagaggctgtagagaacctcacagccttcgcatcaaaccccgagtttgtgtctatcccagctcagatctcctccgaagggagtcaggcacaggagcccatcctggtttccgctaaaactatgctggagtcaagttcctacttgatccggaccgcgcgatcacttgcaattaacccaaaggatcctcctacctggtccgtgctggcgggacatagtcataccgtatcagatagtatcaaatctcttataacctccattcgagacaaagctccaggccagagagagtgtgactacagcatcgacggtatcaatagatgcattagggacatcgagcaggccagcttagctgcagtgagtcagtccctggccacaagagacgacatcagcgtggaggccctccaggagcagctgacatctgttgtgcaggaaattgggcacttaattgacccaattgcaaccgctgcacggggagaagcagcccaactgggccacaaggtgactcagttggcaagctactttgaacctctgattctggccgcagtcggtgtagcgtctaaaatactcgaccaccagcagcagatgacagtgctggaccagactaaaacgcttgctgaatcagcacttcagatgctgtatgccgctaaggagggcggtgggaaccccaaggctcagcacactcatgatgctatcactgaggccgcacaacttatgaaagaggcagtggacgacatcatggttacgctgaacgaagcagcctccgaagtcggacttgtcggcggaatggtggatgccatcgcagaagcaatgtcaaagttagatgagggtactcctcccgaacctaagggaacattcgtggattatcaaaccacagtcgttaagtattccaaggccattgctgtgacagctcaagagatgatgaccaagtctgtgactaatccggaggaactgggaggcttggccagccagatgacctccgactatggacacctcgcatttcaaggccagatggctgccgcaactgccgagccggaggaaattggattccagattcgaacccgggtacaagacttaggccacggctgtatctttctggttcaaaaagcaggagccctacaggtctgtccgaccgacagctatactaagagggaattgatcgagtgtgccagggctgtgaccgagaaagtctcactagtgttgtctgcgctgcaagccggtaataagggcacccaagcgtgcataactgccgcaactgcggtttccggcattattgcggacctggatactacaatcatgtttgccaccgcaggaactctcaacgcagaaaactctgagacttttgccgaccatcgggaaaatatcctgaaaaccgccaaggccctggtcgaggatactaaactgctggtctctggtgccgcttccacccccgataaactggcccaggcagcccagtcaagtgccgcaacaataacgcagctcgcggaggtggtgaaactgggagccgctagccttggcagcgacgatcctgaaacgcaagtggttttaatcaatgccatcaaagatgttgccaaagcattgagcgacctaataagtgctacgaaaggcgcagcgagtaagcctgttgacgacccttctatgtaccagctcaagggggctgctaaggtgatggtcaccaatgtgacttccctgctgaagacggtgaaagcggttgaggatgaggccaccaggggtacccgagccctggaagccaccattgagtgtattaaacaggagttaacagttttccaaagcaaggacgttcccgagaagaccagtagccctgaggagtcaatcaggatgacaaagggaataacaatggcgaccgctaaagcggtcgcagctggcaacagctgtcggcaagaagatgtcattgccacggccaatctgtcccggaaagctgtgtctgatatgctgactgcgtgtaagcaggcctcgttccaccctgacgtgtccgacgaggtgagaacccgagccctacgatttggcacggagtgcactctggggtacctcgacctccttgagcacgtgcttgttatcctgcagaagcctacccccgaattcaagcagcagcttgccgctttctccaagagagtagccggtgctgtgaccgagctgatccaggcagcagaggccatgaaaggaactgagtgggtagacccagaagatccaaccgtgatcgccgagactgagctcctgggagccgctgcgtccattgaggccgcagcaaagaagctcgagcagctgaagcctagggcaaaaccaaagcaggcggatgaaactttggacttcgaggagcagatactggaggcagccaagagtatagccgcagccacgtcggctctcgttaagagtgcctccgcagctcaacgggaattggtggctcagggaaaggtaggcagtatcccagctaatgccgctgacgatggacaatggtctcagggtctgatatcagccgcaaggatggtagccgcagctacctctagtctctgtgaagccgctaacgcatccgtccagggccacgcttcagaagagaaattaataagttctgctaagcaggtggcagccagcaccgcccagctcctggtggcatgtaaagtgaaggccgatcaggattcggaggcaatgaggaggctgcaggccgctggaaatgccgttaagcgagctagcgacaatcttgttcgcgctgcacagaaggcagccttcggcaaggcagatgatgacgatgttgtggtgaaaaccaagttcgttgggggaatcgcccaaattatcgcagcacaggaggagatgttgaagaaggaacgcgagttggaagaagcaagaaaaaaacttgcccagatcagacaacagcagtataagtttctccccaccgaactccgtgaggatgaaggctac

SEQ ID NO: 243394 - DNA, 7628 bp, Artificial Sequence
  Description of Artificial Sequence: Synthetic coding sequence
atggtcgccctgagtctaaagatttgcgtacggcactgcaatgtggtgaagactatgcaattcgagccgtcaaccgcagtgtatgatgcctgcagggtcattcgtgaaagagtccctgaagctcaaaccggtcaggcatccgactacggactctttttatccgacgaagaccccagaaagggcatctggcttgaggcaggacgtactctggactactacatgttgaggaacggcgatattctcgagtacaagaagaagcaacggccacagaagatacggatgctggacggcagtgttaagacagtgatggtagatgatagtaagacggtgggcgaactgttggtgacgatctgctccagaattggtattaccaactatgaggagtatagcctcattcaggagacaatagaggagaaaaaggaagagggaacgggaacccttaaaaaagaccggaccttgctgcgggacgagaggaagatggagaaacttaaggccaagctccacactgacgacgatctgaattggcttgatcattccagaactttccgcgaacagggcgtggacgaaaacgagacactgttgctgaggcggaaatttttctactcagaccagaatgtagacagccgagatccggtccagctgaacctcctctatgtgcaagccagggacgacatccttaatggttcccaccccgtgagctttgagaaagcatgtgaatttggtggtttccaagcgcagatacagtttgggccacatgtggagcataagcataaacctggattcctcgatctgaaagagttcctccccaaggaatacatcaaacaacgaggggcagagaagaggattttccaggagcataagaactgtggcgagatgtcggagatcgaagctaaagtaaagtatgttaaactggcacgatctctgcgtacatatggcgtatcatttttcctagtaaaagaaaaaatgaaaggaaaaaacaagctcgtgcccaggctgttgggcataacgaaggacagcgtgatgagggtggacgagaaaaccaaggaggtattgcaggagtggcctttaactaccgtgaaaaggtgggccgcaagcccaaaatctttcactctggattttggggagtatcaggagtcttattacagtgtccaaactacagaaggagaacagatttcccagttgattgccggatatatcgacattatactgaagaaaaaacagtccaaagataggttcggcttggaaggtgatgaagagagcacaatgctcgaagaatctgtttccccaaagaagtcaacgatcctgcaacagcaattcaatcgaacagggaaagccgaacacgggtccgtggccctgccagcggtgatgaggtctggatctagcggcccagagacgtttaatgtgggatctatgccttcaccacaacagcaagtgatggttggccaaatgcatcgagggcacatgcccccactgacatccgcccagcaagcgctgatgggaacaattaacacttctatgcacgccgttcagcaagcccaggatgatctgagtgaattagactccttgccacccctggggcaggacatggcctcgagggtgtgggtgcagaataaagttgatgaatccaagcacgaaatccattctcaggtggatgccattaccgcaggcaccgcatcagtggtgaacctgactgctggggatcccgctgacacagactacacagccgtgggttgcgccatcaccacgattagctctaacctgactgagatgagtaagggggtgaagttgctggccgctcttatggatgatgaggttgggtccggcgaggacctgcttcgagcggctcgtaccctggccggtgccgtgtccgacctgttgaaggccgtccagcccactagcggcgagcccaggcagaccgtgttgacagcagcaggaagcattggccaggcctctggagatctgctgaggcagattggcgagaatgagacagacgagagatttcaggacgtccttatgagcttggcaaaagccgtcgctaatgctgccgcaatgcttgtgctcaaggctaaaaatgtggcacaggttgccgaggacacggtccttcaaaatcgcgttattgcagccgcaactcagtgtgcgttatccaccagccagctggtcgcctgtgccaaggtcgtcagtccgaccatttcaagccctgtatgtcaggagcagctgatagaggcaggtaaacttgtcgacagatccgttgagaactgcgtccgggcatgccaggcagcaaccaccgacagcgagctcctcaagcaggtatccgcagcggcatcggtggtcagtcaagccctgcacgatttgttgcagcatgtgcgccaattcgccagtagaggagaacccattggtcgctacgaccaggctaccgataccattatgtgtgtaaccgaatcaatcttcagctctatgggtgatgctggcgagatggtccgtcaggccagggtgctggcccaagctacatctgacttggtaaacgctatgcggtccgacgctgaagcagagatcgacatggagaattctaagaagctgctggcagcagctaagctgctcgctgattcaaccgctaggatggttgaggctgccaaaggcgctgccgctaatccagagaatgaggatcagcaacagcgcctccgggaggctgcagaaggactgagggtggccactaatgcagccgcacagaatgccattaagaaaaagatcgtcaaccgactggaggttgcggctaaacaggcagctgccgcagcgactcaaaccatcgccgcatcacagaatgcggctgttagtaacaagaaccccgcagcccaacagcagctcgtacaaagttgtaaagccgtcgctgaccatattccgcagctcgtccaaggagtcagaggctcccaggcccaagccgaggacctgagtgctcaactcgcgctgattatctcctctcagaactttcttcagccaggcagcaagatggtctcaagcgcaaaggccgctgtccccacagtctccgatcaggctgccgctatgcaattgagccagtgcgcgaaaaatctcgccacgtccctcgccgaactgcgcactgcctcacagaaagcccatgaggcctgtgggcctatggagattgactctgccctaaatactgtacaaacacttaagaatgaactacaggatgcaaagatggccgctgtggaatctcagctgaaacccctgcctggagaaactctcgaaaagtgcgcccaagatctcgggtccacctctaaagcagtgggatctagcatggctcagctgttaacctgcgccgcacagggaaatgagcactatacaggtgtggccgcaagagaaacagcacaagctctgaagactctggcccaagccgctcgaggggtcgctgccagtaccacagaccctgcggcagcccacgctatgttagacagtgctagggatgtgatggaaggatctgccatgctgatccaggaggcaaagcaggcgctgattgctcctggagacgcagaacggcaacagcgcctggctcaggtggccaaggccgtttcccattccctcaataactgcgtgaattgtctgcctggccaaaaagacgtggacgtggcattgaagagcatcggcgaaagctcaaagaagttgcttgtcgattctcttccacccagcaccaagccatttcaggaagcccagtccgagctcaatcaggccgctgccgatcttaatcagtctgccggagaggttgtgcatgcaacccgtgggcagagtggtgagctggccgcagcttcaggtaaattttccgatgacttcgatgagttcttagacgccggtatcgagatggcgggtcaggcccagacaaaggaagaccagatccaggtgattggcaacctcaaaaacattagtatggcttcaagtaaattactgctggctgcaaaatccctgagcgtagaccctggagcccctaacgcaaaaaacctgctggccgcagcggctcgcgcagtcacggagagcatcaatcagctcattacactctgcacacaacaggcgccaggccaaaaagagtgcgataatgcgttgcgagaactggagaccgtgaaaggcatgctggacaacccgaacgagcctgtgagcgatctcagctatttcgactgtattgaaagcgtgatggagaactccaaagtactgggcgaatcaatggccggtatttcccagaatgccaaaacaggcgatttgcctgcctttggtgagtgtgtgggcatcgccagcaaagcactatgcggccttaccgaggcagcggcacaggccgcttacctggtcggtatttcagaccctaactcacaggctggccatcagggactcgtggatccaatccagtttgcaagagctaaccaggcaattcagatggcgtgtcagaatttggttgaccctggttctagcccttcacaggtattaagcgctgccacaatcgtagctaaacatacctctgccttatgcaatgcctgcagaatagcctccagtaaaaccgcaaatccggtggccaaacgacatttcgtacagtcagctaaggaggttgcaaattcaactgctaacctcgtgaaaacgatcaaggcgcttgatggggatttttcagaggacaaccgcaacaaatgcagaattgcgaccgcgccactcattgaagccgttgaaaacctaacagcttttgcctcaaatcctgagtttgtaagtatacctgcccagatcagctccgaaggctcccaagctcaggagccaattttagtctcggccaagaccatgttagaaagttcctcatacctgatcagaaccgcaagaagcctggccattaatcccaaagatccaccaacctggtccgtgctcgccggacattcacacaccgtctccgacagtatcaagtccctcatcacttcgattcgcgataaggctcccggtcagagggaatgcgactattcaatcgacggtattaataggtgcatcagagatattgagcaagcgagcctcgctgcagtttcccagagcttggccacccgcgacgacattagcgtcgaggccttgcaggaacaattgacaagtgttgttcaggaaattggtcatctgattgatcccattgctacagccgctaggggagaggccgctcagctgggccacaaagtgacccagctggcttcatatttcgaaccgttgatcctggccgctgttggcgtagcaagcaagattctcgatcaccagcaacaaatgactgtgcttgatcagaccaagaccctggcagaaagtgctcttcagatgttgtacgctgctaaggaaggcggagggaatcctaaggctcagcatacccacgatgctattacagaggccgctcagcttatgaaggaggccgtcgacgacatcatggtgacacttaacgaggccgcatccgaagtcggcctggtaggtggcatggttgatgccatcgctgaggctatgtctaaactcgatgaaggcaccccccctgagcctaagggcacattcgttgattaccagacgacagtcgtcaagtactctaaggctattgccgtgacagctcaagaaatgatgaccaagtctgtgacaaaccccgaggagctcggtggtctggctagtcagatgacaagtgactacggacatctggcattccagggtcagatggccgctgccacggctgaacctgaagaaatcggcttccagattcgaactagagtacaggaccttggacatgggtgtatattcctggtccagaaagccggtgctttgcaagtgtgcccaaccgactcctacaccaaacgtgagctgatagaatgcgcgagagctgtcacagagaaagttagtctcgtgctctccgctctgcaggcagggaacaagggcactcaggcctgtattaccgctgctactgccgtgagcggcattattgcagatctggacaccactatcatgtttgccactgcagggactctcaatgccgaaaattccgaaacatttgcagaccatcgcgagaacatcctgaagaccgccaaggctctcgttgaggacacaaaactcctagtgagcggcgcagcgtctactcctgataagctcgctcaggctgcacaatctagcgcggctactattactcagctggctgaagttgtcaagctcggagcggctagcctggggtctgacgaccctgagacacaggtggttttgattaatgcaatcaaggacgtagctaaggcattgtcagatctcatcagtgcgacaaagggagccgcttcgaagcccgtggacgatccatcaatgtaccagctcaagggagccgctaaggtgatggtcacgaatgtaacctccctgttgaaaacagttaaggcagttgaggatgaggcaacccgtgggacccgggctctggaagccactatcgaatgcattaagcaggagttgaccgtgtttcagtctaaggacgtcccggagaagacatccagcccggaggagtccatcaggatgaccaaaggcattactatggctaccgcaaaagctgttgccgcagggaattcctgtagacaggaagatgttatcgcgaccgccaatctttctcgcaaggccgtgtctgatatgctgaccgcctgtaaacaggctagcttccaccccgacgtgtcagatgaggtccgcacaagagccctgcgctttggcaccgaatgtacacttgggtatctcgatctgctggagcatgttctggttattctgcagaaacctacgccggagttcaaacagcagttagctgctttcagcaagagggtggctggggctgtcaccgagctgatccaggcagcagaggcgatgaaaggtacggaatgggtcgatccggaagaccctactgtgatcgctgaaactgaactcctgggcgctgctgcaagcatcgaagccgcagccaagaaattagagcagctcaaaccacgggctaaaccgaagcaggcagacgaaacactagatttcgaggagcagatactggaggcagcgaagtctatcgccgcagcgacctccgctctggttaagtctgcatccgcagctcaacgtgaactggtggcccaaggaaaagtgggatccatccccgcaaatgccgctgacgatggccaatggtctcagggcttgatctctgccgctcgcatggtcgccgctgccacatcttctttgtgcgaggcagctaacgcttccgtgcaaggccacgcgtccgaggaaaagctgattagcagtgcgaaacaggtggctgcaagtactgcccagctcttagtcgcttgcaaagtgaaggctgaccaagattcagaggctatgaggaggctgcaagccgcagggaacgccgttaaacgggcttccgacaacctcgttagggcagcccaaaaagcggctttcgggaaagccgacgacgatgacgttgtcgtgaagacaaaatttgtcgggggaatcgcacaaattatcgccgctcaggaagaaatgctcaagaaggaacgcgagctggaagaagccaggaaaaaactcgcacagattcggcaacagcagtacaagtttttgcccacagagctccgggaggacgaaggtta

SEQ ID NO: 243395 - DNA, 5190 bp, Artificial Sequence
  Description of Artificial Sequence: Synthetic coding sequence
atgaaagtgagcacacttcgggagagtagtgctatggctagtccattaccccgtgaaatggaggaagagctggtgcctacggggtcagagccaggcgacacaagggccaagccaccagtaaaaccaaaacctagagccctgccggcaaagccagctctgccggcaaagccgtcactgcttgttccagtgggcccacgacctccccgaggcccattggcagaactcccctctgcgaggaagatgaacatgttggccggaccgcaaccctacggaggctccaaaagaccactgcccttcgcacctcgaccagctgttgaggcctcgaccggaggagaagccacccaggagactggaaaggaagaggcaggtaaggaggaacctccccctttgacaccccctgctcggtgtgccgctccgggtggggtgaggaaggctccagcaccattccgcccagcctctgaaaggttcgcggctaccaccgtggaggagattctagccaaaatggaacaaccaaggaaggaggtcctggcgagccccgatcgattatggggatcccgcttgaccttcaatcatgacgggagctctcggtatgggcctaggacatacggaactacaactgcccctagagatgaagacggatctacacttttcaggggatggagtcaggaaggcccagtcaaatcacccgctgaatgtcgcgaagagcattctaaaaccccagaggagaggagcctgccgtctgacctggcatttaatggcgaccttgctaaagcagctagcagcgagcttccagctgatatcagcaagccatggatcccgagtagcccagccccttcctcagaaaacgggggaccggcatcccctggactcccagcggaggcctcaggaagtggtccgggatcccctcaccttcacccacccgataagagctccccatgccattcacaactactagaagcccaaacgcctgaagcaagccaggcatcaccctgtcctgccgtcacccctagcgcacccagcgctgcattgccggatgagggatctcggcacacgccttcgcctgggctgcccgcagaaggggctccggaggcacctaggccatcctccccacctccagaggtcttagaaccacacagcctggaccagccccctgccacatccccccgaccattaatcgaggtaggcgaactgctggatctgacacgcacttttcccagcggcggagaagaagaggctaaaggcgatgctcacttgagacctacaagcctggtacagagacggttttcagaaggtgtgctgcagagcccatcacaagatcaggaaaagctgggcggatccttggccgctctacctcagggtcagggcagccagctggccctggacagacccttcggcgctgagtccaactggagtctctcgcagtcctttgagtggacattcccgactcgaccttccggactcggcgtttggagactggatagtccacccccatctccaatcacagaagcaagcgaggcagctgaagcagccgaagctggaaacctcgcggtatcatctagggaggaaggcgtctcacaacaggggcagggggcaggctctgctccatccggaagcggaagctcttgggtccagggggatgatccctctatgagtcttacccagaagggggacggcgaatcccagccgcagttccctgctgtgccactcgaacctcttcccaccaccgaggggactcccggtctccccctacagcaggctgaagagcgctacgaatcccaagagccactggcaggccaggagagtcccctgccactagctacccgggaagcagctctgcctattctggaacctgtgctgggtcaggagcagcccgctgcaccagaccaaccttgcgtgctgtttgcagatgcaccagaacccggtcaggctctgccagtcgaggaagaggcagtgacgcttgcccgagcagagacaacacaggctagaactgaggcgcaggatctctgtcgcgcatcaccagagcctcctgggcctgagtcatctagtaggtggctcgatgatctgctagcctcccccccacccagtgggggaggagcaagacgcggagctggcgctgagctgaaagacacccagagtccctctacctgcagcgagggactgcttgggtggtcgcagaaagacctacagtctgaattcggcataaccggggatcctcaaccctcatccttttctccatccagctggtgccagggggcatctcaagattatggccttgggggagctagccccaggggcgatccgggactcggcgagagggattggacctctaagtacgggcagggcgcaggagaaggtagtacaagggagtgggcctctcggtgcggcatcggtcaggaggagatggaagccagttcaagtcaggaccagagtaaggtctctgctcctggcgtgttgacagcccaggatcgggttgtaggcaaacctgcccagctggggacacagaggagccaggaagccgacgtgcaggattgggagttcaggaagagagattctcagggcacctactcatcccgggacgccgaactgcaagaccaggaatttggcaaaagagattcactgggcacatactcaagccgggatgtgtccctaggggactgggagttcgggaaacgggatagtttaggggcatacgctagtcaggatgcgaatgagcaaggacaggaccttggtaaaagagaccatcatggtagatacagctctcaggacgctgatgagcaggactgggagttccagaaacgagacgtcagcctggggacctacggatcccgggcagcagagccccaggaacaagagtttggaaagtcggcctggatccgcgactactcctccggagggagctcgcgcaccttggatgcccaggatcgctctttcggcacccgacccttgagttcaggtttttctccagaggaagcacagcagcaggatgaagagtttgagaagaagatcccctcagtggaagatagcctgggagaaggctcccgcgacgccggaaggcctggcgaacggggttctggcggactttttagcccttctaccgcccatgtgcccgacggagctctgggccagagggaccagtcgagctggcagaatagcgacgcttctcaggaggtaggtggccatcaagagcgtcagcaagctggagcacagggaccaggctcagctgatctggaagatggtgaaatgggaaagcgtggttgggtaggcgagtttagtctgtccgtcggaccgcagagagaggcggctttttcaccaggtcaacaggattggtcccgcgacttctgcatcgaagcctccgaaagatcataccaatttggaatcatcggaaatgatcgggtgtctggcgcaggattctctccatcctccaagatggaaggaggacatttcgttccccctggcaagaccacagccggatcggtggactggacagaccagctgggacttaggaacctcgaagtgagctcatgcgtgggctccggcggaagttcagaggcccgagagtcggctgtgggacagatgggatggagcggagggttgtccctgcgagacatgaatctaacagggtgcctggaaagcggtgggtcagaggagcctggtggcatcggggtgggcgaaaaggactggacctccgatgtgaacgtcaaatccaaggacctggccgaggtgggcgagggcggagggcacagccaagcccgagaaagcggggtcggccagacagactggtccggggtggaggccggtgaattccttaaatcaagggaacgaggagttggccaagccgattggacccctgacctggggctacgtaacatggctccaggcgctgtgtgctcaccaggtgagagcaaagagctcggggtaggccagatggactggggaaataacctggggctccgtgatctggaggtgacttgtgatcctgactctggtggaagccaaggcctaagagggtgtggagttggccaaatggattggacgcaagacttggccccacagaatgtggagctgttcggggcaccctctgaagctcgcgaacatggcgtgggaggcgtgagtcagtgcccagagcctggcctcaggcacaatgggagcctcagcccaggactcgaagcccgtgatcctttagaggcacgggaactgggcgttggagagacttccggaccagaaacgcaaggtgaagattatagtagttcatcgctagagcctcatccagcggatcctggcatggaaacaggtgaggcactgtcatttggagccagtcccggacggtgtcccgctcgacctcctccgagtggttctcagggtttgcttgaagagatgctggcggctagtagcagcaaggccgtcgccaggagagagtcagccgctagcgggctggggggattgctggaggaagagggcgcaggggcaggagccgctcaggaggaggtcctcgagcctggccgtgatagcccaccctcctggcggcctcagccagatggcgaggcgtctcaaacggaggacgtggatggcacatggggatcatctgccgctcgatggtctgatcagggtccagctcagacctctaggaggccctcccaaggccctcctgcgaggtcaccctctcaagatttctctttcatcgaagataccgaaattctcgacagcgctatgtacagaagccgggcaaatctagggagaaagcgaggccaccgcgctccagtcatcaggcctggcggaacactgggattgagtgaagctgctgacagtgatgcacacttgtttcaggactcgactgaacccagggctagccgcgtgccttccagtgacgaggaagtggtggaggagcctcagagccggaggaccagaatgtccctgggcaccaagggccttaaggtgaacctgttcccgggactgtccccctctgcccttaaggcaaagcttcgaccaaggaataggtctgcagaggagggtgagcttgcagaatcaaagtctagtcagaaagagtccgcagtccagcgaagcaaatcatgcaaagttcccggattaggaaagcctctgacccttcctccaaagcctgagaagagctcaggtagcgaaggctctagccccaactggctccaggccttaaagctgaagaagaagaaggtctag

SEQ ID NO: 243396 - DNA, 432 bp, Artificial Sequence
  Description of Artificial Sequence: Synthetic coding sequence
atgaaggtgagcacactgagggaaagctccgccatggcctccccactccctcgggaaatggaagaggagctagtcccgaccggttcagagccaggggacacaagagccaaaccaccagtcaaacccaaacctcgagcacttcccgctaaacccgctctccctgccaagcccagtcttcttgtgccggtcggcccaagacccccaaggggccctttggccgaattgcccagtgcccgtaagatgaatatgctagccggtccgcagccatacggagggtcgaagcgccctctgcccttcgcccctcgtccggctgtggaggcgagtaccggcggtgaggctacgcaggaaaccggaaaagaagaagccggtaaggaagaaccaccccctctgactcctccggcacgctgcgctgctcccggtggggtccgttag

SEQ ID NO: 243397 - DNA, 5189 bp, Artificial Sequence
  Description of Artificial Sequence: Synthetic coding sequence
atgaaggtgagtactttgcgtgagtccagtgcaatggccagccccctgcctagagagatggaagaggaattagtcccaacgggatctgagcccggtgacactagagcaaaacctccggtcaaacccaaacccagggccctcccggcaaagcctgcgctgcccgctaaaccaagcctcctggtcccagttggccctagacccccacgtggaccactggctgaactgccaagcgccagaaaaatgaatatgcttgccggtccccaaccatatggcggaagtaaacgccctctgccctttgcacctcgacccgcagtggaggcttccacaggaggtgaagcaacccaggaaacgggcaaggaggaggccggaaaagaagagcctcccccacttacgcccccagcccgatgcgccgcacctggaggcgtgcggaaagccccagcaccgtttcgccctgctagcgagaggttcgcagccactaccgtcgaggagatcctcgcaaaaatggagcagcctagaaaggaagtgctagcaagtcccgataggctgtggggctcccgactcacattcaatcacgatggcagtagtcgctacggtcccagaacatacggcacaaccacagccccacgggacgaagacggctcaacattattccgagggtggagccaggaagggcctgtcaagagccccgcagaatgtcgggaggagcattcgaaaaccccagaagagagaagcctgcccagcgatctggctttcaatggcgacctggccaaggcagcaagttccgaactgcccgcagacatttccaagccatggatcccttcaagtcctgctccctcttcagaaaacggtggtcccgcatcaccaggactgcctgcggaggccagcggctcaggtcccggatcaccgcacttgcaccctcccgacaagtcttcaccctgtcattcacagctactcgaggcacagaccccggaggccagtcaagccagtccttgccccgcagtcacaccgagcgctccctctgccgctcttcctgatgagggctctcgccacacaccttcccctggcttgcccgcagagggtgctcctgaagcacctcgacctagttctccccctccagaagtcctggaaccgcattctctcgatcaacccccagccacttctccaaggccccttatcgaggttggtgagctcctcgatcttacaaggacgtttcctagcgggggagaggaggaagcgaaaggcgacgcccaccttcggccaaccagcctggtgcagcgacgcttctcggaaggcgttcttcaatccccatctcaggatcaagaaaagctcggcggttccctggccgctctgccccaaggccagggcagccagcttgctctggaccggccattcggggctgaaagtaactggagcctgagccaatcatttgaatggactttccccaccagaccttctgggcttggcgtgtggcgcctcgacagccctcctccctctcccatcaccgaagcctccgaagcagctgaggcagcagaagcaggcaacctggccgtgtcctcccgcgaggaaggcgtgtctcaacaagggcaaggcgctgggtctgccccaagtggcagcggatcctcttgggtgcagggagacgatccctcaatgagcctgactcagaagggggatggcgagtcccagccccagtttcccgctgtcccattggaaccactcccaaccaccgagggcacccctggcttacccctgcagcaggccgaagagagatacgagtcccaggaacccctggctgggcaggagtcgccattgccactggcaacacgcgaggctgctctacccatcctggaacctgtgctgggacaggagcagccagccgcaccggatcagccttgtgttcttttcgccgatgcacccgaacccggacaggctttgccagttgaagaggaagctgtcactctggccagggcagaaacaacccaggcccgaactgaggcccaggatctgtgtcgtgcatctcccgagccacccggtcccgagtcgagctctagatggctggacgacttgctggcctccccgccaccatccggaggaggggcacggagaggcgctggagcagaattgaaagatacacagtctccttctacctgttcggaaggcctccttggctggtcccagaaggatcttcaaagcgaattcgggattactggggatccccagcccagctcattttctcctagcagctggtgtcagggagcctctcaagactatggccttggcggtgccagccccaggggcgacccagggctgggagaaagggactggacttccaaatacggccagggcgctggagagggcagcacccgagagtgggcgagtcgatgcggtattggccaggaggagatggaagcctcctcatctcaggatcagtcaaaggtgagtgctccaggtgtgcttaccgcccaagaccgggttgtgggcaagccagcccaactgggaacgcagcgttctcaggaggccgacgtgcaggactgggaattcagaaaacgcgactcccagggcacatattcttctagggacgctgaactgcaggaccaggagtttgggaagcgcgacagtctgggaacctatagttccagggacgtgtccctgggtgactgggaattcgggaagagagactctctgggggcttatgcctcccaagacgcaaacgaacaggggcaggatcttggcaagagagatcaccatgggaggtatagttctcaagatgccgacgagcaagactgggagttccagaagcgcgacgtatccttgggaacctacggcagtcgggctgctgagcctcaggagcaggaatttggcaaatccgcatggatccgcgactactcatccggaggaagttcacggaccctagacgcacaagatcggtccttcgggaccaggccactgtctagtggcttcagccctgaagaagctcagcagcaagatgaggaatttgaaaagaagattccctcagtcgaagattctctcggggaaggaagcagagacgcgggacgcccaggggagagagggagtggcggactgtttagcccttctacagcacacgtaccggatggcgctctaggtcagagagaccagagctcatggcagaattcagatgcctctcaggaagtcgggggacaccaggaacgtcagcaggccggagctcaaggtccaggctccgccgacctggaagacggagagatggggaagaggggttgggttggtgagttcagtctgtccgtcggaccccagcgggaagccgctttttccccaggccaacaagactggtcacgggacttctgtattgaggctagcgaacgctcctatcagtttggaatcatcggcaatgaccgcgtcagtggcgcaggattttcacctagttcgaagatggagggagggcacttcgtaccacccggaaaaaccaccgccggatccgtcgattggaccgaccaactgggtcttagaaatttagaagtctcctcttgtgtgggtagcggtggcagttccgaagcacgcgaatccgcggtgggacagatggggtggtctggaggtctgtccctgcgtgacatgaacctgaccggctgcctggaatctggaggaagcgaggagcctggtggtatcggcgtcggcgagaaagattggacttccgacgtaaacgtaaagagtaaagacctggcagaggtaggggaagggggaggccattcccaggctagggaatccggtgtgggccagaccgattggtccggggtggaggccggtgagttcttaaaaagccgcgagcggggagtgggacaggcagactggactcctgacctgggcctgcgcaacatggctcccggagcggtgtgttccccaggagagagcaaagaactgggcgttggccaaatggattgggggaataacctcggtttaagggatctcgaggtgacctgtgatcctgacagtggcggatcacagggccttcggggttgtggcgtaggacagatggattggactcaggacttggcaccccagaatgtggagctgtttggtgcaccatcagaagcgagggaacacggggtaggaggggtatcccaatgtccagagcccggactgcggcataacggaagcttgtctcctggactggaggccagggaccctctggaggctagggaattaggcgtaggtgagacctcgggtcccgagacccaaggagaggactactcctccagctcactggagccccaccctgcggatcccggaatggagacgggggaggctctctccttcggagcctctcccggacggtgtccggctcggccaccacctagcggctctcagggtcttctggaagagatgctcgcagcgagctcttctaaggccgtggccagaagggaatctgctgcttcaggactaggaggccttctggaggaggagggggcaggcgctggcgcagcccaggaggaagtgctggaaccaggaagagactctcccccttcgtggcgtcctcagccagatggagaggcctctcaaaccgaagacgtggacggaacctggggttcttcagctgctcggtggtccgatcagggacccgctcaaacttccaggcgcccaagtcagggccctcccgctcgatcaccatctcaggacttttcatttattgaggacacggaaattctcgattccgccatgtaccgttctagggcgaatttggggagaaaacgaggacaccgcgctcccgttatcaggcccggtggaactctcggcctgtcagaagcggctgactctgacgcccatctgtttcaagattcaaccgaacccagggctagcagagtgccaagctccgacgaagaagtggttgaggaacctcagagtcgcagaaccaggatgagtttagggaccaagggccttaaagtgaatctgttcccgggactgagccctagtgccctgaaggctaaactgagacctcggaatagatctgccgaggagggcgagttggcggaaagcaaatcttctcaaaaggagtctgcagttcaacggtccaaatcttgcaaggtgccaggcctcgggaagcctctaactttacctcctaaacctgagaaatcctccggttcagaaggctcttctccaaactggttgcaggctctgaagttgaaaaaaaaaaaggtgta

SEQ ID NO: 243398 - DNA, 3006 bp, Artificial Sequence
  Description of Artificial Sequence: Synthetic coding sequence
atgccatctaccaatcgggctggtagtctcaaggatccagaaattgccgagctgttcttcaaagaagacccagaaaagctgttcaccgaccttcgggaaatagggcacggaagttttggcgctgtgtactttgccagagacgttcggacgaacgaagtcgtggccattaaaaaaatgtcctactctgggaaacaatcaaccgagaaatggcaggatatcatcaaggaggtcaagttcttacagcggattaagcacccaaacagtatcgagtataaaggatgctacttgcgcgaacatacagcttggctggtaatggagtactgcctcggatccgctagtgatctgctggaagttcataagaagcccttgcaagaggtcgagatagcggctataacccatggcgcattacagggtttggcttatcttcactctcacaccatgatccatagagacatcaaagcgggaaacattctgctgaccgagcctggtcaggtgaagctggcagactttggatcggccagtatggcaagccccgcaaactcatttgtgggcacgccttactggatggctcctgaggtcatcctggccatggatgaggggcagtatgatggtaaggttgacgtttggtccctgggcataacttgcatagagttagccgagcgcaaacctcccttgttcaatatgaatgctatgtcagctctgtaccatatcgcccaaaacgaatcacccactctgcagtcaaacgagtggtctgattatttccggaactttgtggactcttgcctccagaagatcccgcaggatcggcctactagcgaagagctgcttaaacacatcttcgttttgcgagagagacccgagaccgttctaattgatctcatccaaagaaccaaggacgctgttagggagctggacaatctgcagtatcgcaagatgaagaagctgctgttccaggaggcccacaatgggccagcagtagaggcgcaagaagaggaggaagagcaagatcacggagttggcaggacaggaaccgtgaattccgtgggttcgaatcaatctattcctagcatgagcattagcgccagttcccaatcctcttctgtaaactcgctccctgatgtgtccgatgacaaatcagaacttgatatgatggaaggcgatcatacagtcatgagcaactcttccgtaatccacctgaaacccgaagaggaaaattacagagaagagggggatcccaggactcgggcatcagacccccagagtcctcctcaggtaagccgccacaaatcacattacaggaatcgcgagcactttgctacaatacgcacagcctctctcgtcacacgccagatgcaagagcacgagcaggactccgaacttcgggagcagatgtcagggtataaacgaatgagaagacagcatcaaaaacagctaatgacgttagagaataaactgaaggccgagatggatgagcacaggctccggcttgacaaagatctggaaacacaacgcaataatttcgccgctgaaatggaaaaattgatcaagaagcatcaggccgcaatggaaaaggaggccaaagtaatgtcaaacgaagagaaaaaatttcaacaacacattcaggcccagcagaagaaggaattgaatagctttctggaatcccagaagcgagagtacaagctgcggaaagaacagttgaaagaagagctcaacgagaaccagagcactccaaagaaagaaaagcaggaatggctatcaaaacagaaggaaaatatccagcattttcaggccgaggaggaggccaatctccttaggcggcagcgacagtacctcgagttggagtgcaggcgattcaagcggaggatgctgctggggagacacaacctcgagcaagacttggttcgggaggagcttaataaaagacagacccagaaggatctggagcacgctatgcttctaaggcagcacgagtctatgcaagagctagaattccggcacctgaacaccatccaaaagatgcgctgcgaactgatccgcctgcaacaccagacggaactgaccaaccagctagaatacaataagcgaagggagagagagctgaggagaaagcacgtgatggaagtgcgccaacaacccaaatcactcaagtccaaagaactgcagataaaaaaacagtttcaggatacatgcaagattcagacacggcagtataaagcattgagaaaccatctcctggagactacgcccaagagcgaacacaaagcggtgctgaaaagattaaaagaggaacaaacccgcaaactggcgatcctagccgagcaatatgaccactctattaacgagatgttaagcacccaggccctgcgattggacgaagcacaggaagccgaatgccaggtgttgaagatgcaactgcagcaggaattagaacttctaaatgcttaccagtcgaagatcaaaatgcaggcagaagcacaacacgacagagaactacgtgagctggaacagcgcgtcagccttcggagggccctcctagagcaaaaaatcgaggaggaaatgctcgctttacagaatgaaagaaccgaacggatacgatcattgctggagaggcaagccagagagatagaggcattcgacagcgagagcatgagactgggattctccaacatggtgctgtcaaatttgagcccagaagccttctcgcactcctaccccggtgccagcggatggtcacacaatcccaccggaggacccggacctcattgggggcacccaatgggcggacctccccaggcttgggggcatccgatgcaaggtggccctcaaccctggggacacccgagtgggccaatgcagggagttccgagaggctctagcatgggggtgcgcaattccccacaggcgcttcggaggaccgcttctggtggacggactgagcaaggcatgtctcgctctacctcagtaactagccaaatctcaaacgggagccacatgtcttatacctag

SEQ ID NO: 243399 - DNA, 2562 bp, Artificial Sequence
  Description of Artificial Sequence: Synthetic coding sequence
atgccaagcacaaatagggccggttctctgaaagatcccgaaattgcagagctattttttaaggaagatcctgagaaactgtttacagacttgcgggaaataggtcatggaagctttggtgccgtgtattttgcgagagatgttaggacaaacgaagtggtggcaattaaaaagatgtcgtatagtggaaagcagtctactgaaaaatggcaagacattatcaaggaggtaaagtttttacagaggatcaaacacccaaattccattgagtacaaaggatgctatctgcgcgagcacacagcttggctggtcatggaatactgccttggctccgccagcgacctcctggaggtgcataagaagcctttacaagaggtggagattgctgctattactcatggtgcactgcagggactggcttacttgcattcacatacaatgatacaccgcgacatcaaggctggaaacatcctgcttaccgaaccaggacaggtcaagctcgctgactttggtagtgccagtatggcaagcccagctaatagctttgtgggaacaccttactggatggctcctgaagtgatattggccatggatgagggccagtatgatggaaaggttgatgtctggagcctcggcattacatgcatcgagctggccgagaggaaaccccctttgtttaacatgaatgcaatgtccgccctgtatcacattgcccagaacgagagcccgactcttcagagcaatgaatggtctgactatttccgtaattttgtcgacagctgcctccagaagattccacaagaccggcctacctccgaggagctgctgaagcacatcttcgtgctgagggaacggccagaaacagtgctgatagacctgatccaacgtactaaggacgccgtacgcgaactggataacctgcagtaccgtaaaatgaaaaaactcttgtttcaagaagctcataacggcccagctgtggaagcacaggaagaggaagaagaacaagaccacggagtgggcaggacggggactgtgaactccgtcggttccaaccaatccattccctctatgtctatctctgcctctagtcaatcttcatctgtgaattcactgcccgatgtgagtgacgacaagtcagagctggatatgatggaaggggatcacaccgttatgtctaattcaagcgtcatccacctaaaaccggaggaggaaaattacagggaagagggcgatcctaggacacgtgcctcggacccccagtcacctcctcaagtctctcggcacaagagccactatcgcaatagagaacactttgcaaccattcgcacagcatcgttggtgacccggcagatgcaggagcacgagcaggactccgagttacgggagcaaatgtctggatacaagcgcatgcgccgacaacaccagaaacagctgatgacacttgaaaataagctcaaggccgagatggacgagcaccgcctgagactcgacaaggacctggaaacccagaggaacaattttgcagccgaaatggagaaacttatcaaaaaacatcaggctgcaatggaaaaagaggccaaagtaatgtccaatgaagagaagaagtttcagcagcacattcaggcccaacagaaaaaagaactcaactctttcctggaatctcagaaaagggagtacaagctgcggaaggagcagctgaaggagtctaaagaactgcagatcaaaaaacaatttcaggacacctgcaagatacagacacggcagtataaagccttgaggaaccatttattggagactacacctaaaagcgagcacaaggccgtgctaaagagactgaaagaggagcagaccaggaaacttgccatccttgctgagcagtacgatcattctatcaatgaaatgttgagcactcaggctctaaggctcgatgaggcccaagaggctgaatgccaggtcctgaaaatgcagctccagcaagaactcgagctgctaaacgcttaccagtccaaaatcaaaatgcaggcagaagcacaacacgacagagagcttagggagctcgaacaacgcgtgtcactccgaagagcgctactggaacaaaaaatagaagaggaaatgctcgccctgcagaatgaacgaaccgagagaattagatcattactcgaacgccaggctagggagattgaggcattcgacagcgagtctatgaggcttggcttttccaatatggtactttccaacctctcccccgaggctttcagccacagctaccctggagcttccgggtggtcgcataaccccactggcggacccggacctcattggggccatcccatggggggaccaccccaggcatggggtcaccccatgcagggcggaccgcagccatgggggcacccatctggcccaatgcagggtgttcctcggggatcctcaatgggggtccggaatagccctcaagctctgcgccgaacagccagcggcggacggaccgaacagggcatgagccggtcaacatcagtcacctcacaaatctctaacgggagtcatatgagctacacatag

SEQ ID NO: 243400 - DNA, 3150 bp, Artificial Sequence
  Description of Artificial Sequence: Synthetic coding sequence
atgcccgcaggaggcagagcaggctccttgaaagatcctgacgtcgcagagctctttttcaaagacgacccagagaagctattctccgatctgcgcgagatcgggcatggaagtttcggagctgtgtattttgctagggacgtgcgcaatagtgaagtagttgcaatcaagaaaatgagctacagcggaaagcaatctaatgaaaagtggcaagacattataaaagaggtcagatttctgcagaaactccggcatccaaataccatccagtatcggggatgctacttacgcgagcacacagcatggttggttatggaatactgtctggggagcgcgtcggacctgttagaagttcacaagaaaccacttcaggaggtcgagatcgccgctgttactcatggtgccctgcagggcctggcctacctgcactcacataacatgatccatagggatgtgaaagcagggaatatcctgctgtccgagcccggtctggtgaagctcggggacttcggcagcgcctcaatcatggcacccgcaaatagctttgtgggcacaccctattggatggcaccggaagtgatcctggcgatggatgaaggccagtatgacgggaaagtcgacgtctggagtcttgggatcacctgtattgaactggcagagcgcaaacctcccctcttcaacatgaatgctatgagcgctctgtatcatattgcccagaatgagagtcctgtacttcagtcaggccactggtctgaatatttcaggaactttgtggatagttgtctccagaaaatccctcaggatagacctacttccgaggttctattgaagcaccgctttgttttgcgagagagaccgcctaccgtaatcatggacttgattcagcggacaaaagacgctgtacgtgaactggacaatctacagtacagaaagatgaagaagatactcttccaggaagcacctaacggacccggtgcagaggcaccagaggaagaggaggaagccgagccatatatgcacagggccggaactctaacttcacttgagtctagccactccgtgccttctatgagcatcagtgccagtagccagtcaagctctgtgaactctttagccgacgctagtgataacgaagaggaggaagaggaagaggaagaggaggaagaagaagaagaaggccctgaggcacgagagatggctatgatgcaggagggcgagcacacagtcacctcacattcttccattattcacagacttcccggaagtgataacctctatgacgatccctaccagccggagatcaccccaagcccactgcagccacctgccgctcccgctcctactagcactacatcttcagcgaggcgtagagcttactgccgcaacagggatcattttgccaccatccgtacagccagccttgtatccaggcagattcaggagcacgagcaggactccgccctgcgagagcagttgtcaggctataagcgaatgagacgacagcatcagaagcagctccttgctctcgagtcacggctccgcggtgagagggaggagcactccgccaggctgcagagggagttagaagctcaacgcgctggctttggcgctgaagctgaaaaattggcacgacggcatcaggcaataggtgagaaggaagctcgcgcagctcaggctgaagaaaggaaattccagcagcatattctgggacagcagaagaaggagctcgcagcactccttgaagcacagaaaaggacatacaaattgcggaaagagcagctgaaagaagaactgcaggagaacccctcaacacccaagcgtgaaaaggccgagtggctgctgcgacaaaaagagcagttgcaacaatgtcaagccgaggaggaggccggtctgctgaggaggcagagacagtacttcgaactgcaatgcaggcagtacaaacggaagatgctgttagcaagacacagcctcgaccaagatcttcttcgcgaagacctgaataaaaaacagacccagaaggatcttgagtgcgccttgctgctgagacaacacgaggccacaagagaactcgagctgaggcagctccaggccgtacagcgaaccagggcagagcttacccggctacaacaccagactgagctgggcaatcagttggagtacaacaagcgtcgcgagcaggaactaagacaaaagcatgcggcacaagtacgacagcagcccaagagtctcaaaagcaaggagttgcaaatcaaaaaacagtttcaggaaacctgcaaaattcaaacacgtcagtataaagccctgagagcacacctgctcgagaccacgcccaaggcacagcacaagagcctgttaaaaaggcttaaagaagagcagacgcggaagcttgcaatcctggctgagcaatacgatcagtccatatcagaaatgctatcttcccaggccctccgtctggacgagactcaagaggctgaatttcaggccctaaggcaacaactgcagcaggagttagagttgctgaatgcttatcaaagcaagataaaaatccggaccgagtctcagcacgaaagagagctccgtgagctggagcagcgtgtggcactgaggagagctctcctggaacagcgcgtggaagaagagctgttagctttgcaaacaggtcgatccgagcggatcaggtccctgctggaaaggcaggcaagggaaattgaggcctttgacgcggagagcatgcgtttgggtttcagctctatggccctaggaggaattcccgcagaagctgcggcacaggggtatcccgctccacctcctgcacctgcctggcccagtcggccagtccccagaagcggagctcactggtcgcatggccctcctccacctggaatgcctcctcccgcatggagacagccatctttgcttgcaccgcctggtccaccgaactggctgggcccacctacacaaagcggcaccccacgaggaggcgctctcctgctgctccgtaactcacctcagccactgagaagggcagcatctggcggatcaggatctgaaaatgttggacccccagccgcagccgttccagggccactgtctaggagcacttcagtggcttcacacatattgaacggctcgtctcatttttactcctag

SEQ ID NO: 243401 - DNA, 3708 bp, Artificial Sequence
  Description of Artificial Sequence: Synthetic coding sequence
atgcccgctggaggtcgagccggatcactaaaggaccccgatgtggctgaacttttttttaaggatgaccctgagaagttatttagtgaccttcgggagatcgggcacggcagctttggcgctgtttatttcgccagggacgtgagaaactcggaagttgtggccatcaagaaaatgagttactccggtaaacagtcaaatgagaaatggcaggacattattaaggaggtgagattcctgcagaagcttcggcacccgaacacaattcaatatcggggatgctatctgcgtgagcacacagcctggctcgttatggaatactgtctcgggagtgctagtgatctgctggaggtccataagaaaccactgcaagaagtcgaaatagcagcggtcacccatggcgctttgcagggccttgcctatcttcattctcacaatatgatacatcgcgacgtgaaggctggcaacattctgttgagtgagcccggtctcgtaaaactcggggattttggcagtgccagcatcatggcacctgcaaattccttcgtgggcaccccatactggatggcaccggaggtgatcttagccatggacgagggccagtacgatggcaaggttgatgtttggtctctgggaatcacgtgcatcgaattagccgaaagaaagccacctctttttaacatgaatgctatgagcgctctctaccacatcgcccagaacgagtcccctgtgctccaatctggacattggtctgagtattttcgcaactttgtggactcctgcctccagaagattccgcaagataggcccacatctgaggtcctcctgaagcaccgctttgtcctgagagagcgccctcccaccgttataatggacctcatccagagaacaaaagacgcagtaagagagctggacaacctccagtatcgaaagatgaaaaaaattctcttccaggaggccccaaatgggccaggagcagaggctccagaagaggaggaggaagcagagccatacatgcatcgagctggcactctcacgagtctagagtcctcgcattccgtgccttccatgagtattagcgcctcaagccagtcaagttctgtcaacagcctcgctgatgccagcgacaatgaggaggaagaggaggaggaagaggaagaagaagaggaagaagagggtcctgaagctagggagatggcaatgatgcaggaaggcgaacatactgtaacttcccactcatctattatccaccgcttgcctggatccgacaacttatacgacgacccctatcaaccagaaatcaccccttctcccctgcagcctcccgctgcacctgcaccaaccagtacaacatcctctgctcgcagacgggcatactgccggaatcgggaccattttgcgaccattaggacggcctctttggtaagcagacagatccaagagcatgaacaggattcggctctacgcgagcagctctctggatacaagaggatgcggcgtcagcaccagaagcagttgctggcgcttgagtcgaggctaaggggggagagagaggagcacagcgccagactccaacgagagctcgaggcccaaagagccggattcggcgcagaagcagaaaagcttgccaggcgccaccaggcgatcggggagaaggaagcgagggcagcgcaggccgaggaaaggaagttccagcagcacattctcgggcagcagaagaaagaattggcggcactgcttgaggcgcagaagaggacgtataagctccgtaaggagcagttaaaggaggagctgcaggagaacccaagcacgccaaagcgggaaaaggctgaatggttactccgccaaaaggaacagttacagcagtgtcaggcggaggaggaagctgggcttctgcggagacagcgtcagtacttcgagctccagtgtcgtcagtacaagcggaaaatgctactggcccgacatagcctggaccaggacttgctgcgagaggaccttaacaagaagcagacacagaaagatctggaatgtgcactgctccttaggcagcatgaagcaacgcgagagctggagctcaggcagctccaggccgtgcagcgtactcgggcagagctgaccaggctgcagcaccaaacagagctcgggaaccaactggagtacaacaagagaagggagcaagaattaaggcagaaacatgcggcacaggtgagacagcagcctaaatcactgaaggtgcgggctggccagaggccaccgggactcccattaccaatccctggagcactgggccctccaaacaccggcaccccgatcgagcagcagccttgcagtcccggacaagaggcagtgttagaccagcgtatgttgggtgaagaagaagaggccgttggggagcgccgtatcttgggcaaagaaggcgcaacactggagccaaagcagcaacgtattcttggagaggaatctggagcccctagcccgtcacctcagaagcacggttcattggttgacgaggaagtgtggggcctgccggaagagatcgaggaacttcgggtcccgagccttgtccctcaagagcggagcatcgtagggcaagaagaggccggtacctggtccctgtgggggaaggaagacgagtctctgcttgatgaggaattcgaactgggatgggtccaggggcctgccctcaccccagttccggaggaggaagaggaagaggaagagggcgcacctatcgggacacctcgcgatccaggcgacggctgtccctctccagacatccctcctgagcctccgcctacccacctccggccatgccccgcaagccagctgccgggtttgctgagccatggcctactggccggtctgtccttcgctgtggggtctagctccggccttctgcccctgctgctcctgttgctgctgcctctgctggcagcacaaggcggaggcggactgcaggcagcactgctcgctctagaggtgggcctggtgggcttgggggcaagttacctcctgctatgtaccgcactgcacttgccatcctccctctttctgctgctcgcccagggtaccgcgctgggagctgtgttagggctgtcctggcgcagaggcctgatgggtgttcctctggggcttggcgctgcttggctcctggcgtggccaggactggcgctacctttggtggcaatggctgccggaggcaggtgggttcgacaacaggggccaagggtgcgaagggggatttctcgcctctggctgcgcgttctgctacgcttgtcacccatggccttccgggcactgcaagggtgtggcgcagtgggagaccgcggactgttcgctctgtacccaaaaactaacaaagatggctttagaagcaggctgcccgttcctggcccacgtaggaggaatcctaggaccacacagcatcctcttgcattgttggccagagtgtgggtactgtgtaagggttggaactggcgcctggctcgcgcaagccagggcctggcctcccacctgcctccatgggctatccacaccctggcctcctggggcctccttaggggggaacgccctacacgaatccctaggctgcttcccagatcacagagacagctggggcctccggctagcagacagccattgcctggcaccttagccggtcgcagatcgcgcaccagacagtcacgagccctgcccccatggcgctag

SEQ ID NO: 243402 - DNA, 2268 bp, Artificial Sequence
  Description of Artificial Sequence: Synthetic coding sequence
atgcctgcaggcggtagggctggatctctgaaagacccagatgtcgcggagctcttctttaaggacgacccagagaagttattttccgacttacgcgaaataggccacgggagcttcggggcagtgtactttgcaagggatgtgaggaacagcgaggtcgtagctataaaaaagatgtcatattctggaaaacagagtaatgaaaagtggcaagacataattaaagaggtccgttttctgcagaaacttaggcatcctaatacgattcagtaccgcggatgttatctccgcgaacacaccgcttggctcgtcatggaatattgtctgggctctgcaagtgacctactggaagtccataaaaagcccctgcaggaagttgagatcgccgctgtcacacatggagccctgcagggcttagcctatctgcacagtcacaacatgattcaccgggatgtgaaagctgggaatatattactcagcgagcccggacttgttaaacttggagatttcgggtccgcaagtatcatggctcctgctaatagttttgtgggtacaccatattggatggcacccgaagtgatactggctatggatgaagggcaatacgacggaaaagtggacgtgtggtcactgggaatcacgtgtatcgaactggcggaaaggaaaccacctctctttaacatgaacgctatgagcgcgctgtatcatatcgcccagaatgagagccccgttctccagtctggccactggtctgagtacttcagaaacttcgtagacagctgccttcagaagatcccacaggacagaccgacttccgaggtcctgctgaagcatcggttcgtactgagagagcgaccccctacggtgatcatggacctcatacagagaacaaaggatgccgtgagggagctggataacctgcagtatcgaaagatgaagaaaatcctgtttcaggaggctcccaacggcccaggggctgaagcccctgaggaggaggaggaagccgagccatatatgcatcgcgcagggacactcacttccctggaaagctcacactctgtaccatctatgtcaattagcgctagtagtcagagctcctcggtgaatagtctggccgatgcaagcgacaacgaggaggaagaggaggaggaggaagaagaggaggaggaggaggaggggccagaggccagagagatggctatgatgcaagagggagaacataccgtgaccagtcacagttcaatcattcatcggctgcccggatccgataacctctacgacgatccctaccagccagaaattacaccgtccccactgcagccaccagccgctccagctcctacatcaacgacatccagcgcccgacggcgagcttattgtaggaaccgcgatcattttgctacaattcgtacggcatcccttgtcagccggcagattcaagaacacgagcaagactctgcattacgggaacaactgtccggctacaaacgaatgcggagacagcaccagaagcagcttctcgcactagaatcacgcctgcgtggcgagcgggaggaacattctgccaggctacagagggaactggaagcccaacgcgctggtttcggagcagaggccgaaaaactggcacggaggcaccaggcgatcggagaaaaagaggcgagggccgctcaggccgaggagagaaagttccagcagcatatactgggacagcagaagaaagaacttgccgcacttctggaagcgcagaaaaggacctataagttgagaaaggagcaactcaaagaggaattgcaggagaatccaagcactccaaagagggagaaggctgaatggttgctacgacagaaagagcagttacagcagtgccaagcagaggaggaggcagggcttcttcgtcggcagagacagtacttcgaactgcagtgcaggcaatacaagaggaagatgctcctcgcaaggcacagccttgatcaggacctcctgcgggaagatttgaataagaagcagactcagaaggacttggaatgtgcgttactactacgccagcacgaggccacgagggagttggagttgcgccagctgcaggctgtgcagcgtacccgggctgagcttaccagattacagcaccagacagagcttggaaatcagttagagtataataaacgccgtgagcaggagcttcggcagaaacacgccgcacaggtgcggcagcagcccaagagcttaaagaaaaagaccaacacaaataaaattagcgaacggtag

SEQ ID NO: 243403 - DNA, 3369 bp, Artificial Sequence
  Description of Artificial Sequence: Synthetic coding sequence
atgcccgcaggtggcagagccggttcattgaaagatcctgacgtagctgagctgtttttcaaggatgatccagaaaagcttttttctgacttgagggaaattggccacgggtccttcggcgctgtatactttgccagagacgtgaggaacagcgaggtggttgcgatcaaaaaaatgtcctatagcgggaaacagagtaacgagaaatggcaggacatcatcaaagaagtgaggttcttacaaaagttgcggcaccccaatacgatccaatacagagggtgctatcttcgggagcacactgcctggctggtcatggagtattgtctcggcagtgcctccgacctgctcgaggtgcacaagaaacccctgcaagaagtagagatcgccgctgtgacacacggtgcgctgcagggcctcgcatacttgcactcccacaatatgatacaccgagacgtgaaagctgggaacattctgttgagcgagcccggtctcgtgaaactaggcgactttgggagtgccagcatcatggcaccagctaacagctttgtggggaccccttactggatggccccagaagtgatactggcaatggatgagggccagtatgatggaaaggtggacgtgtggtcactgggaattacctgcatcgaattggccgaaaggaaacccccactgtttaatatgaacgccatgtccgccctctatcatatcgcccaaaatgagagtccggttctgcagagcggtcattggagtgagtatttccgcaactttgttgattcttgcctccagaagattccacaagaccgtcccacatcagaagtgctcctgaagcacaggttcgtcctccgtgaaaggcctcctacggttattatggatctgatccagaggaccaaggacgctgtaagagaactcgacaacttgcaatatagaaaaatgaaaaaaatcctgttccaggaggccccaaacgggccaggggcagaggcacccgaggaggaagaagaggccgagccgtatatgcatagagccggaaccctcaccagcctcgagagtagtcactctgtgcccagcatgtctatctctgctagctcccagagtagttcagttaatagcttagctgatgcttcagataatgaggaagaagaagaagaggaggaggaggaggaggaggaggaggagggcccagaagctagagaaatggctatgatgcaggagggggagcatacagtcaccagtcatagctccatcatccacagactcccaggcagtgacaacctgtacgatgacccttaccagcccgagattacgcccagccctttacagcccccagctgcacctgccccaacttccactacctcttccgcacggaggagggcctattgtaggaatagagatcacttcgccacaattcgaaccgctagtttggtttcccgacagattcaagagcacgaacaagattctgctctgagagaacagctctcggggtataaaagaatgcgtcgacagcaccagaagcagctccttgccctggaatcaagattgcgtggagaacgtgaggagcacagtgcaagactgcagcgcgagctggaggcccaacgtgccggattcggcgcagaagccgagaaactagcaagacggcatcaggcaattggggagaaagaagctagagcagcccaggccgaagaacggaagttccagcaacatattttgggccagcagaagaaggagttagctgctctgctcgaggcccagaagcgtacatataaactgcggaaagagcagctcaaggaggagctccaggaaaatccctctacccccaagagagagaaagcagagtggcttctccgacaaaaggaacagctgcaacagtgtcaggctgaggaggaggctggcttgttgcgcaggcagagacaatattttgaattgcaatgccgccagtacaaacggaagatgctgctggctaggcacagcctggatcaagaccttttgagagaagatttgaacaaaaaacaaacgcagaaggatctggagtgcgccctcctgctgcgccagcacgaagcaactcgggagttggaactgcggcagttgcaggcagtccagcgaactagggctgagctgacccgattgcagcatcagaccgagctgggtaatcagttggaatacaataaacgacgtgagcaggagctccgtcaaaagcatgcagcccaggttaggcaacagcctaagagcctcaaagaaaggagcatcgtgggccaagaagaggcgggaacctggagcttatggggaaaggaggacgagagtctgttggacgaggagttcgaattgggttgggtgcaagggcctgctctgacccctgtgccagaagaagaagaagaggaggaggagggcgctccaatcggcacccccagggaccccggagacggttgcccaagccctgatattccccctgagccacctcccactcacctgcgtccctgtcccgcatcacagcttccagggctcctatcacacgggttactggcaggactatccttcgcagtcgggagctcttcaggtctgctgccactgctgctgctcctgctgttaccccttctcgcagcccagggaggtggaggtctacaggccgcacttctggccttagaagtcggcttggtgggactgggggcttcataccttcttctgtgcacagcattgcatctcccatcctctcttttcttgcttctggctcagggaaccgcccttggcgctgtgctcggcctctcatggagaaggggcctgatgggtgttcctcttggtctaggagccgcttggctgctggcctggcccggactggctctgcctctggtggctatggccgctggaggccgttgggtcaggcagcagggccctcgtgtgcgaagagggatctccagactgtggctccgcgttttgttgaggctttctcctatggcattcagagccctgcagggctgtggagccgtcggggaccgtgggctcttcgccctataccctaagactaataaagacggcttcaggtctcgcctgcccgtgccaggcccacgtcgccgtaaccccaggactacacagcaccctctcgcactcctcgcacgggtatgggtgctctgtaagggctggaactggcgtctcgctagggcaagccagggcctggcaagccaccttccaccatgggccattcacacactcgcatcttggggacttctgcggggagagagaccgactcggatcccacggttgctgcccagatcacaaagacagttgggtcccccagcatcccgccagcctctgccaggaacactggctgggagaaggagtcgcactcggcagtcccgcgctctgccaccctggcgatag

SEQ ID NO: 243404 - DNA, 1401 bp, Artificial Sequence
  Description of Artificial Sequence: Synthetic coding sequence
atgaagtcactcagtctgcttctggcagtcgcgcttggactcgcaaccgccgtttcagcaggcccagctgtgattgaatgctggtttgtggaagatgcctctgggaagggtctggccaagagaccaggcgcactgctgctgcgccagggcccaggggagcccccacctcggccagatctggaccctgaactatatctgagtgtacacgatccagcgggtgccctccaggccgcattccggagatatcctcggggtgcccctgcccctcattgcgagatgagccggttcgttccactccctgcgtccgcgaaatgggcatcgggactgacccccgctcagaattgccccagagctttggacggtgcctggttaatggttagcatcagtagcccagtcctgagtttatcttcccttttgagaccacagcctgaaccgcagcaggagcccgtattaatcactatggccaccgtggaaatgggctttcatcatgtgggtcaggccgcattagagcttttgacaagcgtggtgctcaccgtgctcacgcacacaccagcgcctagggtaagactgggccaggacgctctgctcgacttaagcttcgcctatatgccacccacttcagaggcggctagctcgttggcacccggtccacctcccttcggtctcgaatggcggaggcagcatctgggaaaaggccatttgcttctcgctgcaaccccaggattgaacggacagatgcctgccgcacaagagggagccgtggctttcgcagcctgggacgatgacgagccatggggaccctggactgggaatggaactttttggctgcccagagtccaaccatttcaggagggcacctatctggccactatccacttgccatacctccaaggccaggtcaccctggaattagcagtatataagcctccgaaagtttccctcatgcctgctacactcgcacgtgccgctcctggtgaggcaccccctgagcttctctgcttagtgtcgcacttttatccatccgggggactcgaggtagagtgggagctgaggggaggacccggtggaagatcccaaaaggctgaaggtcagagatggctgtctgccctgcgccatcacagcgacggctcagtcagcctgtctggtcacctccagccacccccagtgactacagagcagcatggcgctagatacgcctgtcggatacaccatccaagcctgcccgctagtggcaggtctgcggaagtgacccttgaagtggccggacttagcggtcccagtcttgaagattctgtcggactgtttctaagcgcctttctgcttctgggcttatttaaggcgctgggctgggctgcagtatatctgagcacgtgcaaggattctaagaagaaggcagaatag

SEQ ID NO: 243405 - DNA, 1347 bp, Artificial Sequence
  Description of Artificial Sequence: Synthetic coding sequence
atgaaaagcctgtctttgctattggccgtggcattaggcctggcaaccgccgtgtcggctgggcctgccgtcattgaatgctggttcgttgaggacgccagcggcaaaggtctggcaaaaagacccggagccttgctgcttagacaaggaccaggggaacccccacccaggccagaccttgaccccgagctatacttgtctgtgcatgaccccgcaggggcactgcaggctgctttcaggaggtaccccaggggagcaccagcccctcattgcgagatgtcaagattcgtcccactccctgcctccgcaaagtgggcctctggcctgacgccagcccaaaactgcccacgggctctggatggcgcatggctcatggtgtctatctcttcaccggttctcagcctgagctccctcttaaggccacagccagagccacagcaagaaccagtgctgatcactatggccactgtcgtcctgaccgtgctgacccacactccggctcctagagtgaggctagggcaggatgctctgctggatctatcctttgcctacatgccacccacatccgaagcagcctctagtctggccccaggtccaccaccattcggcctagagtggaggagacaacacctgggaaaaggacatctattgcttgctgcaaccccaggcctgaacggtcagatgcctgccgcacaggaaggtgcagtagcctttgctgcctgggacgacgatgaaccatgggggccatggactgggaacgggaccttctggttgcctagggtgcagccctttcaggaggggacatacctggcaaccatccatttgccctaccttcagggacaggtcacgttagaactggccgtatacaaacctcctaaggtgtcacttatgcctgctacacttgcaagggcggcacctggcgaggctccccctgagctcctctgtctcgtctctcacttttacccatcggggggattggaggtcgaatgggaactgcgaggtggaccgggaggtagaagccagaaggccgaggggcaacggtggctgagcgccctgcggcatcacagcgatggctccgtttctttgtccgggcacctccagcccccacctgtcaccacagagcagcatggagccaggtacgcctgtcggatccatcaccccagtttaccggcatcaggccgatccgcagaagtgacattagaggtggccggattatccggcccatctctcgaggacagtgtcgggctgttcctgtcagcttttcttctgcttggactgtttaaggccctggggtgggctgcagtgtacctgagcacgtgcaaggactctaaaaagaaagctgagtag

SEQ ID NO: 243406 - DNA, 1515 bp, Artificial Sequence
  Description of Artificial Sequence: Synthetic coding sequence
atgaaaagtttaagtttgctgctggcagtcgccttaggactggccaccgcagtgagcgccggaccagcagtgattgagtgttggttcgtggaggatgcgtctggaaaaggtttggcaaagaggccaggtgcgcttctcctgaggcagggccctggagagccccctcctaggcccgacctagacccggaactgtacctcagcgtccatgatcccgcaggggctttgcaggcagctttccgccgataccctcgcggagcgccagctcctcattgtgagatgagccgctttgtgcctcttcctgcatcggccaaatgggcctcaggcctgacccccgcacaaaattgtccacgagccctggacggtgcctggttgatggtttcaatttcctcacctgtcctgagtctctctagcctgttacgtccccagcccgaaccccaacaggaaccagttttgatcacaatggctacagttgtcttgactgtgctaacacatacgcccgctccacgtgtgcgcttgggacaagatgccctcctcgacttgagcttcgcctacatgcctcctacatcagaagccgctagtagtctcgctcccggaccaccgccatttgggttagagtggcgacgccagcaccttgggaagggacacttactgctcgccgctacccctggtctcaatggtcaaatgcctgccgcacaggagggggcagtggcatttgcagcctgggatgacgacgaaccatggggcccatggacaggaaacggaactttttggctgcctaccgtgcagcctttccaggagggaacttatctggctaccatccacttgccatacctacaaggtcaggtgacattagagttggcagtgtataagccgccaaaggtcagtctcatgcccgctacgctggcacgggcagcccctggggaagcccctccagaactgttgtgcctcgttagccacttctatcctagcggcggtctcgaagtcgagtgggagctaaggggcggacccggaggcaggagccagaaggcagaagggcagcggtggctgagtgccctccggcatcacagcgacggatcagttagcctcagcgggcatctccagcctcccccagtgacgacagagcagcacggggctcggtacgcctgcagaattcatcacccatccctgcctgccagtggcaggagcgccgaagtcactctcgaggttgctgggctctccggaccatcactcgaagactctgtaggcctgtttctctccgcattcctgctgctgggcttattcaaagcacttgggtgggcggctgtctatttgtccacttgcaaagacagtaaaaaggtgcaatgctccacatcactgtacctgtccctcgttacactcagcccccaccctatctcaaaaccaatggaaggcggatgctggtgtgggagacagaacctgggcctggagttcacactgatatgggttaagacttggcactatatcctcactgtcggcctattcgagcacgccacttag

SEQ ID NO: 243407 - DNA, 1347 bp, Artificial Sequence
  Description of Artificial Sequence: Synthetic coding sequence
atgaagtctctgagccttttgctcgctgtcgctcttggtctggctactgccgtatcagccggtccggcagtcatcgagtgttggtttgttgaggacgcttccggtaagggactcgccaaacgtccaggcgctcttctgctgcgacagggccctggggaacctcctccacgcccagatctggaccccgagttgtacctgtctgtccacgaccctgcaggagccttgcaggccgcttttagacgttatccgaggggagctcccgcaccacactgcgaaatgtctcgcttcgtgccgctccccgcttcagctaaatgggcgtcagggctgactcctgctcagaattgccctagggcccttgatggtgcttggttgatggtctccatttcctcaccagtcctgtcactcagcagtctgctcaggccgcagcctgaaccccagcaagagccggttctcatcaccatggccacggtcgtgttgaccgtgttgacccacacgcctgcacctcgagtgagactggggcaggacgctcttttggacctgtctttcgcatatatgccccctaccagcgaggctgcctcctcccttgccccaggccctcctccgttcggactggaatggcgacgacaacaccttggcaaggggcatctgctgctggctgccactccaggacttaacggccagatgccagcggctcaagagggtgcagtggctttcgctgcgtgggatgatgatgaaccatggggtccctggaccggaaacggtactttttggctgcctactgttcagccattccaggagggaacttacctcgcgactatccatttaccttaccttcagggtcaggttacgcttgagctggctgtctacaaaccaccaaaggtgtccttgatgcctgccacgctggcaagggccgcacctggagaagcccctccagagctgctttgcctcgtgtcacacttttacccttccggcggtttggaggtagaatgggagttgagaggtgggccagggggtcgctcccaaaaagccgagggccaacggtggttatcagccttacgtcatcatagcgacgggagcgtttccctgagcggccatctgcagccacctcccgtgacaaccgaacagcatggagcacgctacgcttgtaggatccaccacccctcgctcccagcctcggggaggagtgctgaagtaaccttggaggtcgcgggtctttccgggcctagcctcgaagactcagtgggattattcctgagtgcttttctgctgttaggcttgtttaaagcacttggctgggccgcagtgtatctgtccacctgcaaggatagcaagaagaaggcggaatag

SEQ ID NO: 243408 - DNA, 1401 bp, Artificial Sequence
  Description of Artificial Sequence: Synthetic coding sequence
atgaaaagtctcagcctgttactagcggtcgcccttggactggcgaccgctgtaagcgccggaccggcagtgatcgagtgttggttcgtagaggatgcttcagggaagggactcgccaagcggcctggtgccctattgttacgccagggacccggagagcctcctcctcggcctgatctcgaccctgagctgtacctcagtgtccatgaccccgctggcgcactgcaggcagcttttagacggtacccacgaggtgctcctgcccctcactgcgaaatgagtcgctttgtgcccctgcctgcaagcgccaaatgggcatcggggcttacaccagcgcagaactgcccaagggcactggacggcgcatggctaatggtcagcattagctcgcccgtactgagtcttagtagtttactgcgcccacagcctgagccccagcaagagcccgttctcattaccatggccacagtggagatgggcttccatcacgtgggacaggctgcactggaacttctcacatccgtggtcctgacagtgttaacccacaccccggcacctcgggtgcggttgggccaggatgcgctgttggacctgagcttcgcatacatgccccctacctcggaggcggctagttcactggcccctgggccacctccctttggcctagagtggcggagacagcatttaggcaaaggacacctgctgttagctgccacccctggcctgaatggtcagatgcccgctgctcaggagggagcagtagccttcgctgcatgggatgatgatgaaccatggggcccatggacaggtaatgggaccttctggcttcccactgtacagcccttccaagagggcacatatctggctactatccatctgccatacctgcagggtcaggtgacgctggaactcgccgtctacaaaccccctaaggtgtccctgatgccggctaccttggccagagcagcgccaggggaggcgcctcctgagctgctgtgcctggtcagtcacttctatcccagcgggggactggaagttgagtgggagcttcgtgggggtcccggtggtcggtcacagaaggcagaaggtcagaggtggctcagtgcactgaggcaccatagcgacggctccgtatccctatcaggccacctccagcccccaccagtaacaaccgagcagcatggcgcacgttacgcgtgcagaatccaccacccttctttgccagcctcgggcagatccgctgaagtgacattagaggttgcgggactctccggccctagcctggaggactccgtggggctcttcctttccgccttccttctgttgggtttgtttaaagcactgggttgggctgccgtctacctgtccacatgtaaagacagcaaaaagaaagccgagtag

SEQ ID NO: 243409 - DNA, 1515 bp, Artificial Sequence
  Description of Artificial Sequence: Synthetic coding sequence
atgaagtcattatctttgctcctagccgtcgcactggggctggcaaccgccgtttccgcaggtccagcggtgatcgagtgctggttcgtcgaggatgcaagcggcaaaggcctcgctaaacgacccggtgcccttctgttgagacagggacccggagaaccacctccacggccagatcttgaccctgaactgtatctatccgtccacgatcccgcaggcgcactacaggccgctttcaggagatatcctcgtggggctccagctccccactgcgaaatgtcccgcttcgtccccctgcctgctagcgctaaatgggccagtggactgaccccagcccagaactgtccgagggcactggacggtgcctggttgatggttagcattagttctcccgttctcagcctttcctccttattgcgccctcagcccgagccacagcaggagcctgtgctgatcaccatggctacggtagtactcaccgttttgactcatacccctgctccccgtgtgagactgggtcaggacgcacttttggacctgtctttcgcgtatatgccaccgacttccgaggcagcttctagcctagccccaggccctcccccattcggcctggagtggcgcaggcaacacctgggaaagggccatctgctattggcggctacacccggattgaacggtcagatgccagcagctcaggagggcgcagtggcttttgccgcttgggacgatgacgaaccttggggaccttggactgggaacggtactttctggttgccaagagtgcaacctttccaggagggcacttacctggcaactatccacctcccatatctgcagggccaggtgacactagagctggctgtctataaacccccaaaagtcagtcttatgcctgctactctggctcgggcagccccaggtgaagcccctcccgagcttctctgtctggtctcgcacttttacccttccggcggactggaggtcgaatgggagctcaggggcggacccggtggtagatctcagaaggccgagggacagagatggctatcagcactgcggcaccactcagatgggtccgtgtccctctccggtcatcttcagccgccaccggttaccaccgagcagcatggagctagatacgcatgtcgaattcaccatcctagcctaccagctagcgggaggtctgccgaagtcacgttagaggtcgctggattgagcgggccttcactggaagatagcgtggggctgttcttgtcagctttcctgttgctgggcctcttcaaggccctggggtgggcagccgtctatctcagtacatgtaaggattcaaagaaggtgcagtgcagcacttccctgtatttatcacttgttactctgagtcctcaccctattagcaagcctatggagggcggttgttggtgcggcagacaaaacttggggctggagttcaccttgatttgggtcaaaacgtggcattatatcctgactgtcgggctctttgagcatgctacctag

SEQ ID NO: 243410 - DNA, 1347 bp, Artificial Sequence
  Description of Artificial Sequence: Synthetic coding sequence
atgaagtccctgtcactgcttctagccgtggccttgggcttggccacagcagtgtctgctggcccagctgtgattgagtgttggtttgtggaggatgcaagcggaaaaggcttagctaaacggcctggagctctgctgctacgtcagggtccaggcgagccaccaccacggccagacttggacccggaactttatctgagcgtccacgacccagctggagcccttcaggctgcctttcgcagatatccgcgaggcgcaccagctccacactgcgaaatgagtcgttttgtgccactcccagcctctgcaaagtgggcatctggactcacccccgctcagaattgtccacgcgctttggatggggcttggctgatggtctccatctcaagtcccgtgctgtctctgagcagcctcctacggccacagcccgaacctcagcaggagccggttttgataactatggccactgtggtgctgacagtgctgacacacactccagctcccagagttcgtttaggtcaggatgcccttcttgacctgtcctttgcttacatgccaccaacaagcgaggctgcgagcagcctcgctccaggaccgcctccattcggtctcgagtggcgtcgccagcacctgggtaaggggcacctactgctcgcagcaacgccgggtttaaatggccagatgcctgctgctcaagaaggggcagtcgcttttgctgcctgggatgatgatgaaccctggggaccgtggaccgggaatggtaccttctggcttcctcgagtgcagcccttccaggaaggtacatacctggcaaccattcatctgccctacttacaagggcaggttactctggaactggccgtatataagcctccgaaggtgtcgctgatgcctgcgactttagccagagctgcccctggcgaagcccctccggaactgctgtgcctggtatcccacttttacccttccgggggattggaagtagagtgggaactgcgtgggggacctggtggcaggagtcagaaagctgagggacaacgatggctgtctgctctgcgacatcatagcgacggatctgtgtcactgagtggccacctacagccccctccagtgaccactgagcagcatggagcacgctatgcctgtcgaatacatcacccctccttgccagccagcggccgaagcgcagaggtgaccctcgaagtcgcagggttatcgggtccttccttagaagatagtgtaggcctctttctgagtgcgttcttgctgctaggtctgtttaaagcactaggctgggccgcagtatacctgtcaacctgcaaggacagcaagaaaaaagcagaatag

SEQ ID NO: 243411 - DNA, 1515 bp, Artificial Sequence
  Description of Artificial Sequence: Synthetic coding sequence
atgaagtctttatcattgttgttggcggttgccctgggccttgcgactgcagtcagcgccggacctgctgtgatcgagtgctggttcgtggaagacgcgagcggaaaaggcctggccaagagaccgggagctctccttctgcggcaaggtcctggtgaaccccctccgcgtccggaccttgatcctgagctgtatttaagtgtgcacgaccccgctggcgctctgcaggcggcttttaggcgctatcctaggggagcccctgcccctcattgcgaaatgtcccgtttcgttcccctccccgcttccgctaaatgggcttccggactgactccagcccagaattgtcccagggctctggacggagcatggctaatggtgagcatctcatctcccgtcctgtccctttcatccttgctgagaccccaacctgaaccccagcaggagccagtgctgatcaccatggcaacagtggtgttgacggttctgacccacacgcccgctccacgcgtgagactgggacaagatgctctgctggacctaagttttgcttacatgccgccaaccagcgaggctgcctcttcattggcacccggtcccccaccatttgggctggaatggcgcagacagcacctgggcaaagggcacctgctgctcgccgcaacccccggactgaatggacaaatgcccgctgcacaggaaggagctgtcgcttttgctgcttgggacgacgacgagccctggggaccctggaccggcaacggaacattctggctccccagggtgcaaccatttcaggaggggacatatctggccacaattcacctcccatatctccagggacaggtgacactggagctcgctgtatacaagccccctaaggttagtctgatgccagccacactcgcgagagccgcacctggggaggcccctcctgagctactctgtctggtgtcccatttttacccctcgggaggtctggaggtcgagtgggaactgcgcggtgggcctggaggcaggagccaaaaggctgaaggacagaggtggctcagtgcactgcgacaccactccgacggctccgtttccctcagcgggcacctccaacctccccctgtgacgaccgagcagcacggtgctcgttatgcttgccggatccaccacccctccctgccagccagtggcagatcagccgaagtgacgctggaagtcgccggtctgagtgggccttccctggaggatagcgtggggcttttcctgagtgcttttcttttgcttggtctgttcaaggctttgggttgggccgcagtgtacctgtccacttgtaaggattctaagaaagtccagtgcagcacctcactgtacctgtctttagttacactttcaccccacccaatctccaaaccaatggagggtggatgttggtgcgggagacagaacctgggcctggaatttaccctgatctgggtgaagacctggcattatattcttaccgtcggactcttcgaacacgctacttag

SEQ ID NO: 243412 - DNA, 1401 bp, Artificial Sequence
  Description of Artificial Sequence: Synthetic coding sequence
atgaagagtttgagcctgctattggcagtggcgctcgggttagccaccgcagtcagcgctggcccagctgtaatcgaatgctggttcgttgaggacgcgagtggcaagggattggccaagcgtcctggagccctcctgcttagacagggcccaggcgaacccccaccgagacctgatctggacccggagttgtatttaagcgtccatgaccccgctggagccctgcaggctgctttcagaagatatcccagaggcgctcctgctccccattgcgagatgagtcggttcgtgcctttgcctgccagcgctaaatgggcctccgggctgacgcccgcacaaaattgtcctcgcgctctggatggcgcatggctgatggtttcaatcagctctcccgtcctgtccttgagctcactgctgagaccgcagcctgaaccacagcaggagccggtgctaattacgatggcgactgtggaaatgggcttccaccatgtgggtcaggccgcactggagctacttacctcggtggtgttgactgtgctcactcatacacctgcccctagggtccgccttggccaggatgctctgcttgacttatcctttgcctatatgcctcccacatcagaggccgcatcttccttggcccctggccctcctcccttcggtctagagtggcgcagacaacacctggggaagggccacctcctgctggcagccacccccggtctgaatgggcagatgccagcagctcaggagggcgctgttgctttcgcagcatgggacgacgacgaaccctgggggccttggactggcaacgggacattctggttgcctcgggttcagcccttccaggagggaacctaccttgcgacgattcatcttccgtatttacagggtcaagtgacgctcgaacttgctgtatacaagcccccaaaggtgtctctgatgcctgcaaccctggccagagctgctccaggtgaggcaccacccgaactgttgtgcttagtgtcccatttttatcctagtgggggtctggaagtggagtgggaattacgaggagggcctggaggccgatcccagaaggcagagggccaaaggtggctgagtgctcttagacaccattccgacggatctgtgagtctgagcggacacctgcagcctccgcctgtgacaactgaacaacatggggcaaggtacgcttgtcgcatccaccaccccagtctcccagcatccgggaggagtgccgaggtgactcttgaggtggctgggctgtctggcccaagcctggaggattcagttggcctgtttctgtcagccttcctgctcctgggattattcaaagctttaggctgggcagccgtttatctcagcacttgtaaagactcaaagaagaaggctgagtag

SEQ ID NO: 243413 - DNA, 1347 bp, Artificial Sequence
  Description of Artificial Sequence: Synthetic coding sequence
atgaagagtttatcgctgttgctcgctgtggctctggggttggccaccgccgtgtccgcgggacccgctgtgattgagtgctggttcgtggaagacgcatctggcaaaggcttagccaaacgcccaggagcactcctgcttcgccagggacccggtgagcccccacccaggcccgacttagatcccgagctgtatctgagcgtgcacgatcctgccggagccctacaggctgcattcagacgttacccccgaggagcgcctgcgccacactgtgagatgtcgaggtttgtgcccctgccagcttcagccaagtgggctagcggtctcactccagcccagaactgcccacgcgctttagacggagcctggctcatggtgagtatctcttcccctgtgttgagtctatcaagtctgctgaggccccagcctgaaccccaacaggagccagttctgattacaatggctacggtggtcctgactgtactcactcatacacccgctcctcgtgtcaggctgggccaggacgccctcctggacctttcattcgcgtatatgccccctacgagcgaagccgcttcgtcactggccccaggtcctcctccttttggactggagtggagaagacaacatttaggcaagggccatctgctgctcgccgctactcccggtcttaatgggcagatgccagcggctcaggagggggcagtagccttcgctgcgtgggacgacgacgagccctgggggccatggacagggaatggcactttctggctgccaagggtacagcccttccaagaaggcacatacttggccacaatccatctgccttacctgcagggccaggtaactcttgaactcgctgtatacaagcccccaaaagtgagcctgatgccagccacccttgccagggccgcacctggagaggcccctccggaattgttgtgtttggtatcccacttttacccaagcgggggactggaagtcgaatgggagctgagaggcggacccggtggacggagtcagaaagccgaaggccagcggtggctgagcgcactgcgccatcactcagacggctctgtctcactgtctggacatttgcagccccctcccgtaactacagaacaacacggtgccaggtatgcttgtcgcatacaccatccgtccctgcctgctagtggaaggtctgccgaagtgacattggaggtcgctggactgagcgggccatctctggaagatagcgtgggactttttctttcagccttcttgctgctcggcctttttaaggctttgggctgggcagctgtgtatctgtccacctgcaaggactcaaagaaaaaggcagaatag

SEQ ID NO: 243414 - DNA, 1515 bp, Artificial Sequence
  Description of Artificial Sequence: Synthetic coding sequence
atgaagtctctctctctcttgcttgctgtcgccttagggctggccactgccgtgagtgcagggccagcagtgatcgagtgctggtttgttgaggatgcttcaggaaaaggcctggctaaaaggcccggagccctcctgttgaggcagggtccaggtgaaccacccccacgtccagatctggacccggagctgtatcttagcgttcacgatcctgccggagcacttcaggccgctttccgcaggtaccctaggggagcgcctgcaccacattgtgagatgagtcgatttgtgccactgccggctagcgcgaaatgggcttccggcctgacacctgcccaaaactgtccacgggcactggatggcgcttggcttatggtgagcatatcttcccctgtacttagcttaagctctttgctgagaccacaacctgaaccccagcaggaaccggtccttatcaccatggccacggtggttctaaccgtcctaacacacaccccagcaccaagagtccgccttggtcaagacgccctgctcgacctaagcttcgcatatatgccacccacatcggaggccgctagctctcttgcacccggaccacctcctttcggtctagaatggcggaggcagcatctcgggaaggggcaccttctgttggctgccacaccaggcctgaacggccagatgccagccgctcaggaaggcgcagtcgcattcgctgcctgggatgatgacgaaccctgggggccttggaccggaaacgggactttctggctgcccactgtgcagccgtttcaagagggcacttatctggctactatccatcttccatacctgcagggacaggtgaccctggaactggccgtgtataaacccccaaaggtgtctctcatgccagccactttagcgagggccgctcccggtgaggcaccaccagagctgctgtgcttagtgtcccacttctatcccagtggaggcctcgaagtggaatgggagctccggggaggccctggcggacgttcacagaaggccgaggggcagcgatggctctccgccctccgacaccacagcgatgggtcagtttccttatccggtcacctccaaccccctcccgtcacaactgaacaacatggggcaaggtatgcttgccgcatccaccatccttctttacctgcctccgggcgttctgctgaggtgactctagaagtggcaggcttgtccggcccttccttggaggatagcgtcggcctatttctcagtgcattcctgctgctgggcctgttcaaagctctgggatgggcagctgtgtatctgtcaacctgcaaggactcaaaaaaggtccaatgctccacaagcctgtatctcagcctggtgaccctttccccgcaccctattagtaaacccatggaaggaggttgctggtgtgggcgacagaacctgggactggagtttacactcatctgggttaaaacttggcattacatcctgactgtggggcttttcgaacatgcaacctag

SEQ ID NO: 243415 - DNA, 609 bp, Artificial Sequence
  Description of Artificial Sequence: Synthetic coding sequence
atgaaaagtctcagtctcctccttgccgttgccctggggctggccacggctgtgagcgccggacccgcagtcatcgaatgctggttcgttgaggatgcatccggcaagggcctagcaaaacgaccaggagccctcctattgcgccagggccctggagagcctccgcctcggccagatcttgacccagagctgtacctgtcggtgcacgtggtacttaccgtccttactcatacaccagcccctagagtgagattgggacaagacgcactgctcgatctgagtttcgcttatatgcctcctacaagcgaggcagctagttctctcgcccctggtcctccccctttcggcctcgaatggcgcagacagcacctgggtaaaggacacctgctgttggcggcaacacccggactcaatggtcaaatgcccgctgcgcaggagggggctgtggcgttcgctgcttgggacgacgacgaaccatggggcccatggacaggcaacggtactttctggctccctagagtccaaccgtttcaggaaggcacatacttagctaccattcacctgccatacctgcagggacaggtgaccctcgagctggccgtctactag

SEQ ID NO: 243416 - DNA, 1347 bp, Artificial Sequence
  Description of Artificial Sequence: Synthetic coding sequence
atgaaatcactgtcactgctactggccgtcgctctgggcctcgccacggctgtttccgctggcccagccgtgatcgagtgttggttcgtggaggatgcgtccgggaaaggcctggcgaaacgcccaggcgctctgctccttcggcagggcccaggagaaccacctccaaggcctgatctcgatcctgagctgtatctgagcgtgcatgaccccgcaggtgcgctgcaggctgcctttcgcaggtaccctcgcggagcccctgctccgcattgcgagatgtcgagatttgtgcctttgccagccagcgcaaagtgggcttccgggctgacacccgctcaaaactgtccgagggccctagatggggcttggttaatggtgtcaataagctcacctgttctttcattgtcctccctgctgaggccacagcccgagccacaacaagaaccggtgctgattactatggctactgtggtgttgacagtgctcacacataccccagctccccgagtccgcctgggacaggacgccctgctggatctgagcttcgcatatatgccgccaacttcggaggcagcctcttccttagcaccaggccctccgccatttgggcttgaatggcgcagacagcatctgggtaagggacacctgctgcttgcggcaacgcctggtctgaacggccagatgccagccgctcaggagggcgctgtagccttcgctgcttgggacgacgatgagccatgggggccatggaccggcaatgggaccttctggttacccaccgtccagccatttcaagagggaacgtacctagccactattcaccttccttatctccagggccaggtgacacttgagttggcagtctataaaccaccgaaggtgagtctgatgccggctaccctcgctcgggcagcaccaggagaagcaccgcctgagctgttgtgcctggtatcacacttctaccccagtgggggtttagaagtcgagtgggaacttaggggtggcccagggggtaggtcccaaaaggctgaggggcagcgctggcttagcgcccttaggcaccacagcgatggaagcgttagcttaagcggacatctccagccaccccctgttacaacagagcagcacggggctagatacgcgtgccgcattcatcatccctccctgcccgcttccgggaggtcggcagaggtgacactggaagtggctgggttgtcaggtcctagcctggaggacagtgtcggtctgttcctgtcagccttcctgctcctgggcttatttaaggcactgggttgggcggcagtgtacctgtccacatgtaaggacagcaaaaagaaggcagaatag

SEQ ID NO: 243417 - DNA, 1401 bp, Artificial Sequence
  Description of Artificial Sequence: Synthetic coding sequence
atgaaatctctgagcctgctcctggctgtggcactcggcctcgcgacagcggtaagtgcgggacctgccgtgatcgaatgctggttcgtggaagatgcgtctggaaaaggcctggccaaacgcccaggggcactcctcctgaggcaaggacccggtgagccacctccacgtcctgacctcgatcctgagctctacctgagcgtgcatgaccccgctggcgctctccaggctgcctttagacgttatccgcgaggagccccagctccccactgcgagatgagtcgattcgtccctctgccagcatcggctaaatgggcatctgggctgacccccgcacaaaattgccccagggcactggatggcgcatggctcatggtgagcatttcgtcaccggtgctttcactttcatccttgctgaggcctcagccagaacctcaacaagagccggtacttattacgatggcaaccgtggagatgggattccaccatgtgggccaggccgctttagagctgttgacatctgtagtgctgactgtcctaactcacactccagcccctcgcgttagattgggtcaggacgcccttctcgatctctcattcgcttatatgccacctacctcagaggccgcaagcagcctggcaccaggacctccgccattcggcctggaatggcggaggcagcatcttggaaaaggccatctgttgttggctgccacacccggactgaacggccagatgcccgctgcacaagaaggagcagtcgcatttgccgcttgggacgacgacgaaccctggggaccttggaccggcaatggcactttctggctgccacgggttcagccgtttcaagagggcacctatctggcgactatccatctgccttacctacaaggacaggtgaccctcgagttagctgtttataaaccacctaaagtgtctttgatgcccgcaactctggcccgagcggctccaggggaggcccctcctgagctcctgtgcctggtgagccacttctaccctagcggcggtcttgaggtagagtgggaactccgcggtggcccagggggaagaagccagaaggccgagggtcagagatggttatccgcactaaggcaccactcggatggatccgtgtccttgtcgggacacctgcagcctccccctgtgaccacagaacagcacggggctaggtacgcttgcagaatccaccatccttccctccctgccagcgggagatccgccgaagtcacattagaggtggctggactgagtggtcccagccttgaggactcagtgggcctgttcctaagcgcgtttctgttgctgggcctctttaaagcgcttggatgggctgccgtttacctgagcacgtgtaaggacagcaaaaagaaagccgagtag

SEQ ID NO: 243418 - DNA, 609 bp, Artificial Sequence
  Description of Artificial Sequence: Synthetic coding sequence
atgaaatcgctctcacttctgctggcggtcgcactgggactcgcgaccgcggtgtctgccggacctgctgtgatcgagtgctggttcgtggaagacgcctcaggtaaaggactcgccaagcgaccaggtgcgcttctgttgagacaaggaccaggagagcccccacctaggcctgaccttgatccagagctgtacctgtccgtccacgtggtcctgaccgtgctaacgcacacacctgctcccagggtcagactggggcaggacgcccttctcgacctgagctttgcctacatgccgccaacctcagaggcggcaagcagcttagccccaggcccaccgccttttggcctggaatggcgcagacaacacctgggaaaaggacacctgcttcttgccgctaccccgggactcaacggccaaatgccggctgctcaggaaggggctgtggccttcgccgcttgggatgacgacgagccctgggggccatggactggcaacgggaccttctggctgcccactgttcagcctttccaggaggggacctatttggctaccatccacctaccttatctccaggggcaagtaaccttagagctggccgtgtactag

SEQ ID NO: 243419 - DNA, 609 bp, Artificial Sequence
  Description of Artificial Sequence: Synthetic coding sequence
atgaaaagcctgagtctgttgctggccgtcgctctcggactggctaccgcagtgtccgcgggaccggcagttatcgaatgttggttcgtggaagatgcttccgggaaaggtctcgctaaaagaccaggcgcattgctcttgcgccagggtccgggagagccacctcctcgacccgatcttgacccggagctctacctgtctgtgcacgtggttctaaccgttcttacccatactcctgctccaagggtgcggctcggacaggacgctctcttggatctttcgtttgcatacatgccacctacttcggaggccgcatccagcttggccccagggcctcccccattcggtttggaatggcgccgtcagcacttgggaaaaggacacctcttacttgccgctacacctggcctgaacggccagatgcctgcagctcaggagggagccgtggcatttgcggcttgggacgatgacgaaccatgggggccttggaccggaaatggtactttctggttgcccagggtacagccattccaggaggggacgtacttagctactatacacttgccttacctgcagggacaagtcaccctcgagttggcggtttactag

SEQ ID NO: 243420 - DNA, 609 bp, Artificial Sequence
  Description of Artificial Sequence: Synthetic coding sequence
atgaagtcactgtccctgctcttggctgtggctttgggacttgccaccgccgtgtcagcgggtccagccgtgattgaatgctggttcgtggaggacgcctctgggaagggattggcaaaacggcctggagctctgctactgcggcaaggacctggcgaaccccctccaaggccggacctcgatccagagttatacctgtctgttcacgtcgttctgactgtcctcacccacactccagccccacgggtgaggctcggtcaggacgccctactggacttgagctttgcctacatgccccctacctcagaggccgcaagttctcttgcaccagggccacccccttttggactggagtggcgcagacagcatttggggaaggggcatctccttctggcagcgacccctggactgaatggtcagatgccagctgcccaggaaggagcagtggcctttgccgcttgggatgatgacgagccttggggcccttggactggaaacggaacgttctggttaccacgtgtacagccgttccaggaagggacatacttggccacaatacatctcccttacttgcagggccaggtaaccctggagctggccgtgtattag

SEQ ID NO: 243421 - DNA, 1347 bp, Artificial Sequence
  Description of Artificial Sequence: Synthetic coding sequence
atgaagtccctgagtttactgctggctgtcgctctgggactggcgaccgcagtatcagctggaccagctgtcatagagtgttggttcgttgaggatgcttctggcaaggggctcgcaaaacgcccaggggctctactcctcaggcaaggccctggggagccccctccccgtccagacctggatccagagctgtacctcagcgtgcacgatcccgctggggctctccaggcagcttttaggcgatacccaagaggggctcctgccccacactgtgaaatgagtagatttgtgccattgcccgctagcgccaagtgggctagcggtcttacccccgcacagaactgcccacgggcattagatggcgcatggctgatggtatcaatttcgtcgccagtgctaagtttgagttcactgttgagacctcagccagaacctcagcaggaacctgtgctcatcaccatggctaccgttgttttgaccgtgctcactcacacacccgctccaagagtgagactagggcaagatgccttgctcgatctcagcttcgcatacatgcccccaacgtcggaggccgcaagctctctagctccgggaccacctccattcggactggagtggagacggcagcatctcggaaaaggccatctgctcttagctgctactcctggtctgaatggccaaatgccggctgcccaggaaggcgcagtggcgtttgctgcttgggatgatgacgaaccctggggaccctggacagggaatggcacattttggctgccgaccgtgcagccttttcaggaaggcacatacctcgcgacgattcacctgccctaccttcagggccaggtgacactcgaactggctgtgtataagccgccaaaggtgtctttgatgccagctacacttgctcgagctgcacccggagaagcacctccggagctactgtgccttgtttcacatttttaccctagcggaggcttggaagtggagtgggagctgaggggcggtcccggaggccgatcccaaaaggcggaaggacagaggtggctttccgcactgcgccatcattcagatggttcagtttccctgtcaggccatctacaacctcccccagtcacgaccgaacaacatggtgcacgctacgcctgcaggatccatcacccatcccttccggcatccggacgctccgcggaagtgacgttggaggtggcaggtctgagtggcccttcactggaagactctgtgggtctgtttctatcagccttcctgctgctcgggcttttcaaagcccttggttgggccgctgtctatctttccacatgcaaagacagtaaaaagcatgcaacatag

SEQ ID NO: 243422 - DNA, 1515 bp, Artificial Sequence
  Description of Artificial Sequence: Synthetic coding sequence
atgaagtccctctctctcctcctcgccgtagctttggggcttgcaacagccgtgtctgccggtccagccgtgatcgagtgttggttcgtggaagacgcctctgggaaaggcctcgcgaagcgccctggcgctcttctgctcagacaggggccaggagaacctcccccaaggccagatctagaccccgagctttacctgtccgtccacgaccctgccggagccctgcaggccgcttttagacgatatccccgaggcgctcctgcccctcactgtgagatgagcaggttcgtcccgctccctgcttcagcgaagtgggcctctggactcaccccagcacagaactgccccagagcactggatggagcgtggcttatggtgagcatttcttcaccggtgctgtctcttagctctctgctaagaccgcagcccgagcctcagcaggaaccggttctgattacaatggccaccgttgttctgactgttttaacgcacacacccgctccccgagtgagactcggccaagacgccctgctcgacctttcattcgcttacatgcctccaacttccgaggccgcaagctccctcgccccaggaccacccccattcggtttagaatggcgtcgccagcacttgggaaaaggtcaccttctccttgcagctacccctggcctgaacggccagatgcccgctgcccaggaaggagccgtggcctttgctgcctgggatgacgacgaaccctggggcccatggactggaaatgggaccttctggctcccaagagttcagcccttccaggaagggacatatctagcaacaattcatctaccgtacctgcagggccaagttacgctagaacttgccgtctataagcctccaaaagtaagcttgatgcccgctaccctcgcgagggcagctccgggtgaagcccctccagaattgctgtgcctggtgtctcatttctacccaagcgggggactcgaagtggaatgggagttgaggggcggacccggtggtcggagtcaaaaggccgaaggccagaggtggctgtcagccctgcggcaccattcggacggaagtgtctccctgagcgggcacctgcagcctcccccagtgaccacggaacagcatggggctcggtacgcctgcagaatccaccaccccagcctccctgcctcaggcagaagcgcggaagtcaccttggaagtagctggactgtccgggccttctctcgaggatagcgtggggctcttcctcagcgcctttttacttctgggcctgttcaaggcattaggctgggctgccgtgtacctttcaacatgtaaggattccaagaaagtacaatgcagtaccagcctttacctgagcctggtgacgctctcgccccacccaatcagtaaacccatggaaggaggctgttggtgtggccgacaaaacctgggtctggaatttactctgatttgggtcaagacctggcattacattctgactgtgggtctattcgaacatgcaacatag

SEQ ID NO: 243423 - DNA, 471 bp, Artificial Sequence
  Description of Artificial Sequence: Synthetic coding sequence
atgaaatctctaagcctgctcctagctgtagcgctaggattggccaccgctgtgtctgctggtcccgcagttatagagtgttggtttgtggaggacgcaagcggcaaagggttggccaagcgccctggcgcactcttactacggcagggtccaggtgaacctccaccgcgacccgatctcgatcccgagctgtacttgtccgtccatgatccagccggtgctctgcaggcagcattcagaaggtatccacggggtgctccagcccctcactgtgagatgagtcgcttcgtgcccctgccggcttccgccaaatgggcatccggactcacgcctgcccaaaattgccctcgtgcattggacggcgcttggctgatggtctctatctccagcatggggcacgcaatgccagtggaattcaccatacccgcttgtctaccacggggtgcggcactccggagcccctggcggtag

SEQ ID NO: 243424 - DNA, 1401 bp, Artificial Sequence
  Description of Artificial Sequence: Synthetic coding sequence
atgaagtccctcagcctgcttctggcagtggccctggggcttgctaccgcagttagtgcgggaccggcagtgatcgagtgctggttcgtggaagatgcctcagggaagggtctggcaaagaggccaggagccttactgctaaggcaaggccctggcgagccccctccaagacctgatctggaccccgagctgtatttgagcgtccacgatcccgcaggcgctctccaagcggcatttcgccgttacccgagaggcgcacctgcccctcactgcgaaatgtccaggttcgttccacttcccgcttccgccaagtgggcctctggactgaccccagcccagaactgtcctagggcactcgacggggcatggctgatggtgagcataagctccccagtgctgtcactttcctccctgctcaggccacaaccggaacctcaacaggagcccgtcctgatcactatggccacagttgagatgggcttccatcatgtgggccaggccgctctggaactgctcactagcgtcgtgctcactgtgctcactcataccccagcccctcgggttaggttagggcaggatgcccttctggatctgtcattcgcctacatgcccccaacatccgaagccgcaagtagcctggcgccagggccaccgccttttggactagaatggcggcgtcagcacctgggtaagggacacctgttactcgccgctacacccggtcttaacggacagatgcctgctgcccaggagggggctgttgcttttgccgcatgggacgacgacgagccctggggaccctggaccggcaacggaactttttggctcccaaccgtgcagcctttccaggagggcacatatctagccaccattcacctaccctatctacagggacaagttacactcgagctcgctgtctataaaccccctaaggtgtcactaatgccagccaccctggctcgtgcagcccctggtgaagctcctccagaactgctttgcctagtcagccacttctaccccagcggtgggctggaggttgaatgggagctgcggggaggaccaggagggaggagccagaaggctgaagggcaacgctggctgtccgccttgagacaccacagtgacggctcggtctctctgtccggccacctgcagccaccccctgtcactacagaacaacacggggcacggtatgcctgccgaatacatcaccctagtctccccgcttctggtcgatccgctgaggtgaccctagaagtagccggtctttctggacctagtcttgaagatagcgtcggtctatttctgtcagcttttctgctcctggggctcttcaaggcactcggttgggccgctgtgtatctctcaacctgtaaggactcaaagaagaaggccgagtag

SEQ ID NO: 243425 - DNA, 1086 bp, Artificial Sequence
  Description of Artificial Sequence: Synthetic coding sequence
atgaagtccttgtccttgcttcttgccgtagcgcttggactggccactgccgtctccgctgggcctgcagtcatcgagtgctggttcgttgaggatgcttcgggcaagggcttggcaaagcgcccaggggctctcctgctgcgccagggcccaggcgagcctcccccacggccagatttggaccctgaactatatctgtccgtgcacgttgtactcacagtgctcacgcatactcctgccccacgggtacggttgggccaggatgctctgctggatcttagctttgcctatatgcctccaacctcggaggccgcaagcagccttgcgccaggtcctcctccgtttgggcttgagtggaggcgccaacaccttggaaaggggcatctgttgttggccgctacacctgggttaaacggccagatgcccgcagcccaggagggcgctgtggcctttgcagcttgggacgacgatgaaccatgggggccttggaccggcaatgggaccttttggctccctacagtccagccgtttcaagaaggtacctatctcgccaccatccacttaccctatctccagggacaggtgacacttgagctggccgtgtacaagccacctaaggtgagcctgatgccggctactctggccagagcagctcccggtgaagcgcctccagagctcctgtgtttggtcagccacttctatccgtctggcggactggaagtggagtgggagcttcgcggaggtccagggggaagatctcagaaagccgaaggccagcgctggctgagcgcccttcggcatcactcagatgggtctgtgtctctctctggccacctgcagcctcccccagtgaccacagaacagcacggggctcgctatgcctgtagaatccatcatccgtcactcccagccagcgggagaagtgcagaggtgacactggaggtagcgggactttctggtccttcactagaggattctgtgggcctttttctgagcgccttcctgctgcttggcctgttcaaagccctgggatgggctgccgtttacttgtcaacctgcaaagatagcaagaagaaagccgaatag

SEQ ID NO: 243426 - DNA, 1347 bp, Artificial Sequence
  Description of Artificial Sequence: Synthetic coding sequence
atgaagagcctatctctgctcttagcggtggcactcggactcgccacggcagtgtcagctggacctgcagtgatcgagtgctggttcgttgaggacgcctcaggaaaaggccttgcaaaaaggcctggtgccctactcctccgacagggtcctggtgagccccctcctcggcctgatcttgatcctgagctttacctgtctgtccacgacccggctggcgcacttcaggcagcctttcggcgatatccacgaggtgcaccagcaccacattgtgagatgagtagattcgtcccgttacccgcaagcgcaaagtgggccagtgggctcacccctgcgcagaattgcccaagggccctggacggtgcgtggttaatggttagtatttctagccctgtgctgtctctgagctcgctgctgcgaccccaacccgagccccagcaggaaccggtcctgattaccatggctacagtagtgcttactgtgcttacccacacacctgcaccaagagtacgtttgggccaagacgctctacttgatttgtcctttgcttacatgccaccaacatccgaggccgcatcatcactggcaccaggcccaccaccttttggcctggagtggcgcagacagcacctcgggaagggccatctcttactggctgccacccccggactgaacggacagatgcccgctgcccaggagggcgcagtggccttcgccgcttgggacgacgatgagccatggggtccttggacaggaaatgggacgttttggcttccaacagtgcagccctttcaggaggggacctacctggcaacaatccaccttccatatctgcagggccaagtgacccttgagctggccgtttataagccaccgaaggtcagcctgatgcccgctactctggcgcgagcagcccctggagaggcacccccagagctgctctgcctggtttctcacttttaccctagtggcggactcgaggtcgagtgggaactccgcggaggcccaggtgggaggtcgcagaaggcagagggacagcgatggctctcagccttgaggcatcatagtgatggcagcgtgtcgctaagtggccacctgcagccccctcctgttacgactgaacagcacggcgctcggtacgcctgtaggatccaccaccccagcctaccggcttcaggtagaagcgctgaggtgaccttagaggtagctggcttaagcggccctagcctggaagactcggtggggctgtttttgagtgcttttctgctcctcggtctgtttaaggctctgggatgggctgctgtctacctttctacgtgcaaagattcaaaaaagcatgccacttag

SEQ ID NO: 243427 - DNA, 471 bp, Artificial Sequence
  Description of Artificial Sequence: Synthetic coding sequence
atgaagtccctgagtctcctccttgccgtggccctgggactggccactgctgtgagcgctgggcctgccgtgatcgaatgttggttcgttgaagatgcctcagggaaaggcttggccaaaagacctggcgcattattattgaggcagggtccaggtgaacctcctcctagaccagacttggacccggagctgtatctcagtgtccacgatccggctggggctctacaggccgcatttcgacggtacccgaggggagcgccagctcctcattgtgagatgtcacgcttcgttccccttccggcttcagccaagtgggcatccggtctcaccccagctcaaaactgcccgagggcgcttgacggcgcatggctaatggtgtcaattagcagcatggggcacgcaatgcctgtggaattcaccatccctgcctgtctgcctcggggagcagccctgcgtagcccatggcgttag

SEQ ID NO: 243428 - DNA, 1086 bp, Artificial Sequence
  Description of Artificial Sequence: Synthetic coding sequence
atgaagagcctctccctcctcctggctgtagccttagggctagcaaccgccgtgagtgctgggccagcagtcatcgagtgttggtttgtggaggacgcctcaggcaaaggccttgccaaacgcccaggcgctcttctcctacggcagggacccggtgagcctccgcctcggccagatcttgaccctgaattgtatcttagcgtgcacgtagtcctgaccgtactgacgcacacccctgccccacgcgtgcgtcttgggcaagatgcactcctcgacctgtcattcgcttacatgccccctacatccgaggcagcctccagtctggcaccaggccctccaccattcggactagaatggaggcgccagcacttaggaaaagggcatttgcttctcgccgcaactcccggtctgaacggccaaatgcccgctgcccaggaaggagccgtcgctttcgccgcttgggacgatgatgaaccttggggaccttggaccgggaacggaaccttctggctgccaagagtccaaccttttcaggaaggaacgtacctagcaacgatacacttaccctacttgcaggggcaggtcacgctcgagttagctgtgtataaaccccctaaggtgtcccttatgcccgctaccttagccagggcggctcccggagaggccccacctgagctcttgtgtctggtgtcccacttttacccatctggtggtctggaagttgagtgggaactccggggtggtcctggaggaaggtcacagaaagctgaaggccagagatggctatctgcactgcgacaccactcagatggtagcgtctcactttcaggtcatttgcaaccgcctcccgtcaccaccgagcagcacggggctcgttatgcatgtcgaattcaccacccctctctccctgctagcggccgtagtgccgaggtaaccttagaagtggctggcctgtcaggtccttccctggaagacagtgtggggctttttctgagtgccttcctgctgctcggcctgttcaaagccctcgggtgggcagccgtgtacttgtccacctgtaaagattccaagaagcacgctacttag

SEQ ID NO: 243429 - DNA, 1347 bp, Artificial Sequence
  Description of Artificial Sequence: Synthetic coding sequence
atgaagtcactgtctttgctgctagctgtggccctgggcctagctacggcagtgtcagcagggcctgcggtgatcgagtgttggtttgtcgaggacgctagtggcaaaggactcgctaagaggcccggagctcttttgctcaggcagggaccaggcgaaccccctcccagacctgacctagatccagagctctatctgtccgtgcacgaccccgctggcgctcttcaggccgctttcagaagataccctcgaggagcacctgccccacactgcgagatgtctcgctttgtacccctgcctgcttccgccaagtgggcaagtggcctgaccccagctcagaattgtccacgcgcactggacggtgcatggctaatggtatcgatatcatcaccagtgctgagtctgagtagtttgctcagacctcaaccagagcctcagcaggaaccagtgctgatcacaatggccaccgtcgtcctgacagtcctaacccacactcccgctccccgagtacgactgggacaggatgcgttgctcgacctcagcttcgcatatatgcctcccacaagtgaggccgcatccagcttagccccaggccctcccccatttggtttggaatggcgaagacaacatctcggcaagggccacttgctccttgcagcaacccccggacttaatggccaaatgcccgctgcacaggaaggggcagtcgcctttgctgcctgggacgatgatgagccatggggaccgtggactggcaatgggaccttttggctccctagagtacagccatttcaagagggcacgtatctggctactatccacctcccatacctccaggggcaagtgacactcgagctggcggtttataagccgcctaaagtttcactgatgcccgcaacgctggcaagagctgccccaggagaggctccgcctgaactgttgtgccttgtgtcgcacttttacccctcaggcggacttgaggttgagtgggagctgcgcggtggccctggcggacgttcccagaaggcagagggacagaggtggcttagtgccctgaggcatcattctgatggatcggtgagcctgtccggtcacctgcagcctccacccgtgaccaccgagcagcatggagccaggtatgcatgtcgaatacatcaccccagtctgccagccagcggtagaagtgctgaagtgacgctcgaagttgctggtctgagcggtccgtctctcgaagacagtgtgggtctcttcctgagcgcctttctgcttctgggactctttaaggcactcgggtgggcagcagtgtacctaagtacctgtaaggatagtaagaagcacgccacatag

SEQ ID NO: 243430 - DNA, 1086 bp, Artificial Sequence
  Description of Artificial Sequence: Synthetic coding sequence
atgaagagcctgtcgctgttgctggctgtggcactaggcctagcaaccgcagtgtcagcaggaccagcagtgatagagtgctggttcgtcgaggacgcctcaggtaaggggcttgccaaacgccctggcgcattgttgcttcggcagggcccaggagagcctcctccccgacctgacctagatcctgaactttatttgtctgtacacgtggtgttaactgtactgacccatacgccggctccccgagtgcggctggggcaggacgccctgttagatcttagcttcgcctatatgccaccgacgtctgaagccgctagcagccttgcaccaggccctcctcctttcggcctggagtggcgcagacagcatctgggcaagggccaccttctactggcagccacccctggactgaatggacagatgcccgcagcccaggagggcgcagtggcttttgccgcatgggacgacgatgaaccatggggcccttggacaggaaatgggaccttctggcttccacgtgttcagccttttcaggaaggcacatatctggccacgattcatctgccttatctgcagggacaggtgacgctcgaactcgctgtttacaagcctccaaaggtgtccttgatgcccgctactttggcccgagccgcacctggggaagctcccccagagctgctgtgtcttgtcagtcacttctacccaagcgggggactcgaggtggagtgggagctccgaggcggacccggaggaaggtcccagaaagccgaaggacagagatggctctcagcacttcgccatcacagcgacggatcagtgtctctgagtggccatttgcagcccccaccagtcacaactgagcagcatggcgcacggtacgcttgcaggattcaccacccctccctgccagcttccggtcggagcgcagaggtgacgttagaagtcgcaggtctcagcggtccgtccctcgaagacagtgtaggcttattccttagcgctttcctccttctgggactgttcaaagcccttggctgggccgctgtgtatctctcaacatgcaaagactccaagaagcatgccacatag

SEQ ID NO: 243431 - DNA, 471 bp, Artificial Sequence
  Description of Artificial Sequence: Synthetic coding sequence
atgaagtcattaagcctcctcctggccgtggcgctcggcctcgccacagccgtgagcgcaggacccgctgtgatcgagtgttggtttgtggaggatgcgtccggaaaggggctggcaaagagaccaggtgctctgctcttgcgacagggtccaggcgagcctcctcccaggcccgacctggatcctgagctgtacctctcggtccatgatcccgcaggcgctctccaagccgctttcagaaggtacccccgtggcgcaccggcaccgcactgtgaaatgtctagattcgtccctctgccggctagcgctaagtgggcgtccggtcttacacctgcgcagaattgcccacgtgccctggacggggcatggctaatggtcagcatctctagcatgggacatgctatgcctgtagaatttacgatccctgcctgtctgccacgcggagcagctcttcgcagcccatggaggtag

SEQ ID NO: 243432 - DNA, 1347 bp, Artificial Sequence
  Description of Artificial Sequence: Synthetic coding sequence
atgaaatcactatccctgcttctggctgtggctttgggactggctactgccgtgagtgcgggtccagctgtgatcgaatgttggtttgtagaagatgcctcaggtaaagggcttgcgaagagacccggagctctcctgctgcggcaagggccaggcgagcccccacctcggccagatctggacccagaactttacttatctgtgcacgaccccgctggagctcttcaggcggctttccgtaggtatccaagaggcgcaccggcaccccattgcgagatgtcccgttttgtgcccttgccagctagcgccaagtgggcctcaggtctcaccccagcacagaactgccctagggccttggacggagcctggctgatggtctccatctcaagcccggtgctgtctctttcatccttactacgccctcaacctgagccccagcaggaacctgtcctaatcacgatggctaccgtggtcttgactgttttaactcatacgccagccccacgcgtgcggctgggtcaggacgctttgttagatctgtcgttcgcttatatgccccctacaagcgaagccgcatcatccttagctccaggcccacctcccttcggtcttgaatggcgaagacagcacctgggcaaaggacacctgcttttggcggctactcccggtctgaatgggcaaatgcctgcagctcaggaaggcgctgtggccttcgccgcatgggatgatgatgagccatggggcccttggaccggcaatgggaccttttggttacctcgggtgcagccttttcaggagggaacatatctggccacgatccatttgccatatctgcagggccaggttacgttagaactggccgtatacaaacccccaaaggtgtctctaatgccagccacgctggccagggccgcaccgggtgaagcgcctccagaactattatgtctggtatcgcatttttatcctagcggcggtttagaagtggagtgggaacttagaggaggcccagggggtcgctcacagaaggccgaaggccagcggtggctaagtgcgctgagacaccactcagatggcagcgtgtctctgagcggacatctccagccgcctccggttaccactgagcaacacggagcgagatacgcctgccgcatacaccacccgtccctgcctgctagtggtagaagtgctgaagtgacactggaagttgccggattgagtgggccttcccttgaggatagcgttggattattcctctctgcctttctgctgctgggcctttttaaggctctcggatgggctgctgtctacttgtctacctgcaaggattctaaaaagcacgcaacgtag

SEQ ID NO: 243433 - DNA, 1086 bp, Artificial Sequence
  Description of Artificial Sequence: Synthetic coding sequence
atgaagtccttgtcactgctactagccgttgccctgggactggcgaccgcagtctcagcaggaccagccgtgatcgaatgctggttcgttgaagatgcgagtggcaaaggcctggcaaaaagacccggagctctcctgctgcggcaaggaccaggagagcctccccctcgacctgacctggaccccgaactatacctgtcagtgcatgtcgtactgacagtactcactcatacccccgcaccgagggtgagactgggccaggacgctctgttggacctgtccttcgcctatatgcctccaacgtctgaagcggcatcttcactggccccaggaccccctccttttggacttgagtggagacgccagcacctgggaaaaggccaccttctccttgccgcaacacccggtctgaatggacagatgcccgctgctcaggaaggcgctgtggcttttgctgcatgggatgacgatgaaccttggggcccttggactggaaatggaacattttggcttcctacagttcaacccttccaggaagggacctatctggctaccatccacctaccatacttacagggtcaggtgaccctggaactggcagtgtacaaaccccctaaggtgtccctgatgcccgctacacttgcgagagcggcacccggagaagcgccacccgagctgctctgcctagtcagtcatttctatcccagcggaggccttgaggtcgaatgggaactgcggggaggcccaggtgggagatcccagaaggcggagggacaacgttggctgtccgcattacggcatcatagcgacgggagtgtttccttgtctggacaccttcagcctccacccgtcaccactgaacaacatggcgcacgatacgcctgccggattcaccatccgtccctcccagcctcagggaggagcgccgaagtgacactggaggtagcgggattgagtgggccaagtcttgaggactcggtcgggttgttcttgagcgcatttctcctgctaggccttttcaaagccctcggctgggctgcagtctacttatccacctgtaaggatagcaagaaaaaagcagagtag

SEQ ID NO: 243434 - DNA, 1347 bp, Artificial Sequence
  Description of Artificial Sequence: Synthetic coding sequence
atgaagtccctgtccctgctgcttgccgtggccttgggtttggctactgctgtgtcggcaggccctgcagttatcgagtgctggttcgtcgaggatgcctcgggcaaaggccttgctaaacgtccgggtgctttgctgctgcgccagggaccaggtgagcctccacccaggccagacctcgaccccgagctgtatctgtcagttcatgatcccgctggcgcactacaggctgcttttcgccgataccccagaggcgctcccgctccacattgcgagatgagtcgattcgtgccattgccagcttctgccaagtgggcctctggacttacgcctgctcagaactgcccacgtgcacttgacggagcctggttgatggtaagcattagctcccccgtcctctccctttccagcctgctgcgacctcagccagagccccagcaggaaccggtgctgattacaatggctactgttgtcctgactgttcttacgcacacacccgcacccagagtaaggctagggcaggatgccctgctagatcttagctttgcctacatgccgcctacctccgaggccgcatcgtcattagctccaggacccccaccgttcggcctggaatggcgaaggcaacaccttgggaaaggccacctgctgcttgctgcgacacctggtcttaatggacagatgccggctgcacaagagggcgctgtcgcttttgcggcttgggacgatgatgagccctggggaccgtggaccgggaatgggacattttggctgccaagggtgcagccgttccaagagggaacatatctcgctactattcacttgccgtatctgcagggacaggtaacgctggagcttgccgtgtataagcctccaaaagtctcccttatgcctgccactctggcaagagccgcacccggagaggcgcctccagagctgttgtgtcttgtcagccacttttatcctagcggaggcttagaagtcgaatgggagctaaggggtggtccgggtgggaggagtcaaaaagccgaaggtcagagatggctctccgccctgcgtcaccacagcgacggttcagttagtcttagcggtcatctgcaaccccctccggtcactaccgaacagcacggtgcacgctacgcttgcagaatacatcacccttctctgcccgcatcaggccgttccgccgaagtcactctggaagtggcaggtctgtctggcccttctctcgaagatagcgtcgggttgtttttatccgcattcctgcttctcggtctgttcaaagcactgggctgggcggcagtgtacctgagcacttgtaaggactcgaagaagcacgcaacttag

SEQ ID NO: 243435 - DNA, 1086 bp, Artificial Sequence
  Description of Artificial Sequence: Synthetic coding sequence
atgaagagccttagcttacttctcgcagtggcccttggcctcgccacagcagtgagcgcaggccctgccgtgatcgagtgctggttcgtggaggatgcaagcggaaagggactagccaagcggcctggcgctctcctcctacgccagggacccggagaacctcctccgaggccggacctggacccagagctctatctgagcgtccacgtggtccttaccgtcctgacccatacgccagcaccacgtgttcgcttaggccaggacgctctgctggacctgtcattcgcttacatgccgccaacctctgaggcggctagcagcctggccccagggcctccaccattcgggctggagtggcggaggcagcatttgggcaagggccacctcctcctagcagccacgcccggactgaacggacagatgcccgcagctcaggagggcgcagtcgcatttgcggcttgggacgatgacgaaccatggggcccatggacaggcaacggaaccttttggctccctcgcgtgcaaccatttcaggaggggacctacctcgctaccatccatttgccatatctgcaaggccaagttactttggagctggccgtttataagcctccaaaggtcagtcttatgcccgctacacttgctcgggctgctcccggtgaggcgcctcccgagttactctgcctggtcagccatttttacccgtctggtggccttgaggtggaatgggaattaagaggagggccaggaggcaggagccaaaaagctgaagggcaacggtggttgtccgccctgaggcatcactctgatggtagcgtgagtctgagcggtcacctgcagcctcccccagtgactaccgagcaacatggcgcacgatatgcttgcaggattcatcatccatctttacccgcttccggaagaagtgcagaggtaactttagaggtagcgggtctgtctggacccagtctagaggacagcgtcggactgtttctatccgcctttctgctccttggtctgttcaaggctctggggtgggctgccgtgtatctttcaacgtgtaaagatagcaaaaagcatgcgacctag

SEQ ID NO: 243436 - DNA, 2037 bp, Artificial Sequence
  Description of Artificial Sequence: Synthetic coding sequence
atgctgctggaagctgagaggaggaggggcggtggcgctgcaggggctagactgctggagcggtacagaagagtccctggcgtgcgggcactgagagcggactcggttcttattatcgagacagtgcctggatttccccctgcaccacccgctcccggtgctgcccagataagggccgctgaggtgttagtgtatggggcaccgccaggaagggttagtaggctcctggagaggttcgaccctccagcggcacctcggcgaaggggctctcctgaaagagctaggcctcctcctcctccccctcccccagcccctcctcgaccccctcctgccgctccctctccacctgccgctccaggccctaggggaggcggtgcctcccctggtgccagaaggtccgattttctccagaagactggaagcaatagctttacagttcacccacgagggcttcacagaggcgctggcgcaaggctgttgtccaacggacatagcgcacctgaaccacgtgcagggccagccaatcgtcttgcgggaagccccccaggctctggccagtggaaacccaaggtggagtcgggcgatccctccctacatcctcccccttctcctggaactccgtctgcaaccccagcgagtcccccagcatccgccactccctctcagaggcagtgcgtcagcgcggcaacgtctaccaatgacagcttcgaaatcaggcctgcccctaaacccgtaatggaaaccattcccctgggagatctacaagcgagagctctggcttccctgagggctaactcccgtaattcttttatggtgattccaaagtccaaggcaagtggcgcaccaccacccgaagggaggcagagcgtagaactgcccaaaggcgatctcggcccagcatccccgtctcaggagctgggctcccaacctgtgccagggggagacggagcacccgctttgggaaagagcccactcgaggttgaagcccagtgggcggtcgaagagggcgcatgcccccgaactgcaacagcactcgctgaccgggctatccgatggcagaggccctcctcccccccaccatttctgccggctgcatcagaggaagccgaacccgctgagggattaagggtgccagggctcgcaaagaacagccgcgagtatgtgcgccctgggctgccagtgacctttattgatgaggttgactcggaagaggctccccaagctgcgaaactgccttatctgccccatccagcccgacctttacaccctgctagaccaggttgcgtcgcagagctccaacccagaggctcaaacaccttcactgtcgtgcccaaacgaaaaccgggtacactgcaggaccagcatttttcacaggccaatagagagccgcgaccacgggaggctgaagaggaagaagcatcttgcctactgggccctaccctgaaaaaacgctaccccaccgttcacgaaatcgaagtgattggtggttaccttgcacttcagaaaagctgcctgaccaaggccggaagcagccgcaagaaaatgaagatcagttttaacgataagtctctgcagaccacattcgagtacccctccgaatcaagtcttgagcaggaagaggaggtggaccagcaggaggaagaggaggaagaggaggaggaggaggaagaagaggaagaagggtcaggcagtgaagagaaaccattcgctcttttcctacctcgcgcaacatttgtgagtagtgtgcgccctgagagtagtcgattaccggaaggttctagcggtctgagcagctacacccctaagcactcagttgcattcagcaagtggcaggagcaggcgctggagcaggcacctcgcgaagcagagcccccaccggttgaggctatggttagatgcgggggagtggagaggtggggagagagcgacacacgtgcctcaccgtgcgtgcacatcctcagttctcactttcaacttaccccggcttctcagaatgacctgagcgacttccggagtgagcctgcactgtatttctag

SEQ ID NO: 243437 - DNA, 2136 bp, Artificial Sequence
  Description of Artificial Sequence: Synthetic coding sequence
atggccgcactcgggagaccaggctcagggcctagagcagcagtcccagcttggaagcgggaaattctggaacgaaagagagctaaattagccgctctaggcggaggagcaggacctggcgctgccgaaccggaacagagagttttggccgaatctctgggcccactgagagagaacccttttatgcttctggaagcagaacggaggcggggagggggagcggctggcgctagactgctggagcgttaccgcagggtgcctggagtcagggccctaagggcagatagcgtgctgattatagaaaccgtccccggatttcctcccgcacctccagctccaggcgctgcccagatccgcgctgcagaagttctggtgtatggcgcaccaccaggacgcgtgagccggctccttgaacgttttgaccccccagctgctccgagacgcagggggtctcccgagagggcgcgtccgccacccccacctccccctcctgccccaccaaggcccccaccggcagccccttctcctccggcagcaccaggcccacggggagggggagcaagccccggtgccagaaggtctgacttccttcagaagactgggtccaactctttcacagtgcatccgagggggctgcatcgcggagcaggcgctcggctccttagcaatgggcacagtgcacccgagccacgggctggacccgctaatagattggccggatcacctcccggtagcggccagtggaagccgaaggtcgagtctggtgatcctagcctgcatccccctccgagccctggaactccatccgcaactccggcaagcccccctgcgtccgctaccccgagtcagcggcagtgtgtttctgccgcaactagcacgaatgattcgtttgaaatacgcccagcccctaaacctgttatggagacaataccacttggagacttacaggcaagggctctggcctccttaagagccaactcccgtaactcatttatggtgatcccaaaaagtaaggcttctggcgctccacctccggaggggcgacagtcagtcgaactgcccaaaggagacctgggccctgctagcccctcgcaagaactgggcagtcagcctgtccctggcggtgatggagccccagccctgggaaagagtccgctcgaggtggaagcacagtgggcagtggaagagggggcttgccctagaactgccaccgccctcgccgaccgcgcaattcggtggcagcgtcccagcagtcccccacctttcctacctgcagcgagcgaagaggccgaacctgcggaaggcttaagagttccaggccttgccaaaaattcaagggaatacgttaggcccggactccctgtgaccttcatcgatgaggttgattctgaggaggccccacaagcggcaaaacttccttacctgcctcatcccgcaaggcctctccacccggcaagaccaggatgcgtggctgaactacagcctcgtggcagcaacaccttcactgtcgtcccaaagcggaaacccggaaccctgcaggatcagcacttttcccaggctaacagagagccacgacctagggaggccgaggaggaagaggctagctgtttgttgggccctacgttaaagaagaggtatccaaccgtccacgaaatagaggtcattgggggataccttgctttgcagaaatcatgcctcactaaagctggaagttccagaaagaagatgaaaattagctttaatgataagtctctgcaaaccactttcgaatacccctcagaaagttctcttgagcaggaagaggaggtggatcagcaggaggaagaagaagaagaggaagaggaagaggaagaagaggaagaggggtcagggtccgaggagaagccgtttgccctgttcctgcctagggcgaccttcgtttcgtctgtgagacccgaatccagtaggctgccagagggctcatcaggcctcagtagttacacccccaaacacagtgtggccttcagcaagtggcaggaacaagctctggaacaagcacctagggaggccgagcctccgccagtggaggcaatgctgacaccagcgtcccagaatgacctgtccgatttcaggtccgagcccgcactgtatttttag

SEQ ID NO: 243438 - DNA, 4866 bp, Artificial Sequence
  Description of Artificial Sequence: Synthetic coding sequence
atggagtgggttcttgccgaagcattgttaagtcagtcaagggaccctagagccctgctgggagccctctgtcagggagaggcgtcagccgagagggttgaaacgctcaggttccttctccagagactggaggacgaagaagctcgcggtagtggaggggctggggcattgccggaagcggctagagaggttgcggctggataccttgtgcctctccttcgatccctgcgcggacgccctgccggagggcctgacccttccctgcagcctcgtcacagacgacgagtactgcgggctgccggagcagccctacggtcttgtgtgcgattagcaggcaggcctcagctggccgcagccttagctgaagaggcactgcgtgacctgctggcagggtggcgggctcctggcgctgaagcagcggtggaagtgctggccgcagtcgggccttgtctgaggccccgagaggacgggcctctgctggagcgcgtagcaggaaccgctgtggctttggcactagggggaggaggtgatggtgacgaggcaggccctgctgaagatgctgctgccctggtagccggtaggctcctccccgtgctcgtccagtgtgggggagctgccctgagagccgtgtggggcggactggccgctcctggcgcatcattgggctcagggagagtggaagaaaagttgctcgttctgagcgcactggcagagaaactcttgccagagccagggggtgacagggccaggggggctcgggaagccggacccgacgcacgtcgctgttggaggttttggcgcaccgtccaggctggcctgggccaggcagatgcgttgaccaggaagcgcgcacggtacctgcttcagcgggctgtcgaggtgagcgccgagcttggggctgactgtacctgcggaccccaggagggaaacggaccctcccttttctggtggagcgagaggaaaaaagatgagctgcttaagttctgggagaactacattcttatcatggagacccttgaggggaatcagattcatgttatcaaacctgtcctgcccaagctcaacaacctttttgaatatgctgtgagcgaagagaacggctgctggctttttcatcccagttggcatatgtgtatctacaaacggatgttcgagtccgagaacaaaattttgagcaaggagggtgttatccactttttggagctgtacgaaacaaagatcctccccttctctcccgaattctcagagtttataatcggccctctcatggacgctctttctgagagcagtctgtatagtcggtccccaggacagcctataggctcttgttcccctttggggctgaagctgcaaaagttcctggtaacatacatctcgctcttgccagaagaaatcaagagctccttcctgttgaagttcatccgcaagatgacttccaggcactggtgtgctgttccaatcctcttcctgtccaaggccctggctaacgtgcccagacacaaggctctgggcatcgacggcttgcttgccctcagggacgtgattcactgtactatgatcacacaccagattttgcttcgcggtgctgcccagtgttacttgctgcagacagcgatgaacctgttagacgtggagaaagtctctttatccgacgtgtctaccttcctgatgagtttgaggcaggaggagtccctcgggcgtggaacgagcctctggaccgaactttgcgattggctgagggtcaatgagagttattttaagccgagcccgacctgctctagcataggtttacacaaaacttccttaaacgcgtacgttaagtcaatcgtccaagaatacgttaagtcatctgcctgggaaactggagagaactgctttatgcccgactggttcgaggcgaaactagtgtccctcatggtgttgctggcagtggacgtggaaggcatgaaaacacagtactctgggaaacagcgcaccgaaaatgttctgcgaatttttcttgacccacttctggatgtccttatgaagttttcaacgaacgcttatatgcccctcctgaaaaccgatcgttgtctgcaacttctactgaaactcctgaacacctgccgattgaaaggcagtagcgcccaggatgatgaagtgtcaaccgtgttacagaatttcttcatgagcaccaccgagagcatctcggaattcattctgcggagactgactatgaatgagctgaactcggtcagcgatctcgatcggtgtcacttgtacttgatggtgctgactgagctgattaacctccatctcaaggtgggatggaaaagaggcaaccccatatggagagttataagtcttcttaagaatgcctcaattcagcatctccaggagatggattcaggacaagagccaaccgtgggctcccaaattcaacgggtcgtttccatggctgctctggcgatggtgtgtgaggccatagaccagaagccagagttgcagctggatagtttgcatgcaggcccattggagagtttcttgagttcactgcagctaaatcagacgttgcagaaacctcacgctgaggagcagtcaagctatgctcatcccctagagtgctcgagcgtgttagaggagtcaagtagttcccagggatggggcaagatcgtcgcacaatatatccacgaccagtgggtctgcttaagtttcttgctgaaaaaataccacacccttataccaacaacaggctcagagattttagagccgtttctgcccgctgtgcagatgccgatcaggaccttacagtccgcactggaggcgttgaccgtgctcagcagcgatcaggtcttaccagtgttccactgcctcaaggtcttggttcctaaattgctcacctcctcagaaagcctgtgcatagagtcattcgatatggcatggaagataatttcttcactgtccaacacacagttgattttctgggctaatttgaaagcttttgttcagttcgtattcgataacaaggttttaaccatcgcagctaaaatcaagggacaggcttatttcaagatcaaagagattatgtacaagatcatcgagatgagcgccatcaaaacaggcgttttcaacaccctgatcagctactgttgccagtcctggattgtcagcgcttcgaacgtatcacagggcagcctgtcttccgctaagaattactccgaactgatattagaggcctgtatctttggcacagtctttcggcgtgaccagcgccttgtacaagatgtccagactttcatagagaacctcggtcatgactgcgcagcaaacattgtcatggaaaatacgaaaagggaagaccactacgttaggatctgtgcagtgaagttcctctgcctgttggatgggagcaatatgtcccacaaactgttcatagaagaccttgctatcaaactactggacaaggatgagctggtctcgaaatccaagaagcgatactacgtcaacagccttcagcaccgggtcaagaacagggtgtggcaaaccctccttgttctgtttcctcgtctagaccaaaactttctcaacggtattatcgacagaatcttccaggccggtttcacgaacaaccaagcatctatcaaatactttattgagtggatcatcatccttatcctacacaaattcccccagtttttacctaagttctgggactgtttctcctatggtgaggagaatctgaagacttccatctgcacttttctcgcagtgctttcccatctggatataattacccagaacattccagagaagaaactgattctcaagcaggcccttatcgttgtcctgcagtggtgcttcaatcataacttcagcgtcagactgtatgcattggtcgccctcaaaaaactctggaccgtttgcaaggtgctgtcagtcgaagaatttgacgccctcaccccagtcattgagtcatcactgcaccaggtcgaatctatgcatggggcaggaaatgccaagaaaaattggcagcgcatccaagagcactttttcttcgcgacattccatccattgaaggactattgtctcgagaccatattctatattctcccccgactcagcggactgatcgaggacgagtggatcacaattgataagtttacccgattcacagatgtgccgctggccgcaggatttcagtggtatctttctcagactcagctttcaaaactgaagcccggtgactggtctcagcaagacatcggcaccaatctcgtcgaggccgataaccaggcggaatggacagacgtccagaaaaagataatcccatggaattcgcgtgtgtctgacctggacctggagctgctgttccaagaccgagcagccagactggggaaatcgatctcccggctgatcgtcgtcgcaagtttgatcgataaacccacaaacctgggcggactatgcaggacatgcgaagtctttggagcgagcgtgcttgttgttggttctctgcagtgcatttcggataaacagttccagcacttgtcagtttctgccgagcaatggctgcccttggtggaggttaaacctccacagctgattgactacttgcagcaaaagaagacagagggatacactatcataggggtggaacagaccgccaaatctctagatctcacccagtattgctttccggaaaaatcactgttgcttcttggcaatgaacgagagggcatacctgccaatcttatccaacaactggatgtttgcgtggaaattccccagcagggcattatcaggagtcttaatgtgcacgtgagcggggcactcttgatttgggagtacactcgccagcagctgttgagccatggtgacaccaaaccctag

SEQ ID NO: 243439 - DNA, 1101 bp, Artificial Sequence
  Description of Artificial Sequence: Synthetic coding sequence
atgtccgaggaggagcagggcagcgggacgactaccgggtgtggccttccttcaattgaacagatgttggcagctaacccaggtaaaactccaatcagcttgctccaggaatatgggacacgcatcggtaagacccctgtctacgatcttctaaaggcggaggggcaggcacatcagcccaatttcactttcagagtaaccgtgggagatactagctgcaccggacagggcccatctaagaaggccgcaaagcataaagcagccgaagtggccctcaagcatttgaaaggtggtagcatgttagaacccgctctcgaggacagcagcagcttcagccctctggatagctcgctgcccgaggacatccctgtcttcacagctgccgcagccgctacccccgtgccatccgttgttctcaccagaagcccccctatggagctgcagccaccggtttcgccacagcagtccgagtgcaaccccgttggcgctctgcaggagcttgttgtgcagaagggatggagactgccagagtacactgttacccaggagagtgggccagcccaccgaaaggaatttaccatgacttgtagagttgagcgttttatagagattggaagcggaaccagcaaaaaactggccaagagaaatgcagcagcgaaaatgctgctgcgggtacatacagtgcccctggatgcaagagacggcaacgaggttgagcccgacgacgatcactttagcattggggtggggagtcgcctggatggcttaaggaaccggggaccagggtgtacctgggatagcctgcgtaattctgtgggagaaaagatcctgagcctccgcagctgttctcttgggagcttgggggctctgggtccggcttgctgccgcgtgctttccgaactgtcagaagaacaggcattccacgtgagctatcttgacatcgaagagcttagtctgagtggtctgtgccagtgtcttgtcgaactcagcacacagccagccacggtctgccacggtagcgctactacaagagaggccgctcgtggagaagcggcacggagagccctccaatacctaaaaataatggccggaagcaagtag

SEQ ID NO: 243440 - DNA, 1038 bp, Artificial Sequence
  Description of Artificial Sequence: Synthetic coding sequence
atgttagcggcaaacccaggcaagactcccattagcctacttcaggaatacggcaccaggattggtaaaactcctgtgtatgatcttcttaaggctgagggacaagcgcaccagcccaattttacttttcgggttacggttggcgatacaagttgtactggacagggtccaagcaagaaggccgctaagcataaggcagccgaggtggcactcaaacatttgaagggcggaagcatgcttgagcccgctcttgaagattcatcatccttttcgcctctggactctagcctgcctgaggacatacctgtctttacagctgccgctgcggctacccctgtcccttccgtcgtgctgactcgttctcctccgatggaactccagcctccggtctctccccaacaaagcgagtgcaatcccgtgggagccctccaggaattggtcgtgcagaaaggctggaggctcccagagtacaccgtgactcaggagtcagggccagcacatcgtaaagaattcacaatgacatgcagagtggagagatttatagaaatcggcagcggtacttccaagaaacttgctaagagaaacgcagctgcgaaaatgttgcttcgcgttcatacagtgcctctggacgccagggatggtaatgaggtcgagcccgacgacgatcatttcagcatcggtgttggctctcggctcgatgggcttcggaatcggggacctggatgtacatgggatagcctgcggaactctgtgggcgagaagattttaagtttgcgctcttgttcactgggctccctcggagccctgggaccggcatgttgccgcgtgctatccgagctgtcggaggagcaggcctttcacgtgtcctacctggacatcgaggaactttcgctcagtggattgtgtcagtgccttgtcgagctgtccacccaacctgcgacagtctgtcacggaagcgctaccaccagggaggccgcaaggggagaggctgcgcgacgagcgctgcagtacctcaagatcatggccggtagcaaatag

SEQ ID NO: 243441 - DNA, 1038 bp, Artificial Sequence
  Description of Artificial Sequence: Synthetic coding sequence
atgctggccgctaatcccggaaaaaccccaattagtctgctgcaagagtacgggactcgaataggtaagacacccgtgtacgatctgctgaaagccgaggggcaagctcatcagcctaattttacttttcgtgtaacagtgggggacacctcgtgcacaggccagggccctagtaagaaggcagcaaaacataaagcagctgaagtcgccctgaagcaccttaaggggggaagcatgctggaacctgcattggaagacagctcctctttctccccactagattcttccctgcccgaggacatcccggtcttcacggcagcggctgctgctacacctgtgccatcagttgtactgacgcgatccccccctatggagctgcagcctcctgtgtctccccagcagtctgagtgcaacccggttggagccctccaagagctggtcgtgcagaaaggctggcggctccccgaatatactgtcacgcaagagtcagggcctgcccaccgcaaggaatttaccatgacgtgccgagttgaaaggtttatagagattggaagcgggacaagcaagaagcttgccaaacgcaacgcggctgccaagatgctactccgtgttcatacggtgcctctggacgctcgggatggaaacgaggttgaaccagacgacgatcacttctctattggggttggttctcgcctggacgggctgaggaacagaggcccagggtgcacctgggacagcctcaggaattcagtgggggagaagatcctgtctttacgcagttgttctctgggctcactgggagcacttggcccagcatgctgtcgtgtgttatccgagttgagcgaagagcaggccttccatgtgtcatatctcgatatagaggaactttctttgagtggactttgtcagtgcctggtggaactatccacacaacctgctactgtgtgtcatggctctgccacaacaagagaagccgctcgcggagaagccgctagaagagcactgcaatatctgaaaatcatggcaggatctaagtag

SEQ ID NO: 243442 - DNA, 1245 bp, Artificial Sequence
  Description of Artificial Sequence: Synthetic coding sequence
atgagcgagtatattcgggtgactgaggacgagaacgatgagccgatagaaatcccttccgaagatgacggtacggttcttctttcaactgtaacggctcagttcccaggggcatgtggtctgagataccggaatccggtgagtcagtgcatgcgcggagtccggctggtagagggcatcctgcacgcgccagacgctggctggggcaatcttgtgtacgttgtgaactatcctaaagataacaagcggaagatggatgagacagacgctagctctgccgttaaagtgaaaagggccgtccagaagacctccgacctgatcgttctcggcttgccctggaagaccacagagcaggatttgaaagagtactttagcaccttcggggaggttttaatggtgcaggtgaagaaggatctaaagaccggacacagtaagggatttgggttcgtaaggttcaccgaatatgagacacaggtcaaggtcatgtcgcaacggcatatgatcgacggacgctggtgtgattgcaagctacctaatagtaagcagagtcaggacgaaccactgcgatcacggaaagtttttgttggacggtgcacagaagacatgaccgaggatgagttgcgtgaattctttagccagtacggggacgtaatggatgtgttcatccccaaacctttcagggccttcgcctttgttaccttcgccgacgaccagatagctcagtcgctctgcggagaggacctgataattaagggaatcagcgtgcacattagcaatgccgagcctaaacacaatagcaatcgccagctggagcgttccggccgatttgggggtaatccaggtggctttggcaaccagggcggatttgggaacagtcgcggagggggtgccggactcgggaataatcaggggtcaaatatgggcggaggcatgaatttcggggcattttctataaaccctgctatgatggcagccgcacaggctgcactgcagtcgtcttggggcatgatgggcatgctagccagtcaacagaatcagtctgggcctagcgggaataaccagaaccagggaaatatgcagagagagcctaaccaggcttttggctctggaaataattcttattcaggctctaatagcggagccgctatcggatggggatccgcgtccaatgccggttcagggtccgggtttaatgggggatttggaagctctatggacagcaagtcctcagggtggggcatgtag

SEQ ID NO: 243443 - DNA, 888 bp, Artificial Sequence
  Description of Artificial Sequence: Synthetic coding sequence
atgagcgaatacattagagtcaccgaggacgagaacgacgagccaatcgaaatccctagcgaggatgatggaacagtcttgctgagcactgtgacagctcagtttcccggtgcctgtggtctgcgctacaggaatcccgtttcacagtgcatgaggggcgtcaggcttgtggaggggattttgcacgctccagatgcaggctggggcaatttggtgtacgttgttaattatcccaaagacaataaacggaagatggatgagacggacgcctcttctgcagtgaaggtgaaaagagccgtgcaaaagacaagtgacctgatcgtgctgggactgccttggaagacaaccgagcaggatctgaaggagtatttcagcacattcggggaagttctcatggtacaagtcaagaaagatttgaagactgggcactccaaaggctttggttttgtgcgcttcaccgaatacgagacgcaagtgaaagtcatgtcacaacggcatatgattgatggtagatggtgcgactgtaaactgccaaatagtaagcagtctcaggacgagcctctgcgcagccggaaggtgtttgtgggaaggtgcacagaagacatgacagaggatgaattacgcgaatttttcagccagtacggcgatgtcatggacgtgttcatccccaagccgttccgcgcttttgccttcgtgacgtttgcagatgatcagatcgcccaatcattgtgtggggaggacctcataattaagggaatcagtgtacacatttctaacgcagagccaaaacataatagcaacagacaactcgagaggtctggcagatttggcgtgcacttgataagtaatgtttacgggagatccacaagtttgaaagttgttctctag

SEQ ID NO: 243444 - DNA, 897 bp, Artificial Sequence
  Description of Artificial Sequence: Synthetic coding sequence
atgcctcagatgctggccggagaaatttggtgtatgctgtccacgattcagaaggttaagaaagatctgaagaccggacatagcaaggggtttggcttcgtccgattcacagaatatgagactcaggtcaaggtgatgagccagcgacacatgatagacggtaggtggtgtgattgcaagctgccgaacagtaagcagagtcaggacgagccgctgagatccagaaaggtattcgtaggtaggtgcaccgaggatatgaccgaagacgagcttcgtgagtttttcagtcagtatggggacgtgatggatgtgtttatacccaagccctttcgggcttttgcatttgtgacgttcgcagacgatcagattgcccagtcactatgtggggaagacctcattatcaaagggatttccgtccacatatccaacgccgagccaaagcacaattcgaatagacagctggaaaggtccggacggtttggcggaaacccaggcggattcggaaatcaggggggattcggaaattcaaggggcggaggagcaggccttggcaacaatcaggggtccaatatgggcggtgggatgaattttggtgcattcagcatcaaccccgcaatgatggcggctgcccaggctgccctgcagagcagctggggtatgatgggtatgctggcctcacaacaaaaccaatcaggaccatcaggaaataaccaaaatcagggcaatatgcagcgggagccaaatcaggctttcgggagcgggaataattcatattctggatcaaacagcggtgcagccatcggctggggttcagcaagcaatgccggaagcggaagtggcttcaacggcggtttcggaagctctatggactcaaagagctcggggtggggaatgtag

SEQ ID NO: 243445 - DNA, 1533 bp, Artificial Sequence
  Description of Artificial Sequence: Synthetic coding sequence
atggcagccgacagcgacgacggagccgtgtccgccccagcggcaagcgatggcggagtcagtaagtctactacgagcggcgaagagctagttgtgcaggtaccagtcgtggacgtgcagtccaacaattttaaagagatgtggccatcgctactgctggcgatcaagaccgcaaactttgttgcggtagacacggagctatccggactgggggacaggaaatccctcctcaaccagtgtatcgaagaaaggtacaaagcagtgtgccatgccgcacgaaccagatctatactcagtctgggcctggcttgcttcaaaaggcagccagataagggggaacacagctacctggcgcaggtgtttaaccttactctgctatgcatggaggagtatgttatcgagccgaagagcgtccagtttttgatccagcatggcttcaactttaatcagcagtatgcccagggaattccctatcacaagggaaacgacaagggagatgagagccagtcacaatcagtaaggaccctattcctggagctgatccgcgctcgacgaccgctggtgctgcacaacggccttattgatctggtgtttctgtaccaaaatttttacgcccacttgcccgagtcactggggaccttcaccgcggatctgtgcgagatgtttccggcaggaatttacgacacaaagtacgcagcggagttccacgcacgattcgtggcgtcctacctggagtatgcttttcgcaaatgcgagagggaaaatggaaaacagagggcagccggatctccacacctgactctggaattctgcaactatccttcgagtatgcgggaccacatcgactatcggtgctgtttgcccccagccacacataggccacatcctacttcgatttgtgacaacttttctgcctacggatggtgtccattgggaccacagtgtccacaatctcatgatatcgatcttataatagacacagacgaagctgctgctgaggataaaagaaggaggagacgcagacgcgagaaacgcaagagagccttgttgaatctgccaggcacccagacctccggagaggctaaggatggccctccaaaaaagcaggtgtgtggagattcaatcaagccagaggagacagagcaggaagtggccgcagatgagaccagaaacctgccgcattcaaaacagggaaacaaaaatgatctggagatgggaatcaaggccgcacgcccagagattgccgatcgcgcaacctccgaggtgccagggagccaggctagtcccaatcccgtgcctggagacgggctgcatagggctggttttgacgcctttatgacgggctatgtaatggcttatgtggaggtgtcccaggggccacaaccttgttcctcagggccatggttacctgagtgccacaacaaggtatatctttccggtaaggccgtacctttgacagttgccaaatcacagttttcccggtctagtaaagcgcataatcaaaaaatgaagttgacctggggctcttcctag

SEQ ID NO: 243446 - DNA, 1293 bp, Artificial Sequence
  Description of Artificial Sequence: Synthetic coding sequence
atggccgcagatagcgacgacggggctgtatcagccccagccgcatccgatggggctgagtgggcctggggtcaagaggagtttgccgaacctggtgaacactcctacttggcccaagtgtttaacctaacgcttctttgcatggaggaatacgtaatcgaacccaagagcgtccagtttctgattcaacatgggttcaacttcaaccagcagtatgcccaaggaatcccttaccacaaagggaatgacaagggcgacgagagccagtctcaatctgtgcgcacactcttcctggagttaattagagcaaggcgccctctcgtgctgcacaacgggctaatcgacctagtgtttctttaccaaaatttctacgctcatctccctgaatccctgggcaccttcactgctgatttatgtgagatgttccctgcaggcatctacgacacaaagtacgccgcagagttccatgcacgttttgtggccagttacttagaatatgctttcagaaagtgcgaacgcgagaacgggaaacaacgtgcagcaggcagtccgcacctgacccttgaattctgcaattacccttccagcatgcgggaccacattgactacaggtgttgtctgcctcccgcaacccacagacctcaccccacgtcaatctgtgacaatttcagcgcatatggctggtgcccccttggcccacaatgtccccaatcccacgacatcgatctgataattgataccgacgaggctgcggcagaagataagcggagacgtcggagaaggcgtgagaaacgcaaacgcgcactcctgaaccttccaggtactcagacgtctggcgaagccaaggatggtccaccaaagaagcaggtctgcggtgactcaattaagcctgaagagacagaacaggaagtggccgctgacgaaacgcgcaatctgcctcacagcaagcagggcaataaaaatgatctggagatgggcattaaggccgctagacctgagatcgccgatagggctacttctgaggtcccgggaagccaagcttcaccaaatcccgtgccgggtgacggattacatcgtgctgggttcgacgccttcatgactgggtacgtcatggcatatgtggaggttagccagggccctcagccatgtagcagtggaccctggctgccagaatgtcacaataaggtatatctgtcagggaaggcagtgcctcttaccgtggctaagagccagttcagcagatcctccaaagcacataatcagaagatgaaattaacctggggctcatcttag

SEQ ID NO: 243447 - DNA, 1263 bp, Artificial Sequence
  Description of Artificial Sequence: Synthetic coding sequence
atgacaatggagaagggaatgagctccggcgaaggcctgccaagccggtcaagccaggttagtgccggaaagatcacggccaaggaactcgagacaaaacagtcctataaggaaaagcgcggaggattcgtccttgtacatgccggtgctggctaccacagtgagtctaaagccaaagagtataagcacgtatgtaagagagcttgccaaaaggcaatcgagaaattgcaggctggagccctcgcaacggacgctgttacagctgccttggtggaactggaggatagcccattcactaacgccggtatgggctccaatctaaatctcctcggcgaaatcgagtgcgacgcctctatcatggatgggaagagcctgaattttggggcagttggggctctgtctggaataaagaaccccgtcagcgttgccaatagacttctgtgcgagggccagaaaggaaaactgtcggctggccgaatcccaccttgcttcctcgtgggggaaggcgcatacaggtgggctgtcgaccacggtatccccagctgccctcccaatatcatgacaacacggttcagcttagcagccttcaagcggaataagagaaagctggagctggccgagagagtggacaccgattttatgcagcttaagaagcggcgtcagtccagcgagaaagagaacgatagcggaacactcgacacggtcggagccgtggtcgtggaccacgagggcaatgtagccgctgcagtgagctctggaggcctcgcactcaagcacccaggcagagtgggccaggccgctctgtatgggtgtggctgctgggcagagaataccggggctcataacccatattccacagctgtatcgacttctgggtgtggcgaacacctcgtgaggactatcctcgcaagagaatgtagccatgcacttcaggctgaggacgcgcatcaggcgctactggaaaccatgcagaataagttcatctcttcccctttcctcgcctctgaagatggggtgctgggcggagtaatcgtgttgaggtcttgtagatgtagcgcagagcctgactcctcccaaaacaagcaaacactactggtagagtttctttggtcccacaccactgagtcaatgtgtgtgggttatatgtctgctcaggacggtaaggcaaagactcatatttcacggttgcctccaggcgctgtagctggccagtcagtggccatagagggtggcgtatgtcggctcgaatcccctgtcaactag

SEQ ID NO: 243448 - DNA, 918 bp, Artificial Sequence
  Description of Artificial Sequence: Synthetic coding sequence
atgaccatggagaaagggatgtcgtccggcgagggcctcccttcgcgaagctcccaggtcagcgccggtaagattacagccaaagagctggagaccaaacagagctacaaagagaaaaggggaggattcgtgcttgttcatgccggagccggataccactccgagagcaaggctaaggagtacaaacatgtctgcaaacgcgcttgccagaaagatagtccattcacaaacgcaggaatgggttccaacctgaacttgcttggggaaatcgaatgcgatgcctccataatggatgggaagagcctgaacttcggcgcagtaggtgcgttgtctggaatcaagaacccagtgtcagtggccaataggctcctgtgcgaaggccaaaagggaaaacttagtgctggaaggattcctccttgttttctggttggcgagggagcctatcgttgggccgtcgaccatgggatccctagctgcccgcctaatatcatgaccacacgtttctcgttagcagcttttaaacggaacaagagaaaactggaattagctgagcgtgtcgatacagacttcatgcagcttaagaagaggagacagtcttcggaaaaggaaaatgatagcggcacactggataccgtgggtgcagtggtcgtagaccacgaaggtaacgtcgccgcagcagtgtcgtctggaggattagctcttaaacatccgggtagggtcggccaggcagcactctacggttgcggatgttgggccgagaacacgggggcacataatccatactcaaccgctgtcagcaccagcggctgtggcgagcatttggtgcgcacaattctcgcccgtgaatgctcccatgccctgcaggccgaagacgctcaccaggcactacttgaaaccatgcaaaataagttcatatag

SEQ ID NO: 243449 - DNA, 333 bp, Artificial Sequence
  Description of Artificial Sequence: Synthetic coding sequence
tagaaaattactgccaaagaactggagacaaaacagtcttataaagaaaaacgcggaggttttgttctggtgcacgcgggagccggttatcactccgagagtaaggccaaggaatataagcatgtctgcaaacgggcttgccagaaagcaattgagaagctacaggccggagccttggctacagatgctgtcaccgccgcacttgtcgagctcgagctcatgtggaaaggtcagttccaggtgctctgtgtgctgaccaatctgtttttagacattatcaaaaaccctacaaagacaaagtttaagaccatcagcaatgtgaaggtctattag

SEQ ID NO: 243450 - DNA, 918 bp, Artificial Sequence
  Description of Artificial Sequence: Synthetic coding sequence
atgacaatggagaaaggtatgagctctggcgaggggctgccctcccgatcctcacaagtgagcgctggtaaaattactgcaaaggagctggaaactaaacagagttacaaagagaaacggggtgggtttgtcctggtccacgccggagccggataccactcagagagtaaggccaaagaatacaaacacgtctgcaagcgtgcgtgccagaaggattccccttttaccaacgcagggatgggaagcaaccttaatctgcttggggaaatcgaatgcgacgcctctatcatggatgggaaaagcttgaatttcggagccgtgggcgcattatcagggatcaaaaacccagtctcagtagcgaaccggctgctctgtgagggtcaaaagggcaagctgagcgcagggagaatacctccatgttttcttgtcggagaaggggcatacagatgggccgtggatcacgggattccgagctgtccacccaatataatgacaaccaggttcagcctggccgctttcaaaagaaataagaggaaactggaattggccgagcgcgtggacaccgactttatgcaactaaaaaaacgtagacagagtagtgaaaaagagaatgactccgggaccctcgataccgtgggtgcagtcgttgttgatcacgaaggtaacgttgccgcagccgtgtccagtggcggtctagctcttaaacacccagggcgtgttggacaggcagctctctatgggtgtggttgttgggccgagaataccggggctcacaacccttattcgactgctgtgtctactagcggctgcggcgagcatttggtacgcacaattctagcccgtgagtgtagtcatgccctccaggccgaggacgcccaccaagccctactagagactatgcaaaacaagttcatttag

SEQ ID NO: 243451 - DNA, 438 bp, Artificial Sequence
  Description of Artificial Sequence: Synthetic coding sequence
atgactatggagaagggcatgagttcgggggagggactgccatctcggtcatcacaggtgagtgctggaaaaattaccgctaaagaactcgaaaccaaacagtcgtacaaggagaaaaggggtggattcgtgttagtgcacgctggggctggttaccacagtgagagtaaagcaaaggaatacaagcatgtttgcaagagagcatgccagaaagctattgagaagttgcaggcaggcgctctggccaccgatgccgtgacagctgctctagttgagcttgaagatgtggagtctatcctgtgcgcaccatattggctggaaaatgtccatatgttatataaactgaggatgttgacgaaaccctgctggcggttatgtaagaccagtctttctgtgcatttatccctcccagtgaagatggcctgtttggctgaatag

SEQ ID NO: 243452 - DNA, 390 bp, Artificial Sequence
  Description of Artificial Sequence: Synthetic coding sequence
atgacaatggagaagggcatgtcctcgggcgagggccttccaagtaggagttctcaggttagtgcgggtaaaatcacagcaaaagaattggaaaccaagcaaagttacaaagaaaaaagaggcggatttgtgcttgtacacgccggagctggttaccattccgagtcaaaggccaaagagtataagcacgtgtgtaaacgagcctgccagaaagcaattgagaaattgcaggccggagcactggccacagacgctgttactgctgcactggttgagctggaagtgtacacacattcgtatacctcttggagctgcatccaaccttccatacatgttctcctggtgaagcggcagagaaagagtccgctcccgcgtattagcactttctag

SEQ ID NO: 243453 - DNA, 1443 bp, Artificial Sequence
  Description of Artificial Sequence: Synthetic coding sequence
atgctgctgtgcaccgcgagactggtggggttgcagctgctaatctcttgttgttgggccttcgcttgccactccactgagagctctcccgatttcaccctcccgggagattatctgctcgccggactgttccccctacacagcggttgcctgcaggtgcgacatagacctgaggttactctgtgtgataggtcctgtagtttcaatgagcacgggtaccacttgttccaggccatgcgcctcggggtcgaggaaatcaacaattctacagctttgctgccaaacataacattgggttaccagttgtatgatgtctgttctgactccgccaatgtctatgccaccttgcgagtcctgagcctcccagggcagcaccacatcgaattgcagggcgatttgctccactatagtcccactgtgctagccgtgatcgggcctgactcaactaacagggcagcaactaccgccgcactgctcagcccattcttagtgcctatgattagctacgctgcctctagtgaaaccctgagcgttaagcgccagtatccaagtttcctgcgaacaattccgaatgataagtatcaagtcgaaaccatggtcctcctgctccagaaatttggctggacctggatctccctggttggtagctctgatgactacggccagttgggtgtccaagctctcgagaatcaggctacagggcaggggatttgtatagctttcaaagacatcatgccctttagtgcgcaggtaggggacgagaggatgcagtgcctgatgcggcacctcgcccaagccggtgccaccgtggtggtggttttttcttctagacaactcgctcgagtgttttttgagagcgtggtgctgactaatcttaccggcaaagtgtgggtcgcaagtgaagcttgggccctgtctaggcacattaccggcgttcctggaatccaaaggataggtatggtcctgggtgtcgctattcagaaaagggctgtcccaggattgaaagctttcgaggaggcgtatgctagagcagacaaaaaagcgcctcggccatgccacaagggcagctggtgcagcagtaatcaactgtgccgcgaatgtcaggcctttatggctcacaccatgcctaaactgaaggcattctcgatgtcttcagcatacaatgcttatcgcgctgtttatgccgtcgcacacggtctgcatcagctgctggggtgcgcgagtggcgcatgctctagaggtagagtttacccatggcagacaagtaccgatgcctccctggtcggcaaaaaatcaggccatcttagggaagcccgtccagccagcagggcgctttggtgtttctggctatgcgtgtcaactcctctgggctgttgttggcagttgaccagatgttgttgttgctgctgtctgggactgctggcttgcctgcccggtacttag

SEQ ID NO: 243454 - DNA, 2526 bp, Artificial Sequence
  Description of Artificial Sequence: Synthetic coding sequence
atgctgctgtgtaccgcacggctggtaggtctgcagctgctgatctcttgctgctgggcatttgcctgccattccacagagagttcccccgatttcaccctccccggtgattatctgctggcaggcctgttccccttgcatagcggatgccttcaagtccggcacagacccgaagtgacactctgcgatcgcagttgtagcttcaacgaacacgggtatcatctgttccaggccatgaggttgggggtggaggaaataaacaacagcacggccctgttaccgaatatcacgttgggctaccagctatacgatgtgtgttcagactccgctaatgtctacgccacactgcgggttttaagcctgcccggacagcaccacatagaattacagggggatcttcttcattactcacccaccgtactcgctgtgattggccctgacagcactaaccgggctgcaactaccgctgccctgctgagccctttccttgtacccatgatatcctacgcagcctcttcagagacactgtcggtcaaaagacagtacccttccttcctgcgcacaatccccaacgacaaatatcaggtagaaacaatggtactccttctccaaaaatttggatggacctggatcagcttagtagggtctagcgatgattacggacaactgggagtccaggccctcgagaatcaggctacgggacagggcatttgtattgccttcaaagacatcatgccattcagtgcccaggtgggagatgagaggatgcagtgtctcatgcgacatttggctcaggccggagcgactgtggtggtggtgttcagttcccgacaacttgctcgcgtttttttcgaatctgtcgtgttaactaatctgaccgggaaggtgtgggtcgccagcgaggcatgggctctgtctcggcatattaccggggtacctggcatacagcgcataggcatggtcctgggcgtcgctatacagaagcgagccgtgccagggttgaaagcgttcgaggaggcctacgctcgggcagacaagaaggccccacggccttgccataaggggtcgtggtgcagctctaatcagctgtgccgggagtgccaggcctttatggcccacactatgcccaaactgaaggccttcagtatgtcaagtgcctataatgcatatagggctgtctacgccgtggcgcacgggctgcaccagctgctgggatgcgcaagcggggcatgctctagaggccgagtgtacccctggcaacttctcgagcagattcacaaagttcactttctgctccacaaagacactgtggccttcaacgacaaccgcgatcctctgagttcatataatattattgcatgggattggaacggtcctaaatggacatttactgttctgggatcttctacctggtcccccgtgcagctgaatatcaacgaaacaaaaatacagtggcatggcaaggacaatcaggtgcctaagtccgtatgtagctccgactgcctcgagggacaccagagagtcgtgacagggttccatcactgttgcttcgaatgcgtcccttgcggggctggaaccttcctcaacaagagcgacctgtatagatgtcagccatgcggaaaggaagagtgggcccctgagggaagtcagacttgctttcctagaaccgtggtgttcctggctctgagggaacacacttcgtgggtactccttgctgccaacacactgctcctgttgctgctgctgggcacggcaggtttgttcgcttggcacttagacaccccggtcgtcagatctgctggcggacgcctctgcttcctgatgcttggttctctggccgcaggcagcgggagtctctacggtttcttcggagagcctacccgtccagcttgtctgctccgccaagcgctgttcgccctgggatttaccatattcctgtcttgtttaacagtcaggtccttccagctgatcatcatttttaagttttcaacaaaagtgccaacattctatcacgcttgggtccagaatcacggcgctggtttgttcgtgatgatctcaagtgcagcccagctcctgatatgcctaacatggttggtggtatggaccccactccccgcacgcgaataccagcggttccctcacctggtcatgctggagtgcactgaaacaaatagccttggctttattctggcttttctttataacggccttctcagtatctccgcgtttgcctgcagttatctggggaaagacctgccagagaattacaatgaggccaaatgcgttacattcagcctattgtttaatttcgtgtcttggatcgctttctttactaccgctagtgtttatgacggcaagtacctccccgcagccaatatgatggcaggactaagctctctgtcaagtgggtttgggggttacttcctgcccaagtgctacgtgattctgtgtcggccagacctgaatagcacggagcactttcaggccagcatacaggattatacaaggaggtgcggaagtacctag

SEQ ID NO: 243455 - DNA, 1764 bp, Artificial Sequence
  Description of Artificial Sequence: Synthetic coding sequence
atgcttctctgtaccgctcggctcgtcggactgcagttgctaatctcgtgttgttgggcatttgcatgtcactccacagaatccagccctgatttcaccctcccaggggattacttgctcgccggtctgttccctctccattctggttgcctacaggttcgccacaggcccgaagtaacactctgtgataggagctgcagctttaatgagcacgggtatcacctctttcaagcgatgcgtctcggagtcgaggagataaataatagcactgccctgttacccaacatcaccctggggtaccagctatacgatgtgtgttcagattccgcaaatgtgtatgccactctccgggtgctatccctcccgggacagcaccacattgagctacagggcgatttgcttcattattcccctaccgtgctggcagttatcggcccagattccaccaatcgggctgctaccactgctgcactgctgtctccatttttggtaccgatgctgctggaacaaatccacaaggtgcatttcctgctgcataaagacactgttgcctttaatgataaccgcgatcccttgagctcttacaacatcattgcatgggattggaacggaccaaagtggaccttcactgtgttgggatcctcaacctggagcccagttcagctgaacataaatgagaccaagatccaatggcacgggaaggacaaccaggtcccaaagtcagtgtgcagctccgactgcttagagggccatcagagagtggtcacaggcttccaccactgttgtttcgagtgtgtaccatgtggcgctggcactttcctgaacaagagtgatctgtatcgctgtcagccttgcggtaaggaagagtgggctcctgagggtagccagacatgcttcccacggactgtcgtttttctggctctgcgtgagcacacgtcctgggtactgctcgcggcaaacactcttttgctgctgctgctcctggggactgcaggcctattcgcctggcacctggacactccagttgtgcggagtgcaggcggacgcctgtgtttcctaatgctcggaagcctcgccgcaggcagcggttcactttacggctttttcggagagccaacccgtcctgcctgtctgctgaggcaggccctgtttgccctgggctttacgatttttctcagttgcctgactgtgcgcagtttccagctaataataatttttaagttctccaccaaggtgcctacattctatcatgcctgggtgcagaatcacggtgcaggcctgttcgtgatgattagttcagccgcacaattactgatttgcctaacttggttggtggtctggaccccactgccagccagggagtaccagagattccctcacctggttatgctggaatgtactgaaactaactcacttggcttcatcttagcttttctgtacaatggacttctgtcaatctctgcgtttgcctgctcctacctgggcaaagacctgcctgaaaattacaacgaggctaagtgcgtcaccttttccctgctgtttaacttcgtgagttggatcgcattttttactaccgcaagtgtgtacgatgggaagtatctaccagctgccaatatgatggccggactatcttcactgagctcagggttcggtggctatttcctgcccaaatgttatgtcatattatgcaggcccgacctgaattctaccgagcactttcaggcatcaatccaagactatactcggagatgcggaagcacatag

SEQ ID NO: 243456 - DNA, 921 bp, Artificial Sequence
  Description of Artificial Sequence: Synthetic coding sequence
atgcgcctgggcgtcgaggagatcaacaactctactgccctcctgcctaacatcacgttaggctatcagctttacgacgtctgtagcgatagtgctaatgtctacgccactttgagggtcctgtccttgccaggccagcatcatatcgagctgcagggggatctgctgcactacagccctactgttctggcagtgattgggccagacagtactaaccgcgcagcaactaccgcggcactcctgtctccatttctggtcccgatgcttctggaacagatacacaaagtgcatttcctgctccacaaagatactgtcgcttttaacgataaccgcgatcctttatcatcttacaacataattgcctgggattggaacggccctaagtggacttttacagtccttggtagtagtacttggtctcccgtgcagctgaacataaacgagaccaagatccagtggcatggcaaagataaccaggtgccaaagagcgtgtgttctagcgactgtctcgaaggtcaccagagagtggttacagggttccaccactgttgctttgaatgtgtcccttgcggggcaggaacctttctgaacaagtccgatctttataggtgccaaccctgtgggaaggaagaatgggctccagagggcagtcagacatgctttccaagaacagtagtgttcctcgcactgagggaacatacaagctgggtcctgctggcagccaacacactgctcctgttattgctattaggaactgccggtctctttgcatggcacctggatacacccgtggtgaggagtgctggcggacgactgtgcttcctcatgcttgggagcttggccgctggtagcggaagcctgtatggcttttttggcgaaccatcgttgcctctcgtttccccaagttcgtgtccagcttag

SEQ ID NO: 243457 - DNA, 2520 bp, Artificial Sequence
  Description of Artificial Sequence: Synthetic coding sequence
atgggcccaagggctaaaactattagttcccttttcttcctgctgtgggtcctggcagagcccgctgaaaacagcgatttctatctaccgggtgattatctgttaggaggattgttttctttgcatgctaacatgaaaggtattgtacacctcaattttcttcaagttcctatgtgcaaagagtatgaggtgaaagtcatcggctacaatctgatgcaggctatgaggtttgcggttgaagaaataaacaacgattcttccctcctgcccggagtcctgctgggctacgaaattgtagacgtttgttatatctcgaacaacgtacagcctgtgctgtatttcttggcgcacgaggataatcttttgccaatccaggaagactactcaaattacatttcccgggtagttgcagtcataggacccgataattcagagagtgtcatgaccgtcgcaaacttcctcagtctatttctgctccctcagattacgtactctgcaatcagtgacgaactgagagacaaggtgagattccccgcacttttaaggacgactccttctgctgatcatcacattgaagcaatggtgcagcttatgctgcactttaggtggaactggatcatcgtattggtttcttccgatacatacgggcgagataacggtcagttgctgggagaacgggttgccaggagagacatctgtatcgctttccaggaaaccctgcccacgctccagcccaatcagaacatgacctcggaagaaagacagagactcgtaaccattgtagataaactgcagcagtcaacagccagggtggtcgtagtattttcgccggatctcacactgtaccatttctttaacgaagttctgaggcagaacttcaccggtgctgtttggatcgctagcgagtcctgggcaattgaccctgtgctccacaatcttacagaactgcggcacctgggtacgttccttgggatcacaattcagtcggtgccaataccgggattctcggagttccgtgagtgggggccacaagccggtcctccccctttatccaggacatctcagtcttatacctgcaaccaggagtgcgacaactgtctcaacgccactttaagtttcaacactatactgcggctgtccggtgaacgggtggtgtactcagtctattcggccgtttatgctgtagcacatgcactgcactcattgctgggctgtgacaagtccacttgtactaagcgggttgtttatccctggcaactgttggaagaaatctggaaagtcaacttcacactacttgatcatcagatcttctttgacccgcaaggtgacgtcgcccttcacctggaaattgttcaatggcagtgggataggtcccagaacccctttcagagcgtggcctcttattaccctctgcagcggcaactgaagaatatccaggatatttcatggcatacaatcaataataccatcccaatgtccatgtgcagcaagcggtgccagtccggtcagaagaaaaagccagttggaatccatgtgtgctgtttcgagtgtatcgactgcctcccaggaacgttccttaatcacacagaggacgaatatgagtgccaggcctgtcccaacaacgaatggagttatcaatccgagacgagctgttttaaaaggcagctggtctttttagagtggcatgaggccccaactatagccgtggccctgcttgccgcactcggtttcctgtccacactcgccatactcgttatcttctggcgacactttcagacacccatagtgcgatccgcagggggtcctatgtgttttcttatgctgacactgttactggtggcctatatggtggtccccgtgtacgtcggaccaccaaaggtcagcacatgtctgtgcaggcaggccctgttcccactatgcttcacaatttgcatcagctgcattgcagtccgaagtttccaaattgtctgcgcctttaagatggcctcaaggttcccaagagcctattcatattgggtgcgctaccagggcccttacgtgagtatggccttcattactgttctgaagatggtaatagtggtgatcggaatgctcgcgactggactaagccccaccaccaggaccgatccggacgaccccaaaatcaccattgtttcatgtaatcccaactatcgaaactccctgctcttcaacactagtttggatctgctgctctctgttgtgggtttctcattcgcctacatgggaaaggagctgcccacaaattataatgaggccaagttcatcacactgagcatgacattctattttacctcctccgttagtctctgcacctttatgtccgcctatagcggcgtgttggtcacgattgtagatctgctcgttactgtcctaaatctactcgccatttccctcggttattttggacctaagtgttacatgattttgttctacccagagcgcaacacgccagcgtatttcaatagcatgatacaggggtacactatgcgcagagactag

SEQ ID NO: 243458 - DNA, 2559 bp, Artificial Sequence
  Description of Artificial Sequence: Synthetic coding sequence
atgttaggccctgcagtgttaggtctctcactgtgggctctgcttcaccctggaacgggggctccactgtgcctgtcccaacaactccgaatgaagggagattacgtgttgggcggactatttccactgggtgaggccgaagaggcaggtctacgatcccggacaagaccctcgtctcccgtttgcactcgatttagtagcaacgggctgctgtgggcactggcaatgaaaatggccgtggaggaaatcaataacaagtctgacctccttccgggtctgcgactcggctatgacctgttcgacacctgctctgagcctgtcgtcgccatgaaacccagtctcatgtttctcgcgaaggcaggtagcagagatattgcagcctattgcaactatactcagtaccaaccgagagtgcttgctgtcatcggaccccactcgagcgaactggcgatggtgacaggcaagtttttctcatttttcttgatgccccaggttagttacggggcaagtatggagctgttgagcgctagagagacctttcctagcttttttagaacagtgccctcggaccgggtgcaactaactgccgctgcagagctgttgcaggagttcggttggaactgggtggcagcactgggatccgacgacgaatatggacgacaaggtctctccatcttcagcgctctggccgcagcgcgaggcatctgcatcgcccacgagggcttggtgccactgccccgagctgacgactccagattggggaaagtgcaggacgtactgcatcaggtgaatcagtcttcagtgcaggtggtactgcttttcgcgagtgttcacgcagctcatgccctatttaactacagcatcagctctcgcctgtccccaaaggtgtgggttgcgtctgaagcctggctgactagtgatttagtaatggggctccccggaatggcacagatggggacagtgctaggattcctgcagcggggtgcacagttacacgagtttcctcagtatgtgaagactcatttagccctggccacagaccccgctttctgctcggccctgggagaacgagaacagggccttgaggaagacgttgtggggcagcgctgcccccaatgtgactgtattaccttgcagaacgttagtgcaggactgaaccaccatcagaccttttctgtttacgctgctgtatacagcgtggcccaggcattgcacaacacactacagtgtaacgcaagcgggtgtccagctcaggaccccgttaaaccatggcaactcctggaaaacatgtataacctgaccttccacgtgggcggtctacccctaaggttcgattcctccggtaatgtcgacatggagtacgacctgaagttgtgggtctggcagggctccgttcctcgcttgcatgacgtaggcagatttaatggatccctgagaacagagcgtctcaagatcaggtggcacacctccgacaaccagaagcctgtgagcagatgttccagacagtgtcaagagggacaggttaggcgcgtcaaaggtttccactcttgttgctacgactgcgttgattgcgaggccggatcatataggcaaaatcctgacgacattgcgtgcactttctgtggccaggatgaatggtcacctgagcggtctacacgctgtttcaggcgcagatctaggtttctggcgtggggtgagcccgctgtacttctgctgctcctgttgttgtcactggccctgggtttggtgttggctgcattgggtttatttgttcatcaccgtgatagtccacttgtccaggcctccggcggtccactcgcatgcttcgggctggtctgtttgggtctggtatgtctctccgttttacttttccccggacagccctcacctgcaagatgcctcgctcagcagccactgagccacctgcctctgacaggatgtctatccacactctttctgcaagcagctgaaatattcgttgaatctgaacttcccctgtcctgggcagataggctctccggctgtttgaggggcccatgggcctggttagtggtgctattagcaatgctggttgaagttgctctatgcacatggtatctggtggcatttcccccagaggtcgtgacagattggcacatgctacctacagaggcacttgttcactgccgaacccggtcctgggtctctttcggtctggcccatgccacaaacgccacactagccttcctatgcttcctcggcacattcctagtccggtcacagccaggatgttataaccgcgctcggggactgacgtttgctatgctcgcttacttcataacgtgggtctctttcgttcccctgttggccaacgtgcaggttgttttgcgtcccgcagtccagatgggagctttactgctctgcgtgttaggtattcttgccgcatttcacctgcctcgatgttacctgcttatgaggcagcccggtctgaacacccctgagttcttcctagggggagggccaggtgatgcgcaagggcaaaatgacggcaacactggcaaccagggaaagcatgagtag

SEQ ID NO: 243459 - DNA, 876 bp, Artificial Sequence
  Description of Artificial Sequence: Synthetic coding sequence
atgatcccgatccagttgacagtctttttcatgatcatttacgtcttggaaagtctgaccataattgtgcagtctagcctgattgttgctgtgttgggcagggagtggctgcaggtgaggagacttatgccagtggacatgatcctgatatcactgggaatttcccgcttctgcctgcagtgggcgagtatgctaaacaatttctgctcatatttcaatctgaattacgttctatgcaacctcacgattacctgggaattctttaatattcttactttctggttaaactccctcctcaccgtgttttattgcataaaagtgtcaagtttcacccaccatattttcctgtggctgcggtggcgtatccttcgtctgttcccatggattctccttggcagccttatgatcacctgtgttactatcattccttctgcgatcgggaactatatacagatccaactcctcactatggaacacctaccaagaaactcaactgtgactgataagctcgaaaacttccaccagtaccagttccaggcacacacagtagctctagtcatccccttcatccttttcttagcatccaccatcttcctaatggcctctctgaccaagcaaatccaacaccattctacgggtcactgcaatcctagcatgaaagccagattcacagccctgcggtccctggctgtactatttattgttttcacctcctattttctcactatcctgataaccatcattggcacactgttcgataagcgctgttggctttgggtctgggaggcgttcgtttacgccttcattctcatgcacagcacatctctgatgctatccagccctacactcaaacgaatcctcaaaggaaagtgttag

SEQ ID NO: 243460 - DNA, 900 bp, Artificial Sequence
  Description of Artificial Sequence: Synthetic coding sequence
atgatgtgttttctgctcataatctcctctatcttggttgtatttgctttcgtcctggggaacgtggctaacgggtttatcgccttggtcaatgttatagactgggttaacacaagaaaaatttcttcggccgaacagattttaactgctcttgtcgtgtctcgtatcggtctgctgtgggtcatgctgttcttgtggtacgcgacggtttttaactccgccttgtacggtctggaagtgcgcatagtagcctctaacgcctgggctgtgacaaaccacttctccatgtggttagcggcttccctctcaatcttctgccttctcaaaatcgcaaacttctcaaatctgattagcctgcacctgaaaaagaggattaaatccgtcgttctcgtgatcctgctgggaccgctggtgtttctgatctgcaatctcgccgtgattacaatggatgaacgggtgtggaccaaggaatatgagggcaacgtgacgtggaagatcaaactccgaaacgcgatccatctgagttccctgacggtcacaacgcttgctaaccttatacccttcaccctttccttaatctgctttctcctacttatctgctctttgtgcaagcatctcaaaaagatgcggctacatagcaaagggagtcaggacccatctacaaaagtgcacatcaaggcacttcagacggtgacatcattcttgatgctgttcgctatctatttcctgtgcataatcacttccacctggaacctccggacccagcaaagcaagcttgtcttactcctctgtcagacggtggctatcatgtacccaagttttcactcattcatcctgatcatgggatcaagaaagctaaagcaaactttcctgtctgtcctgtggcaaatgacaagatag

SEQ ID NO: 243461 - DNA, 930 bp, Artificial Sequence
  Description of Artificial Sequence: Synthetic coding sequence
atgatgtctttcttacatattgtcttctccattctggttgtggtggccttcattctcggcaatttcgcaaatggatttatagctttgattaactttatcgcctgggtgaaacgccagaaaatttcttctgctgaccaaatcatcgccgctctggcagtcagtagggtaggcttgctctgggtgattttactccattggtactccaccgtgttgaaccctacttcatctaacctgaaggtgatcattttcatctcaaacgcctgggccgttaccaatcatttttctatatggctggccaccagcctgtccatcttttatctcctgaagatcgtgaacttttcgagattaatcttccaccacctcaaacggaaagccaaatccgtggttctggtaatcgtgctaggcagtttgttcttcctggtgtgccatctggtcatgaagcacacatatattaacgtctggacagaggaatgcgagggtaatgtcacctggaagatcaagcttcgcaatgccatgcatctctccaatctgacagtggcaatgctggcaaacctaatccctttcacattgacactcatttctttcctgctgctgatttactccctctgtaaacacctgaagaagatgcagcttcatggcaaagggtcacaagatccgagcacaaagatacacattaaagcactccagactgtgaccagcttcctcatcctgcttgccatctacttcctctgcctgatcatatctttctggaatttcaaaatgaggcccaaggaaattgtcctgatgctgtgccaggccttcggaataatctacccaagcttccatagttttattcttatttggggcaataaaactctcaagcaaacattcctcagcgttctttggcaagttacctgttgggctaaaggacagaaccagagcaccccttag

SEQ ID NO: 243462 - DNA, 951 bp, Artificial Sequence
  Description of Artificial Sequence: Synthetic coding sequence
atgatggggctgactgaaggggtgttcttgatcctgtccggcacacaatttaccctggggatactggttaactgtttcatcgaactggtaaacggcagcagttggtttaaaacaaagaggatgtctctctctgattttattatcaccacactggctttgttaaggatcatcctgctatgtattatcctgactgactccttcctaattgaatttagccctaatacccacgattccgggatcatcatgcaaatcatcgacgtgtcttggacattcacaaaccacctttcgatctggctggcgacttgcctaggggtgctctactgcctgaaaatcgccagttttagtcatcccacattcctgtggctgaagtggagagtaagccgagtgatggtatggatgctgctcggcgctctcctgttatcatgcgggtctactgcctctctgatcaacgagtttaaactctacagcgtgttccgcggaattgaagctactcgaaatgttacagagcacttcaggaaaaaacggtccgagtactatctaatacacgtgctgggcaccctgtggtacctgccccctcttattgtttccttggctagctactccctgctgattttctccctggggagacatacaagacagatgctccagaatggcacttccagcagagaccccacaacagaagcccataagcgggctataagaattatcttaagtttcttcttcctttttctgctgtactttttggcattcctaattgcttcgttcggaaacttccttcccaagacaaaaatggcgaagatgatcggggaagttatgacaatgttttaccctgcaggccattccttcatcctgatcttgggaaacagcaagctgaaacaaacctttgtcgtgatgttgcggtgcgaaagcggccaccttaaacccggtagtaaaggtcctattttcagctag

SEQ ID NO: 243463 - DNA, 960 bp, Artificial Sequence
  Description of Artificial Sequence: Synthetic coding sequence
atgatcaccttccttcctatcatcttctctatcctgatcgtagtaattttcgtgatcggtaactttgccaacgggttcatcgctttggtcaactccatcgaatgggttaaacgccagaagatttcttttgtcgaccagatcctaacagcactcgccgtgtcacgagtagggctgctgtgggtgttactgctccactggtatgcaacacaactgaatccagcattctactcggttgaggttcggataactgcatacaacgtatgggctgtgactaaccacttttcgtcttggttggctacatctctttccatgttctacctgctgcgcattgccaacttttccaatctgatcttccttagaatcaaacgcagagttaagtccgtggtcctcgtaatcctgttaggcccactgttgtttttggtgtgccatctatttgtgattaacatggacgagactgtttggaccaaagagtacgagggcaacgtgacctggaaaatcaagctgcggtcggctatgtaccactcaaatatgactcttaccatgcttgcgaacttcgtccctctgacccttaccctcatctcttttctcttactgatctgctccctttgcaagcatctcaaaaagatgcaactccatgggaaaggcagccaggacccaagcaccaaagttcacatcaaggccctgcagacagtcacctctttcctattattgtgcgccatttacttcctgagcatgatcatttccgtttgtaattttgggcgactggagaagcagccggtgtttatgttttgccaggctattatcttcagctatcccagtacccatcctttcatccttatcctgggcaataagaaattgaagcaaattttcctctctgtgctacgccatgtgcgctactgggtcaaggatcggagtctgcggctgcaccgctttacgcggggtgctctttgcgtgttctag

SEQ ID NO: 243464 - DNA, 930 bp, Artificial Sequence
  Description of Artificial Sequence: Synthetic coding sequence
atgactacatttataccgattattttcagttcagtcgtggttgtcttgttcgtaatcggtaatttcgcaaacggctttattgccctcgttaattctatcgagagggtgaagcggcagaaaatcagcttcgctgatcaaatattgactgctttagctgtatctagggtaggactcctatgggttctgctcctgaactggtactccacagtctttaatccagcgttctacagcgtggaggtaaggaccactgcgtacaatgtctgggctgtgaccggacacttcagtaactggctcgcaacctcgctctctattttttaccttctcaagatcgcaaatttctccaacttaatctttcttcatctgaagagaagggtaaagtctgtaatacttgtcatgctccttggtcctcttctatttcttgcctgtcagttattcgtgattaacatgaaggaaatagtaagaacaaaagaatatgaaggtaacctcacttggaaaattaagcttcgatccgcagtctatctgtctgatgccaccgtcaccacccttgggaatttagtacctttcacactgacactattgtgttttttgctgctgatttgctctctgtgtaaacacctgaagaagatgcaactccatgggaaaggtagccaggatccctctactaaggttcatatcaaagcactacaaacagtaattttctttctgctgctgtgtgcagtttatttcctgagcattatgatctcagtttggtccttcgggtcgttagaaaataagccagtcttcatgttctgtaaagccattcgcttctcgtatccatccatccatcccttcattcttatctggggaaacaagaagctcaagcaaacgttcctgtcagtgctcaggcaggtgaggtactgggttaagggcgagaagccctcaagcccctag

SEQ ID NO: 243465 - DNA, 1002 bp, Artificial Sequence
  Description of Artificial Sequence: Synthetic coding sequence
atgctgaccctgaccaggataaggacagtgtcctatgaagtgaggtccacctttctgtttatatcggtcctggaattcgctgtgggtttcctgacgaacgcatttgtcttcctggtcaacttctgggacgtggtcaaacggcaggccttaagcaattcagactgcgtccttctgtgcctgtcaatctcacgactttttctccatggactcctctttctgtctgccatccagttgactcatttccagaagcttagtgagcccctcaaccattcgtaccaggcgatcatcatgctgtggatgatcgcaaatcaggccaatctttggttggccgcttgcctgagccttctttattgcagcaaactgatcaggtttagccacacctttcttatttgtctggcaagttgggtgtcaagaaaaatatcccagatgctcttggggattatactgtgttcctgtatctgtaccgttctgtgcgtctggtgtttcttttcacggcctcatttcaccgtgactaccgtgttgtttatgaacaacaacaccaggcttaactggcagattaaggatttaaacctgttttatagttttttgttttgctacctgtggagtgttcccccattcctgctgttcctggtgtcttcgggcatgctgacggtgagtctcgggaggcacatgagaaccatgaaagtgtacacacggaacagccgcgacccctccctggaagcccacatcaaggcccttaagtccctcgtatcctttttctgcttttttgttatcagttcgtgcgctgccttcataagcgtgccactgttgatcctgtggagggacaagattggggttatggtatgtgtgggcataatggcggcatgcccctctggccatgccgcaatcctgatttctggcaacgcgaagttgcgcagagctgttatgacaatacttttgtgggcacagagttctttgaaagtgagagctgaccacaaagctgactcacggactctctgctag

SEQ ID NO: 243466 - DNA, 900 bp, Artificial Sequence
  Description of Artificial Sequence: Synthetic coding sequence
atgttgagacttttctacttctcggctattatcgcctccgttatccttaactttgtgggtatcatcatgaatctgttcattaccgtcgtgaattgcaaaacctgggtgaaatcacacagaatttcttccagtgatcgcatcctgtttagcctgggaatcacacggtttctgatgctgggcctctttttggttaacacaatttacttcgtgagctccaataccgagcggtcagtatatctgtccgctttctttgtcctgtgctttatgtttctggattcatcctccgtttggtttgtaaccctgctgaacatcctgtactgcgtgaagataaccaatttccagcattcagtgtttctgctgctgaaaagaaatatcagccctaagatccccaggctcttattggcctgcgtgctgatttccgcattcaccacctgtctttatatcacactatcacaggcttctccgttccctgagctggtcaccaccagaaacaacacaagcttcaacatatccgagggtatactgagcctcgtggtgtctttagtgttgagttcaagcctccaatttattattaatgtgacgagtgctagcctgctgatacattcattgcggaggcacatccagaagatgcagaagaatgcaacgggtttttggaatccacagacggaggctcatgtgggcgctatgaaactcatggtgtacttcctcatactttatatcccatactcagtggccacgctggtacagtatctgcccttttatgcgggaatggacatgggaactaagtctatctgcctgatctttgcaaccctgtactctcctggtcactcagtgctcatcattatcactcatcccaagctaaagaccaccgccaaaaagattctctgcttcaagaagtag

SEQ ID NO: 243467 - DNA, 972 bp, Artificial Sequence
  Description of Artificial Sequence: Synthetic coding sequence
atggctactgttaatacagatgcgacagacaaggatatttccaagttcaaggtgacctttaccctggttgtgtccggcattgagtgcattacaggtattttggggagtggctttattaccgctatttatggtgcagagtgggctagaggcaaaaccctcccaacaggcgatagaatcatgcttatgttgagcttttctcgactgttactgcaaatctggatgatgctggaaaacatcttttcgctgctttttagaattgtctataaccagaactcagtgtatattctgttcaaggtgataaccgtctttcttaaccattcgaatctgtggttcgctgcatggctcaaggtgttttattgcttaagaatcgccaactttaaccaccccctgttttttctgatgaaacgaaagatcattgtcctcatgccttggctattgcgtctgtctgtgcttgtttcactttctttttctttccctctatcaagagacgtgttcaatgtctatgttaactcatcaattcctattccttcatcgaacagtactgaaaagaagtatttcagtgagaccaatatggtgaatttggttttcttctacaacatgggcatttttgtgccactgataatgttcatcttagcggcaactctcctgatactgtccctaaaacgccataccttacacatgggttctaatgcaaccggcagccgcgatccttctatgaaggcacacattggcgcaataaaggcaacaagttacttcttgatcttgtacatcttcaatgccatcgcattattcctgtctaccagtaatattttcgatacctatagcagttggaacattttgtgcaagattattatggcggcataccccgctgggcacagtgtgcagctgatccttggcaaccccggactgcgaagggcctggaagagattccagcatcaggtgcctctctaccttaaggggcagacgctttag

SEQ ID NO: 243468 - DNA, 924 bp, Artificial Sequence
  Description of Artificial Sequence: Synthetic coding sequence
atgcaagctgccttgaccgccttttttgtcctgttgttctctctcctgagtctgctaggaattgccgctaacggctttatcgtattggttctggggagggagtggcttcgctacgggaggctgctccctctggacatgatcctgattagtcttggagccagtcgcttttgcctccagctcgttggtacagtacataatttctattactcagcccagaaagtcgagtacagcggtgggctgggccgtcagtttttccacctacactggcactttctgaatagtgccacattctggttttgcagttggctgtccgtgttgttttgcgttaaaatcgctaacattactcactcaacattcctatggctcaaatggcgcttccccggatgggtcccatggctgctgctgggatcagtactgatttccttcataatcacactgctgtttttctgggtcaactacccagtctaccaggaatttctaattagaaaattctcaggaaacatgacttataagtggaacacacgtatagagacatactatttcccctctctgaagctcgtcatatggagcattcccttctccgtcttcctggtgagtatcatgctactcatcaactctttgcgaaggcatacacagagaatgcaacataatggccattccctacaggatccctccactcaggctcacacccgtgccttaaaatctctcatttccttcttgatcttatatgcgcttagctttttgtccctaatcattgacgccgctaaatttatctccatgcaaaacgatttctattggccctggcagatcgcagtctacctctgtatcagcgttcatccgtttatcctgatctttagcaatctgaagctccggtcagtgttttcccaactgttgctgctggccagagggttttgggttgcctag

SEQ ID NO: 243469 - DNA, 945 bp, Artificial Sequence
  Description of Artificial Sequence: Synthetic coding sequence
atggcgaccgagcttgataagatcttcctgattctggccattgcagagttcatcatcagcatgctcggaaacgtgtttatcggcttggtgaattgtagcgagggcatcaagaaccagaaagtcttctccgccgactttatactcacttgtctcgcaatcagtaccattggccagctgttagttattctgtttgatagcttcctggttggattagcttctcatctctatacgacatacaggctcgggaagactgtaattatgctttggcacatgaccaatcacttgaccacatggctcgcgacatgtctgagcatcttttactttttcaagatagcccattttccccatagccttttcctctggctgcgttggcgcatgaacggtatgatcgtcatgctgctgatcctgtcgctatttcttctgatattcgactcactcgtgctggaaatcttcatcgatattagcctgaatattatcgataaaagtaatctgacactgtacctggatgaatctaagaccttatatgataagctgagtatcctcaagactctcttgtcactgacaagcttcatccctttcagcctgttcttgacttcactcctgttcctgttcttatcgctggtaaggcatacaaggaatcttaagttgtcttctctggggagccgagatagctcaacagaagctcaccgcagggccatgaaaatggttatgtcattcctgtttctgttcattgtccactttttttcccttcaagttgccaacgggattttcttcatgctgtggaataacaagtacatcaagttcgttatgctcgcgctgaacgcattcccctcctgccattctttcatactgattttaggaaatagtaaactgagacagaccgccgttaggctgctgtggcacctccggaattacactaaaactcccaatgccctgcccttgtag

SEQ ID NO: 243470 - DNA, 930 bp, Artificial Sequence
  Description of Artificial Sequence: Synthetic coding sequence
atgatcacctttttacctatcattttctcctcactggtagtcgttactttcgtgataggcaacttcgccaacggtttcattgcactggtgaatagtatcgagtggttcaaaaggcagaagatttccttcgcggaccagatcctgaccgccctcgctgtgtcgcgagtggggctgctgtgggtcctcttactaaactggtactctactgtgttgaatcccgctttcaatagcgtggaagttagaacaacagcatataacatttgggcggtgataaaccatttctcaaactggctggcgacgacactatcaattttctatctcctcaagattgctaatttttcgaattttatcttcctccatcttaaaaggcgggtgaagtccgtcatactagtgatgcttctggggccacttttattcctcgcctgtcacctttttgtgattaatatgaatgaaatcgtccgcactaaagagttcgagggtaatatgacctggaagattaaactgaagtctgcaatgtacttctccaacatgactgtcaccatggtagccaacctcgtacccttcacacttacacttctgagcttcatgctgctcatctgtagtctatgcaagcatctaaaaaagatgcagttgcacggtaaaggctctcaggacccaagcaccaaggtccatattaaggcactgcaaaccgtaatctccttcttactcctctgtgccatctacttcctcagcattatgatctctgtctggtcatttggttcactggagaacaagcccgtgtttatgttctgtaaagctattcgtttcagttatccgagcatccacccctttattctgatctggggtaacaaaaaactgaagcagacctttctctcggtgttttggcagatgcggtactgggtgaaaggcgagaaaacaagcagtccgtag

SEQ ID NO: 243471 - DNA, 930 bp, Artificial Sequence
  Description of Artificial Sequence: Synthetic coding sequence
atgatcactttccttcccatcatcttttccatcctcatcgtcgtgaccttcgttattggtaactttgcaaacgggttcatcgcccttgtgaattcaatcgagtggtttaagcggcaaaaaatctccttcgctgaccagatcctgacagctctcgcagtatctagagtcgggctgttatgggttctcgtcctgaattggtatgcaacagaattgaatcctgccttcaattcgatcgaggtccggattaccgcgtataatgtttgggccgttattaatcacttcagtaactggctggctactagtctttccatattttacttgctcaaaattgccaatttcagtaatttgatcttcttgcatctgaaacgacgcgtcaaatctgtagtgctggtaatcctactaggaccgctcctttttctggtttgtcacctgttcgtgataaatatgaaccagatcatatggactaaggaatatgagggaaacatgacctggaagataaagttgaggagcgccatgtatttgtcaaatacaacagtgacgatcctggcaaatctggtgccatttacgctgacactcataagctttctgctgctaatttgttccctttgcaagcacctgaaaaagatgcagctgcatggcaaaggatcacaggacccaagcatgaaggtccatataaaagccctgcaaacagtgacatctttcttactcttgtgtgctatttattttctgagtatcattatgtcagtatggtcgtttgaaagccttgaaaataagcccgttttcatgttctgcgaagccatcgctttcagctatcctagtacccatccctttatccttatctggggcaataagaaactgaagcaaacatttcttagcgtgctgtggcatgtgcggtactgggtcaagggagagaaaccatctagctcttag

SEQ ID NO: 243472 - DNA, 900 bp, Artificial Sequence
  Description of Artificial Sequence: Synthetic coding sequence
atgctcagcgcaggcctaggtttattaatgttggtggccgtagtggaatttctgattgggctcatcgggaacggatcactcgttgtatggagttttagagagtggatcagaaaattcaactggagcagttataatctgatcatcctgggcttggctggatgtcgttttctgctgcagtggctgattatcctcgatttgtctctattcccgttattccagtccagtcggtggcttcggtacctcagcatattctgggtgcttgtatcccaagctagcctgtggtttgcaacattcctgtccgtgttttattgcaagaagattacaaccttcgataggccagcctacctgtggctcaaacaaagagcctataacctttctctttggtgcctccttgggtactttataatcaatctcctgctcaccgtgcaaatcggcctgacgttttaccaccctcctcaggggaactcttctatacgctatcccttcgagtcttggcagtatctctatgccttccagctgaacagcggctcatatctgcctttagtggtgttcctcgtttcctctgggatgcttatcgtatctctttacactcaccacaagaagatgaaggttcatagtgcaggaagacgggatgtgagggctaaggcacacataacagcactcaaaagcttaggatgcttcctgcttctgcacctggtttacatcatggccagccctttttcaatcacatctaagacataccctcctgatctcacaagcgtgttcatctgggagaccctgatggctgcttacccgtcccttcattcgctcatactgataatgggcattcccagggtgaagcagacctgccagaagatcctttggaagaccgtatgtgctcgaagatgttggggtccatag

SEQ ID NO: 243473 - DNA, 900 bp, Artificial Sequence
  Description of Artificial Sequence: Synthetic coding sequence
atgatcacgttcctttatattttcttcagcatcttgatcatggtgctgttcgtgctaggcaactttgctaacgggttcattgctctggttaattttattgattgggttaagcgaaaaaagataagtagcgctgatcagattcttaccgcactggccgtctcccggattgggctcctctgggccctgctgctcaactggtacctcacagtgttgaatcccgcattttatagcgtcgagctccgcattacttcctataatgcctgggtagtgactaaccacttttctatgtggttggccgctaacctgagcattttttaccttctcaagatcgcgaatttctctaatcttctgtttctacatctaaagcggcgtgtcaggtcagtgatcctggtcatcttactgggaactcttattttccttgtgtgtcacctgttagttgccaatatggatgaatccatgtgggcggaagaatacgagggcaacatgacgggaaagatgaagctcagaaacacagtgcacctgagctatttgactgtgaccaccttatggtccttcattccttttacactgtcccttatctcttttcttatgctcatctgcagcctttgtaagcatctcaagaaaatgcagctccacggcgaaggctcccaagacctttctacaaaggtccacattaaggcactgcagactctcatctctttcctattactgtgtgcaattttttttttgttcctgattgtcagtgtgtggtcccccagacgactcaggaatgaccctgtggtgatggtgagcaaggccgtgggtaatatttacctcgccttcgactctttcatcctgatttggcgcactaagaaactaaaacacaccttcttgttgatactgtgccagattcgttgctag

SEQ ID NO: 243474 - DNA, 957 bp, Artificial Sequence
  Description of Artificial Sequence: Synthetic coding sequence
atgaacggggatcatatggtgcttgggagtagcgttacagataaaaaggcgattattctggtgacaatccttctactacttcggctggtcgccattgctggcaacggtttcatcacggctgccctaggagttgaatgggtgctgcgcaggatgttactaccatgcgacaagctgctcgtgtctcttggggctagccgcttctgtctgcagagtgtggtgatggggaaaactatttacgttttcctgcatcctatggcgttcccatataaccctgttttgcagttcctagccttccaatgggacttcctgaatgccgctaccttatggtcttccacttggctgagtgtgttctattgtgtcaagatagccacattcacccacccagtgttcttctggttaaagcataagctcagtgggtggctgccttggatgttgttttcatccgtaggcttgagcagcttcactacgatcctgtttttcatagggaaccaccgaatgtatcagaattacctccgcaatcacctccagccctggaacgttacaggcgactctatacggtcctattgcgaaaagttctacctgttcccgctgaagatgatcacctggactatgccgaccgctgttttcttcatctgcatgatacttcttataacatccctggggcgtcacaggaaaaaagccctgttgaccacgtcagggtttcgtgaacccagcgtgcaggcccacattaaggccctccttgctctgctgagttttgcaatgctatttatctcctacttcctgtcccttgtgttttctgcagcgggaatctttcctccactcgactttaaattctgggtctgggaaagcgttatctacctctgcgctgcggtgcacccgatcattcttctgtttagtaactgtaggttgagggcagtattgaaatctaggagatcaagtaggtgtggtacaccttag

SEQ ID NO: 243475 - DNA, 1314 bp, Artificial Sequence
  Description of Artificial Sequence: Synthetic coding sequence
atgcccaaattcaaggcagcacgtggggtcgggggtcaggaaaagcatgcaccgttggccgaccagatattagctggaaacgccgtcagggctggcgtgagagaaaagcgcaggggaaggggaacaggggaggcggaggaagagtacgtggggcctcgcttaagtcgtagaattctgcagcaggctcgacagcagcaggaagagcttgaagccgagcacggaacaggggataagcccgctgctccacgggagcgcaccacgaggctgggtcccaggatgccgcaggatggaagtgacgatgaggacgaagaatggcctacactggagaaagccgctaccatgaccgccgcaggccatcatgcagaggtcgtggtggatcctgaggacgagagagcgatcgaaatgtttatgaacaaaaatccaccagccagaaggaccttggctgatatcattatggagaaattgacagagaagcagactgaggtcgagaccgtgatgtctgaagtttctggctttccaatgcctcaactcgaccccagggtgttggaagtttaccggggagtgcgagaggtgttgagtaaatataggtcaggtaagctcccaaaggcatttaaaatcatcccagctttatctaattgggaacagatcctctatgtgaccgaaccagaagcttggacagcggcagccatgtaccaggccacaaggatatttgctagcaatctgaaggaaagaatggcccagaggttctacaatttggtcttattgccaagagttagggatgatgtggccgagtataaaagactaaacttccacctttacatggccctcaaaaaggccctattcaagccaggagcctggtttaaggggattctaatccccctgtgcgagagcggcacctgcacactaagggaggccatcatagtgggctctattatcactaagtgttcaatcccggtcctccattcctcggctgccatgctgaaaatagccgagatggaatacagtggcgcaaactcaatcttcctccgtctactgttggataagaagtacgccctgccatatagagtcctggacgccctggtgtttcacttcctgggctttcgaacagagaagcgggagctgccagtcctgtggcatcaatgtcttctgacactcgtgcagagatataaagctgacttggccaccgatcaaaaagaagcgctgctggagctactcaggttgcagccacacccccagctttccccagaaatccgccgagagctgcagtcagctgtaccacgtgatgtagaagatgtgcctatcactgtcgagtag

SEQ ID NO: 243476 - DNA, 951 bp, Artificial Sequence
  Description of Artificial Sequence: Synthetic coding sequence
atggatcagaacaatagcttgccaccatatgcacaaggattagcttctccacaaggcgcaatgacccccggaatcccgatttttagcccaatgatgccctacgggactgggctcacaccacagccaattcaaaacacaaactctctcagcattctcgaagaacaacagcgccagcagcaacagcagcagcagcagcagcagcaacaacagcagcaagccgtagccgcagccgctgtgcaacagagtacctcacaacaggctacacagggcacttccggccaggcaccccaactgttccatagccagacccttaccacagctcccctgccaggtaccacacctctgtacccatctcccatgacgccgatgactccgataactcccgctacccctgcatctgagagctcaggaatcgtcccccagctccaaaatatcgtgtccacggtcaaccttggctgtaaactggatcttaagacaatagccctgagagccaggaacgcagaatacaaccctaagcggttcgcagccgtcatcatgaggatccgcgagcccaggacaacagctttaatctttagttccggtaagatggtttgtacaggggcaaagtctgaagaacaaagtcgtctggctgccagaaagtacgccagagtcgtgcagaagctgggtttcccggcaaaatttctggatttcaagatccaaaatatggtcggctcctgcgacgttaaatttcccatccgcctagagggtctggtcttgactcaccagcagtttagctcctatgagccagagttattcccaggcctaatctacaggatgatcaagcctaggatcgtgcttttgatttttgtgagtggtaaggtagtgctcacaggcgctaaggtgagagccgagatctacgaggccttcgagaacatctatccaattcttaaaggtttccgcaagacaacctag

SEQ ID NO: 243477 - DNA, 1020 bp, Artificial Sequence
  Description of Artificial Sequence: Synthetic coding sequence
atggatcaaaacaacagtttaccaccatatgcccaaggactggccagcccgcagggcgctatgacacccggaatccctatcttcagtcccatgatgccctatggcaccgggctgacgccacaacctatccaaaataccaatagtttatccatcctggaggaacaacagcgccagcagcagcagcagcagcagcagcaacagcagcagcagcagcaacagcagcagcagcagcagcaacagcagcagcagcagcaacagcaacagcagcagcagcagcaacagcaggcagtggccgcagcggcagttcaacaatcgactagtcagcaagccacccagggtactagcggacaggcccctcagctctttcactcgcaaaccctgactaccgctcctcttcccggaaccacgcccctctaccccagcccgatgacgccgatgacgcctataacaccggctacccctgcctcagaatcctcaggaatcgtgccacaactccagaacatcgtttcaactgttaacctcggttgtaagttggatctcaagacaattgctttacgagctcgtaacgccgaatataatcctaaaaggttcgcagctgtcatcatgagaatccgggaaccacggaccactgcactgattttctccagtggtaagatggtgtgcaccggcgcaaagagcgaagagcagtcccgccttgccgctaggaagtacgcccgagtggtgcagaagctcggttttcctgcaaaatttctggattttaagatacagaacatggtgggctcgtgtgacgtgaagttccctattcgcttagaggggctggtactgactcatcagcagttttcctcgtacgagcccgagctgttccctgggctcatttatcgcatgatcaaacccaggatcgtgctcttgatattcgtctcaggtaaagtagtcctcaccggggctaaggtccgtgcagaaatctatgaagcgttcgaaaacatatacccaatccttaaagggtttaggaaaaccacatag

SEQ ID NO: 243478 - DNA, 627 bp, Artificial Sequence
  Description of Artificial Sequence: Synthetic coding sequence
atggatcagaacaatagcctgcccccttatgcccagggcttggcgtctccccaaggtgctatgacaccaggcatccctattttcagcccaatgatgccttatggtacagggctgaccccccagccgatccaaaacaccaactctctgagtattttggaggagcagcaacgacagcagcagcagcagcaacaacagcagcagcaacagcaacagcaacagcagcagcaacagcaacagcaacagcagcagcaacagcagcagcaacaacagcagcagcagcagcaagctgttgccgcagccgcagtgcagcaatcaacaagccagcaggccacccaagggacatcaggtcaagctcctcagctctttcactctcagaccctgaccaccgcacccctgcccggtaccacacctttgtacccttcaccgatgacacctatgacccctataaccccagctaccccagccagcgagtcaagcggcattgttcctcagcttcagaacatcgtttcgacagtgaacctaggctgtaaactggatctgaagaccatcgcccttagggcacgcaacgcagaatacaatcctaagcggtttgcggcagtgatcatgaggatacgagagccacggtag

SEQ ID NO: 243479 - DNA, 456 bp, Artificial Sequence
  Description of Artificial Sequence: Synthetic coding sequence
atggatcaaaacaactctctccctccctatgcgcaagggttggcttctccacagggagcaatgaccccgggaatccccatttttagcccgatgatgccatacggaaccggcttgacgcctcaacccattcaaaatactaactcgttatccatcttggaggagcagcagcgacagcaacagcaacagcaacaacagcagcaacaacagcaacagcagcaacagcagcagcagcagcagcaacagcagcagcaacagcagcagcagcagcagcagcagcagcaacaggccgtggcggctgccgcagtgcagcaaagcacaagccaacaggccacgcagggcacttccggccaggccccacagctctttcattctcaaacgttaacgactgctcctctgccgggaactacacccctgtatccaagtcccatgacgccaatgacacccattacaccctag

SEQ ID NO: 243480 - DNA, 306 bp, Artificial Sequence
  Description of Artificial Sequence: Synthetic coding sequence
taagaggagcagtcgagactggcagccagaaagtacgctcgagtggttcagaaactgggtttcccagcgaagtttctagactttaaaatacagaatatggtaggctcctgtgacgtgaagttcccaatcagttatgagcctgagttgtttcccggtttaatttataggatgattaaacctcgtattgtcctgcttatctttgtgagcggcaaggtcgtgctgactggcgcaaaggtgcgagccgagatctacgaagccttcgaaaacatttaccctatactaaaaggtttccgcaaaacaacatag

SEQ ID NO: 243481 - DNA, 960 bp, Artificial Sequence
  Description of Artificial Sequence: Synthetic coding sequence
atgaccccaggcatccctattttctccccaatgatgccatatggcacgggtctgactccacagcctatccaaaatacaaatagcctttcaattctcgaagaacaacaaaggcagcagcagcaacagcagcagcagcagcagcagcagcaacagcagcagcagcagcagcaacagcaacaacaacagcagcagcaacagcagcagcaacagcagcaacaacaacaggcggtggcagccgctgccgtccagcagtctaccagccagcaagcaacacagggtacaagcgggcaggctcctcagctttttcatagtcagaccctgaccaccgctccacttcccggtaccacccccttatacccgagcccaatgacccccatgaccccaattactcctgctacccctgcaagcgaatcatcaggcattgttccgcagttgcagaacatagtttcaactgtaaatcttggttgcaagctggatctaaagacaatcgctctccgggctaggaatgcagagtacaaccccaaaaggtttgctgcagtcattatgcggatccgcgaaccgagaactacggcactgatattctctagtggaaagatggtgtgtaccggggcaaagtccgaggaacagagcaggctggccgctagaaaatacgcacgcgtggtccagaagttaggcttccctgccaagtttctcgacttcaaaatccagaatatggtggggtcctgtgatgtcaagttccctatccgccttgaaggtctagtgctcacgcatcagcaattctcctcatacgaaccggagctctttcccggtctgatttaccggatgatcaaaccacggatcgtcctcttgatctttgtgtccgggaaagtggttctgaccggtgccaaagtacgtgcagagatttacgaagcttttgaaaacatctatcctatcctcaaaggcttccggaagaccacatag

SEQ ID NO: 243482 - DNA, 2610 bp, Artificial Sequence
  Description of Artificial Sequence: Synthetic coding sequence
atggatttccctagttcactgcggccagcattgttcctgactggcccacttggcctgtctgatgttccggacctgagcttcatgtgtagttggcgcgatgctctgaccctgcccgaagcccaacctcagaactccgaaaatggtgcactccatgtgacaaaagacctcctgtgggagcctgcgacaccgggtccactccccatgctgcctcctctgatcgatccctgggatcctggactgaccgctcgggatctcctgtttcgtggcggatgccgctacaggaagagacccagagtcgtgttggatgtaacagagcaaatcagtcgctttctgttggaccacggtgatgtagccttcgctccattgggaaaactgatgctcgagaatttcaagcttgagggtgctgggtcccggactaagaagaaaacagttgttagcgtcaagaagctgttgcaggatctcggaggccatcagccctggggctgtccttgggcttacctttcaaaccgccagcgtcgcttttcaattctgggaggacccatcctgggaacatctgttgcatcacacctcgctgagttgctccacgaagagcttgtactaagatgggagcagcttttacttgatgaggcctgtacagggggtgccctcgcttgggttccaggcaggacgccgcagttcggtcagctcgtgtaccctgccggtggtgcccaagatagactccactttcaggaggtcgtcctgactcccggagacaaccctcagtttctgggaaaacctggcagaatccagttgcaaggtccagttaggcaggtggtaacatgcaccgtccaaggtgagtcaaaggcactgatttatacttttctcccacactggctgacatgttacctcacacccggtccatttcatccgagttctgctttgctggcagttaggtcggattaccactgtgccgtctggaagtttggcaagcagtggcagccaactctcttacaagccatgcaggtggagaagggcgctaccgggattagcctcagccctcatctgccaggtgagctggctatttgctcccggtccggcgcagtctgtctttggtcccccgaagatggattacggcaaatttaccgggatcccgagacgctggtctttagagatagctcctcctggaggtgggccgactttacggcgcatccccgagtgcttacggtgggcgatcgcaccggggtaaaaatgctggatacgcagggcccacccggatgtgggctcctgttatttaggttgggcgcagaggcatcctgccagaagggagagcgggttctgctaacccagtacctcggccattcaagccctaagtgtttacctccaacactacatcttgtgtgcacacagttttcactctatctggtggacgaacgcttacccttggtgcctatgcttaagtggaaccatggacttccctctcccctcctgttggccagactcctccccccaccacgcccttcctgtgtccaaccactcctactcgggggtcagggaggccaactgcagttgttgcatctggcaggcgagggagccagtgtacctcgactcgcgggacccccacagagcctcccctctagaattgacagtttacccgctttccctcttttggagcctaagattcagtggcgtctgcaggagaggctaaaggcgcctaccattgggctggccgcagtggtgcctccattgccaagtgcgcctacccccggactggtattgttccaactgtccgctgccggtgacgtattctaccagcagctgagaccacaagtggattctagtctccggcgagacgccggaccacctggagatactcaacctgactgccacgcgccaacagcatcatggacaagccaggatactgccggatgcagccagtggctgaaggccttactgaaagttcccctagcacctcccgtgtggactgcacctacatttacccaccggcagatgctcggctccacagagttgcgccgtgaagaggaggaaggtcagaggttaggcgtgttacgaaaagctatggcccgaggacagctcctgttacagcgagatctgggctcactgccagctgccgaaccacctccagctcccgaatcgggattggaagataagcttagcgagcgcctaggcgaggcctgggcgggacggggtgccgcatggtgggaacgccagcaggggcgaacatctgagcctggcagacagacaagacgtcccaaacgtagaacacaattatcctctagcttctctctctctgggcacgtggatccgtccgaagataccagcagcccccactcccccgagtggcctcccgctgacgctctgcccctgccgccaactaccccccctagtcaggagctgaccccagatgcttgtgcccagggcgtgccgtctgaacagcggcaaatgctgcgagactatatggccaaacttcctccgcaaagggacacccccggatgtgccactacccctccgcactctcaggcttcaagcgtccgggcaactagaagccagcagcatacacctgtgctatcgtcctcccagcctctgagaaagaagccccgaatgggattttag

SEQ ID NO: 243483 - DNA, 1353 bp, Artificial Sequence
  Description of Artificial Sequence: Synthetic coding sequence
atgtccgacttttccgaggagttgaaaggaccagtgactgatgacgaagaggtggagacttccgtgttgtccggagcaggaatgcactttccttggctgcagacctacgtggaaacggtggccatcggaggcaagcgccgtaaggactttgcccagaccacgtcggcctgcttgagttttatccaggaggccctgctcaagcaccaatggcagcaggccgctgagtacatgtacagctacttccagacactcgaagatagcgattcatataaacgccaggctgccccagagattatatggaaactcgggagcgaaatcctgttttaccacccaaaaagtaacatggaaagttttaatacatttgctaatcggatgaaaaacatcggcgtaatgaattacctgaaaatttctctgcaacacgccctgtatctcctgcatcatggtatgctcaaggacgcgaagaggaacctgagtgaagccgagacttggcgccatggagaaaatacgagttctagagagatcctcatcaacctgattcaagcctacaagggtttgctgcagtactacacctggtctgagaagaagatggaattgtccaagcttgacaaggatgactacgcctacaacgccgtggcccaagacgtcttcaatcattcttggaagacatcagccaatatcagcgctctcattaagatccccggtgtgtgggacccctttgtaaagtcctatgtggagatgctggaattttacggcgatcgagatggcgcacaggaagtccttaccaattacgcttatgatgaaaagtttccctctaaccccaatgcacacatctacctgtacaatttcctgaagcgccagaaggcacccagaagtaaacttatctccgtactcaaaatcctctatcagatagtcccctcacataagcttatgttggagtttcacactctgctgagaaaatccgagaaagaagagcatcgtaagctcgggctagaagtgctattcggcgtactggatttcgctgggtgcacaaagaatatcacagcctggaagtatcttgccaagtacctgaaaaatatcctgatgggaaaccatttggcatgggtgcaggaggaatggaactcccggaaaaactggtggcccggatttcatttctcatacttttgggccaagtccgattggaaagaggataccgcactggcctgcgagaaagcctttgtggccggacttctgctgggcaaaggatgcagatatttccgatacattctcaaacaagaccaccagatccttggaaagaagatcaaaaggatgaaaaggtctgtcaaaaagtactccatcgttaatccccgattatag

SEQ ID NO: 243484 - DNA, 1353 bp, Artificial Sequence
  Description of Artificial Sequence: Synthetic coding sequence
atgtcagacttctcggaggaactgaaagggccagtaacagacgatgaggaagtagaaacctccgtgctctcaggcgcaggaatgcacttcccttggctacagacatacgtggaaacagtggccattggagggaaacgcagaaaggatttcgcccagactacatcggcttgccttagttttatacaggaggcactgttaaagcatcaatggcagcaggccgctgagtacatgtactcttatttccaaacgcttgaggactccgactcctataagcggcaggccgcacccgagatcatttggaaactcgggtctgaaatactgttctaccatcccaagtctaacatggaatcgtttaacacttttgccaaccgaatgaaaaacataggagtgatgaattatcttaagatctccctccagcatgcactgtatctcctgcaccatggcatgctgaaagacgcgaagaggaacttatctgaagcggagacctggcgccatggcgagaataccagttcacgtgaaatccttatcaaccttatccaagcttataagggcctgctgcaatactatacatggagcgaaaaaaaaatggaactgagcaaactggataaggacgactacgcctacaatgcagtcgcgcaggacgtcttcaaccacagctggaaaactagcgcaaatatctcagccctcattaaaattccaggagtgtgggatccgttcgtgaagtcctatgtggagatgctggagttctatggtgaccgggacggtgcccaagaagtccttactaactatgcgtatgatgagaaatttccatctaatccgaacgcccacatctacctctataactttctgaaacgccagaaggcgccacggagcaaactgattagcgttctgaaaatcctgtaccagatcgtgccgagtcataagctaatgctggagttccacactctccttaggaagagcgagaaagaagagcacaggaagttgggtcttgaagtgctttttggcgttctagacttcgccggatgtacaaagaacatcacggcctggaaatacctcgccaagtatctgaagaacatcctcatggggaaccatctcgcctgggttcaggaagagtggaacagcaggaagaattggtggccgggattccacttttcctacttttgggccaagtcagactggaaggaggacaccgcactggcctgtgagaaagctttcgtcgctggcctgctcctaggtaagggatgtcgctacttcaggtacatccttaaacaggatcatcagatcttaggtaagaagattaaacggatgaaacgaagcgtcaaaaagtacagcatcgtcaatcctagactatag

SEQ ID NO: 243485 - DNA, 1011 bp, Artificial Sequence
  Description of Artificial Sequence: Synthetic coding sequence
atggagtcattcaatacatttgccaaccgtatgaagaatatcggcgttatgaattacctcaagatatcattgcagcacgctctgtacctcctccaccatgggatgttaaaagatgcaaagagaaatttgtctgaagccgagacttggaggcacggggagaatacttcgtctcgagagattctcatcaatctgatccaagcatacaagggcttactgcagtactacacttggtcagagaagaagatggagctctcgaagctggataaggacgactacgcctataatgccgtagcccaagatgtgtttaatcatagctggaagacaagcgccaatatctctgcactgatcaagatcccgggagtttgggatccatttgttaagtcttatgttgaaatgcttgagttttacggtgatagagacggtgctcaggaagttctcactaactacgcctacgatgagaagtttccttccaatcctaacgcccacatttatctgtacaatttcctgaagcgccagaaggccccaagatcaaaactgatatctgtcctgaagatactctatcagattgtgccgagccacaagctgatgctggagtttcacacattgcttagaaaaagcgagaaggaggaacatcgtaaacttggactggaagtcctgtttggcgtgctggatttcgccggatgcactaaaaacatcactgcatggaaatatcttgctaagtacctcaagaatatcctaatgggaaatcacctggcctgggtgcaggaagagtggaactctcggaaaaattggtggcctgggttccacttcagctatttctgggccaaaagtgactggaaggaggacacagctctggcctgcgagaaggcctttgtagcaggcctcctcctaggcaaagggtgtcgctatttccgctatattctgaagcaggatcaccagatactcggaaagaaaatcaaacgaatgaagagatcggtcaagaagtactccatcgtgaaccctaggctttag

SEQ ID NO: 243486 - DNA, 1011 bp, Artificial Sequence
  Description of Artificial Sequence: Synthetic coding sequence
atggagtccttcaacacattcgctaacaggatgaagaatattggggtgatgaactatttgaaaatttctctccagcatgccctgtacctgcttcatcatggaatgctcaaggacgcaaagcgcaacctgtccgaagcggaaacctggagacacggcgagaatactagttctcgcgagatcctaattaacctgatacaggcttacaaaggactcctccaatattacacctggtctgagaaaaaaatggagctctccaagttagataaagacgactacgcatacaacgctgtggctcaagacgtgttcaaccactcctggaaaacttctgccaacataagcgccctaattaaaattccgggagtctgggacccattcgttaaatcttatgtggaaatgctcgaattttatggggatcgggacggcgcacaggaggtccttactaattacgcatatgatgagaaatttccctccaacccaaacgcccatatctatctctataatttcctaaaaagacagaaagcccctcgtagtaagctcattagcgtgcttaagatcttgtatcagattgtcccctcacacaaactaatgttggaatttcataccttactgcgcaaatctgagaaagaggaacaccgaaagctcggtctggaagtactgttcggcgtgcttgacttcgcgggatgtaccaagaacattacggcgtggaagtaccttgccaagtacctgaaaaacatcttgatgggaaaccatctagcatgggtgcaagaggaatggaattccaggaaaaactggtggccaggctttcacttctcttacttttgggccaaaagcgattggaaggaagacactgcgctggcatgcgaaaaagcctttgtggccggactcctgctcggcaagggatgtcgctacttcaggtatatcttgaagcaggaccaccagatcctgggaaaaaagatcaaaagaatgaaacggagtgttaaaaagtacagtattgttaatccgcgtttgtag

SEQ ID NO: 243487 - DNA, 861 bp, Artificial Sequence
  Description of Artificial Sequence: Synthetic coding sequence
atgtctgatttctctgaagagctgaaaggcccagtcactgacgacgaggaggtggagacttcggtgctgtctggcgctggaatgcactttccatggctgcagacctacgttgaaacagtcgctataggcggtaagaggcgaaaggatttcgctcagacgaccagcgcatgcttgagtttcatccaggaagccctactgaaacatcagtggcaacaggcagctgagtatatgtattcttattttcaaacgctggaggactccgatagttacaaacgacaggcagccccagaaatttctctacaacatgctctctaccttctgcaccacggcatgctcaaagacgccaaaagaaatcttagcgaagctgagacgtggcggcacggcgaaaatacaagctcccgagagattctgatcaatttaatacaggcctacaagggcttgctccaatattacacatggagtgagaagaaaatggagctctccaagttggataaagacgactatgcctacaacgctgtcgcacaagacgtgttcaatcactcttggaaaaccagtgccaatatcagtgccctgattaaaataccgggagtgtgggaccctttcgtgaagagttatgtcgagatgttggaattttacggagaccgtgacggagcacaggaggtgctgaccaactatgcttacgatgaaaaattcccctcaaatcccaatgcacacatatatctgtacaatttcctgaaacggcagaaagccccaagatccaagctgatttccgttttgaaaatcctgtaccagatcgttccatcccacaaactgatgctcgagttccatactctcctgcgaaagagtgaaaaggaagaatag

SEQ ID NO: 243488 - DNA, 849 bp, Artificial Sequence
  Description of Artificial Sequence: Synthetic coding sequence
atgagtgacttcagcgaggagctcaagggccctgtgaccgatgacgaggaagtcgagaccagcgtattaagcggggctggcatgcacttcccctggctgcagacctatgtcgaaacagtggccatcgggggtaagagaagaaaagattttgctcaaaccacatctgcctgcttgtcttttatacaggaggccctacttaagcatcaatggcagcaggccgcagagtatatgtattcttattttcaaacgttggaggactcagactcatacaaacgacaggctgcccctgagatcagcctacagcacgccttgtatcttcttcatcatggaatgctgaaagatgccaagcgcaacctgtcagaggccgagacgtggaggcacggtgagaacacctccagccgagagatattgattaacttaatccaagcatataaaggcctgttgcaatactacacatggtcggagaaaaaaatggaactgtctaaattggacaaggatgattacgcttacaatgctgttgcccaggatgtttttaaccattcttggaaaacatccgcgaacattagcgcccttattaaaatccccggagtgtgggaccccttcgtgaagagctatgttgagatgctcgagttctatggcgatagggacggggctcaggaagttttaaccaactatgcatacgacgagaaattccccagtaaccctaacgctcatatttatttatataactttcttaagcgacagaaagcccctcgcagtaagcttatcagcgtgctcaagattctctaccagattgtacctagtcataagctcatgctcgaattccatacactgctacgcaagagctag

SEQ ID NO: 243489 - DNA, 936 bp, Artificial Sequence
  Description of Artificial Sequence: Synthetic coding sequence
atgtccgatttctctgaagagcttaaaggtcctgtcacagatgacgaagaggttgaaactagcgtgttgtccggggctggcatgcactttccctggctgcagacgtacgtggaaaccgtggcaataggtggtaagcgccgaaaagatttcgcccagacgacctctgcgtgcttatcattcatccaggaagctcttctcaaacatcagtggcagcaggctgcggaatatatgtacagctattttcagacgcttgaagactccgactcgtataaacgccaagccgcacctgagatcatatggaagctgggatccgagatcttgttctatcaccccaagagcaacatggagtcttttaatactttcgcaaatcggatgaagaatatcggggtgatgaactatcttaaaatttcgctgcagcatgctctgtatctgctgcaccacggaatgctgaaggacgcgaaaagaaatctttccgaagccgagacatggcggcatggcgagaatacatcctctcgcgaaatccttattaaccttattcaagcttataaaggattgcttcagtactatacatggagcgagaagaagatggaactgagtaagctggacaaagacgattatgcctacaatgctgtagcacaggatgtgttcaatcattcctggaagacatctgctaatattagcgcactcattaagattcccggagtctgggaccccttcgtcaagtcttatgtagagatgcttgaattttatggtgacagggacggtgcacaggaagtcctcacaaactacgcctacgatgagaagttcccatccaacccaaacgcacacatttacctatataactttctgaagagacagaaggcaccacgaagcaaactgatctctgttctcaagcaccttcaaaaaatctctatcatgtattccacattaaggtag

SEQ ID NO: 243490 - DNA, 2328 bp, Artificial Sequence
  Description of Artificial Sequence: Synthetic coding sequence
atgctgcccccactgatcgacccctgggatcccggactgaccgcacgggatctgctgtttagaggcggatgccgttaccgaaagcgccctagagtggttctggatgtgacggagcaaatctctcggttcctgctagaccacggtgacgtcgcgttcgcccctctcggaaagctcatgcttgaaaattttaagctagagggggctggctccaggacaaaaaagaaaaccgtggtgtctgtaaaaaagttgctgcaggatctcggaggacaccaaccatgggggtgcccttgggcatacctgagtaatagacaaaggagatttagcatcttggggggacctattctgggtacatctgtggcctcacacctcgccgagcttctgcacgaagagctcgttctgcggtgggagcagctgttactcgacgaagcatgcacgggcggtgccttagcttgggttcccggtagaaccccccagttcgggcagctagtgtatccagctggaggtgcccaggaccgcctgcactttcaggaagtcgtcctgacacccggagataacccacaatttctcggtaaacccggaagaatccagttacaaggtcccgtcagacaggtagtaacatgcactgtccagggagagactcttctggctgtacgaagtgactaccactgtgccgtatggaaattcgggaagcagtggcagcctactctactgcaagcaatgcaggttgagaaaggtgctacaggaatttctctgagtccccatcttcccggtgaacttgccatctgctcccggtctggcgcagtttgcctgtggtcacctgaagacggactgcggcaaatttatcgcgaccccgaaaccttggtcttccgtgacagctcatcatggcgctgggccgattttaccgctcatccacgcgtcctcaccgtaggcgaccgtaccggtgtcaaaatgttagacacgcagggccctccgggatgtggactgcttttgtttcggcttggcgcagaagcctcttgccagaaaggtgagcgagtgctcctgacacagtatttaggacattcttccccgaagtgcctcccaccgacacttcacctggtgtgcacacagttcagtttgtatctggtcgacgagcgactgcctctggtgccaatgctaaaatggaaccacgggttgccctccccgttactcctagctcgtctgctacctccgccaaggccctcttgcgtgcagcctctcctgttggggggacaagggggtcaattacagctgctccacctggcagagggggcatcagtaccccgattggctggacctccgcagtctctacctagcaggatcgatagtctgccggcttttccccttctcgagcccaagattcagtggagactgcaggagcgattaaaggcacccaccattggcctggcggcagtggtgcccccattgcctagcgcacccacccccggtcttgttctctttcagctctctgcagcaggagacgttttctatcagcagctgcgaccccaagtggatagctcattacgacgcgatgcaggccctccgggtgacacccaacccgattgccacgcacctaccgcaagttggacttcccaggataccgccggttgttctcagtggctgaaggccttgcttaaggtgccgctcgcacccccagtgtggaccgcccctaccttcacgcataggcagatgttgggctctaccgagcttcgccgagaggaggaagagggacagcgcctcggcgtgcttcggaaagccatggcacgcggacaattactcctgcagagggatctggggtcactcccagcagcagagccaccacccgctcccgagagcgggctggaagacaagctgagtgagcgtttgggcgaagcttgggccggtcgcggagccgcttggtgggaacgacaacagggcagaacctctgaacctggacggcagacacggagaccaaagagacggactcagctgtcctcatcatttagtctgagcggacatgtggatccatctgaggacacttcttcccctcactccccagaatggccacctgcggacgccctcccgctgccccctaccaccccaccgtctcaggagttaacccctgacgcttgtgcacagggggtgcctagtgagcaaaggcagatgctgagagactacatggcaaaactgcctccccaaagggatacaccaggctgtgcaaccacaccaccacacagccaggcttcatccgtgcgggctactcggtcacagcagcatacacctgtcctgagctcaagtcagcctctcaggaagaagcccagaatgggcttctag

SEQ ID NO: 243491 - DNA, 2610 bp, Artificial Sequence
  Description of Artificial Sequence: Synthetic coding sequence
atggatttcccctcatccctgcgacccgctctgttcttgaccggccctctgggcctgtccgatgttcctgacctgagcttcatgtgtagctggagagacgcactgacactaccagaggcccagcctcaaaattccgagaatggcgctcttcatgttacaaaggacctgctgtgggagcctgctaccccaggccctctgccaatgctacccccattgatagatccatgggatccgggactgacagcaagggacctgttattcaggggaggctgcaggtatagaaaacggccaagagtcgtgctcgatgtcactgagcagatttcccgtttcctgctggaccatggggacgtggcctttgcacccttaggcaaacttatgctcgagaattttaaattggaaggagcagggtcgaggactaagaagaaaacagtggttagtgtcaagaaattactgcaggacctgggaggccaccaaccctgggggtgtccatgggcgtatctgagtaaccgccaacggaggttcagcatcctggggggacccattctcggcacctccgtcgcttcccatctggcggagctgctgcacgaagagttggtgctgcgctgggaacaactgttgctcgatgaagcctgcaccgggggagcactggcctgggtcccgggtcgcaccccgcagtttgggcagctggtttaccctgcgggaggagcccaggaccgcctccactttcaggaggtggtcttgactcctggtgataacccacagtttctgggaaaacctgggagaattcagctgcaggggccagtgcgccaggtcgtgacttgcaccgttcagggggagtcaaaagctcttatctatacttttcttccccactggctgacttgctatttaaccccaggaccgtttcacccctcctccgcgctgttggcagtaaggagtgactatcattgtgccgtgtggaaatttggcaaacaatggcaacccacacttttacaggcaatgcaggtcgaaaaaggagcaaccggcatttctttgtcccctcatttaccaggggaactggccatttgctcaagatctggagccgtgtgcctctggagccctgaagacgggttgcgtcagatctaccgcgaccctgaaacactggtcttccgagactcttcctcttggcgctgggcggattttactgcgcaccctagagtccttactgtcggtgatagaaccggtgtcaagatgctcgacacacaggggccaccaggatgcgggttgctgctcttcaggcttggcgctgaggctagctgccaaaaaggcgagagggtcctgctaacccagtaccttggccattcttcaccgaagtgccttccacccactttacacctggtctgcacacagttttctctttatctggtggatgagagactcccactggtccccatgctaaagtggaaccatggcctgccgtcaccactgttgttggccaggctcttacctcctcctcgaccttcctgcgtgcagcctctgctgctggggggacaggggggtcagctgcaactcctgcatttagccggtgaaggggcttcagtcccacgactagctggacctcctcagagcttgccaagtagaattgacagccttccagctttcccccttcttgaacccaaaatccagtggagactacaggaacggctgaaagccccaactattggtttggcagccgtggtgccacctctgccaagcgcaccaacccccggtttggtgctctttcagctgagtgccgctggcgatgtgttctaccagcagctgcgcccacaggtggacagcagccttagaagggacgccggaccaccaggtgacacccagccagattgtcatgcccctaccgcttcctggactagccaggatacagccggttgttctcagtggcttaaagccttgctgaaagttccactggcgcctccagtctggactgccccaaccttcacgcatcggcagatgttggggtccacagaactccgccgagaggaggaggagggccagaggctgggagtcctcagaaaagccatggcacgaggtcaactcctgctacagagggacttgggatctctacccgctgctgaaccgcctcctgccccagagtccggtttggaggataagctgtctgagcgactcggtgaggcgtgggccggtcgtggcgcagcctggtgggagaggcagcagggcagaacctctgagcccggtaggcagacccgaaggcccaaaagacgtacacagctgtcctcttctttcagcctgtcaggacatgtggacccctcagaagatacgtcaagcccacacagtcccgaatggcccccagcggacgcactgcccttaccgccaacgacacctccctcgcaggagctgaccccagacgcctgcgcccagggcgtgccctccgagcagcgccaaatgctaagggactacatggctaaacttccaccccagagggacacaccgggatgcgccaccaccccgcctcactcacaggcctcgtcagtgagggcaacaaggtcacagcaacatactccagtcctgagcagctcccagccactgcggaagaaacccagaatgggattctag

SEQ ID NO: 243492 - DNA, 1047 bp, Artificial Sequence
  Description of Artificial Sequence: Synthetic coding sequence
atggatttcccctcgagcttgcggcctgccctgttcctcacgggacccctcggccttagcgacgtgcctgacttatccttcatgtgtagctggcgagacgcactgaccctcccagaagctcagcctcagaattctgagaacggtgccctgcacgtcaccaaggatctgctctgggaacctgctaccccgggacccttgcccatgctcccccctcttattgatccctgggaccctgggctgacagcgagagatctgctatttagaggaggctgcaggtatcgcaagaggccacgcgtagttcttgatgtgaccgagcaaatcagccgctttctgctggatcacggggatgtcgccttcgcccctctcgggaaactcatgcttgaaaatttcaaactagagggcgctggatcacggactaaaaagaaaacagtcgtgtccgttaagaagctgctgcaagaccttggaggtcaccagccctgggggtgtccatgggcttacctgagtaatcgccaacggagattttctattttgggtggccctatactcggtacatcggtggcctcccatctagcagaacttctgcacgaggagcttgttctccggtgggagcagttactcctggacgaagcctgcaccggcggagctctggcttgggtgcctgggagaaccccacagtttggccaacttgtgtatcctgcgggaggtgctcaggataggctgcacttccaggaagtggtgctaacccccggagacaatccacagttcctgggcaaacccggaagaatccaattgcagggaccagtgaggcaggtggtgacttgtacagttcagggcgaaactttgctggctgtcagatctgactaccattgcgccgtttggaagtttggaaaacagtggcagccaaccctgctccaagcgatgcaggtggagaaaggggcaaccgggatcagtctctctccccatctgcccggtgaattggctatctgtagtagatccggggcagtgtgcctgtggagtcctgaggatgggtaccgccgttttctgtag

SEQ ID NO: 243493 - DNA, 2331 bp, Artificial Sequence
  Description of Artificial Sequence: Synthetic coding sequence
atgctgccacctctgatcgatccctgggatcccggtctgactgccagggatctgctcttccggggtggatgtcgttaccggaaacgtcctagggttgtcctggacgtgacagagcagatttcacgttttctactcgatcatggcgacgtggctttcgccccactgggtaaactgatgctcgagaatttcaagttagagggggcaggctctcggaccaaaaagaaaacggttgtttcggtaaaaaagcttcttcaggacctgggcggacaccagccctggggctgtccatgggcctacctctccaacagacagcggagattttcaatactggggggaccaatcctgggcacaagcgtggcctctcatttggccgagctgctgcacgaggagttggtgctcagatgggaacagctacttctcgacgaagcctgcaccggaggtgcccttgcctgggtgccagggaggacgccgcagttcggacagctggtttacccagctggtggggcacaggatcgcttgcattttcaagaagtcgttctcacacctggggataacccccagttcctgggaaaacccggtcggatacagttacaaggacctgttcgacaagtggtgacctgtactgttcagggcgagacgctactcgccgtaagaagtgactaccattgcgccgtgtggaagtttggcaagcaatggcaacctaccctgctgcaggctatgcaggttgaaaaaggggctactggcatttcgctgtctccccatctgcctggagagctggcaatctgcagtaggtctggggcagtgtgcctctggtccccggaagacggattgcgccagatctatcgggacccagaaaccttggtatttagggacagcagctcttggaggtgggcggacttcacagctcaccctagagtgctgactgtcggcgatcggactggcgtgaagatgcttgatacccagggacctcctggctgcggcctcctgctctttcgcctcggagctgaagcgtcgtgccagaaaggtgagagagtcctgttgacccagtacttgggacacagttcccccaaatgtctgcccccaacactgcatctggtctgcacacaattttcgctatatttggtggacgagaggctccccctagtgccaatgttgaaatggaatcatggcctaccctcacctcttttgctcgccagactgttaccaccaccccgaccctcgtgtgtccaacccctgttgctcggagggcagggcggacagctccagcttctgcacctggctggtgagggagcaagtgtgccacgcctagcaggccctcctcagagtctgccttctcgcatcgactctctgccagcattccctctgctggaacctaagatccagtggcgcttgcaagagcgtcttaaggccccaactatcgggcttgctgcagtggtgcccccactgccctcagcccctacaccgggtcttgtccttttccagcttagtgccgctggagacgtgttctatcaacagcttcgcccacaggtagactctagcctaagacgggatgccggtccccctggagacacacagccggactgtcacgccccaacagccagctggaccagtcaggatacagctggctgtagtcagtggctgaaggcattattgaaggtccccttagcccctcccgtgtggaccgcccctacctttacgcaccggcagatgctcggttcaaccgaactgagacgcgaggaagaggagggtcagcgcctgggcgttcttaggaaagccatggctcgaggtcaactcttgctgcagagagatcttggcagccttcctgcagccgagccaccgccagcacccgaatctggactggaagacaagttatccgaaagactaggtgaagcgtgggccggaaggggcgcagcctggtgggaaaggcagcaggggaggacttccgaaccagggagacagacacgaaggccaaagcgcagaacacagctctcaagtagcttttcactgtctggtcacgtggatccaagtgaggacacctctagcccgcatagtccagaatggccacccgcagacgcccttcccttacctccgactacgcccccatctcaggagttgacaccagatgcgtgtgcccaaggcgtaccttctgaacagaggcagatgcttagggactatatggctaagctgccaccacagagggacacccctgggtgcgcgaccactccccctcactcgcaggcttcaagtgtacgcgctacgcggtcccaacagcacactccagtgttgtctagcagccagccgttgaggaaaaaacctagaatgggattttag

SEQ ID NO: 243494 - DNA, 1179 bp, Artificial Sequence
  Description of Artificial Sequence: Synthetic coding sequence
atgctgaagtggaaccacggcttaccttcacctctgctactggcgcgtttgctgcccccaccgagaccaagttgtgtgcagccactattgttaggaggccagggcggacaacttcagctgttacatctggccgagggcgcatcagttcctcgcctggcgggtccacctcagtcacttccaagtaggattgattcactgcctgcattccctttgctcgagccaaaaatccagtggcggttgcaggagcggctcaaagcacccacaattggactggccgctgtggttcccccactccctagcgcacctacgcctggacttgttttgtttcagctcagtgccgctggagatgtcttctatcagcagctgcggccacaggttgattcttccctccgcagggacgccggtcctcccggagacacgcaacctgattgtcacgcccctacagcctcttggacatcccaggatacagccggatgctcccaatggttgaaggccctcctgaaggtgccgttggccccaccggtgtggaccgctcccacattcacccatagacagatgctgggttctacggagcttcgcagagaggaggaggagggccagaggttaggggtgttgaggaaggcaatggccagagggcaactgctcctccagagggatcttggctctctacccgcagccgaacctccaccggcacccgaatctgggctcgaggacaaactgagcgagagactgggcgaggcttgggcaggacggggtgccgcttggtgggaaagacagcagggcaggactagcgagcccggacggcaaactagaaggcctaaaagacgaacccagctgtcatccagctttagcctttccggtcatgtggatccttccgaggatactagcagcccccatagccctgagtggccgccagctgatgccctgcccctgccaccaaccacccccccttctcaagagctcactcctgatgcctgcgcacaaggcgtgccaagtgaacagaggcagatgcttcgggattacatggctaaattgcctcctcaacgagatacgcctggctgcgccaccacgccgcctcactctcaggcttcttcagtaagagccacgagatcgcagcagcataccccagtactatcatcctctcagccactacgtaagaaaccacgtatgggtttctag

SEQ ID NO: 243495 - DNA, 837 bp, Artificial Sequence
  Description of Artificial Sequence: Synthetic coding sequence
atggacaagtccgggattgacagcctggaccacgtgactagcgacgccgtggaattggctaatcgttccgataatagcagcgattcttccctgtttaaaacccagtgcattccatactccccaaagggcgagaaaagaaaccccattcgcaaattcgtccgaactcccgagagtgtccacgcatctgactcaagttctgacagcagtttcgagcctatacctctgactatcaaagcaatattcgagagattcaagaatcgtaaaaagcgatataaaaaaaaaaagaagaggagatatcagcccacaggtcgcccaagggggagacctgaagggcgtcggaacccaatttacagcctaattgataagaagaaacaattccgctccagggggtctgggtttcccttccttgagagcgagaacgagaagaacgcaccgtggaggaagatcctcacatttgaacaggccgtggccagggggtttttcaattacatcgagaaattgaaatatgaacatcacctcaaggagtcactgaaacaaatgaacgtgggagaggatctggagaacgaggactttgactctcgtcggtataaattcctcgacgatgatggttcaatctctcctatagaagagagcacagcggaggatgaggacgcaactcacttggaggacaatgaatgcgatatcaaactcgctggggattcctttatcgttagcagtgagtttcctgttagattgtccgtatacctggaagaggaggatatcaccgaagaagctgcactgtctaagaaaagagcaacaaaagctaaaaacaccgggcagcggggactcaagatgtag

SEQ ID NO: 243496 - DNA, 837 bp, Artificial Sequence
  Description of Artificial Sequence: Synthetic coding sequence
atggataaatctgggatcgatagcctggatcatgtgacaagcgatgctgttgaattggccaataggtctgataatagcagcgacagttctctattcaagactcagtgtatcccgtacagcccgaagggcgagaaaagaaaccccatccggaagtttgttcgcacacctgaatccgtgcacgctagcgatagcagctcagactcctccttcgaacctattccactcaccatcaaagccatcttcgaacggtttaaaaaccgtaagaaaaggtataaaaagaagaagaagaggcggtatcagcctactggcagaccgagaggtagacctgaagggcgaagaaatcctatatattcactcattgataagaagaaacagttcagatctagaggttctggatttccttttctagagagtgaaaacgagaagaatgccccatggcgaaagatcttgacgtttgaacaagcggtagcccgtgggttcttcaactatatagaaaagctgaagtacgaacaccacttgaaggagtctctgaaacagatgaatgtgggtgaggatctggagaacgaagactttgactcaagacggtacaagtttttggacgacgacggaagtataagtcctatcgaagagagcaccgccgaagatgaggacgctacacaccttgaggacaacgagtgtgacataaaactggccggagatagctttattgtgtcctctgagttccccgtccggctttcagtttacctcgaggaggaggatataaccgaggaggccgctctgtccaaaaagcgcgcaacaaaagccaaaaacaccggtcagcgaggcctgaagatgtag

SEQ ID NO: 243497 - DNA, 837 bp, Artificial Sequence
  Description of Artificial Sequence: Synthetic coding sequence
atggacaagagcgggatagatagtctggaccacgtaacatcagacgctgtagagctcgctaaccgatccgataactcttcagactctagcctcttcaagacccaatgtatcccttattctccgaaaggggagaaacgcaacccaatccgaaaatttgtgcgcacgcccgaatctgttcacgcatctgattccagctccgattcctcctttgaaccaattccattaacgatcaaagccattttcgaaaggttcaagaaccggaagaagcggtataagaaaaagaagaaaagacgctatcaacctacagggaggccacgcggtagaccggagggtcgacgtaaccctatctactcccttatcgacaaaaagaagcaattcaggtcccggggaagcgggttcccatttcttgaatctgagaatgaaaaaaacgccccttggaggaagatattgacttttgaacaggccgttgcgcgtggtttttttaactacattgaaaagctcaaatacgagcaccatcttaaggagtccctgaaacagatgaacgttggggaagatctggagaacgaggatttcgacagccgaagatacaagttcttggacgacgacggtagtataagtcctatcgaagaatctacagccgaggatgaggatgcaacacatctcgaggataacgagtgcgatattaagctggcaggcgattccttcatcgtatctagcgagtttcctgtccggctctctgtttacctcgaggaggaggatatcactgaggaagcggcattaagcaagaaaagagctacaaaggccaagaataccggtcaaagaggcctgaagatgtag

SEQ ID NO: 243498 - DNA, 27 bp, Artificial Sequence
  Description of Artificial Sequence: Synthetic coding sequence
atggacaaatccggaatcgattcctag

SEQ ID NO: 243499 - DNA, 3030 bp, Artificial Sequence
  Description of Artificial Sequence: Synthetic coding sequence
atgagctggtttaatgccagccagctcagctcattcgcaaagcaggcactaagccaggcccagaaatccatcgatagagttcttgatatccaggaggaggagccatccatctgggccgagaccatcccctacggtgagcccggaatctctagccccgtgtctggaggttgggatacatcaacctgggggttgaaatctaacactgaaccacagtctcccccaattgcctcacctaaagccattacaaaacccgtgcgtcgtactgtcgtagacgaatccgagaactttttcagtgctttcttgagccccaccgtctccctgaaggtgagcgagagcgttatcgatgtaaagaccactatggaatctatatcaaacacatctactcaaagtttgaccgcggagacaaaggatatagctctcgaaccaaaagagcagaaacacgaagacagacagtccaacacaccaagtcccccagtaagcacattttcaagcggaacatcgacaacaagtgatatagaagtgcttgatcacgagtccgttattagtgagtcctccgccagctctcgccaggagactacagattctaagtcttccctccatctcatgcaaacctcatttcagcttttaagcgcctccgcctgtccagagtacaaccggctggacgatttccagaaactgacggaaagctgctgttccagcgacgctttcgagcgcatagattccttttctgtacaaagcctcgattcgagaagtgtgtccgagatcaacagcgacgatgaattgtccggtaaagggtatgcgctcgtgccaatcatcgtgaacagtagcacaccgaagagtaagaccgtggaaagcgccgaagggaagtctgaggaggtgaacgaaactcttgtcatccctacggaagaagctgaaatggaagagtcaggaaggtcagccactccagtgaactgtgaacagcccgacatactggtgagcagcacccccattaatgaaggacaaacagttcttgataaggtggcagagcagtgtgagcccgctgagtctcaacccgaggccctttctgaaaaggaggatgtctgtaaagtgactctaaccgtcgaatttctgaatgaaaaattagagaagcgggaagctcagttgttatccctttccaaagagaaagcattactcgaagaggctttcgataatctaaaagacgaaatgttcagagtgaaagaggaatcttcaagcatcagcagtttgaaggacgaattcacacagcgcattgccgaggcagagaagaaggtacagcttgcatgtaaggaaagggacgcagcaaagaaggaaatcaaaaacattaaggaagaattggctacccgtctgaactcatcagagactgccgacctgctgaaagaaaaggacgaacaaattagaggcttaatggaggaaggagagaaactgtcaaagcagcagctgcataattcaaatatcatcaagaaattgcgggctaaggacaaggaaaacgaaaacatggtggccaaattgaataagaaggttaaggaattggaggaagaattgcagcatctgaagcaggtgctggatggcaaagaggaggtcgaaaagcaacacagagagaatattaaaaagctgaactctatggtagaacggcaggagaaggacctgggacgattgcaagttgacatggatgagcttgaagaaaagaatcgatccattcaggccgcactcgactcagcatacaaagagcttactgatcttcacaaggccaacgctgccaaagacagcgaggcacaggaagcagcactcagccgggagatgaaggcaaaagaggaattgtccgccgcactggagaaggcccaagaagaggctcggcagcagcaggaaacactggccatccaggtcggagacctgcgcttggccctgcaacggaccgaacaggcggcagcccgaaaggaggattatctccggcacgaaattggcgaattacagcagcgactgcaggaagcggagaaccgaaaccaagaactgagccagtctgtctctagcactaccaggcccctgctccggcagattgaaaatctgcaggccactctggggagccagacgagctcttgggaaaaactggagaaaaatttgtcagataggctgggtgagtcccagactctattggctgctgctgtggagcgcgaacgcgctgcaacagaggagctcctcgcgaataaaatccagatgtccagtatggaaagccagaactccctcctgaggcaggagaacagcagattccaagcccagctcgagtctgaaaagaatcgcctctgcaaactggaggacgagaataatcgctatcaagtggaactggagaacctgaaggatgagtatgtgagaacactggaggaaactcggaaggagaaaacactgctaaactcacagctggagatggaaagaatgaaggtggagcaggaacggaagaaagccatcttcactcaggaaacgatcaaagaaaaagagcggaaaccattctctgttagttctactccaacaatgtctagatctagctcgatcagtggggtggatatggctggactgcaaacctcatttttgtctcaggacgaatcccatgatcatagctttgggcctatgcctatctccgctaacggcagcaacctctacgacgccgtgcggatgggggctggctcgagtatcatcgaaaatctccaaagtcagttaaaactgcgcgaaggtgagatcacccacttgcagctggagattggaaacctcgaaaagactcggtcaataatggccgaggagctggtgaaactcacgaaccagaacgatgaactcgaagagaaagtgaaagagattcctaagttacggacccagttgagagatctagatcagagatataacacgatcctacagatgtatggagagaaggcggaggaggctgaagaactgcgactagatttggaggatgtgaagaacatgtacaagacccagatcgacgagctcctgcggcagagtctctcatag

SEQ ID NO: 243500 - DNA, 3282 bp, Artificial Sequence
  Description of Artificial Sequence: Synthetic coding sequence
atgagctggttcaatgcttcccaacttagcagtttcgccaaacaggccctgagccaggcccaaaagtccattgacagggtcctggacatccaggaggaggagccttccatctgggccgagactatcccatatggcgagcccggaataagttctcctgtctctggcggttgggacacctccacttgggggctgaaatccaacacagagccccagtccccccctattgctagccccaaggcaataacgaagccagtgcgaagaacggtggttgacgagtccgagaattttttcagcgcttttttatcacccaccgatgttcaaactatccagaaatccccagtggtcagcaaacctccagcaaagtcacagagacctgaggaggaggtgaaaagtagtttgcatgagtctttgcatattggccaaagtcgcaccccagagaccacagaatcccaggtgaaagattcctctctgtgcgtgtcaggcgagaccctggctgctggcacatcctctcccaaaaccgagggcaagcatgaggagacggtgaataaagagagcgacatgaaggttcctacagtgtcccttaaagtcagcgagagcgtgattgatgtcaaaaccaccatggagtccatctcaaatacatccacccaatctctcaccgctgagacaaaggacattgccttggaacctaaagagcaaaagcatgaggatagacaatccaatactccctcacctccggtatctacttttagcagtggtacctcaactacatctgatatagaggtgctcgaccacgagtccgtaatttccgaaagcagtgctagctcccgccaagagacgactgattctaagtcatcacttcacctcatgcaaactagtttccaactcttatcggcttctgcgtgtccggaatacaatcgcctcgatgatttccaaaaactgactgagagttgttgttccagcgatgcattcgaacgtattgattccttttctgtacaaagcctggattcaagatccgtgtctgagatcaattctgacgacgaactgagcggtaagggatacgctcttgtccctattatcgtaaattctagtactcccaagagtaaaaccgtggaatcagcggaaggtaagtccgaggaggttaatgaaacactagtgatccctacagaggaagcagaaatggaagagagtggcaggtctgctacgcctgtcaattgcgaacagccagacattctggtgagcagcacaccaataaacgaaggccagacagtcctagataaggttgctgaacagtgtgaacccgcagaatcccagcccgaagccctgtcagagaaagaggatgtctgtaaaaccgtagaatttctcaatgagaaattggagaaacgagaagcccagctgttgagcctgtccaaagagaaagcccttctcgaggaagcatttgacaatctcaaagatgagatgttccgcgttaaggaggaaagtagttcgatcagttcattaaaggatgaattcacccagcggatcgcagaagcagagaaaaaggtgcagctggcatgtaaggagagagacgccgctaaaaaggaaattaaaaatataaaggaggagctcgcgaccagactcaactcctctgaaacagccgacctcctcaaagagaaggatgagcagatcaggggcctgatggaggagggcgagaaactctccaagcagcagctgcataattccaatattatcaaaaaactgagagcaaaggacaaagagaatgaaaacatggtggcgaaactgaacaagaaggttaaagaactagaagaagaactccagcatcttaaacaggtacttgacgggaaggaggaggtggaaaagcagcacagggaaaatatcaaaaaattgaatagcatggttgagaggcaagaaaaggacctcggcagactgcaagtggacatggatgaactggaggagaagaaccgcagcattcaagcagcattggactccgcctataaggagctgaccgatttgcataaagctaacgccgctaaagattcagaggcccaggaggcagccttaagccgggagatgaaagctaaagaggagctgtctgccgcactggaaaaagcgcaggaagaagcaagacagcagcaggaaacactcgccatccaggttggcgacctgaggctggccttacagcgaactgaacaggcagccgctaggaaagaagactaccttcgacacgagataggggagttgcagcagagattgcaggaggctgaaaatcgcaaccaggaattatctcaatcagtctccagtaccacccgccctctcttgcgccagatcgaaaacctacaggccacgctcgggtcgcagacttcctcctgggagaagctggaaaagaacctgagtgaccgacttggtgagtctcagacccttttagcagccgcagttgagcgagaaagagccgctacagaagagcttctggctaacaagatacagatgtcttccatggagagccaaaatagtctgttaagacaagagaacagcagattccaggctcagcttgaaagcgagaaaaatcgactatgtaagctggaggatgagaacaacagataccaagttgagttggaaaatctgaaagacgaatacgtaagaacactagaagagactaggaaggagaaaaccttactgaatagtcaactggagatggagcggatgaaggtggagcaggaacgaaagaaagccatctttacccaggagaccattaaagaaaaagagagaaaaccattcagcgtctcatctactcctacgatgtctaggagctcaagtatctcaggcgtggatatggccggacttcagacgtcctttctgtcccaggacgagtcccacgaccactcctttggacctatgcccatcagtgccaatgggagcaatctgtacgatgccgtcagaatgggcgcaggttccagtattatagaaaaccttcagtcacagctcaaactgcgagagggcgaaattacccacctccagctggagattggaaacctggagaagactagatccatcatggccgaagaactggttaagctgacaaatcagaatgatgaactggaagagaaggtgaaagagatccctaaacttaggacgcagcttcgagaccttgatcagcggtacaacaccattctccaaatgtacggcgaaaaagctgaggaagcagaagaattacgtcttgacttggaagacgtgaaaaatatgtataaaactcagatagacgagctgttgcgccaaagtctttcatag

SEQ ID NO: 243501 - DNA, 1602 bp, Artificial Sequence
  Description of Artificial Sequence: Synthetic coding sequence
atgagctggttcaacgcgtctcagttgtcatctttcgcaaagcaggctttatcacaagcccagaaatcaatcgatcgggtcttagacatccaggaggaggaacctagcatatgggccgaaaccataccctatggggagcctggaatcagtagcccagtgtcagggggatgggacacaagtacatggggactgaaaagcaatacagagccccagtcccccccaatcgcctcaccgaaggcaatcaccaaacccgttcggcgaaccgtcgtggacgaatcagagaattttttctctgccttcctttcccctacggatgtgcagacaatccagaagagtcctgtggtctcaaagccgccagccaaatcacaacgtccagaggaggaggtgaaaagctccctgcatgaatctctgcatatcggacagtcacgtacaccagagaccactgaatcacaggttaaagattctagcctctgtgtctccggggaaacacttgccgctggcacctccagcccgaaaacagaagggaagcatgaggagacggtcaataaagagtcagacatgaaggtgcctactgttagcctgaaggttagcgagagtgtcatcgatgttaagacaactatggagtcaattagcaacacctctactcagagcctcactgctgagaccaaggatattgcgctcgagcctaaggagcagaaacacgaagaccggcaatctaacacaccttcaccacccgtcagtaccttcagttccggcacatcaactacctcagacattgaggtgctggatcacgagtctgtgatcagcgagtccagcgcttcttcccgccaggagactacggactcaaagtcttcacttcacttgatgcagacttcattccagttattgagcgcttccgcttgtcccgagtataaccgactcgatgacttccagaaactcaccgaatcttgctgtagctccgacgcctttgagcgcatagactcattctcagtgcaaagcttggattctaggtccgtcagcgagataaatagtgacgacgagctgtctggcaaaggctacgcactggtgcctataatcgtgaacagcagcacccccaagagcaagactgtcgagagtgctgagggtaagtcagaagaggtgaacgaaaccctggtgatccctaccgaagaggctgaaatggaggaaagtggacggtccgcaacccccgtgaactgcgagcagccggacatcctcgtgtcctctacccccattaacgagggacagaccgtattggacaaggtggccgaacagtgtgagccagccgagagccagcctgaggctctttctgagaaggaagacgtgtgtaagactgtggaattcctaaatgaaaagcttgaaaaaagggaagcacagctgctttccctgtcaaaagagaaggctttgctggaagaagcattcgacaacctcaaggacgagatgttcagggttaaagaggaatccagctccatctcttctcttaaggatgagttcacccagcgcatcgccgaggctgaaaaaaaggtccaactagcctgcaaggagcgggacgccgctaaaaaggaggtgaagagaaaaaagaggtag

SEQ ID NO: 243502 - DNA, 3291 bp, Artificial Sequence
  Description of Artificial Sequence: Synthetic coding sequence
atgtcctggttcaacgcgagtcagttgtcctctttcgccaagcaggccctgtcccaggcccagaagtctatcgatagggttctcgacattcaggaggaggaacctagtatttgggcagaaactattccgtatggcgagccaggcatctccagccccgtcagtgggggatgggatacatctacatggggtctgaaaagcaatacagagccacagtctccacccatcgctagtccaaaagctatcaccaaacctgttcggagaaccgttgtggacgagagcgagaactttttctccgcgttcttaagcccaacagatgttcaaaccatccagaaaagccctgtagtatccaagccaccagcgaagagccagaggcccgaagaagaagttaagtctagcctgcacgaatctcttcacatcggacagagccgcacacctgagactactgagtctcaggtaaaagattcctctctctgcgtgtccggagaaactttggcagctggcacatccagccctaagaccgagggcaagcacgaagaaactgttaacaaggaaagcgatatgaaagtaccaaccgtgtctctaaaagtgagcgagtcagtaatcgatgtgaaaacaacaatggaaagcatcagtaatacaagtacgcaatcactgactgccgaaaccaaggacatagctttggagcctaaagaacagaagcatgaagataggcaaagtaacacgccatcacctcccgtgtctacattcagttctggcacttccacaacatcagatatcgaggtgctggatcacgagtctgtgatctcagaaagctccgcatcaagcagacaggaaaccaccgacagtaagagttccctccacctaatgcagacatcctttcagctgctctccgccagtgcatgccccgagtacaaccggctggatgattttcaaaagctgacggaaagctgctgttcgtctgatgcatttgagaggatagatagcttttctgtgcagtcacttgacagccgcagcgtgtccgagatcaacagtgacgatgaactcagcggaaaggggtacgcgttagtgccaattattgtgaactcgtctaccccaaagtctaaaactgtcgagtctgctgaaggcaagtccgaggaggtgaatgagaccttagtgattcccacggaggaagccgagatggaggagtccggtaggtcagccacaccagtaaactgcgagcagccagacatactggtgtcctcaaccccgatcaacgaaggccagactgtattagacaaagtggcagaacaatgcgagcctgcagagtcacagcctgaggcgttatccgagaaagaagacgtctgcaaagttactctaaccgtagagttcctgaacgagaaactcgagaagagagaggctcagctcctcagcctgtcgaaggagaaggcgctactggaggaggctttcgacaacctcaaggatgagatgttcagagtgaaggaagagtcgtcatctatttcttcgctcaaagacgaatttacacagagaatcgctgaggcagagaagaaggtgcagcttgcttgcaaggaacgcgacgccgctaagaaggagattaagaacatcaaagaagagctggctactcgactcaactcttccgaaacagcggatctgctcaaagagaaggatgaacagatacgcggattgatggaggagggcgaaaaactctccaaacagcaactgcacaacagcaatattatcaagaagctgagagccaaagataaagaaaatgaaaacatggtcgcaaagctgaataagaaggtgaaggaattagaggaggaattgcaacatctcaagcaggtcctggatggaaaagaggaagtagagaaacagcatcgcgaaaacattaagaagctcaactccatggtggagagacaagaaaaggatcttggaagactgcaggtggatatggatgaactagaggagaaaaaccgcagcatacaggcggcactggattccgcatataaggaactgaccgacctgcacaaggctaatgcagctaaagattccgaggctcaagaagccgctctatctcgggaaatgaaggccaaggaggaattgagtgctgcgttggaaaaggctcaggaggaggccagacaacaacaagaaacgctcgccatccaggtgggagatctaagattggccctgcagcgaactgagcaggccgcagctcggaaagaggactacctgcggcatgaaatcggcgaactccagcaaagactccaggaagctgagaacagaaatcaggagctgtcacaaagcgtgtcgtccacaacgaggcccctgctgaggcagattgaaaatttacaggccaccctcggttcccagacatccagctgggagaagctggaaaaaaacctgagcgataggctgggtgaatcacagacgctacttgccgcagccgtcgagcgagagcgggctgccaccgaagaacttctggccaacaaaatccaaatgtctagtatggaatcccagaatagcctgttgcgtcaggaaaacagcaggtttcaggcccagttagagagcgagaagaatcgactgtgcaagttggaggacgagaacaatcgatatcaggtggagttggagaatttgaaagatgagtatgttcggaccttggaggaaacacgaaaggagaagacactgctgaattcgcagctggaaatggaacgaatgaaggtagaacaggagcgtaaaaaggcaattttcacacaggagacaattaaagagaaggagcggaaaccgttctcggtctccagtaccccaaccatgagcagaagctccagtatttccggcgtggacatggccggtctgcagaccagtttcctgagccaagacgagtcccatgatcactcttttggcccaatgcctatttcggccaatggcagtaacttgtacgacgccgtccgcatgggtgccggaagctccattatcgagaacctccaatctcagttgaagctgagggaaggcgaaattacccacttgcagctcgaaattggtaacctggaaaaaacacgaagcattatggccgaggaactcgtgaagctcacaaaccagaatgacgagttagaggagaaggtgaaagaaattccaaagcttaggacacagctgagggacttggatcagaggtataacaccatcttgcagatgtatggcgaaaaagccgaagaggcagaagagctgcggttggacttggaagatgtaaagaacatgtacaagactcagattgacgagctcctgcggcagtcccttagctag

SEQ ID NO: 243503 - DNA, 4950 bp, Artificial Sequence
  Description of Artificial Sequence: Synthetic coding sequence
atggagtccgtggaaaaagactggggttgggggttgtggcgaaacctgcgctgcctaggccacgcgcaccagggaaaatgctgtactgaaggtggcatctcgtccactaccaaaacatccagcgaaaacggctcttgctgcttcgagaaggcggcacgaaaagaccatgtgtgcaggtttatcgggtgcggaaggaacgacaggttcaactacgttgtcatgcaattacagggccgtaatctggcggatttgcgaaggtcccagagccgaggtactttcaccatttccaccactcttaggctgggtcgacaaattctggagtctatcgaaagcattcatagcgtgggcttcctgcaccgagatattaaaccttctaattttgccatgggtcgcttcccaagcacatgtcggaaatgctatatgctcgacttcggactggccagacagttcactaactcctgtggagatgtgcgccctcccagagctgtagctggcttcaggggaactgtgcgatacgctagtatcaatgcccataggaatcgggagatgggcagacacgatgacctgtggtcccttttctatatgttagtggaatttgtggtcggacagctgccttggaggaagatcaaagacaaagaacaagtgggcagcatcaaggaacgttatgaccaccgcctgatgttgaaacatctgcctcctgaattcagcatctttcttgaccacattagctctttagattattttaccaaacctgactaccagatgagcatccgcgtgacccgaaagagctacaaagtgagtacatctgggccacaagccttcaacagtttgtcgtatacctctggtccgggagcatgtatatcgtcatccagcttttctcgtatggggtcctccagtttccggggaggactcggtgctggctacggcggtgcaagtggcggaattacaacaatcactgtgaaccagagcctcctgtctccactcaatttggaggtggaccccaatatacaagctgtcagaacccaggaagaaaagcaaattaaaaccctgaacaacaaattcttctccttcattgataaagtgagattcctggaacagcagaataagatgctcgaaacgaagtggtctctagtgcagcagcagaagatggctcgatctaacatggacaacatgtttgagagctacattaataacctgaaatggcagctggagactctggggcaggaaaagctgaaactcgaagccgagctggggaacatgcacggtctggtggaggactttcgtaataaatacgaggtggagatcagcaaatgcacagagatggagaatgagtttgtcctgatcaaagagtacgtggatgaagcttatatgaacaagatggaactggagtcttctttgaaggaactcacagccaagatttcctttttgcggcagctctacgaagaggagattgggtcttgctctcctcggtctagaatacatttatggtgctgttcgtggacaacagcagcctcttggacctggactgcttccagcctgcgatcacggcctgaggggtttcccggaggctgtcacgccgacactgaacagagaggagagctcgcaattaaggacgccaatgctaagttgtcggagcttgaggcggcactacaactggctagccaggacatggctcggcagctcagggagtaccaagagttgatgaacgtgaagcttgctctcgacattaaaattgcaacttatcgaaagctgctggaaggcgaagaatcttggcttgagtccggaatgcagaatatgtcaattcacatgaagacaacctcatcatacgctgggggacagagtctagcttacggaggtttgacatcgccaggcctgagttacggtctgggctcttcctttggttctgggatgggaagcagctctttcagccatactagctcaagtcgcgctgtggtgatgaaaaagattgagaccagagatggcaagctagtatcagagtctagtaacgttttaccaaatctgaggatcacagctacgctgctgacatcggtgttcgacaatagtatcaagacatttggagtcattgagtctgacccttttgattgggaaaagaccggcaacgatggctcacttaccacaacaaccacttccactacaccccaattgcatacaagattgactcccgcagcaatcggcatagctaacgcgactcctattccgggagatctcctcagggagaatacagatgaggttttcccagatgagcaactatcagatggtgaaaatgggattcccgtcggagttagtcccgacaaactacctggttccctaggacatcctcgacctcaggaaaaggacgtctgggaggagatggatgccaataaaaacaaaatcaagttgggaatctgtaaagcagccacggaggaggaaaactcgcacggacaggcgaatggactgttgaacgctccaagcttgggcagtcccatccgtgtgaggagcgagattactcagcctgaccgtgatattccgttggtgagaaaattgcgctccatccattccttcgagcttgagaagcgtttgacgctagagccaaagcccgacactgacaagttccttgaaacctgcctggaaaagatgcaaaaggacacctctgccggtaaagagagtattctgccagccctgctccataagccttgcgtgcctgcagtctcacgcaccgaccacatttggcattacgacgaggaatacctgcctgacgctagcaagcccgcaagtgctaatacacccgagcaagctgacgggggaggttcaaatggtttcatcgcagtaaacctcagttcatgcaaacaggaaattgacagcaaagaatgggtgattgtcgataaagaacaagaccttcaggactttagaacgaatgaagccgtaggccacaagaccacaggatcaccgtcagatgaggagcctgaagtacttcaggtgttagaggcatctcctcaggatgaaaaactgcaactgggaccttgggctgagaatgatcatctgaagaaggagacttctggtgtcgtgctggctctaagtgcggaaggtccacccacggcggctagtgagcagtacacagaccggttggaactgcagcccggtgcggcttcccagttcattgcagcaactcctacttcgctgatggaggcccaggctgaggggcctctgacagcgataacaatacccagaccatccgtcgctagcacacagtccacctccggcagttttcactgcgggcaacagccagagaaaaaggatctgcagcctatggagccaacagtggaactatacagtccaagggaaaacttcagcggcttggtagtcacagagggcgaacccccttctggtggatcaaggaccgacttgggactgcagatcgaccacattggacatgatatgttgcctaatatcagggagagcaacaaatctcaagatctggggccaaaagaactacccgaccacaaccgcctcgttgtgagagagtttgaaaacctccccggtgagacagaggaaaagtctattctgctcgagagcgacaacgaagacgagaagctgtcacgaggacaacactgtatcgagatctcaagtctcccgggagatctcgttatcgtagagaaggatcatagcgccacaacagaacctctggatgtcactaaaacacagactttttctgtcgtcccaaatcaagataagaataacgaaattatgaagcttctgaccgtgggaacctctgaaatatctagccgggacattgatcctcatgtcgagggccaaattggccaggttgcggaaatgcagaaaaacaagatcagcaaagatgatgacattatgtccgaggacctgcctgggcatcagggtgacctgtccaccttcttacaccaggagggcaaacgagaaaagataacacccaggaacggggaattattccattgtgttagcgaaaacgagcatggcgctcctacacgcaaggacatggtcagatctagttttgtaacccgacactcccggatccccgtattggcacaggaaatcgatagtacactggaaagcagtagtcctgttagcgccaaagaaaaactcttgcagaaaaaggcctaccaacctgacttggtcaagctgctagtggaaaagaggcaattcaagtccttccttggcgacttgagtagcgcttccgacaagttactagaagaaaagttggccactgtgccagctcccttctgtgaagaggaagtgctgactccgttcagcagactcaccgtggatagtcacttgtcaaggtccgctgaggactcctttctttccccaattatttcacaaagccggaaaagcaagattccacggcctgtaagttgggtgaacacagaccaggtgaactcgtcaacctcctcacagtttttccctaggccccctcccggtaagccacctaccaggcccggagtagaagcccgactgcgccgatacaaggttctgggtagcagcaattcagattctgacctctttagccgactcgcccagatcttacagaatgggagccagaaaccacggagtactactcaatgcaagagccctggatcaccacacaaccccaaaaccccccctaagtcacctgtggtgcctagacgctcaccgagcgcttcccctagaagctcatcacttcccagaacgagctcttcgagcccttccagagccggacgccctcaccacgaccagaggagttccagccctcatctgggaagaagtaaatctcccccttcccatagcggctcttcttcctcccgacggtcatgtcagcaggagcattgcaaaccaagcaaaaacggcctcaagggcagtgggtccttgcaccatcactccgcaagcactaagacgcctcaagggaaaagcaagcctgccagcaaactgagccggtag

SEQ ID NO: 243504 - DNA, 3735 bp, Artificial Sequence
  Description of Artificial Sequence: Synthetic coding sequence
atgtccggcggtggggagcagctggatatcctgtctgttggtattctcgtcaaggagcggtggaaagtcctccgaaagatcgggggtggaggcttcggcgaaatttatgacgccttagacatgctcacacgagagaatgtggccctcaaggtagaaagcgcgcagcaacccaagcaggttttgaaaatggaggttgccgtcctgaagaagctccagggcaaagatcacgtctgtcgatttattggctgcggcagaaacgaccggttcaactacgtggtcatgcaactgcagggccgtaacctggccgacttgaggagatcacaatcacggggaacctttaccatcagcactactctgaggcttgggagacagattctggagagcattgagagtatccactccgtgggctttctgcaccgcgatatcaagccctcgaacttcgcaatgggccgatttccaagtacttgtcggaagtgctatatgctggactttgggctcgcccgacagtttactaactcttgcggggatgtgcgcccaccgagggcagtggcgggattccggggaactgtgcgctacgcgagtataaacgcccacagaaatcgcgagatgggcagacatgacgatctgtggagtctcttttatatgctggtggaatttgtggtcggacaattgccatggcgcaaaatcaaggacaaagagcaggtgggatctatcaaagagcgctacgaccatagactgatgcttaaacatctgcccccagagttttccatctttctggaccacattagcagtctggactactttacaaagcctgactaccaactcttgactagcgtgttcgacaatagtattaagacatttggagtgatcgaatccgatccattcgactgggagaagacaggcaacgatggatcactcacaaccaccacaactagtaccactccccagctccacaccaggttaacacccgcagccatcggaattgctaacgccactccgataccaggagatctgctgagagaaaacaccgatgaggttttcccagacgaacagctgagtgacggagaaaacggcatcccggtcggtgtatccccagacaaactccctggcagcctaggtcaccctcgaccacaagagaaagacgtgtgggaggagatggatgcaaacaaaaacaaaattaagcttggcatctgcaaggcagccactgaggaggaaaacagccacgggcaggcaaatgggttattgaatgcgccttcactcggctctccaatacgcgttcggagcgagattacgcagccggatagggacattcctttggtgcgtaaactccggtccattcatagcttcgaacttgaaaaaaggttgacattggagcccaagccagatacggacaagtttctggaaacctgtctagaaaaaatgcaaaaagatacttccgcaggaaaggagtcaattctccccgctctgctccataaaccgtgcgtgcccgctgttagtcgaacagatcatatctggcactacgatgaggagtacctcccagatgctagtaagccagcatctgccaatactcctgagcaggccgacggcggaggatccaatggtttcatcgcggttaacctgtccagctgcaagcaagagattgattctaaggaatgggttatcgttgataaggagcaggacttgcaggactttcggaccaatgaggcagttgggcataaaacaacaggtagcccttccgatgaagagcccgaagtcttgcaggtgctggaagccagtccccaggatgaaaagcttcagctgggcccatgggcagaaaacgatcacctcaaaaaagaaacaagtggggtagtgttagcactgagcgccgaggggccaccgactgccgcaagcgaacaatataccgataggctggaattacaacccggagcggctagccaatttattgctgccacgcctacatctctgatggaggctcaagccgagggcccattgacagccattactataccacgacccagcgtagcctccacccagtcaacgagcggatccttccattgtgggcagcagccagagaaaaaagacctgcagccaatggaacccaccgtcgagttgtattcccccagagagaattttagcggtttggtggtcactgagggcgaacctccatcagggggttcacgcaccgacttgggcctgcaaatcgaccacataggccatgacatgttgcccaacatccgtgagtccaacaagtcgcaggatttaggcccaaaagaactgccggatcataacagactggtggtccgcgagtttgaaaacctgcccggagaaacagaggaaaagtcgatcctgttggaatctgacaacgaggatgaaaaactgtcgagagggcagcactgtattgagataagttcgctaccgggagacctagtcatcgttgaaaaagatcactcagctactaccgaacctctggatgtaacaaagacgcagactttttctgtcgtacccaaccaagacaagaacaatgagatcatgaagctgctgacagtcggcactagcgagatatcgtcgagagacattgatccacacgtcgaggggcagattggacaagtggcagaaatgcagaaaaataaaattagcaaagatgacgatatcatgtctgaggacctgccgggacaccagggagacctgagcacattcctgcaccaggagggcaaacgggagaaaatcacccccaggaatggcgagctgtttcattgtgtgtcagagaatgagcacggtgcacctacacgcaaagacatggtgagaagctcatttgtcacccgacactctcgcatccctgtgctcgcacaggaaatcgactctacccttgagagtagtagtcccgtgtctgctaaggagaagttactccagaaaaaggcctatcagcctgatttggtgaaactacttgtggaaaaacggcaatttaaaagttttctgggcgatctgagttctgcatctgacaagctgcttgaagagaagctggccaccgttcctgcgcctttctgcgaagaggaagtgttgacccccttctcaagacttaccgtggattcccatctgtccaggtctgccgaagactcgttcttgagccccattatatcacaatcacgcaagtcaaagattccaaggccagtcagttgggtgaatacagatcaagtgaactcttctacatcgtcacagttcttcccacggcctcctcctggaaaaccacccacacggcctggtgtggaagcaaggctgcgcagatacaaggtgctcggatcatccaattctgatagcgacctgttcagtcgcttggctcagatcctacagaacggatcccagaaaccgagatccaccacacaatgcaaaagcccaggaagtccacacaatccaaagacacctcctaagtcccctgtcgtccctagacggtcaccatctgcttcaccacggtccagttccctgccccgaacttcgtcatcctctccatctagggccggaaggccccatcatgatcagcggagctcatcacctcacctcgggcgtagcaagagtcccccaagccactccggctcatccagctcccgccgttcttgtcagcaggagcactgcaagccctcaaaaaacgggctgaagggctcagggtctttacaccaccattctgcatccacaaaaacacctcaagggaagtctaagcccgcaagtaaactgagcagatag

SEQ ID NO: 243505 - DNA, 3525 bp, Artificial Sequence
  Description of Artificial Sequence: Synthetic coding sequence
gagccaggtaaggatcacgtttgtcgtttcattgggtgtggcaggaatgacaggttcaattacgtcgtgatgcagttacagggtcggaacctggctgatctcagacggtcacagtcccgaggaacattcaccatttccacaaccctgagactgggaagacaaattcttgaatctatagaatccatccactccgtcggcttcctccacagggatatcaaacctagcaattttgctatgggtagatttccctccacatgcagaaagtgctacatgctggacttcggactggccagacagtttactaactcttgtggcgacgtccgcccaccacgggcagtggcagggttcagagggactgtgcgttatgccagtattaatgcccatagaaaccgggagatggggagacacgatgacctctggagcctattctacatgctcgttgagttcgtcgttgggcagttgccttggaggaaaattaaggataaagaacaggtaggcagcattaaggaaagatacgaccatcgacttatgctgaagcatcttcctcctgagttttccatctttttggatcatatttctagcctggactatttcacaaaacctgactatcagctcctgaccagcgtttttgacaacagcatcaaaacctttggcgtcatcgagagcgatccatttgactgggagaaaacaggcaacgacgggagccttaccaccacaactaccagcacaactccgcagcttcatacccggttgacaccagcagctatcggaattgctaacgccaccccgattcccggagatctactgagagagaacacagatgaagtgttcccagacgagcagctgagtgacggagagaatggtatcccagtcggcgtctccccagataagttacctgggtccttaggccaccctagaccacaggagaaggacgtgtgggaggaaatggacgccaataaaaacaaaatcaagctggggatttgcaaggcagctaccgaggaagagaactctcatggccaggccaacggcctgctgaacgcgccatccctgggatcccccattagggtgaggtccgaaataactcagcctgaccgcgatattccgctggttcgcaagttgcggtcaatccacagtttcgaactggaaaaaagattgactctggagccaaaacctgacactgataagttcctggagacctgtctggagaaaatgcagaaagacaccagcgcaggcaaagaaagtatcctaccagctctcctccacaaaccttgtgtgcccgctgtgtcccgcaccgaccacatttggcattacgatgaagaatatctgcccgacgccagcaaacctgctagtgccaacaccccagagcaggctgatggaggagggagcaatgggtttattgctgtgaatctgtcttcatgtaaacaggagatcgattcgaaagaatgggttattgtggataaagagcaggatctgcaggactttcgaaccaatgaggctgtaggacacaagacaacgggtagcccctcggacgaggagccagaggttctccaggttctggaggcgtcacctcaggacgagaaattacagttgggcccatgggcggagaatgatcacctgaagaaggaaactagcggggtggtactggccctgtctgctgagggacctcccaccgccgcatcggagcagtacacagaccgcttagaactgcagcccggagcggcttcgcagtttatcgccgcaacgccgacctccctgatggaggcccaggctgaagggcctttaaccgccataactattcccagaccctccgtcgctagcacccagtctacatccgggagcttccattgtggacagcagcccgaaaaaaaggatttacagcctatggaaccaaccgtagagctgtattcacctcgcgagaatttttcagggttggtggtcacagagggcgagccaccctcaggcggatcaaggacagacctcggacttcaaattgatcacatcggccacgacatgctcccgaacataagggaatcaaacaagtcccaggacctggggccaaaagaactccccgatcacaacaggctggtagtgagggagtttgaaaacttgccgggagaaacagaggaaaagtcaattctgctggaaagtgataacgaggacgagaaactctctcggggacaacattgcatcgaaataagcagcctaccgggtgatttagtcatcgtggagaaggaccattctgctacaaccgaaccccttgatgtaactaaaactcaaaccttttccgtggtgccgaaccaggataagaataacgagatcatgaaactgttaaccgtcggaaccagcgagatttccagcagagacatcgacccacatgtcgagggacagattggccaggtggcagaaatgcagaagaacaagatctctaaagacgatgatattatgtccgaagacttgccgggtcaccagggcgacctgtcaaccttcctccaccaggagggcaagagagaaaagatcacgcctagaaacggtgagttatttcattgcgtaagtgaaaacgagcatggggctcctacacggaaggatatggtcagatcttccttcgttacccggcatagcagaattcctgttttggctcaggagatcgactccactctggaaagctcaagccctgttagcgcaaaggagaaattactgcagaaaaaggcttaccagccagacttagtgaagctgcttgtggagaaacgtcagtttaagagcttcttgggggatctgtcaagtgcctctgacaagcttctggaggagaagttggcaaccgtgcccgctcctttttgcgaggaggaggtcctgacaccgttctcccgtttaaccgttgactcccatctgtcacggtcggctgaagactcttttctatccccaatcataagccagagcaggaagtccaagattccaaggcctgtcagttgggtgaataccgatcaagttaattctagtacctccagtcagttctttcctcgacctccgccaggaaagcctcctacccgccctggcgttgaagcccgactgcggaggtacaaggtactgggaagctccaatagcgattcggatctgttttcgaggctggcccagattctccaaaatggaagtcagaagcccagatctaccacccagtgtaagtccccaggttcgcctcataacccaaaaactccccctaagtccccagtcgttcctcgtcggtccccctcagcttcacctagaagctctagcctgccaaggaccagttccagtagcccttctagagccggaagaccccaccatgaccaacgctctagcagcccccacctgggcaggtctaaaagccctccgtcacacagcggaagctcctcgtcccgtaggagctgtcagcaggaacattgtaaaccaagtaagaacgggctgaagggatccgggagtctgcaccaccactcagcatccaccaagacccctcagggcaagtccaaaccagcttcaaaactgagccgctag

SEQ ID NO: 243506 - DNA, 2244 bp, Artificial Sequence
  Description of Artificial Sequence: Synthetic coding sequence
atgacctcgtttcaggaagtaccactgcagacctccaactttgctcatgtaatcttccagaatgttgctaagtcgtatcttcccaatgcgcacctggaatgccattataccttgaccccatacattcacccacatcccaaggattgggtgggcatttttaaggtgggttggtctaccgccagggactattatacctttttgtggagccctatgcctgagcattacgtggaagggagcacagtgaactgcgtactggcgttccagggttattacctgccgaacgacgacggcgagttctaccagttctgttatgtcactcacaagggtgagatccgtggcgcttcaaccccctttcaattccgcgcaagctctccagtggaagagctcctgaccatggaagatgagggcaattccgacatgctggttgtgacaactaaggccggactgttggaattaaagatcgagaagacaatgaaggagaaggaagaactactgaagctcatcgccgtgctggagaaggagacagcccagcttagagaacaggtcggacggatggagcgggagctcaaccacgagaaggagaggtgtgatcagctgcaagcagagcaaaagggccttaccgaggtcacacagtccctgaaaatggaaaacgaggagtttaagaagagattcagcgacgctacttctaaggcccaccagctggaggaagatatcgtgtcagtcacacataaggcgatcgaaaaagaaaccgagctcgactctcttaaagataaattgaagaaggcgcagcacgaacgagagcagctcgaatgccagctcaaaaccgaaaaagacgagaaggagttatacaaggtgcacctgaaaaacaccgagattgaaaataccaagctaatgtcagaggtgcagacactaaagaatctggatgggaacaaagaaagcgttattactcactttaaggaagaaataggtagactgcagctgtgcttggcggagaaggagaacctccaaaggacattcctgctgaccacatcttctaaggaggacacttgtttcctgaaagagcagcttcgtaaagcggaagaacaggtgcaggcgaccagacaggaggtggtttttttggcaaaagagcttagcgacgccgtgaatgtaagagaccggactatggcggatctccacacagcacgcctggagaacgagaaggtaaaaaagcagctcgccgacgccgtcgctgaactgaagttgaatgctatgaaaaaagaccaagacaaaaccgatacactggagcatgagcttaggcgtgaggtggaggacctcaagctccgcttacagatggctgcagatcactacaaggaaaagtttaaagagtgccagcgcctgcaaaaacagataaataaactaagcgaccagagcgctaacaacaataacgtgttcactaagaagactggtaaccagcagaaggtgaatgacgcaagcgtcaatacggatcccgctacgagcgcttccaccgttgacgtcaagccaagcccttccgcggctgaagctgattttgatatcgtgactaaggggcaagtctgcgagatgaccaaagaaattgctgacaagaccgagaagtataacaaatgcaaacagttgctccaggacgagaaggctaagtgcaataaatatgccgatgagctggcaaagatggagctcaagtggaaagagcaggtgaaaatagcagagaacgtaaaactggagctagcagaggtgcaggacaattataaggaattgaagcgaagtcttgaaaacccggctgagcggaaaatggaagacggcgcagatggcgctttctaccctgatgaaatccagcgtcctccggtgcgcgttcctagctggggattggaggacaatgttgtatgttctcaacccgcaaggaattttagtcggcctgatggactcgaagattcagaagattccaaggaggacgaaaatgtgccaactgctcccgatccccctagccagcatctgcgaggtcacggtacaggcttctgctttgacagcagctttgacgtgcacaaaaagtgccctttgtgcgaactgatgtttccccctaactatgatcagtcaaaattcgaggagcacgtcgagagccattggaaagtttgtccaatgtgttcagagcaatttcctccagattacgatcagcaggtatttgagaggcacgtccagacccattttgaccaaaacgtgctgaactttgattag

SEQ ID NO: 243507 - DNA, 2370 bp, Artificial Sequence
  Description of Artificial Sequence: Synthetic coding sequence
atgacttcattccaggaagttcccttacaaacgagtaatttcgctcacgtgatctttcagaacgtggctaaatcatacctgcctaacgcccatctggagtgccattatacgctgacaccttacatccacccccaccctaaggactgggtgggaatatttaaagtggggtggtccactgccagagattactacacgtttctttggagtcccatgcctgaacactatgtggaggggtccaccgtgaattgcgtactggccttccaaggctactacttgcccaacgatgacggtgaattctaccaattttgctatgtgacgcacaaaggcgagataagaggagcttctacccccttccagttccgagctagttcccctgtcgaggagctgctgaccatggaggacgaggggaacagtgacatgctggtggtgacaacaaaggccggactcctcgagttaaaaatagaaaagaccatgaaagagaaggaggagttactgaaactcattgctgtactggagaaagagaccgcccaactgcgggaacaggttggccgaatggaaagggagctgaaccatgaaaaagagcgttgtgaccagctgcaggcagaacagaagggtcttactgaggtgacccagtctctgaaaatggaaaatgaggagttcaagaagcggttcagtgacgccacctctaaggcccaccagctggaagaagatatcgtgtcagtgacccacaaagccatcgagaaggagaccgagctcgatagcctgaaggacaagctgaaaaaagcccagcacgaacgagagcaactcgagtgtcaactgaaaacagagaaggatgagaaagaactttacaaggtgcatttaaagaacacagaaatcgagaacacgaagctcatgtccgaagtacagaccctcaagaacctggatgggaataaggagtccgtgatcacgcactttaaggaggagatcggcagactccagttgtgcctggctgaaaaggagaatctacagagaacttttctcctcacgaccagttccaaggaagacacctgcttcctgaaggagcaattgagaaaggcagaagagcaggtgcaagctactaggcaggaagtggttttcctggctaaggaactttccgatgccgtgaatgtgcgggaccggactatggccgacctacatacagctcggctggagaacgaaaaggtgaaaaagcagctggccgatgcagtggccgagctgaagcttaatgctatgaagaaagatcaggacaagactgacacactggaacacgaattgcgcagagaagttgaggatctaaaactccgactgcagatggcagccgatcattataaagaaaaatttaaggaatgtcagagactgcagaaacagattaacaaattgtcagatcaaagcgcgaataacaataacgtttttacaaagaaaacaggtaaccagcagaaggttaacgatgcaagcgtgaacacagatcccgctacttccgcgtcaaccgttgatgtcaagccctcgccctccgcggctgaagccgatttcgacatcgtgactaaggggcaagtgtgcgagatgaccaaggagatcgccgataagacagaaaagtataacaaatgtaaacaactcctccaagatgaaaaggccaagtgcaataagtatgctgatgagttagcaaagatggaactgaagtggaaggagcaagttaagatcgctgaaaatgtcaaactcgaacttgctgaagttcaagacaactacaaggaactgaagcgttcgctggagaatccagcggagagaaagatggaaggtcagaattcgcagtccccgcagtgctttaaaacatgcagcgaacagaatgggtatgtgctgaccctttccaacgcccagcctgtgctgcagtatggaaatccctacgcctcacaggagacaagggatggagcggacggggcattttaccccgatgagattcagagacctcctgtccgagtgccttcatgggggcttgaggataacgtggtctgcagccagcctgccagaaacttctcgagacctgatgggctagaagacagtgaggattccaaggaagatgagaacgttcccactgcacccgatcctccctcccagcacctgcggggacacggcacaggcttttgctttgattccagtttcgatgtccataaaaaatgtcccctatgtgaattgatgttcccgccaaactacgatcaatccaaattcgaagagcacgtagagagccactggaaggtttgcccaatgtgcagtgagcaatttcctcccgactacgaccagcaggtatttgagagacacgtccaaactcacttcgaccagaatgtgctcaacttcgattag

SEQ ID NO: 243508 - DNA, 417 bp, Artificial Sequence
  Description of Artificial Sequence: Synthetic coding sequence
atgactagctttcaagaagtgcccctgcagacttcgaacttcgcacatgtgattttccaaaatgtggccaaaagttatttgcccaatgctcacctagagtgtcattatactctgacaccatacatccacccccacccgaaggattgggtcgggatttttaaggtggggtggtccactgcaagggattattatacctttctgtggagtcccatgcctgagcattacgtggagggatcaaccgtcaactgtgtgttggccttccagggatattatctgcccaatgacgacggagaattctatcagttttgttacgtgacacataagggagaaataagaggggcttcaacccccttccagttcagagcaagtagccctgtagaggaacttctgactatggaggacgaaggaaactcttag

SEQ ID NO: 243509 - DNA, 297 bp, Artificial Sequence
  Description of Artificial Sequence: Synthetic coding sequence
atgaccagtttccaagaggtcccgcttcaaactagtaatttcgcacacgtgattttccagaatgtggccaagtcttatttacctaatgcccacttggagtgccattataccttgaccccatacatccacccacacccaaaagattgggtcgggatcttcaaggtaggttggtccacggccagggattattacacctttttgtggagtccaatgcccgaacattacgtcgaggggtcgacagttaattgcgtgcttgcattccagggttattatcttcccaacgacgacggagagtag

SEQ ID NO: 243510 - DNA, 1773 bp, Artificial Sequence
  Description of Artificial Sequence: Synthetic coding sequence
atgaaggagaaagaggaactacttaagctgatcgccgtgctggaaaaagagaccgcgcagctgcgtgagcaagtggggaggatggaacgggagctgaatcatgaaaaggagagatgcgaccaattacaggctgaacagaaggggctgactgaagtaacccagagcctcaagatggaaaatgaagagtttaagaagaggtttagcgacgcaacatcgaaggctcatcaactagaggaggatattgtgagcgttacacataaggcaatcgaaaaggaaactgagctggactctctgaaggataaactcaaaaaggcccagcacgaacgcgagcagcttgaatgccaactcaagaccgaaaaggacgaaaaagaattgtacaaggtgcatttgaagaacaccgagattgagaacacgaaactcatgagtgaagtgcagactctcaagaatctggacggcaacaaggagtcagtgattactcacttcaaagaagagattgggaggctgcagctgtgtttagccgaaaaggagaatttgcagcggactttcttgctgactacctcatcaaaagaagatacctgtttcctgaaggaacagctgcgaaaagccgaggaacaggtgcaggccacacgtcaggaggtagtcttcttggccaaagagttgtctgatgccgtgaacgtacgagatagaaccatggcagatctgcatacggctcggctagaaaatgagaaggtgaaaaaacaactcgcagatgcggtggccgaattaaagctcaatgctatgaagaaagatcaagacaagacagataccctagagcatgaactgagacgggaagttgaggatctcaagctacggctccagatggccgctgatcattacaaggagaaatttaaggagtgccagagactgcagaaacaaatcaataagttgtctgatcaatctgcgaacaacaataatgtgttcacaaagaaaaccggcaatcagcagaaagttaacgatgcttccgtcaataccgatcccgcaaccagcgcttccacagtggatgttaagccctcgccgtcggccgcagaggctgatttcgacattgtgactaagggccaggtctgcgagatgacgaaagagatcgcggacaaaacggaaaagtacaataaatgtaaacagctacttcaggatgaaaaggccaaatgcaataaatacgccgacgaactcgcgaaaatggagttaaaatggaaggagcaggtgaagatcgcagagaacgtcaagctggaattggctgaagttcaggacaactataaggagctgaaaaggtccctcgaaaaccccgcagagcgcaaaatggaggacggagccgatggagcattttacccggacgagatccaacggccacctgtgagggttcctagttggggccttgaagacaacgtcgtgtgctcgcagcccgctcggaatttctctaggccagatgggctggaggattcagaggatagtaaggaagacgaaaatgtgccaacagctcctgaccccccttctcaacatctgaggggccatggaaccggattctgtttcgacagttcctttgatgttcacaaaaagtgcccactgtgtgagctgatgttcccaccaaattatgaccaatccaaattcgaagagcatgtcgagtcacattggaaggtgtgccctatgtgcagtgaacaattccccccagattacgatcaacaggtttttgaaagacacgtgcagactcattttgaccagaatgttctgaactttgactag

SEQ ID NO: 243511 - DNA, 2244 bp, Artificial Sequence
  Description of Artificial Sequence: Synthetic coding sequence
atgaccagcttccaggaagttcccttgcagacgagcaattttgcccatgtgattttccagaacgtggccaagtcctatctgcccaacgctcacctggagtgccactacaccctgactccttatattcatcctcaccctaaggattgggtgggaatttttaaagtgggctggtcgaccgccagagactattatacttttctctggtccccgatgcccgaacactatgtagaggggtcaactgtcaattgtgtgctggcattccagggttactacctacccaacgatgacggcgaattctaccaattctgttacgtcactcacaaaggagagatcaggggggcttccaccccattccagttcagagcatcttcacccgtagaggaattactgactatggaagatgagggtaatagtgacatgttggtggttacaactaaagccggattgctggaactcaaaatcgagaagaccatgaaggagaaggaggagcttctgaagttgatcgccgttctcgagaaggagactgcccagctccgcgaacaggttggtaggatggagagagagctcaaccacgaaaaagagcggtgcgatcagctgcaggctgagcagaaagggctgacagaggtgactcaatcactcaagatggagaatgaggaattcaagaaacgcttctctgatgctacttctaaggcccaccagctggaggaagatatagtctcagttacccacaaagctatcgagaaggaaaccgagcttgattcgctcaaggataagttaaagaaagcccagcacgaacgcgagcagcttgaatgccaactgaaaaccgagaaggacgagaaggagctgtataaagttcacctgaaaaataccgagatcgagaacactaaactgatgtccgaagttcaaacccttaagaatctagatgggaacaaagagtcagtgatcactcactttaaggaggagattggccgtctccagctgtgtttagccgagaaggaaaatttacagcggacgttcctcctcaccacctctagcaaagaagacacgtgttttctgaaggagcaactgcggaaggctgaggagcaagtccaagcaacacggcaggaggtggtgttcctggctaaggagctgagtgacgccgtgaacgtgcgtgatcgcactatggcagatctgcatactgcgaggctcgagaatgagaaagtgaagaaacaactggccgatgctgttgcagagctgaaactgaacgccatgaagaaagatcaggataagaccgatacactcgagcacgagctgcgaagagaagttgaggatttgaaactgaggttgcagatggcagccgaccactacaaggaaaaatttaaggagtgtcaacgcttgcaaaagcagatcaacaaactgtctgaccagtcagctaacaacaataatgtttttacaaagaaaaccggaaaccagcagaaggtcaatgacgcttcagtgaataccgatccagctacctccgcctccaccgttgatgtcaaaccatctccatcagccgcagaagcagacttcgatatcgttacaaaaggccaggtctgtgagatgacgaaggaaatcgccgataagaccgagaagtataacaagtgcaagcagctgttgcaggatgaaaaagctaagtgtaataaatacgctgacgaactggctaagatggagctgaagtggaaagaacaggtgaagattgctgagaatgtcaaacttgaactggccgaagtgcaggacaactataaggagctaaaaagaagcttagagaaccccgcagagcgcaaaatggaggacggagcagacggcgctttctacccagacgagatccagagacctcctgttagagtcccttcttggggcctggaggacaacgtcgtgtgctcacaacctgctcggaattttagccggccagacggattggaagatagtgaagattccaaggaagacgagaatgtccccaccgctccggatcccccttcacagcatctgagggggcatggaaccgggttctgttttgactcgtcattcgacgttcacaagaaatgtcccttatgtgagcttatgtttccacccaattacgatcagtctaaatttgaggagcacgtcgagtctcactggaaagtgtgcccaatgtgtagcgagcagttcccacctgattatgatcagcaggtgttcgaacgccatgtgcagacccactttgaccaaaatgtcctgaactttgattag

SEQ ID NO: 243512 - DNA, 3480 bp, Artificial Sequence
  Description of Artificial Sequence: Synthetic coding sequence
atggagcccatcacttttacagctcggaaacacctcctgtcaaatgaagtgagtgtggatttcggcctgcaactggttgggagcttgcctgtccattctttgactaccatgcccatgctcccctgggtagtcgccgaggtgcgtcgactgtctcgacaatccacacggaaggaaccggtgacgaagcaggtccgcttgtgcgtgagtccgagtggacttagatgcgaacccgagcccggacgcagtcagcagtgggacccgctaatctactcttccatttttgaatgtaaaccccaaagggtacacaaactcatccacaactcacatgatccatcatactttgcctgcttaattaaggaggatgctgtgcataggcaatctatatgttatgtgtttaaggccgatgaccagacgaaagtgccagaaattatatcgagcatacggcaggccggaaagattgcccgacaggaggagctgcattgcccatccgagttcgacgataccttcagcaagaaattcgaggtcctgttttgtgggagggttaccgtggctcacaagaaggcgccaccggcacttatcgatgaatgcatagagaagttcaatcacgtgagcgggtctcgtggttcagaaagcccccgacctaacccacctcatgcagctcctacaggctctcaagagccggtgcgtcgacccatgcggaaatcattctcgcaaccagggttgcgctcgttagcctttagaaaggaactccaggacggtggcttgcgctcctccggattctttagcagcttcgaagaatcggatatcgaaaaccatctgataagcggacacaacatagtgcagccgaccgacatagaagagaataggacgatgctgttcaccatagggcagagtgaggtgtacttgataagcccagatacaaaaaagatcgccttagaaaagaactttaaggaaatttccttctgttctcagggtatacgccacgtggaccactttggattcatctgcagagagtcttcaggtggtggtggcttccatttcgtgtgctatgtttttcagtgcaccaatgaagcactggtggacgagatcatgatgacgttaaagcaggcatttactgtcgcagcggtccagcagaccgcaaaggctccggcacagctctgcgaaggatgtcctctgcagtctctgcacaagctgtgcgagagaattgagggaatgaactcttccaagaccaagctggagctccagaaacacctaacaacccttactaaccaggagcaggcaacgattttcgaggaggttcagaagctgcggccaagaaacgagcaacgcgagaacgagcttattattagcttcttgagatgtctgtacgaggaaaagcaaaaagagcatatccatataggcgagatgaagcagactagtcagatggctgcagaaaacatcggctctgaactgcccccttcggccaccagatttcggctggacatgctgaaaaataaggctaagagaagtttgaccgagtccctggagtcaatattgagtcgaggtaacaaggctaggggcctgcaagagcactctatttcagtggaccttgacagtagcctaagttccactcttagcaatacctcaaaggagcccagcgtgtgcgaaaaagaggcactccctatatcagagtcctctttcaagcttctggggtcctccgaggacctctcttccgactccgaatcccatctgccggaggaaccagccccattgagccctcagcaggcctttcgccgtagggctaacacattgtcacactttcctattgaatgtcaggaacctccccagcccgctagaggttcaccaggggtttctcagcgtaaactgatgagataccactctgtgtctacagagacaccccatgaaaggaatgtggacccttcccctgtgggggaatccaagcataggcccggtcagtcaagcgccccagctccgcctcccagactgaacccctcggcctcatctccaaatttcttcaagtacttgaagcataacagttccggggagcagagcggcaacgccgttcctaagagcatctcttatcggaatgccctacggaaaaaacttcacagttcttcttctgtccctaactttctgaagttcctggcaccggtcgacgaaaataacacttcggactttatgaacaccaagcgagacttcgagtcgaaagccaatcatctgggcgatagcggtggcaccccagtgaagaccaggcgacactcctggcgccagcaaatcttcctgcgagtcgccacacctcagaaagcatgcgactcatctagccggtatgaggattacagcgagttaggagagctacctcctcgaagcccgctggaaccagtgtgtgaagacgggcctttcggccctccgccagaagagaagaaacggaccagcagggagttgcgcgagttgtggcagaaagccatcctccaacagatcttacttttacgcatggaaaaggagaaccagaaactgcaagcttccgaaaatgacttgctgaacaaaagacttaagctcgattacgaagaaattactccgtgcctgaaggaagttactactgtatgggaaaaaatgctaagcacgcccggtagatctaagatcaagttcgacatggaaaagatgcattccgcggtcggccaaggggtgcccagacatcatcgtggagagatttggaagtttctcgctgagcagtttcacctaaagcaccagtttccttctaagcagcaacccaaggacgtgccttacaaggaactacttaagcagctcacttcccagcagcacgctattctgatagatcttggccgaacctttccaacacacccttacttttcagcgcagctaggcgcaggacagctttccctctataacattcttaaggcttactcattgctggatcaggaagttgggtattgccaggggttgtccttcgtagccggtatattactcctccacatgagtgaggaagaggcgtttaaaatgcttaagtttctcatgttcgacatgggactaagaaaacagtatagacctgacatgatcatcctccaaatggaaaagacaattaaccaggtttttgaaatggatattgccaagcagttacaagcctacgaggtggaatatcacgtcttgcaggaggagttgattgatagtagtcctttgtcggacaatcaaaggatggataaattggaaaaaaccaacagtagtcttcgcaaacagaacttagatctgctggaacaactgcaggttgccaatgggcgtatccaaagcttggaggcaactattgagaagcttctttcgagtgagtcaaagttaaagcaggctatgttgacactggaactcgaacggagcgctctgctccagacagtggaggaactgaggaggcgatcagccgagccatccgatcgtgagccagagtgcactcagccagagcccacaggggactag

SEQ ID NO: 243513 - DNA, 3507 bp, Artificial Sequence
  Description of Artificial Sequence: Synthetic coding sequence
atggagccgataacgtttactgctaggaagcatctgctctcaaacgaggtcagcgtcgacttcggattacagctcgttggtagcttaccagttcactctctaacaacgatgccaatgctcccctgggttgtggcagaggtgcgccgactgagccgacaaagtacccgcaaggagcccgtcactaagcaggttaggctttgtgtttcgccttctggcctgcggtgtgagccagagcccggaagaagtcagcaatgggatccactcatttactcaagtatatttgaatgcaagccccaacgtgttcataagcttatccacaatagccacgatcctagctacttcgcctgccttatcaaggaagacgcagtacacagacagtcaatatgctacgttttcaaagcggacgaccagaccaaagttcccgagatcatcagcagcatccgtcaggctggcaagatcgctcgccaagaagaactgcactgtcccagcgagttcgacgatacgttctcaaagaagtttgaggtccttttctgtgggagggtgacagtggcacacaaaaaggctccgccagccttaatcgacgaatgcatagaaaaatttaaccacgtaagcggctccagagggtccgagtcgcctcggccaaaccctccacacgccgctcccaccggcagtcaggaaccggtcaggaggcctatgcggaaatcattttcccagccaggcctccgaagcctggcgtttcgcaaggaactacaggacggtggcctgagatcaagcggttttttctcctcattcgaggagagcgatatcgagaatcacctgatctccgggcacaacatagtgcaacccactgatatcgaagaaaataggaccatgttatttactatcggccagagcgaggtttacctgatttcccccgatacaaaaaaaatcgcgttagagaagaactttaaagagatatcattctgctctcagggcattagacatgtcgatcactttggttttatatgtcgggaaagcagcgggggaggcggatttcactttgtgtgctacgtcttccagtgcactaacgaagccctggtcgacgaaattatgatgaccttaaagcaggcttttaccgtcgctgccgttcagcaaaccgccaaagctccagcccaattgtgtgaagggtgtccactacagtccctgcataaattatgtgagcgcatagagggaatgaatagtagcaaaacaaagcttgaactgcagaagcatctcaccacccttaccaaccaggaacaggctaccattttcgaagaagtccagaaactcaggccccgaaatgagcagcgggagaatgagctgatcatttcttttctacgatgtctatatgaggaaaaacagaaagagcatatccatattggggagatgaaacagacttcacagatggccgctgaaaatattggatctgaactccccccatccgccacccggttccgcttggacatgctaaagaataaggcaaaaaggtccctaaccgagtctctggagagtatccttagcaggggtaacaaagccagagggctgcaggagcacagcatttctgttgatcttgatagtagtctttcgtcaacactcagcaatacttccaaggagccctccgtctgtgagaaggaagccctgcctatcagcgagagttcctttaagcttcttgggtcaagcgaggacctctcttctgatagcgagtcgcacctaccagaggagccagcccctctcagccctcaacaggcgttccggagacgcgctaataccctgtcgcacttccctatcgagtgtcaggagccaccgcaacccgctcgcggttccccaggcgtctcccagcgcaaattaatgcggtaccacagcgtgtccaccgagacgccacatgaaaggaaagactttgagtcaaaggcgaatcacctgggcgattcgggcggaacgcctgtgaaaacaaggcgacacagctggagacagcaaatatttctacgggtggccactccacagaaagcatgtgattccagctcacggtacgaggattattctgaactgggggaactaccccctcgcagtccgttggaacctgtttgcgaggacggaccctttggccctccacccgaggaaaagaaaaggactagtcgtgagttgagggaactgtggcagaaggcaatcctgcagcagatactgttgctgcgcatggaaaaagagaaccagaagctccaagcttcagagaatgatttgctcaataagcgcctgaagctcgactacgaagagatcacaccttgcctgaaggaggttacgaccgtctgggagaagatgctgtcaactccgggaaggagtaagattaagtttgacatggaaaagatgcacagcgcagttggccagggggttcctcggcatcacagaggggaaatttggaaattcttagcagaacagtttcacctgaagcaccagttcccttctaagcagcaaccaaaggacgtgccctataaggagctccttaagcaactcacctcccagcagcacgctatcttaatcgacctcggtaggactttccctacccatccatatttttccgcacagcttggtgccggacagttgtctctgtataatatcctcaaggcttatagtcttcttgaccaggaggttggctactgccagggcttgtccttcgtcgccggtatattgctgttacatatgtccgaagaggaggccttcaagatgttaaagttcctcatgtttgatatggggcttaggaaacaatatcggcctgacatgattatactgcagatccagatgtaccaattatcccgtctcctgcacgactatcatcgggatctgtataatcatctggaagagcacgagatcgggcctagtctttacgccgctccttggtttctaaccatgttcgcctcccagtttcctctgggattcgtggcacgcgtgttcgatatgatttttctgcaaggcacagaggtgatcttcaaagtcgccctttccctgctggggagccacaagcccctcattctgcagcacgaaaaccttgagactattgtagacttcataaaatcaaccctccctaatttggggctggtgcaaatggagaagacgatcaatcaagtgtttgaaatggatattgctaagcaactacaagcctacgaagtggaatatcatgtgctccaggaggaactgattgattccagccctttaagcgacaaccagcgcatggataagctcgagaagacaaactcctcactcagaaaacagaatctggatctcctggaacagctacaagttgcaaacggccgtatccagtcgctcgaggccaccatagagaagctgctcagctccgagtccaagctcaaacaggcaatgctcaccctggagctcgaaagatccgccctcctgcagactgtggaggagctgcggagacggagcgccgaaccgagcgatcgagagcccgagtgcacgcagcccgagcccacgggcgactag

SEQ ID NO: 243514 - DNA, 1299 bp, Artificial Sequence
  Description of Artificial Sequence: Synthetic coding sequence
atggaaaaggaaaaccagaagcttcaagcttccgagaatgacctcctgaataagcggttgaagctggactatgaggagattaccccatgcttgaaagaagtcacaactgtttgggagaaaatgttatcaacgcctgggcgttctaagatcaaatttgatatggagaagatgcactcagcagtggggcagggagtacctcggcatcacaggggggagatttggaagttcctggctgagcagttccaccttaagcatcagttccctagtaaacagcaaccaaaggatgtcccatataaggaactactgaaacagttgacgagccagcaacacgccattttgattgacttgggccgtaccttcccgacccacccatatttctctgcacaactcggcgcaggccagctgtctctgtacaatattctgaaagcctattccctgttggaccaggaggtaggctactgtcagggtctgtcatttgttgcagggatcctcttgttgcatatgtcagaggaggaggcttttaaaatgcttaagttcctcatgttcgacatgggcttgcgaaaacagtaccggccagacatgatcatcctccagattcaaatgtaccagttgtctcggctgctccatgactatcatcgcgacttatataatcatctggaggagcacgagataggacccagcctttatgccgcaccctggtttctcacaatgtttgcttcccagttccccctcggcttcgtggccagagtctttgatatgatttttctccagggcaccgaggtgattttcaaggttgcactgagcctgctaggatcacacaagcccctgattctgcagcatgagaaccttgagaccatcgtggattttattaagtctactttgccgaacctgggactggttcaaatggagaaaaccatcaaccaggtttttgaaatggatattgctaagcagcttcaagcatacgaagtggagtaccatgtgctccaggaagagctgattgattcctctcctctgagcgacaatcaaagaatggacaagctggagaagaccaacagctccctgcgaaagcagaacctggacctcttggaacagctccaggtggccaatggcagaatccagtctcttgaagctaccatcgagaagctcttgtcctctgagagcaagctgaagcaggcaatgctcaccctggagttggagagatccgctctcctgcagacggtggaagaactgcgcagaaggagcgccgagcctagtgaccgcgagccagagtgcacacagcccgagcccaccggcgattag

SEQ ID NO: 243515 - DNA, 933 bp, Artificial Sequence
  Description of Artificial Sequence: Synthetic coding sequence
atggcccaagctcttggggaggatctggtgcagcccccagaactccaggatgacagctcaagtctgggctccgactccgagctgtcaggcccaggtccttacagacaggcagaccggtatggttttattggagggtcctctgctgagccagggcctggccatcctccagcggatctcattaggcagagggaaatgaagtgggtcgagatgacctctcactgggagaagactatgagcagacgttacaaaaaagtgaaaatgcaatgccgcaagggaatcccatccgccctccgggctcggtgttggcctctcctgtgcggtgcgcacgtttgccagaagaactcccctggcacatatcaagaattggcagaggcccctggggaccctcagtggatggagacgatcggacgggatctccataggcagttccctctgcacgagatgttcgtgtcaccccagggacacggaaggggatcctgtagatgcagtagaccaaccccctgcatcgaccgcagccgagccaccgcacgcccacggggaccctggcttttgtgctgctcctgtacttgtccacagagacgacccagtggagcctggtgcaggtctgttaggtcgaccagcctgggtactaccgggccaacatggtgccaatccacagtgccctgcggggctgataccggagcccctggagccggacactgtagagctgcccgaggcctcccctggcccccaggcgacacaggatcaccttctagccaccctcctagagccgcagccggagggggtctccacgttaccggcgctcagcggggagctgtgagagcgggaccagctgctggggatcaaggccctgcaggacctgccgcaaggttcagagccggaacaccagcaccggctacaggccctcctagaaggggcccatcccatctgtag

SEQ ID NO: 243516 - DNA, 1662 bp, Artificial Sequence
  Description of Artificial Sequence: Synthetic coding sequence
atggattctcctggctacaactgtttcgtggacaaggacaagatggacgcagccattcaggacctcggccctaaagaattatcctgtacagagctgcaggagctgaaacagctggcaagacaaggatactgggcccagagccatgcccttcggggtaaggtctaccaaaggcttatccgcgatatcccttgtcgtacggtgacgcccgatgcgtctgtctacagtgacattgtcggcaagattgtgggaaaacattcatcctcgtgtctacctctccccgaatttgtcgataatacacaggtccccagctattgcctgaatgcaaggggagagggggcagtccggaagatcctcctgtgtctggctaatcagttcccggacatttcgttttgcccagcgctgccagcggttgtagccctgctgttgcactacagcattgacgaagcggagtgcttcgagaaggcatgtagaatcctagcctgtaatgatcccggaaggcggctcatcgaccaatctttcctggccttcgagtcctcctgtatgacctttggagatctggtgaacaaatattgtcaggctgcccataaacttatggtcgctgtttcggaggacgttctgcaggtatacgccgactggcaacgttggctttttggagaactgcccctttgttacttcgctcgggtgttcgatgtgttcttggtcgagggctacaaggtgctttatagggtagccctggccatccttaagtttttccataaggtacgcgctggacagcctctggaatcggactccgtaaagcaggacatcagaacttttgtgagggacatcgcaaaaaccgtgtccccagaaaagctgctggagaaagcattcgccattcgccttttctccagaaaagaaatacagctgcttcaaatggccaatgagaaggccctgaagcaaaaaggaatcacggtgaagcaaaaacggcaatttgtccatctcgcagtccacgccgaaaacttccggtctgaaatcgtctctgtgcgcgaaatgcgtgatatctggtcatgggtgccggaaagatttgctttgtgccagcccctgctgctgttttcttccctccagcatgggtactccttagcacggttttattttcagtgtgaggggcatgagcccaccttgctgctcattaaaaccacccagaaggaggtgtgtggcgcttacctgtcaacagactggagtgaacggaataaatttggcggtaagctgggcttttttggcactggggaatgctttgtgtttcgtctccagcccgaggtacagcgctacgaatgggtggttatcaaacaccctgagctgacaaaaccgccacccctgatggcagctgagcctactgccccactctcccattctgccagttccgatccggctgacagactgagtccattcttggctgcccgacattttaatttaccttccaagacggaaagcatgtttatggccggaggatcagactgcctgatcgtgggtgggggtgggggacaggctctgtatattgatggcgatttgaatcgtggccgtacatcacactgcgacacctttaacaatcagccgctgtgtagcgagaattttcttatagcagccgttgaagcctgggggttccaggatcccgacacacaatag

SEQ ID NO: 243517 - DNA, 759 bp, Artificial Sequence
  Description of Artificial Sequence: Synthetic coding sequence
atgggagtgctgctgactcagaggaccctgctttccctggtgctggctttgctgtttccttcgatggcctccatggccgctatcggatcctgttcaaaggagtaccgtgttctgttgggtcagctgcagaagcagacagacctgatgcaagacacgtctcgtctgttggatccctatatccgcattcagggattagatgttcccaaactgagagagcactgtcgcgaacgacccggagcctttccaagcgaagagacactgaggggccttgggcgaagggggtttttgcaaacactcaatgccaccctcgggtgtgtgttacatcggctggccgatttggagcagcgcttgccaaaggcacaagacttggagaggtctggcctgaatattgaggatctggagaagcttcagatggccagacccaatatcctgggacttagaaacaatatctactgtatggcacaactgctggataacagcgatacggccgagccaacaaaagccggacgtggtgcctcccagcctcctacacctactcctgccagcgacgcctttcagcggaaattagagggctgtcggttcctgcacggctaccacaggttcatgcatagcgtggggcgagtgttctctaagtggggggagtctcccaaccgtagtcggaggcatagtccccaccaggctctgagaaagggcgtacggagaactcgtccatccaggaaggggaagcgactaatgacacgaggtcagctacctagatag

SEQ ID NO: 243518 - DNA, 1263 bp, Artificial Sequence
  Description of Artificial Sequence: Synthetic coding sequence
atgttgaacaattgggacaagtggatggctaaaaagcacaagaaaatccgactccgttgtcagaagggtattccaccgtccttgcgcggtcgagcctggcagtacctttccggtggaaaggtcaaactgcaacagaacccaggtaagtttgatgagctagacatgagtcctggggatcctaagtggctggacgttatcgaaagggatttacacagacagtttccattccacgaaatgtttgtctctcggggaggtcacgggcaacaggatctgttccgggtgctcaaagcttataccctgtaccgccctgaggagggctactgccaggcacaagcgccaatcgcggctgtgctcctcatgcacatgcccgctgaacaggccttttggtgtcttgttcagatctgcgaaaagtacctccctggctactactccgagaagctcgaggccattcagctggacggagaaatcctattctcgctgttacaaaaggtgtctcccgtggctcataaacatctgtccagacagaagatagatcccttgctttatatgacagagtggtttatgtgcgccttctcgcggaccctgccgtggtctagcgtactgagggtttgggatatgttcttttgtgagggagttaagattatcttccgcgtcggcctcgtactgttaaagcatgctcttggttcgcctgagaaagtgaaagcctgccagggacaatatgaaacaatagagagattaagatctctctcccctaagataatgcaggaagccttcctcgttcaagaagtcgtggaattgcctgttacggaacgccagattgaacgagaacacttgatccagttgagacggtggcaagagactcgtggggagctccagtgtagatcacctccacggcttcatggagccaaggccatacttgatgctgaacctggcccacgtcccgctctccagccatctccgagcatccgactacccttagatgccccactccccggatcaaaggctaaaccgaaaccccctaagcaggcccagaaggaacagcgaaagcagatgaagggtcgtggtcagctcgaaaagcccccagctccgaatcaagcgatggtcgtggcggcagccggtgatgcttgcccccctcaacatgtgcctccaaaagacagtgcccctaaggacagcgcccctcaggacctggctcctcaggtgagcgcgcatcaccggagtcaggaatccttgacttctcaggagtctgaggacacatacctgtag

SEQ ID NO: 243519 - DNA, 1548 bp, Artificial Sequence
  Description of Artificial Sequence: Synthetic coding sequence
atggccaagtccaacggcgagaatggacctcgggcacccgcagccggagagtcgctgagtgggacgagggaaagcttagcccaggggccagacgctgccaccacagatgagctttccagtctaggaagcgatagcgaagctaacggatttgctgagcgcagaatcgacaaatttggattcattgtgggctcgcagggagcagagggtgcaccatgcccactgctccatcggctcgaagaagtccctctcgaagtcctccgacagcgagagagcaagtggctggatatgttaaacaactgggacaagtggatggccaagaaacataagaagataaggttaaggtgccagaagggcatcccgccttcactccgagggagagcatggcagtacctctcagggggaaaggttaaactccagcaaaatcctggaaagttcgacgagcttgacatgagccctggtgatccaaagtggttagacgtgatcgaacgggatttgcaccggcagtttccgttccacgagatgttcgtgtctcggggtgggcacggacagcaggatctcttccgcgttctgaaggcttacactctttatcggcctgaagaggggtactgccaagcccaggccccaatagctgctgtgctgctgatgcatatgccagccgaacaggctttttggtgccttgttcagatttgtgagaaatatcttcccggttactatagcgagaagctggaggctattcaacttgatggtgagatactgttctcgctgcttcagaaggtctcacctgtcgcacacaaacacctgtctcggcagaagatcgatcccttgttgtatatgacggagtggttcatgtgcgccttcagccgcacccttccctggagttctgtcctgcgcgtttgggacatgtttttctgcgaaggcgtgaagataattttccgggtcggcttggttctgctgaagcacgcactgggaagtccagaaaaggtaaaggcatgtcagggacagtacgaaacgattgagcggctgcgaagcctttccccgaaaatcatgcaagaagcgttcttagtgcaagaggtggtcgaactgcctgttactgaacggcagatcgaacgggagcatctgattcaactccgaaggtggcaggagactcgaggagaacttcagtgccgatcgccccctcgactgcatggcgctaaggccattctggatgcagagccaggaccacgcccagcccttcaaccttcaccttccattcgtttacctcttgacgcccctctgcctggcagtaaggccaagcccaagcctcctaagcaggcacagaaagaacaacgaaagcagatgaaaggcagagggcaattagagaagccaccggcacccaaccaggcgatggtggttgcagccgctggagacgcatgtccacctcagcatgtcccccctaaggatagtgcgcctaaggattcagcaccgcaagacctggcaccacaggtcagcgcgcatcaccggagccaagagagcctgacctcccaggagtccgaagacacgtatctgtag

SEQ ID NO: 243520 - DNA, 2427 bp, Artificial Sequence
  Description of Artificial Sequence: Synthetic coding sequence
atggaaacaggcactgctcccctcgtcgctccccctcgtaggcacggagcacccgcagccccatccccccctcccagggggtccagggcaggcccagtagtggtcgtcgcccctggacctcccgtgaccacagccacgtcagccccagttaccctcgtagcacccggagaagcacgaccagcttgggtccctgggagtgccgaaaccagcgcgcctgccccagctcctgctcctgcccctgccccagcagtcactggttcaacggtggttgtgctgactctggaagctagccctgaggctcccaagccccaactaccatcggggcctgagtcccccgagcctgccgctgttgctggggttgagaccagccgcgctctcgccgcaggggcagactcccccaaaactgaggaagcccgaccatcccccgcacccggtcccggaactcctacaggcactcctaccaggactccttcccggacggcaccaggagccctgaccgctaaaccaccattagcccctaaaccaggcaccacagtggcctctggagtgacagcaaggagtgcgtctggccaagtgaccggaggtcacggggcagccgcagccacatctgcaagtgcaggacaggcccctgaagatcctagcggacctggaaccggccctagcggaacttgcgaagcccctgtggccgtggtcaccgtgacaccggctccggagcctgcagagaattcccaagatttgggctcaaccagctccctcgggccagggatcagtggccctcggggacaggcgccagacacattgtcttacctggattccgttagtttgatgagcgggaccctggaatcccttgccgacgacgtaagctcaatgggtagtgatagcgagataaatgggttggctttacgcaagactgataagtatgggttcctgggtggctcacaatactccggaagcctggagtctagcattcccgttgatgtggccaggcagcgcgagctgaagtggctggatatgttttctaactgggacaagtggctaagcagacgatttcagaaagtgaagttgcggtgtcgtaaagggatccccagctccttgagggctaaggcctggcagtatctgtccaatagtaaagaactgctcgaacagaaccctggcaagttcgaagagctcgaacgggctcctggggacccaaaatggttggacgtaatcgagaaagacctacatagacagttcccttttcacgaaatgtttgcagctcggggaggtcacgggcaacaggatctttacaggatcctgaaggcttatacaatttacaggcctgatgagggctactgccaggcccaagctcctgtggctgccgtgctgttaatgcacatgcctgcagaacaggccttctggtgcctcgttcagatttgtgacaagtatctgcctggctattactctgccggactggaggccattcaactggatggggagatattcttcgcactgcttcgtagagctagcccactggcgcaccgccatctgaggaggcaacgcatagaccctgtcctgtacatgaccgagtggtttatgtgtatcttcgccagaacactgccctgggcttccgtcctgcgcgtgtgggacatgtttttttgcgaaggcgtgaaaataattttccgggtggccctcgttctcctgaggcatacattaggatccgtggagaagttacggtcctgtcaggggatgtatgagaccatggaacaactcaggaacttgccacaacagtgtatgcaggaagatttcttggtacacgaggtcactaatttaccggtgaccgaggctttgatagagagagagaatgctgctcagttgaaaaagtggcgcgagacccgcggagaactccagtataggccctcaagacgacttcatgggtcgcgggctatccacgaggagaggcggaggcaacagcctcctttgggaccttcgagttcccttctgtcactgcccggactgaaatcaagaggcagtcgcgctgccggaggcgcaccgtcgccgcctcctcctgttcggagagcaagcgctgggcctgcacctggccctgttgtgactgctgaaggattgcacccttcattgccatccccaactggcaatagtactccactcggatcgtcgaaagagacccggaaacaggaaaaggagcggcagaagcaggaaaaagagcgccaaaagcaggagaaggagcgcgaaaaagaaaggcagaaacaggaaaaagaaagagaaaagcaagagaaagagagagagaaacaggagaaggaacgacagaaacaggagaaaaaggcccaggggcgaaaactgagcttacgaaggaaagccgacggcccacctggccctcatgacggtggagaccggccatcagccgaggctcgccaggacgcttatttttag

SEQ ID NO: 243521 - DNA, 1341 bp, Artificial Sequence
  Description of Artificial Sequence: Synthetic coding sequence
atggcccaggccttgggggaggacctggtacagccaccagaattacaggacgactcatccagcctgggctcagatagcgaattaagtggtcctggtccctaccgtcaagccgatcggtacggcttcattgggggatccagtgccgagccaggcccagggcatccccctgcagacctgattcggcaaagggaaatgaagtgggtcgaaatgacttcgcactgggagaaaacaatgtcacggcgatataagaaggtgaagatgcagtgcaggaaaggaattccttctgccctgcgcgcacgttgctggcctttgctctgtggtgctcacgtttgtcaaaagaacagtccaggtacatatcaggaattagctgaggcacccggtgacccacagtggatggagactatcgggagagaccttcatcggcagttccctctccacgaaatgttcgtgtcaccccagggtcatggacagcaaggcttattgcaagttctgaaggcgtatacactgtacaggcccgaacagggctactgtcaagcacagggcccagttgctgcagttctcttgatgcacctgccaccagaagaggcattctggtgcctcgttcaaatatgcgaggtctacctgcccggttactatggacctcacatggaggcggtgcgtctcgacgcagaggtgtttatggccctactgagacggctgttgcctcatgtacataaacatctgcagcaggttggcgtcggccctcttctgtatttgcctgaatggtttctttgtctttttgccaggtctcttccgttccccaccgtgctgcgagtgtgggacgcatttctaagcgaaggcgcaagagtgctgttcagggtgggattaaccctggtccggctggccttaggaaccgcagagcagaggggagcatgtcccggtctcctggaaactcttggagccctaagagccattcccccagcacaacttcaagaggaagcatttatgagccaagtccacagcgttgtgctgagtgagagggatctccagcgagaaatcaaggcccaattggctcagctgcctgactccgcccctgggccaccccctaggccccaggtaagacttgctggggctcaggccattttcgaagcgcagcagctggcaggcgtcaggaggggggcaaagccggaggttccaagaattgtagtccagccccctgaagagcctagacccccaaggcgtaagccccagacccgtggtaaaacttttcatggtttgctgacaagggcgagaggacctccaatcgaggggccaccacggccacagaggggctccacatcatttctagacacacgcttttag

SEQ ID NO: 243522 - DNA, 1341 bp, Artificial Sequence
  Description of Artificial Sequence: Synthetic coding sequence
atggcacaagccctgggggaagacctcgtgcagccccctgagctgcaagatgactcttccagcctcgggagcgattcggaacttagcggccctgggccataccgccaggccgatcgttacggttttatcgggggatcctcagctgagccgggacctggccacccacctgccgatctcatccgccaaagagagatgaaatgggtcgagatgacaagtcattgggagaagacaatgtccaggcgatataagaaggtgaaaatgcagtgtcgaaaaggcattccaagcgccctaagagcaagatgctggccactgctatgcggtgcacatgtgtgccaaaagaactcacctggcacataccaggaactcgccgaagcccctggtgacccacagtggatggaaacaattgggagagacctccatcgtcagttcccgctccatgagatgttcgtgagtccccaggggcatggccaacaagggctcctgcaggtcctgaaggcctataccctttaccggcctgagcagggttactgccaggctcagggccctgtcgcagcggttctgctgatgcatttaccgccagaggaagccttttggtgtttagtccagatttgtgaggtataccttcctggctactacggacctcatatggaggccgtgagactggatgcggaggtgtttatggcactgctacggcgattgctgccgcatgtccataaacatctgcagcaggtcggagtggggcctcttctgtacttacctgagtggtttctgtgcttgttcgccaggagcctcccctttcctacagtcctgagagtgtgggatgcctttctcagcgagggggctcgggtgctgtttcgggtcgggctgacgttggtgcggctagcactaggaaccgccgaacagagaggtgcctgtccaggcctcctagagaccctgggcgctctgcgtgccattccccctgcccagctacaggaagaagccttcatgtcccaggtacactctgtcgtcctcagcgagagggaccttcagcgtgagatcaaggcccagcttgcccagctgcctgattcagcgcctggtcccccaccacggccacaagttcggctggcaggcgctcaggcgatctttgaagcccagcagctagctggggtgagacgcggagctaagccagaagttcctaggatagtggtgcaaccacctgaagagcctaggcctcctcggagaaagccccagaccaggggaaaaactttccacggcctgctcacccgcgcacggggacctcctatcgagggcccaccgaggcctcaaaggggttcaacatcttttctggatacaagattttag

SEQ ID NO: 243523 - DNA, 2049 bp, Artificial Sequence
  Description of Artificial Sequence: Synthetic coding sequence
atgtgcccgggtctatacccatactcatccctgctcgagtatggcaggtctatgattatctatgagcaggagggggtgtacattcattcttcttgtggcaagaccaatgatcaggatggcctcatcagcggaatccttagagtgctcgaaaaagatgccgaagtcattgtggactggagacccctcgatgatgccctggacagctcctcaattctgtacgctcgaaaggactctagttctgtcgtggaatggacacaggcgcctaaggaacgagggcataggggaagcgaacacttaaatagctatgaagcggaatgggacatggttaacacagttagctttaagagaaagccccacacaaacggagacgctccttctcatagaaacggtaaatccaagtggtccttcctgtttagcctgacagacctgaagtctatcaagcaaaataaggaaggaatgggctggtcttacctggttttctgccttaaggacgacgtagttctgccggctctgcatttccaccagggagacagcaagcttctgatagagtcactcgaaaaatacgtcgtcctttgcgaatcacctcaggacaagcgaacactgttagtgaactgtcaaaataagagtctaagtcagtcttttgagaacctcctggatgaaccagcttacggattgatccaaaagattaagaaggatccatacacggcaacgatgatagggttttcgaaggtgactaattacatcttcgactccctccggggtagcgacccttctacccaccagcgtcccccatccgagatggccgactttctgagcgacgccatcccgggactgaaaatcaatcagcaggaggagcccggattcgaggtcattactagaattgacctgggcgagcgaccggtcgtgcagcgcagggaacccgtctcccttgaagaatggacgaagaacattgatagtgaaggcaggatcttgaatgtggacaatatgaagcagatgatatttcgcggaggcttatcgcatgcgttgagaaaacaggcatggaaatttcttctggggtacttcccatgggacagcacgaaggaggagaggacccaactccaaaaacagaagacggacgagtattttcgaatgaaactgcagtggaagagcatttctcaggaacaggaaaaacggaattcaaggctccgcgattatagatccctgatagaaaaggatgtcaaccgcactgatcgaacaaacaagttttatgaaggacaagacaacccgggtctgatcctgctccacgacattctgatgacttattgtatgtatgattttgatctcggctacgtccaaggtatgagcgacctactaagccccctgctatatgtgatggagaacgaggtggacgccttctggtgttttgcatcttatatggatcagatgcatcagaacttcgaggagcagatgcaaggcatgaagacccagttaatacagctgtctacactgctccggctgttagattccggattttgctcttatctagagtcccaggactctggttacctatacttctgctttcggtggctcctgatacggtttaagagggagttctctttcttagatattctccgcctttgggaggtcatgtggacagagttgccatgtaccaattttcacttgctgctctgttgcgcgatcttggagtccgaaaaacaacaaataatggagaagcattatgggttcaatgagatactgaaacacattaacgaactctccatgaagatcgacgtcgaggacattctgtgcaaagcagaagcaatttccctccagatggtgaagtgcaaagagctgccccaggctgtctgcgagatactgggccttcagggctcggaggttactacacctgacagcgacgttggcgaggacgagaatgttgttatgacaccatgccccacctccgcctttcaatccaatgccctgcccactcttagcgcatctggtgcgagaaatgacagccccacccagatccccgtttcctcggatgtttgtaggctcaccccagcctag

SEQ ID NO: 243524 - DNA, 1338 bp, Artificial Sequence
  Description of Artificial Sequence: Synthetic coding sequence
atgatcggcttctctaaagtgacaaattatatctttgacagtctccgcggatctgaccccagtactcatcagcgcccaccatcagaaatggcggacttcctgtcggacgcgattcccggtctgaaaattaaccagcaggaggagcctggttttgaggtcataaccagaatcgacttaggtgagagacccgtcgtgcaacgacgggaaccagtctcactggaggagtggacaaaaaacatcgactcagaagggaggattctcaacgtggacaacatgaaacagatgatatttaggggcggtctctctcacgccctgcggaagcaggcctggaaatttctattgggctatttcccatgggactctactaaggaggagcgcacccaattgcaaaagcaaaaaactgacgaatatttccgcatgaagctacagtggaagagtatcagtcaggagcaggagaaacgaaactcccggcttagagattatcggtctctaatagaaaaagacgttaaccgcacagaccggaccaataaattttacgaggggcaggataatcctggactgatcctcctgcacgatatcctgatgacatactgcatgtacgacttcgacctggggtatgtccaggggatgagtgatctgctcagcccattactctatgttatggagaatgaagtggatgccttttggtgctttgcctcttatatggatcagatgcaccagaactttgaggaacagatgcaaggcatgaagacccagctgattcagttgagcacactgctccggctgctcgattctggcttttgcagctatctagagtctcaagatagtggttacctctacttttgttttagatggttgcttatcagattcaaacgtgagttcagctttctggacatactcaggctctgggaagtaatgtggacggagctgccctgtaccaatttccacctcctcctttgttgcgcaattttggagtcagagaaacagcagatcatggaaaagcactatgggttcaatgaaatcctgaaacacatcaacgagctctcaatgaaaatagatgtcgaggacattttgtgtaaagcggaagcgattagcctacagatggtgaagtgcaaggaactccctcaagccgtgtgtgagatcttagggctccaaggctcggaggtgactactcctgactccgatgtgggcgaggatgagaacgtggtcatgacaccctgtcctaccagcgctttccaatccaacgcgctgccaaccctgagcgcatccggggctaggaacgacagtcccacgcagatccctgtatcctccgatgtgtgtaggctgaccccagcttag

SEQ ID NO: 243525 - DNA, 2025 bp, Artificial Sequence
  Description of Artificial Sequence: Synthetic coding sequence
atggccgctgcaggcgttgtgtccggcaagatcatttacgagcaagagggggtctacatccattcctcttgcgggaaaactaacgatcaagatggcctaattagcgggatactgcgagtgctggagaaagacgcagaagtgattgtggactggcgaccattggatgatgccttggattcctcatcaatcctttatgctcggaaggattcttcttcagtggtagagtggacccaagcccctaaggaaagaggccaccgagggagtgaacacctgaattcctatgaagctgagtgggacatggtgaacaccgtgtcatttaagcgtaaacctcacaccaatggagacgcaccgagtcacagaaacggcaaaagtaaatggagcttcttgttctcactgaccgacctcaaaagcatcaagcagaataaagagggcatggggtggtcctatctagtattttgtttaaaagatgacgtagtgttgccggctctgcattttcaccagggtgacagcaagcttttgatcgagtccctcgaaaaatatgtggtattatgcgagagcccccaggataagcgcaccctcttggtgaattgccaaaataagtcactgagtcaaagctttgagaacctgctggacgagccagcgtatggtttgatccaaaagattaagaaagacccatacacagccactatgattggcttttccaaggttaccaattatatcttcgactcacttagagggtctgacccaagcacacatcagagaccccctagcgaaatggccgatttcttgagtgacgcaattcctgggttgaaaatcaatcagcaagaggaacctggattcgaagtgattacccgaattgatctgggggagcgccctgtcgtgcagcgcagagagccggtcagcctggaggagtggaccaaaaatatcgactctgaaggacgaattctcaacgttgataacatgaagcaaatgatatttagaggcggactgtcccacgcactccgaaagcaagcctggaagtttcttctgggatactttccttgggactcaaccaaggaggagcgaactcaactccagaaacagaagacagatgaatacttcagaatgaagctgcagtggaagagcatatctcaggaacaggagaagcgcaacagccgactcagggattatagaagtctcattgagaaagacgtgaacagaacagaccgcactaacaaattctacgagggacaggacaaccccggacttattctgctgcatgatatccttatgacttattgcatgtatgacttcgacctggggtacgtacagggtatgtccgacttattatctcctttgctctatgtcatggagaatgaagtggacgctttctggtgtttcgccagctacatggatcagatgcatcagaatttcgaagaacagatgcaggggatgaagacccagttgatccaactcagcacacttctgagattgctggactctggcttctgctcctacctagaaagccaggactcaggatacctgtacttctgtttccggtggttgcttatcagattcaagcgcgagttttcttttctggacattttgcggctgtgggaggtcatgtggacagagctgccttgcaccaatttccacttactcctctgttgtgcgatcctggagtccgaaaagcagcagatcatggagaagcattatggattcaatgagatcctgaaacacatcaatgagctgtcaatgaaaattgatgtggaagatatattgtgtaaggcagaggcgattagtctgcaaatggtaaaatgcaaggagctgccgcaagcggtctgtgaaatcctgggactgcaagggagtgaagtcaccactcccgactcagatgtgggtgaagatgagaatgtcgtgatgactccatgtccaaccagtgcttttcagtccaacgctctccccaccttatctgcctcaggtgccaggaacgactccccaacacaaattccagtgagtagcgacgtatgccgccttacgcctgcttag

SEQ ID NO: 243526 - DNA, 2076 bp, Artificial Sequence
  Description of Artificial Sequence: Synthetic coding sequence
atggccgctgcaggtgtggtcagtggcaaaatcatctacgagcaggaaggagtatacatacactcatcatgtggaaaaacaaatgaccaggatggtttaatcagcggaatcctaagagtgctcgaaaaggacgccgaagtgatcgtcgactggaggccacttgatgacgccctggattctagttccattttatacgccagaaaggacagctccagtgttgtagagtggacccaggctcctaaggaacgagggcatcgtggctccgaacatctgaatagctacgaggccgaatgggacatggtcaatactgtttcgttcaagcgaaagccccatacaaacggagacgcccctagtcacaggaatgggaaatccaaatggagctttttattttcactgactgatctcaagagtatcaagcaaaacaaagaggggatggggtggtcttatttggtcttttgcctcaaggacgacgttgtcttgcccgcactgcatttccatcagggagattcaaaactgctcatcgagtctttagaaaaatacgtggtactgtgtgagtcccctcaggacaaacgaactctcctagtgaactgccagaacaagagtctgtcccagtccttcgaaaacttactggacgagccggcttacggactgattcaggcaggcctcttggatcgaaggaagctgctctgggctatacaccactggaaaaagattaagaaggatccttatactgcaacaatgatcggattttccaaggtgacaaactacattttcgatagcctgcgcggttcagatccttcaacacaccagagaccacctagcgagatggctgacttcttatctgacgccatacccggactaaaaatcaaccagcaggaggaacctgggttcgaagtaataacacggatagatttgggcgagaggccagtcgtccaacgacgtgaaccggtgagtcttgaggagtggaccaagaacatcgattcagaaggtcggatcctcaacgtggacaatatgaaacagatgatcttccgcggtgggctgtctcatgccctgcgcaagcaggcctggaagtttcttctcgggtatttcccatgggactctacaaaagaagagaggacccagttgcagaaacagaagaccgatgaatacttccggatgaaacttcaatggaaaagcatctcacaggagcaggagaaaagaaactcaaggctgcgggactacaggtctttgatcgagaaagatgtgaatcgtaccgatcggacaaacaagttctatgagggtcaggacaaccccggacttattttgttacacgacatcttaatgacctattgtatgtacgactttgacttgggatatgttcagggcatgagcgatttactgtcacctctgctctacgtgatggaaaacgaggtcgacgctttctggtgcttcgcttcctatatggaccagatgcaccaaaatttcgaggagcagatgcaaggaatgaagactcagctgatccagctgagtaccctgttacgcctgcttgatagcggcttctgctcctatctggagagccaggacagcggctatctatatttctgtttccgctggctcctgatacgctttaaacgcgaattctcattcctcgacatccttcgcctgtgggaggttatgtggacggagctgccatgcacaaattttcatctcctgctctgttgtgctatccttgagagtgagaaacagcaaattatggaaaaacactacggcttcaatgaaattcttaagcatatcaacgaattaagcatgaaaatcgatgttgaggacattttgtgcaaagctgaggctattagtctgcaaatggttaagtgcaaagagctcccccaggccgtgtgtgagattctgggtctccaggggagtgaggtgaccacacccgattctgatgtcggcgaagatgagaatgttgttatgacaccctgccctacgagtgccttccagagtaacgctctgccgaccctgtcagcttccggcgctcgcaatgactcaccaactcagattcctgtgagttctgacgtgtgtcgtttgaccccggcttag

SEQ ID NO: 243527 - DNA, 2133 bp, Artificial Sequence
  Description of Artificial Sequence: Synthetic coding sequence
atgcacaacatacggggtaataagcaggctcagggcaccggccacgagcctcccggagaggactccccccagagcggcgaaccacagcgcgaagagcagccgctcgcatctgatgcaagtacccccggaagagagcccgaggattcccctaaacctgcccctaaaccttccctgacaatcagctttgctcagaaagctaaaaggcagaacaacaccttccccttcttttcagagggcataacgcgcaaccgcacagcccaggagaaggttgccgcactggaacagcaagttctaatgcttacaaaggagctcaagagtcagaaggagctcgttaaaattctgcataaggcactggaagccgctcagcaggagaagagggcttcgtccgcgtatcttgcagcagccgaagacaaggaccgtttggagctggtgcggcacaaagtgcggcagatagccgagctggggagaagggtggaggcccttgaacaggaacgggagtcgctggctcatactgcgagcttgagagagcagcaggtccaggaactgcaacagcatgtccaactgttgatggacaaaaatcatgcaaagcaacaggttatatgcaagcttagtgagaaggtcacacaggattttacacatccgcctgatcaatcaccactgagacccgatgctgctaacagggatttcctctcccaacaaggcaaaatcgagcacttaaaggatgacatggaagcctaccgaacacagaattgcttcctgaactcagagatccaccaggtgaccaagatttggcggaaggtggccgagaaggagaaagccttattgaccaagtgcgcgtacctacaagctaggaactgccaggtggaatccaagtaccttgctggcctcaggcgcctacaagaggcactgggagacgaggcatctgagtgttccgaactgctccggcagctcgtacaagaagctctgcagtgggaggcgggtgaagcgagttctgacagcattgagttgtcgccaatcagcaagtatgatgagtacggttttctgacagttcccgattatgaggtcgaagatcttaagctgctggccaagattcaggcgttggagtctagaagtcaccacctcctggggttggaagcggttgatcgtcctctgagggagaggtgggcggctctcggcgacctggtcccttcagcagaattaaaacagcttctgagggctggagtgccacgtgaacataggcctcgtgtgtggcgatggttggtgcacctcagagtgcagcaccttcacacgccaggctgttatcaagagctactatcaaggggccaggcacgcgaacatcccgcagccagacaaattgagcttgacttaaataggacatttcccaataataagcacttcacttgcccgacaagtagcttccctgacaagctacgtcgcgttttattggccttttcctggcagaatccaacaatcgggtactgccaagggctgaacaggctggctgcaattgctttactcgtgctggaggaggaagagtcggcattttggtgcctggtggccattgtggagaccatcatgccggctgactattattgcaacactctcacggcatcccaggttgaccagcgagttttacaggacttactgtctgagaagttgcccagacttatggctcatttaggccagcaccatgtggacttgtcactggtgacatttaactggttcttagtcgtattcgctgactctcttatcagcaacatcctgctgcgtgtgtgggatgccttcttgtacgaaggaaccaaggtggtattcaggtacgccctcgcgatttttaaatataatgagaaggagatcctgcgcctacagaacggactcgagatttaccaatatctaagattcttcaccaagactatctcaaattcgcggaaactgatgaatatcgcattcaacgatatgaacccttttcgcatgaagcagctgcgccaactgcgtatggtacatcgcgaacggctggaagccgaactgagagagttggaacagcttaaagcagagtacctagaacgtcgggcatcccggaggcgagctgtttccgagggatgtgcctcggaagacgaagtcgaaggcgaagcgtag

SEQ ID NO: 243528 - DNA, 1407 bp, Artificial Sequence
  Description of Artificial Sequence: Synthetic coding sequence
atggaggcttacagaacgcaaaattgttttctgaacagcgagatacaccaggtcaccaaaatttggcggaaggttgccgagaaggaaaaggctctgctgacgaaatgcgcctacctccaagccaggaattgccaggtggaatcgaagtatctcgccggtctgagaaggcttcaggaagcactgggggatgaggcatcagagtgtagtgagctgctgagacagctagtgcaggaagccttacagtgggaggcaggcgaggcaagcagcgactctatcgagttgtcgcctatctctaagtacgatgaatacggttttcttacggtaccggactacgaagtcgaagacctaaagctattggccaaaatacaggcactggagtcgcgcagtcaccacttgcttggactcgaggccgtggacagaccgctccgtgagagatgggccgcactgggggacctcgtgccttccgcagaactgaagcagcttctgcgagccggagtgcccagggagcataggcctcgagtctggcgatggctagtgcacctgagagtgcaacacttgcatacgccagggtgctatcaggagctgttgtcccgcggacaggctcgagagcatccagcggctagacagattgaactggacctgaaccgaactttcccaaataataagcactttacatgccccaccagctcttttccagataagctgagacgggtgcttctggcattttcttggcaaaaccccaccatcgggtactgtcagggactcaatagactcgcagccatcgcactgctggtcctggaagaagaggaaagcgcattctggtgcttggtggccatcgtggaaacaataatgcccgctgattactattgcaacactctgacggcgtctcaggtcgaccagagggtcctgcaagacctgctgtcggaaaaattgcctaggcttatggcccatctcgggcaacaccacgtggacctgtcactggtaacttttaattggttcttggtcgtgttcgctgactccctgatctcaaacatcctactgagggtctgggatgcattcctctacgagggcacgaaggttgtcttcagatatgccttggccattttcaaatataatgaaaaagaaattctgcgactgcagaacggattagagatttatcagtacctcagattttttactaaaaccatttctaattcacggaaactgatgaacatagcctttaatgacatgaacccctttagaatgaagcagctgaggcagctgcggatggtgcaccgggaacgcctggaggccgaactccgcgagctggaacagctcaaagcagaatacctcgaaaggagagctagccgacgtagagccgtttccgaggggtgcgcatccgaagatgaggtggaaggggaagcatag

SEQ ID NO: 243529 - DNA, 2583 bp, Artificial Sequence
  Description of Artificial Sequence: Synthetic coding sequence
atggaaggagctggagaaaacgccccagaaagctcttcttcagctcccggatctgaagagagcgccagagatcctcaggtccctccacccgaggaggagtccggagattgcgcaagatcacttgaagccgtcccaaagaaactttgcgggtacctttctaagttcgggggaaaaggccctattagaggctggaagtcgcgctggttcttttatgacgaaagaaaatgtcagctatattactcaagaactgcccaggacgcgaacccactggattccattgaccttagcagcgccgtgtttgattgtaaagcagatgcagaggaaggaatttttgagatcaagactcctagccgcgtgattaccctgaaggccgcaacgaaacaggctatgctttactggctgcagcagcttcaaatgaagcgatgggaattccataactcccctcctgctcccccagctactccagatgccgcactcgccggtaatggacccgtcctgcatctagagctgggacaggaggaagccgagctggaagaatttctttgccccgtgaagacgccaccaggcctcgtcggggtcgccgcagctctgcagcctttcccggcactccagaatatatcccttaaacatctgggaaccgagatccaaaatactatgcacaacatcaggggtaacaagcaggcacaaggaactggccacgagccgcctggagaggacagcccacagagcggggagccgcagcgagaagagcagcccctggcctctgacgcaagtaccccgggacgcgagcccgaggactctccaaagcctgccccaaaaccatctctgactatttcttttgcccagaaagctaagagacagaataacacatttccattcttcagcgagggtattacccggaacaggacagcacaggagaaggttgccgctctggagcagcaggtgcttatgctgactaaggaactgaaatctcagaaagaactggtgaaaatacttcacaaggcccttgaggccgcacagcaagaaaaacgggcaagcagtgcatacctggcagctgcggaggataaggatagactggagctggttcggcataaggtgagacagatagctgaattaggacggagagtcgaggcacttgagcaagagcgggagagccttgcccacaccgcaagtctgcgcgagcagcaggtgcaggaactgcagcagcatgttcagttgttaatggacaaaaatcacgccaaacagcaggtcatctgcaaactgagcgagaaagttacacaggactttacccacccgcctgaccagagccccctgcgccctgacgccgctaaccgggacttcctgtctcagcagggtaagatcgagcaccttaaggacgacatggaggcctatcgtacacaaaactgttttttgaacagcgagatccaccaggtgacaaagatctggagaaaagtcgccgagaaagagaaggcgcttttgactaagtgcgcttatctgcaggctcggaactgtcaggtggagagcaagtatcttgctggtttgcgtcgacttcaagaggcactgggcgacgaagcttccgaatgctctgagttgctgcgtcagttagtacaagaagccctgcagtgggaagcgggagaggcctccagcgattccattgagctgtctcccatctcgaagtacgacgagtacggatttctgacagtccctgactatgaggtggaggatctgaaactgctggcgaagatccaggccctggagtcccggtcccaccatctgcttggattggaggctgtggaccgtccgcttcgagaaagatgggcagccctcggagatctggtgccatccgctgaactgaagcagctgctgagggctggcgttcctagggaacaccggcctcgcgtgtggaggtggctggttcacctgagggttcagcatctgcacacaccgggttgttaccaggagctgctctcccgcggtcaggcccgagagcatcctgctgccaggcagatcgaactggacctgaatagaaccttccccaataacaagcactttacctgtccaacttcaagctttccagataagctgcgcagggttctactcgccttcagctggcagaatccaaccattggctactgtcaggggctgaatcgtctggccgctatagccctgctggttctggaggaggaagagtctgctttttggtgccttgttgcgatcgttgaaacgattatgcccgcagattactattgcaatacccttacagccagccaggttgatcagagggtactgcaagatttactttctgagaaattaccccgactcatggctcacctcggccagcaccatgtcgatctgtctctcgttactttcaattggttcctcgtggtgtttgcagattccttgatctccaatatactgctgcgagtctgggatgcgtttctgtatgaggggactaaggtcgtgtttcggtatgccctcgcaatcttcaagtataatgaaaaagaaatcctaaggctccagaacgggttggagatctatcagtatttgcgtttttttacaaagacgatcagtaattctagatag

SEQ ID NO: 243530 - DNA, 2754 bp, Artificial Sequence
  Description of Artificial Sequence: Synthetic coding sequence
atggaaggagctggcgaaaacgccccagagtccagctctagcgccccaggctcagaggagtctgcccgtgacccccaggtccctccacctgaggaagaatctggagactgcgcaagaagtcttgaagccgtgcccaaaaaattatgtgggtacctgtccaagtttgggggtaagggacccattcgcggatggaagtcacggtggtttttctatgacgaacgcaagtgccagttgtattactccagaaccgcacaagatgctaaccccttggattcaatcgacttgtctagtgcagtttttgattgcaaagctgacgccgaagaagggattttcgagattaaaacccctagtcgtgtgatcacactaaaggcagccacaaagcaggcaatgctgtattggcttcaacagctccaaatgaagcggtgggagtttcataactctccacccgcacctccagccactcccgatgctgctctggcagggaatggtccagttctccatcttgagctgggccaggaggaggccgagctggaggagtttctgtgcccagtgaaaacccccccagggctggtgggcgtggctgcggctctgcaacccttccccgcacttcagaatattagcctgaagcatctgggaaccgagattcagaataccatgcataacatccggggaaacaaacaggcacagggcactggacacgagccccctggagaagactctcctcagtccggagaaccacagcgggaagaacagccgcttgcgtccgatgcctcaacccctggcagggaacctgaagactcgccaaagccagcacccaagccaagcttaactatctcgtttgctcagaaagccaaaagacaaaacaataccttcccgttcttcagcgaggggattacacgcaaccggacagctcaggaaaaggtagccgctttggagcaacaggtgctgatgttgaccaaggagctcaagtctcagaaggaactggtgaagatcctgcacaaggccttagaggccgctcagcaggagaaacgggcatctagcgcctacctggccgctgctgaggacaaagataggctggagttggttaggcacaaagtgagacagatcgctgagctcggtcggcgagtagaagccctggagcaagagagagagagcctggctcacaccgcctccttaagggagcaacaggtacaggagctgcagcagcacgtccagcttctaatggacaaaaaccacgctaaacaacaggtgatctgcaagttgtcggagaaagtcactcaggacttcacccaccctccagaccagtccccactcagacctgacgctgctaaccgcgactttctatcccagcagggaaagatcgagcatcttaaggatgacatggaggcgtatcgcacccaaaactgctttctcaattctgagattcatcaagtcacaaaaatctggcggaaggtggccgaaaaggagaaagcgctcctaacgaagtgtgcttacctgcaggcccgtaactgtcaggtggagtctaagtacctagctggcttgcggaggctgcaggaggctctaggggacgaggcaagtgaatgctctgagctactgagacagctcgtgcaggaggcgctgcagtgggaagctggggaagcgtcatcagattcaatcgagttgagccctatcagcaaatatgatgaatatggatttttgactgtgcccgactacgaagtggaagacctcaaacttttggctaaaatacaggcactggagagccgctcccatcatctactggggctggaagccgtcgatcggcctctgagggagcgttgggctgccttaggggatcttgtgccatctgccgagctgaaacagcttctgagagccggtgttcccagggaacatcgacccagagtctggcgctggctggttcacctcagagtgcagcaccttcacacccccggatgttatcaggaattactgtccagggggcaggctcgtgaacatccagcagccaggcagatcgagctcgacctcaatcgaacatttcccaataacaagcattttacctgtccgacaagttccttccctgataaacttcggagagtgcttctagctttcagctggcaaaaccccactattggatactgtcagggcctaaaccggctcgccgctattgcactactcgtccttgaggaggaggagtccgccttttggtgtctggtggccattgtggaaacaatcatgccggcagactattattgtaacacgttgactgcatcacaggttgaccagcgggtcctgcaggacctccttagcgaaaaacttccacgcctcatggcccacctggggcagcatcacgtagacctgagtcttgttacattcaattggtttcttgttgtattcgcagattcgctcatttctaacatactcttaagggtttgggacgccttcctgtacgaaggcactaagtataacgaaaaggagattctccgcttgcagaacgggcttgagatttaccagtacctgagattcttcactaagactatcagcaacagtcggaagctgatgaacatcgcatttaacgacatgaacccttttcgtatgaaacagctacgacagctcagaatggttcacagggaacggctcgaggcagagttaagagagcttgaacaactgaaagcagagtacctggagcggagggcaagccgcaggagagcagtctcggagggatgtgctagcgaagatgaggtcgaaggcgaggcatag

SEQ ID NO: 243531 - DNA, 1287 bp, Artificial Sequence
  Description of Artificial Sequence: Synthetic coding sequence
atgccttcaggatgctacgtccctcggagcgagccaaggctcctgccagctcccccacccgctggtgcaagagtgggcgcactcagaagcgctcaaggcgatggccctacctccggccattgggatggcggagcagagaaggccgattttaatgcaaagcgcaagaaaaaagtggcggaaattcatcaggccttaaatagcgaccctaccgatgtcgcggcactgcgcaggatggccatttctgaaggcggattactgaccgatgaaattaggaggaaggtatggccaaagctcctcaatgtcaatgctaacgatcccccacctatttctggcaaaaacctacggcagatgtccaaggattaccagcaggtcctcctcgatgtccggaggtctctacgcaggtttcctcccggaatgcccgaagagcagcgcgaaggcctgcaggaggaacttattgacattatactcctgattctcgaaagaaacccccagctgcattattaccagggatatcacgatatcgtggttaccttcctgctggtcgtaggggagaggctggccaccagcctggtggaaaagctttccacccaccaccttcgggatttcatggatccaacaatggacaacacaaaacacattctcaactatttgatgcccattatcgaccaggtgaaccctgaacttcacgatttcatgcagtccgctgaagtgggcacaatctttgccctgtcttggctcataacgtggttcggacacgtgctaagcgattttcgccatgttgtgcggttgtacgatttttttctggcatgccaccccttaatgcctatctatttcgctgcagtcattgtactctatagggaacaggaggtgctggattgtgactgcgacatggcatcagttcaccatctacttagccagattcctcaggaccttccatacgagacactgataagcagagccggagaccttttcgtgcagttccctcccagtgagctggcccgagaggccgctgcacaacaacaggcagagcggacggcagcgtccacctttaaagacttcgaactggcctcggcccagcagcggcctgacatggtcctgaggcaaagatttagagggttattgcgtcctgaggacaggaccaaggatgtgctgaccaagcccaggaccaatagattcgttaaacttgcagttatgggcctgacagtcgccctgggtgctgccgcactcgccgtagtgaaatccgctctcgaatgggcaccgaagttccagctccagctatttccttag

SEQ ID NO: 243532 - DNA, 1212 bp, Artificial Sequence
  Description of Artificial Sequence: Synthetic coding sequence
atggctctgagatcagcgcagggagacgggccaacttctggccactgggacggaggagctgaaaaggcggactttaacgccaagaggaagaaaaaagtcgccgagattcaccaagctctgaactctgacccaactgacgtcgcagctctacggagaatggcgatcagcgagggaggactgctgaccgatgagatccggagaaaagtgtggcccaaactactgaacgttaatgcgaacgatccccctcctattagcgggaagaatctgcggcagatgtccaaagactaccagcaagtattgttagacgttagaaggagcctgaggcggtttcctcccggaatgcctgaggagcagcgtgaaggcctacaggaggaactgatcgatattattctgcttatcctcgaacgcaacccccagttgcactactaccagggttaccacgacatagtcgtgactttcttgctggtagtcggagagagattggccaccagcctcgttgagaaacttagcactcaccaccttcgagatttcatggatcccaccatggacaacacaaagcatatcctcaactacttgatgcctatcatagatcaagtcaacccagagctccacgattttatgcagtccgccgaggtggggactattttcgccctgtcctggcttattacatggttcgggcacgtcctgagcgacttccggcatgtcgttaggctttatgacttttttctggcctgccaccccctcatgcctatctattttgctgccgtcattgttctctatcgagagcaggaagtgctggattgcgattgtgacatggctagtgtacaccacctgctgagccagattcctcaggatttgccgtacgagactttgatctctagagcaggtgatctcttcgtccagttccctccttcagagctggcaagggaagccgctgcacagcagcaggccgagaggacagctgctagcacctttaaggatttcgaactggcctccgcacagcagagaccagatatggttctacgccaaagattccgagggctgctcaggcccgaagatcggaccaaagacgtactgactaagcctagaaccaacaggttcgttaagctcgctgtgatgggacttactgtggccctcggtgctgcggctctggctgtggtcaaatcagcgctggagtgggctcctaaattccaattacagctgttcccctag

SEQ ID NO: 243533 - DNA, 1212 bp, Artificial Sequence
  Description of Artificial Sequence: Synthetic coding sequence
atggctctacgctcagctcagggtgatggccctacttccggtcactgggatggcggagctgaaaaagccgatttcaacgcgaagcggaaaaagaaggtggcagaaatacaccaggctctgaactcagaccccacagatgtggctgccctcaggcgcatggcaatatctgaaggcggactcttaaccgatgaaattcggaggaaggtgtggccgaagctactcaacgtcaacgccaacgatcccccacccatcagtggaaagaatctgaggcaaatgagtaaagactaccaacaggtgcttctggacgtccgtcggagcctcaggcgctttcccccaggcatgcccgaggagcagcgggaaggcttacaagaggaacttatcgacattatacttcttatcttggagcgcaacccgcagctgcactactatcagggataccacgacatcgtggtaactttcctgctggtggtcggggagaggctggccacatctctggtggagaagctgtctacccaccacttgcgggatttcatggaccccactatggacaacactaagcacatcctcaattacctgatgcctatcatcgaccaggtgaatcccgagctgcacgattttatgcagagtgccgaggtcggaacgatattcgcgttgtcctggctgattacgtggttcggtcacgtgctgtctgatttccgacatgtggttagattatacgacttctttctcgcctgccaccccctcatgcctatatatttcgcagcagttattgtactctaccgggaacaggaagtgttggattgcgattgcgatatggcctccgtgcaccacctgcttagtcagatcccgcaggacctgccttatgaaactctaattagccgcgctggagacctttttgtccagttcccccctagcgaacttgcacgcgaagctgctgcacagcagcaggcagagcggaccgccgcatctaccttcaaggactttgagctggcttccgctcaacaacggcctgacatggtgctgcgccagcgctttcgcggtctgctgaggccggaagatcggacgaaagatgttctgaccaaacccagaacaaatcgattcgtcaagctcgcagtaatgggtctaactgtcgccctgggggcagctgccctagcggtcgtgaagtccgcactggaatgggcccctaagttccaactgcagctgttcccctag

SEQ ID NO: 243534 - DNA, 1662 bp, Artificial Sequence
  Description of Artificial Sequence: Synthetic coding sequence
atggattctcccggttacaattgcttcgtggacaaggataagatggacgccgctatccaggacctaggaccgaaggagctgtcttgtaccgaactgcaggagctaaagcagctggctagacagggctactgggcacaatctcacgccttacgcggaaaagtctaccagcggctcattagagatattccttgtcgcacagtgactccggatgccagcgtgtactctgatatcgtcggtaaaatcgttggcaaacattcttcatcatgcctgcctttgccggagttcgtggataatacccaggtgccctcttactgtttaaacgcccgaggggaaggagcagtgcggaaaatccttctctgcctcgccaaccagtttcccgacatttcgttctgtcccgcactgcctgccgtggtggctctgctgcttcattactccattgacgaagccgaatgttttgagaaggcctgccgtatactggcctgtaatgaccccggacggaggctgatagaccagagcttcttggctttcgaatcctcctgtatgacctttggtgatctcgtgaacaagtactgccaggccgcacacaaactgatggtggcagtgtccgaagatgtgctccaggtctatgcagactggcagcgctggctgtttggagaattgccactgtgctacttcgcgcgagtgtttgatgtttttttagtggagggatataaggtgttgtatcgggtcgctctggccatcctgaagttcttccataaagtgagagctggccagcctttagagtcggacagtgtgaagcaggatattagaacctttgtgagggatatcgccaaaactgtctcaccggaaaagctgctagaaaaggctttcgccattcgccttttcagcagaaaggagatccagttgctccagatggcgaacgagaaagctcttaaacagaagggcatcaccgttaagcagaagcggcagtttgttcatcttgcggtgcacgccgaaaatttcagatcagagattgtgagcgtacgtgaaatgagagatatttggtcttgggtcccagaacgattcgcactgtgtcagcccttactgctgttttccagcttacaacacggatattccctggccagattctactttcagtgtgagggacatgagcctactttgctccttatcaagaccacacaaaaagaagtctgcggagcttatctgagtacagactggagcgagcgcaataaatttgggggtaagctggggttctttggaaccggtgagtgttttgtgtttcggcttcagcctgaggtacagagatacgagtgggttgtgatcaagcaccccgagcttaccaagccgcctcccctgatggccgctgagccgaccgcacctttgtctcacagtgcctctagcgacccagccgatcggctgtcgccttttttagcagccaggcatttcaaccttcctagcaaaactgagtcaatgtttatggcgggaggatccgattgcctcatcgtgggcggaggcggaggacaagccttatacatcgatggagatctgaaccgaggccgtacttcccattgcgacacattcaacaatcaaccgttgtgttctgagaatttcctgattgccgctgtggaagcttggggttttcaagatccagatacgcagtag

SEQ ID NO: 243535 - DNA, 1680 bp, Artificial Sequence
  Description of Artificial Sequence: Synthetic coding sequence
atggatagtccgggatacaactgcttcgtcgataaagataagatggacgccgctatccaggaccttgggcctaaggagctctcatgtactgaattacaggagctcaagcaattggctcgccaaggatattgggcacaatcacacgcccttcggggaaaggtgtatcagagactgatccgagacatcccttgtagaacagtaactcccgacgcttccgtctacagcgatatagtcgggaagattgttggcaagcactcatcttcctgtttacccctaccagagttcgtggataacacacaggtgccttcttattgtctcaatgcaagaggggaaggtgctgtgaggaagatattgctttgtttggccaatcagtttcctgatataagtttttgtccagctctgcccgctgtggtggctctcctcctgcactatagcatcgatgaggccgaatgtttcgagaaagcatgccggattttggcctgtaacgaccccggaagacgactgatcgaccagagcttccttgcttttgagtcatcctgcatgacctttggcgacctggtgaacaaatactgccaggcagcacataagctgatggtcgctgtaagcgaggatgttttgcaggtgtatgcagactggcagagatggttgtttggtgaactccctttatgctattttgccagggtgtttgacgtgtttcttgtcgagggctacaaagtcctgtatagagtggcgctcgcaattttgaaattcttccacaaagtgagggctggacagcccttggagtctgacagcgtcaagcaagatatccgtacttttgtccgggacatcgctaaaaccgtctccccggaaaaactgctggagaaggcattcgcaatcaggctgttctccagaaaggaaattcagctgttacagatggccaacgagaaggcgctgaaacagaaaggcatcacagtgaaacagaaatcagtgtcgttatcgaaacgccagttcgtgcatctggcggtccatgcggaaaactttcgttccgagattgtaagcgtccgggagatgagggacatctggtcctgggtcccagagcgctttgcgctatgccagccattgttgctcttcagctccctgcagcacgggtactccctggcccgattttatttccagtgtgaggggcatgagccaacccttctcctgatcaagactactcagaaggaggtgtgtggagcatacctctcaaccgactggtccgagcggaataagttcggaggcaagctggggttcttcggcaccggcgaatgcttcgtcttccgattacagccagaggtccaacgctacgaatgggtcgtcattaagcaccccgaactcactaagccccctcctctgatggcagcggaacccactgctcctctctctcacagtgcgtcgagcgaccccgctgataggctgagcccgttcctcgcggctagacacttcaacttaccatccaagactgaatcaatgttcatggctggaggaagtgactgccttattgtcggtggaggcggtggccaggccctctacattgacggggatctgaaccggggtaggacaagccactgcgatacatttaacaaccagcccctttgctctgaaaactttctcattgccgcagtggaggcatggggattccaggatcctgacacacagtag

SEQ ID NO: 243536 - DNA, 2067 bp, Artificial Sequence
  Description of Artificial Sequence: Synthetic coding sequence
atggctacggcctctggcgcatcagatttgagcgggagcggcgctcctcctcctggcgtgggtgctcaggcagccgcagctgctgaggaggaggagcgagaggtcgtcagagttcgcgttaagaagtgcgaatcttttcttcctcctgagttcaggtctttcgcagtcgacccacagataacctcccttgacgtcctgcagcacattctcatcagggcattcgacctgtccggcaaaaagaattttgggatctcatatcttggacgggacagactgggccaggaggtgtatctgtctctcctaagcgattgggatctgtccacagcatttgccaccgccagtaagccatacttacagttaagggtggacatccgcccatctgaagactctcccctactggaggactgggatatcatcagccccaaggatgttattggaagtgatgtgcttctggcagagaaacggtcctctctcaccaccgccgcattgccgttcactcaatcaatcttaacccaggtaggcaggacgctaagcaaggtgcagcaggtgctgtcatggtcctacggggaagacgttaagccattcaagccccctctctctgacgcggaatttcacacttatttgaatcacgaaggtcagcttagcagacctgaagagctcaggttgcggatctaccacgggggagtcgaacccagcttgcggaaagtggtgtggaggtatcttctgaatgtttatccggatgggctgaccggaagggagaggatggattacatgaagagaaagtcccgcgagtacgaacagttaaagagtgaatgggcacagcgcgctaacccggaagatctggaatttatcagatcaaccgtgctaaaagatgtcctccggaccgacagagcccacccgtattatgctgggcctgaagacgggccacacctacgcgctctgcacgacctcctgactacatacgccgtgacccatccgcaagtcagctactgtcaagggatgtcagacctcgccagccctattttggcagtcatggaccatgaagggcatgcattcgtatgcttttgcggcattatgaagaggctggcagccaacttccacccagacggcagggccatggccacaaagttcgcccacctaaaacttctattgagacacgcagatcctgatttctaccagtatttgcaggaagctggagccgacgacctgttcttttgttacagatggctccttctggaactgaaaagagagttcgccttcgatgatgcattgcggatgttggaagttacatggtcttccctcccgcctgatcccccagagcatgaggtggagcttgttgggccaccctcacaggtggccgatgccggatttggcggtcatcgaggatggccagtacgccagcgccatatgctgcggcctgccggaggcggaggatccacatttgaagacgctgttgaccatctcgcaactgctagtcagggaccagggggtggaggaagattattgagacaggcctccttggatgggctgcagcagctgcgcgataatatggggtccaggcgggacccgttagtccaacttccccaccccgcagcactgataagctcgaagtcgctgtcagaaccactgcttaattccccagatcctctcctcagtagcttcagccaccccgatagtccttcttcatcgagcccgccaagcacccaagaagcttcaccaaccggggatatggcagtgggttcccctctcatgcaagaggttggcagccctaaagatccaggaaagtccttacccccagtgccaccgatgggcctcccaccaccgcaggagttcggcaggggcaatccgtttatgctgttcctctgtctcgccatcctgctggagcaccgtgatcatatcatgcggaatggactcgactataacgaactggcgatgcatttcgatcgacttgttagaaaacatcatctgggcagagtgctgcgtcgagccagagctctgtttgcagattacttacagtctgaagtgtgggattctgaggaaggagccgaagcaactgctgcctcatag

SEQ ID NO: 243537 - DNA, 693 bp, Artificial Sequence
  Description of Artificial Sequence: Synthetic coding sequence
atggccacagcctctggagcctccgatttgagtggctcaggcgctccccctcccggagtgggcgctcaggcagcagctgctgctgaagaggaagagagagaggtggtgagagttagagtgaaacatggggacggcgcacctggtggcctcccccacgtcttttctccccaaaagtgcgaatcctttttacccccagaattcagatcttttgcagtcgacccccagatcacaagcttggacgtgttgcagcacatcttgatcagagcatttgatctgtccggcaaaaaaaactttggtatctcttacctgggcagggatcgcctgggccaggaggtctatctaagcctactaagcgattgggacttgtctactgctttcgccaccgccagcaaaccttacctgcaactcagagtggacatccggccttctgaagatagccccctcctcgaagattgggatatcattagtccgaaggacgtgatcggctccgatgtgttactggcagagaaacgctcgtcccttaccaccgctgccttgccattcacccagagcattctgacccaagtcggacgcaccctgtcaaaggttcagcaagttctcagttggtcctatggcgaggatgtaaagccctttaaacctcctttgtccgacgcggaatttcatacgtacctcaaccacgagggtcagctctag

SEQ ID NO: 243538 - DNA, 303 bp, Artificial Sequence
  Description of Artificial Sequence: Synthetic coding sequence
atggcgactgcttccggggctagcgatctctctggttccggagctccccctcctggagtcggtgctcaggccgctgccgctgccgaggaagaggagcgcgaggttgtccgcgtgagggtgaaaaaatgcgagtcctttctcccacctgagttccgttcatttgcagtcgacccgcagattacctccctagatgtgctacagcacatcctcatccgtgcgttcgacctctctgggccaatcgcacgcaggttgggccacaatcagccccagcgctgccactggctgcggagggtagcagggtag

SEQ ID NO: 243539 - DNA, 1305 bp, Artificial Sequence
  Description of Artificial Sequence: Synthetic coding sequence
atggactatatgaaacgcaaatcacgcgaatatgagcagctaaaatcggagtgggcacagcgcgctaatcccgaagacctggaatttatccgcagtactgtgctgaaagacgttttgcggactgaccgcgctcatccatattacgccggacctgaagatgggcctcatctgagagcactgcacgatctgctaactacctatgccgtgactcacccacaggtgtcctattgtcagggtatgagcgatttggcatctccaatcctagcggtcatggaccacgagggccatgcattcgtctgcttttgtggaatcatgaaaaggctggctgcaaattttcatcctgatgggagggcaatggcgaccaagttcgcccatctgaagctactgttgcgccatgcagatcctgacttttatcagtaccttcaggaagcaggcgctgatgacctgtttttctgctataggtggctgttgctcgaactgaagcgcgaattcgctttcgacgatgccctcagaatgctggaagtgacctggtccagcttgccacccgacccacccgaacacgaggttgagctcgtgggccctccgagtcaagttgccgacgccggtttcggtggtcacaggggctggccagtgcgacagagacatatgttacgccctgcaggcggtggcggaagtaccttcgaggacgcagtagaccacctggctactgcaagccaggggcctgggggaggcggacgcttgttaaggcaagcatccctggacggcttgcagcagctgagagacaacatgggctctcgaagggatcccctagtacaattgccacatcccgctgcattaatcagctctaagtctctgtctgaacctctcctgaactcacccgacccccttctatcctctttttcccacccagattccccgtccagcagctctccccctagcacacaggaggcaagcccaaccggtgacatggccgtgggaagcccgctgatgcaagaagtggggagtcctaaggatcctggcaaaagtctgcctcccgtccccccaatgggcctgccaccccctcaggagttcggtcggggaaatccatttatgctgttcctgtgtttggcaattcttttagagcatagagaccacattatgagaaacggcttggactataacgaactggccatgcattttgacaggctggtacgaaagcaccacctgggacgggtcttgcggcgagccagggccctattcgcagattatttgcagagtgaggtctgggattccgaagagggcgcagaagccactgccgcatcctag

SEQ ID NO: 243540 - DNA, 876 bp, Artificial Sequence
  Description of Artificial Sequence: Synthetic coding sequence
atggatgtcgtggaggtggcgggaagctggtgggcccaggaaagggaggatatcataatgaagtatgagaagggtcatcgcgctggactgcctgaggacaaagggcctaagccattccggagctataataataacgtggaccacttgggcatcgtgcacgaaaccgaactgccacctctgaccgcacgtgaggcgaaacagatcagacgggagatctcccgcaaatctaagtgggtcgacatgctgggggactgggagaagtataaaagctcccgcaagctgatcgaccgcgcatataaaggaatgcctatgaatataaggggacccatgtggtccgttctcctgaacattgaggaaatgaaactgaaaaatccaggcaggtaccagatcatgaaggaaaaaggcaagcgctcaagcgaacatatccagcgtatagaccgggacgtgagtggcaccctcaggaaacacatatttttcagggatcgctatgggacaaaacaacgagaactgctgcacatcctgttagcttacgaggagtataacccggaagtgggatattgtagggatctatcacacatcgccgcattgttcctgctgtatttacccgaagaggatgctttctgggctttagtccaattattggcaagcgaacgccacagcttgcagggtttccattcccccaacggcggtaccgtgcaggggttgcaggaccagcaggagcatgtagtcgctacttcccagccaaagactatggggcatcaatccgcgtcccggaggcgaccaggggtggccagaggccatgttttcgctactggttctctgatccccggtcccggaatgcggaccctctgttcaagcatcctcggcccactatag

SEQ ID NO: 243541 - DNA, 1650 bp, Artificial Sequence
  Description of Artificial Sequence: Synthetic coding sequence
atggatgtggttgaggtcgcgggtagttggtgggcccaggagcgggaggacatcatcatgaagtacgagaagggccaccgagcagggttgcctgaagataaaggcccaaaaccttttcgctcttataacaacaatgtcgaccatctcggtatagtgcatgagacagagctgcctccattgactgccagggaagccaaacagatccgacgtgaaatctccagaaagagcaaatgggttgacatgctcggcgactgggaaaaatataagtctagccggaaactgattgaccgggcttacaagggtatgcctatgaatattaggggccctatgtggagcgtgctcctgaacattgaagagatgaagctgaagaacccaggccgttatcagattatgaaggagaaagggaaaaggagctcggagcacatccagcgcatcgacagagatgtgtctggaacgctgaggaagcacatcttctttcgagacagatacggtacgaagcagagggagcttctccatattctcctagcatacgaggagtataatccggaggtggggtactgtcgcgacctgtcgcatatcgcagccctattcttgctatacctcccggaagaggatgccttctgggccctagtgcagctgttagccagtgagcggcactcattgcagggatttcatagtcctaacgggggaaccgttcaggggttacaggatcagcaggagcacgtggtcgccacctcgcaacctaagactatgggccatcaggataagaaggacttatgtggccagtgtagccccttgggctgtttgattaggattctcatcgatggcatctccctgggactgactctgcgcctgtgggacgtgtacctggtggaaggggagcaggcgcttatgccgattacacgaattgcttttaaggtgcagcagaagaggctcacaaagacttctaggtgtgggccttgggcgagattctgcaatcggtttgtggatacttgggctcgggatgaagacaccgtcctcaaacacctgcgcgcatcaatgaaaaagctgactcggaagcaaggggatctgccccctcctgcaaagccggaacaaggcagttccgcgagtaggccagtgcccgcttcccgcggaggtaagacgttatgtaaaggcgacaggcaggctcctccaggaccacctgcgagattcccccgtcctatttggtccgcctctccaccaagagcgcctaggtcttccactccgtgtccaggtggagccgttagagaggacacgtatccagtgggaacccagggtgtgccatctcctgctctggcccaagggggaccacaaggctcttggcgttttttacagtggaactcaatgccaaggcttcctaccgatctcgacgtggaagggccttggtttaggcactacgatttcagacagtcctgttgggtccgcgctatcagccaagaggaccagttggccccatgctggcaggccgaacaccctgcagaaagagttagatctgccttcgccgcacccagtacagacagcgaccagggcactcctttccgggctcgggacgagcagccttgtgctccaacctcggggccttgtctgtgcgggcttcaccttgaatccagccagtttcccccaggcttttag

SEQ ID NO: 243542 - DNA, 900 bp, Artificial Sequence
  Description of Artificial Sequence: Synthetic coding sequence
atgggccatcaagacaagaaagatctttgcggccaatgttcgcccctcggctgcctcatccgtatactgatcgacgggatctccctgggcctcactctcagattgtgggatgtgtacttagtggagggggagcaggccctgatgccgatcacaaggattgcgtttaaggtgcagcagaagcggttgactaaaacttcacgctgtggtccgtgggcccgtttctgcaatagattcgtcgacacctgggccagagatgaagatacagttctgaaacatctgcgggcttccatgaaaaaattgaccagaaagcagggtgacctgcccccacctgcgaaacccgagcagggctcgagcgcctcacggcctgtgcccgcatctcgtggtggcaagaccctgtgcaagggtgaccggcaggcccctcccggacctccagctcgatttccgcgacccatctggtccgcatcaccccctcgggctccacgctcttccactccctgtcccggaggcgctgtccgagaagacacttaccccgtaggtacacagggtgtcccttcccctgctttagcccaggggggaccgcagggatcctggcggttccttcagtggaattcgatgcccaggctgccaacagacttggatgtagaaggcccatggttcaggcattatgattttcggcagtcttgttgggttagagcgatcagtcaggaggaccagctcgctccctgctggcaggcggagcaccccgctgagcgggtccggagcgccttcgccgctccatcaactgacagtgaccaggggacacccttcagggcacgcgacgaacagccctgtgcaccaaccagcgggccttgcttgtgcgggctccacctggagagttcacaatttccgcctgggttctag

SEQ ID NO: 243543 - DNA, 1584 bp, Artificial Sequence
  Description of Artificial Sequence: Synthetic coding sequence
atggatgtagtcgaggtcgccggatcatggtgggctcaggagcgcgaagatatcattatgaagtacgagaagggtcaccgggcagggctgcctgaagacaaaggaccaaaaccttttaggagttataacaacaacgtggatcacctgggcattgttcatgagactgagctcccacctctgaccgcacgcgaagccaagcagattagacgagaaatttcaagaaagagcaaatgggtcgatatgctgggcgactgggaaaagtataagagtagtcgcaaactcatcgatagggcatacaaggggatgcccatgaatatccgtgggcctatgtggagcgtgctgttgaatatcgaggagatgaaattgaagaacccaggtaggtatcaaattatgaaggaaaagggcaagcgtagctctgagcacatccagcggatcgatcgtgacgtaagcgggacactgcgcaaacacattttcttccgtgatcggtacgggactaaacagcgcgaacttctgcacattctgctagcatatgaggagtataatcctgaagtggggtactgtcgagaccttagtcacatagccgcactctttctgctgtatctgcccgaggaggatgcgttctgggcactcgtgcaattgctagcctcagagaggcactctctccagggtttccacagccccaacgggggaacagtgcaggggctgcaggatcagcaggagcacgtagtggcaacatcccagccaaagacgatggggcatcaaatctctctcggcctcaccctccgcttatgggacgtttacctggtcgaaggtgagcaggccctgatgcccataacaaggattgcctttaaggtgcagcagaagcgcttaactaagacctcgcgatgcggaccctgggccagattttgcaaccgcttcgtcgatacttgggcccgtgacgaagacaccgtgttgaaacatctaagagcctctatgaagaaactaactcggaagcagggggatctgccacctccagccaaacccgagcaaggaagcagcgctagtaggcccgtcccggcatccaggggaggcaaaaccttgtgtaaaggggatcgccaggcccctcccggacctcctgcccgttttcccagaccaatctggagcgcatctccccctagagccccaagaagcagcacaccttgccccggaggcgctgttagagaagacacgtacccagttgggacccaaggggttccttctcctgccctggcccagggaggtccccaggggtcctggcgcttcctgcaatggaattcaatgcccaggctaccaaccgatctagacgtagagggcccttggttccgccattatgacttccgtcagtcttgttgggttagagctatatctcaggaagaccagctggccccttgctggcaagccgagcatcccgcagagagggtgcggagcgccttcgccgcaccaagtacagacagtgatcagggcacaccttttagagcccgagacgaacagccgtgtgcacctacttctggaccatgcctctgtggcttgcacctggaatccagccaatttccacctggcttctag

SEQ ID NO: 243544 - DNA, 1650 bp, Artificial Sequence
  Description of Artificial Sequence: Synthetic coding sequence
atggacgtggtggaagtcgccggttcgtggtgggcacaggagagagaagatattataatgaaatacgagaaaggccatcgagctgggcttcctgaggacaagggaccaaagccatttagatcctacaacaataacgtcgatcatctagggatagtgcatgagactgaacttcccccactgactgcaagagaagctaagcaaatccgtagagagatcagccggaagtctaagtgggttgacatgctgggggactgggagaaatataagtctagccgcaagctgattgatagggcctacaaagggatgcctatgaacatcaggggcccaatgtggagcgttctcctgaatatagaggaaatgaaattaaaaaatcccggaagataccagattatgaaggaaaaaggcaagaggagtagtgagcacattcaaagaatcgatagagacgtatctggcaccctccgtaagcacatcttcttcagagacaggtacggaacaaagcagcgcgagcttctgcatattctgcttgcttatgaggaatacaaccctgaggtgggctactgtagggacctgtcccatatcgctgccctattcctactgtacctgcctgaagaggacgccttctgggccctggtgcaactcctggcgtccgagcgccattccctgcaggggttccactcacctaatggaggtaccgtccaagggctccaggatcagcaggaacacgtcgtggctacgagccagcctaaaacaatgggccaccaggataagaaagatctttgtggccagtgcagccccctcggatgcctcataaggatcctgattgatgggatctccctgggactgacactcagactttgggacgtttacctagtcgagggagagcaggcactgatgccaattaccagaattgccttcaaggtccagcagaagcgactgaccaaaaccagccggtgtgggccatgggcgagattttgcaataggttcgtggatacctgggctcgagacgaggatactgtactgaaacacctgagagcatccatgaaaaaactcaccagaaaacagggtgatcttcccccacccgctaagcccgagcagggctccagcgccagtcggcctgtgcctgcctcaagaggaggaaagactttgtgtaagggagacaggcaggcccctcctggcccacccgcaaggttccccaggccgatttggagcgccagccctcctagagctcccagatcttccaccccctgccccggaggagcagtgcgcgaagatacttatccggtgggaacacaaggcgtccctagtccagccctcgctcaggggggtccacagggctcttggagatttctgcaatggaactctatgccgcgtctgccaacagacttggatgtggaaggtccctggtttagacattacgacttccgccagtcctgttgggtccgggctatcagccaggaggatcagctggccccttgttggcaggccgagcatcctgccgaaagggttcgcagcgccttcgccgctccctcaaccgattccgaccagggaacaccctttagagctagagatgagcagccatgtgcccctacatcgggcccttgcctgtgcgggctgcatctggaatctagccagttcccacctggattctag

SEQ ID NO: 243545 - DNA, 1584 bp, Artificial Sequence
  Description of Artificial Sequence: Synthetic coding sequence
atggacgtggtggaggtagccggttcatggtgggcccaggagcgcgaagacataatcatgaagtacgagaaaggccacagggctggactcccggaggataaagggccaaagccgttcaggtcttacaataataacgtagatcacctcggcatcgtgcacgagacagaattgcctcccctaacagcgagggaggccaagcagattcggagagagatttcgaggaaatctaagtgggtcgacatgctgggtgactgggaaaagtataagagttctagaaaattgatcgaccgcgcttacaaaggcatgcccatgaatatcaggggcccaatgtggagtgttctgctcaacattgaggagatgaagttgaagaacccaggtcggtatcagatcatgaaagagaaaggcaagagaagtagcgaacacattcagagaattgatcgtgacattagtggcactctgcggaaacatatgtttttcagggacaggtatggaaccaagcagcgtgaactactgcacatcctccttgcttacgaagagtacaatcctgaagtgggttattgtcgtgatctgtcacatatcgccgcactctttctgctgtactttccggaggaagatgccttttgggccctagttcaattgctggcttcggaacgacacagcctgcagggattccattcacctaacggcggaacagtacagggcctgcaggatcagcaggagcacgtcgtggctacttcacagagtaagacaatggggcaccagatcagcctgggcctgaccctccgactctgggacgtgtatttagtagaaggggagcaggctttgatgcctataacgagaattgcctttaaggttcagcaaaagcgcctcaccaagacgtcaaggtgcgggccatgggctagattctgtaataggttcgtggacacttgggccagggacgaggacactgtgctgaaacatctgcgagcaagcatgaagaaactgacaagaaagcagggggacctcccccctccagccaaaccagagcaggggagcagcgcctcccgtcccgtgcctgcttctcgcggtggcaagactctctgcaaaggtgatagacaggccccacctggcccacctgcccgtttcccgcgaccaatctggagtgcaagtcctccgagagccccacggtcatctacaccatgcccaggaggtgccgtgcgagaggacacataccccgtcggtacccagggcgtgccaagcccagccctggctcaaggtggaccccagggtagttggcggttcctccagtggaatagcatgcctaggttgccaactgatctcgacgtggagggaccctggttccgacattacgactttcggcagtcttgctgggtccgggctatcagccaagaagaccagttggctccctgctggcaggccgaacatcccgctgagcgtgtgagatcagctttcgcggctccaagtacagattccgatcagggcacaccatttagagcccgtgacgaacagcagtacgctccgaccagtggaccttgtctgtgtggtctgcatctcgaatccagtcagtttccccctggattttag

SEQ ID NO: 243546 - DNA, 1650 bp, Artificial Sequence
  Description of Artificial Sequence: Synthetic coding sequence
atggacgtcgtggaggtagctggctcatggtgggcccaggagagggaggacatcatcatgaagtatgagaaaggccaccgtgctggccttccagaagacaagggtccgaagcctttccgtagttacaataataatgtagaccacctggggatcgtacatgagactgaactcccccctctcacagcgagggaggcgaagcaaattaggcgggaaatctcgcggaaatccaagtgggttgatatgctgggagactgggagaaatacaagagtagccggaagttgattgaccgggcttacaaagggatgccaatgaacatcaggggtcctatgtggtctgtgcttttgaacatcgaggagatgaagctcaagaatcctggcagatatcagattatgaaagagaagggcaaaaggagttcagagcacatccagcgcattgatcgggacatctccggaacgctcaggaagcacatgttctttcgggatcggtatgggaccaaacagagggagctgctgcatatcctactggcctacgaggagtacaatccagaagtcggctattgtcgggacctgtcccatatcgcggctctgttcctcctctatttcccagaggaagatgctttttgggctttggtacagctgcttgcgtccgaaagacactcactccaaggcttccatagtcccaacggcggaaccgtacagggcctgcaggatcagcaagagcacgtggtcgctacaagccaaagcaaaaccatgggacaccaggataaaaaggacctgtgtgggcaatgttctcccctgggctgcctgattaggattctgatcgacggaattagcttgggtctgacactccgcctgtgggatgtatacctagttgagggcgagcaggctctcatgccgatcacccgcattgctttcaaggtccaacagaagagactgactaaaacttctaggtgcggcccatgggccaggttttgcaatcggttcgtagatacctgggcacgcgacgaagacacagtactcaaacacctgagggcgagtatgaaaaaattgactcggaaacaaggcgacctccctccgccagcaaaacccgaacagggctccagtgcttctcgacctgtccccgcttcacgcggtggcaagacactatgcaagggtgatcggcaagcacctcccggacctcccgctagattccccagaccaatttggagcgcttctccgcctcgtgccccaagatcatcgacgccgtgccccggtggcgcagtcagggaggacacttatcccgtaggaactcagggcgttccttcccccgcactcgcccagggagggccacaggggagttggagattcctgcagtggaatagcatgccccgactcccgaccgacctggatgtggagggcccatggttccgccattacgattttaggcagagctgctgggtacgcgcaatctctcaggaagatcagctggcaccatgctggcaggctgaacatcctgcagagagggtgcgctcagcttttgcggcacccagcaccgattcagaccagggcactccattcagggccagggatgagcagcagtatgcgcctacctcaggaccttgtctgtgtgggctccatctagagtcttctcaatttcccccagggttttag

SEQ ID NO: 243547 - DNA, 1650 bp, Artificial Sequence
  Description of Artificial Sequence: Synthetic coding sequence
atggatgtggtcgaggtggccggatcctggtgggcccaggaacgggaggatatcataatgaaatatgagaaaggccatagagcgggactgccggaagacaagggacctaaacccttcaggtcatataacaataacgtggatcatctgggcatcgtgcacgagacggagctccctcccctcacggcccgtgaagctaagcagatccgcagagaaataagtcgcaagtccaagtgggttgacatgctgggggactgggagaaatacaaatccagtcggaagctaattgaccgggcttacaagggaatgccgatgaatatcagaggcccaatgtggagtgtgctcctgaatatcgaggaaatgaaactgaagaatcctggcaggtatcagatcatgaaggaaaaaggtaaaagatcttctgaacacattcagcgcattgatagggatatttctggtaccctgcgtaagcatatgtttttccgggatcgttacgggacgaaacaacgtgagctcctgcatattctgttagcatacgaggaatacaaccctgaagtcggatactgcagagacctgagccatatcgccgctctctttctactctacttcccagaagaagacgcattctgggccctggttcaactgctggccagcgaacggcattccctgcaggggtttcactctcccaatggaggcactgtgcagggccttcaagatcagcaagagcatgtcgtagcaacatcccagtctaagaccatgggacaccaagacaaaaaagatctgtgtggacagtgcagcccactggggtgccttattcgaattttaattgacggtataagccttgggctgacactccggctgtgggatgtgtatctggtagagggcgagcaagcactgatgccaatcacgcggatagcctttaaagtgcaacagaagcggctaacgaagacctcccggtgtggaccatgggcacggttctgcaaccggtttgtggacacctgggcccgagatgaagatacagtgcttaagcatttgcgcgcttccatgaaaaaactgacaaggaaacagggcgacttgcctccccctgccaaacccgagcaagggagttccgcaagtcgtccagtgcccgcttcccgcggaggaaagacactttgtaagggagaccgacaggcgccaccaggtcctcctgctcgtttccccagacccatttggagtgcgtctccccctcgcgctcccagaagctctactccttgtcccggaggagctgtgcgagaggacacctaccccgttggcacccagggcgtccctagccccgctctggcccaagggggaccacaaggctcctggagatttctccaatggaattctatgcctcggctgccaaccgatctggacgtggagggtccgtggttcagacattatgattttcggcagagttgttgggttcgcgcaatttctcaagaagaccagctcgcaccatgttggcaggccgagcacccagctgagcgagtgcgcagtgcattcgccgctccatccacagatagtgaccagggcactcctttcagagcacgagacgagcagcaatatgcccctacctcaggaccttgcctgtgtgggctccatcttgaaagttcccaatttccgcctgggttttag

SEQ ID NO: 243548 - DNA, 1650 bp, Artificial Sequence
  Description of Artificial Sequence: Synthetic coding sequence
atggacgtggtcgaggtagctgggtcctggtgggcgcaggaacgcgaggacatcattatgaagtacgaaaaaggacaccgagctggcctccccgaagacaagggtcctaagcccttccgctcatacaacaacaacgtggaccaccttggtatcgtgcatgagaccgaactgcctcccctgaccgcgagggaggccaagcaaatccgcagggaaatttctcgtaagtcaaagtgggtggatatgctcggtgactgggaaaaatataagtcgtcccgaaagcttatagatagggcatacaagggaatgcctatgaatatccgaggacccatgtggtcagtgttactcaacatagaggagatgaagctgaagaatccgggacgttaccaaataatgaaggaaaaggggaagcgctccagtgagcatatccaaaggatcgacagagacatatccggtaccctgcgcaaacacatgttctttcgcgacaggtacggtactaagcagcgggaacttttgcatatactgctcgcctacgaagagtataatcccgaggtgggttattgtcgcgatctgagccatatcgcggctctgtttctgctgtaccttcccgaggaggatgctttttgggcactggtgcaactcctagcaagtgagcgccactcccttcagggatttcactcgcctaacgggggaaccgttcagggcctccaggaccagcaggaacatgttgtggcaactagccaatcgaagaccatgggccaccaagacaagaaagatctgtgcggccagtgcagcccgctcggctgtttgattagaattctgatagatgggatttcactggggttgactctgaggctttgggatgtctacctggtggaaggcgagcaggcactgatgccaattactaggatcgcgtttaaggtgcagcagaaacgactgactaaaactagccgctgtggaccatgggcccgtttctgtaaccgcttcgtggatacgtgggccagggatgaggacaccgtccttaagcatctcagggctagcatgaagaaattaacacgcaaacaaggcgacctaccccctcccgcaaaaccggagcagggttcctcggccagccgtcccgtcccagcttcacggggaggcaagacgctatgcaagggggaccgacaggctccccctggtccacccgcatggttccctcggccaatatggtctgccagcccccctagagctcccaggtccagtaccccctgtccagggggtgctgtgagggaagacacctacccagtaggaacccagggggttccaagcccagccttagcccagggcggacctcaggggagctggagatttttgcagtggaacagtatgccaagactgcctacggatctggatgtcgagggcccttggtttcggcattatgacttccgccagtcctgttgggtgcgggctatctcccaggaggatcagctcgccccttgctggcaggctgagcaccctgctgagcgcgttcgcagcgccttcgccgctccttccactgattctgaccaggggactccattcagggctcgtgacgagcagcagtgcgcgccaacgagcggaccctgcctctgtgggctccacctggagtctagccagttccctccaggcttttag

SEQ ID NO: 243549 - DNA, 1584 bp, Artificial Sequence
  Description of Artificial Sequence: Synthetic coding sequence
atggatgtcgttgaggtcgccggaagttggtgggcccaggagcgcgaggatatcattatgaagtacgagaagggtcacagagccggtctgccggaggataagggaccaaagccctttagatcctacaataacaatgtggaccacctgggtatcgttcatgagaccgagcttcctccccttacagccagagaggccaagcagattagaagagaaatctccaggaagagtaagtgggttgacatgctgggcgattgggagaagtataaaagctctaggaaacttatagaccgcgcatataagggaatgcccatgaacattcgagggcctatgtggtcagtgctgttaaatatagaggaaatgaaactgaaaaacccagggaggtatcagatcatgaaggagaaaggaaaaagatcttcagagcacattcagcggatcgaccgggatatttctgggaccctcaggaagcatatgttttttagggaccggtatggcacaaaacagagagaactgctacatattctgctggcttacgaggaatataatcctgaggttggatattgccgcgacctgagccatatcgccgctctgttcctgctctaccttccagaagaggacgctttttgggccctcgttcagctactggcatcagagaggcactccttacaggggttccacagccctaatggagggactgtgcagggcctgcaggaccagcaggagcatgtggtggccacctcgcaaagtaagactatggggcatcaaatatctctcgggctgaccctaaggttatgggacgtttacttagttgagggcgagcaggccttaatgcctatcacccggattgcattcaaggtgcagcagaaacggttgaccaagacatcgagatgtggaccctgggctcgcttttgcaacaggttcgttgatacctgggctagagacgaggatacagtcctgaagcatctgagagcgtctatgaagaaactcaccaggaaacagggtgatctcccgcctccggcaaagcctgagcagggtagctcagcaagtcggccagtccccgcatcaagaggagggaaaacactgtgcaaaggagatcggcaagccccacctgggcctcctgcctggtttcctaggcctatctggagcgcatcgcccccacgggctccacgcagctctactccttgccccggaggcgctgtacgagaagacacttatccggttggaacacagggtgtcccctccccagcactggcccagggaggcccacagggctcctggcgttttttgcagtggaacagtatgccacggcttccaacggatctggacgttgagggtccgtggttccggcactatgactttaggcagagctgttgggtaagagcgatctctcaggaggaccagcttgcaccttgctggcaagcagaacatccagccgagagggtgcggtcagcttttgcagccccatccaccgatagcgatcaggggactccatttagagcaagggacgagcagcagtgcgcccctacgtccggtccgtgcctgtgcggcctgcacctggagtctagccaattccctcctgggttttag

SEQ ID NO: 243550 - DNA, 1650 bp, Artificial Sequence
  Description of Artificial Sequence: Synthetic coding sequence
atggacgttgtcgaggttgctggctcctggtgggctcaggagagggaggacattataatgaaatacgagaagggtcacagggccggtttaccagaggataagggccctaagcctttcaggtcttacaataataacgtggatcaccttggcatagtgcatgagactgagttgcctcccttgactgcacgagaagccaagcagatccggagagaaataagccgcaagtccaaatgggttgatatgctgggcgactgggaaaagtataagagctcccggaagcttatcgacagggcctataaaggcatgcccatgaatatcaggggcccaatgtggagcgttctgctcaatatcgaggaaatgaagctgaagaaccctggcagatatcagatcatgaaggagaaaggtaaacgcagttctgaacacatccaacggatagatcgcgacatttctggaaccctccggaaacatatgttcttccgcgatcgatacggcacgaagcagcgtgagctgttgcacattttgctcgcctacgaggaatacaaccctgaggtggggtactgccgtgacctttcgcacatcgccgctctgtttctgctctacctgcccgaagaagacgcgttctgggccctggtccagctgctggcttcggagagacactctcttcaggggtttcactcaccgaatggcggaacggtacaagggctacaagatcagcaggagcacgttgtcgccacaagtcagtctaagaccatggggcaccaggacaagaaggatctttgtggacagtgctcaccccttggctgcttgattcgaatactgattgacgggatcagtttaggtctaaccctccgattatgggacgtgtacctggtggagggagaacaggctttaatgcctatcacccgaattgcctttaaggtgcagcagaaacgtttgacaaagacatcccgctgtgggccatgggctcggttctgtaacagattcgtggatacttgggcacgtgatgaggatactgtcctcaagcatctgcgggcttccatgaaaaagttgactaggaagcagggagacctgcccccacccgcaaaacccgaacagggttcatccgcctcccggcctgtgcccgcttctagaggaggaaaaaccctctgcaagggagaccgtcaggctcccccaggccctcccgcttggtttccacgcccaatttggtcagctagcccaccccgagcgcctcggtcctcaacgccctgtccaggcggagcggtccgggaggatacctatcctgttgggacccagggcgtacccagtccagctctggcccaaggtggacctcaagggtcctggcgtttcctccaatggaactccatgcctagactgcctaccgatctcgatgttgaaggtccctggtttaggcactacgacttcagacagtcttgttgggtaagagccattagccaggaggaccagttggcgccatgctggcaggctgaacacccagccgagcgggtccggagcgctttcgccgctccctctacagatagtgaccagggcaccccttttagagcacgggatgaacaacagtgtgcacccactagcggcccttgtctctgcggcctccacctggaaagctcccaatttccgccaggcttctag

SEQ ID NO: 243551 - DNA, 1650 bp, Artificial Sequence
  Description of Artificial Sequence: Synthetic coding sequence
atggacgtggtcgaagtcgccggtagctggtgggcccaggaacgcgaggatatcattatgaaatacgaaaaaggccaccgggctggcctgccggaggataaagggccaaaacctttccggtcttacaataacaacgtggaccacctgggtatcgtacatgagactgaactgccgcctttgacagcgcgtgaggcaaaacagattcgcagggaaatctccagaaagtctaagtgggtcgacatgctgggagactgggagaagtacaaatcatcccggaagctgattgaccgggcatacaaggggatgcccatgaatattagagggcctatgtggtccgtactgctgaacacggaggaaatgaaactcaagaacccaggcagatatcagattatgaaagagaagggaaaacgttcctctgaacacatacagcgcatcgaccgggatgtgtcaggtaccctccgaaaacacatttttttcagagatcggtacgggactaagcagcgggagctgttgcacattcttcttgcctacgaagaatacaatccagaggtgggctactgtcgtgatctgtcacacattgctgccctatttctcctgtaccttcccgaggaggatgcattttgggccctggtgcaactattggcttcagagcggcattcactgcaggggtttcattctcccaatgggggaaccgtacaaggtctacaagatcagcaggagcacgtggtggccacctctcagccaaaaactatgggacatcaggataaaaaggacctttgtggccagtgtagccctctcggatgcctcattcggattctaatcgatggtatcagcctgggactaaccctgcggttatgggatgtgtatctcgtcgagggtgagcaggctcttatgcctatcacacgcatcgcctttaaggtgcagcagaagcgcttgaccaagacttctcgatgcggaccttgggcacgtttctgtaacagattcgtagacacctgggctcgggatgaggacaccgtgttaaaacacctgcgggcatctatgaagaaactcaccagaaagcagggagacttgcctcctccagccaagccagagcagggatcctcagcttccagaccagtgcccgcttctcggggaggcaagactctctgcaaaggcgaccggcaggcccctccgggacctcccgctagatttcccagacccatctggtctgctagtccccctagggcaccacggagcagtaccccatgccctggaggggctgttcgcgaagacacttatcctgtgggcacacagggcgtgccaagtccagcgctggctcaggggggaccacaagggtcctggaggttcctgcagtggaacagcatgcctcggctgcccaccgatctcgatgtcgaggggccttggttcaggcactacgattttcgtcagagctgttgggtaagagccattagccaagaagatcaactcgcgccatgctggcaggcagagcatccagccgagagagtgcggtcagcattcgcagcacccagcaccgattcagatcaagggacaccatttcgggctagagatgagcaaccctgtgcacccacaagtgggccatgcctatgcggcctacatctcgagtcttctcagtttccaccgggtttctag

SEQ ID NO: 243552 - DNA, 876 bp, Artificial Sequence
  Description of Artificial Sequence: Synthetic coding sequence
atggacgtggtggaagtggccggaagctggtgggcgcaggaaagagaggatataattatgaagtatgaaaaggggcaccgggcaggcctgcccgaggataagggcccaaaacccttccgatcatataacaacaacgtagatcatcttggcattgtccatgaaaccgagctaccaccgctaacagcgagagaagctaagcagatccggagagagatctctcgcaagtcaaagtgggtcgacatgttaggtgactgggagaagtacaaatcaagcaggaaactgattgaccgcgcttacaaggggatgcctatgaatattaggggacccatgtggtcagtgctgcttaacaccgaggagatgaagctgaaaaacccaggcaggtaccagattatgaaggagaaaggcaagcggtctagtgaacatatccaaagaatcgaccgcgacgtgagcggaactctccgcaagcacatattcttccgtgatcgatatggcacgaaacagagagagctcctgcatattctcctcgcctatgaggagtataacccagaggtaggatattgcagggatctttcccatatcgccgcactgtttctcttgtatctgccagaagaggatgcattctgggctctcgtgcagttactcgcttccgaaaggcactccctgcaggggtttcattcccctaacggagggactgttcagggactgcaggatcagcaggaacacgtggttgccacaagtcagcccaagacgatgggccatcagtctgcaagcagaagacggcctggtgttgcaagagggcacgtgtttgccaccgggtctctgatccccggacccggaatgcgaacattgtgtagcagcattttgggccctctctag

SEQ ID NO: 243553 - DNA, 900 bp, Artificial Sequence
  Description of Artificial Sequence: Synthetic coding sequence
atgggacatcaggacaagaaggatttgtgtgggcagtgcagccccctcggctgccttatcaggatcctcatcgacggtatttcactgggattaactctgaggctttgggatgtgtacctggtggagggggaacaagccttaatgccaattacacgtatcgccttcaaggttcagcagaagcgcctgacaaagacttcccgctgtggaccctgggcgagattttgtaatcggtttgtcgacacatgggctcgggacgaggatacggtgctgaagcaccttcgcgcttcgatgaaaaaactgacccgcaagcagggagacctcccgccacctgcgaaacctgagcagggatcatcggcatcgcgacccgtacctgccagccgcggaggcaagactctctgcaagggtgatcgacaagctccacccggaccaccggcaagattccctagacccatctggtccgcaagcccacctcgggcaccaaggtctagcacgccgtgccctggtggcgctgtccgagaggatacctaccccgtgggcacccagggtgttccttcccctgccctggcccagggcggaccacaaggcagttggaggttcctccagtggaatagcatgcccaggttacccaccgacttggatgtagaagggccttggtttaggcactatgattttaggcagtcgtgctgggtgcgcgcaatcagccaggaggatcagttggctccttgctggcaggctgaacaccctgccgaacgcgtgaggtccgctttcgcagcgcctagtaccgacagcgatcaaggaactcccttcagggcaagagatgagcaaccctgcgctcctacctcagggccttgcctgtgcggcctgcatctagaatctagccagttcccaccgggattctag

SEQ ID NO: 243554 - DNA, 1410 bp, Artificial Sequence
  Description of Artificial Sequence: Synthetic coding sequence
atgcttggggattgggaaaagtacaagtcatcgagaaagctcattgacagagcgtataagggaatgccgatgaacattagagggcctatgtggtctgtcctgctgaatacagaggagatgaaacttaagaatccagggagatatcagataatgaaggagaaagggaagagatcatccgaacacattcaaaggattgatagggatgtgagtggtaccctgcggaagcacatctttttccgggatcgctacggaaccaagcagagggaacttctccatattctgctagcttacgaagaatataaccctgaagtgggatattgcagagacctgagtcacatcgcggctctgttcctgttgtatctgcctgaagaggacgccttctgggctctggttcagctgttagctagtgagaggcattcactgcaaggatttcacagccccaacggcggtaccgtgcaggggcttcaggaccaacaggagcacgttgttgccacttctcaacccaagaccatgggccatcaagataaaaaagacttatgtggccagtgctctccactgggatgcctaatccgtatattaattgatggtatatctctgggcttgaccttgagactgtgggacgtgtacctcgtcgagggcgaacaagcattgatgccaatcacccgcatcgcattcaaggtccaacaaaagcggctgaccaaaaccagcagatgcggtccgtgggccaggttctgcaatcggttcgtggacacgtgggctcgggacgaggacaccgtcttgaagcaccttcgggcatctatgaagaagctgactaggaagcagggggatctgcccccacccgcaaagccagaacaggggagctcagcttctcgcccagtgcctgcatcccgcggtggtaaaacactgtgtaaaggcgaccgacaggccccaccaggcccacccgcaaggtttccccgtcctatttggtctgcgtccccgccaagagcccctcggtcctctactccatgcccaggcggagccgttcgcgaggacacgtaccccgtaggaacacaaggtgtgccttccccagccctggcacaaggcggtccgcagggctcctggcgattcttacagtggaacagcatgccccgacttcccactgacttggacgtggaaggaccttggtttaggcactatgatttcagacagagctgctgggtccgagccattagccaggaagatcaacttgcaccatgttggcaggctgaacatcccgctgagcgggtaagatccgcctttgcagctccctcaacagactcagatcaggggactccatttagagcccgagatgagcagccatgtgcaccaaccagcgggccatgtctgtgtgggctccacctagagtcgtctcagtttcctcccggattctag

SEQ ID NO: 243555 - DNA, 1650 bp, Artificial Sequence
  Description of Artificial Sequence: Synthetic coding sequence
atggacgtagtggaagtggccggttcctggtgggcccaggagcgcgaagatattatcatgaagtatgagaaagggcatcgtgccggtcttcccgaagataaggggcctaaaccgtttagaagctataacaacaacgtggatcaccttgggatcgtgcatgaaaccgagctaccacccctgacagctagggaggccaaacagattcggagagagatctcacgcaagtcaaaatgggtggacatgctgggggattgggaaaaatacaaaagcagtcgcaagctaatcgatcgagcatacaagggaatgcctatgaatatacgtgggcctatgtggtctgtgttgctgaacatcgaggaaatgaagcttaagaatcctgggaggtaccagattatgaaggaaaaaggcaaacgctcttcagagcatatccagagaatcgaccgtgacatcagtggtacactccgtaagcacatgtttttccgggacaggtacggaactaaacagcgcgaactgctccacatactactagcttacgaggaatacaatcccgaggtgggttattgtagagacttatcccacatcgccgctctcttcctgctgtacctgcccgaagaagacgctttctgggccctggttcagctcctggccagcgaacggcattcactgcagggatttcactccccaaatggtggaacagtgcaaggccttcaggaccagcaggagcacgtcgtcgctacttcacagcctaaaaccatgggccaccaggacaagaaagacctctgcggtcagtgtagcccccttggttgccttatccggatcctcattgacggcatctccctcggcctgaccctgcggctctgggacgtttacctcgtggagggtgagcaggcgctgatgcccatcaccagaatagcatttaaggtccaacagaagcgtttgacgaagacctctagatgcgggccatgggccagattttgcaaccgttttgtggatacttgggctcgcgacgaagacaccgtcttgaaacatttgagggctagcatgaagaagcttacaagaaagcagggcgacctgcctcctccggctaaacccgaacaaggatccagcgccagccggccagttcccgcaagtcgtggtgggaaaacactctgtaaaggcgaccgtcaagcccctccaggacccccagccaggtttcccaggccaatttggagcgcctccccgccacgggctccccgatcctcgaccccgtgtcctgggggagcggtgagggaggacacctaccctgtcggcactcagggcgtaccctcacctgctctcgcccagggtggccctcagggatcatggcgattcttgcaatggaatagtatgcccaggttacccaccgatttagatgtagaagggccttggttccggcactacgactttcgccagagctgttgggtgagggcaatttcccaggaagaccaactcgcaccctgctggcaggcagagcaccctgcggaaagagttaggagcgcattcgccgcaccttccaccgatagtgaccagggaaccccctttcgcgctagggacgaacagcagtgcgcacccacgtccggcccatgcttgtgcggattgcacctcgagtcttcccagttccccccagggttttag

SEQ ID NO: 243556 - DNA, 1650 bp, Artificial Sequence
  Description of Artificial Sequence: Synthetic coding sequence
atggatgtggttgaggttgcgggttcatggtgggcacaagaacgggaagacattataatgaagtatgagaaaggtcatagagctgggctgccagaagataaaggccctaaacctttcagaagctataataataacgtggaccacctggggatcgtccacgagacagagttaccccctctaacagctcgggaagcgaagcaaatcagacgcgaaatcagtcgcaaatctaagtgggttgacatgctgggagactgggaaaagtataagagctcccggaaactgatagacagggcctacaaaggcatgcccatgaacatccgaggccctatgtggtcagtgctgttaaacattgaggagatgaaactcaaaaacccaggccgttatcagatcatgaaggaaaagggtaagaggtctagtgaacacatccagaggattgatagagatatatccgggacattacgaaaacacatgttttttcgggatagatacggcaccaaacagagggaattgctccatatccttcttgcctatgaagaatacaatccagaggtgggctactgcagggacctcagccacattgccgctctgtttctgctctatcttcccgaggaagacgctttctgggcgctcgtccagctgttggcctctgagcgccacagccttcaggggtttcatagcccaaatggtggcaccgtacagggtctccaggatcaacaagagcatgtcgtcgcaacatcgcagcctaagactatgggacaccaagataaaaaggacctgtgcggtcagtgtagtcccctgggctgtttaatcaggattctgattgacgggatatccttaggactcactctgaggctatgggatgtatatttagtggagggcgaacaggcactgatgccgatcactcgaatcgccttcaaggtgcagcagaagcgactgacaaaaactagtcgttgtgggccttgggccaggttctgcaatagattcgtggatacatgggcaagagacgaggataccgtgctgaagcaccttcgcgcttccatgaaaaagcttacccggaagcagggagatttgccccctcctgccaaacccgagcaaggcagctccgcttcacggcctgtgcccgctagtaggggtgggaaaaccttgtgcaaaggggatcgtcaggctccaccaggcccacctgccaggttccccaggccaatatggtctgcgtcgccacccagggcgccacgcagctcaaccccgtgccccggaggtgccgtgagggaagacacctatcccgtcggaacccaaggggtaccctcccccgcacttgcacagggcggaccccagggatcctggcgatttttgcaatggaactctatgccacggctcccgaccgacctggatgtggaagggccatggtttcgccactacgatttccggcagtcatgttgggtgcgtgcgataagccaagaggaccagctggctccctgctggcaggccgagcaccccgcagaacgcgtgcggagcgcctttgcagccccaagcaccgacagcgatcagggcacaccatttagggccagagacgagcagcagtgtgccccaaccagcgggccttgtttgtgcgggttacaccttgaaagttcccagttccctcccggtttctag

SEQ ID NO: 243557 - DNA, 1584 bp, Artificial Sequence
  Description of Artificial Sequence: Synthetic coding sequence
atggatgttgttgaagtcgcaggttcctggtgggcccaggagagggaagacataattatgaagtatgagaagggacaccgcgctggactccccgaagacaagggcccaaaaccctttagatcctacaataacaacgtggaccatctcggaatagtgcacgagaccgagctgccccctctgaccgccagagaagccaagcagatccgaagagagatttcccggaaatctaaatgggttgatatgctgggcgactgggagaagtacaaatcatccaggaagttgatcgacagggcatataaaggtatgcctatgaatattagagggccaatgtggagcgtgttgttgaatatagaggaaatgaaactcaaaaacccgggacgttatcaaatcatgaaagaaaaaggcaagagatcaagcgagcatatacagcgcatcgaccgcgatatctcagggactctgcgtaaacatatgtttttccgggaccggtatggcaccaagcaaagagagcttttacatattctactggcctatgaggaatacaatcctgaggtcggctactgtcgggacctgtcgcacatcgccgctctctttcttctctaccttccggaggaggatgctttttgggcacttgtccagttgttagcctcagaaagacattccctccaggggttccatagcccaaacggcggaaccgtgcagggcttacaggatcagcaggagcatgtggtggcaacttctcaacccaagaccatgggccaccagatcagcttagggctgaccctccggctgtgggatgtgtatctggttgaaggggaacaagctctgatgccaatcactcgaatagctttcaaggtgcagcagaagcggctgaccaagacatccagatgcggcccatgggcacgcttctgtaatcgatttgtggacacctgggctagagatgaagacactgttcttaagcacctgcgggcatcgatgaaaaagctcacccggaaacagggagatttacccccaccagctaaacctgaacaaggtagttctgcaagcagacctgtacctgcgtcacgcggaggtaaaactttgtgcaagggcgatcggcaggctcccccaggtccccctgccagattccccaggcccatctggtccgctagtccccctagggccccaaggagttctacaccttgccctggaggagcggttagggaggatacttacccagtgggaacacagggagtgccatctcccgcacttgctcagggcggtccacaaggatcatggcggtttctgcaatggaatagcatgcctcgcctgcccaccgacctcgatgtggaaggaccatggtttcggcactatgactttcgtcagtcatgttgggtgcgggctatcagccaagaagatcagctcgcaccctgttggcaggcggagcacccagctgaaagggtcaggagcgccttcgccgcaccctccaccgacagtgaccagggaacaccatttcgggcaagggatgagcagcagtgcgccccaacttccggcccatgtctgtgcggactgcatcttgagtctagccagtttccccctggcttctag

SEQ ID NO: 243558 - DNA, 1584 bp, Artificial Sequence
  Description of Artificial Sequence: Synthetic coding sequence
atggatgttgttgaagttgccggttcatggtgggcacaggaaagagaagacattatcatgaagtatgagaagggccacagagccggtctgcctgaggacaagggccctaagcctttccgctcctataataataatgtcgaccatctcgggatagtccacgaaacagagctcccacccctcaccgctcgtgaggccaagcagatccgacgcgagatttcacgcaaatcgaaatgggtggacatgctgggggattgggagaaatataaaagtagccgcaaacttattgacagagcatataagggtatgcctatgaacatcaggggacccatgtggagcgttctgctgaatatagaggagatgaagctgaagaacccaggaaggtatcagattatgaaagaaaagggtaagcgctcgtctgaacatatccagcggattgatagggacatttcaggcacccttcgaaaacacatgttcttccgagacagatatggcaccaagcagcgggagcttctgcatatcttgctggcttacgaggagtacaaccccgaagtcggctactgtcgcgatttatcccacatcgctgcgctctttctgttgtatctcccagaagaagatgccttctgggcactggtccaattgctggcctcagaaaggcactccttacagggctttcattccccaaacggcggtactgtccagggcctccaggaccaacaggagcatgtggttgccacctcacagccaaagaccatgggtcaccagatctctctgggtttgaccctccgcctgtgggacgtgtatctggtcgagggcgaacaggcattgatgcccatcaccagaatcgccttcaaagtgcaacaaaaacgcttgactaagacctctcgttgcgggccatgggcaagattctgtaaccgatttgtggatacttgggctagagatgaagacactgttctgaaacatctgcgagcctcaatgaaaaagttaacgagaaaacagggcgacctgccaccgcctgcaaaacccgagcaagggtcatcggccagtcgccctgtgcccgcttcgagagggggtaaaactctgtgcaaaggggataggcaggcccctccaggaccccctgccaggtttcccagacctatatggtctgcttctccccctcgcgctccacgcagcagcactccctgtccaggcggtgcagtccgggaagatacctaccccgtaggcacccaaggtgtgcctagcccagctttggctcagggtggccctcaaggatcctggcggtttctccagtggaacagcatgccacgcctccccactgacctggacgtcgagggcccatggttcaggcactacgatttcagacaaagttgctgggttcgagccatcagccaggaagaccaactggccccatgctggcaggctgaacatcctgccgaaagggtacggtccgcatttgccgcaccaagtaccgatagtgatcagggcacgccttttcgtgcccgtgacgaacagcagtgcgccccaaccagtggtccatgcttatgtggtctgcacctagaaagtagccaatttcctccagggttttag

SEQ ID NO: 243559 - DNA, 1410 bp, Artificial Sequence
  Description of Artificial Sequence: Synthetic coding sequence
atgctcggggattgggagaagtacaaaagcagtaggaagcttattgatagggcttacaaaggtatgccgatgaacattcgcggacctatgtggtctgtcctcctgaatatagaggagatgaagctcaaaaatccaggcaggtatcaaattatgaaggagaagggaaagaggtcatccgagcacatacagaggatcgatcgcgacatctcagggactttgcgcaaacacatgttctttagagacaggtacggtacaaaacagagagagctgctgcatatcctgttggcatacgaagagtataatcctgaggtgggatattgccgggacctgtcacatattgccgcactgttcctgttgtatctacccgaagaggacgccttctgggcactggttcaactgttagccagcgaaaggcacagcctccagggcttccattctcccaatggtgggacagtgcaggggctccaggaccagcaggagcacgtggtggcgacttctcagccaaagaccatgggtcatcaggacaagaaagacctgtgcggccagtgctcgcctctgggatgcctgattcgcattctgattgatggcattagcctgggcctgacgttgcgtctgtgggatgtgtatctggtcgagggcgaacaggccctaatgcctatcacccggatcgcctttaaagttcaacagaagaggctgacaaagactagccggtgcggaccctgggccaggttctgtaacaggttcgtcgacacatgggctcgagatgaagataccgtgctgaagcatctgagggcgagcatgaagaaactaacaagaaaacagggggacctgccccctcccgcaaagcctgagcaggggtcttccgcatcgcggcctgttccggcaagccgcggtggaaagaccctgtgcaagggcgataggcaggctccaccagggccacccgctcgatttccaaggccgatttggagcgcatcccctccccgagcgccacgatcatccacaccttgcccaggcggagccgtccgcgaggatacttacccagttgggactcaaggcgttcctagcccagctctcgctcagggtggaccacagggtagctggaggtttctgcagtggaactcaatgcccaggttgccaacagatcttgatgtggaggggccttggtttcgacattatgactttagacagagctgctgggtcagggctatttcccaggaggatcaactggcaccatgttggcaggccgagcacccggcagaaagagtaaggtctgccttcgctgctccatctacggactccgaccagggcacgccattcagagcacgtgacgagcaacagtgcgccccaacctcagggccttgcctctgcgggctgcacctggagagcagccagttccccccagggttttag

SEQ ID NO: 243560 - DNA, 1410 bp, Artificial Sequence
  Description of Artificial Sequence: Synthetic coding sequence
atgttgggagattgggaaaaatataagtcgagtcgaaaactgatagaccgggcatataagggcatgccgatgaatattcgcggacctatgtggtcagtgctgttaaatatcgaggagatgaagttgaagaatcccggacgctaccaaatcatgaaagagaaggggaagcggtcctccgagcacatccagcggatagatagagacatcagtggaaccttgcggaaacatatgttctttcgagacaggtacgggaccaagcaacgggaactgctgcacatcctgctcgcatatgaagagtataatcctgaggttgggtactgcagagatcttagtcatatcgcagcactgtttttgctgtaccttccagaggaggatgcgttctgggctctcgtacagctgctcgcatcagaaagacatagccttcaggggtttcattctcccaatgggggaaccgtgcagggcttacaagaccagcaggagcatgtggtggctaccagccaacctaaaaccatgggacatcaagataagaaggacctctgtggacagtgttcccctctgggctgtctcatccgcattcttatagatggcattagcctcggcctcaccctacgactgtgggacgtgtacctggtagaaggggagcaggcgctaatgccaatcaccagaatagcctttaaggtacaacagaaacggctgactaaaacctcacggtgtggaccctgggctagattctgcaacagatttgtggacacatgggctagagacgaggataccgttctgaaacacttgcgggcttccatgaaaaaacttactcggaagcagggcgatctccctcccccagccaaacccgagcagggctctagcgcatcacgccctgtccctgctagtcgcggtgggaagacactgtgtaagggcgaccgacaggcccctccaggcccaccagcctggtttcccaggccaatctggtctgccagccccccacgagcccctaggagcagcaccccttgcccaggtggtgctgtgcgtgaggacacttatcccgtagggacacagggagtcccctcaccggcactggcccaggggggtccccagggcagctggcgatttctccagtggaattccatgcccaggttacctaccgatctggatgtggaaggtccgtggttccgccactacgatttccgccagtcatgctgggtgcgcgcaatctcgcaggaggaccagctggctccctgctggcaagccgagcaccccgcagaaagggtgcgctctgccttcgccgcacctagcaccgatagcgatcagggaacgccattccgcgcacgggacgaacagcaatgtgccccaacatccggtccatgtctatgcgggttgcatcttgagagtagccagtttcctcctggcttttag

SEQ ID NO: 243561 - DNA, 1650 bp, Artificial Sequence
  Description of Artificial Sequence: Synthetic coding sequence
atggatgttgtagaagtggccggttcatggtgggcgcaggagcgtgaggacatcattatgaaatacgaaaagggacatcaggcagggctgcctgaagacaaggggcctaaacccttcaggtcctacaacaataacgtggaccacctgggaatcgtgcacgagacagagttacctcctttaactgccagagaggcgaagcagattcgcagggagattagccgtaagagcaagtgggtggatatgcttggggactgggagaagtacaagtcgtcgcgtaagcttatagaccgcgcttacaagggtatgcccatgaatattaggggacctatgtggtccgtgctgttgaacattgaagaaatgaagctgaagaatcccggtcgctatcagattatgaaggaaaaaggaaagagaagttccgaacacatccagcggattgatagggacattagtggcactcttcggaagcatatgttcttcagagatagatacggtacgaagcagagagaacttctgcatatattgctggcctacgaagaatacaaccctgaggtggggtattgcagagatctctcccacatcgctgctctcttcctcctgtaccttccggaggaagatgccttttgggcactggtccagcttctggcatcagagcggcactcacttcagggttttcattcccctaacggtggaacagtccaggggttacaggatcaacaggaacacgtcgttgctacaagccagcctaagactatggggcatcaggacaagaaggacctctgtgggcagtgcagtccactgggctgtctgattaggatcctcattgacggaatttcactgggtctcactctaaggctgtgggacgtgtacttggtagagggggagcaagctctcatgcccatcacccgaattgcgttcaaggtccagcagaagaggctgacaaagactagccggtgcggaccctgggcacgcttctgcaatcggtttgtggatacctgggccagagatgaagatacggtccttaagcatctgagagctagtatgaagaaacttacgcgcaagcaaggggatctgccccctcctgcgaaaccggaacaggggtcttccgccagtagacctgtgcccgcatcacgcggagggaagacattgtgtaagggagacagacaggctccaccgggaccaccggcaaggttcccgcgaccaatctggtctgcctcgccgcctagagcaccacgttctagtactccatgccctgggggtgcagttcgtgaagatacttaccccgttggtacgcagggtgtcccttcaccggctctcgcacaggggggtccacaagggtcatggagattcctgcagtggaatagcatgccacgcctgccaacagatttggacgtcgagggaccttggtttcgccactatgactttcgccaaagctgctgggtgagggccatatcccaggaagatcagttagcgccttgttggcaggcagagcatcccgctgagagagttcggtctgcttttgccgctcccagcaccgacagtgaccagggaaccccttttagagcacgggacgagcagcaatgcgcacctactagcggaccctgcctatgcggccttcacctagaatccagtcagttccctcctggattctag

SEQ ID NO: 243562 - DNA, 1410 bp, Artificial Sequence
  Description of Artificial Sequence: Synthetic coding sequence
atgcttggagactgggaaaaatataaatcctcccgtaagttgattgaccgggcttacaaggggatgccaatgaacataaggggtcctatgtggagcgtgctactcaacattgaagagatgaagctgaagaatcccggtagataccaaataatgaaggaaaagggaaagcgtagcagtgaacatatccagcgaatagatagagacataagtggaacactgcggaagcacatgttctttcgagacagatacggtacgaagcagcgggaactattgcacattttgcttgcctacgaggagtacaacccagaggtggggtactgcagggacctctctcacatcgcagcactgttcctgttgtacctgccagaagaagacgctttctgggccctggtgcagttgctggctagcgaaagacacagtcttcaaggtttccatagcccaaacgggggaactgtgcagggtttacaggatcagcaggaacacgtcgtggctacctcccagccaaaaaccatggggcaccaggataagaaagatctgtgcggccagtgttcacccctggggtgtctcatacgcatcttaattgatggtatctctttgggcctgacactgaggctgtgggatgtttacttggttgagggggagcaggccctgatgcccattactaggattgcttttaaggtacagcaaaagcgactgacaaagacaagccggtgcggaccatgggccagattttgcaaccggtttgtagacacctgggccagggatgaagatactgtgctgaaacacctccgggcttcaatgaaaaaactgactaggaagcagggggacttgccaccccctgccaaacccgaacaggggtctagcgctagtaggcccgttcctgcctcacggggaggcaagaccttatgtaagggggatcgacaagccccacccggtcccccagcatggttcccacgtccaatctggtcagcctcccccccaagagccccacgtagcagcactccctgccctggcggagctgtgagggaagatacttacccagtgggaacccagggggtgccctctccagctcttgcccagggcggacctcagggctcttggaggttcctccagtggaattcaatgccacgcctgccaaccgacttggacgtcgagggcccttggttccgccattatgatttccgccagtcctgctgggtcagagcgatcagccaggaagatcagctggccccttgctggcaagccgagcaccctgcagagcgggtgcgatcagcttttgccgcaccgtcaactgacagtgatcagggcacgccatttcgcgctcgggacgagcagcagtgcgccccaacatcaggaccttgcctgtgcggtcttcacctggagtctagccagtttccccctggcttctag

SEQ ID NO: 243563 - DNA, 3708 bp, Artificial Sequence
  Description of Artificial Sequence: Synthetic coding sequence
atggaacctccgagctgtatccaggatgagcctttcccccacccgcttgaaccagaacccggagtgtctgctcaacccggtccaggtaagccttcagacaaacgctttaggctctggtatgtcggcggatcatgcctggatcatcggaccaccctccccatgttaccttggcttatggctgagatcagaaggcgttctcagaagcctgaggcaggcggatgtggcgcacctgctgcaagagaggtgattttggtgctgtcagcaccatttctgcgctgcgtgcctgctcctggggctggcgcatcagggggaacaagccccagcgctacacagccaaatcccgctgtgttcatctttgagcataaagcccaacacatctcacggttcatccacaattctcacgacttgacctattttgcatacctgattaaggcccagccggatgatcccgagagccagatggcctgccacgtgtttcgcgctaccgatcccagtcaggtccccgacgtgatttcatccattagacagctatcaaaagccgcaatgaaggaggacgcgaagccctctaaggacaacgaagacgccttttacaactcccagaagttcgaagtgctgtactgtggaaaagttaccgttacccataaaaaagccccatcgtctttgatagacgattgcatggagaagttctccctgcacgagcagcagagactcaaaatacaaggggagcagaggggccctgaccccggtgaggatctggcggatcttgaagtggttgtgccaggaagccccggtgattgtctccccgaggaggccgatggcactgacactcacctagggctgcccgcaggggcttcacagcctgctttgacgtcctcaagagtttgttttcctgagcgaatcctggaagacagcggcttcgacgagcagcaagagttccggagtagatgttctagtgttacaggggtccagaggagagtccacgaggggagccagaaatcacagcctaggagacgccacgcctcggcccctagtcatgtccagccgtcagactcagagaagaaccggacaatgttgttccaggtcggacgatttgagattaacctgatctctcccgatacaaagagtgtggttctcgagaaaaattttaaggacatttcctcctgctcacagggcattaaacacgttgaccacttcgggtttatttgccgggagagccctgagcctgggctgagtcagtacatttgttacgttttccagtgtgcgagcgaaagccttgttgacgaagtcatgctcactttaaagcaggctttctccacggcagctgctctgcagtccgccaaaacacagataaaactgtgcgaagcttgccctatgcactctctacacaagctgtgcgagagaattgaaggattgtatccaccacgcgctaaattggtcattcagcggcacctctcttccctcaccgacaacgagcaagcagatattttcgaacgtgttcagaaaatgaaacccgtgagtgaccaggaggaaaacgagctggtgatcttacacttaaggcagctctgcgaagctaagcaaaagacgcacgtacacattggcgaagggccaagcaccatctccaatagcactatccccgagaatgcgacctcatcgggcagattcaaactggacatcctcaagaataaggccaaacgctctctcacttcctccctggagaacatcttttcaagaggcgcaaataggatgagggggaggttagggagtgtcgactccttcgagcgttcgaacagtctcgctagcgagaaggactatagcccgggagactctccgccaggcaccccaccagcttcacccccatcatcagcatggcaaaccttccccgaggaagacagcgattccccacagtttagacggagagcccacaccttctcccatcccccatctagtaccaaaaggaaactcaacctacaagacgggcgagcccagggagtgcgctctccacttcttaggcagagttcctccgagcaatgctctgacggggaaggaagaaaacgaaccagcagtacttgttccaacgaaagtctttcagttggtgggacatccgtgacgccacgtcggatttcctggcggcagagaatctttctacgcgtggcgtcaccaatgaacaaaagtccctctgccatgcagcagcaagacggtctggacaggaatgaattgctcccactgtccccactctccccgaccatggaggaggaacctttggttgtgtttctgagtggcgaggatgatcccgaaaagatcgaagaacgaaagaagagtaaagagctccgctccctgtggcggaaggccattcaccagcagatcctcttgttgcgcatggagaaagagaaccaaaagctggaggccagccgcgacgagttgcagtcacggaaggtcaagctcgactacgaagaggtgggcgcttgccagaaggaggtcctcatcacatgggataaaaagctgctcaattgtagggccaaaatccgatgtgacatggaggatatccatacccttcttaaagaaggagttcccaaaagccgcagaggcgaaatttggcagttcctggctctgcaatatcgactaaggcatcgcctgccaaacaaacagcagcctccggacatatcttataaggaactcctaaagcagctgactgcgcagcagcatgccatcctcgtggatctgggcaggaccttccccactcatccttactttagcgtgcagctagggcctggccaattgtctttattcaacctactcaaggcctattctctccttgacaaagaagttggatactgccaaggaatcagttttgtcgcaggcgtgcttctgctgcacatgtctgaggaacaggcctttgaaatgctcaagttccttatgtatgacctggggttcagaaaacagtataggccagacatgatgagcctccagattcaaatgtaccaactctccaggctgctgcacgactatcaccgcgacctgtacaatcacctggaggagaacgagattagtccatccctatatgctgccccatggtttctgaccttgtttgcatcccaattttcactcggatttgtggctcgtgttttcgatattatcttcctacagggtaccgaggttattttcaaagtggctctcagccttctcagcagtcaggagaccctgattatggaatgtgaatcctttgaaaacatagttgagtttctaaagaatactctccctgatatgaatacgtccgagatggagaaaatcatcacacaggtgttcgaaatggacatctcaaagcaattgcatgcatatgaggtggagtaccacgtgctgcaggatgaattgcaagagtctagctacagctgtgaagattccgagactctggagaagctggagagagccaattcccagctgaaaagacagaatatggatctgctagagaagctgcaagtcgcccacactaaaattcaggctctggaatcgaatctggagaatctgttaaccagggaaactaaaatgaaaagtttaatcagaaccctcgaacaggagaaaatggcctatcaaaaaactgtcgagcaactaagaaaactgctgcccgctgacgcactcgtgaattgtgatcttctcctgcgtgacctgaactgtaaccccaacaacaaggctaagattggcaacaaaccctag

SEQ ID NO: 243564 - DNA, 3897 bp, Artificial Sequence
  Description of Artificial Sequence: Synthetic coding sequence
atggagccgccttcctgcatccaggatgaaccattcccccacccgctcgagcctgagcctggagtaagcgcacagcctggacccggaaaaccttcagacaaaagatttcgcctatggtatgtaggcggaagctgcctcgaccatcgcaccacactgcctatgctgccatggcttatggctgagattaggaggaggtcccagaagcccgaagctggaggctgtggtgctcccgcagccagagaggtgattttagttctgtccgctccattcctgaggtgtgtccccgcaccaggagcaggggcatcagggggtacaagtccaagcgcgacacagcctaaccccgctgtgttcatattcgagcacaaggcgcaacacatttcccgcttcatccataacagccacgaccttacttattttgcctacttgattaaagcacaacctgacgaccccgaatctcaaatggcttgccacgtgtttcgagccaccgatcccagccaagtccccgacgtgatatcttctattcgtcaactgtctaaagcagccatgaaggaagacgccaaacccagcaaagacaatgaggacgcattctacaattcccagaaatttgaagttctgtattgtggcaaggtgaccgtgactcacaagaaagcccctagttccctaatagacgactgcatggagaagttctcactgcacgagcagcagcgcctgaagattcagggagaacagcgtgggcctgatccaggggaagaccttgccgatctggaagtcgtggtgccgggttcgcccggtgactgtttaccagaggaggccgatggtacggacactcatcttgggctgcccgcaggagcgagtcagcctgcactgaccagcagcagagtgtgtttccccgagagaattctggaagatagcgggttcgacgagcagcaggagttcagatcacgatgctcttctgtgaccggtgtgcaacgcagagtccatgaaggtagccagaagtctcagccaaggaggagacatgctagcgctcctagccatgtccagcctagcgattcagagaagaaccggaccatgctatttcaagtcggcagatttgagattaatctgatctctcccgacaccaaaagtgtcgtcctggagaaaaactttaaagatatcagctcatgctcacaggggattaaacacgtagaccatttcggtttcatatgccgcgagtctccagagccaggcctctctcaatacatctgttatgtctttcagtgtgcttccgaatccctcgtggacgaggtgatgttgactctcaagcaggctttctctaccgctgctgctctgcaatccgccaagacccagattaagctctgcgaggcctgccctatgcatagtctgcacaaattgtgcgaacgaattgaaggtctttaccctcccagggccaagctggtcattcagagacacttgagttctcttaccgataatgaacaagcggacattttcgagagggttcagaagatgaagcccgttagtgaccaagaggaaaatgagctggttattctgcacttacgccaactgtgtgaggccaaacagaagactcatgttcacataggggaaggcccaagcaccatcagtaatagtactatccctgagaacgccacgtcgagcgggcgtttcaaactggacattctgaagaacaaggcaaagaggtccttgacgagcagtctggaaaatatctttagcagaggagcaaaccgcatgcgtggacgtttaggttccgttgacagtttcgaacgctctaattctctggctagtgagaaggattattcgcccggtgacagtccaccgggaactcctcctgcctctccacctagctccgcttggcagacattccctgaggaagacagcgacagtcctcagttccgacggagagcccatacttttagtcatcctccatcgtccaccaaacgtaaactgaacctgcaggatggtcgtgcacagggagtccggtctcccctgctgagacagtccagctcagaacaatgctcaaacctctcctctgtgcgacgaatgtataaggaatctaatagcagttcctcactgccctccttgcacacatcgtttagcgccccttccttcaccgcacctagcttccttaagtcattttaccagaactccggcaggctctcaccacagtatgagaatgaaatccgacaagacaccgcctccgagtccagcgatggcgagggcaggaagaggacttccagcacgtgctcaaacgagtcactgtccgttggaggcaccagcgttactcccaggcgaatctcatggaggcagcgcatcttcctgagggttgctagtccaatgaataagtcaccatctgcaatgcagcagcaagatggcctggatcgcaacgaacttctgcccttaagccctctgagccccacgatggaagaggaaccactggtggtttttctgtcaggcgaggacgaccctgagaagatcgaggaacgcaagaagtctaaagaactgcgtagtctatggcgaaaagctatccaccaacaaattcttctcctacgcatggaaaaggagaatcagaaacttgaggccagcagggacgagctccagtccaggaaagtgaagctggactacgaagaagttggagcttgccagaaggaggtcctgatcacatgggataagaagctgctgaattgtagggccaagattcgttgcgatatggaggatatccacacattactgaaggaaggagtgcctaagtcgcgcagaggagaaatatggcagtttctggcgctgcagtacaggttgcggcatcgactccccaacaaacagcagcctcccgacatcagctataaagaactcctgaagcagctcaccgctcagcagcacgccatcctggtcgatttgggaaggaccttcccaactcacccttacttctccgttcaacttggaccaggccagctcagcctgtttaatctgctgaaggcctattctctgctcgataaagaggtcgggtactgtcaggggattagctttgttgccggtgtcctacttctccacatgtcggaagagcaggcgttcgagatgcttaagtttctgatgtacgatctgggattccgcaagcagtatcgccctgacatgatgagtctgcagattcagatgtaccagctgtcccgcttgctgcatgattaccacagagacctgtacaaccatttagaggagaatgaaataagcccatcactgtacgctgcaccttggttcctgactttatttgcctctcagttcagtttgggcttcgtggcacgcgtttttgatattatttttctgcaggggacggaggtcatatttaaggtcgccctctccctcttgagttcccaggagaccctgattatggaatgcgagagcttcgagaacatcgtggaattcctgaagaataccttgcccgacatgaacacctccgaaatggaaaagattattacgcaggtttttgagatggacatctccaagcagctgcacgcctatgaggtggaatatcacgttctacaggatgagctgcaagagtcctcctacagctgtgaggacagcgaaactctggagaaattggagagagccaactcccagctgaagaggcagaatatggacttgctcgaaaaacttcaggtcgcccacactaagattcaggccctggaatccaacctggaaaacctcttaacaagagaaacaaaaatgaagtcattgatcaggactctggaacaagagaagatggcctatcaaaaaacggtggagcagctgagaaagttactacccgctgacgcactggtgaactgtgatctattgttacgggacttaaactgcaatcccaacaacaaggcaaagatcggtaataaaccatag

SEQ ID NO: 243565 - DNA, 849 bp, Artificial Sequence
  Description of Artificial Sequence: Synthetic coding sequence
gacaacgagcaggcagatatattcgagcgggtccagaaaatgaagccagttagtgaccaagaggagaacgaactggtgatactacacctgcgccagttatgcgaggctaagcagaaaactcacgtccatataggcgaaggtccttctactataagcaactctactattcctgagaacgctaccagcagcggcaggttcaagctggatatcttaaagaataaggcgaagcgttctctaacatcctccttggaaaacatattttcccggggagccaaccgtatgcgcggaagactcgggtctgtcgatagcttcgaaagatccaacagcctcgccagtgaaaaagactattctcctggagatagcccgcctggtactccgccagcgtctcctccctcgtctgcctggcaaacctttcctgaggaagacagcgactcacctcaatttaggagaagagcccacacattttcccaccctccgtccagcaccaagcgtaagttaaaccttcaggatgggagagcccagggtgtccggagcccacttctacgccagtcatcatctgagcagtgtagcgacggggagggacggaaaaggacatcttcaacatgtagcaacgaaagccttagcgtcggcggaacatcagtgacgccaagaaggatctcgtggagacagcggatattcctgagagtggcctcaccgatgaacaaatccccttcggctatgcagcagcaggatggcctcgaccgcaatgaattactgcctctatctcctctctcacctacgatggaggaggagcccctggtcgtgttcctgtctggagaagacgaccccgaaaaaatcgaggagcgttag

SEQ ID NO: 243566 - DNA, 1389 bp, Artificial Sequence
  Description of Artificial Sequence: Synthetic coding sequence
atgaacaaaagtccttcggctatgcagcagcaggacggccttgatcgcaacgaattattacctctcagtcctctgagcccaactatggaagaggaaccactcgtggtgttcctgagtggagaggatgatcctgagaagatagaggagcggaagaagtccaaggagctgaggtcactgtggcgcaaggccattcaccagcagatattgctcctgagaatggaaaaggagaaccagaaactggaaggcgtacccaaatctaggcgcggtgagatctggcagttccttgctctgcagtacaggcttagacacaggctcccaaacaagcagcagccaccagatattagctacaaggaactgctgaagcaacttacggcccaacagcatgctatcctggtggacctgggcagaacatttcccacacacccctacttctcagtacaactcggacctggccagctctcactgtttaatttgcttaaagcctacagtctgctggacaaagaagtcggctactgtcaggggatctctttcgtggctggagtgctcctcctgcacatgagcgaagagcaggcctttgagatgctcaaattcctgatgtacgatctggggttcaggaagcagtataggccagacatgatgtccctccaaatccaaatgtaccagctctctcgcctgctccacgactaccaccgggacctgtataatcatcttgaagagaacgagatctccccctcactatacgctgctccttggttcctgacgttattcgcatcccagttcagccttggcttcgtggcgagagttttcgatattatttttctacaggggactgaggtgatttttaaggtcgctctctcgctgctttccagccaggagacactgattatggagtgtgagtccttcgaaaacatcgtcgagtttcttaagaacacgctccccgacatgaataccagcgaaatggagaagattatcacgcaggtttttgagatggacatcagcaaacagttgcatgcatatgaagtggaataccacgtgttacaggacgagttgcaagagtcttcatattcatgtgaagatagtgaaacgctggaaaagttagaacgtgctaactctcagctaaaacggcaaaacatggacctgctcgaaaagcttcaagtcgcacacactaagatccaggctcttgaatccaatcttgaaaacctgctcaccagggaaacaaaaatgaagtcgctgatcaggaccctcgaacaagagaaaatggcttatcagaaaactgttgagcagcttaggaagttattgccagctgatgcgctggtgaattgcgatctcttgcttagagacctgaattgcaatcccaataataaggcgaagattggcaataaaccttag

SEQ ID NO: 243567 - DNA, 3873 bp, Artificial Sequence
  Description of Artificial Sequence: Synthetic coding sequence
atggagccgccaagttgtatccaggacgaacccttcccccaccccctggagcccgagcccggagtgtccgcacagcccggacctggaaagccttccgacaaacggtttagattatggtacgtcggcggttcttgcctggaccaccgcacaacactgccaatgttgccctggctgatggccgagattcgccgacgatcacaaaagcccgaagccggtgggtgtggcgcaccagctgcgcgagaggtcatactcgttctgagcgcccctttcttgcgatgcgtaccagcccctggggctggcgcaagcgggggtaccagccctagtgccacccaaccaaacccagctgtttttatctttgaacacaaggcacaacacattagtagattcatacacaattctcacgatctgacttacttcgcttacctgataaaagctcagcctgacgacccagagtcacagatggcctgtcatgtgtttagggccactgacccctcccaggtgccggacgtcataagttcaattaggcagctcagcaaagctgcaatgaaggaggatgccaagccatctaaggacaacgaggacgcattctacaactcacagaagttcgaggtgctgtactgtgggaaagtcactgtgacccataaaaaagcaccatcaagtttgattgacgattgcatggaaaaattctccctgcatgagcaacagcgcctcaaaatacaaggggaacaaagagggccagatcccggagaggatctcgctgacttagaggtggtggtgccagggagtcctggagactgcctccctgaggaagctgatggaacagacacgcacctggggctccctgcaggtgcctcgcaacccgcattaacaagtagccgagtctgttttcccgagagaatactggaagacagtggatttgatgagcagcaagaattcaggagtaggtgtagctccgttactggggtccagaggcgggtgcatgagggctctcagaagagtcagccaagaaggagacacgcctccgccccttcacatgtgcaaccaagcgactccgagaaaaatcggaccatgctgtttcaggtgggcagattcgaaataaatttaattagtccagatacaaagtctgtggttctcgagaaaaactttaaagacatctccagctgtagtcagggcatcaagcatgttgaccacttcgggtttatctgtcgggagtcaccggagccaggcttgtcccagtacatctgttacgtgtttcagtgtgcctcagaatctctggttgacgaagtcatgctcaccttgaagcaggcattctcgacagcagccgcactccagagcgctaagacgcaaatcaaattgtgcgaggcttgccccatgcattccctgcataagctgtgtgaacggatagaggggctgtatcctccgcgtgcaaaactagttattcagagacatttatcttctctgacagacaatgaacaggctgacatcttcgaacgcgtccagaagatgaaaccggtatcagaccaggaggaaaatgagctggttattctgcacctcagacaactttgcgaggctaagcagaagacccacgtacatattggagaaggcccttcaactatttctaactcgactattccagagaatgctacctcttcagggcgttttaagcttgatattctaaaaaacaaggcaaagaggtctctcacctcctctcttgagaatatattctcgcggggagctaaccgcatgagaggacgcctggggagcgtcgacagctttgaaaggtctaatagtcttgcgagcgagaaagactattctccaggcgactcaccccctggaacaccccctgcctcccccccaagctctgcctggcaaactttccctgaagaggacagcgattcaccacagttccgcagacgcgcacataccttcagccacccaccctcatcaacgaagaggaaactgaaccttcaggatgggagagcccagggggtccggtctcccttgctccggcagagctcttcagagcaatgttccaatttgtcgagtgtgagacggatgtacaaagagtctaacagctcatcaagcttgccctcactacatacaagcttttccgctcctagttttacagccccatctttcttgaagagcttttaccagaactccggacgcctttccccacaatacgagaatgagatcagcgatggcgaaggacggaagcggacatcctctacctgttccaacgagtcgctttccgtggggggaacatcagtcacgccacgcagaatatcttggagacagcgcattttccttcgagtggcctctcctatgaataagtctccctccgccatgcagcaacaagacgggctcgatcgaaatgaactgctgccactaagcccactgtcgccaaccatggaagaagagcccctagtagtcttcttgtcaggggaagatgatcccgaaaaaatcgaggaaagaaaaaagtctaaggagctgcgcagcttgtggcgtaaagctatccatcagcagatcctcttgctgcggatggagaaagagaatcagaagcttgaagccagccgcgatgaactgcaaagcagaaaagtaaaactagattatgaggaagtaggcgcttgtcagaaagaggtactcatcacttgggacaagaaactgctcaattgccgggcaaagatcaggtgcgacatggaagacatacataccctgctgaaagagggcgtaccaaagtcacggcgaggcgaaatctggcagttcttagctctgcagtaccgcttaagacacagacttcccaacaaacaacaaccccctgatatcagttacaaggagctgctgaagcaattaacagctcagcagcatgccatcctggtggatctcggcagaaccttcccgactcacccctacttttccgtgcagctcgggcctgggcagctatccctgtttaacctgctaaaggcttactctctgttggataaagaagttgggtattgtcagggcattagtttcgttgcaggggtgctactcctgcatatgtcagaagagcaagcattcgaaatgctgaagtttcttatgtatgacctcggcttccggaagcaatacagaccagacatgatgtctctgcagatacagatgtaccagctttcgaggcttcttcacgattaccaccgagacctgtacaaccatctggaggagaatgaaattagtccttccctctacgcagccccatggttcctgaccctcttcgcctcgcagttctcgttgggctttgtggcccgtgtgttcgatatcatatttctacaggggacagaagtgatctttaaggtggcccttagtctgctctcttcacaggaaacacttatcatggaatgcgaatcctttgaaaatatcgtcgagttcctgaagaataccctgccagatatgaacacctctgagatggagaaaattatcactcaggtctttgaaatggacatctccaagcagcttcacgcctacgaggtagagtaccacgtcctgcaagacgagcttcaagagtccagctactcttgcgaggattctgaaaccctggaaaaattggagcgtgctaattcgcagctgaaacggcagaacatggatttgctcgaaaagctccaggtggctcacacgaaaatacaggctctcgagagtaacctggaaaacctcttgacacgggaaactaaaatgaaatcactaattagaacattggaacaggagaagatggcatatcagaaaacagtcgagcagctgaggaaattgcttcccgctgacgcccttgttaactgcgatctgctgctgagggacctgaattgcaacccaaacaacaaagctaagatcggaaacaaaccatag

SEQ ID NO: 243568 - DNA, 1197 bp, Artificial Sequence
  Description of Artificial Sequence: Synthetic coding sequence
atgcatttttccacggtgaccagggacatggaagcctttacggccagctcactttccagcttgggcgcagcagggggttttcctggtgccgcaagccctggagcagacccctacggacctcgcgagccaccaccaccaccccctcgatacgacccttgtgccgctgcggctccaggggcaccaggaccaccaccaccacctcatgcctacccatttgcacccgctgctggcgctgcgaccagcgccgcagccgagcctgagggacccggtgcctcttgtgctgctgcagcaaaggcccctgtgaagaaaaacgcaaaggtagctggagtatcagtccagctggagatgaaggcactgtgggatgagttcaatcagcttggcactgagatgatcgtgactaaagcaggacggaggatgtttccaaccttccaggtaaaactcttcggaatggacccaatggccgattacatgctactaatggacttcgtacccgtggacgataaacggtataggtatgcctttcattcatctagttggctggtggccggtaaagctgatccagctactcctgggcgtgtgcactaccaccctgactccccagctaaaggggcacagtggatgaagcagatcgtgtccttcgataagttgaaactgaccaacaacttacttgatgataacggccacattattcttaattcaatgcacaggtatcagccacgtttccacgtggtgtatgtggaccctaggaaggattctgaaaagtatgcggaagagaatttcaagacctttgtgtttgaagagacaagatttaccgccgtgactgcttatcaaaatcaccgtattactcagctgaagatcgcatcaaacccctttgccaaaggcttccgcgattgtgaccccgaggactggcctcggaatcaccggcctggggctctgccattgatgtctgccttcgcgcgttctcggaatcccgtggcttcaccaacccagccttccggcacagagaagggagggcacgtcctgaaagacaaagaggtcaaagcagagacctcgagaaacactcctgagcgagaagtggagctcctcagagacgccggaggctgcgtcaacttgggactcccctgccccgctgaatgtcagccatttaacactcagggcctagtcgccggtaggaccgccggagataggctgtgctag

SEQ ID NO: 243569 - DNA, 1488 bp, Artificial Sequence
  Description of Artificial Sequence: Synthetic coding sequence
atgcacttttccaccgtaacccgcgatatggaggctttcactgccagtagcttatcaagccttggagctgccggtggctttcccggtgcagcttcccccggtgcagacccctacggacctcgcgaaccgcctccccctccccctagatatgacccttgcgcagctgccgcaccgggtgctcctggcccaccccctcctccacacgcctatcctttcgctccagctgcaggcgctgcgaccagcgcggctgcagagccagaaggccctggggcatcctgcgctgcggcagcaaaggcacccgtaaagaaaaacgcaaaggttgccggtgtttcggtgcagttagagatgaaggctctgtgggacgagttcaatcagctgggcacagaaatgatcgtgaccaaagctgggaggagaatgttcccgacttttcaggttaaactttttggcatggatccaatggcggattacatgctgctgatggatttcgtccccgtcgacgataagaggtatagatacgcattccattcaagcagttggctcgtggcgggaaaggccgacccagccactcctggacgagtccactatcatccagactcccccgctaagggtgcacagtggatgaagcaaatcgtgagcttcgacaagcttaaactgacaaacaacctcctggacgacaacggacacatcattctgaacagcatgcatagatatcagccccgattccatgtcgtttatgtggatcctaggaaggattcagaaaaatacgctgaggagaatttcaaaacatttgtgttcgaggagacgaggttcaccgccgtgacagcctaccagaatcaccgcatcactcagctcaaaatcgcgtctaacccatttgccaagggatttagggactgtgaccctgaggactggcctagaaaccatagaccaggcgctttacccctaatgtctgcattcgctagaagccgcaatccagtcgccagtccgacccaaccaagtgggacagagaaggatgccgctgaggcacgacgcgaattccaacgtgatgcgggtggtcctgctgtcctgggggaccccgcacatccgccacagctgctggccagagtcttatccccctcactccctggggctggcggagctggtggcctggtgccgctccctggggctcctgggggacgaccttcaccccctaacccagagctgcgcttggaggccccaggtgctagcgagcccttgcaccatcatccatataaataccccgcagcggcttatgaccattatctgggtgctaaatccagacctgcaccctatccattacccggtcttaggggacatggctatcatccacatgctcacccccatcaccaccaccaccccgtctctcctgcggctgccgctgctgccgcagccgctgctgccgctgccgcagccaatatgtactcttcagcaggggctgctccacctggttcttacgactactgcccacggtag

SEQ ID NO: 243570 - DNA, 1119 bp, Artificial Sequence
  Description of Artificial Sequence: Synthetic coding sequence
atgcatttcagtacagtcacaagagacatggaggcattcaccgcttcaagcctgtcctctttgggcgcagcaggaggctttcccggagctgcttccccaggcgctgacccctatgggccacgagagcccccaccacctcccccacgatacgatccatgcgccgcagcagctccaggcgctccaggacctcccccacctcctcacgcgtatccctttgcacccgcagccggagcagctacctcagccgctgccgagcccgaaggacctggcgcttcttgcgccgctgccgcaaaagcgcctgttaaaaaaaacgctaaagtggccggagtctcagtgcagttggagatgaaagccttatgggacgaattcaaccagttaggaacagagatgattgtcactaaagccggaagacggatgttcccaacatttcaggtgaagctattcgggatggatcctatggccgattacatgctgttgatggatttcgttcctgtggatgacaagcgatacagatacgcgttccactcctcttcctggttggtggctggcaaggcagatcctgcaactcctggacgtgtccactaccatccagacagccctgcgaagggtgctcagtggatgaaacaaatcgtcagtttcgacaagctgaagctgacaaataatttgcttgatgataatggccacataatcctaaattctatgcatagataccagccgagattccatgtcgtgtacgttgacccacgcaaggattctgagaagtacgcagaggaaaacttcaagacattcgtgtttgaagagaccagatttaccgccgttactgcttaccagaatcatagaataacccagcttaagatcgcgtccaatccctttgcaaaggggttccgggactgtgacccggaggattggccacggaaccacagaccgggagccctgcctctgatgtccgcttttgccaggtccaggaaccctgttgcctcgcccactcagccaagtggcaccgaaaagggcctggtaaccgagggaagcggactacagccaggactgctcgacgttcttctgaagcccccatccaagaaatccgaaagcctgcgtccaccgcactgcaaggatacatag

SEQ ID NO: 243571 - DNA, 1158 bp, Artificial Sequence
  Description of Artificial Sequence: Synthetic coding sequence
atggcggcattcttatccgccggacttggaatcctcgcccctagcgagacatatcctctccccactaccagttccggttgggagccgcgactgggctctcccttcccaagcggtccttgcacctcaagcaccggtgctcaggctgtggccgaacccactggccaaggaccaaagaatccccgtgtttcaagagtaaccgtgcaactcgagatgaagcccctgtgggaagagttcaatcagctgggaactgaaatgattgttaccaaagccggacgaaggatgtttccgccatttcaagtgaaaatcctgggaatggactcactggccgattacgcacttttaatggacttcatcccattggacgacaagcgatacaggtatgcatttcactcaagcgcctggctggttgccggtaaagccgaccccgctactcccggtagggtgcactttcaccctgatagccctgcaaagggggcacaatggatgagacagattgtgagtttcgataagctgaaattgaccaacaacctcctggacgacaacggccacattatccttaacagtatgcatcggtatcagccacggtttcacgttgtgtttgtcgaccccagaaaagactctgagcgatatgcccaggagaattttaaatccttcatattcaccgagacccagtttaccgcggtaactgcataccaaaaccatcgcatcacccagcttaaaatagcctccaatccatttgccaaagggttcagagaatccgacctggacagctggcccgtcgcgcctaggcctctgctgagtgtccccgctcgatcacactcctccttgtcaccctgtgtgttaaagggagccaccgatagagagaaggacccaaacaaagcctcggccagtacctcgaagacacccgcttggctccaccaccagctacttccacctccagaagtgctcctggccccagctacttatcggcctgtcacctaccagtcgctgtacagcggcgctccaagtcacctgggaatcccccgaacacgcccagctccctatccgttgccaaacattcgagccgaccgggaccagggagggctgccattaccagcaggcctgggcttgttaagcccaacagtggtttgcttaggaccaggacaagactcacagtag

SEQ ID NO: 243572 - DNA, 2454 bp, Artificial Sequence
  Description of Artificial Sequence: Synthetic coding sequence
atgatggacgggcctcggtccgatgttggccgatggggcggaaacccactgcagcccccaaccactcctagccctgagcctgagcccgagcccgatggccgaagtaggagaggtggcggtcgttccttctgggcgagatgctgcggttgctgctcttgcaggaacgcagctgatgatgactggggcccagagccctccgatagccgtggtaggggctcaagctccggcactcgtagaccaggcagtcgaggctctgactcccggaggcctgtgtcaaggggaagcggggtgaatgcggcaggtgacggcacaatcagggaggggatgcttgtcgtaaacggagttgacctactgtcatcaaggtccgaccagaatagaagggaacaccacacggatgaatacgaatatgatgagctcatcgtacgtagaggacagccctttcatatgctactattactttcacgtacctacgaaagttccgacagaattaccctcgagctgcttatcggaaacaaccctgaggtcggaaagggcacccacgtaattatcccggtggggaaaggtggctcggggggttggaaagcacaggttgtgaaggcctctggccagaacctgaatttaagggtccacacaagtcctaatgccataatcggaaagttccagtttactgtgcggacacaatctgacgccggtgagtttcagctgccattcgaccctcgcaacgaaatctatatactcttcaatccttggtgcccagaagacattgtgtacgtagaccacgaggactggcgccaggaatatgtgcttaacgagagcggtagaatctactacggcaccgaggcccaaatcggcgagcgcacctggaattacggccagttcgaccacggagtgttggacgcttgcctgtacatcttagaccgaagaggcatgccatatggtgggcgaggggatccggttaacgttagcagagtaatcagcgcaatggtcaactcattagatgataacggagtgctcataggaaattggagtggcgactacagcagagggaccaatccctcagcttgggtcgggtccgtcgaaattctcttgtcttatttgagaactggctacagcgtgccatacggtcagtgctgggtcttcgctggagtcacaacaaccgtcctgcggtgcctcgggcttgctactcgaacagtgacaaacttcaatagtgcccacgatactgatactagcctgactatggacatatactttgacgagaacatgaagccattggagcacctgaatcacgatagtgtttggaacttccatgtctggaacgactgttggatgaagaggcctgacctgccctccggttttgatgggtggcaggtcgttgacgccaccccccaggagacttcttcggggatcttctgctgcgggccttgtagcgtggagtctatcaaaaatggtttagtgtacatgaagtatgacaccccctttatatttgcagaggtgaacagcgataaggtgtattggcagcgtcaggatgacgggtcatttaagatagtctatgtggaggagaaagctatcggcacactgatcgtcactaaggccatttcctctaacatgagggaggatatcacatatttgtataagcatcccgaaggcagcgatgccgaacgaaaagccgtggaaactgcggcagcacacggttctaagccgaacgtgtatgctaatcgagggagtgcagaggacgtcgctatgcaagtggaggcccaggacgccgtaatgggtcaagatctcatggtgtccgtgatgctcattaaccactcttcttccaggaggaccgtgaaactccatctgtacctgagtgtaaccttttataccggggtatcgggtaccatttttaaggaaaccaagaaggaagttgagctggcacctggggcttccgacagggtaacaatgccagtggcttataaagaatatcgacctcacctggttgatcaaggggcaatgctgctaaacgtgagtgggcacgttaaggagagtggccaagtgctggccaagcagcacacatttcgattgcgaactcctgatctatctctaactttgctgggtgcagccgtcgttgggcaagagtgcgaggttcagattgtgtttaaaaaccccctgcctgtgacactaactaacgtggtatttcgactcgaaggttccggactacaacgacccaaaattctgaacgttggtgacattgggggtaatgagactgtgacgttacgacagagcttcgtgccagtccggcctggacctcgccagctaattgcctcactcgattcacctcaactgagtcaggtgcatggagttatacaggtggatgttgcccctgcccctggagatgggggatttttttctgacgccggaggggacagccacctcggagagacaattccaatggcctctaggggtggagcatag

SEQ ID NO: 243573 - DNA, 1200 bp, Artificial Sequence
  Description of Artificial Sequence: Synthetic coding sequence
atgcataaataccagccacgggtgcatgtaatccggaaggatttttcctctgacctttctccgactaagccagtgccagtgggagatggtgtcaaaaccttcaattttccggagacagtttttaccaccgttaccgcataccagaatcaacagatcacccggctgaagattgacaggaatcccttcgccaaagggtttcgtgatagtggaagaaataggaccgggctggaagctattatggaaacatacgccttctggaggcctcctgttcgaacccttactttcgaagacttcactactatgcagaaacagcaggcatctaagaaaaccagtcagggctataccgtcaatcagcactcatccgagaccgacgctatcgagttatacgagcgtagagtctggctaatggaaaggcggggttctaccggcacgtcacccactaccagtagcaccggcacaccatcccctagtgcttcgagccacttgctaagtccctcctgttcccctcccacttttcaccttgcacccaacacctttaatgtgggatgtcgagaaagtcagctgtgtaacctcaacctgtctgactaccctccatgcgcacgctccaatatggccgcactgcagtcgtacccaggtttaagcgatagcggatataaccggctgcaatcaggcactacctccgcgacccagccttctgagactttcatgcctcaaagaacacccagtctgatttccgggattcccaccccccctagtctcccaggaaactcgaaaatggaagcctacggtggacagttgggatctttccctacaagtcagtttcaatacgtgatgcaggccggtaacgccgcatcctcctcttctagtccacatatgttcgggggatctcacatgcaacagagtagctataacgccttctcattgcacaatccttataatctttacgggtacaacttccctacttctccacgattggccgcttcaccagaaaagttaagtgcttcccagtctactttattatgctcaagcccttcaaacggggcttttggggagcgacagtatcttccatccggtatggagcattcaatgcacatgatcagtccctcaccgaataatcagcaggcaacaaacacatgtgacggcaggcagtatggggcagtcccagggtctagcagtcagatgtctgtgcacatggtttag

SEQ ID NO: 243574 - DNA, 1809 bp, Artificial Sequence
  Description of Artificial Sequence: Synthetic coding sequence
atgagcgagaggagacgctccgccgtcgctctgagctccagagcgcacgccttctcagtcgaagcactgattggcagcaacaagaaaaggaaactaagggattgggaggaaaaggggctggacctgtctatggaggccctgagtccagctggacccctaggcgacaccgaggatgccgctgcccacggattagagccccaccctgatagcgaacagtctacaggttctgatagcgaagtcttgaccgagcgtaccagctgcagcttttcgactcacaccgatctggcctctggtgcggctggcccagtcccagcagccatgtccagcatggaggaaattcaggtcgagcttcaatgcgcagacctgtggaagagatttcacgatattggaacagaaatgattatcacgaaagccggtcggaggatgtttcccgcaatgcgggtcaaaattaccggcttggaccctcatcagcagtactatattgccatggatatcgtacctgtggacaacaagagatatagatacgtttatcatagtagcaagtggatggtggcgggaaatgccgatagccctgttcctccgagggtatacattcacccagatagtctggcttctggagacacatggatgcgccaggttgtttcctttgacaagcttaagttgaccaacaatgaactcgatgatcagggccacattatcctgcattccatgcacaaataccagcccagagtacatgtgattagaaaggatttttccagcgatttgtcaccgaccaaaccagtgcccgtcggagatggggtaaagactttcaactttcccgaaaccgtgttcactactgtcacggcctatcagaatcagcagatcacacgcctaaagatagatcggaatccttttgccaaggggttcagggacagtggtcggaatagaactggccttgaagcaatcatggagacctatgctttttggaggccccctgtgagaacactgacctttgaggattttacgacaatgcagaaacagcaaggcggatctaccggaacttcacctaccaccagttccaccggaactccttcccccagtgcttcctcccatctgctcagcccatcatgtagcccccctacattccacctagctcctaatacctttaacgtggggtgtcgggagagtcagctgtgcaatttgaatttgtctgattaccccccttgcgcccgatctaatatggcggctttgcaatcgtatcctgggttgtccgattccggatataatcggctgcaatccggaacgacaagcgctactcaaccctcagagaccttcatgccacagagaactccttcccttatctccgggatcccaacgcctccaagtttgcctggcaattcaaagatggaagcttatgggggacagttgggatcatttccgacatcccagttccagtacgtcatgcaagccggtaatgcagcttcgtccagctcttcgccgcacatgtttggcggttctcatatgcagcagtcatcttataatgcgttcagtctgcacaacccatataatctgtatgggtataatttcccgaccagtcctagactggcagcctcaccagaaaagctgagcgctagccaatccacactcttgtgttcatctccgtccaatggtgcctttggggagaggcagtacctcccaagtggtatggaacactccatgcacatgattagcccatctccgaataaccagcaggctactaatacatgtgacggtagacagtatggggcagtgcccggatccagtagccagatgagcgtccatatggtctag

SEQ ID NO: 243575 - DNA, 762 bp, Artificial Sequence
  Description of Artificial Sequence: Synthetic coding sequence
cgagttcgtaccggactggaggccatcatggaaacctacgcattttggcggccacccgttagaacactgacattcgaggatttcaccacaatgcagaagcaacaggcatcaaagaagactagccagggatacacagttaatcaacactcctccgagaccgacgcgatagagctttacgaacgacgagtgtggttgatggagaggaggggttccacaggcacaagccccacaacaagctcaaccggaacaccctcaccgagcgcttctagccacttactgagtccatcatgtagccctcctacctttcaccttgcaccgaatacctttaacgtcggatgcagggaaagtcagctgtgcaatctgaacctgtcagattaccccccatgtgcacgctcaaacatggccgctctgcagtcataccctggcctctctgactcagggtataacaggttacagtcaggcacaactagcgctacccaacccagcgagacctttatgccgcagcgcaccccaagtctgatcagcgggatccctacaccacctagcctgcctactgctcggtggaagcccactgtggcctcctggggaccattccctttgccatcctttagcatgagttgccgccaggccatgctccctcctgctccccaccaccacacttgctcaggggcagccacgtgttcccgggcaccaacaatgccaagcccttttaccaccttaacaacctgtatggacactattagccctcttcccctgggctag

SEQ ID NO: 243576 - DNA, 993 bp, Artificial Sequence
  Description of Artificial Sequence: Synthetic coding sequence
ggcagaaatcggacgggcctggaggcaattatggaaacgtatgccttctggcgcccaccagtgcggactctgacttttgaagatttcaccacgatgcagaagcaacaagccagcaagaagacgtcccaggggtacaccgtgaaccagcattcttccgaaaccgatgcaattgaattgtatgaacgacgggtgtggctcatggagcggaggggttccactggcacatctcctactacgagctccaccggcactccttctccaagcgcatccagccacctcttgtccccttcttgttcccccccaactttccacttagccccaaatacgttcaacgtcgggtgtagagaatctcaattgtgtaacctgaatctgtccgactatcccccttgcgccaggtctaacatggcggctttacagtcataccccggactcagtgactccgggtataatcgcctccaatccgggactacctctgccactcagcctagcgagactttcatgcctcagcgcactcccagtcttattagtgggatcccaactccaccaagcctccctggtaatagcaaaatggaagcatacggtggccagttaggcagttttcctacttcccaattccagtatgttatgcaggctggtaacgctgcctcctcttcttcttcccctcacatgttcgggggatctcacatgcaacagtcgagctacaatgctttctcactgcacaacccgtacaatctgtatgggtacaactttcccacgagccctcgtctggcagcaagtcctgagaagctgtcagcaagtcaatccactttgttgtgcagttccccgtcaaatggcgcatttggggagcgacaatacttgcccagcgggatggagcactcaatgcacatgatatccccatcacctaataaccaacaagcaacaaacacttgcgacggtcggcaatatggagccgtcccgggatcttcctctcagatgagcgtgcacatggtgtag

SEQ ID NO: 243577 - DNA, 1347 bp, Artificial Sequence
  Description of Artificial Sequence: Synthetic coding sequence
atggctatgagtgaattagggacccgcaaacccagcgatgggaccgtaagccatcttcttaatgtggtggagtcagaactgcaggccggtcgggagaaaggcgatccaaccgaaaaacaacttcagatcattctggaggacgcacctctgtggcagaggttcaaagaagtcacaaacgaaatgattgttacgaaaaacggcagacggatgtttcccgtgctgaagatctccgtgacaggcctggatcctaacgccatgtattcgctactgctcgattttgtcccaaccgatagtcacagatggaagtacgtgaacggtgagtgggtcccagccggtaaacctgaagtgagctctcattcctgtgtgtatatacaccctgactcacctaattttggcgcacattggatgaaagctcccattagctttagcaaagtgaaactgacgaataaactaaatgggggagggcagattatgttgaactccctccacaagtacgagcctcaggtacatattgtgcgcgtgggctctgcccatagaatggtgactaattgcagcttcccagaaacccagtttattgccgtaacggcttaccagaatgaggaaatcactgcactgaagataaagtacaacccgttcgctaaagcttttctcgatgcaaaagaacggaatcacctgagagatgtgcctgaggcaattagcgagtcacagcatgtgacttactctcacctgggcggatggattttttcaaaccccgacggagtgtgtactgcgggaaactccaactatcaatacgccgctccgctgcccctgcccgctcctcatacccatcatggttgcgaacactattccggcctgcgtggacacagacaagcgccatacccatctgcatacatgcatcggaatcattcaccttctgttaacctcatcgaatcatccagtaacaatctccaggttttctccggaccagatagttggacgagcctttccagcacccctcatgcttctatcctgtccgtaccccacactaacggacctatcaacccaggaccatccccgtacccgtgcttatggaccatctccaacggggcagggggacccagtgggcctggacctgaagtccacgcaagtacccccggagcttttctgctgggtaaccccgcagttactagtccaccctccgtattgtccacccaggctccaaccagcgccggagtggaggtgttgggggagccatctctgaccagtattgccgtgtctacgtggaccgcagtggcctctcatccattcgcaggttggggaggccctggtgccggtggtcatcactctccctcctcactcgacggatag

SEQ ID NO: 243578 - DNA, 978 bp, Artificial Sequence
  Description of Artificial Sequence: Synthetic coding sequence
atgatcgtcaccaaaaatggcaggagaatgttccccgtgctgaagatatctgtgactggcctagaccctaatgccatgtactccctgctgctagactttgtccccactgacagccatcgctggaaatacgttaatggtgaatgggttccagcaggaaagccggaagtgagttcccactcatgtgtgtacatccaccctgactcccctaacttcggcgcacactggatgaaggccccaatatcttttagcaaggtcaagctgaccaataaattgaacggcggtggacagattatgctgaattcactgcacaagtatgagccacaggtgcacatagttcgcgtgggctctgcgcataggatggttactaattgtagcttccctgagacacaatttatcgccgtgacagcatatcagaatgaggaaatcaccgccctgaagattaagtataatccattcgcaaaggcttttcttgacgctaaagagcgcaatcacttacgggacgtgcccgaagcgatcagcgagagtcagcacgtaacttacagtcacctgaatctcatcgagagttcctctaataatctccaggttttttcaggcccagactcgtggacgtcactgtcatctactccacatgcttccattctgtcggttccgcacactaacggacccatcaacccgggacccagcccatatccctgtctctggaccatatctaatggcgctggcggaccatctggcccaggacccgaagtgcatgctagtactcctggggcatttctcctgggcaatcctgccgtcacctccccaccatctgtgttatctacccaggctccaacgagtgcaggagtcgaggtgttgggagagccatctctgacttctatagccgtgagcacctggaccgctgtcgcctcccacccttttgccggatggggtggacctggagccggagggcatcactctccaagcagtctggacggctag

SEQ ID NO: 243579 - DNA, 957 bp, Artificial Sequence
  Description of Artificial Sequence: Synthetic coding sequence
tgaaggatgttccctgtgcttaagatcagcgtgaccggactcgaccccaatgccatgtactcactcttgctcgatttcgttcccacggatagccacaggtggaaatatgtgaatggcgagtgggtccctgctggcaaaccagaagtgtcctctcattcctgcgtctacatccatcccgactcacccaactttggcgctcactggatgaaggcacctatcagcttcagtaaagttaagttgacaaacaaacttaacggagggggtcaaataatgctgaatagcctgcacaagtatgagccacaggtacacattgtgagagtggggagtgctcataggatggtcacaaattgctctttccccgagactcagtttatcgctgtaacagcctatcagaatgaggaaataaccgcactcaagatcaagtataatccttttgctaaagcgttccttgacgccaaagagcggaaccacctgcgggacgttccggaggctatcagcgaatctcagcatgtcacttacagccatctgaacttaatagagagttcttcgaataaccttcaagtgttctccggccctgacagctggacgtcattgagttcaactccccacgcaagcattcttagcgtgccccatacaaacgggccaattaaccccggaccctccccctatccttgtctgtggacgatcagcaacggtgccggagggccatccggtcctggaccagaggtccatgcttctactcctggagcttttctgctcgggaatccagccgtcacctctcccccatcggtgttaagcacgcaagccccaacgtctgcaggagtcgaggtgctgggggagccatcactgacctctattgctgtctctacatggacagctgttgcctctcacccctttgccggatggggcggtccgggtgccggtggacatcattctcctagttccctggacggatag

SEQ ID NO: 243580 - DNA, 846 bp, Artificial Sequence
  Description of Artificial Sequence: Synthetic coding sequence
taaaaagaacgagagctcaattggttctacagacgtcagcgggttctgttcgcccacgtgtaccctacattcaccaacacaagctgcctgtgtaaatgcaagatcactgcactaaagattaagtacaatcctttcgccaaggcgttcctcgacgctaaggagagaaatcacttgagagatgtgccagaagcaattagcgaatcccagcacgtgacttacagccacctggggggttggatattcagtaaccctgacggggtgtgtacagccggtaatagcaactatcagtacgccgctcccctacccctgcctgctccccacacccaccacgggtgtgaacattattctggcctgagggggcacaggcaagctccatatccctcagcttacatgcacagaaatcacagcccatctgtcaacctgattgagagctcctctaacaatctacaggttttttccggacccgatagctggacatccctatccagcacaccccacgctagtatcctgtccgtgccccatactaacggtcccataaacccaggcccatccccttatccctgcttgtggacaattagcaatggagcaggcggtccaagcgggccaggacctgaagtgcacgctagtactcccggagcctttttgctggggaatccggcagtgacttccccccctagtgtcctcagcacacaggctccgacatcagccggagtagaggtgctaggagagcccagtctgacctctatcgctgtgtctacctggaccgctgtggcctcacacccctttgccggatggggaggtccaggagcgggagggcaccacagtccatccagtctggacgggtag

SEQ ID NO: 243581 - DNA, 1344 bp, Artificial Sequence
  Description of Artificial Sequence: Synthetic coding sequence
atggaattcacagcatcacctaagccccaactgtcctcgagggctaacgctttctctattgccgcactaatgtcaagtggcggatcaaaagagaaggaagcgaccgaaaacactataaagccacttgagcaattcgtggaaaagtcaagctgtgcccagccactcggcgagttgactagcctggatgcacacggagagttcggaggaggctccggcagtagtccctctagctctagcctatgtaccgagcctttgataccaactacccccatcatcccctctgaggaaatggcaaaaatagcttgttcattagaaacaaaggagctttgggacaagtttcatgagctcggaaccgagatgatcataaccaagagcggacgtcgcatgttccccacgattcgcgtgtctttctcaggggtcgacccagaagcgaaatacatcgtgctgatggacatcgtgcccgtggataataagcgctaccggtacgcctatcataggtctagttggctggtagccggaaaggcagacccaccgctcccggcacggttatatgttcacccagattcccccttcaccggagaacagctgcttaagcaaatggtgtcttttgaaaaggtcaagctgactaataatgaactggatcaacatggccatattattctgaacagcatgcataagtaccagcctagagtgcacatcataaaaaaaaaggatcacactgcttccctcctgaaccttaaatcagaagagttccggacattcatctttcccgaaaccgtgttcacagctgtcacagcatatcagaaccaactgataaccaagctgaaaatcgatagtaacccatttgcaaaaggcttccgggattcttcaagactgacagacattgagcgcgagagcgtggagtccctcattcagaagcatagctacgctcgcagcccaataaggacttacgggggagaggaggacgtgctcggagatgagtcccaaacgactcctaaccgcggttccgcttttaccacaagtgacaacctctctctctcctcatgggtgtcgtcgtcatccagttttccaggctttcagcatccacagtccctgacagctctgggcactagtacagcctccatcgcgactcccatcccgcaccctatccagggctccctgccaccatattccagactggggatgcccctgactccaagtgcaatcgccagcagcatgcagggcagcggaccaacgtttccctcttttcacatgcccagataccatcattactttcagcagggcccttatgctgccattcaggggctgcggcattcatccgcagtgatgacaccattcgtatag

SEQ ID NO: 243582 - DNA, 1608 bp, Artificial Sequence
  Description of Artificial Sequence: Synthetic coding sequence
atggggatagtggaaccaggttgtggggatatgctgaccggaaccgagcctatgcccggatcagatgagggccgtgcgccaggggctgatccccagcatagatacttttacccagagcctggggcacaggatgccgacgaaaggagaggaggaggtagcctaggatcgccctatcccggaggcgctctggtacccgctcccccatcgagattcctcggagcatacgcgtatcctcccagaccacaggctgctggttttcctggtgccggagaaagctttcccccaccagcagatgccgagggttaccaacccggagaaggctatgctgcacccgacccccgagccggactgtatccgggtccaagagaagattacgccttgccagccggtctggaggtgtctggcaaactgcgagtggccttgaataatcatctgctctggtccaagtttaatcagcatcagacagagatgattatcaccaaacaaggtagaaggatgttccccttcctgtctttcaccgtagctggactggaacccacaagtcattatcggatgttcgtggatgttgtgctcgtggatcagcaccactggcgataccagtccggtaaatgggtgcagtgcgggaaggctgaaggctccatgcctggcaacaggctgtacgtgcacccagacagtcccaacacaggcgcacactggatgagacaagaagttagtttcgggaagttgaagctgacaaacaacaaaggagcttcaaacaatgtgacccagatgattgtcctacaatcgctgcacaaataccaaccacggcttcatatagtagaggtcaatgacggcgagcctgaggccgcttgcaacgccagtaacacccatattttcacttttcaggagactcagtttattgccgttacagcgtatcaaaatgctgaaataactcagttaaagatcgataataatccatttgccaaggggttcagggagaacttcgaatccatgtacacctcagttgacacgagtattccatccccacctggtcctaattgtcagttcctgggcggagatcactactctcccctgttaccgaatcagtatccagtgccctcgagattttacccagacttgccaggccaggctaaggatgtcgtcccacaagcctattggctgggcgctccaagggaccatagttacgaggccgaattcagggccgtgtctatgaaacctgctttcttgcccagcgcgccaggccctacgatgtcctattacaggggacaggaggtgctcgctcctggggctggttggccagtggcaccacagtatcctccgaagatggggcctgcgagctggtttcgaccgatgaggacgctgcctatggaaccagggccagggggaagtgaaggcagaggcccagaagatcaggggcctcctttggtatggacagaaattgcacctatccggcctgagagctctgacagcggcctgggagagggtgactcgaagagaagaagggtcagcccctacccctcaagcggcgattcttctagccccgcaggtgcgccatcaccattcgacaaggaggccgaagggcagttctataactattttccaaattag

SEQ ID NO: 243583 - DNA, 1203 bp, Artificial Sequence
  Description of Artificial Sequence: Synthetic coding sequence
atgttcccttctgtccgcgtgaaggttaaaggtctggacccagggaaacagtatcacgttgccatcgatgtagtacctgtggactccaagcgatatcgctacgtgtaccactctagtcagtggatggtggcaggtaacacggaccacctctgtataatccctcgcttctacgtgcatcccgactccccatgttcaggtgagacctggatgcggcagattattagcttcgatcgcatgaaactaacgaacaatgaaatggatgacaagggtcatattatccttcagagtatgcacaaatataagcccagggtgcacgtcatcgagcagggatcttcagtggacttgtcgcagatccagtccctgcccaccgaaggggtgaaaacattttcttttaaagaaaccgaattcacaaccgtcacggcttaccaaaatcagcagattaccaagctgaagatcgaacgtaacccttttgcaaagggcttccgcgacacgggaaggaacaggggggtactggatggtctgctggaaacatacccatggcggccatcattcacgttggacttcaagacctttggtgctgacacccagtctgggtctagtggatcttctcctgtgaccagcagtgggggagcaccaagccccctgaatagcctcctttcaccactgtgctttagtccaatgtttcatctgccgacgtctagtcttggcatgccatgcccagaggcctacctgccaaacgtgaacctacctctttgctataagatatgtccgacaaatttttggcaacagcaacccctggtgttgcctgcgcctgagcggctggctagtagtaattcgtctcagagtctcgctcctctgatgatggaagtgccgatgctgtcttcattaggcgtgaccaatagtaaaagtgggtcgtccgaagacagctcggaccagtacttgcaagccccaaactctaccaaccagatgctgtacgggcttcaaagccccggtaacatcttcctccccaactctataacccctgaggccctgagttgctctttccacccttcatacgacttttaccgatacaacttcagcatgccgtcccggctcatctctggtagcaatcatctgaaggtcaatgacgactcccaggtaagcttcggtgaaggtaagtgcaaccacgtgcattggtatcctgcaattaatcattacctttag

SEQ ID NO: 243584 - DNA, 1563 bp, Artificial Sequence
  Description of Artificial Sequence: Synthetic coding sequence
atggccctatcatcacgcgctcgagcattcagcgtggaagccctagtaggaagaccaagtaaacgaaagctccaggatcccatacaagcagagcagcccgagctgcgagagaagaagggaggagaagaggaggaagagcgtcgcagctcagccgcaggaaaaagtgagcctctagaaaaacagccaaaaacagagccttccactagtgcctccagcggatgtggaagtgactcaggctacggaaacagctccgaatccctggaggaaaaagacatacagatggagcttcagggcagcgaactttggaaacgctttcatgatattggaaccgagatgatcatcacaaaggcgggtaggaggatgttcccttccgtacgtgtgaaagtcaaggggttggacccgggtaagcagtatcacgtggctatcgacgtggttccagtagattccaaacgttacaggtatgtgtatcactctagccagtggatggtggccggaaataccgatcacctctgtatcatcccccgattttacgtgcaccctgattctccttgttctggcgagacctggatgcggcaaatcataagcttcgataggatgaaactgactaacaatgaaatggatgacaagggccatattatcctccagtcgatgcataagtataaaccacgcgtccacgtcatcgagcaaggcagttccgtggaccttagtcagatccagtccctgcctacagagggagtgaagaccttctccttcaaagaaaccgaattcacaacagtgaccgcataccagaatcaacagattacaaagcttaagatcgagaggaacccattcgcaaagggcttcagagacactgggcgtaatcgaggtgtgcttgacggcttattggaaacttacccatggcgacccagtttcacactggactttaaaacattcggagctgacacacagtcgggatcctcaggctcctctccagtaacgtcttcggggggtgcccctagtcccctgaactcattgctctctcccctctgcttttcccccatgttccatttacccactagctcgctgggcatgccttgtccggaggcataccttcccaacgtcaacctgccactatgctataaaatatgcccaacaaatttttggcagcagcagccgctagtactgccagctccagagcggctggcttcatctaacagctcacagtccctcgcaccactaatgatggaggtccctatgctttcaagcctgggggtcaccaacagcaaaagtggctccagcgaggacagttccgaccagtatctgcaggcgcctaactccaccaatcagatgctttacggactgcaaagccccggaaacatcttcctgcctaattcaattactcccgaggccctaagctgcagcttccacccttcttacgatttctaccgctacaacttctccatgccgtccaggctcatctctggctctaaccatctgaaggtcaacgacgacagccaggtttccttcggggagggaaaatgcaaccacgtgcactggtatccagctataaaccattacctgtag

SEQ ID NO: 243585 - DNA, 1563 bp, Artificial Sequence
  Description of Artificial Sequence: Synthetic coding sequence
atggctctgtcatctcgggcacgcgctttcagtgttgaggcactagtgggacggccatccaagagaaagctccaggatcccattcaagccgagcagccagagctacgcgagaagaaaggtggcgaagaggaggaagagcggaggtcatccgccgctggcaaaagcgagcccttagagaagcagcctaagactgaacctagtacttcagcttcgtccgggtgcggaagcgactctggatacggtaattcgagtgagagcctggaagagaaggatatccagatggagctgcagggctctgaattgtggaaaaggtttcatgacatcgggacggagatgatcattactaaagccggacgcaggatgttccctagtgtaagagttaaagtcaagggcctcgatcccggtaagcagtatcacgtggcaatcgacgtggtccctgtggactccaaacggtaccggtatgtctaccactccagtcagtggatggtggcaggaaacacagatcacctgtgtataatccccagattctatgtgcacccagatagtccttgtagtggagaaacttggatgagacaaattatttccttcgacagaatgaagcttactaataacgagatggacgataaaggacatattatcttgcagtctatgcacaagtacaagccccgtgttcacgtcatagagcagggcagttcggtggatttgtctcagattcagtcactgccaactgaaggtgtgaagactttcagctttaaagagacagaatttactaccgtgaccgcataccagaaccagcaaatcaccaagttgaagatcgaaaggaatccatttgcaaaggggtttcgtgacactgggagaaatcgcggagtccttgatggccttctggaaacctacccttggcgtccgagcttcactctagacttcaaaaccttcggtgccgacacacagtccggttcatccggctcctcacctgtgacaagcagtggcggagctccgagtcccttgaacagcctcctgagtcctctttgtttcagcccaatgtttcacctgcctaccagcagcctgggtatgccctgcccagaggcgtacctccctaatgttaaccttccattgtgctataagatctgcccaacaaatttttggcagcagcagccccttgttctgcccgctcctgagcggcttgcaagttccaacagcagccagtccctggccccactgatgatggaagttcctatgctgagctcgctgggtgtgaccaattcaaagtctggcagcagtgaggactccagcgaccaatatctccaagcccctaattccacaaatcagatgctctatggattgcagtcccctgggaacatctttttgcccaattccattacccctgaggcactgtcttgttcttttcatccctcgtatgatttctatagatacaacttctcaatgccatccaggctcatctccgggtccaatcatctgaaggtcaatgatgattcccaagtaagcttcggagaaggcaaatgcaaccacgtccactggtaccccgcaataaatcattacctgtag

SEQ ID NO: 243586 - DNA, 1203 bp, Artificial Sequence
  Description of Artificial Sequence: Synthetic coding sequence
atgttcccctctgtaagggtgaaagtgaaaggacttgatcccggaaaacagtaccacgtggctatcgatgtcgttcccgtggattctaaacgctataggtatgtgtatcacagcagtcagtggatggtcgccggaaatactgatcatctatgtattattccaaggttctatgtacatcctgactcaccatgtagcggcgaaacctggatgaggcagatcatttccttcgacaggatgaaactcaccaataacgagatggacgacaaaggccacattatcctgcagtcaatgcacaaatacaaaccaagagtgcatgtgattgagcagggttctagcgtggacctgtcccagatacagtctctccctactgagggcgtcaagacatttagcttcaaggagaccgagttcactaccgtgaccgcctatcagaaccaacagatcactaagctgaaaatagaacgaaatcccttcgcaaaggggtttcgggacacaggtcggaaccggggtgtactggatgggttgctcgaaacctatccgtggcgtcctagctttaccttggactttaaaacctttggagcagatacccaaagcggctcttccggaagttcaccagtcacctccagcgggggagcaccaagtccgctgaactccctgctgtcaccactctgctttagccccatgtttcatctccccacgtcgtctctgggcatgccttgtcccgaggcctacttgcccaatgtgaacctacctctttgctataaaatttgtccaactaatttttggcaacagcagcctctcgtcctgccagccccagaaaggctggccagttcaaacagttcgcagtctctggcccctctcatgatggaggtacccatgctgtcctccctgggcgtcactaacagtaaaagcggcagctccgaggactctagtgaccagtacctgcaagctcccaactcaaccaatcaaatgttgtacggtttgcagtcccctgggaatatctttctgcctaattcgattacaccagaggccctcagctgttcattccacccctcttatgacttttaccgttacaatttcagcatgccttcccggctgataagtggaagcaatcacctaaaggtcaacgacgactctcaagtgagcttcggggaggggaagtgcaatcacgtgcactggtacccagctataaaccactatctgtag

SEQ ID NO: 243587 - DNA, 2232 bp, Artificial Sequence
  Description of Artificial Sequence: Synthetic coding sequence
atgagtctgagcatgagagaccctgtgatccctggcacctccatggcctatcatccctttctccctcaccgggctccagacttcgccatgagcgccgtgctcggccatcagccacccttttttccggctctgactttgccgcctaacggagccgcagctctgtcgctccccggtgctctggctaaacccattatggatcagttagtgggggctgccgaaactggaatcccctttagtagccttggaccacaggcccacctgcgccctctaaaaacaatggagcctgaagaggaagttgaggatgacccgaaggtgcacctcgaagctaaggaactgtgggaccaattccataaaagggggaccgagatggtgatcaccaaaagcgggaggaggatgttccctcctttcaaggtgagatgcagtggcctagataagaaagccaaatacatccttctaatggatattatcgccgcagacgattgccgttataagttccataattctagatggatggtggcaggcaaggccgaccccgaaatgcccaaacgaatgtatatccatcctgactcccccgctactggcgagcagtggatgtccaaggtcgtgacctttcacaaactcaagctgaccaacaatatatcggacaagcacggattcacgctcgccttcccctccgaccatgccacttggcagggtaactactcatttggcacgcagactattctgaacagtatgcacaagtatcagccgaggttccacatcgtcagggcaaatgacattttgaagctaccatactcaacctttaggacgtatctattccccgaaactgaatttatcgccgtgacagcctatcagaacgataagatcacccagctcaaaatcgacaacaaccctttcgccaaagggtttcgcgataccggaaacggccgacgggagaaaaggaagcaacttacactccagagtatgcgcgtgttcgatgaaagacataagaaggaaaacggtacctctgacgagagtagttccgagcaggcggctttcaattgcttcgcccaagctagttcccccgcagcaagtacggtgggaacgtcaaatctgaaggacctgtgcccgagtgagggcgaaagtgacgccgaggcagagtccaaggaagaacacggaccagaagcttgcgatgccgcaaagatttccactacgacatcggaagagccttgcagagataaaggcagcccagctgtgaaggcccacctgttcgcagctgaaaggccgcgagacagcggccgactggataaagcgagtccggacagtagacatagccccgcaaccattagtagcagcaccaggggcctgggagccgaagaaaggaggtcccccgtgcgggagggcaccgcaccagccaaggtggaagaggccagagctctgcccggaaaggaggcctttgccccactaactgtccagactgatgccgcagctgctcacctggcccaaggccctctgcctggtctcgggtttgccccaggtctggctggtcagcagttcttcaatggccacccactctttctgcacccctcccagttcgccatgggtggagctttcagctccatggctgctgccggaatgggacccctgctcgcaactgtgagcggggcaagcaccggagtgtcaggtcttgattctaccgctatggcctcggctgcggcagcccagggcctatctggggcatccgcagccacgttgccgttccatttgcagcaacatgtgttggcctctcagggactcgctatgagccctttcggcagtctcttcccctacccttacacatacatggcggctgccgcagccgctagttccgctgctgcctcttcatctgtgcacaggcatccatttctgaatctcaataccatgcgcccacgcctgaggtactccccttacagtatccccgtgccagtccccgatggtagtagtctgttgaccaccgctctcccttctatggcagcggcagctggacccctggacggaaaggtggcggcattagctgcgtctccagcttctgtggccgtggactctggtagtgaactgaactcaagatcttcaactctgtcgtcaagctcgatgagcctttcacctaagctctgtgccgagaaggaggctgctaccagtgagctgcaaagcattcagagactggtctccggcctggaggcaaaaccagataggagtcgaagcgcctccccatag

SEQ ID NO: 243588 - DNA, 2172 bp, Artificial Sequence
  Description of Artificial Sequence: Synthetic coding sequence
atgagccttagtatgcgcgaccctgtaatccctgggacatcaatggcctaccacccctttctcccgcatcgagctcctgatttcgccatgtcagccgtgctgggacaccagccgccattctttcccgctctgaccctgcctcccaacggagctgcggcactttcactaccgggagccctggccaagcctatcatggatcagctggtgggcgctgctgaaactgggatccccttctcttctctcggacctcaagcccacctccggccactcaaaaccatggaacctgaggaagaggtcgaggatgaccccaaagtgcacctggaggccaaggaactgtgggaccagtttcataaaaggggaacggagatggtgattaccaagtctgggagacgtatgttccctccatttaaggtccgctgctcaggcctcgacaaaaaggcgaagtacatcctcctgatggacattatcgcagccgatgattgtcgctataaattccataacagcagatggatggtcgcaggcaaggccgatccagaaatgcccaagcgcatgtacatccatcctgacagtccagccactggcgaacagtggatgagcaaagttgtcacatttcacaagctcaagctcaccaacaatatctccgacaaacacggcttcaccatcttgaattctatgcataaatatcagcccagatttcatattgtcagagcaaatgacatcttaaagttaccttattctacatttaggacatatctgtttcccgaaaccgaatttatcgccgtgacagcctatcagaatgataaaatcacacagctcaaaatagataataatccttttgccaagggttttagggatacgggcaacggccgtcgggagaagcgcaagcaactgaccctgcagtcaatgagggtgttcgatgagaggcataagaaggaaaacggcacgagcgatgagtcttcaagcgaacaggctgccttcaattgtttcgcccaggcaagttcacctgccgcatccacggtggggacatcgaacctgaaagacttgtgtcccagcgaaggggagagtgacgcagaggctgaatccaaggaggaacacgggcctgaagcttgtgacgccgctaaaatctctactacgacatcagaggaaccctgtagagacaagggctcaccagcggtaaaggcacacctgttcgcagctgagcgtccaagagatagcgggcgtctggacaaagcatcgcctgactctcgtcattcacccgctaccatcagttcgtccacccgaggcctgggcgctgaggagaggcgttctccagttcgcgagggtaccgctcctgctaaagttgaggaagccagagccctgcccggaaaagaagcgtttgctccactaaccgtccagactgatgccgcagccgcacacctggcacaggggcctttgccgggtctcggcttcgctcccggactcgcaggccagcagttttttaatggacatccgttattcttgcaccctagtcaatttgcgatgggcggagccttcagcagcatggccgctgcaggcatggggcctctgctggccacggtgtctggagcatccactggggtctctgggctggactccaccgccatggctagtgcagcggcagcacagggcctatccggagcaagtgcggcaactttaccattccacctgcagcagcatgtccttgcttcacagggcctggctatgtccccttttggtagccttttcccttacccatacacatacatggctgcggctgcagcagcctcaagcgcagctgccagctccagcgtccatagacatcctttcctcaatcttaacacaatgaggcccagactgcgatacagcccctactccataccagttccggttcctgacggttcgtcactcttgactacagcgctgccttcgatggcagcagccgcagggcctttggatggaaaagtagcagccttggctgcttcccccgctagtgttgccgtcgactcagggagtgagctcaacagccgaagcagcacactgagttctagctcgatgagtctttctccgaagctttgtgccgagaaggaggcggcaaccagcgagttgcagagcatccaaaggctggtttcaggcctggaggctaaaccagaccggtctcggagcgcttccccatag

SEQ ID NO: 243589 - DNA, 1803 bp, Artificial Sequence
  Description of Artificial Sequence: Synthetic coding sequence
atgtccctgtcaatgcgtgaccccgtcatccccggaacctccatggcgtatcacccgtttcttccccacagagctcctgactttgcaatgagtgctgtcctgggtcatcagccacccttctttcccgctctgacactgcctcccaatggcgctgccgctctctcattaccaggcgctcttgcaaagcctattatggatcagttggtcggtgcagccgagaccggcatccctttttccagtttggggcctcaggcccacttgcgcccattgaagaccatggaacccgaggaggaggttgaggatgatccaaaagtgcacttggaggccaaggaactctgggatcaattccacaaaaggggcaccgaaatggtgataaccaaatccggacgaagaatgttcccccctttcaaagtgagatgtagtggtttggacaagaaggcaaagtatattctgctgatggacattatagcggcagacgactgtcgatataagttccacaacagccgctggatggtggcaggtaaggcagaccccgaaatgcctaagcgaatgtacatccatcccgattctccagccactggagaacagtggatgagtaaggttgtcacctttcacaagctgaaactgacaaacaatatttctgataagcatggattcaccctggcttttcctagtgaccatgctacttggcaaggaaattacagctttggaacacagactatattgaacagcatgcataaatatcagccgagatttcacattgtcagggccaacgacatactgaagctcccgtactcaacatttaggacataccttttcccagagaccgaatttatcgccgtgacagcttatcaaaacgacaagattacccagctgaagatcgataacaatcctttcgccaaaggctttcgcgataccggcaatggccgacgggagaagagaaagcagctcacccttcagagcatgcgggtgttcgatgaaaggcataaaaaggagaatggtacctctgatgagagctctagcgagcaggctgcattcaactgttttgcccaggcaagctctccagccgcttccacagtaggcacttcaaacctgaaggatctctgtccttccgagggcgaatccgatgcagaggcggaaagtaaagaggaacacggcccagaggcctgtgacgccgcaaagatttctaccacaacgagcgaagagccatgccgcgacaaaggtagtccagcagtgaaggctcatctctttgccgctgagcggcctcgtgactcaggaaggcttgacaaggccagtcccgactcaaggcacagccctgctacaatatccagttctaccagggggctaggcgcagaagagagacgatcaccagttcgtgagggcacagcacccgctaaggtggaagaggcacgagccctccccggaaaggaggccttcgctcccctgactgtgcagacagacgccgcagctgccgcagcctcaagtagcgtccacaggcatccattcttgaatctcaatacgatgaggcccagactgcgctattcaccgtactcaatcccagtgcccgtgcccgatggaagttctctgctgactaccgcactggccgcaagcccggcttccgtcgccgttgacagcgggtcagaactgaatagcaggtcttcaacactctcttcctcttctatgagcttgagcccgaagctttgtgcagagaaggaagctgctacctctgaactccagtctatccagcgactagttagtggtctggaagccaaaccagacaggtcacggagtgccagcccatag

SEQ ID NO: 243590 - DNA, 1638 bp, Artificial Sequence
  Description of Artificial Sequence: Synthetic coding sequence
atgctgcaggacaaagggctgtccgagagcgaagaggcttttcgcgctcccggaccagcactcggcgaggcctctgcggctaatgcacccgaacccgcattagctgcgccaggcctgagcggtgccgcactggggagtccaccaggccctggcgctgacgtggtggcagcagccgcagcagagcagaccattgaaaatataaaagtgggtctgcatgaaaaggagctgtggaagaaatttcacgaagcagggacggagatgatcatcacaaaggccggacgccgtatgtttccttcctataaggttaaagttaccggcatgaatccaaagactaaatatattttgctcatagacatcgtgcccgctgacgatcataggtataaattctgcgataacaagtggatggtggcaggcaaagcagaacccgcaatgcctggccgactctacgtgcaccccgattctcccgctacaggagctcattggatgagacaactagttagtttccaaaagctgaagctgaccaacaaccatctggacccgtttggtcacattatcctgaacagtatgcacaagtaccagccacgcctgcacattgtcaaggcagacgaaaacaacgcattcggatctaaaaacactgcattctgtacacatgttttccccgagacatccttcatctccgttacatcttatcagaaccacaagattacccagctgaagattgagaacaatccattcgccaaaggattcaggggcagtgacgatagtgacctcagagttgccagactccagtctaaagaatacccagtgatctcaaagtccatcatgaggcaacgacttatatccccacagctgagcgccacccctgacgtcggccctctgctggggacccatcaagctctacaacactaccaacatgaaaatggtgctcacagtcaattggcggagcctcaagatctccctctctcaacttttccgactcagcgcgatagctcactgttttaccactgtcttaagcgcagagatggaacccgccatctcgatttgccttgtaaacggtcatacctggaggccccatccagtgttggagaggaccactacttccgctcgccgccaccctatgaccagcagatgctttcaccctcttattgcagcgaagtcactcccagagaggcctgcatgtattccggctcaggccctgagatagccggagtctctggggtggacgacctcccaccaccacctttaagctgtaatatgtggacctccgtttctccctatacttcttattcggtgcagacaatggagacagtgccttaccagccatttcccacccactttaccgccactactatgatgcccaggttgccaactctctccgcccagtctagccagccgcctggaaacgcacactttagcgtatataaccagctgagccagtctcaggtacgcgaacgtggaccttcggctagcttcccgagggaacgcggtctcccccaagggtgcgaacggaagcctccttctccccatttgaatgcagctaacgaattcctctacagccagaccttcagcctctctagagaatccagcctccagtaccatagcggaatggggaccgtcgagaattggaccgacggctag

SEQ ID NO: 243591 - DNA, 1641 bp, Artificial Sequence
  Description of Artificial Sequence: Synthetic coding sequence
atgctccaggacaaaggactgagcgaatctgaggaggcttttagagctcccggacctgcactgggcgaagcctcagcagcgaacgctccggaacccgctctcgcggctcccggactctcaggagccgctctcggaagtcccccagggcctggggcagatgttgtagctgccgctgctgctgagcagaccattgagaacatcaaggtcggactccacgagaaggagctctggaaaaagtttcacgaagccggtactgagatgattattacgaaggctggacgacgaatgtttccctcttacaaagtgaaagtgaccggcatgaatcccaagacaaagtatatactcctgatcgatatcgtgccagccgacgaccaccggtataagttctgcgataacaaatggatggttgcagggaaggccgagcctgccatgccgggtaggctctatgtgcacccagacagtccagcaacgggggctcattggatgaggcagctcgtctccttccagaagctcaaactcaccaataatcacctagaccctttcgggcatattattctgaatagcatgcacaagtatcagccacgcctccatatcgtgaaagccgacgagaacaacgccttcggcagtaagaacaccgccttctgcactcatgtgttcccagagacgtccttcatctcggttacaagctaccagaaccataaaataacgcagctgaagatagagaataatccttttgctaagggctttcgaggctccgacgacagcgatctgcgcgtcgcgaggttgcaaagtaaggagtaccctgtaattagcaaatcaattatgagacaaagattgattagtccacagttatcagcgacccccgatgtcggcccactgcttgggacccatcaagccctgcagcactaccagcacgagaatggggcacatagccagctggccgaaccacaggacttacccctgtctactttcccaacacagagggactcgtcacttttttaccattgcctaaaaaggcgtgccgacggtactcgacacctggacttgccatgtaaaagaagttacttagaggccccttcgtcggtgggagaggatcattatttcagaagcccacctccctacgaccaacagatgctcagcccctcttactgtagtgaggtaaccccaagggaggcctgcatgtactcaggctcaggacccgaaatcgccggagtcagcggagtcgatgacttaccgcctcccccactgagctgtaatatgtggacatcagttagcccttacacctcctactctgtgcagaccatggaaacagtgccataccagcctttccctacccacttcactgcaacaacaatgatgcccaggctgcctaccctgtcagcccaaagttcccaaccgccagggaacgcccactttagtgtatataatcagctttcccaatcccaggttcgggagagaggcccaagtgcctctttcccacgcgaacgaggactcccccaagggtgtgaaagaaagcctccttccccccacctcaatgccgctaacgagtttctatatagccagaccttctccctttctagggagtcttcgttacagtatcactctggtatgggcacagtcgagaactggactgacggctag

SEQ ID NO: 243592 - DNA, 1557 bp, Artificial Sequence
  Description of Artificial Sequence: Synthetic coding sequence
atggctgacgccgacgagggcttcggcctagcccataccccactggaacctgacgctaaggacctgccttgcgacagtaagccagagtccgcacttggggcaccgagtaagtcaccatcttccccccaggccgcatttactcagcaagggatggagggtatcaaagtttttctgcacgagcgagagctctggttgaagtttcatgaggtgggcaccgagatgattataactaaggcaggccgtaggatgtttccaagttacaaggtaaaggttaccggactgaatccaaaaaccaagtacatccttcttatggacatcgtgcccgcagacgatcatcgttacaagttcgctgataataaatggagcgttacagggaaagcggaaccagcgatgccgggacggctctatgtccatccagacagtccagccacaggcgctcattggatgaggcagttggtgtcgttccagaaactcaagttaactaataaccacttggatcccttcggtcacattatactgaattccatgcacaagtaccagccgaggctgcatattgtgaaggctgatgaaaacaatggcttcggttcaaagaatactgccttctgcacgcatgtgttccctgagacagcgtttattgctgtgacgtcttaccagaatcacaaaataacccagctgaagattgagaataatcccttcgccaaaggcttccggggtagcgatgatatggaactccaccgcatgtctcgtatgcagagcaaagagtatcctgtggtgcctcgaagtacagtgcgacagaaagtggccagcaaccacagccccttctcctcagagagtagagctctctccacatcctcaaacctgggctcgcaatatcagtgcgagaatggtgtgagtggaccctcgcaggaccttctgcccccacccaacccctaccccttgccgcaagaacactctcagatttatcactgcacaaaacgcaaagaagaagagtgtagcacaaccgaccacccctacaagaaaccatacatggagacttcacccagtgaggaggattctttctacaggtcttcatatccacagcaacagggactgggtgccagttatcggaccgagtccgcacagcgtcaagcctgcatgtatgctagctccgcccctccctccgaaccagtccctagcttggaagacatctcctgcaacacctggccttctatgcctagctactctagctgtaccgtcacaaccgtgcagccgatggacaggcttccctatcagcactttagcgcccattttacctccggacccctagtgcccagactggccggaatggcaaatcatggaagccctcagctgggagaggggatgtttcaacaccagacgagtgtggctcaccaaccagtggtgcgccagtgtgggcctcaaacaggtctccagtcccccggaaccctgcagcctcccgaattcctctatagccatggggtacccagaactctctctcctcatcagtatcactctgtgcatggcgtcggaatggtgcccgagtggtctgacaattcatag

SEQ ID NO: 243593 - DNA, 1407 bp, Artificial Sequence
  Description of Artificial Sequence: Synthetic coding sequence
atggaagggatcaaggttttcctccatgagcgggagctatggttgaaatttcacgaagtcggcacagagatgataattactaaggcgggaaggagaatgttcccatcatataaggtgaaggtgacgggactgaatcctaagacaaagtatatcctgctgatggacatcgtgcccgcagatgaccaccggtataagtttgccgacaacaaatggagcgtgaccggcaaggccgagccggcaatgcccggaaggctgtacgtgcaccctgacagcccagctaccggcgctcattggatgaggcagcttgtcagcttccagaagctgaagctgaccaataatcatctggatccatttggccacataatactgaactcaatgcataagtatcaaccaaggcttcacattgtcaaggctgatgaaaacaacgggttcggcagcaagaacaccgccttttgtacacatgtctttcccgagacagccttcatcgcggtcaccagttaccagaaccataaaatcacacagcttaagatcgagaacaatccgttcgcaaaggggttcaggggtagcgacgatatggaattgcatcgcatgtcgaggatgcaatcgaaagaataccccgtggttccaaggtctaccgtccgtcagaaggtcgcaagcaaccacagtccgttctccagtgagtctcgggcactttcaaccagctccaatctgggctcccaataccaatgcgagaatggagtgtctggcccttcacaggatctcttgccgccacctaacccttaccccctgccccaagagcactcacagatctaccactgtacaaaacggaaagaggaagagtgctctacaactgaccacccttataagaagccttacatggaaacgtcaccttccgaagaagattctttctatcggtcatcctacccacagcaacaaggcctgggcgcaagctataggactgaaagtgcacaaagacaggcatgcatgtatgcttctagtgcccctccatcggagcctgtgccatctctggaagacattagctgcaatacttggcccagcatgccctcttattcctcatgtaccgttaccaccgtccaacctatggacaggcttccctatcaacacttttcagcccactttacgtccgggcctctagtgcccaggttagccggaatggctaaccacggctccccacaactgggcgaaggcatgttccaacatcagacctcggttgcacaccaacctgtggtcagacagtgcgggcctcagaccggattgcagtcccccggtactctgcaacccccagagtttctgtattcccacggagttcccagaacactctccccacaccagtaccattccgtacacggagttgggatggttccagagtggtccgacaactcctag

SEQ ID NO: 243594 - DNA, 1557 bp, Artificial Sequence
  Description of Artificial Sequence: Synthetic coding sequence
atggcagatgcggatgagggcttcggactggcgcatactcccctggagcccgacgccaaagatctcccctgtgattctaaacctgagagcgcacttggagccccatcaaagtctccaagctctccccaggccgcttttactcagcagggaatggaggggattaaagttttcctacacgagagggagctatggctgaaatttcacgaagtcggcacagagatgatcattaccaaggctggtcggagaatgttcccatcatacaaagtcaaagtgaccgggttgaatcccaaaactaagtacatactcctgatggatattgtccccgctgatgatcacaggtacaagttcgcagataacaaatggtcagttaccggtaaggccgaaccagccatgcctgggaggttatacgtgcatcccgattcgcctgctacaggcgcacattggatgagacaactagtctccttccagaagctgaagctcactaataaccaccttgaccccttcggacatatcatcctcaattccatgcataagtatcagcctaggctgcatattgtgaaggctgatgaaaacaacggattcggatctaagaataccgctttttgtacccatgtctttcccgaaaccgctttcatcgctgtaacaagttatcaaaatcacaaaattacacagctgaaaattgagaacaacccctttgcaaaagggttccggggatctgatgacatggaactgcataggatgtcaagaatgcaaagcaaggaatatcctgtggttccacgctccactgtgcgacagaaggtagcatctaatcactcaccgttctcctcagaaagtcgggcactctccactagcagcaatcttgggagtcagtaccagtgtgaaaacggagtgagcggcccttcccaggatttactgcccccaccgaatccctaccctttgccccaagaacacagtcaaatctaccactgcaccaaaagaaaggaggaggagtgcagtactactgaccatccttacaagaaaccatacatggagacttcaccgtcggaagaggattccttctatagaagtagctatcctcagcagcagggacttggtgcctcatataggaccgagtctgcacagaggcaagcctgcatgtatgcatccagcgccccacccagcgagcctgttccttctctagaggatatctcatgtaatacatggccaagtatgccctcttacagtagttgtactgtaaccactgtccagcctatggacaggttgccttatcagcacttttctgctcacttcacaagtgggccacttgtccccaggctcgccggtatggccaatcatggaagcccgcagctcggagagggaatgttccagcaccagacatctgtggcccatcagccagtggttagacagtgcggaccacagacgggcctccagagccctggcacccttcaaccgccagagttcctgtactctcatggggtgccgagaactctttctccgcaccaatatcattccgttcatggggtaggcatggtaccagaatggtcagataattcatag

SEQ ID NO: 243595 - DNA, 1269 bp, Artificial Sequence
  Description of Artificial Sequence: Synthetic coding sequence
atggacatagtaccggctgacgatcacaggtacaaattcgctgataataagtggagtgtaaccggaaaagcagaacctgcaatgcccggtcggctttacgtgcatccagactctccagcaaccggtgcgcattggatgagacagctggtttcttttcagaaactcaaactcacgaacaaccacctggacccctttggacatatcattttgaattcaatgcacaagtatcagccacgcctgcacatcgtcaaggctgacgagaacaatgggttcggttccaagaacaccgccttctgcacacatgtgttccccgagacagctttcatcgcagttacctcttaccaaaaccacaaaatcacacaattgaagattgagaacaacccatttgccaagggcttccgcggatcagatgacatggaattgcacaggatgtcccgaatgcaaagtaaagaataccctgtggtgcctaggtcgacagtgcgtcagaaggtggccagcaaccactcacccttctcttctgaatcccgggctctctcaaccagctccaacctgggctcccagtaccagtgcgagaacggcgtatcaggaccctcacaggatttgctgcctccaccaaacccataccctctgcctcaagaacactcccagatttaccactgcaccaagagaaaggaagaggagtgttctactacagatcacccgtataaaaagccctatatggagacatccccatctgaagaggacagtttttacaggtcttcttaccctcaacagcagggactgggcgcaagttaccgcacagagagtgcccaaaggcaggcctgtatgtatgctagctcagccccaccttctgagcccgtgccatctctagaggacatctcctgtaatacatggcctagcatgccgagttattcaagctgcacggttaccaccgtgcagcctatggaccggttaccttaccaacatttcagcgcccactttacaagtggaccgttagtccctcggcttgctggcatggcaaatcatgggtcaccacagctcggggagggcatgttccaacaccagacctccgtagcgcaccagcctgtagttagacagtgcggaccccaaaccggcctgctacacaatcggcatttcctcgaaaaggaacgggaaaggggggaaagagagagacgcagagagaccgtagcaaagcggacccccagaactaggttctttatctcccctaacgtacacatatgcactcagggcagatggatgctgatatag

SEQ ID NO: 243596 - DNA, 1050 bp, Artificial Sequence
  Description of Artificial Sequence: Synthetic coding sequence
atggcggacgccgacgaaggctttggactagcccacacaccactcgagccagacgctaaggatctcccctgtgattccaagcctgagtctgctctgggcgctccctctaagtccccatcctcacctcaggccgcatttacccagcagggtatggagggcatcaaagtgttcctccacgagcgcgagctctggctgaagtttcacgaggtgggaacggagatgatcattactaaggcagggcgtagaatgttcccatcgtacaaggtgaaggtgacaggcctgaaccccaaaactaaatatatcctcttaatggatatcgtcccagccgacgatcacagatacaaattcgcagataacaaatggtccgtaacaggtaaagctgagcctgccatgccgggtcgcctgtacgtgcaccctgattctcctgctaccggtgcacattggatgcgacagctggttagtttccagaagcttaaactgaccaacaaccatttggatccattcgggcacattattctgaattctatgcataagtaccagccccgtttgcatatagtcaaagcggatgaaaacaacggatttggctctaaaaacactgcattttgcacccatgtctttcccgaaacagccttcattgccgttaccagttatcaaaatcacaaaattactcagctaaagattgagaacaacccgtttgccaaaggattccgcggttctgacgacatggagttgcacagaatgtcgaggatgcagtcaaaggaatatcccgtggtccctcggtcaaccgtgagacagaaagtggcgagtaaccattccccctttagctctgaatccagagcgttgagtactagcagcaacttaggttcccagtatcagtgcgagaacggtgtgtcaggcccatcacaagatcttcttccacctccgaacccgtatcctttgcctcaggaacactcccagatctaccattgtacaaaacgcaagggtgagtgtgaccacccatggtcaatttgctttctctcttatctgttcctaagccttggttggggatag

SEQ ID NO: 243597 - DNA, 1311 bp, Artificial Sequence
  Description of Artificial Sequence: Synthetic coding sequence
atgtaccatccccgtgagctttatccatcactaggggctggttaccggctgggacctgctcaacctggggctgactcctccttccccccagcattggctgagggctatagataccccgaactggacacccccaagctggactgcttcctatccgggatggaggccgctcctcgaacactagcagctcacccacccttgcccctcctcccccctgcaatggggacagagccggctccatctgctccagaagctctgcacagcctccctggcgtcagcctgtccctcgagaaccgggagttatggaaagagttttcctccgtggggacagaaatgattatcacaaaggcaggccgtaggatgtttccggcttgtcgcgtgtccgtcaccgggctggaccccgaagcacgataccttttcttgttggatgttattcctgttgacggagctcggtaccgctggcagggacggcgatgggaaccttctggaaaggccgaaccaagactgcctgaccgcgtgtacattcatcccgactctcctgcgacgggagcacactggatgagacagcctgtatcttttcatcgtgttaaactaacaaactctaccctggaccctcatggccaccttattctgcattcgatgcacaagtatcagccgcgtatccacttggtgcgcgcagcgcagttatgttcccagcattggggagggatggctagtttccgatttcccgaaactacattcatatctgttaccgcctaccaaaacccacagataactcagctcaagatcgctgccaacccttttgccaaggggttcagagagaatggaaggaactgcaaaagggaaagggatgcgcgagtgaaacgaaaactgcgtggcccagagccagccgctaccgaggcctacggatccggcgatacccctggcggtccatgcgattccaccctcggcggagatattcgtgagtctgaccccgaacaagcgccagctcccggagaagcaaccgcggcaccagctccgctctgtggcggaccctctgctgaggcctatctcctgcatccagccgctttccatggggctccctcccacctacccacccgctctccgagcttcccagaagcgcctgattcaggcaggtccgccccttactctgccgcatttttagaattacctcacggcagcgggggatccgggtaccctgctgcccctccggcagttcctttcgcacctcactttctgcagggtggcccatttcccttgccctacaccgcccctggcggttaccttgacgtcgggagtaagcccatgtactag

SEQ ID NO: 243598 - DNA, 1311 bp, Artificial Sequence
  Description of Artificial Sequence: Synthetic coding sequence
atgtaccatcctcgggagctctatccatcattaggcgcaggttataggcttgggccagcacaacctggagctgacagctcgttcccaccggcacttgctgaaggttacaggtaccccgagttagacacaccaaagctcgattgcttccttagcggcatggaggcggcaccacgaacactggccgctcacccgccattacccttgcttccacctgccatgggtacggagcccgcaccgtcagctcccgaggccctgcattcattgccaggagtgagcctctctctggagaaccgcgagctctggaaggaattctcctcagtggggactgaaatgattattacaaaggcgggacgtcgtatgtttcctgcctgtagggttagtgtgaccgggcttgatccagaggcgagatatctcttcctcttggacgtgattcccgtggacggggctaggtatcgatggcaaggcaggagatgggagccttccggcaaagctgaacccagattacctgatcgggtatacatacacccggacagccccgcaacaggggcacactggatgagacagcctgtcagtttccaccgagtgaagctgactaactcaactctggacccccatgggcatctcatccttcactccatgcacaagtatcagccaaggattcacctggtccgcgctgctcagctgtgttcccaacattggggtggtatggccagttttcgcttcccggagaccacttttatcagcgttacagcataccagaaccctcagattacccaactcaagatcgccgctaacccatttgctaaaggattccgagagaacgggcgtaactgcaaacgagagcgggatgcgcgagtgaaaagaaaattgagaggacctgagcccgctgcaaccgaggcgtacggttcgggggacactcctgggggtccatgtgatagcacgctgggaggggacatccgcgaatccgatcccgaacaggcaccagctcccggagaggccaccgccgctcccgcaccactgtgtggcggaccgtccgctgaggcctatctgctgcaccccgctgcattccatggtgccccaagccaccttccgactagaagcccgtcttttcctgaagcacccgattctggacgaagtgcaccctactccgcagcgttcctggagcttcctcacggttccggcggaagtggctaccccgcagcccctcccgcagtccccttcgctccacacttcttgcaagggggacccttcccacttccttacacagcgccaggtggctaccttgacgttggtagcaagccgatgtactag

SEQ ID NO: 243599 - DNA, 888 bp, Artificial Sequence
  Description of Artificial Sequence: Synthetic coding sequence
atgtatcaccccagagagctttacccatctctaggagccggttaccgcttgggacctgcccaaccgggagcagactctagttttccgcctgccctggcagagggctaccggtaccccgagctggacacccctaagttagattgctttctgagtggaatggaggctgccccaagaacacttgccgcacatccccctctgccattactcccaccagccatgggcaccgagccggcaccttccgcacctgaggcgctgcattctcttcccggtgtgagtcttagtttggagaacagggaactatggaaggaattttctagcgtcgggaccgagatgataattacaaaggcagggagacggatgttccctgcttgtcgcgtcagcgtgaccggactcgaccccgaagctagatacctgtttctgctggacgttatacccgtggatggggcaagatataggtggcaggggagacggtgggaaccctccggcaaggccgagcccagacttcctgaccgagtgtacattcaccctgattcgcccgcaactggggcacattggatgagacagccagtgtcattccaccgcgttaaacttaccaattcaaccctggatccccacgggcatctgatcctgcactcgatgcataaataccagcccaggatacatttggttcgggctgcgcagctgtgctcccagcattggggaggcatggcaagttttcgctttccagaaacgactttcatatctgtgacggcatatcagaacccacagatcacacagcttaaaatcgcagcaaacccctttgccaagggcttccgagaaaacgggaggaactgcaaacgctgggagctttttattcacctctttatgcattccactaacgtgtattag

SEQ ID NO: 243600 - DNA, 1974 bp, Artificial Sequence
  Description of Artificial Sequence: Synthetic coding sequence
atggaaatggaaacaacagaacccgaacctgactgcgtggtgcagcccccatcacccccagacgactttagttgccagatgagactgtcagagaaaattacacctctgaaaacgtgctttaagaagaaagatcagaagcgcctgggcacaggaactctgcggagcctgcgccctatcctgaacaccctgctcgagagcgggtcactggatggcgtgttccgctctagaaaccaatcgaccgacgaaaattccctgcatgaaccaatgatgaagaaggccatggagattaacagctcttgtcccccagctgagaataacatgtctgttctgattccggatcgtacaaatgttggagatcagatccccgaagcccacccaagcaccgaagctcctgaaagagtggtaccgatccaagaccatagctttccatcagaaactctctctgggactgtcgccgatagtactcccgctcattttcagacggatctcctccaccccgttagcagcgacgttcccacatctcctgactgcttagacaaggtcatcgactatgttccgggaatctttcaggagaacagttttactattcagtatattctagatacctctgataagctgtcaaccgagctctttcaagataaaagcgaggaggccagtctggacctcgtgtttgagctcgtgaatcaactgcagtatcatacccaccaagagaacgggattgagatctgcatggacttcctccagggaacatgtatctacggaagggactgtctcaaacatcacactgtcttaccataccattggcagatcaaaaggaccaccacgcagaagtggcagtcggttttcaacgacagccaagagcaccttgagcgcttttactgtaacccagaaaatgaccggatgcggatgaagtacggagggcaggagttctgggccgacctgaacgctatgaatgtctatgaaactacggagtttgatcaactgcggaggctgtccaccccgccaagcagcaatgtaaactcgatctatcataccgtctggaaattcttctgtcgggatcacttcggctggagggaatatcctgagtccgtgataaggctgattgaagaggccaactcgcgaggtttaaaggaagtaaggtttatgatgtggaacaatcattacatcctgcataactctttcttccgccgagaaatcaaacgcagacctctgtttcggagctgtttcatcttgctgccttatctgcagaccttggggggtgttcccacacaagcccctcctcccttagaggctacaagtagcagtcagattatttgtcccgatggtgtgacatccgctaatttctatcccgaaacatgggtgtatatgcacccttcccaggactttatacaggtccctgtaagtgcagaggacaaaagctataggattatttacaatctatttcataaaaccgtgcctgagttcaagtaccgaattttacagatactgcgcgtgcagaatcagtttctgtgggaaaaatacaagcgcaagaaggagtacatgaacaggaaaatgtttggacgagacagaataatcaatgagaggcacctgtttcacggaaccagccaggatgttgtcgatggaatctgcaaacacaacttcgaccctcgagtctgtggcaagcacgccaccatgttcgggcagggatcctactttgcaaaaaaggcaagctactcacataatttcagcaagaaaagctcaaagggtgtccactttatgttcttggccaaggtgctgacaggcaggtacacaatgggctcgcatggaatgcgcaggcccccaccggtaaaccctgggtcggtcaccagtgatctgtatgactcatgcgtcgataacttctttgagcctcagatattcgttatatttaatgacgatcaatcctacccttacttcgtgatccagtatgaggaagtgagcaacaccgtgtctatttag

SEQ ID NO: 243601 - DNA, 1974 bp, Artificial Sequence
  Description of Artificial Sequence: Synthetic coding sequence
atggagatggaaacgaccgagcctgagcctgattgcgttgtgcagcctccaagccccccagatgatttttcatgccagatgcggctgtcagagaagattacgcctctgaaaacctgcttcaagaaaaaggaccagaagcgcctcggaactgggaccctacgatcactgaggccaattctgaacactctcctggagtctggctcactggacggtgtgtttaggtctaggaaccagagcaccgacgagaacagtctccatgagcctatgatgaagaaggctatggaaatcaatagcagctgcccaccggctgagaacaatatgagcgtgcttatcccggatcgaacaaatgtaggagatcagatcccggaagcgcacccttcgactgaggctccggagagggtggtacccatccaggatcattctttcccctcagaaactctgagcggcactgtcgcagattctacccctgcacactttcaaacagacctgcttcatccggtgagctcagacgtccctacttctcctgattgcctcgacaaagtcattgactatgtccccggaatctttcaggagaactcttttaccattcagtatattttggatacatcagacaagcttagtaccgagctttttcaagataaatctgaggaggccagtctagacctcgtttttgagttggtgaaccagttacagtaccatacccatcaagaaaacgggattgagatctgcatggactttctgcagggcacttgtatatacgggcgagactgcctgaaacaccacacagtactcccctaccactggcagataaagcggaccactactcagaagtggcagtctgtgttcaacgactcccaggaacacctggagagattctactgcaaccccgagaatgataggatgaggatgaagtacggtggccaggagttctgggccgacctgaacgcaatgaacgtttatgaaaccacagagttcgatcaactccgccgattatccacccctcctagttccaacgtgaactccatatatcacactgtgtggaagtttttctgtagagatcactttgggtggagggagtaccctgagagcgttattaggctcatcgaggaggctaactcacgcggtttgaaagaagtgaggtttatgatgtggaacaaccactatatcctgcacaattcttttttccgaagggagattaaacggaggccactgtttcgcagttgttttatcctgctgccctatctccagaccctaggaggggtgccaacccaggcacctccccctctcgaagccacatcaagcagccaaatcatctgccctgatggggtaacatctgctaatttctaccctgagacatgggtctatatgcacccgtcccaggatttcatccaggttcccgtctccgctgaggataagagttatcggatcatctataacctgttccataagacagtaccagaattcaaataccggatcctgcagatcctgcgcgtgcagaatcaattcctgtgggaaaaatataagagaaaaaaggaatacatgaaccgtaagatgttcgggagagacagaatcatcaatgagaggcacctctttcatggtacctcgcaggacgtggtcgatggcatctgcaaacacaatttcgaccctagagtatgtggcaaacatgccaccatgtttggccagggatcctactttgccaagaaagcatcctactctcacaacttttcaaagaaaagtagcaaaggcgttcactttatgtttctggcgaaggtgctgaccggaaggtacactatgggatcacacggaatgaggaggccaccgccagtcaatccaggcagcgtgacctccgatctgtacgattcatgcgtggacaattttttcgaaccccaaatatttgtaatttttaacgacgatcagtcttatccgtattttgttatccagtacgaagaggtctctaacacggtgagcatctag

SEQ ID NO: 243602 - DNA, 1521 bp, Artificial Sequence
  Description of Artificial Sequence: Synthetic coding sequence
atggaaatggaaaccactgaacccgaacctgactgtgtcgttcagcccccatcaccacccgatgactttagctgccaaatgaggctgtcagagaaaatcacaccgttaaaaacatgtttcaaaaagaaggaccagaaaaggctgggcactggaacgcttcgaagtctgcgccctattttgaacaccttgttggaatctggctcactcgacggtgtcttccggtctcggaatcagtccacagatgaaaattcactgcacgaacctatgatgaaaaaagcgatggagatcaactcctcatgccctccagctgagaacaacatgtctgtgctaatcccagaccgcaccaatgtcggcgatcagattcctgaggcccatccgtcaactgaggctccagagagggtcgtgccaattcaggaccactccttcccatcagagaccctctcgggaactgtggctgacagtacacccgctcacttccagaccgatctgctgcacccagtgtcttccgatgtgccgacaagcccggattgcttagacaaagtcatcgattacgtgccaggaattttccaggagaattcctttaccattcagtatattcttgatacgagcgataagctgagcacagagctgttccaggacaagagcgaggaggcttctctcgatctcgtgtttgaattggtgaatcaattacagtaccatacacaccaggaaaacggaatcgaaatctgcatggacttcctgcagggcacctgcatttacggacgagattgtcttaaacaccacactgtcctcccttatcattggcagatcaagagaacaactacacagaagtggcaatccgtctttaacgacagtcaggaacacctggaacggttttattgcaatcccgagaacgatcgtatgcgcatgaagtatgggggacaggagttttgggcagatctcaatgcaatgaatgtgtacgagacgaccgagttcgaccaactgcgcagactctcaacgcccccaagcagtaatgtaaacagtatctatcacaccgtctggaagttcttttgcagggaccattttggatggagggagtacccagaatcagtcatccggctgatcgaagaagcaaactcgcgaggactgaaggaggttagatttatgatgtggaataaccattatatcctgcacaatagcttttttagacgggagatcaaacggaggcccttgttcaggtcctgtttcattctcctgccttacttgcagaccctcggcggtgttccaacccaggcacccccacccctggaggcaacatcttcctctcagataatctgtcctgatggggtgacctctgcgaatttctaccccgagacatgggtttacatgcatccctcccaggattttatacaagttccagtgtccgctgaggacaagtcctatagaattatttacaacctgtttcataagacagtcccggagtttaagtaccgtatactgcagattctccgagtccaaaatcagttcttatgggagaaatag

SEQ ID NO: 243603 - DNA, 1965 bp, Artificial Sequence
  Description of Artificial Sequence: Synthetic coding sequence
atggagatggaaaccacggaacctgagcccgactgtgtagtgcagcccccaagtcctccggatgactttagctgtcagatgcgcctctccgaaaagataaccccgcttaagacttgttttaagaagaaagatcaaaaacggctcggaaccgggacgctgcgtagcctcagaccgattctgaatacactacttgagagcggatctcttgacggggtgttccgctccagaaaccagtcaactgatgaaaacagtttgcacgagcccatgatgaagaaggctatggaaattaactcgagctgccccccagcagaaaataatatgagtgtgctgattccagataggactaatgtgggcgaccagattcccgaggctcacccaagcaccgaggctcccgaaagagttgtacccattcaggatcacagctttccctccgagaccctgagcggaactgttgccgattcgactccagctcattttcagacggacctactacaccctgtgtcttctgacgtcccaactagcccagactgtctggacaaagtgatagactatgtgcccggaatattccaggagaattctttcaccattcagtacatcctcgatactagcgataagctgtcaaccgaactgttccaggacaaatccgaagaagctagtctcgacctggtgttcgaacttgttaaccagctgcagtaccacactcaccaggagaacgggatagagatctgcatggactttctgcaaggaacttgcatatacggccgagactgtctgaagcaccacaccgtcctaccttatcactggcagattaagcgaacgacaacccaaaagtggcagtccgtgttcaacgatagtcaagaacacttagaaagattttattgcaatccagaaaatgaccgtatgcgtatgaaatacggcggacaagagttctgggctgatctgaatgcaatgaatgtgtatgaaacaacagaatttgaccagctgagaagactctcaacacccccatcttctaatgtaaactctatctatcacaccgtctggaagtttttctgtcgagaccattttggctggcgggagtaccccgagtccgtaatcaggctaattgaggaggctaacagtagaggtctcaaagaggttcgttttatgatgtggaacaaccactacatcctccataattctttttttcggagggaaataaagaggcgccctctgtttcggagttgctttatactcctaccttatcttcaaactttgggtggtgtgcccactcaggctcctccaccactcgaagctacctcaagttcccagattatctgtcctgacggagtcactagcgctaacttttacccggagacttgggtttacatgcaccccagtcaggacttcatacaggtgcccgtgagtgcagaggataagtcctatcgtataatatacaatttatttcataagactgtgcctgagttcaagtacaggatcctacaaatcctgcgggtccagaaccaatttctttgggaaaagtacaaaaggaaaaaagaatatatgaacagaaagatgtttggacgcgatcgcatcattaatgagcgccacctctttcacggtacatcgcaggacgtggtggacgggatctgcaaacacaattttgacccacgggtatgcggaaagcacgcaaccatgtttggtcagggttcttatttcgccaaaaaagcctcttacagtcataacttcagcaagaagtctagcaagggcgttcactttatgtttttggccaaggtacttaccggacggtacacgatgggcagccatggtatgaggcggcctccaccagtcaatcctggaagcgtcaccagcgacctttatgattcatgtgtggataattttttcgagcctcagatctttgtgatcttcaacgatgaccagagctacccttactttgtcattcagtatgaggaggtgagtaatacttag

SEQ ID NO: 243604 - DNA, 1974 bp, Artificial Sequence
  Description of Artificial Sequence: Synthetic coding sequence
atggagatggaaaccaccgagccagagccggattgtgtcgtccagccacccagcccacctgacgacttttcctgccaaatgaggttgtccgagaaaataacgccactcaagacatgtttcaaaaagaaagatcagaaaaggttggggactgggaccctgcgctccctgcgtcctatcctgaacacactgctggaatcaggatccctggacggggtgttccggagcaggaaccagtcaacagacgagaatagtctgcacgaaccaatgatgaagaaggccatggaaattaacagttcttgccctccagctgaaaataacatgagtgttctgatacctgatcgtaccaacgtgggtgaccagatccctgaggctcatcctagtactgaagctccagaaagagtcgtgccaatccaagatcactccttccccagcgaaacactgtcaggcaccgtcgccgacagtacaccggctcatttccagaccgatctgcttcaccccgtttcttccgacgtacctacatctcccgactgcttagacaaagtgattgattatgtgcccggaatttttcaagagaactcctttactatccagtacatcctggatacaagcgacaaattatccacagaactgttccaagacaaaagtgaggaagcgtctctggacttagtgttcgaactcgtaaaccagctccagtatcacacccatcaggagaatggaatcgaaatctgtatggatttcctgcagggaacttgcatttatgggcgtgactgtttaaagcaccacaccgtgcttccatatcactggcagatcaagcgcaccacaacacagaaatggcaaagtgtcttcaacgattctcaggagcatttagagcggttctactgcaaccctgagaatgatcgcatgcgtatgaaatacggcggacaggagttctgggctgatctgaatgccatgaacgtgtacgagaccacagagttcgaccaattgcgtcggctctctacacctccctctagtaacgtaaattctatttaccatacagtgtggaagttcttctgccgggaccacttcggctggcgcgagtaccctgaaagtgtgatacgcctgatagaagaagccaatagcaggggtctgaaggaggtgaggtttatgatgtggaacaatcattatatcctgcacaactctttctttcgcagagaaattaagcggagacccctgtttcgaagctgcttcatactgttaccttatttgcagaccctgggcggtgttcccacgcaggctccaccgcctctggaagcaacgtcttccagccagataatctgtcccgacggcgtaacatcggcgaatttttatccggagacttgggtgtacatgcatccttcccaggacttcatccaggttccagtgtcagccgaagataagtcttataggatcatatataacctcttccataagactgtgcccgaatttaaataccggattttgcaaatactgcgggttcaaaatcagtttctgtgggaaaaatataagagaaagaaggaatatatgaacagaaagatgttcggaagagaccgaatcatcaatgagcggcacttattccacggtacatcccaggatgtggtcgacggtatttgcaaacataacttcgatccgagagtgtgtggcaagcacgctacgatgtttggccagggctcctacttcgccaagaaggcttcatatagccacaacttctcaaaaaaatcaagcaagggggtacatttcatgttcctggctaaagtactcactggtagatatacaatgggcagccatggaatgcgcaggccgcctcccgtgaacccaggcagtgtgacaagtgacctgtatgatagctgcgtggacaacttctttgaaccacagattttcgtgatatttaacgatgaccagagttacccgtatttcgtgatccagtacgaggaggtatctaacacagtgagcatttag

SEQ ID NO: 243605 - DNA, 1974 bp, Artificial Sequence
  Description of Artificial Sequence: Synthetic coding sequence
atggaaatggagacaaccgagcccgagcccgactgtgtagtgcagcctccaagcccccctgatgacttctcctgccagatgagactgagcgagaagatcacacctttgaagacttgctttaaaaagaaagatcagaaacgactgggcacaggaacactccgttccctcaggcccatactgaatacacttcttgagagtgggtctctggacggcgtcttcagatcccggaatcagtcaacagacgagaacagtcttcacgaacccatgatgaagaaagccatggagattaacagtagctgtccacctgccgaaaataacatgtccgtacttattcccgaccgcactaatgtaggagaccagatacctgaggcccacccctcgactgaagctccagagcgcgtagtgcccatccaggatcactcatttccctcagaaacactgagcggcacagtcgctgactcaacccccgctcattttcaaacagatctgctgcaccctgtaagcagcgacgttccaaccagtcctgattgtctcgacaaagtgatcgactatgttcccggtatatttcaagagaactccttcactattcaatatatcctggacaccagtgataagctctccacagaactattccaggacaagtccgaagaggcctccctggacctcgtgttcgaactcgtaaaccagctgcagtatcacacgcatcaggagaacggcattgagatctgtatggacttcctgcaggggacctgtatatacgggagggactgtctcaagcatcacacggtcctgccataccactggcagatcaagcgaactacaacacagaagtggcagtcggtgtttaacgattcacaggaacacctggagagattttactgcaaccctgagaacgatcggatgagaatgaaatatggcggacaggaattttgggcagacctaaatgccatgaatgtgtacgaaacaactgagttcgaccagctacgcaggctgtccacaccacctagtagcaacgtcaattctatctaccatactgtgtggaaattcttttgtcgggaccacttcggatggagagagtatcccgagtccgttatccgcctcatcgaggaagccaattctcggggtctcaaggaggtcagatttatgatgtggaacaatcattacatcctgcataactccttttttcgcagagaaatcaaacgcaggcctttgtttaggagctgtttcattttactgccttacctgcagacccttggaggagtgcccacacaggcccctcctcccctcgaagcgacgagcagctcccagatcatatgtcccgacggagtcacatctgcaaacttttacccggagacatgggtctacatgcatccgtcccaagacttcatccaagtgccagtgtccgcagaagacaaatcgtatcgaattatctataatttgtttcataaaacagtgccagaattcaaatacagaattttacaaatcctgagggtacaaaatcaattcctgtgggagaaatataaaaggaagaaggaatacatgaataggaagatgtttggacgggatagaatcattaatgaacggcatctgttccatggaaccagtcaggacgtggtggatggaatctgcaaacataatttcgacccacgggtatgtgggaaacatgcaacaatgttcggacagggatcgtattttgccaaaaaggcttcttattctcataactttagcaagaaatccagtaagggagtgcactttatgtttcttgctaaagtcctgacgggcagatatacaatgggtagccacggaatgcgcaggcctcctccagttaatcccggtagcgtcacctctgatctgtatgatagttgtgtggacaatttttttgaaccacagatattcgttatttttaatgatgaccagtcttatccctatttcgtgatccagtacgaggaggtttctaatacagttagtatctag

SEQ ID NO: 243606 - DNA, 1662 bp, Artificial Sequence
  Description of Artificial Sequence: Synthetic coding sequence
atgggtgccttggaaatgcaagatgaagaagaccgcatcgaggccctgaaacaagtggcagacaaactccccaggcccaacctgctactgctcaaacatcttgtttacgtgctccatctgatcagcaagaatagcgaggtgaatcggatggattcatctaacctggcaatttgcatcgggccaaatatgctgacgcttgaaaacgatcagagtctgagcttcgaagcgcaaaaggatctaaataataaggttaagacccttgtggaattcctgattgataactgtttcgaaatatttggggaaaatattccggtgcattctagcattacaagtgatgatagcctcgagcacacagactccagtgacgtgagtactctgcaaaatgactcagcatacgattctaacgaccccgatgtcgaatccaactcgtcttcaggtataagctccccttctcgccagccacaggtgcccatggcgactgctgctggtcttgactcagcaggccctcaggacgcacgtgaggtgtctccggaaccaatcgtgagtacagtagccagattaaagtcatctctcgcccagcccgaccgcagatactctgaaccctccatgccatcatcccaggaatgcctggagagccgagttaccaaccagacccttacaaagtccgagggagattttccagtgcctagggtggggagccgtctggaaagtgaggaggctgaagaccccttccctgaggaggtcttccccgctgtgcaaggtaagactaaaagacccgtggacttgaaaatcaagaatctcgcccctggttctgtgctgccccgagccttagtattgaaagccttcagttctagctccctggacgcaagttcggacagttcccctgttgcatcccctagcagccctaagcgtaacttcttttctcggcaccagtctttcacaaccaaaaccgaaaaaggcaagcctagccgagagataaaaaagcattccatgtcgtttacatttgccccacacaagaaggtccttaccaagaacctcagtgccggaagcggaaagtctcaggattttactagagatcacgtcccgagaggcgtgagaaaggagtcccaattggcaggacgaattgtgcaggaaaatggctgcgagacacacaaccagacagcgcgaggattttgcctacggcctcacgctttaagtgtggacgatgtttttcagggggctgattgggagaggccaggatcacccccatcctacgaggaggccatgcagggccctgcagcacgattagtggcatctgagtctcagacagtcggatccatgacagtggggagcatgagggccagaatgctggaggcccactgtctgcttcctccgctcccccctgctcatcacgtggaggacagcagacacaggggatctaaagaacctcttcctggccacggcctgagcccattaccggagagatggaagcagtcaaggactgttcacgcttctggcgattcactcggccacgtgagtgggcctgggagacctgagttactgcctctcaggacagtctcagagagcgtacagagaaacaagcgggactgcttagtacggcgttgctcccagccagtgtttgaggccgatcagtttcaatacgccaaggaatcttacatctag

SEQ ID NO: 243607 - DNA, 801 bp, Artificial Sequence
  Description of Artificial Sequence: Synthetic coding sequence
atgaaactgaggtcctcacacaacgctagtaaaactctgaacgctaacaacatggagactctgatagagtgtcaatcagagggggacattaaggaacatcctctactggcgtcttgtgaaagtgaggactccatttgccaacttatcgaggtaaaaaaaagaaagaaggtgctaagctggccatttctgatgcggagactgtcaccagcatccgatttcagcggggctctggagaccgatctaaaggcctctctgtttgaccagcccctgagtatcatttgtggggactctgatacactaccacgcccaattcaggatattcttactatcctgtgtttgaagggaccttccaccgaggggatcttccgccgagccgcaaacgaaaaagccaggaaagaactgaaggaggagttaaactctggcgacgctgtggatctcgagaggttgcctgtccatttattagccgttgtatttaaggattttctgcgcagcatccctcggaaacttctctcgtcagatctatttgaagagtggatgggtgctttggagatgcaggacgaggaggatcggatcgaagcgctcaaacaggtggccgataagctcccaaggcctaacctgttattattgaagcatctggtgtacgtgctgcacttgatcagcaaaaattccgaggtaaataggatggattcttctaatctggccatctgcattggcccaaatatgttgaccctcgagaacgaccagagcttgtcatttgaggctcagaaagacctgaataacaaggtctgttctgcctattag

SEQ ID NO: 243608 - DNA, 2196 bp, Artificial Sequence
  Description of Artificial Sequence: Synthetic coding sequence
atgaaactcagaagttcccataacgcgtcaaaaactctcaatgcaaataatatggagactctcattgaatgtcagtctgaaggtgacatcaaagagcacccgctgttggctagttgcgaaagtgaagatagcatttgccagctgatcgaggtcaaaaagcgaaaaaaggtgctgagttggccgtttctaatgcgtaggctgagcccggctagcgacttcagcggggcactagagaccgatctcaaggcatcgttgttcgaccagcccctgagcattatttgcggggatagtgacacgctgccccgacctattcaagacattctgacaatcctttgcttgaagggcccaagtacagagggtatctttagacgcgctgccaacgaaaaagcacgcaaagaactcaaggaggagttgaatagtggcgatgccgtcgatctggaacggcttcctgtccatctattggccgttgtatttaaggacttcctacgcagcattcctcgaaaactactatcatctgatctcttcgaagagtggatgggagcactcgaaatgcaagatgaggaagacagaatcgaagccttaaagcaggtggcagataagctcccccgaccaaatttactgttactgaagcacctggtgtacgtactgcatttgattagcaagaacagcgaggtcaaccggatggactccagcaatctagccatatgtattggccctaatatgttgacactggaaaatgaccagtccctcagcttcgaagcccagaaggatctcaacaacaaagtgaaaacactggtcgaatttcttatcgacaattgctttgaaatcttcggcgagaacattcccgtgcacagcagtattacttccgatgatagcttagagcatacggatagctcggatgtgagcaccctgcagaacgactccgcctacgactccaacgaccccgatgtcgagtctaactcaagctctggcataagtagtccaagcaggcagccccaggtgcctatggccacggccgctggacttgacagcgctggaccacaggatgccagagaggtgagtccagagcccattgtttccaccgtagccagactgaagtcatccctggcccagccggatcgcagatactccgagccctcaatgccttcttctcaggagtgcctggagtccagggtcacaaaccagactctcactaaatccgaaggtgatttcccagtgcccagagtgggttcacggctcgaaagcgaggaggcagaggatcccttcccggaagaagtcttcccggcagtccagggaaagaccaagaggcctgtggatcttaagataaaaaacctggcaccaggctccgtgctgccacgcgctctggtgcttaaagcctttagttcatcctctctcgacgcgtctagcgactcttctccagtcgcatcaccctcctctcccaaaagaaattttttttcgcgacaccagagctttaccactaagaccgaaaaaggaaagccaagtagggaaataaagaaacattccatgtcatttacgttcgcaccccataagaaggtcctaacgaagaatttgtccgccggtagcggaaagtctcaggattttacccgcgatcacgtgcccaggggggtgagaaaagagtcccagctggccggaagaatagtgcaggagaatggatgcgagactcacaatcaaaccgccagggggttttgtctgcgcccacacgctctgagcgttgacgacgtgtttcagggagcggactgggagagacccggatctcctccttcatacgaggaggccatgcaaggtccagctgccagactcgtggcttctgaatctcagaccgtgggaagcatgactgtgggcagtatgagagctaggatgctggaagcccattgcctgcttcctcctctaccacccgctcatcatgttgaagattcacgtcatagggggagcaaggagcccctgcccggacacgggctgtcccccctgcccgagaggtggaagcaaagcagaacagtacatgcatctggcgactccctgggtcatgtgtctgggcctggtaggcctgaactgctgccgttgcgaacagtgtccgagtctgtacagcgaaacaaaagggattgtctggtgcgtagatgttcacagccggtattcgaggcggatcagttccaatacgcaaaagagtcctacatatag

SEQ ID NO: 243609 - DNA, 828 bp, Artificial Sequence
  Description of Artificial Sequence: Synthetic coding sequence
atggccactgcggcaggactagattccgcaggcccacaggacgcacgtgaggtgtctccggagcccattgtttcaaccgtcgctagacttaaaagcagcctggcccagccagacaggagatattcggagccatctatgccctcttctcaggagtgtctggaatccagggtcaccaaccagacactcacaaagagcgagggtgatttccccgtgcccagagtgggcagccgcttggagtctgaggaggctgaggatccattccctgaggaggtgtttcccgctgtccagggtaagaccaaacgtccagtagatctcaagatcaagaatctcgccccaggctctgtcctacctcgggcactggtgttgaaagccttctcaagcagctctcttgacgcatctagtgacagcagcccagtagcgtctccatcttcgcccaagcggaacttcttctctcgccatcagtctttcaccactaaaacagaaaagggcaagccttcaagggaaatcaagaaacactcgatgtccttcacattcgcgcctcataagaaagtgctgactaagaatctgtccgccggttcaggcaagagccaagacttcactcgagaccacgtgccccgaggcgtgaggaaggagtctcagctggccggtcggatagtacaagagaacgggtgcgaaactcacaatcagacggcccgaggcttttgtctaagaccccacgcgctctctgtggacgatgtttttcagggcgctgactgggaacgacccggtagcccaccaagctatgaagaggccatgcagggcccagccgctaggccatggggcgcttag

SEQ ID NO: 243610 - DNA, 327 bp, Artificial Sequence
  Description of Artificial Sequence: Synthetic coding sequence
atgacccgaaagatcttcactaacacacgtgaaagatggcggcaacaaaacgtgaactccgcctttgccaagctgaggaagctcatacctacccaccccccagacaagaagctgtccaagaacgagacgctccgtctggccatgcggtacatcaattttctggtaaaggttctcggagagcagagccttcagcagactggcgtggcagcacaaggcaatatcttggggctctttccacaggggcctcacctccccggactggaagacagaaccctgttagaaaactaccaggtcccctcccctggtccctcacaccatatcccgtag

SEQ ID NO: 243611 - DNA, 780 bp, Artificial Sequence
  Description of Artificial Sequence: Synthetic coding sequence
atggcctccccacaagggggacagatcgccatcgcgatgaggctccgcaatcaattgcagagtgtttacaagatggatcccctgaggaatgaagaagaagtgagagtcaagatcaaagatctgaatgaacacattgtatgctgcctgtgtgcaggctacttcgtcgacgccaccacgataaccgagtgccttcacaccttctgtaagagctgtatagtaaagtatttgcagactagcaagtactgcccaatgtgtaacatcaaaatacacgagacccaacctctcctcaatctgaaactggacagggtgatgcaggacatcgtttacaaacttgttcccggactacaggactctgaggagaagaggatcagggaattttaccagagccggggacttgatagggtcacacagcccacgggcgaggagccagccctttcgaacctgggcctccctttctcctctttcgaccactctaaagcccactattatagatacgacgaacagctgaacctgtgtctggagcgcctgtcaagcgggaaggataaaaacaaatcagtgcttcagaataaatatgtgaggtgcagtgttcgagccgaggtgcgccatctgaggagagtcctgtgccacagactaatgctgaacccgcagcacgtccaactgttgttcgacaatgaggttcttcccgatcacatgaccatgaagcagatttggctcagtaggtggttcggaaagcccagcccactattgctgcagtacagtgttaaggagaaacgacgctag

SEQ ID NO: 243612 - DNA, 876 bp, Artificial Sequence
  Description of Artificial Sequence: Synthetic coding sequence
atggaggctcccgcttccgcgcaaaccccccacccccacgaaccgatcagttttggcatcgaccagatactgaactcgcctgaccaagattccgcgccagcccctcgaggtcccgacggtgcttcttaccttggcggtcctcctggaggaaggccaggcgcaacctacccgagtttgccagctagcttcgccggactgggggcaccgttcgaagacgccggaagttactccgttaacttgagcctggcgccagctggggttatccgcgtgcccgctcatcggccactgcccggtgccgtgccgccacccctgccaagcgctctgccagcaatgcctagcgtgccgaccgtgagctcattgggtggactgaattttccgtggatggagtccagccgacggttcgtgaaagacaggttcaccgccgctgctgccttgacaccctttacggtcacgaggcggatcggacatccctatcagaatagaacccctccgaaaaggaagaaacccagaacaagcttctcgcgcgtacaaatttgtgaacttgagaagagattccatcgacagaaatatcttgcgtccgcggaacgggctgcattagccaagtctctcaagatgactgacgcccaggtgaagacctggtttcagaaccgtcgcacaaaatggagaaggcagacagctgaagagagggaagcagagaggcagcaagccagcaggcttatgttgcagctgcagcatgacgcttttcaaaaatcattaaatgactctatacagccagaccctctgtgtctccacaactccagcctgtttgctctgcagaaccttcagccatgggaggaagattcatcaaaagtgcctgctgtgacctccctggtctag

SEQ ID NO: 243613 - DNA, 312 bp, Artificial Sequence
  Description of Artificial Sequence: Synthetic coding sequence
atggcagagagctggagcgggcaggctctgcaggccctcccagctaccgtccttggcgctcttggctcagaattcctgagagagtgggaggcacaagacatgagagtcactctattcaagctgctcttgctctggcttgtactgtccctgttaggaattcagttagcttggggcttctatggtaataccgttacgggcttgtaccacagaccgggtttaggtggacagaatgggagcacccctgatgggtctactcactttccctcttgggaaatggccgctaatgagcccctgaaaacgcatagggagtag

SEQ ID NO: 243614 - DNA, 387 bp, Artificial Sequence
  Description of Artificial Sequence: Synthetic coding sequence
atggcatctgaggcctccgtgcgcctcggagtgcctccagggaggctctggatccaaagacccggaatttacgaggatgaggaggggaggacttgggtcactgtagtagtcagattcaacccctctcggcgagaatgggcaagggcatcacaaggctcacgttacgagccctcaatcacagtacacctgtggcagatggcagtgcatactagggaactcctctcttcgggacaaatgccgttcagtcaactgcctgctgtttggcagttgtaccccggtaggaagtatcgagccgctgattcctcattctgggaaatcgcagaccacggacagatcgactctatggaacagctcgtactgacctaccaacctgaaagaaaagactag

SEQ ID NO: 243615 - DNA, 387 bp, Artificial Sequence
  Description of Artificial Sequence: Synthetic coding sequence
atggcctcagaggcgtccgtgagactgggagtccccccaggtcgactctggatccagcggccaggtatctacgaagacgaagagggcaggacctgggtgactgtcgtggtccgattcaaccctagcagacgcgagtgggctagggcttctcagggatctcgctacgaaccaagtattaccgtccacctttggcagatggctgtgcatacccgcgagctgttatcatcaggtcagatgcccttttcccaactcccagcagtttggcagttgtatcccggtagaaaataccgtgctgcggatagcagcttttgggaaatagccgaccacgggcagattgactctatggaacagctggtgctgacctatcagcccgaaaggaaagattag

SEQ ID NO: 243616 - DNA, 4776 bp, Artificial Sequence
  Description of Artificial Sequence: Synthetic coding sequence
atgggaaatgctgaaagtcaacatgttgaacatgagttctatggcgagaaacatgcctctctggggagaaagcacacctctcgctccctgaggctaagccacaagacccggaggactagacacgcctcatccggcaaggttattcaccggaactcagaggtctccacacgttcgtcctctactccttcaattccccagtctcttgccgagaatgggctagaaccctttagccaggatggaacactggaagactttggaagccctatatgggtggatagggtcgatatgggccttcgtcctgtgagttataccgactcttctgtcacacctagtgtggactctagcattgttctgacagcagccagtgtgcaatcaatgccagatacagaggagagccggctgtacggagacgacgccacttatttagccgagggtggcagacggcaacatagctataccagcaacgggcctacgtttatggaaaccgcctcttttaagaagaagaggagtaaaagcgccgatatttggcgcgaggattctcttgaattctctttatctgatctatcccaggagcatttgacgtcgaacgaggaaatactgggctctgccgaagaaaaggattgcgaggaagccagaggaatggaaacaagagcctccccccgacaattgtcaacatgccaaagggcaaactccctaggtgacttgtatgcgcagaaaaattctggcgtcaccgccaatggcggacccggaagtaaattcgcaggatattgtcgcaatttggtgagcgacattcccaacctcgcgaaccataaaatgccccctgctgcggcagaggagacgccaccctattctaactataacaccttgccatgccgaaagagccattgcctgtcagagggcgctactaatccccaaatcagccattccaacagtatgcagggaagacgcgctaaaaccacacaagacgtgaatgctggggaaggatctgaatttgccgactcaggaatagagggagccactactgataccgatttactcagtaggagaagcaacgctactaacagcagctacagcccaacaacaggaagggcattcgtcggaagtgactcagggtcttcctctaccggcgatgcagctcgtcagggcgtgtatgaaaatttcaggcgagagcttgagatgagtactaccaattcggaatcactggaggaggcgggatctgcccactctgacgaacagtcaagtggcaccctgtcaagtcccggacaaagcgatattttactgacagcggctcagggcaccgtccgaaaggccggtgctctcgccgtgaagaactttttggttcataagaagaacaagaaggtagaatcagccacaaggaggaagtggaaacattactgggtcagtttgaagggctgcactctgttcttttatgaatccgatggcaggagcggcatcgatcacaatagtatccccaaacatgccgtctgggtcgagaacagcattgtgcaggccgtgcccgaacaccccaagaaagatttcgtattttgtttgagcaattctctcggagacgcattcttgtttcagactacgagccagacagagttagagaattggattacagccatacactctgcctgcgctaccgccgtggccagacaccatcacaaagaggacacactcaggctgctgaagtccgaaataaaaaagcttgagcagaagattgacatggatgagaagatgaaaaagatgggagagatgcaactttcatcagtcaccgatagcaagaagaaaaaaaccatcctggaccaaatcttcgtgtgggaacaaaacctagagcagtttcagatggacttatttcgattcagatgctacctggccagcctgcagggaggtgaattacccaacccaaagaggttgcttgcgtttgcatcccgacctaccaaagtcgccatgggcagattaggtatctttagcgtatcttccttccacgctttggttgccgcacgcacaggtgaaaccggagtcagacgcagaacccaggctatgtctcgctctgctagcaagcgcagaagtcgcttcagttccctctggggcctcgataccacgtccaaaaaaaagcaagggcgaccaagcattaatcaagtgttcggcgaaggcacagaagcggtgaagaagtctctcgagggcatatttgatgacatcgtcccagatggcaaaagagagaaggaggtggtcctgcccaacgtacaccaacataacccagactgtgatatctgggttcacgagtacttcacaccttcctggttttgtctccctaacaaccagcccgcactgaccgtggtcaggcccggagacaccgctcgagatacactagaactgatttgcaagacacatcaactggatcactccgctcattatttacgcctgaaatttctaattgaaaataagatgcagctatacgtgccacagcctgaagaagatatctacgagcttttatataaggagatcgagatttgtcccaaagtgacccaaagtattcatattgagaagtcagacactgctgccgacacgtacggattttccctgagttcagtcgaagaggatggtatccggaggctgtatgtgaattctgttaaggaaacgggtctggcctccaaaaaaggcctgaaggcaggggacgagatcttggagattaataacagggccgcagatgcattgaattctagtatgctgaaagactttctctctcagccttcactcggcctgctggtgaggacttatccggaattggaggagggagtcgaactcctggaaagcccacctcatagggtggacgggcctgccgatttaggagagagtcctttggccttcctcacatctaaccctggacatagcctctgctctgagcaagggagttcagccgaaacggcaccggaggaaacggagggacccgacctggaatcaagcgatgagacggatcactcgtcaaaaagcacagagcaggtggctgccttctgtcgcagccttcatgaaatgaatcccagtgaccagtcaccttccccgcaggacagcacggggccacagctcgcaaccatgcgccaactaagcgatgccgataaactcaggaaagtcatctgtgaattactggagacagaacgcacatatgttaaggacctgaattgcctgatggaacggtacctgaaacccctgcagaaggagacctttttgacccaggatgagctggatgtactgttcggaaatctgaccgaaatggtggaatttcaagttgaattcctgaaaaccctggaggacggtgtcagactggtaccggacctggagaaattagaaaaggtagaccagttcaagaaggtccttttctccctgggtggatcattcctttattacgcagaccgttttaaactttattctgccttttgtgcttctcacactaaggttcccaaagtgttagtaaaggccaagactgatactgcctttaaggctttcctggatgcccagaatcctaagcaacaacactcttcgactttggaaagctacctgatcaagcccatacagagaatcttgaagtatccgctgctgctgcgcgaactctttgctctaactgacgcggaaagtgaagaacactatcacctcgacgtggccatcaagacaatgaacaaggttgctagtcacattaatgagatgcagaaaatacacgaggagtttggggctgtctttgaccaacttatagcagaacagactggggagaaaaaggaagtcgctgaccttagtatgggagatctccttctgcataccactgtgatctggctgaaccctcccgcatcactgggcaagtggaagaaggagcccgagcttgccgcttttgtgtttaaaacagcagttgtactggtgtacaaagatggttcgaaacagaagaaaaaactggttgggtctcaccgcttaagcatctatgaggactgggacccttttcgatttcgacatatgattcctactgaagccctgcaagtgcgcgctctcgctagcgcagatgccgaggccaatgcagtatgcgaaatcgtgcacgtaaaaagtgaatccgagggcaggcctgaaagggtgttccatctatgctgctcgagtcccgagagccggaaggattttctgaaggcagtccactctattttgcgggacaaacaccgtcgccagctgctgaagacagaatccctgccttcaagccagcagtacgttcccttcggaggaaaaaggctctgtgccctcaaaggcgctaggccagcaatgagtcgggcagtaagcgctccctccaagagcctcgggaggcgacgcagaaggctggcacgtaacagattcactattgattctgatgccgtgtcagcaagtagtccagagaaggagagccaacaaccacccggaggtggagatacagataggtgggtggaggagcagttcgatttagcacaatacgaagaacaagatgatattaaggaaactgacatactgtcagatgacgacgaattctgtgagagcgtgaaaggtgcaagcgtcgaccgggacctccaggaaaggttgcaggccacgtcaatcagccagagggagaggggcaggaagacactggatagccacgcctcacgaatggctcagctgaagaaacaggcagcgttgtccggaatcaatgggggattggagtctgccagtgaggaggtaatatgggtgcgcagggaagactttgcacccagtagaaagcttaacactgagatttaa

SEQ ID NO: 243617 - DNA, 3216 bp, Artificial Sequence
  Description of Artificial Sequence: Synthetic coding sequence
atggaaacggcctcattcaaaaagaaaagatcaaaatcggcagacatttggcgggaggactctctcgaattctcgctgagcgatctgtctcaggagcacctcacttcgaatgaggaaatcctgggctctgcagaagagaaagattgcgaagaagccagaggaatggaaacgcgggcttccccaagacagctgagcacctgccaacgggctaattccctcggcgacctttatgcacagaagaacagtggggtcacggcgaatggcggaccaggatctaaatttgccggatactgccgtaatctcgtgtcagatattccaaatctggcgaaccataaaatgcctcctgctgccgcagaagagactcccccttactcaaactacaacacattgccctgtcgaaaaagccactgtctgtctgaaggggcaacaaatccacagatctcccatagcaatagcatgcagggacggagagcaaaaactacacaggacgtcaacgccggtgaggggtccgaattcgctgattccggcatcgaaggcgctactacagacaccgatctcttaagtaggaggagcaatgcaaccaactcgtcctattctcccaccaccggaagagcattcgtcggaagtgatagcggatcttctagtacgggcgacgccgctcgccaaggtgtctacgaaaatttccgcagggagctggaaatgagtacaaccaatagcgagtccctcgaggaggcgggaagcgcacattccgacgagcaaagttctggaactctatctagccccggtcagtcggacatcctgctaacagcagcacaagggacggtgagaaaagctggtgcgcttgccgtgaagaatttccttgtgcacaaaaagaataagaaagtggaatctgccacccggaggaagtggaaacactactgggtgtccctgaagggatgcacactgtttttttacgagagcgatggaagatcgggtattgaccacaactcaatacccaaacatgcagtgtgggtcgaaaatagtatagtgcaagcagtgcccgagcacccaaagaaggactttgtgttttgcctttctaatagtttgggggacgcgttcctgtttcaaacaacatctcaaaccgagctggagaactggattacagccatccattctgcctgtgctactgccgtcgcacgccaccatcataaggaggataccctgagactgttgaagtctgagatcaaaaagttggagcaaaagatcgacatggatgaaaaaatgaagaaaatgggtgagatgcagctgtcctccgtgactgacagcaaaaagaaaaaaacaatcttggaccaaatttttgtgtgggaacagaacctggagcagtttcagatggacctgttccgttttcgatgctaccttgcttctttacaggggggagagttgcctaacccaaagcggctgctggcctttgcctcaaggcccactaaggtcgcaatgggccgtttaggaattttctctgtgtcgagctttcacgctctggttgctgccaggaccggggaaacaggcgtgagacggagaacccaggcaatgtcacgatctgcaagcaaacgacgcagtagattcagctcactgtgggggctggatacaaccagcaagaaaaagcagggccgaccatctattaatcaggtgttcggggagggaactgaagccgtgaagaaatctctagaaggtatcttcgatgatatagtgccggatggtaagagagagaaagaggttgtgctcccgaatgtgcaccagcacaaccccgactgcgatatatgggttcatgagtacttcacacctagctggttttgcttacccaacaatcagcccgcattgaccgtcgtccggccaggggatacagcgagagatacgctggagctgatttgcaaaacccatcaacttgaccattcagcacattacctgaggttgaagttcctcatcgagaacaaaatgcagctgtacgtcccacagcccgaagaagatatctatgaacttttgtacaaggagattgaaatctgtcccaaggtgacacaatcaattcatatcgaaaaaagtgacacggccgctgacacttatggatttagcctttccagtgtggaggaagatggtattaggcgcctttatgtcaatagtgtgaaagagactggattagccagcaagaagggtctcaaggctggagacgagattctcgagatcaataaccgcgcagcagatgccctgaacagctccatgctcaaagactttctgtcccagccttccctgggactcctggtcaggacctaccctgaactggaggagggtgtggagctgctggagtcacccccacacagggtcgatggacctgccgacttaggcgaatcaccattggcctttctgacctctaaccctggacactcgctgtgctctgagcagggaagctccgctgagaccgcaccagaagaaacggaaggccctgacctggaatcttcggatgagaccgatcacagttccaagtcaacggagcaagtcgcagccttctgccggagcttacacgagatgaatccttccgatcaatccccatcacctcaggactccaccggcccacagttggcaaccatgagacaactgtcagacgcagacaaacttcgaaaagtgatctgcgaactcttagagacagagcgcacatatgttaaggacctcaactgccttatggagaggtacctgaaacctctgcagaaggagacgtttctaactcaggacgaactggacgttctgtttggaaaccttaccgaaatggtggagttccaggttgagttcctaaagactctggaggacggagtaaggttagtacccgatttggaaaagcttgagaaggtggatcaattcaagaaggtgctgttttcccttggcggaagctttttatactacgctgatagatttaagctctatagcgccttctgcgcacacaagtcctcccaggggcctggcgagtcacaggatcggcatggattccaaggcatactggggtgtccagagcctgaagcagctgccttaatccatgccggtgtcgtgccacatcaggcgcacccagaggatccgcaagtccccacaagcgcccagggggcagtccgccctgaccgatgtggagagcgaggagcattgcctccagggagagggcaccaggaccatgaacagggctgtcagagccaccagtag

SEQ ID NO: 243618 - DNA, 678 bp, Artificial Sequence
  Description of Artificial Sequence: Synthetic coding sequence
atgggtaacgctgaaagccagcatgttgaacacgaattttatggggagaaacatgcttctctgggcagaaagcacaccagcagatccctcagacttagtcacaaaaccaggcggacaaggcatgcgtcatctggaaaggtgatacaccgcaacagcgaagtctcaacaagaagttctagtaccccttccatcccccagagtctggcagagaacggtctggagccattcagtcaggatggaaccctcgaggactttggatcccctatttgggttgatcgggtagatatggggctgagacccgtcagctatacagacagcagcgtgacccccagtgtcgacagttccattgtgctgaccgctgcctccgtccagtcgatgcctgataccgaagaaagcaggttatacggcgatgacgccacgtacttggcggaggggggaaggcgccagcactcgtacactagcaacggcccaacgttcatggagaccgcctccttcaaaaagaagagatcgaagagcgccgacatctggcgggaggatagcctcgaatttagcttaagcgatctttcccaagagcacctaacttccaacgaggaaatccttggtagcgccgaggagaaggattgcgaagaagctagagggatggagactagagcttccccacgtcagctgagtacatag

SEQ ID NO: 243619 - DNA, 4596 bp, Artificial Sequence
  Description of Artificial Sequence: Synthetic coding sequence
atgggcaatgcggaatcccagcacgtagagcacgaattctatggcgagaagcatgcctccctgggaaggaagcacaccagtcgctctttgcgcctgagccacaagacccggaggactagacacgcctcatccgggaaggtaattcatcggaactctgaagtttctacgcgctcctcatctacacctagtatcccccaatctctggctgagaacgggctggagcctttcagtcaggacggcaccctggaggacttcggaagtcctatctgggtggatcgcgtggacatgggactgcgaccggtatcatatactgattcttccgtgacccctagcgttgactcaagcatcgtcttgaccgccgcttccgtgcagagcatgccagatacagaggagagtagattgtacggggacgatgcaacgtacctggccgaagggggtagacgccagcatagctatacatctaacggccctacattcatggagacggcctcattcaagaagaagcggtctaaaagcgccgacatctggcgggaggatagccttgaattctctctgagcgacctgtcccaggaacaccttacctctaatgaggagatcctgggctccgctgaagagaaggattgtgaggaggcacggggtatggaaactagagcttctcctcggcagctctctacctgccagcgagcaaactcacttggggacctgtatgctcaaaagaattccggtgtcacagctaacgggggtcccggatccaagtttgcgggatattgcaggaatctcgtgtctgacatcccgaacctggccaaccataaaatgccacccgctgctgccgaagagacccctccctactccaactataacaccctaccctgccgcaagagtcattgcttgagcgagggagcgaccaatcctcagatttcccactccaactccatgcagggccgtcgcgcaaagactactcaggacgtcaacgctggtgagggctctgagttcgcagatagtggaatagaaggagccacaaccgacaccgatctgctatcccggcgatccaacgccaccaattcctcttactccccaaccactggtcgagccttcgtaggaagtgatagcggctcctcgagcactggagacgcggcacggcaaggagtctacgagaatttcaggagggagctagagatgtcaaccacaaattccgagtctcttgaggaggctggatctgcccatagtgacgaacagtcatccggcacgctgtcatcacccggacagagtgacattctgttgactgcagcacagggaacagtgaggaaagcaggagcactcgcggtgaaaaacttccttgtccacaagaaaaataaaaaagtagaatcagcgacacgaagaaaatggaaacattactgggttagtcttaaggggtgcaccctatttttctatgaatcagatggacgttctgggatagaccataattctattcccaaacatgctgtttgggtggagaactccatcgtacaagcagtacctgaacatccaaagaaggattttgtcttttgcctgtctaatagcctcggcgacgcctttctgtttcagacaacaagtcagacagaattggaaaattggattactgccatacactccgcatgcgccacggccgtggctagacatcaccacaaggaggacacgctcaggctgttaaaatcggagattaagaaactggaacagaagattgatatggacgagaaaatgaagaagatgggggaaatgcagctatcaagcgtgaccgacagcaagaaaaagaaaacgattctagaccagatttttgtttgggagcaaaacctagaacagttccagatggacctgttcagatttcgatgctacctggccagtttacaaggcggtgagttgcctaatcctaagcgcctgctggcatttgcgtccaggccaaccaaggttgccatggggagactgggtattttcagtgtttctagctttcatgcattggttgctgccagaaccggggaaaccggcgtgagacgtagaacccaggccatgtcccggtcggcaagcaaaagacgcagcaggtttagctccttatggggtctggatacgacctcaaaaaaaaaacagggcagaccttccattaaccagcgcgagaaagaggtcgtgctccccaatgtgcaccagcacaatccagactgcgacatctgggtccacgaatacttcactcctagctggttctgcctaccaaacaaccaacccgctctgacggtagttcggccaggtgatacagcgcgagacaccttggagctgatttgcaagttgtataaggagatagagatctgtccaaaagtcacacagtccattcatattgagaagtccgacacagccgcagatacctatggcttttcactctcctctgtggaagaagatgggattcgcagactttatgtcaatagcgtgaaggagaccggattggcgtccaaaaaaggtctgaaagccggtgacgaaattttggagatcaacaaccgtgctgctgacgccctgaactcctctatgttgaaggattttctgtcacaaccatctctgggcctgctggtgcggacttatcctgagctggaagagggagtggaacttctggagtcccctccccaccgggtggatgggcctgcagatcttggggaatctccactggcattcctcacttccaaccctggccacagcctgtgctccgagcagggcagtagcgcagagacagcacccgaggagaccgagggtcctgacttggagtctagcgatgagaccgatcacagctctaagtcaacagagcaggtagccgctttctgtcgctctttacatgagatgaacccctcggaccagagcccctcaccacaagattcaacgggtccccagctagcgaccatgcggcagttgagcgatgccgataaactgagaaaagtgatatgtgaattgttagaaactgagcgcacctatgtgaaagacctgaactgcctgatggagaggtacttaaaacctctgcaaaaagagaccttcctcacgcaggacgaacttgatgtgctctttggcaacctgacagagatggtggagttccaagtggagttcctgaagaccttggaggacggggtcaggcttgttcctgacttggaaaagctggagaaagtcgaccagttcaagaaagttctttttagccttggcggttctttcctatattatgccgacaggttcaagctctattcagcattctgcgcatcccacaccaaagtgcctaaagttctcgtcaaggctaagactgatacggccttcaaggcatttctcgacgcccagaatcccaaacagcagcactcgtccacactggaatcatatctgattaaacctatacagagaatcctcaaatacccactgttgctcagagagctttttgccttaacagatgctgaaagtgaagagcactaccatctggatgtggctatcaagacaatgaacaaggtggcctcgcatataaatgaaatgcagaaaatccacgaggagttcggagccgtgttcgaccagctaatcgctgagcagaccggcgagaaaaaagaggtcgccgacttgagcatgggggatttactcctgcacactaccgtgatctggctcaatccgcctgctagcctgggaaagtggaaaaaggagcccgagctggccgctttcgtgtttaaaactgcagttgtgctggtgtacaaggacggtagtaagcagaaaaaaaagctggtcggatcccaccgattatccatatatgaggattgggatccgtttcggttccgccacatgatccccaccgaagccttacaggttcgggctttggcctccgccgatgctgaggctaacgccgtatgcgaaattgtgcacgtcaagagcgagtcagaaggacggccagagcgtgtattccacctttgctgcagttctcctgagagcaggaaggactttctgaaggccgtgcactctatcctgagggataagcatcggaggcagcttctgaagaccgagagcctgcctagcagccagcagtacgtgcccttcggtgggaaaagactatgcgcccttaagggcgcaaggccagctatgagccgagctgtttccgcaccctctaagagcctgggaagaagacgcagacgcctcgctaggaataggttcacaatcgattccgacgccgtgagcgccagctctccggagaaggagtcccagcaaccacctggaggaggtgacacggatagatgggtggaggagcaatttgatctggcacaatatgaggaacaggatgatataaaagagaccgatattttgagcgacgacgatgagttctgcgaatccgtcaagggcgcatccgtcgaccgagatctgcaagaaagacttcaggcgacctccatttcgcagcgcgaaaggggaaggaaaaccctggacagtcacgcctctcggatggcacaattgaaaaagcaggccgcattgtccgggatcaatggaggcttggagtctgctagcgaagaagtaatttgggtgcgcagggaagacttcgctccatcgagaaagttgaataccgagatatag

SEQ ID NO: 243620 - DNA, 2493 bp, Artificial Sequence
  Description of Artificial Sequence: Synthetic coding sequence
atgggcagcatgtttcggagcgaggaggtggccctggtgcagctgttcctgcccacagcagcagcttacacttgtgtttctcgactcggcgaactggggctcgttgagttcagggatttgaatgcttccgtctccgcctttcaaagacggtttgtcgttgatgtacgcaggtgcgaggagctcgaaaagaccttcaccttcctgcaggaggaggtgcgtcgggctggtctggtgcttccacccccaaaaggcaggttgccagcccctcccccaagagacctgctaaggattcaggaagaaaccgaaagactggctcaggagctccgcgatgtccggggaaaccagcaagccctgcgagcccagctccaccagctgcagctgcatgccgcagtgctacgccagggccatgagccacagttggctgcggcacacacagacggcgctagtgagaggactcctctgttgcaagccccagggggaccgcatcaagatcttcgggtgaacttcgttgccggagccgtcgagccgcacaaagcacccgctttggaaaggctgttgtggcgggcatgccggggtttcctaattgcttctttccgagagttggaacagcctctcgaacatcctgtgacaggggagccagcgacatggatgactttcttgattagctattggggggaacaaattggacagaagatccgaaagattaccgactgcttccactgccacgtctttccatttctccagcaggaagaagcccgactaggagcacttcagcagttgcagcagcaatcccaggagcttcaagaagtgttgggagaaaccgaacgatttctctcacaggtcctgggacgcgttctgcagcttttgccgccaggtcaagtccaggtccataaaatgaaggcagtatacttggcgctaaaccagtgttccgtgtcgacaacacacaaatgtttgatcgctgaagcttggtgtagtgtgcgcgacttgcctgccctgcaagaggccctcagggacagttcaatggaagaaggggtgtccgctgttgctcacagaatcccctgccgagatatgccccctactctcataaggaccaataggtttaccgcctctttccaaggaattgttgacgcgtacggggtaggccgataccaggaggtgaatccagctccctataccatcatcaccttcccttttcttttcgctgtcatgttcggcgatgtcggccacggcctgcttatgtttctgttcgcactggccatggtcttagctgagaatagaccagccgtgaaagcagcacaaaatgagatctggcagacttttttccgaggacggtacctcttgctgctgatgggattgttttcaatctacacaggcttcatctacaatgaatgcttttccagagccacgagtatcttcccatctggctggagcgtggctgccatggcaaatcagtccggatggtccgatgcattcttggctcagcacactatgctgacgctcgaccctaatgtgacgggtgtcttcctcggcccatatccttttggtattgacccaatctggtccctggcagcaaatcatctgagctttcttaattccttcaagatgaagatgtccgtgatactaggagtggttcacatggcctttggggtggtgctgggcgtgttcaaccacgttcacttcggtcaacggcaccggctgttgctggagaccttgccggagctgacctttctcctaggtctgtttggctacctagtgttcctggtgatctataaatggctttgcgtgtgggcggctagagccgcttcagccccttccattttgattcatttcataaacatgttcttgttcagtcactcacctagtaacagactgttgtatccgagacaggaagtagtacaagccaccctagtggtactcgccctcgctatggtgcctattcttctgcttggtacccccttgcacctgctgcatcggcatagaagaagactaaggcggaggccagctgataggcaagaggagaacaaggcgggtctcttggacctccctgacgcgtccgtgaatggctggtcctcggatgaggaaaaggctggcggtctggatgatgaggaagaggctgaactagtgccaagcgaggtgttgatgcatcaggccattcacactattgagttctgcctcgggtgcgtgtccaataccgcttcctacttaagattatgggcactgtcactcgcccacgcccagctcagtgaagtgctgtgggctatggtcatgcgcatcgggctcggactgggcagggaagtgggggttgccgctgtggtgctggtgccaattttcgccgctttcgcagtaatgaccgtggctattttgcttgtgatggagggcctgtctgccttcctccacgcactgcggctgcactgggtagaattccaaaacaagttttactccggcaccggatacaaattgtcacctttcaccttcgcggcaacagacgattag

SEQ ID NO: 243621 - DNA, 657 bp, Artificial Sequence
  Description of Artificial Sequence: Synthetic coding sequence
atgggatccatgttcagatctgaggaggtggcccttgttcagctgttcttacccacagccgcagcatacacatgtgtgtctcggctgggcgagctggggctggtggagttcagggatctgaacgccagcgtctccgccttccagaggcggtttgtggttgacgtacggagatgcgaggagctcgagaaaaccttcacgttcttgcaagaggaggtgagacgcgctggcctggtactgccccctccgaagggccgactccctgcaccaccgccacgggatttactgcgcatccaggaggaaacggagcggctggcccaggagctgcgggatgtgcgcggaaatcaacaggcattgagagcccagctccatcagctgcagttgcatgccgcagttttgcggcagggtcacgaaccccagctcgcagccgcacatactgatggagccagcgagcgaactccacttcttcaggctccgggagggccacatcaagatttgagagtgaattttgtcgcaggcgcagttgagccgcacaaagctcctgccttggagcgcctcctttggagggcatgccgcggattcttaatcgctagtttccgcgagctggagcagcccttggagcacccggtgactggagaacccgcaacatggatgacctag

SEQ ID NO: 243622 - DNA, 186 bp, Artificial Sequence
  Description of Artificial Sequence: Synthetic coding sequence
gacgacgaagaagaggccgagctggtgccaagcgaggtgttaatgcatcaagcgatccacactatcgagttctgcctgggctgcgtatcaaacactgccagttatttgaggctgtgggcattgagcctcgcgcatgccagatggaactcgcgcacttctagtacacaagccagagcaacctcatag

SEQ ID NO: 243623 - DNA, 1845 bp, Artificial Sequence
  Description of Artificial Sequence: Synthetic coding sequence
atgacgtttctgatatcatactggggggaacagattggccagaaaatccggaaaattaccgactgcttccattgccacgtgttccctttcctgcagcaggaggaggccagactgggggcattacagcagctgcagcagcaaagtcaagaactgcaggaggttttaggtgaaacagagcgatttttgagccaggtcctcggcagagtcctacaactgttgcctcctggccaggtacaggtccacaagatgaaagctgtgtatcttgcattaaatcagtgcagcgtgtctactactcacaagtgtctgatcgcagaggcatggtgttctgttcgtgacttgccggcattgcaggaagcactacgggatagtagcatggaagaaggggtgagcgccgtcgcccacaggattccctgtcgggacatgccgcctacccttatccggactaatcgttttactgcttcgtttcagggtatcgttgatgcatacggagtgggtcggtatcaggaggtcaatccggctccgtacaccatcataaccttcccattcttgtttgctgtgatgttcggcgatgttggccacggactgctgatgtttctcttcgcccttgctatggtgctagctgagaaccggcctgccgtgaaggctgcacaaaacgagatatggcagacttttttccggggaaggtatttacttctgctgatggggctgttcagtatctataccggtttcatatataacgaatgcttctcccgcgctacatctatatttccaagcgggtggtcagtggccgcaatggcaaaccagtcgggctggagcgacgcctttctggcacagcataccatgctgaccctcgatcctaacgtgaccggcgtgtttctcgggccatacccctttgggatagaccctatctggtctctcgccgctaaccatctgtcttttcttaactctttcaagatgaagatgtccgtgatccttggggtagtgcacatggccttcggagtggtccttggtgtgttcaaccacgttcattttgggcaaagacacagacttctcctcgagactctgccggaactgacctttctgttgggcctgttcggctatcttgtgtttttggtgatttataaatggctttgtgtctgggcagccagggccgcttccgccccatctatattgattcatttcatcaacatgtttctgttttcacactcaccctctaatcgactgttgtatcccaggcaggaagtggtgcaggctactctggtggtgctggccttggccatggtccccattctgttgttggggaccccactccacctgcttcacaggcaccgccgtcgtctgcgcaggagacctgcggatcgtcaggaagaaaacaaagccggactgctggaccttcccgatgcatccgtgaatgggtggtcctctgacgaggagaaggcgggtggattagatgatgaagaggaggccgagctggtcccgagtgaggtactgatgcatcaggcgatccacaccattgaattctgcctcggctgcgtatcgaatacagcatcttacctcaggttgtgggcactgagtctggcgcatgcgcagctttccgaggtgctgtgggctatggtaatgcgcattgggctcgggctgggacgtgaagtgggagttgcggctgttgtgcttgtgccaattttcgcagcatttgccgtgatgaccgtggccattcttttggttatggagggattgtctgcctttctccacgcccttagactccattgggtcgaattccagaataaattttattcaggaactggatacaagctgtctcctttcacatttgctgcgactgacgactag

SEQ ID NO: 243624 - DNA, 357 bp, Artificial Sequence
  Description of Artificial Sequence: Synthetic coding sequence
atggtcccaatcttactgctgggcacccccttgcatctgctccatagacatcgcagaaggctgaggaggagaccggctgatcgtcaggaggaaaataaagccggactgctggacctgcctgatgctagcgtgaatggttggagctcggacgaagaaaaagctgggggtctggatgatgaagaggaagccgagctcgtcccaagtgaggtgctcatgcatcaagctatacacactatcgagttttgcctcggttgtgtgtccaacacggcctcttatttacggctctgggcgctgtctttggcacatgcgcgttggaactcccgcacttcttctactcaagctagagctacttcatag

SEQ ID NO: 243625 - DNA, 1671 bp, Artificial Sequence
  Description of Artificial Sequence: Synthetic coding sequence
atggagggcccattgtccgtgttcggagaccgcagcactggagaaacgatcaggagtcagaatgtcatggctgctgcatcaatagccaacattgtgaaaagcagccttggaccagtcggccttgacaagatgctggtggatgatatcggagacgtcacaatcaccaacgatggagccactattctgaagctacttgaggtggagcaccccgctgctaaagtcctgtgtgaactggcagaccttcaggacaaggaggtgggcgacggcacaacctctgtggtgattattgcagctgaacttctcaagaacgccgacgagttggtgaagcagaaaattcaccccacctctgtaatttctggctatcgtctggcttgcaaggaagccgtaagatatatcaacgagaacctgatcgtgaatactgatgagctcggaagagattgtctcatcaatgccgctaagaccagcatgtcaagcaaaataatcggcataaacggtgacttttttgccaacatggtggttgacgccgtgctggccattaaatataccgacatccgagggcagcccagatatcccgtgaatagtgtcaatatattgaaagctcacggtagaagtcagatggagtcaatgctgatttcaggttacgccctgaattgcgtcgtgggctcgcagggcatgcccaagcggatagtgaatgccaaaatcgcctgcctggatttcagtttgcaaaaaacaaagatgaagctcggagttcaggtggttatcactgaccccgaaaaactggatcagattcggcagcgggagtcggatatcacaaaagagcgaattcagaaaattcttgccaccggggctaacgtgattctcaccaccggtggaattgacgatatgtgccttaagtattttgtggaagccggtgcaatggctgtgcggagggtgctgaagagggacctgaagagaatagccaaagcgagtggcgctaccattctgtccaccttagccaatctggaaggagaagagacctttgaggctgccatgctaggccaggcagaggaggtcgtgcaggaacgaatctgcgacgatgaactgatcctaatcaaaaacacgaaagctaggacctcagctagtattatcctgcgcggagcgaacgacttcatgtgcgatgagatggagaggtctctgcacgatgcgctctgcgttgtgaaaagggtgctggaaagtaaatccgtggtgccaggaggcggagcggtagaagcggctttgagtatttatttagaaaactacgcgacatcgatgggatctagagagcagctcgctatcgctgagttcgccaggagccttctagtgattccaaatacactggcagtgaacgcagcccaagactccacagacctggttgctaagctgagggccttccataatgaggcccaggtcaatccagaacgcaagaacttaaaatggattggcctagacctcagtaatggaaagcctcgagataataaacaggccggagtgttcgagcccaccatagttaaggtcaagagtctgaagtttgcaactgaggcagccattaccattctgcgaatcgatgacctgatcaagctgcacccagagagtaaggacgacaagcacggcagttatgaagacgctgttcactctggcgcattgaatgactag

SEQ ID NO: 243626 - DNA, 1206 bp, Artificial Sequence
  Description of Artificial Sequence: Synthetic coding sequence
atgagcagtaagatcatcggaataaacggagatttttttgcgaacatggtcgttgacgccgtgttagctattaaatacaccgatattcgcggacagcccaggtaccctgtgaattctgttaacatcctgaaggcccatggcagatcccagatggagtctatgctaatctcaggctacgccttaaattgcgtcgtgggcagccaggggatgcccaagcgcatcgtcaatgcgaaaatcgcctgtctggactttagcctacaaaaaaccaagatgaaactcggggtgcaagtcgtaataaccgacccagaaaagttggaccagattcggcagcgcgaaagtgacataactaaagaaagaatccagaaaattctggccacaggtgctaacgtgatcctgaccactggcggaatcgatgatatgtgtctcaaatacttcgtggaggccggtgccatggctgttcggagagtactgaaaagagacttgaaaagaatcgccaaagcctctggcgctaccatcctgtcaacccttgcaaatctagaaggggaagagacctttgaagcagccatgttaggacaggctgaagaagtcgtccaggaacgaatctgtgacgacgaactgatactgatcaaaaacaccaaggctcgaacaagcgcaagcattattctccgcggagctaacgacttcatgtgtgatgagatggaacgctcactccacgatgctttgtgtgtagtgaaaagagtcctcgagtcaaaatccgtggtgccaggcggaggggcagtcgaggctgctctgagcatttatctggaaaattatgccacttctatgggctccagagagcagttagctatcgccgaattcgcaagatccttgcttgtgatcccaaatacattagcagtcaatgctgctcaagactcaacagatttagttgcaaagctgcgggcttttcacaacgaagcccaagtcaaccccgaacgcaagaacctgaagtggatcggcctcgacctgtcaaatggaaaaccgcgagacaataaacaggccggagtcttcgagcccacaattgtcaaggtcaagtcacttaaatttgcgaccgaggccgcaattacaatcctgaggatcgatgacctgattaaactgcatcccgagtctaaggatgacaagcacgggtcatacgaggatgcggttcacagcggtgctttgaatgactag

SEQ ID NO: 243627 - DNA, 1302 bp, Artificial Sequence
  Description of Artificial Sequence: Synthetic coding sequence
atggaagggccattaagtgtgttcggcgatcgcagcacaggcgaaacaatacgaagccagaatgtaatggcggctgcctcaatcgctaacattgtaaagtccagtctcggccctgtcggcctggataaaatgctcgtagatgacataggcgatgtcaccattactaatgatggcgctactattcttaagttgttagaggtggaacaccctgccgctaaggtgctgtgtgaactcgcggacctccaggacaaggaggtgggtgacggaacaactagcgtcgtgattatagctgccgagttgttaaagaatgctgacgagctcgtgaaacagaagattcaccccacatctgttatttcaggctaccggcttgcctgtaaggaagccgttaggtatataaatgagaatctgatcgtgaatacagatgagttgggcagagactgcttgattaacgcagccaaaacttccatgtcttccaaaatcatcggcatcaacggtgacttctttgccaatatggtcgtagatgccgttcttgccatcaaatataccgatatccgcggtcaaccgaggtatccagtcaattcggtaaatattctcaaggcccatggtagaagtcaaatggagtcaatgcttatctctggctacgcgctgaactgcgttgttggctcccagggcatgccaaaacgtattgtgaacgctaaaattgcctgcttggacttttctctccagaaaaccaaaatgaagctgggggtgcaagtggtgatcacggacccagagaagctcgaccagattagacagagagagtctgacatcaccaaggagcggatccagaagattttggcgaccggcgctaacgtgatcctgactactggtggaattgatgacatgtgtttgaagtattttgtggaggccggagctatggcggtacgacgcgtgcttaagcgggacctcaagcggattgctaaggctagcggcgctactatcctatccactttagctaatcttgagggcgaggaaacctttgaggccgcaatgctgggacaggccgaagaagtggttcaggagagaatctgcgacgacgagctgattctcatcaaaaacactaaagcaaggacgtctgcttccattatcctgcgaggggctaacgacttcatgtgcgatgaaatggagaggagcttgcatgacgctctgtgcgtggtgaagcgcgtactcgaatccaaatccgttgtccccggagggggtgcggtggaagcagctttgagtatttacttagagaactatgcgacatctatggactggtcttag

SEQ ID NO: 243628 - DNA, 648 bp, Artificial Sequence
  Description of Artificial Sequence: Synthetic coding sequence
atgctggccggacagctggaggcaagggaccccaaggaaggtacccaccccgaagatccttgcccgggagcaggcgctgtcatggaaaaaaccgctgtcgccgcagaagtccttactgaagactgtaacaccggagaaatgccacctctgcagcagcagattataagactgcaccaggaactggggaggcagaaatcactttgggccgacgtgcacgggaaacttcgatctcacatagacgccttgagggaacaaaacatggagctgcgagagaaactccgtgccctgcagctgcagcgctggaaggctcggaaaaagtctgcagcctcaccacatgctgggcaggagtcccatactctagccctggagcctgctttcggcaaaattagtcctctctcagcagacgaggagacgattcccaagtacgccggtcataaaaatcagtccgctacactgctaggccaaaggtccagctccaacaattccgcccctcctaaaccaatgtcccttaaaattgagcgcatttcatcttggaagacccctccgcaggagaaccgagataagaatctgtcgcgcagacgccaagatagaagagcaacaccaactgggcgacccacaccttgcgccgagcgtagggggggagtgtag

SEQ ID NO: 243629 - DNA, 981 bp, Artificial Sequence
  Description of Artificial Sequence: Synthetic coding sequence
atggagaagacgccggctgccgcagaagtaccccgtgaagactctaatgctggcgagatgcccagcttgcaacagcagatcaccagtctgcatcaggagttggggagacaacaatctctttgggctgacattcatagaaaacttcagtcacatatggacgctctgagaaagcagaacagagaactcagggaagagctccggggtctccagcgtcaacagtgggaagctggaaagaagcccgcagcctcaccacatgccggacgggaatcacacactctggccctagagcccgcattcgggaagatttctcacctcagcgctgacgaagacacgactcctaagtacgccggacgcaagagtcagtccgcgactctgttgggccagcggtggtcatctaatcaccttgcaccacccaagcccatgtccttaaagaccgaacgcattaactccggcaagactcccccacaggaggacagagagaagtcgccaccaggacggagacaagaccgctccccggcaccgaccgggaggccaaccccaggcgcagagcgaagaggcgtgagtgaagacgggaaaatcatgcacccttcctcccgcagcccacagaatagtggcggaagaaagagccctgtgcaagccagtcaagcaaccacactgcaggaacaaactgctgctgctcgcggtgcagaccggagcagctctgttctgggttcatccgaagggggattcttaagcagggtgcaggctgatgaattcgctagcagcgcacccgactccgctgaaaggcaaaatttgccagtgaacccacctagttcattggagatcgctcaggccatggacaccaagatgaaaaaggaagaggtccaggaggagaagagacatccaaagggaaaggccgatgactgccggagatcaggtttcccctctgaattccccggtgctctgcatgccgcaccatctcgacaagatatgggtccatag

SEQ ID NO: 243630 - DNA, 1326 bp, Artificial Sequence
  Description of Artificial Sequence: Synthetic coding sequence
atggcgcctaagggcatcctcggaagctttccaaccgctatgaacctgtccctcgaggggaaggttaaggagactgtccataacgcattttgggatcacttgaaggagcagctgagcgccacaccaccagattttagctgtgctctggaactgctgaaagaaattaaagaaatcctacttagcctcttgttgcctagacaaaaccgattgcgaattgagatagaagaggcactcgacatggatcttcttaagcaggaggcagaacacggcgcattgaaggttctgtacttgagcaaatatgtcctcaatatgatggccctcctgtgcgccccagtccgcgatgaagccgtacagaaactggagaacattacagatcctgtgtggctattacgaggaatattccaggtgctcggtcgcatgaaaatggatatggtaaactatactatccaaagcctgcaaccacacttgcaagaacattccattcagtatgaacgcgctaagtttcaggagttgttaaacaagcaaccgtcactcctgaaccacacaacgaaatggttgacccaggccgctggcgacttgacaatgtcccctcccacttgtccagacacaagtgattcaagctctgtggccggaccctctcctaatgaggccgcaaacaaccctgaaccgcttagcccaaccatggtgctgtgtcagggattcttgaacttgttactatgggacttagaaaacgaagagtttcctgaaaccttgctgatggatcgcacgcggctccaggaattaaagtcacagctgcatcagctaaccgtcatggccagcgtgctcctggtggcatcgtctttttctggttccgtgttgttcggaagtccccagttcgtggacaagctcaagcgcattactaagtctttactggaggattttcactctagacctgaagaggccattctcacagtttccgaacaggttagccaggagatccaccagagcttgaagaacatgggcctcgtggccctttcatctgataacacagcctctctcatgggtcagttacaaaatatcgctaagaaggagaattgtgtctgctctgttatcgatcaacggattcatctattcctgaagtgttgcctggtgctgggcgtgcagcggtctctgctggatctgcccggtggtctgaccttgatcgaggcggagctggctgagctggggcaaaaattcgtcaacttgacgcaccacaaccagcaggttttcgggccatattacacggagattctgaaaacactgatttcccccgcacaggcattggagaccaaggtcgagtctgtttag

SEQ ID NO: 243631 - DNA, 1551 bp, Artificial Sequence
  Description of Artificial Sequence: Synthetic coding sequence
atgacacgaggtgggggaggcggagataccatatccaagatgccagacgtgaaggaaagtgtgccacctaagtacccaggggacagtgaaggaaggtcttgcaagcccgagacatctgggcctcctcaagaggacaagtcagggagcgaggatcccccaccattcctgagcgtcacaggattgacagagaccgtgaatgaagtgagcaagctgtctaataagatcggaatgaactgcgattattatatggaagagaaagtcctgccaccatccagcctggagggcaaggtaaaagagactgttcacaatgccttctgggatcatctcaaggagcagctcagcgcgacaccccctgacttctcttgcgctttggaactattgaaggagatcaaagagatcttgctgagccttctgttgcctcgccagaacaggctacggatagagatcgaagaggccttggatatggacttgcttaaacaggaagccgagcatggcgcacttaaggtgctctatctgtcaaagtatgtattaaatatgatggccctgctgtgcgccccagtccgagatgaggcagtgcagaaactcgaaaatattaccgatcccgtgtggcttctgcgtgggatattccaggtgctggggagaatgaagatggatatggttaattataccatccagagtctacagcctcacctgcaggaacactcaatccagtatgaacgcgcaaagttccaagaactgctgaataaacaaccctcacttctcaaccacacaaccaagtggttaacccaggccgctggagacctgaccatgtctccacctacgtgccccgacaccagcgacagctccagcgtagctggcccttccccaaatgaagctgccaacaaccctgagccactgtcacccacaatggtgctgtgccaggggttcctaaacttactgctgtgggatcttgagaatgaagaatttcccgaaaccctcctcatggatagaacacggttgcaggagcttaaaagccaactccatcaactgacggttatggccagcgtcctactcgttgctagctcattttccgggtcagtgctgttcggaagccctcagttcgttgacaagcttaaaaggatcactaagtccctcctcgaggactttcatagtcggccagaagaggcgatcctaaccgtcagcgagcaggtcagccaggagatccaccaatccctgaaaaacatgggcctcgtggctctctcttcagacaatacagcctctctgatgggacagcttcagaacatcgcaaaaaaggagaactgcgtgtgctcggtgatcgaccagagaattcatctcttccttaagtgttgcctcgtgttgggtgtgcagaggagtctgcttgacttacccggtgggctaactttaattgaggccgaactcgccgaactggggcagaagtttgtgaatctaacacatcacaatcaacaggtgttcggaccatactatactgaaatcctgaagacactgatcagccctgcccaggcccttgagactaaagtggagagcgtgtag

SEQ ID NO: 243632 - DNA, 822 bp, Artificial Sequence
  Description of Artificial Sequence: Synthetic coding sequence
ggtctcagtcatcgcgcaaccccacaacccgcagccccaccacggtggtatgctccaggcaggcaagcagccagaccgactgagcgtacacctgtggacgatcctaggcggggaaggcgcagtctcgagggcaaagtgaaggaaacggtgcacaatgccttttgggaccacctgaaggagcagttatccgccacccctcctgacttctcatgcgctttggagttgctgaaagagatcaaagagatcctgttgagcctgctgctaccaaggcagaatagactccgcattgagatagaggaagcacttgatatggatctcttaaagcaggaggcggagcacggagccctgaaagtgctgtacttaagtaagtatgtgttgaatatgatggccctgctctgtgccccagtgcgagacgaggccgtgcagaaattggagaatatcacggatcccgtgtggctgctccggggaatctttcaggtgcttggcagaatgaagatggacatggtgaattacaccatccagagtctccaacctcacctgcaggagcattctattcaatatgagcgtgcgaagttccaggagctactgaataagcaaccttccctccttaatcacacaacaaagtggcttacgcaggctgcaggcgaccttactatgagcccccctacatgcccggacacctcagattcgtctagtgtggccggacccagcccgaatgaagccgcaaataacccagaaccattaagcccaaccatggtgctttgccagggttttttgaatttattactatgggacttagagaacgaagagttccccgagtag

SEQ ID NO: 243633 - DNA, 1326 bp, Artificial Sequence
  Description of Artificial Sequence: Synthetic coding sequence
atggcccctaagggaatcttggggtcctttccaacagcaatgaacctctcgcttgaaggcaaagttaaggaaaccgtgcacaacgcattctgggaccacctgaaggagcagttgagcgctactccacccgactttagttgcgctctagagctcctcaaggaaatcaaagagattcttctctccctcctcctgcctcggcagaatcgccttcggatcgagattgaggaagccctggacatggatttactgaagcaggaggcggagcatggggctctcaaagtgctctatctctcgaaatatgtcttaaatatgatggctctactgtgtgcacctgtgcgagacgaggcagtgcagaagttggagaacatcactgatccagtttggttactgcgcggtatttttcaggtgcttggcaggatgaagatggatatggtcaattataccattcagtcccttcagcctcatctgcaggagcattctatccaatatgagcgcgctaaattccaagagcttctgaacaagcagccctcactgttaaaccacacaaccaaatggctgactcaagcagctggtgatctgacaatgtccccaccaacatgtccagacacatctgattctagctcagtagccggacccagtcccaacgaggcggcaaataaccctgagcctctgagccctaccatggtgttatgtcaaggcttcctgaacttgttgttgtgggatctggaaaatgaggaattccctgagacactgctgatggatcgaacacgattgcaggaacttaagagccagctgcaccagctgactgtgatggcgagcgtgctgctggtggcctcatccttctcaggatctgtcctgtttggttcacctcagttcgttgacaagcttaagaggatcaccaagagcctgcttgaagactttcactccagacctgaagaggcgattctgaccgtatcggaacaggtatcacaggaaatacaccagtctcttaagaacatgggactagtcgccctaagttcggacaatactgccagcctgatgggacagctgcaaaacattgccaagaaagagaattgtgtttgtagcgtgatcgaccagcggattcatctgttcctcaaatgctgcttggttctcggcgtccagcgctcactgctcgatctgcctggcggtttaacccttatcgaggcagagctggctgagttgggccagaagttcgtgaatctgacccatcacaaccagcaagtttttggcccttactatacggagatcctgaaaacactgatctccccagcgcaagcccttgagaccaaagtggagagtgtctag

SEQ ID NO: 243634 - DNA, 312 bp, Artificial Sequence
  Description of Artificial Sequence: Synthetic coding sequence
atggcacccaagggaatcttagggtcctttcccacggccatgaacttgagtctcgaaggcaaggtcaaggagaccgtccacaacgctttctgggatcacctgaaggaacagctctccgcgaccccgcctgactttagctgcgcccttgagctgctgaaagagatcaaggaaatccttttatccctgctgcttcctcggcaaaaccggctgagaattgagatcgaagaggcgcttgacatggaccttcttaaacaagaggctgaacacggagcactcaaggtcttatacctttcaaagtatgtcctgaactag

SEQ ID NO: 243635 - DNA, 1512 bp, Artificial Sequence
  Description of Artificial Sequence: Synthetic coding sequence
atgccagacgttaaagagtctgtgccccctaaataccccggagactccgagggccgaagctgtaagccagagacatctgggccacctcaggaggacaaaagtggctcagaagaccctcccccatttctctccgtgacagggttaaccgaaactgtgaatgaggtgtctaaactgtcaaataagatcggaatgaactgcgattattacatggaagaaaaagtactccctccctcctctttggaaggcaaagtcaaggagactgtgcacaacgccttttgggatcatctcaaagagcagctcagtgcaaccccaccagactttagttgcgcactggagctcctgaaagaaattaaggagattttgctgagcttgctgctccccagacagaaccgccttcggatcgagatcgaggaggctctggacatggacctgctgaagcaggaagccgagcatggggcattgaaagttctgtatctgagtaagtacgtcctgaatatgatggctcttctgtgcgcaccggttagggacgaagctgtccaaaagttagagaacatcactgatcctgtatggcttctccgtggcatatttcaggttctcggacgcatgaagatggatatggtaaactatacaattcagagcttgcagccccacctgcaagaacactccatccagtacgaaagagcgaaattccaggagcttctgaacaagcaaccgtccctactaaaccatactaccaagtggctgacccaagccgcaggagatcttacgatgtctcctcccacatgcccagacaccagtgactccagctctgttgccggaccttccccaaacgaagcagctaacaacccagagcctctgtccccgacaatggtgctctgccaggggtttctgaatttactgctctgggacctcgaaaacgaagagttcccggaaaccttattgatggaccgtacacgcctgcaggaactaaaatcacagttgcaccagttgactgtcatggcatccgtcttgctggtggcgtcaagtttttctgggtcagttctgttcggctccccccagtttgttgataaactgaagagaatcactaaatctctgctggaagactttcactccagacctgaggaggctattcttaccgtgagtgaacaggtgtcacaggaaatacaccaatcccttaagaacatgggactcgttgcgctgtctagtgacaatactgcttccctgatggggcagctccagaacattgcaaaaaaggagaattgtgtgtgttctgtcattgatcagaggatacatctgtttctcaagtgctgcttggtgctgggcgtgcagcgcagcctgctggacctcccgggaggcctgactttgatcgaggctgaattggccgaactaggtcagaagtttgtaaaccttacgcaccataatcagcaggtattcgggccatactacaccgagatactgaagactctgatctcacctgcccaagcgctcgaaaccaaagtagagtccgtgtag

SEQ ID NO: 243636 - DNA, 1413 bp, Artificial Sequence
  Description of Artificial Sequence: Synthetic coding sequence
atgacccggggaggcggtgggggagtgttgtctgtgaccggtctgactgagacagtcaacgaagtatctaagcttagcaataagatcggtatgaattgcgattactacatggaagagaaagtcctgcctccttctagcctggaggggaaagtaaaggagacggtgcacaatgctttctgggaccatctgaaggagcaactgtctgcaaccccgcctgactttagctgcgcactggagttgctgaaagagatcaaggagattctgctttccctcctgctgccacggcaaaacagactccgtatcgagatcgaggaggccttggatatggatctccttaagcaggaggccgaacacggcgctctgaaggttctttatctgagtaagtacgttttgaacatgatggccctgctttgcgctcctgtgcgagatgaggctgtccagaaactggagaatattaccgacccggtctggttgttgcgcggaatcttccaagtactcggtaggatgaagatggatatggtcaactatacaatccagagcctccagccacaccttcaggaacactccattcagtacgagagagcaaagtttcaggagttgctgaataagcaaccttcactgttgaatcacactacaaagtggctgacccaggccgctggcgatcttaccatgagtccgccaacgtgtccagataccagcgactcttcttctgtggcaggtcccagccctaacgaagccgctaataatcctgaacccctatctccaacaatggtcttatgtcagggctttctcaaccttctgttatgggatctcgaaaacgaggaatttcccgaaacactgcttatggataggaccaggcttcaggagcttaagagccagctgcatcagctcactgtaatggcgagcgttctgttggtggcgagctcatttagcggctctgtgcttttcggcagccctcagtttgtggacaaacttaagagaatcactaaaagtttactagaagattttcatagtcgtcctgaggaagctatcctgactgtctccgagcaggtgtctcaggagatccaccagtcgcttaagaacatgggacttgtagccctctcatccgacaataccgccagtcttatgggacagttgcagaacatcgccaaaaaggaaaattgtgtgtgtagcgttattgatcaacgtatacatctatttctgaagtgttgcctggtgttaggcgtgcagcggtctcttttggacctgcctgggggattaaccctcatcgaagcagagcttgccgaactggggcaaaagttcgtcaatctaacccaccacaatcagcaggtctttggcccttactatactgagatcttgaagacattaattagtcccgctcaggccctcgagacaaaagtagaaagtgtgtag

SEQ ID NO: 243637 - DNA, 1398 bp, Artificial Sequence
  Description of Artificial Sequence: Synthetic coding sequence
atgaccagaggaggaggtgggggagggttaaccgagactgtgaacgaagtctccaagctgagtaataaaattggtatgaattgcgactactatatggaagagaaggttctgccccctagcagcctggaggggaaagtgaaagagacagtgcacaatgccttttgggatcacctgaaagaacagcttagcgccactccccctgattttagctgcgctctggaactgcttaaggagataaaggaaatcttgctgagcctgctcttgccacggcagaataggctccggattgagattgaagaggcactggacatggacctgctgaagcaggaggccgagcatggtgcgctgaaggtcctttacttgtctaagtacgtcctcaacatgatggccctcctttgtgctcctgtgagggatgaagccgtccagaaactagaaaatatcacagaccccgtttggctcctgaggggaatattccaggttttgggcaggatgaagatggacatggtgaattacacgatacagtcactccagcctcatctccaggagcacagtatacagtacgagcgagccaaatttcaggaactcttaaataagcaacctagcctattaaaccacacgacaaagtggttgacacaggctgccggtgacctaactatgagtccccctacttgtccggatactagtgactcctcaagcgtggctggtcccagtccaaatgaagccgctaacaaccctgagccgctgagccccactatggtactctgtcagggattcctgaatctactgctgtgggacctggagaatgaagaatttccagagaccctgctgatggacaggacccgtctacaggagctgaagtcgcaattgcaccagctcacagtgatggctagcgtgctgcttgtggctagctccttctcaggctctgttctatttgggtccccacagttcgtagataagttaaagagaataactaagtcgcttttagaggactttcattcgaggcctgaggaggccatacttactgtaagtgagcaggtgtcccaggagatacatcaaagtctaaagaatatgggcctggttgccctttcctcggacaatacagcttcattgatgggccagcttcagaatatcgccaaaaaggagaattgcgtgtgttcagtgatcgaccagcgtatccacctgttcctaaaatgttgtctggttctcggtgtgcaacggtccctgctggatttgccgggaggccttactctcatcgaagctgaattggcggagctcggccagaaattcgtgaatctgacccaccataaccagcaggtgttcggtccgtattacactgagattttaaaaaccttaatcagtccggctcaggccctggaaaccaaagtggagagcgtgtag

SEQ ID NO: 243638 - DNA, 165 bp, Artificial Sequence
  Description of Artificial Sequence: Synthetic coding sequence
atgacacgcggtggtggcggaggcgacactatttcgaagatgccggacgttaaggaaagtgtgccacctaagtaccccggtgacagcgagggcagaagttgtaaacctgagacaagcgggcctccccaagaggacaagtctggttccgaggacccccctccttag

SEQ ID NO: 243639 - DNA, 165 bp, Artificial Sequence
  Description of Artificial Sequence: Synthetic coding sequence
atgacccgaggtggaggtggcggagacaccatttccaagatgccagacgtcaaagagagcgtgccacccaaatacccaggcgactccgaggggagaagctgcaagcctgagactagcggtcccccacaagaggataaaagtggatcagaagaccctcctccttag

SEQ ID NO: 243640 - DNA, 597 bp, Artificial Sequence
  Description of Artificial Sequence: Synthetic coding sequence
atgttcttcgagaggcatctcgaaaacctgctaaagcactttattcccggaaccaccgatccagctgtcatcctggacctgctgcccctatgccgcaactacgttcgcagagtgcatgtggatcagtttctcccccctgttcagctgcctgcccagctgcggcctggcgatcagtccgacagcggtagcgagggcgagatggaggaacccaccgtcgatcactaccagctgggcgaccttgtcgcaggccttagccatctcgaggagctggacctcgtgtatgacgtgaaggactgcggaatgaatttcgagtggaaccttttcctgttcacatatcgggactgtctatctctggccgctgccatcaaggcatgccacaccttgaaagacgggggtaagcagctgttggagggcatgtcagataataagactctgcttgaatttgacctgcggctctcggacgtggcccaagagtctgagtacctcattggtcaggctctgtatgcaaatagagaggctgctaggcagcgagcactcaatccgagtcattttatgtccacaatcacagcaaacggaccagaaaacagcgtcggttag

SEQ ID NO: 243641 - DNA, 597 bp, Artificial Sequence
  Description of Artificial Sequence: Synthetic coding sequence
atgtttttcgaaagacatcttgagaatttgctgaagcatttcatcccgggtactaccgatccggcagtcattctagaccttcttccgctgtgtcggaattacgtccggcgagtgcacgtggaccagtttttgcctccagtgcagctgcctgcacagctgagacctggagatcaatctgatagcggtagcgagggggaaatggaagagccaaccgtggaccattatcagttaggagacctggtggcgggactttcacacctggaagagctggatctggtctacgatgtgaaagactgcggaatgaacttcgagtggaacctgtttctgttcacttaccgcgactgtttatctctcgccgcagccatcaaagcatgccacacattgaaggacgggggaaagcagctcctggaaggcatgtcggataacaagaccctcctcgaattcgatctgcggctctccgacgtcgcacaggaatctgagtacctgatcggtcaagcactctacgctaacagagaagccgctagacagagagcacttaatccatcccacttcatgagtactattaccgccaatggccctgaaaactcagtcggctag

SEQ ID NO: 243642 - DNA, 1506 bp, Artificial Sequence
  Description of Artificial Sequence: Synthetic coding sequence
atgcaggacactgtgacgaccagcgccttgctcgacccttcacactcgagtgtgagcacccaggataactcctccaccggaggacacacttctagcacatctccacaactgagtaagccctcaatcacccccgtacctgcaaagtcacgtaaccctcaccctagggcgaacattcggcgtatgcggagaatcattgcagaagatcctgagtggtccctggctattgtaccgctgctcacagagctgtgcatccagcatataattcggaacttccaaaaaaaccccatactcaagcagatgctaccagaacatcaacagaaggtactaaatcacctgtcacctgatctgcccctggcggtcacagcgaacttaattgattccgaaaactattggctccgttgttgcatgcaccgctggcccgtgtgtcacgtagcccaccacgggggtagctggaagcgtatgttctttgaacgccatctcgaaaacctcctcaagcattttatcccagggactacggaccctgcggtgatcctggacttactcccgctctgtcggaactatgtgagaagggtgcacgtcgatcagttcttaccccctgtgcagttgccagcccaacttcggcctggcgaccagagcgattctggtagtgagggagagatggaggaacctacggtggaccactaccagctcggcgacctggttgcaggcctcagtcacctggaagagctggacctggtgtatgatgttaaagactgcgggatgaactttgaatggaatctgtttctgtttacttatcgggattgtctttcccttgcggcagcaatcaaagcttgtcacactcttaagatatttaaattgacccgctcaaaggtggatgatgacaaagcgaggatcatcattcgttcactgcttgatcaccctgtcctagaggaactggatctgagccagaacctgataggcgaccgaggggctaggggggctgccaagctcctgagtcactcccgactgagagtgctgaatctggccaataatcaagtcagggccccaggggcacagtctctggcccacgccttagcccacaatactaacttgataagtctgaacctcagattgaattgtatcgaggatgagggcggacaagcgctggcacacgcgttacaaaccaacaagtgtctgacaaccttacacttggggggtaatgagctgtctgaaccaaccgcaaccctcttgagccaggtgttggccataaacacaacattgacaagcattaaccttagttgcaatcacattggtcttgatggaggtaagcagcttctggagggcatgtctgataataagactctcctggagttcgacctgagactttccgacgttgcccaggagtccgagtacttaattgggcaggccctttatgcgaatagggaagcagctcgccaacgggctctgaatcctagccattttatgagcaccatcaccgcaaatggtcctgagaacagcgtggggtag

SEQ ID NO: 243643 - DNA, 597 bp, Artificial Sequence
  Description of Artificial Sequence: Synthetic coding sequence
atggaaaaacgcggaaggggggttaagtcgagtccaatacagaccccaaatcagacaccccaacaggcccctgttacacccagaaaagagcgcagacccagtatgttcgaaaaggaggcatatacccagattcttcgcgagagactccgtgaatccattcacaacgttcagtacgtggagccgccattcgatgacagcatagcagatatcggcaaggaatggaaaagtgcattagccaagttgaagtttgccaatagctatcgcatggaacctctcaagaagttccaggcccattcggtggaaaccaaggtgcagcagattctaacggagtcgctaaaagacgtgaagtatgacgacaaggtcttttcacacttgtctctggaattagccgacagaatcctactggctgtcaaggaattcggctatcaccgctacaagtttataattaaagtgctcttcattcagaaaactgggcaggctataaatattgcgtcaaggtggatatgggacattgcctgggactcatgggttgcagcgaagcacgaagctgaaagttacgtagcactggtgctcgtgtttgccctttactatgagtag

SEQ ID NO: 243644 - DNA, 666 bp, Artificial Sequence
  Description of Artificial Sequence: Synthetic coding sequence
atggctagtcgcccactgcctcccggtcgacaggaggaagagaatgcgaaggacagtggccgaaaaccctcccccgtgagacctcggggttgcctgccaagcattgacgaggctcggccagccggaccaggtcccgctccagcctcccggagagggagcatgttaggattggcggcatccttctcgcgccgtaacagcctggttggacccggagctggcccaggtggccagaggccctctctcgggccagtcccccctcttggatcacgggtttctttttcaggcttacctctggctcccgcacgttgggttgcaccaagctatcggaccgagcccgtgccaggcgagagatgggaagctgccagggcacagcgtgccctggaggctgccttagccgctggcctgcacgatgcttgttattcctctgacgaagctgccagactcgtgcgggaactgtgtgagcaggtgcatgtgaggctaagagagctctccccaccacggtataagttggtttgctctgttgtcttgggtccacgcgctggacagggagtccatgtagtctccagggctctctgggatgtggcacgcgacgggctcgcttccgtgtcttataccaatacgagtctttttgctgtcgcgactgtgcacggtttgtattgtgagtag

SEQ ID NO: 243645 - DNA, 666 bp, Artificial Sequence
  Description of Artificial Sequence: Synthetic coding sequence
atggccagcaggcccctgcctcccggacgccaggaagaagagaatgcaaaggactctggaagaaaacccagtccagtcagacctcgcggatgcctgccaagcatcgatgaagctagaccggctggcccaggcccagcccctgcaagtagacgaggtagcatgctgggcctcgccgcttcattctccagacgcaattccctggtggggccaggggctgggccagggggacagagaccttcactcggaccagttcctcctctcggttcgcgcgtgagcttcagcgggctccccctagcacccgcacggtgggtggctccctcatacaggaccgaacccgttccgggagaaagatgggaagctgctcgcgctcagcgggcactagaggccgcattggcagctggactgcatgacgcgtgttattcctccgacgaagccgcacggttagtacgcgagctgtgcgaacaggtccatgtgaggctgcgtgaactgtctcctcccaggtataagctggtatgtagtgtagtgttggggcctcgggctggccagggagtccatgtggtttcaagggctctatgggatgtcgctcgagatgggctggcctctgtgagttatactaacaccagtctattcgctgtcgccactgttcacggcctgtattgtgaatag

SEQ ID NO: 243646 - DNA, 1074 bp, Artificial Sequence
  Description of Artificial Sequence: Synthetic coding sequence
atggagaggatgtcagattccgcagacaaacccatagacaatgatgcagagggagtttggtcaccagatatcgaacagtctttccaagaagctctcgccatctatccaccatgcgggagacgcaagatcattctgagcgatgagggcaagatgtacggcagaaatgagctgatcgccagatacattaagttgaggaccggaaaaacccgaacgagaaagcaggtctcatcccatattcaggtcctggcgaggaggaaatccagggatttccactccaaactaaaggtcacaagcatggaccagacggcaaaagacaaggcactgcaacacatggcggctatgtcttctgcccaaatcgttagcgccaccgcaatccataacaagctcggactgccagggatcccccgacccactttcccgggagccccaggcttctggccgggtatgatccagacaggacaacctggaagcagtcaggatgttaagccatttgttcagcaggcctaccctatccagcctgctgtaactgctcctatccctgggttcgagcccgcatcggctcccgctccttctgtccccgcttggcaggggaggagtattggaaccacgaagttgcggttggtcgagtttagtgccttccttgaacagcagcgcgaccctgacagtgccgacctgaactgcaatatacaagatgatgccggagccttttatggagtaacatctcagtacgagagctcagaaaacatgaccgtgacctgcagcacaaaagtgtgtagcttcggaaaacaggtggtggagaaggtagagactgagtatgctaggttcgagaacggcaggtttgtctatagaattaaccgcagtcctatgtgtgaatatatgattaatttcatccacaagctaaaacacctgccagagaagtatatgatgaatagcgtgctggagaactttacaatccttctcgtggtgaccaatcgagacactcaagaaaccctattgtgtatggcatgtgtgtttgaagtctccaactcagaacatggagctcagcatcatatctacaggctggtgaaggattag

SEQ ID NO: 243647 - DNA, 1236 bp, Artificial Sequence
  Description of Artificial Sequence: Synthetic coding sequence
atggaaagaatgagcgatagcgcagataagccaatcgacaatgatgcggagggagtgtggtcgcctgacatagagcagagctttcaggaggccttagccatttacccaccttgcggccgtcgaaagatcattctctctgacgagggcaaaatgtatggcagaaatgagctgatagccaggtacattaaattgcgcacaggcaaaactcggacacgcaaacaggttagcagtcacattcaggtcctggccagacgcaaaagccgtgactttcatagcaagcttaaggatcagacagctaaagataaggcacttcaacacatggctgccatgtcttcggcccagattgtgagcgccactgccattcacaacaaactcggcctccccggaattcctaggcccacgtttcccggagctcccggtttctggcctggcatgatccagaccggccagccagggagcagtcaggacgtgaagcccttcgttcagcaggcctatccaattcagccagccgtgactgcccctataccgggttttgagcctgcatccgctccagccccatccgtcccggcttggcagggacgatcaatagggactactaaactgcgtcttgtggagttcagtgcctttttggaacaacaacgggatcctgactcatacaacaagcatctttttgtccatatcggacatgctaaccactcttacagtgatccactgcttgagtctgtagacatcagacaaatctacgataaatttccggagaaaaagggcggactgaaggagttgttcggaaaggggccacagaatgctttctttctggtgaaattttgggctgacctgaattgcaacatacaggacgatgccggtgcgttttacggtgtaacctcacagtatgagagttcagagaatatgaccgttacctgttctacaaaagtctgtagttttgggaagcaagttgtagaaaaggtcgaaaccgaatacgctagatttgaaaatggccgatttgtctacagaataaacagatctcccatgtgcgagtatatgattaacttcattcataagctgaagcacctgcccgagaaatacatgatgaacagcgttctggaaaactttactatcctgttggtggtcacaaaccgggacacccaggagactctgctgtgcatggcctgtgtgttcgaggttagtaatagcgagcacggcgcacaacatcatatttatagactagtgaaggactag

SEQ ID NO: 243648 - DNA, 1281 bp, Artificial Sequence
  Description of Artificial Sequence: Synthetic coding sequence
attgaacccagtagttggtctgggtcagagtcccccgctgagaacatggagaggatgtccgactctgcagataaacctatagataacgatgctgaaggcgtatggtcccctgacatagaacaatcgtttcaggaggctctagctatttacccaccgtgcggtaggaggaagattatcctctcagacgaaggcaaaatgtatggcagaaatgagctcattgcgaggtacatcaagctgagaacagggaagacccggactagaaagcaggtctcttcccacatccaagtcctggctaggagaaagagtcgcgattttcattctaagcttaaggatcagaccgcaaaagataaggctctgcaacatatggcagcgatgtcaagcgcacagatcgtgagtgccacagcgatccataataagttgggcctgcctgggattcccagacccaccttcccaggagccccaggtttctggcctgggatgatccagaccgggcagccaggttcctctcaggacgtgaagccctttgtgcagcaggcatatcctatacagcccgctgtaacggccccaatacccggattcgaaccagcctccgcaccggctcccagtgtgcctgcttggcagggtcgctccattggtaccaccaaactccggctggtggagttctccgcttttcttgaacagcagcgcgatcccgattcttacaacaaacatctgttcgtgcatataggacatgccaaccactcttattccgacccccttctcgagtctgtggatattcggcaaatctatgataagtttcctgagaagaagggaggtttaaaggagttatttggaaaggggcctcagaacgcgttctttctggtaaagttttgggcagacctcaactgtaatatccaggatgacgcgggagcgttttatggcgtgacctcacagtacgagtcttccgagaacatgacagttacctgttcgaccaaggtgtgctcattcggcaagcaggtcgtcgaaaaggttgagactgaatatgccagattcgaaaacggacgtttcgtttatcgtattaatcggtctcccatgtgcgagtatatgatcaacttcatccataaactgaaacatctgccagaaaaatacatgatgaatagcgtgctcgagaacttcacaatactgctggtagtcacaaatcgagatactcaagagactttactgtgcatggcatgcgtatttgaagtttccaactccgaacatggagcccagcatcatatatacagattggtaaaagactag

SEQ ID NO: 243649 - DNA, 993 bp, Artificial Sequence
  Description of Artificial Sequence: Synthetic coding sequence
atgaggtatgtgctgtcctggtgcgtgacagtcactttcaaggatcagaccgccaaggataaagccttgcagcatatggcagcaatgagctctgcccagattgtgagtgctaccgcgattcataataaactcggcctgcctggaataccccgtcccacctttccaggggcacctggcttttggccaggcatgatccagacaggccagcctggctcttcgcaggatgttaaaccctttgttcaacaggcatatccgatacagcctgccgttaccgcccctatccccggattcgaaccggctagcgccccagcgccatcagtgcctgcttggcaggggcgttccatcgggaccactaagctgagattagttgagttttctgccttcctggagcagcagagagatccagatagttacaataaacatctgttcgtgcacattggccacgcgaatcattcctactccgaccctcttctggagtcagtggatattaggcagatctacgataagtttccagaaaagaaggggggattaaaggagctgttcgggaaagggcctcagaatgcctttttcctggttaaattttgggccgacttgaactgcaacattcaggacgatgctggcgctttttatggggtcacctcacagtatgaaagctctgagaatatgacagtaacctgcagtacaaaagtatgcagttttggcaagcaggtggtagaaaaagtggagactgaatatgccagatttgaaaacggccgattcgtttataggattaatagatccccgatgtgcgaatacatgatcaattttatacacaaactgaagcacctgcccgaaaaatatatgatgaatagcgtattggaaaattttaccatcttattagtggtcacaaatagagatacacaggaaacccttctctgtatggcctgcgtgttcgaagtatccaactccgagcacggcgcacaacaccatatctataggctggtgaaagactag

SEQ ID NO: 243650 - DNA, 207 bp, Artificial Sequence
  Description of Artificial Sequence: Synthetic coding sequence
atcgaacccagttcttggagcggatccgaaagccccgctgagaacatggagcgcatgagtgatagcgccgataaacctatagacaatgatgccgagggggtctggtcccctgacatcgagcagagcttccaagaggcacttgccatttatcctccctgtggccgacgcaaaatcatcctcagcgacgaaggtaagatgtatggctag

SEQ ID NO: 243651 - DNA, 1281 bp, Artificial Sequence
  Description of Artificial Sequence: Synthetic coding sequence
atagagcccagctcctggagtggcagcgagtctcccgcagaaaatatggaacggatgtcagattccgcagacaagcctatcgataacgacgccgaaggtgtatggagccctgacattgagcagtcttttcaggaggccctagccatttatcctccttgcgggagacggaaaataatcctttcagacgagggcaagatgtatggacggaatgaattgatcgctcgatatataaaactgaggaccggtaagactcggaccaggaaacaggtatctagccatatccaggtactggctagacgcaagagccgggacttccattctaaacttaaggatcaaactgcaaaagataaggcactgcagcatatggcggctatgagctccgcgcagattgtgtctgcgacagctattcataacaaactcggcttgcccggaatccctcgcccaacttttccgggagctccgggattttggccagggatgattcagactggtcagccgggtagctcacaagatgttaaaccattcgtgcagcaggcataccccatccagccagctgtgacagcccctattcccggtttcgagccagcttctgctcccgctccttccgtccccgcttggcaggggaggagtatcggaaccaccaaactcaggctcgttgagtttagcgcctttctggagcagcaacgagacccagatagttataacaaacatctctttgttcacatcggacatgctaaccatagttacagcgacccactgctggagagcgtggatatccgacagatttatgacaagttcccagaaaaaaagggtggactgaaggaactgttcgggaagggccctcaaaacgcgtttttcctagttaagttctgggcagacctcaactgcaatatacaggatgatgcaggagccttttacggtgtgacatcccagtacgagagttcggaaaacatgactgttacctgttcaacaaaggtttgttcattcggtaaacaggtggtagaaaaggtcgagaccgaatacgctagattcgaaaacgggaggtttgtgtaccggatcaatcgtagtcccatgtgcgagtacatgatcaattttatacacaagctcaagcatcttccagagaagtatatgatgaatagtgtgttggagaacttcaccattctgctggtggtgacaaatcgggacactcaggaaacattgctctgtatggcgtgtgttttcgaagtgtctaactcagagcacggtgcacagcatcacatttataggctcgttaaagattag

SEQ ID NO: 243652 - DNA, 1344 bp, Artificial Sequence
  Description of Artificial Sequence: Synthetic coding sequence
atgggtgaacctcgagccggagccgcactagatgatggctccggatggaccggctccgaggagggatccgaagaagggacaggtggcagcgagggagctgggggtgacggcggaccagacgcagagggcgtttggtctcctgatattgagcagtcattccaagaagcgctggccatttaccctccctgcggtcgtagaaagatcatcctttccgacgaaggaaaaatgtatggacggaatgaacttatagcgagatatattaagctaagaactgggaagacgcggacacgcaagcaggtctccagccatatccaggtcctggccaggagaaaatctcgtgagatccaatccaaactgaaggatcaggtttcaaaagacaaagcgttccagacaatggccacgatgagttccgcccagctgatcagcgccccatctctccaggccaagctgggccctacaggccctcaagcctccgagctattccagttttggtcaggaggttctggccctccttggaacgtgcctgacgtgaaacctttcagccagacgccatttacactcagtttgactccaccaagtaccgatcttccgggatacgagccaccccaggctttatccccactcccccctccaaccccatcacccccagcatggcaggctcgtggccttggcaccgccaggttacagctggttgagttctctgctttcgtggaaccgccagacgccgtcgatagttaccagcggcacctgtttgttcatataagccagcactgtccgtctccaggtgcaccgcctctggaatctgtggatgtcaggcaaatatatgacaaatttcccgaaaaaaaggggggtctgcgggaactgtacgatcgcggacctcctcatgctttctttcttgtaaagttttgggcagatctgaattgggggccatctggagaggaggccggtgctggcggaagcatttccagcgggggattctatggcgtgagtagccagtatgagtcattggagcacatgacgttgacatgcagctctaaggtgtgtagttttggtaaacaggtcgtggagaaagttgagacggaacgggcacagttggaagacggtcgctttgtgtatagactgctgagaagcccaatgtgtgaatacctcgtgaacttcttgcataaactaaggcagctaccagagagatatatgatgaacagcgttttggaaaatttcactattctgcaggtagtcacaaatagggatacccaggagctcctgctgtgcaccgcttacgtgtttgaggtttccaccagcgagcggggagcacaacaccacatctacagactagtgcgggactag

SEQ ID NO: 243653 - DNA, 1353 bp, Artificial Sequence
  Description of Artificial Sequence: Synthetic coding sequence
atgggggagcccagagctggtgcagccttggatgatggatctggctggaccggaagcgaagagggcagcgaagagggcacagggggaagcgagggagctggaggcgatggaggaccagacgctgaaggtgtttggagcccagacattgaacagagttttcaggaagccctggccatctaccccccatgcgggaggcgcaaaataattctgagtgacgagggcaagatgtatggtaggaacgaactgatagccagatatatcaagctcaggacaggaaaaactcgcacacgcaaacaagttagttcacatatccaggttctagctcgcagaaaaagtcgcgagattcagagcaaactaaaagatcaggtttccaaggacaaggcctttcagactatggcgactatgagcagtgctcaactgatttcagccccaagcctgcaggctaaattgggtcccacagggccacaagtggttcaggcaagcgagctttttcaattctggtctggtggcagcggaccaccctggaacgttcctgacgttaaaccgttcagtcagactccttttactctgagtctcacgcccccttccactgatctgccaggatatgagcctccacaagccttatctccactgcctccacctacaccttcgccgccagcttggcaggctcggggactgggcacagccagactgcagttggtggaattctccgcttttgtcgaacctccagacgcggtggattcctaccagcggcacctgttcgttcatatctcacagcactgtccctcccccggagctcctcccctggagtccgttgacgtcagacagatttacgacaaattcccagaaaaaaagggaggcctgcgtgagctgtacgaccgaggacctccccatgccttctttctggtcaagttctgggccgacctcaactggggtcccagcggggaagaagcaggcgcaggaggaagcatatcctcaggaggcttttatggagtatcctcccaatacgagtcgctcgaacatatgacactaacctgtagtagcaaggtttgctcctttggaaagcaggtggtggagaaggttgagactgagagagcccagctggaagacggacgctttgtgtatagactcctgcgtagccctatgtgtgaatacctggtcaatttcctccataaactaaggcagcttcctgagcggtatatgatgaactctgtcctggaaaacttcacaattcttcaagttgtaacaaatcgagacacccaagagctgctgctgtgcactgcttatgtgtttgaggtgtctacttccgaaaggggcgcacagcaccacatctaccggctggtgagggactag

SEQ ID NO: 243654 - DNA, 960 bp, Artificial Sequence
  Description of Artificial Sequence: Synthetic coding sequence
atggctacgatgtcgtctgctcaactcatctccgccccttcattgcaggctaaactgggacccaccggtccccaggtcgtgcaggcttcagaactgtttcagttttggagtgggggttctggccctccctggaacgttccggacgttaaacccttctcccagacccccttcaccctaagcctcaccccacccagcacagatttgcccggttacgagccccctcaggcactctccccattgccccctcctaccccaagcccccctgcctggcaagctagagggttaggaaccgctagacttcagttggtcgaatttagtgcctttgtggaaccccctgacgcggtcgactcatatcagcggcacctcttcgtgcacatatcccagcattgccccagccctggggcaccacccctggagtcagtagatgtgcgtcaaatctatgataagttcccagaaaaaaagggagggttgagagagctctatgacaggggcccaccccatgcctttttcctggtgaagttttgggccgacctaaattggggccctagcggggaggaggccggagccggaggctcaatcagctccgggggattttatggggtaagctctcagtacgagtctctggagcacatgaccctcacatgttcttccaaggtgtgtagcttcgggaagcaggtggtcgagaaggtggagactgagagggcccagttagaggacgggagattcgtgtaccgactgctacgtagccccatgtgcgagtacctggtcaacttcctccacaagctgcgtcagctgccggagaggtacatgatgaactctgtcctcgaaaatttcaccattctgcaagttgtgactaatcgcgatactcaggaactcttgttgtgcaccgcgtatgtgtttgaggtgtctacatcggaacgaggcgcacaacatcatatttatcgcctggtcagggactag

SEQ ID NO: 243655 - DNA, 1356 bp, Artificial Sequence
  Description of Artificial Sequence: Synthetic coding sequence
atgggcgaaccccgtgcaggcgctgctctagatgatgggtcagggtggacaggatccgaggagggctcagaggagggcaccggcggatctgaaggggcaggcggtgacggaggcccagacgctgaaggcgtgtggtcgccggatatagagcagtccttccaagaggccctcgcaatttatccaccgtgtggtagaagaaagatcatcctcagcgatgaaggtaaaatgtacgggagaaatgaactcatcgcaaggtatatcaaactgcgcacagggaaaacccgaacacgaaagcaggttagttcacatatccaagtactagcgcgtagaaaatccagagaaatccagtctaaactgaaggccctaaacgtggatcaagttagcaaggacaaggcctttcagacaatggccaccatgagctctgcacaactgattagcgccccttctttgcaggctaagcttggcccaactggaccccaggcatccgagctgtttcaattctggagtgggggaagcggacctccttggaatgtgccagacgtgaaacccttttcacaaacaccatttactctctcccttaccccccctagtacagacttacccggatatgagcctccccaggccctatcccctctccccccaccaaccccatcacctcccgcatggcaggcacgtggcctagggacggccaggttgcagctcgtggagtttagcgcctttgtggaaccccctgatgctgttgattcttatcagcgccacctgttcgttcacatatctcagcattgtccttctccgggtgcccctcccctagagtccgtcgacgtgcgccagatctatgacaaatttccggagaagaagggcggactccgcgaattatatgacagaggaccaccgcatgcgttctttctcgttaaattctgggccgacctcaactggggcccaagcggagaagaagcaggggcaggcggatccatctctagcggaggcttttacggggtctcatctcaatacgaatcgctagagcacatgaccctgacttgctctagcaaggtgtgctccttcgggaagcaagtggtggagaaagttgaaaccgagcgagcacagctcgaagatggcagattcgtgtaccgactcctaagaagccctatgtgcgaatatttggttaacttcctgcataaactgcggcaattacctgagaggtatatgatgaacagcgtgttggaaaatttcacaatcctgcaggtggtcacaaatagggacactcaggagctcctgctgtgcactgcatatgtttttgaagtgagcacctctgagcgaggcgctcagcatcatatctatcgactagtgcgcgactag

SEQ ID NO: 243656 - DNA, 1356 bp, Artificial Sequence
  Description of Artificial Sequence: Synthetic coding sequence
atgggcgagccgagggcaggcgctgctctggacgacggctccggttggacggggtctgaagagggaagcgaagagggcaccggagggagtgaaggcgcaggcggtgacggtggacctgacgccgagggagtttggtcaccagatattgagcagtcttttcaggaggccttggcaatataccctccatgcgggcgtagaaaaatcatcctgtccgatgagggtaaaatgtacgggaggaatgagctcatcgccagatatatcaagctgaggaccggaaagactaggacccgaaagcaggtatcctcacacattcaagtgctagctcgcaggaaaagtagagagatccaaagtaaactgaaggctctcaacgttgatcaagtgtcaaaggataaggcctttcaaaccatggccaccatgtctagcgcccagcttatctcagccccttctctgcaggctaagctaggccctacagggccacaggcatctgagctgtttcagttctggtctggtgggtcaggcccaccctggaatgttcccgacgtaaaacccttttctcagaccccatttacactttcactgacacctccatccacagacctgccgggttacgagccacctcaggccctgagtcctctgccccctcccaccccctctccacctgcatggcaagcacgtggtctcggaacggctagactgcagctggttgaattttctgcctttgtagaaccacctgacgccgtggattcctaccagcgccacctgtttgtgcatatctcccagcactgcccctctcctggggcacctccccttgaaagtgttgacgtcaggcaaatctacgataaatttcctgagaagaaggggggactcagagaactgtatgaccgcggaccaccgcatgccttttttttggtgaagttctgggccgacctgaactggggtcctagcggcgaagaagccggagcgggaggctctatctcttctggcggtttctacggggtctccagccagtacgaaagcttggaacacatgaccttaacttgttcttcaaaggtttgttcctttgggaagcaagtagtggaaaaagtggaaaccgaacgagcccaactggaagatggcaggtttgtatatcgcttgttgcgctctcctatgtgcgagtatctggttaatttcctgcacaagctacggcagctacctgaacggtatatgatgaactctgtgttggaaaattttactattctacaagtggtgaccaaccgggatactcaggaattactactttgtactgcgtatgtcttcgaagtgtccactagtgaacgaggcgcacagcatcacatctacagacttgtccgtgattag

SEQ ID NO: 243657 - DNA, 1353 bp, Artificial Sequence
  Description of Artificial Sequence: Synthetic coding sequence
atgggggagcccagggcaggcgctgcgctggacgacggctccgggtggactggcagcgaagaaggaagtgaggaggggaccggagggagtgagggggctggtggcgatggcggtcccgatgccgagggcgtgtggtccccagacattgaacagagcttccaggaagctctcgcaatctacccaccatgtggcaggaggaagattatcctctccgatgagggcaagatgtacggcaggaatgaactgattgcacggtacatcaaactgcgcacggggaagacccggacccggaagcaggtttccagccatattcaggtgctcgcaaggcgtaagtcccgagaaatccaaagtaagttgaaagatcaggtcagcaaagataaggccttccagacaatggccaccatgtccagcgcccagctgatctcagctcctagtttacaagccaagctagggcctacaggccctcaggtagtgcaggcctcagagttgtttcaattctggtccggcggtagtggacctccttggaatgtgccagatgtgaaacctttttctcagacaccattcaccttatccctcacaccaccttctactgatctaccagggtatgaaccacctcaagcactgagccccctgccaccaccgacacccagccctcccgcttggcaggctcggggtctgggaactgccaggcttcagctcgtagagttctctgcctttgtagagccccctgacgccgtggatagttatcaacggcacctgttcgtgcatatatcccagcattgtccttcccctggagcacctcccctggaatcggttgacgtacgccagatttacgataaattccctgaaaagaaagggggtctgcgcgagttgtatgatcggggacctccccatgccttttttctggtaaagttctgggcagatctaaactgggggcctagcggagaagaagctggagccggtgggagcatatctagcggcggtttttatggggtgtcatctcaatacgaatcgctggaacacatgacactgacttgttcatctaaagtgtgcagcttcgggaagcaggtggttgagaaagtggaaaccgaaagggctcagctcgaggacgggagatttgtctatcgtctcctacggagtccaatgtgtgaatacctcgtgaacttcctgcacaagttaagacagttgcccgaaagatatatgatgaactccgtgctcgagaacttcactatactccaggtagtcaccaatcgcgatactcaggagttgctgttgtgtactgcctacgtgttcgaggtgtcaactagcgaaagaggcgcacagcatcacatctaccgcctggtgcgagactag

SEQ ID NO: 243658 - DNA, 1308 bp, Artificial Sequence
  Description of Artificial Sequence: Synthetic coding sequence
atagcttccaacagttggaacgcttccagcagccccggagaggcccgagaggatgggccagaaggcttagacaaaggtctcgataacgatgctgagggcgtgtggagccctgatattgaacaaagtttccaggaggccctggccatctatcctccatgtggtcgtcggaaaattattctcagtgacgagggcaaaatgtatggaaggaatgaactcatcgctcggtatattaagctgcggactggcaagacaaggacacgcaaacaggtgagtagccacatacaggtgttggcacggaagaaggtaagggagtatcaagtgggaattaaagctatgaaccttgaccaagtctcaaaagacaaggctctacagtcaatggcctccatgagctccgcacagatcgtgtctgcttcagtgcttcagaataagttctcaccgccatctcccctcccacaggctgtgttttccacctcgagccgtttctggtctagtccccctctcctgggccaacagccaggaccatcccaagacattaagccatttgctcaacccgcatatccaattcagcctccgttgccgccaaccctgagtagctacgaacccctcgcacctcttccatccgcagccgctagcgtgccagtttggcaagataggacaatcgctagtagcagattaagactattggagtactccgcctttatggaggtacagcgcgatccagacacatactccaagcatctatttgtccacatcggacaaacgaatcctgctttctccgacccccctctagaagctgtagatgtgagacagatctatgataaatttcccgaaaagaagggcggtttgaaagagctctatgaaaaggggccacccaatgcctttttcctggtgaagttctgggccgatctgaattcaacaattcaggagggacccggagccttctacggcgtaagcagccagtactcctcagccgatagtatgactattagcgtgtcgaccaaggtgtgcagttttgggaaacaagtggtggaaaaggtcgagacagaatacgccaggctcgagaacggccgttttgtatatcggattcacagaagccccatgtgcgagtatatgatcaactttattcacaagcttaagcatctcccggagaaatatatgatgaattctgttttggagaacttcacaattctgcaggtggtaacttcccgggacagccaggagacgctgctggtgatcgcctttgtctttgaggtgtctacatccgagcacggggcacagcaccacgtatacaagctggtgaaagattag

SEQ ID NO: 243659 - DNA, 1356 bp, Artificial Sequence
  Description of Artificial Sequence: Synthetic coding sequence
ttgtcacgaccagtaggaagtgggcctgagcctcgggctacttctacaattgcatctaactcttggaacgcttctagttcccctggagaggctcgggaggatgggccagagggccttgataagggtttagataacgacgccgagggcgtctggtcgcccgacattgaacagagctttcaagaggccttggcaatttatccgccatgcggaagaaggaagatcattctctccgatgaagggaagatgtatgggcgaaatgagcttattgcgcgatacatcaagttgcgcacagggaaaacacgcactcggaaacaagttagctctcacctacaagttctggccagaagaaaatctagggaaatccaatccaagcttaagagttcgccacaggaccaggtgtcaaaagataaggccttacagagcatggctagtatgagtagtgcccagatcgtgtctgccagcgtgctccaaaacaaattcagcccacccagtcctctgcctcaggccgtcttttccacgagctctcggttctggagttctccccctctgttagggcagcagccaggacccagccaggatataaaacccttcgcacaaccggcttacccaattcagcccccacttcccccaactttgagttcctatgaacccctcgcccctttgccctccgctgccgcaagcgtcccggtatggcaagacagaacgatagcatcttctcgcctcagactattggagtatagcgcattcatggaagtacagagggatccagacacatactctaagcacctgttcgtccacattgggcagactaatcccgcattcagcgaccctccactggaggcagtggatgttcggcagatctacgataagtttccagaaaaaaagggagggctgaaggagttgtacgagaagggcccacctaacgccttctttttggttaagttctgggccgacctgaactccacgatacaagaaggtccgggagccttttacggagtcagcagtcaatatagcagcgccgactccatgaccatctccgtgtccaccaaggtgtgctcttttgggaagcaggtggtcgaaaaggtcgagactgaatacgcacgcttggaaaacggacgctttgtgtaccgtattcaccgcagtccaatgtgtgagtatatgataaatttcatccataaactgaaacatcttcccgaaaagtacatgatgaattccgtcctggagaactttactatacttcaggtggttacctctcgcgactcccaggagaccttgctggttatcgcttttgtatttgaagtctccactagcgagcatggcgctcagcatcatgtgtacaaactggttaaggattag

SEQ ID NO: 243660 - DNA, 1176 bp, Artificial Sequence
  Description of Artificial Sequence: Synthetic coding sequence
ctcgaaggaacggccggaacgattacttccaatgaatggagctcacctacgtcacccgagggtagtacagcgtctggcggttctcaggcactggacaaacctatagataacgatgcggagggtgtgtggagccccgacattgagcaatcttttcaagaagcccttgcaatctacccaccctgtggcagacgcaagattatcctcagtgacgaaggcaaaatgtacggacggaacgagctcattgctcggtatataaaattgaggacagggaagaccagaacacgcaagcaggtgtccagtcacattcaagttctggccagacggaaagcccgagaaatacaggctaagcttaaattttggcagggtgcactaccaggacaggcgggaactagccacgatgtcaagcctttcagccagcagacctacgcggtgcagccacccctccccctgcctgggttcgagtctcccgctggcccagcccctagcccttccgctccccctgccccaccctggcagggtcgctccgtggcttccagtaaactgtggatgctcgaattttcagcctttctggagcagcagcaagatcccgacacgtataacaagcatctgttcgtacacatagggcagagcagcccctcttacagcgacccctatctggaggctgtggacatccgtcagatttacgacaaattccctgaaaagaagggcggtctaaaggacctgtttgaacgcggtccctcaaatgcctttttcctcgtcaagttctgggccgacctgaacacaaatatagaggacgaggggtctagtttttatggagtgtcctcacaatacgagtctccagaaaatatgattatcacttgttccaccaaggtgtgtagctttggcaaacaagtggtagagaaagtggagacagagtacgctcggtatgagaatggccactattcctatcggattcatcggtcacctttatgtgagtatatgattaactttatccacaagctgaagcacctgcccgaaaaatatatgatgaactcagtgttagaaaacttcaccattctgcaagtcgtcacaaatcgcgacactcaggagaccctgctgtgtatagcctatgtcttcgaggtatctgcatctgagcatggcgctcagcaccacatttaccgactagtgaaggagtag

SEQ ID NO: 243661 - DNA, 1305 bp, Artificial Sequence
  Description of Artificial Sequence: Synthetic coding sequence
ctcgagggcacagccggtactatcacttctaacgagtggtcatcccctaccagcccggaaggcagtaccgcttcaggtggtagccaagccttggacaagccgatcgacaacgatgctgaaggcgtttggagtccggatatcgagcagtcatttcaggaggccctagccatctatccaccatgtggacggaggaagatcatactgagcgacgaagggaagatgtacggtagaaacgagttaattgccaggtatataaaactgagaactgggaagacccgaaccaggaagcaggtgtcttcacacatacaggtgctggccaggaggaaagcccgagagattcaagccaaactaaaagaccaggccgcaaaagacaaagccctgcagtccatggctgcgatgagctccgctcaaattatctccgctactgctttccatagttctatggccctcgctagagggcctggccgacccgcagtctccggcttttggcagggcgcattgcccggacaggcagggacaagtcatgacgtcaaacccttcagccagcagacttacgcagtacagcctccgctgcctctgccaggctttgaatccccggcaggacccgcaccttcgccttctgccccacccgcaccaccctggcaaggccgatccgtcgctagcagcaagctgtggatgctggagttttccgctttcttagagcaacagcaggaccccgacacctataacaaacatctgttcgtccacattgggcagtccagccccagctattcagacccttatttggaagcggtggacatccggcagatctacgacaaatttccagagaagaagggcggtctcaaagacctgtttgaaaggggcccttccaacgccttctttttagttaagttttgggccgatctgaatacaaacatcgaagatgaaggatcctctttctacggggtcagcagtcagtatgaaagccctgaaaatatgatcattacctgctccacgaaggtgtgcagcttcgggaagcaggttgttgagaaggtggagactgagtatgctcgatacgagaatgggcactactcgtatcgcatccaccgcagtccgctatgtgaatatatgatcaacttcatccacaagttgaagcacctgccggagaagtacatgatgaattcagttctcgagaacttcactatcctacaggtggtgacgaaccgggatacccaggaaacgctgctttgtattgcttatgtattcgaggtgagcgcctccgagcacggggcacagcaccatatctatcgcctggttaaagagtag

SEQ ID NO: 243662 - DNA, 918 bp, Artificial Sequence
  Description of Artificial Sequence: Synthetic coding sequence
atggcagctatgtcatccgctcaaatcatctcagcgactgcgttccattcatctatggctctcgcccgtggcccaggtagacctgctgtctcaggattttggcaaggggctttacccggacaggctgggacctcacatgacgtgaagccattctcccagcagacatatgctgttcagccacctttaccactccccggttttgaatcccctgccggtcccgctccctctccatcggccccaccagccccaccttggcaaggacgctcagtcgcctcttcaaaactgtggatgctcgaattcagcgctttcttggaacaacagcaagatcctgatacgtacaataaacatctgttcgtgcatatcggacagagttccccctcctattctgacccttacttggaggctgtggacatacgccaaatctacgataaatttcccgagaaaaaggggggactgaaggacctgtttgaacggggtccaagcaacgcgttcttcctggtaaagttttgggccgatctgaatactaatattgaggacgagggcagctctttctatggcgtcagctctcagtacgagtctcctgagaacatgattataacctgcagtactaaggtgtgcagttttggaaagcaagtggtggagaaagttgaaactgaatacgccaggtatgaaaatggtcactatagctaccgcatccaccggtcacctctgtgcgagtatatgattaattttatccacaaactgaagcatctgccagagaaatatatgatgaattctgttttggagaatttcactatattgcaagttgtgactaatcgcgatactcaggaaactctgttatgcatcgcctatgtatttgaggtgagtgcatccgagcacggtgctcaacaccacatatatcgccttgtgaaggagtag

SEQ ID NO: 243663 - DNA, 219 bp, Artificial Sequence
  Description of Artificial Sequence: Synthetic coding sequence
cttgagggaactgctggtaccataacttccaacgagtggtcatcccctacatcaccggaaggcagcactgcctccggcggaagtcaagccctggacaagcccatcgataatgacgccgaaggcgtttggagccctgatatcgaacagagtttccaggaggctcttgcgatctatccgccttgcggtaggcgaaagataatcctgtccgatgagggatag

SEQ ID NO: 243664 - DNA, 69 bp, Artificial Sequence
  Description of Artificial Sequence: Synthetic coding sequence
ctggaaggcactgccggtaccattacttcaaacgaatggagttcccctacttcacctgaaggaagctag

SEQ ID NO: 243665 - DNA, 528 bp, Artificial Sequence
  Description of Artificial Sequence: Synthetic coding sequence
ctggagggaactgcaggaacaattacgagtaacgagtggagctccccaacctctcccgagggttcaacggctagcggaggcagtcaggccttagataaaccgatcgacaacgacgcagagggcgtctggtctcccgatatagagcagtcattccaggaagccctggccatttatcctccatgcggtcgccgtaagatcatcctctccgatgagggcaagatgtatggacgaaacgagctgatagcacggtacataaagctccggactgggaaaaccaggaccaggaagcaggtgagctcacacatccaagttctggccaggagaaaagctcgtgaaattcaagcaaagctcaaagaccaagccgcaaaggataaggccttgcagtcgatggccgctatgagtagcgcccagatcatatccgccacagcgtttcatagcagcatggccctagctcgaggcccaggcaggcctgctgtctccggattttggcagggagctctccccggacaggcagggactagccattag

SEQ ID NO: 243666 - DNA, 3099 bp, Artificial Sequence
  Description of Artificial Sequence: Synthetic coding sequence
atgtgcaacgaagagacagagatcaaagaggcccagtcctatcagaacagtcctgttagctcggcaaccaaccaggacgctggctacggctccccattctcggagtcatctgatcagctcgcccacttcaaaggaagctcttcaagggaggaaaaggaagatccccagtgccctgacagcgtgtcttacccacaggactccttagcccagatcaaagctgtttatgccaacttgttttcagagtcttgctggtcctcactggccctcgatctgaagaaaagcggttccaccactagcaccaacgacgctagccagaaggagtcatctgcaccaactccgacgccgcctacatgccctgtcagtactacagggcctaccacttccaccccctccacctcatgtagctcttccacttcccatagttctactacaagtaccagctcctcttctggctatgactggcatcaggccgctctcgccaaaacactccagcaaacatccagctacggactgctaccagaaccatctctattcagcaccgttcagctgtacagacaaaataacaaactctacggcagcgtgttcacaggcgcttctaagttccgatgcaaggactgttcggcagcctacgatactttagtcgaattaactgtgcacatgaacgaaactggccactatcgagacgacaaccgggacaaagattcagagaagactaagcggtggtctaagccgagaaaacggtccttgatggagatggaaggcaaagaggacgctcaaaaggtgctgaagtgcatgtattgcggacacagtttcgagtcattgcaggatttgtccgtccatatgatcaagaccaagcactatcagaaggttcctttgaaggaaccagtgcccgcaattaccaaactcgtgccatcgaccaagaagcgggctcttcaggatttggctcccccatgctcccccgaacctgcaggcatggcagccgaagtagctctatccgagagcgctaaagatcaaaaagccgctaatccctatgtgacacccaacaatagatacggatatcagaacggagcaagctatacctggcagtttgaggctcggaaggctcagatcctcaagtgtatggaatgcggatccagccatgatactctgcagcagctgactgcccatatgatggtcacgggacactttttaaaggttaccacgtccgcaagcaagaaggggaaacagctggtcctcgacccagtagtcgaggaaaagatacagagtataccattaccacctactacacacaccagacttcccgcaagctcgatcaaaaaacagcccgattctcccgcaggaagtactacatccgaggagaagaaggagccggaaaaagagaaaccacccgttgccggtgacgccgaaaagatcaaggaagagagcgaggatagcctggagaagtttgagccttcaaccctttacccttatcttagagaggaggacttggatgacagcccgaaagggggactggatatacttaagtctttagaaaatacagtgtccacagccatttctaaggctcagaacggcgctccgtcttgggggggttacccctctatacacgctgcctatcaactgccagggaccgtgaaaccgttacccgctgccgttcagagcgtccaggtccaaccctcatatgcaggcggtgtgaagagtctgagctccgctgagcacaacgctctgctgcatagtccgggatctctcacccctcccccacacaaatcaaatgtgtccgccatggaggagcttgttgaaaaggtcacggggaaagtcaacatcaagaaggaggagagaccccctgaaaaagagaaaagttccctcgcaaaagccgcatccccaatagcgaaagagaataaggatttccctaagacggaagaagtgagcgggaaacctcagaaaaagggacctgaagcagagacaggtaaggcaaagaaggagggtcctctcgacgtccacactccaaacgggactgaacctctaaaggccaaagtcactaatggatgtaataacttgggcatcatcatggatcattctccggagccctccttcattaatccccttagcgcgctgcaaagcatcatgaacactcatctgggaaaggttagcaagcccgtgagtcctagcctcgaccctttggccatgctctataaaattagtaacagcatgttggataagcctgtgtaccccgctactcctgtaaaacaggcggacgccattgacagatactactacgaaaattctgatcagcctattgatctgacaaagtctaagaataagcccctggtcagttctgtcgccgacagcgtagcttcgccactgcgggagagtgcattgatggatatttctgacatggtgaaaaaccttaccggacgcctgacgcccaagtcaagcaccccttctacagtgtcagaaaaatcagatgccgacggcagttctttcgaagaggcactcgatgagctctcccctgtgcacaagaggaaagggaggcagtctaactggaaccctcagcacctgctgatcctgcaggcccagtttgctagcagtctgcgcgagaccaccgagggcaaatacatcatgtcggacctgggccctcaggaacgcgtgcacattagcaaatttacggggctctctatgaccactatctctcactggctggcaaacgtgaaataccagttgcgcaggacaggaggcaccaagtttctaaagaatctggacaccggacatccagtatttttttgcaatgattgtgcttcacaatttcggacagcgtccacctatatcagccatctggagactcacctgggatttagcttgaaggatttatctaaactccccctgaatcagatccaagagcaacagaacgtgtctaaagttctgaccaacaagaccctgggacccctgggcgctacggaagaagatttaggttcgactttccagtgcaaactgtgcaacagaacatttgcgtctaaacatgccgtgaaattacatctgagtaaaacacacgggaagtcaccggaagatcatctgatttatgtcacggaactcgagaagcagtag

SEQ ID NO: 243667 - DNA, 237 bp, Artificial Sequence
  Description of Artificial Sequence: Synthetic coding sequence
atgtgcaatgaagaaacagagatcaaggaggctcagtcataccagaattcacctgttagtagcgctacaaaccaggacgccggatacggcagccctttcagcgaaagttctgatcaactcgcacactttaaaggcagttcttcaagagaagaaaaagaagacccccagtgtcccgacagtgtcagttatcctcaggattctctcgcgcagataaaggccgtgtacgccaacctgtag

SEQ ID NO: 243668 - DNA, 321 bp, Artificial Sequence
  Description of Artificial Sequence: Synthetic coding sequence
atgtgcaatgaagagaccgagatcaaggaggcacagtcttatcaaaacagccccgtctcctccgccaccaatcaggatgccggatacgggtccccattctccgagtcttccgaccagctggctcactttaaagggtctagctcccgagaagaaaaggaagatccccagtgtcccgactccgtctcttatccacaggattcactagctcagataaaggccgtgtacgccaacctgttcagcgagtcttgctggagctccctcgccctggacctcaaaaagtcaggttcaaccacttctacaaacgatgcgagccaaaagtag

SEQ ID NO: 243669 - DNA, 3096 bp, Artificial Sequence
  Description of Artificial Sequence: Synthetic coding sequence
atgatggctgctgcgttattgcattataccggttatgcacaagaagagcagctgaaagaggaagaggaaatcaaggaggaggaggaagaggaggactctggatccgtggctcagctacaaggtgggaacgacacaggtacggatgaggaattggaaacagggccagagcaaaaaggctgtttttcgtaccagaactcacccggttcacatctgtcaaatcaggatgccgagaatgagtcactcctaagtgacgctagcgaccaggtgtcagatatcaagagcgtctgcggcagagatgcatcagacaagaaagcccacactcacgtgcgattgcctaatgaggctcacaactgtatggacaaaatgaccgccgtttatgcaaacatactgagcgattcttattggagtgggctgggcctggggtttaagctaagtaattccgagcgtagaaactgcgacacgcgcaatggcagcaacaaatccgacttcgactggcatcaggacgctctgtccaagagccttcagcaaaatcttccctcacgttctgtgtccaagccctctttatttagtagtgtccaactttaccgccaatcaagtaaaatgtgtggcactgtctttactggtgctagcagatttcgctgccgccagtgttccgccgcatatgataccctggttgagctcaccgttcacatgaatgaaacaggtcattaccaggacgataatcgcaaaaaagacaaactgaggcctacatcctatagtaagcctcgcaagcgagctttccaagacatggacaaggaagatgcccaaaaggtgctcaagtgtatgttctgcggggacagcttcgactcgttacaagatctgagcgtgcatatgataaaaaccaaacactatcagaaggtacctttgaaggagcctgtccctactatcagctcgaaaatggtcacccccgctaagaagcgggtgtttgacgtgaatcggccttgctctccggacagcacaactggctcgttcgcggacagcttctcatctcaaaagaacgcaaacctacagttgtcatccaacaaccggtacggctaccagaatggggctagttacacatggcagtttgaggcgtgcaagtcacaaatcttaaagtgcatggagtgtggaagctctcacgataccctgcagcagctgaccactcacatgatggtgacagggcacttcttgaaagttacctcctccgcctccaagaagggcaagcaactggtgctcgatcccttagcagtagaaaaaatgcagagtctgagtgaagcgcctaatagcgacagtttggcccctaaaccttccagtaactccgcttccgactgcacagctagtactacagagctaaagaaggaaagtaagaaagaacgcccagaagaaacgtccaaagacgagaaggtagtaaaatccgaggactacgaggacccactccagaagccactagaccccactataaaataccagtaccttagggaagaggaccttgaggacggatctaagggcggtggagatatccttaaatcactcgagaataccgtgaccaccgcaatcaacaaagctcagaatggtgcacctagttggtccgcctacccatctatccatgctgcctatcagctgtctgaggggactaaaccaccattgcctatgggctcccaagttcttcagatcagaccgaacttgaccaataagctacgacccatcgcacccaaatggaaagtgatgcccctggtttcaatgccgacccatctggccccttacacccaggtgaaaaaggaatctgaagataaggacgaagccgttaaggagtgcggcaaagagagtcctcatgaagaggcgagttcgttcagccactcagagggggacagctttcggaaaagcgaaactcccccagaggccaaaaaaactgaactgggaccacttaaggaagaagaaaaactaatgaaagaagggagcgaaaaggagaaacctcagcctttagagccaacttcggctctgtccaacggatgcgccttggctaaccatgcgccagcactgccatgtattaatcccctcagtgcgctccagtctgttttgaacaatcacctcggtaaggctaccgaaccccttcggagcccctcttgttcaagcccatcatcatccacaatctcaatgttccataagtccaatttgaatgtaatggataagcccgttctttcacccgcaagcacaaggagtgcctctgtatcccgccgatacctcttcgagaattccgatcagccaatcgatctcacaaaatcaaaatccaaaaaggctgagtcatcccaggcacagagctgtatgtcacctccacagaaacacgccctgtccgacattgcggacatggtcaaggtgctgcctaaggcaacaacaccaaagccagccagctcgtcaagagtacctcctatgaaactggagatggatgttagaagatttgaagatgtttctagtgaagtatcaaccctgcacaagcgtaagggtcggcaatccaactggaaccctcagcacctattgatccttcaggcccagtttgcctcttctctttttcagacaagtgaggggaagtacctgctaagtgatctgggcccacaggagagaatgcagatttctaagtttaccggactgtccatgactacaatatctcattggctagccaatgttaaataccagttgcgaaagaccggaggaactaaattcctgaaaaatatggacaagggacatcctattttttactgctctgattgcgcctcacagtttaggaccccctccacctatatttcccatcttgagagccacctcggcttccagatgaaagacatgacacgactgtctgtggaccagcagtctaaggtcgagcaggaaataagtagggtatctagcgcccagagatcccctgagaccatcgctgcggaggaggacaccgacagtaagttcaagtgcaagctctgctgccggaccttcgtgtccaagcacgctgtcaagctgcatctctctaaaacccactctaagtctccggagcaccatagtcagtttgtaactgacgtcgacgaggaatag

SEQ ID NO: 243670 - DNA, 3105 bp, Artificial Sequence
  Description of Artificial Sequence: Synthetic coding sequence
atgcctcgacggaagcagcaggctcccaagagggccgcaggttatgctcaggaggaacagctgaaggaggaagaggagattaaggaggaggaggaggaggaagactccggttctgtggctcagttacagggcggtaacgacaccggcaccgatgaggaattggagaccgggcctgaacaaaaggggtgtttctcttatcagaattccccaggtagccatttaagcaatcaggacgccgaaaacgagtccttgctctccgatgcgtctgaccaggtgtctgacatcaagtctgtttgcggacgcgacgcctctgacaaaaaggctcatacccacgtgaggttgcccaatgaggcccataactgtatggataagatgacagcagtgtatgccaacattctttcagattcatattggagcggccttggactcggttttaagctctccaatagcgagcgtagaaattgcgacacgcgtaacggaagtaacaaatccgacttcgactggcaccaggacgctctcagtaagtccttgcaacagaacctgcccagtcggtccgtttcaaagcccagtttgttcagctcagtccagttgtatcgacaatcttctaagatgtgtggaacagtcttcacgggggcatcccgattccggtgcaggcaatgcagtgcagcctatgataccctggttgaactgacggttcacatgaacgaaactgggcattaccaggacgataaccgcaaaaaagacaagctaaggcctaccagctacagcaagccgcgaaagcgggctttccaggacatggataaggaggacgcacagaaggttctgaagtgcatgttctgtggcgatagctttgactctttgcaggacctctctgtgcacatgattaagacgaagcactaccagaaggttccgctcaaagaaccagtacctaccatcagcagcaaaatggttaccccagccaagaagcgggtttttgatgtcaatcgtccttgtagccctgattctaccaccgggtcattcgctgattctttttccagccaaaaaaacgccaaccttcaattgagctcaaacaaccgatatggctaccaaaacggtgcttcctacacctggcagttcgaggcatgcaaatcccaaattttgaagtgcatggagtgcggaagtagccatgacactttacaacaactgaccactcatatgatggtgaccggccacttcctcaaagtgacctcttccgccagcaaaaaagggaagcagctggtgctcgacccactggccgtcgagaaaatgcagagcctctcagaggcacccaattccgactctctggcccctaagccctccagcaatagtgcctccgattgtactgcttccactaccgaacttaaaaaagagagtaagaaggaacgccctgaggagactagtaaggacgagaaagtggtaaagtcagaagattacgaggatccactgcagaaacctcttgacccgaccatcaagtatcagtacctacgcgaagaagatttagaggatggaagtaaagggggaggcgacatcctcaagagcctggagaatacggtgactacagctatcaacaaggctcagaatggcgctccttcctggtctgcttacccaagcatccatgccgcttaccagctgagcgaggggacaaagccacccctaccaatgggctcccaggtactgcagatcaggccgaatcttacaaacaaattgaggcctattgctccaaaatggaaggttatgccgctcgtaagtatgcctacacacctagcgccatatacacaggtgaaaaaggaaagcgaggacaaggatgaggcagtaaaagagtgcggaaaagagtcaccccatgaggaagctagctcctttagccactctgagggagacagttttcgcaagtcggaaactccacctgaggctaagaagaccgagttgggcccactgaaggaggaggaaaaacttatgaaggagggatcagagaaggagaaacctcagcctttggaacctacttcggcactgtctaatggttgtgcactcgccaaccacgcacccgcactcccctgtatcaatccactcagtgctcttcagtcggttctgaacaaccatttaggaaaagcaactgagcccctgaggagccctagttgctcctcccctagcagtagcaccatcagcatgtttcataagagtaacctcaacgtgatggataaaccagtactgtctccagcgagcaccagaagcgcttctgtgtcccggcgatacctgtttgagaattctgaccaacctatagacctaacgaagtcgaaatcaaaaaaagccgagtctagccaggcccagagctgtatgagtccaccacagaagcatgcattaagcgatatagctgacatggtcaaagttttgcctaaagctaccacacccaaacctgcttcatcgtcccgtgttccccctatgaagctggagatggacgtgcgcaggttcgaggatgtgagcagtgaggtgtccaccctccacaaacggaagggaagacaatccaactggaatccccagcatctactcattttacaggcacaattcgcgtcctcactgtttcagacatcggaaggaaagtatttgctatccgatctcggtccccaggagaggatgcagatatcaaaattcaccggactgtcgatgaccacgatttcgcactggcttgccaatgttaaatatcagctacgcaagacaggaggtaccaagtttctgaaaaatatggataagggtcatcctattttctactgctctgactgcgcttctcagttcaggacgccctcaacgtatatctctcatttggaatctcatttgggctttcagatgaaagatatgacacgcctgtccgttgaccagcaaagtaaggtggagcaggagatcagccgagttagcagcgcacagcggtctcctgagacaattgccgctgaggaagatacagacagcaaattcaagtgtaagttgtgctgcagaacattcgtgtccaagcatgccgttaaactccacttgtccaagacacattccaagagtcctgagcaccactctcaattcgtcacggatgtggatgaggagtag

SEQ ID NO: 243671 - DNA, 3246 bp, Artificial Sequence
  Description of Artificial Sequence: Synthetic coding sequence
atgccacggaggaagcagcaggcccctcgccgagcggctgcctacgtgagtgaagaactcaaggctgccgcactggtggacgaggggcttgaccctgaagaacacacagccgacggtgaaccatccgcgaaatacatgtgtcccgagaaagagctggcgagagcctgcccctcataccagaattctcccgctgcagagttctcttgccacgaaatggacagcgaatcccacataagtgaaacctccgataggatggcggatttcgagtccgggtctatcaagaatgaggaggaaactaaggaggtgacggttccccttgaggatacaacagtgtcagattccctggaacagatgaaggctgtttataacaactttctgagcaactcatactggagcaacctcaatctaaaccttcaccagccgagtagcgagaaaaacaatggaagctcttcaagttcatcgtcctcttccagctcctgtggatcaggaagcttcgactggcaccaatccgcaatggcaaagactctccagcaagtttcccaatcccgcatgctccctgaacccagtctcttctccaccgttcagctgtaccggcagagctctaagctgtacggctcgatttttactggtgcatccaaatttagatgtaaagactgctcagcggcttacgacacgctggtggaactgaccgtgcacatgaatgaaacaggccactaccgcgacgacaatcacgagacagataacaataacccgaaacggtggtcaaagcccaggaagcgaagcctgttggagatggaggggaaggaggatgcgcagaaggtgttaaagtgtatgtattgcgggcacagtttcgagtccctgcaggatctgagcgtgcacatgattaaaacaaaacattaccagaaggtgccccttaaggaacctgttacacctgtggcagcaaaaatcatccccgcaacaaggaagaaagcatctctggagttagagctcccatcatcaccagattcaactgggggaacccccaaagccaccatttctgacaccaatgatgcattgcagaaaaacagcaatccctatattaccccgaataaccgatatggacaccagaatggtgcctcatatgcatggcattttgaggctaggaaatcccagatcctgaaatgcatggagtgcggctcgtcccatgacacgttacaggagcttaccgcgcatatgatggtgactggccactttatcaaagttacaaacagcgcgatgaagaagggcaaacctatcgtcgagacaccggtcacgccaactattactacactcctcgacgagaaggtgcagtccgtcccactcgccgcaaccacatttacttcaccctctaatactcctgccagtatttctccgaagctaaacgtcgaagtgaaaaaagaagtagataaagaaaaggcagttacggacgagaagccgaagcaaaaggataaacctggggaggaggaggagaaatgcgatatctcatccaagtaccactacctcacagagaacgacctggaggagagccctaaaggagggctggacattcttaaatccctcgagaacaccgtgacgtccgctatcaacaaagctcaaaatgggaccccttcttggggaggctatccttccatacatgctgcttaccagctacccaacatgatgaaattgtcattggggagttctggaaagtccactcctctgaagcccatgttcggtaattccgagatcgtgagccccacgaagaaccagaccctggtgtctccaccctctagccagacttcacctatgcccaagacgaattttcacgcgatggaagaactggtcaagaaagtgacagaaaaggttgccaaggtcgaagaaaagatgaaggaaccggatgggaaattatccccccctaaaagggccacacccagtccctgttccagcgaggttggcgagccaatcaagatggaggcgagttcagacggcggtttccggagtcaggaaaatagtccgagtcccccacgagacgggtgtaaagatggcagccctctcgcagaacccgtggagaatggcaaagagctggtcaaaccccttgcctcttctctcagcggaagtacggcgattattactgaccatccacccgagcagccgttcgtgaatcctcttagtgccctccagtctgttatgaacatccaccttggaaaggcagctaaaccatccctcccagcattggacccaatgtccatgttattcaagatgagcaacagcctggctgagaaggctgctgttgcgaccccccctccattgcagagcaagaaagcagatcacttggacagatacttttatcacgtgaacaacgaccagccaattgacctcactaagggcaagtccgataagggctgttctttgggatctgtcctcctctcgccaacttcgaccgctcccgctaccagctccagcaccgttactactgcaaagaccagcgcagttgtcagcttcatgagtaattctcctcttcgtgagaacgctctcagtgacattagcgacatgctgaagaatctaaccgagtcccatacgtctaagtctagcacaccatcttccatatccgaaaaatctgatatcgacggagctactctagaggaagctgaagaatctacacctgcccagaaaagaaaaggcagacaatctaactggaatccacaacacctgctgattctgcaagcccagttcgccgcaagccttcgccagacatcggaggggaaatacatcatgtcggacttgtctccccaagagaggatgcacattagtagattcaccggactgtccatgaccaccatctcccactggcttgcaaacgtcaaatatcagctgagacgcaccgggggaaccaaattccttaaaaatttggacacaggccaccccgttttcttttgtaacgactgtgcaagccagatcaggaccccctccacatacatttcacacttagagtctcacttgggtttccgcctccgcgatctcagcaagcttagtacggagcagatcaacagtcagatcgcacagacgaagagcccgtctgaaaaaatggttacttcatcacccgaggaggacctggggacttcatatcagtgtaagttgtgtaaccggacctttgcctccaagcatgccgtaaagcttcatttatcgaagacccatggtaaatcgccggaggaccacttgttgtacgttagtgagctggaaaagcagtag

SEQ ID NO: 243672 - DNA, 1896 bp, Artificial Sequence
  Description of Artificial Sequence: Synthetic coding sequence
atgaattttaatactattcttgaggagattttaatcaaaaggtcacagcagaaaaagaaaacatccccactgaattataaagaacgtctctttgtgttgacaaagagcatgctcacctactacgagggaagagccgagaagaaataccgcaagggatttatcgacgtaagcaagatcaaatgcgtggagatcgtcaaaaacgacgatggcgtgattccctgccagaataagtacccttttcaggtggtgcacgacgctaacaccctctacattttcgcacccagcccccagtcacgtgacctttgggtgaaaaagcttaaagaagagattaagaataacaataacattatgatcaagtaccaccccaaattctggacggatggttcataccaatgctgtcgccagactgaaaagctggcacctggctgcgagaagtataacctgttcgagtcttctattcggaaagccctccctcccgcacctgaaaccaagaaaagacgcccacctccccctattcctctcgaagaagaagacaacagcgaagagatcgtggttgccatgtacgatttccaggcagctgaggggcacgacctgagacttgagagaggccaggagtacctgattctggaaaaaaacgatgtgcattggtggcgggctcgcgataaatatggtaacgaggggtacattcccagcaattatgtgaccggcaagaaatccaataatcttgatcagtatgaatggtactgtaggaacatgaatcgaagtaaagcagagcaactgctccggagcgaggataaggaaggaggcttcatggttcgcgatagcagtcaacctggcttgtatacggtctcactctacaccaagtttggcggtgaagggtccagtggtttcagacactaccacataaaggaaaccacgacgtcacccaaaaaatactacttggctgaaaaacatgcatttggtagtatccccgaaattatcgagtaccacaagcataatgcagctgggcttgtgacaaggttgcgctatccggtgagcgttaagggcaaaaacgcccctactactgcaggtttctcctacgagaaatgggagattaaccctagcgaactgacatttatgagagaactcggctccgggctcttcggcgtggtgaggctggggaagtggagagcacagtataaagtggccatcaaagccatcagagagggcgcaatgtgtgaagaagattttattgaagaggccaaggtgatgatgaagcttacacacccaaaattagtgcagctgtatggcgtgtgtacccagcagaaacctatctatattgtgactgagttcatggagcgcggatgtcttctcaattttctcaggcaacggcagggccacttcagcagggatgttttgctgagcatgtgtcaagacgtctgcgagggtatggaataccttgaacgaaattcttttattcaccgcgaccttgcagccagaaattgcctagtctctgaagctggagtcgttaaagttagtgattttggcatggctcgttatgttctcgatgaccagtataccagtagcagcggagctaaattcccagttaagtggtgtccgcctgaggtgttcaattatagccggttctcctccaagagcgatgtttggagtttcggagtcctgatgtgggaggtcttcacagagggtcggatgcccttcgagaagtacaccaactacgaggtcgtgacaatggttactcgagggcatcgactgtatcagccaaaactggcctccaactacgtctatgaggtgatgctgcggtgctggcaagaaaagccggaagggagaccctccttcgaggacctactgaggaccattgacgaactcgtggagtgtgaagagacattcggacggtag

SEQ ID NO: 243673 - DNA, 2094 bp, Artificial Sequence
  Description of Artificial Sequence: Synthetic coding sequence
atgggctttcagcctcctgccgctctcctgcttcgcctctttttactgcaaggtattctgcgacttctgtggggagacttggcgttcatcccaccgttcattagaatgagcggccctgcagtcagtgcctccctggtaggggatactgagggcgtgacagtttcactcgcagtgctgcaggacgaggccggaatcttgcccattcctacctgcggtgtgctcaacaacgaaactgaggactggagcgtgaccgtgattcctggtgccaaagtgctggaggtcactgtgaggtggaaaagagggctggattggtgcagttctaacgaaactgactcattctcggagtccccctgtatcctccagacactgttggtgtccgccagtcacaactcaagctgctccgcccaccttctcattcaagtggaaatctatgccaactcaagtctgacacataacgcgagcgagaacgttaccgttatccctaaccaggtataccaaccactgggcccttgtccgtgtaatctcacggctggcgcatgcgacgtgcggtgctgctgtgaccaggagtgttcttcaaatctgactacacttttcagacggtcatgttttactggggtttttggtggagacgtcaacccaccttttgatcaactgtgcagtgctgggacaaccacccggggtgtgcctgattggttccccttcctttgcgtgcagagtcctttggcaaacaccccctttctcggctacttttaccatggggctgtgagcccaaaacaagacagtagcttcgaagtctacgttgacaccgacgccaaagacttcgccgacttcggctacaaacagggtgaccctataatgaccgtcaagaaagcatactttactatcccccaagtgagcttagcgggtcagtgcatgcagaacgccccagtcgccttcctgcataactttgacgtcaagtgtgtgactaacttagagctataccaggaaagagatggtattatcaacgccaagatcaaaaatgtcgccctcggaggcattgttacaccaaaggtgatttacgaagaggccactgacctagataaattcattactaacaccgaaacaccccttaacaacggttctacaccgaggattgtgaatgttgaagagcattacattttcaagtggaacaacaatactataagcgaaattaacgtgaaaattttccgggcagagatcaatgcccatcagaagggaattatgacacaaagattcgtggtgaaattcttatcttacaacagcggcaatgaagaggagctttccggcaatccgggataccaacttggcaagcctgttcgagcactcaatattaaccgcatgaacaatgtaacaaccttacacctctggcagtccgccggtaggggcctgtgtactagcgccacttttaagcctatattatttggagaaaatgtacttagcggctgccttctggaggtgggaattaatgaaaattgtacccagctgcgcgaaaatgccgtggagcgattagacagtctgatccaggcaacacacgtggctatgcgagggaattctgactatgccgacttatctgatgggtggctcgagattatccgagtggacgcccctgaccctggggctgatcctcttgcatcatctgtgaatggcatgtgccttgatatccctgcgcatttaagtatccgcatcctgatcagcgatgccggagccgtagagggaataacacagcaggaaatactgggcgtcgaaacacggttcagctcagtgaactggcagtaccaatgcgggctgacctgtgagcacaaggccgaccttcttcctatttctgcctctgtgcagttcatcaaaattccagcgcagttaccacaccccctaactagatttcagattaactatactgagtatgattgcaaccgaaacgaagtgtgttggccacaactcctgtacccctggacacagtactaccaaggtgagcttcactcacaatgcgtggcgaaaggcctgttgctccttctgttccttactttggccttattcctctccaatccatggaccaggatttgcaaggcatacagttag

SEQ ID NO: 243674 - DNA, 2091 bp, Artificial Sequence
  Description of Artificial Sequence: Synthetic coding sequence
atgggatttcagccaccagccgctctgctcctgcggctgttcctcctgcagggcatcctgaggttactgtggggtgacttagcctttataccaccattcatccgcatgtccggtcctgcggtcagtgcctcactagtgggcgatactgagggggtgacggtaagcctcgctgttctgcaggacgaagctggaattctgcccatcccaacctgcggtgtactcaacaacgagacagaggattggtccgtcactgtgattccaggagcagtcctggaagttactgtgcgctggaagcgcggtttggactggtgctcttcaaacgagaccgactcattctcagagagcccgtgtattcttcagactttactggtgagcgctagtcataactcttcctgctcagcccatttgttaatccaggtggaaatttacgctaacagctccctcactcacaacgcaagtgaaaacgttacagtcatcccaaaccaggtgtaccaaccattaggtccctgcccctgcaatctcactgctggcgcatgtgatgttagatgttgctgcgaccaggagtgttctagtaacctgacaacattgttccggaggagctgtttcaccggcgtgtttgggggtgacgtcaacccaccattcgaccagctgtgctcagccggtactacaacccgcggagtgcccgactggttcccatttctatgtgtccaatcacccctagccaatacccctttcctggggtatttttatcatggcgcagtatcaccaaagcaggattcttccttcgaggtttacgttgacacagatgctaaagatttcgctgactttggttacaagcagggggatccaatcatgaccgtgaagaaggcctacttcacaataccgcaggtatccctggcagggcagtgcatgcagaacgccccagtggcctttcttcataatttcgatgtgaagtgtgttactaacttagagctgtaccaagaacgggacggcattataaacgcaaagattaaaaatgtggcattaggagggatcgtcacgcctaaggtgatatacgaggaagccactgacctggataagtttattacaaacacagagactcccctgaacaacggctccaccccccgtattgtgaacgtggaagagcactatatctttaaatggaataataatacaataagcgagattaacgtgaagatttttagggcggagatcaatgcccaccagaaaggcattatgactcagcggttcgtggttaagttccttagctacaactccggaaacgaggaagagctttcaggcaatcccggttaccagttaggaaagcccgtcagggcacttaacataaaccggatgaacaacgtgacgaccctgcatctatggcagtcagccggtagggggctttgtactagtgcaacattcaagccgatcctgtttggcgagaacgtactcagcggatgcctgctggaagtcggcattaatgagaactgtacacagttgagggaaaacgcagtggaacgcctagattcccttattcaggcaacccacgtcgcaatgcggggtaatagcgactacgctgatctgagcgatgggtggctggagatcattagggtcgacgcccctgatcccggtgctgatccattagcttcttcggtcaacgggatgtgcctagatatccctgcccacctgagcattagaatcctgatatctgacgcaggagcagtcgaaggaattacccagcaagaaatactgggggtggaaacgagatttagcagcgtaaactggcagtatcagtgtggactgacctgcgaacataaggcggacttactccctatatccgccagcgtacagtttatcaagatcccagctcagttacctcatcccctgacaaggtttcagatcaactatacagagtacgattgcaaccggaacgaggtatgctggccccagttgctgtacccatggacacagtattatcaaggggagttgcactcacagtgcgtagctaaaggactgctgttattgttgtttctgaccctggccctgtttctttctaatccgtggacaagaatctgtaaggcatattcctag

SEQ ID NO: 243675 - DNA, 1824 bp, Artificial Sequence
  Description of Artificial Sequence: Synthetic coding sequence
atgcgaacaccacagcttgctctgttacaggtcttcttcctggtcttccccgacggtgtgcgaccccagccctccagttccccgtctggcgcagtgcctacaagtcttgagctgcagcggggaacagacggaggaacgttacagagcccctctgaggctactgctactcgccctgcagtgccaggcctccccaccgtagtgccaactctagtcacgccaagcgctccagggaatcgaactgtggaccttttcccagtacttcctatttgcgtctgcgatctcacccccggtgcgtgtgatatcaattgctgctgtgaccgggactgctatctcttgcatccaaggaccgtatttagcttctgcctgcccggaagcgtacgcagctcatcatgggtctgcgtcgacaattctgtcatcttcaggagtaactccccctttccaagtcgagtgttcatggatagcaatggtattaggcagttttgcgtgcacgtgaacaattccaatttgaactatttccagaaactacaaaaggtcaatgctacaaactttcaagcgctggctgcagagttcggcggagaaagctttacatctacatttcaaactcagagtccaccctccttttaccgtgcgggagacccaatattaacttactttccaaaatggagcgtgatcagtctgctgcgccagcctgcaggagtaggtgcaggcggactgtgtgcagagagcaaccccgcaggttttctcgaatctaaaagtaccacgtgtacacggttcttcaagaatctggctagcagttgcactctggactcagccttgaatgccgctagttactataactttacagtcttaaaagtgccccgttcaatgacagatcctcagaatatggaattccaagttccggtcattctgacttcccaggccaacgcaccgcttctggcaggcaatacttgccagaacgtggtgagtcaggtcacctacgagatcgagaccaatggaactttcgggattcagaaagtcagcgtgtctctgggacagacgaatttgacagtggagccaggagcttctctgcaacagcacttcatcctgcgatttagggcctttcaacagagcaccgccgcaagcctgaccagccctcgcagtgggaatccagggtacatcgtgggtaaacccttactggctcttactgacgatatctcttattcaatgaccctgttgcagtcccagggcaacggaagctgtagtgttaaaaggcatgaggtgcagtttggagtgaacgccatttccgggtgcaagctgaggctgaaaaaagcagactgctcacacttgcagcaggaaatataccagacgctacatggcaggcctagacctgaatacgtggccatcttcgggaatgctgacccagcccagaagggcggatggacccggatcctgaataggcattgttctatcagcgctataaactgcaccagctgctgtctgatcccagtgagcctggagatccaggtgctgtgggcatacgtgggactgctgtcgaacccacaggcccacgtaagcggcgtccgttttttgtatcagtgtcaatcaatccaggactcccagcaagtgaccgaagtcagcctgaccacactggtaaattttgtggacattacccaaaagccacagcctcccaggggtcagcccaaaatggattggaaatggccctttgacttcttcccattcaaagtggctttcagccggggagtgttcagccagaaatgctcagttagcccaatactgattctctgtttattgctcttaggcgtattgaatctcgaaaccatgtag

SEQ ID NO: 243676 - DNA, 1290 bp, Artificial Sequence
  Description of Artificial Sequence: Synthetic coding sequence
atggacagcaacggaattcggcagttttgcgttcatgtgaacaattctaacctcaactacttccaaaaactgcagaaggtgaacgcgaccaattttcaagccctggccgcagagttcggaggcgagtctttcacttctacatttcaaactcagtcaccacctagtttctacagggcgggtgatcctattttgacatactttcctaaatggagcgtcatatcgctcctcagacaacctgctggtgtaggggcaggcggactgtgcgctgagagcaacccggcaggtttccttgagtcaaagagcactacctgtacacgcttttttaaaaatttagcctcctcttgtaccctagactccgccctgaatgctgcttcatactacaattttacagtacttaaagtcccacgttcaatgaccgacccacagaacatggaggtcacttacgaaatagagacaaacgggacttttggaattcaaaaggtcagcgtgagcctgggccagaccaacctcactgtggaacctggagcaagcctgcagcaacacttcattctaaggtttagggcgttccaacagtctactgccgcaagcctcacgagccctcgaagcggaaacccaggctacattgtagggaagccccttcttgctctcaccgatgatattagctactctatgacgctcctccagtctcagggcaacggctcatgctcagtcaagcggcatgaggtccaatttggcgtcaatgcaatttccggctgtaaacttaggctcaaaaaagctgattgcagccatttacagcaggaaatttatcagaccttacatggcagacctcgtccagaatatgttgccatcttcggcaatgctgatccagcacaaaaaggcggatggacccggatcctgaatcggcattgctccatctctgcgattaactgcacatcttgttgtcttattcccgtgagtctcgagatccaggtattgtgggcatatgttggtctgctgtcgaatccccaagctcatgtgtccggagtaagattcttgtatcagtgtcagtcaattcaggactctcaacaggtgaccgaggtctccctgacaacacttgtgaatttcgtcgacataacacaaaagccccagccgcctaggggacagccgaaaatggattggaagtggcccttcgatttttttccttttaaggtggccttttcgcgaggggttttcagccagaagtgctctgtcagccccattttaatcctttgtctccttctactgggtgtgctcaatctggagaccatgtag

SEQ ID NO: 243677 - DNA, 1332 bp, Artificial Sequence
  Description of Artificial Sequence: Synthetic coding sequence
atgagaaccccacaactggcgctccttcaggtgttcttcttggtcttccctgatggggtgcggccacaaccctcatcgtccccaagcggggctgtaccaacatccctggagttacagaggggaacagacggaggcacactgcagagcccttcggaagccaccgccacccgcccagccgtccccggactgcctaccgtagtgcccactctggtgacaccatcagcgcctggtaaccgtactgtggacttgtttcctgtgctcccaatatgcgtctgcgacctgacacccggagcatgtgatattaattgctgctgcgatagagactgctatttacttcatccaagaacggttttcagcttttgtctcccgggttccgtgcgaagttcaagctgggtatgcgtagacaactctgttatttttcggagcaatagtccttttccctcccgagtgtttatggattcgaacgggatcaggcagttctgcgtacatgtcaacaacagcaatctgaattacttccaaaagcttcaaaaagtaaacgcaactaatttccaggcgctcgcggcagaattcggcggtgagtctttcacgtcaacttttcagacccagtctccaccttctttttaccgggcaggggatccaattttgacttatttccctaagtggtccgtcatcagcctgctgcgccagcccgctggggtcggtgcaggcggactgtgtgcagagtcaaatcctgcaggattcctcgagtctaagagtacaacttgcacaagattctttaaaaatttagcgtcatcctgcacgctcgattccgccctcaacgctgcgtcctactacaattttacagtcctgaaggtacctagatctatgaccgatccccaaaatatggaatttcaggtcccagtaatcctgacgtcacaggccaatgctcctctgctggctgggaacacatgccaaaatgtcgttagtcaggttacttatgaaatcgagacaaacgggacctttggcattcagaaagtctccgtgtccctgggtcagaccaatctgacagtcgagccaggcgcttctttacaacagcacttcatcttgcgcttcagggcattccagcagtccacagccgcaagcctgacaagccctagatctgggaacccagggtatattgtgggaaagcccctgcttgctctgacagacgatataagctattccgtgtccttcctggaactcggaggactgttgcagccgaatgaaaagtcatgtaaaggtttccagacttatgtgagactggcaaagggtgaagagtttttcgtgcattacaatgaagtcctgatctactag

SEQ ID NO: 243678 - DNA, 1878 bp, Artificial Sequence
  Description of Artificial Sequence: Synthetic coding sequence
atgcggctcgaaactgcggaagcctacgtcggaccaggcggaccagagtgtcccatgcggaccccacagctggcccttttgcaagtattcttcctcgtgttcccagacggggtcaggccccagccaagtagtagcccttctggggctgtccccacaagcctagagcttcaacggggtacagatgggggtacactgcagtctccttctgaggccacggccactcgcccagctgtgcccggtctaccaactgtggtaccaacactggtgacacctagtgctcccggaaacaggaccgtggacctcttcccagtcctgcctatctgcgtttgtgatctcactcctggtgcatgtgatatcaactgctgttgtgaccgggactgctatcttctgcaccctcgtaccgtgttcagcttctgtctccctggctcggtccgcagctcttcatgggtatgtgtagataacagtgtcatatttcgatccaactctccttttccctctcgcgtattcatggacagcaatggtattcgtcaattttgcgtccacgtcaacaattcaaacctaaactattttcagaaactccagaaggtgaacgctactaatttccaggcccttgccgcagaattcggtggggagagttttacgtccacttttcagactcagagtcctccaagcttctatagagctggggatcccattttaacatattttcccaagtggtcggttatttctctcttgagacaacctgctggggtgggggctgggggtctctgtgctgaatctaatcctgctggttttctggagtcaaagagcacaacctgtacccggttctttaagaatttggctagctcctgcaccctcgactcggccctcaacgctgcaagttactacaactttacagtgttgaaggtgcctagaagcatgactgatccacagaacatggagttccaggtgccggttatcctgacatcacaggccaatgcgccactgttagccggaaacacctgccaaaacgtcgtgtctcaggtgacttacgagattgagaccaacggtacgtttggtattcagaaggtgagtgtttctttaggacagaccaacctgacagttgagcccggtgcctcgttgcagcaacatttcatcctgcgattcagagcttttcagcagagtaccgctgcaagcctgacatctcccaggtcaggaaacccaggatatatcgtgggaaagcctctccttgcactgactgatgacatctcctacagtatgactctgctccagtcacaagggaacggcagttgctcggtaaagaggcacgaggttcagtttggcgtgaacgctattagcgggtgcaagctccgcctgaagaaggccgactgcagccacttgcagcaggagatttaccagaccttacatggacgcccaaggcccgaatatgtggcgatcttcggaaacgcagatccagcccaaaaggggggttggacacggattctgaaccgccactgttccatctccgccatcaactgcaccagctgctgcctaataccagtttccctggagattcaggtgctctgggcctatgtaggcctcctgagcaatccacaggcacatgtgagcggagtgcgctttctgtaccagtgccagagcatccaagattctcagcaggtgactgaagttagcctgaccaccctggttaacttcgtggacattacgcagaaaccacagccccctcggggacagccgaaaatggactggaagtggccgttcgattttttccctttcaaagtagcattctctaggggagtgttttcacaaaagtgcagcgttagccctatactgatcctgtgcctgctcctcctgggcgtactgaatttggaaaccatgtag

SEQ ID NO: 243679 - DNA, 1380 bp, Artificial Sequence
  Description of Artificial Sequence: Synthetic coding sequence
atgaggactcctcagttggcactcttacaggtcttttttctggtatttccagacggcgttaggccgcagcctagttccagcccttccggagctgtgcctactagcctggagctgcagcgaggaacagatggaggcacgctgcaatctccatccgaggcgaccgcaactaggcccgctgtcccaggactccccaccgtcgttccgactctcgtgaccccttctgcgccagggaaccgtacagtggacctgtttccagtccttccgatctgcgtctgtgatttgactcctggagcgtgcgacattaattgctgttgtgaccgtgactgctatttacttcacccgaggaccgtgttttctttttgtctccctggcagtgttcgatcaagctcctgggtgtgcgtggataactccgtgattttccggtcaaattctccattcccttctcgggttttcatggactcgaacgggatcaggcagttttgcgtccatgtaaataactgtttcctggagtccaagagtaccacctgtactaggttcttcaagaacctcgcctcgtcctgcaccctggacagcgccctgaatgccgcttcgtactataactttacggtactaaaagtccctaggtccatgactgatccacaaaatatggaggcctttcagcaatctacggcagcgagcctgacttcgccgaggtcggggaatccaggatatatcgtggggaagccccttttggccctcacagacgacataagctatagtatgaccctgcttcaaagccagggcaacgggtcctgttcagtaaaacgccatgaggtccagtttggagtcaacgcaatcagcggctgtaaactgcgcctgaagaaggcagattgtagccacctgcagcaggagatatatcagacccttcatgggaggcccaggcccgaatatgttgctatctttggcaacgccgatcctgctcagaaaggtggctggaccaggatcctgaataggcactgcagtatctcagcgataaactgcacttcttgctgcctgatccccgtaagcttggagatacaggtgctctgggcctacgtgggactgctcagcaaccctcaggctcacgttagtggtgttaggttcctgtaccagtgtcagtccattcaggacagccagcaggtgacagaagtaagtctcacaactctggtcaatttcgttgatattacacagaaaccccaacctcccaggggccaacccaaaatggactggaagtggccctttgacttttttccctttaaggtagcattcagcagaggggtgttttcccaaaaatgcagtgtttctcccattctcatcctttgcttactgctgctgggggtactgaatctggagaccatgtag

SEQ ID NO: 243680 - DNA, 6468 bp, Artificial Sequence
  Description of Artificial Sequence: Synthetic coding sequence
atgaattactccagcttcctccgaatttgggtctcctttatttttgctctggttcagcatcaggcgcagccgagagaactgatgtaccctttctggcagaatgataccaaaacgccaaaggtggatgatggatcttcctctgagatcaaactggccatccccgttttcttttttggcgttccttatagaaccgtgtacgtaaataacaacggcgtcgtttccttcaacgtgctcgtcagccagttcacccccgagagctttccgctgaccgacggcagggcctttgtggcaccattctgggctgacgtgcacaatggcatacgaggagaaatctattatcgagagacgatggagcccgctattctgaagagggccaccaaagatatcagaaaatacttcaaggacatggcgacattttcagccacctgggtgttcattgtgacctgggaggaagtaacattctacggaggctcttctactacccccgtgaacacatttcaggccgtcctggtatccgatggctcatacacttttactctgtttaactactacgaaataaactggaccacagggactgcctccgggggtgaccctctgacaggactcgggggagtaatggcgcaggctggatttaatggcggaaatctaacaaatttcttttcgttgcccggttccagaactccagagatcgtcaatatacaggaaaccaccaacgtaaatgtgcccggtagatgggctttcaaggtggatggaaaagagatcgacccagccaacgggtgtacgtcgaggggccaattcctgcgccgaggagaggtcttctgggatgatctcaattgtactgtaaagtgccggtgcttggattttaacaatgaaatctactgtcaagaggcctcttgctccccttacgaagtgtgtgagcccaaagggaagtttttttattgttcagcagtggagaccagcacatgtgttgtttttggtgaaccccactaccacacttttgatggcttcctcttccacttccagggctcttgcgcctacttgctggccagacagtgcctgcagaccagcagcttgccattttttagcgtggaggccaagaacgaacaccgacgtggatctgccgtcagttgggtcaaggagttgagcgtggaagtgaacgggtataagatattgatccctaaaggaagttatggaagggttaaggtgaacgacttggtgacatctttgccagttacccttgacctgggcacagtaaagatctaccagagcggaatttcgacagcagtggagaccgacttcgggctgctggtgacttttgatggacagcattatgcatccatctctgttccaggcagttatataaattctacttgcgggttatgcgggaactataacaagaaccctctggatgacttcctccgccctgacgggagacctgcaatgtctgtgctggacctgggggagtcatggcgagtgtaccacgccgactggaaatgcgacagcggctgtgttgataactgcacacaatgtgacgcggcaaccgaggctctgtatttcggttccgattattgcggcttcctcaataaaaccgacggacccctctgggagtgcggtaccgtcgttgaccccacagcttttgtgcactcatgtgtctacgatctgtgctccgttagggataatggcaccctgctgtgtcaagcaatacaggcctatgctctggtttgccaggccttggggattcccatcggagattggaggactcagaccggttgtgtttccaccgtccaatgcccttcattttctcattactccgtgtgtacgtcaagttgtcctgacacatgtagtgacttaacggcaagtaggaattgtgctactccctgcacagaaggctgtgagtgtaatcaaggatttgtactctctacatcccagtgcgtcccactccacaaatgtggatgtgacttcgacggacattattacacaatgggggaatttttttgggcaaccgctaattgtaccgtccaatgcctgtgcgaagagggcggagatgtgtactgttttaacaaaacctgtgggtctggagaagtctgtgcagtcgaagacggttaccaaggatgctttcccaagcgcgaaaccgtctgcctactttcacagaaccaggtgctacacacattcgatggagcctcctacgcatttccgagtgagtttagttataccctcttgaaaacatgcccagaacggcctgagtacctggaaatcgacatcaacaaaaagaaaccagacgctggcccagcatggctccgaggcctgagaattctggttgcagatcaggaagtcaaaatcgggggaatcggggcaagtgaggtgaagctgaacggccaagaggtggaactgcctttttttcacccatccggcaagctggaaatctaccgtaataaaaactcgactaccgttgagagcaagggggttgtgacagtccagtattcagatattggacttctctatattagactatctacaacctactttaactgcacgggtggactctgcggattttataacgccaacgcctcagacgaattctgtctgcccaatggcaagtgcaccgataatctcgccgttttcctggaatcatggaccacatttgaagaaatttgtaacggagagtgtggcgacttgctgaaagcctgcaacaacgactccgaactgctgaagttttaccgctcccggtcccgctgcggcatcattaatgacccgagtaatagctcattcttggagtgtcatggcgtcgtcaatgtgacagcttactatcggacctgtctattcagactctgccagagcggagggaatgagtccgagctgtgtgactcggtggctaggtacgcatccgcctgtaaaaacgccgatgttgaagtgggcccatggcggacttatgacttctgccccctagaatgtccagagaacagtcatttcgaagagtgtattacctgcactgagacctgtgagaccttgacactgggacctatctgcgtagattcttgtagcgaagggtgccagtgtgatgagggttacgccctgttaggatctcagtgtgtgactcgcagcgagtgcggttgcaacttcgaagggcaccagcttgccacgaacgagacgttctgggtggatctcgattgtcagatcttctgttactgcagtggaacagataaccgcgtgcattgtgaaaccattccatgtaaggatgatgagtactgtatggaggagggcggattgtactactgtcaggctagaaccgacgccagttgcatcgtgtctgggtatggacattatctcacattcgacggcttcccttttgactttcagacatcctgtccattgattctctgtactacaggatctaggccatcctcagattccttccccaaatttgtggttactgcaaaaaacgaggatagggaccctagcctcgctctctgggtgaagcaggtcgatgtgactgtttttggctactcaatcgtcattcatcgtgcatataagcacacagtcctcgtgaacagcgagaggctctatctgcccctgaaactgggccaaggcaagatcaacatcttttcatttgggttccatgtggtcgtggaaactgacttcgggctcaaggtggtgtacgactggaagacgttcctcagtatcacagtgcccagatctatgcagaatagcacttatggactttgtggtaggtataatggtaacccagacgacgacctggaaatgcccatgggtctgctggcatcgagcgtaaacgaatttggacaaagctgggtaaaacgagataccttctgtcaggtcggatgtggcgatagatgcccttcctgcgccaaggtggagggattctcgaaagtgcagcaactgtgttccctgattcccaaccagaacgcggcattctccaagtgccactcaaaagtgaaccctaccttcttctacaaaaattgtctgttcgacagctgcatagacgggggagctgtgcaaaccgcctgctcttggttgcagaactatgcatccacttgtcagacacaaggcatcactgtcacgggctggaggaactacacttcctgtaccgtcacttgtcccccaaactcgcactacgaatcctgcgtcagtgtctgtcaaccacggtgtgctgccattcgcctgaagtccgactgtagtcattattgtgtagagggctgccactgtgatgcgggttatgtcctgaacggaaagagttgcattctgccacactcctgcggctgctattccgatgggaaatactatgagcctaagcagctgttctggaactctgattgtacacggagatgtaggtgtttccggcgtaatgtgatccagtgcgatccgagacaatgtaagtcagatgaggaatgcgctctgaggaacggagttcgcggatgcttcagtaccaaaacttcatactgcctggccgcagggggaggcgtcttcaggacctttgatggggctttcctgcgcttccccgcaaactgcgctttcgtcctctccacaatctgccagaagttacctgatatttccttccaactcattatcaatttcgacaaatggtccgctcccaatttgacaattatctcaccagtttatttctacatcaacgaggagcagatcctgatcaacgacaggaacacagtaaaagtcaacggaacacaagtcaatgtcccatttataaccggacttgccacgaagatctattctagtgagggcttcctagtgatcgatacatcaccggacatacaaatctactacaatgggtttaacgtgattaagatctcaatctctgaacggctacaaaataaagtgtgtggcctgtgtggcaactttaacggagacctcaccgacgattacgtcacactgcggggaaagcctgtggtgtcgagtgttgttcttgcccaatcctggaaaacgaacggaatgcagaaaaggcctttagcccctagctgcaacgaactccaattcagccaatacgccgctatgtgcgataatgtccacatccagaaaatgcaaggagacgggtattgcttgaaattaacagacatgaaggggttctttcaaccctgttacgggctcttagaccccttgccattctatgagagctgttaccttgatggctgttatagtcacaagaagttccagctgtgtgggtctctagctgcatacggggaagcctgccgctcttttgggatccttagcaccgaatggatcgaaaaagaaaattgctctggcgtagttgaagatccatgtgtgggggctgactgtcccaaccgcacctgtgaactgggcaatgggagggagctgtgcggatgtatcgaaccacctccctacggtaataatagccatgacatcattgacgccgaagtaacctgcaaagctgcacagatggaagtgagcatcagtaaatgtaagttattccaactcggctttgaacgagagggggtgagaattaacgaccgacaatgtactggcatcgaaggagaggatttcatctctttccaaattaacaatacaaaaggcaactgtgggaacatcgtccagtctaacggcactcatatcatgtacaagaacacactttggattgaatcggctaacaacaccggcaatatcatcacccgcgaccgtacgatcaacgtagaattctcttgcgcatacgaactcgacattaagatctctctcgacagtgtggtgaagccaatgctgtccgtgatcaacctgacagtgccaacccaggaagggagcttcattacgaaaatggccttgtacaagaacgcttcttacaaacatccatatagacagggcgaggttgtcctaaccacacgcgatgtcctgtacgtgggggtattcgtggtcggcgcagacgctacccatctcatattgactttgaataagtgttacgctacaccaacgcgggattccaacgacaaacttcggtattttatcatcgagggtgggtgtcagaacctgaaagacaacacgatcgggattgaagaaaacgccgtcagcctgacgtgcagatttcacgtgacagtgtttaagttcatcggtgattatgacgaggtgcatctgcattgcgctgtgtccctgtgcgatagcgagaagtactcatgcaaaatcacatgtcctcacaactcacgtatagctaccgattataccaaggagcccaaggaacagattatctccgtggggcctattagacgtaaaagactggattggtgcgaagacaatggcggatgcgagcagatctgtactagccgggtggacggtcctctgtgttcgtgcgtgactggcaccctccaagaagacggaaagtcttgccgggcatccaatagtagcatggaactgcaggtatggacattgctgctaattatgattcaaatatctctgtggcactttgtatacaagtcgggcaccaccagctac

SEQ ID NO: 243681 - DNA, 6467 bp, Artificial Sequence
  Description of Artificial Sequence: Synthetic coding sequence
atgaactactcgtctttcctacggatttgggtcagctttatttttgctttagtgcagcaccaggctcagcctcgcgagttgatgtatcctttctggcagaacgacaccaaaactccaaaagttgacgacggaagttcctcggaaattaaactggcaattcctgtctttttctttggcgtgccttaccgaactgtttatgttaataataacggcgtggtatcctttaatgtgcttgttagtcaatttactccggaatcctttccgctaaccgacggacgcgcttttgtcgcccctttctgggctgatgtgcataatggaatccgaggtgaaatatattatagagaaaccatggagcctgcaatactgaagagagcaactaaagatatcagaaaatatttcaaggatatggccactttctccgcaacgtgggtctttattgttacatgggaggaggtgactttttatggcggtagctcgactacacccgtaaatacgtttcaggctgtacttgttagcgacggcagctacacctttaccctgtttaactactacgagataaattggaccaccggcaccgcttcaggcggagatcctctaaccgggttagggggtgtaatggcacaagcagggttcaacggaggcaatctcaccaatttcttttcactcccagggtccagaacgcctgaaatcgtgaatattcaagagaccacaaatgtgaacgtccccggtcgctgggccttcaaagtggatgggaaagagattgatcctgccaacggttgtacttcgcgtggccagttccttcgaagaggggaggtgttctgggatgatctgaactgtaccgtgaagtgccgatgtctggatttcaataatgaaatttattgccaggaagccagctgcagcccgtacgaggtttgtgagccaaagggcaaattcttttattgctcagcagtggaaacttcaacctgcgtggtattcggcgagcctcactatcacacctttgatggctttctgtttcactttcagggttcctgtgcgtacctgctggcccgtcagtgcctgcagacctcctcccttccattcttcagtgtagaagccaaaaatgaacaccgcaggggatcagccgtctcttgggtgaaagaactgagcgtagaagtcaacgggtacaagattctcattcctaaaggctcttacggtagagtcaaagttaacgacctggttacctccctgccggtcacgctggatctgggaaccgtgaagatttatcagtccggaatttcaaccgcggttgaaactgacttcggacttttggtcacattcgacgggcagcactatgcatccattagcgtccctggcagttacattaattctacatgcggcttgtgcggaaactacaacaagaatccactagatgactttttgcgaccggacggccgtcctgctatgtcagtgctagatttgggagagtcctggagagtctaccacgcagattggaaatgcgattcgggctgcgtagataattgcacacagtgtgacgctgccacagaggcactctattttggatccgactattgcggcttcctgaataaaaccgatggtcccctgtgggaatgcggtactgtagtcgatccgacagcattcgtccactcttgtgtctatgatctctgttctgtgcgggacaacggaacactgttgtgtcaggccatccaagcttacgcgctcgtgtgccaagccttagggatcccaattggggactggcgcacccaaaccggctgcgtgtccactgtgcagtgcccttctttcagccactacagtgtttgcaccagcagctgtcccgatacatgttctgacctgacagcttcgagaaattgtgccacgccttgtacagaggggtgtgagtgcaatcagggctttgtgctctccacttcacagtgtgtcccgctgcataaatgtgggtgtgacttcgacggacattactacactatgggagaatttttctgggccaccgcaaattgcactgttcagtgtctgtgtgaagagggaggcgatgtgtattgcttcaacaaaacatgcgggagcggagaagtgtgcgcagtagaggacggctaccagggttgcttcccaaaacgggagacagtgtgcctccttagtcagaatcaggtcctgcatacgtttgacggcgcttcctacgccttccctagcgaattctcctatactctcctgaagacatgcccagaacgacccgagtacctggaaatcgatataaataaaaagaagcccgacgctggccctgcatggctgaggggcttgcgtatccttgtggccgatcaggaggtgaagattggcggtataggcgcatcggaggtcaaacttaatggccaagaggtagagttacccttcttccatccgtccggaaagctggaaatttaccggaataagaactccactacggttgagagcaagggcgtggtgacggtccaatatagtgatatcggtctcctgtatatcaggctgtccacaacctacttcaattgcactgggggtctgtgtgggttttataacgcgaatgcctccgacgagttctgtctgccaaacggtaagtgcacggacaacctcgccgtcttcctggaatcttggacaaccttcgaagaaatttgcaacggtgagtgcggcgacctcctaaaggcatgtaataatgacagtgagcttcttaaattttaccggagtaggtccagatgtggcatcattaatgacccatctaactcttcctttctggaatgtcatggggtcgtgaacgtgacagcatattacaggacctgcctttttcgtctgtgtcaaagtgggggtaacgagagcgagctgtgcgattcagtggcacgatacgccagcgcttgcaagaacgccgacgtggaggtcggaccttggcggacctacgatttttgtcctctcgagtgccccgagaactctcacttcgaagaatgcatcacatgcaccgagacatgtgagacgctgacgctgggtccaatttgtgtggattcctgcagtgaaggctgtcagtgcgatgaaggatatgctctgctgggttcacaatgtgtcaccaggagtgaatgcgggtgtaattttgaaggccatcaactggcgactaatgagactttctgggtggatctcgattgtcagatcttttgttattgcagcgggacagataatcgagtgcactgcgaaactattccatgcaaagatgatgaatattgtatggaggaaggaggcttatattattgtcaggcacgtacggacgcctcatgcattgtctcaggatatggacactatctgacttttgatggctttcctttcgatttccagaccagctgtccactgattctgtgcactacaggctccaggccatctagcgatagtttccccaagttcgtggttaccgcaaagaacgaggacagagatcctagcctggccctctgggtgaaacaggtggacgtgacagtgtttggttacagtatcgtgattcatagagcgtataagcatactgtcttggtgaactccgagagactttacttacccctcaagctggggcagggcaaaataaacatcttttcctttggctttcatgtggttgtggaaacggactttggccttaaagtggtttatgactggaagaccttcttaagcatcactgtcccacgatctatgcaaaacagcacctacggcctgtgcggaaggtacaatggaaatcctgacgatgaccttgaaatgcctatggggctgttagcctcaagtgtaaatgagtttgggcagtcatgggtgaaacgggatacattctgccaggtgggctgcggcgatcggtgtccatcttgtgccaaagtcgaggggtttagcaaggtccaacagctttgttcgctgattcccaatcaaaatgcggcattttcaaagtgtcattctaaagtgaatcccaccttcttttacaagaattgtctgttcgactcgtgtatcgacggaggcgcagttcagactgcttgcagctggttgcaaaattatgccagtacttgtcaaactcagggaattaccgttaccggatggcgaaattacacaagctgcaccgtcacttgcccccctaactctcactatgaaagttgcgtctccgtgtgccagccgcgatgcgcggctatacgactcaagtccgattgcagccactactgcgtagaaggttgtcactgtgacgctggctatgtgcttaacggcaagtcctgtatcctgccccattcatgcgggtgctattctgacggaaaatactacgagccaaagcagctgttctggaacagcgactgcactagacgctgtagatgtttccggaggaatgtgattcagtgtgacccccgacagtgcaagtccgatgaagaatgtgccctcaggaatggtgtcagagggtgtttcagcactaagactagctactgcctggctgccggtggaggtgtatttagaacatttgacggcgcattcctgaggttccccgcaaattgcgccttcgtgctcagcactatctgccagaaactgccagacatctccttccagctcatcatcaacttcgacaagtggtcagcgccaaatctgacgatcataagcccagtttacttttatattaacgaggaacagatacttatcaacgacagaaacacagtcaaggtcaacggcactcaggtgaatgttccttttattaccggtttggccacaaagatatacagctccgaagggttcttagttattgatacctctcccgatattcaaatctactataacggcttcaatgtcatcaagataagcatctccgagagactgcaaaataaggtttgcggtctttgtggcaactttaacggggatctgactgatgactatgtcaccctgcgcggaaagcctgtggtgagctctgtggtgctcgctcagtcttggaagacgaacggtatgcagaagcgccctttagccccttcttgcaacgaacttcagttcagccagtacgctgcaatgtgcgacaacgtgcacatccagaaaatgcagggtgacggatattgcctgaaattaaccgacatgaaaggcttttttcaaccctgttacgggctgctcgacccactgcccttttatgagtcctgttacctcgacggatgctatagtcataagaaatttcaactgtgtggtagtttggctgcctacggcgaggcgtgtaggtcctttgggatcctttctactgaatggatcgagaaggagaattgctccggcgtggtcgaggacccttgtgtcggcgcagactgcccgaatcggacttgcgagttgggcaacggtagggagctatgcggctgcatagagcctccaccctatgggaacaacagccacgatatcatcgacgctgaagttacctgcaaggcggcacagatggaagtgagtattagcaagtgcaagctcttccagctgggatttgagcgtgaaggcgtgaggatcaacgataggcagtgcaccggcatcgaaggagaggacttcatttccttccaaattaataatacaaaaggaaattgtggcaacatagtacaatctaatggcacgcacatcatgtataagaacacactgtggattgagtccgcaaacaatacgggaaatatcatcactcgcgaccgcacgataaatgtggaattttcatgcgcgtacgagctcgatataaagatatcgttggacagtgtggtgaagccaatgctgagcgtgatcaatctcacagtgcccacacaggagggatcgttcatcacaaaaatggccctctataagaatgcatcttacaagcatccataccgccagggtgaggtggtacttaccacacgggatgtgctgtatgtcggggtgttcgttgtcggcgcagacgccacacatcttatattaacactgaataagtgttacgccacccccacaagggatagcaatgacaagctacggtattttatcatcgaaggaggctgtcaaaacttgaaagataatactatcgggatcgaggaaaacgctgtgagcttgacatgtcgcttccacgtcactgtttttaaattcattggggattacgatgaagtacacctgcattgcgccgtgtccctgtgcgattccgagaagtatagttgcaagattacctgcccacacaactctaggatagcaacagactacacaaaggagcctaaggaacagattatcagcgtgggaccaattaggcgcaagagactcgactggtgcgaagacaacggagggtgcgagcagatctgtaccagccgcgtggacggccctctttgcagctgcgtgacaggaacgctgcaagaagatggcaaaagctgtcgcgcttccaattcctcgatggaactgcaggtgtggaccctgcttctgatcatgatccagataagcctgtggcacttcgtgtataagagcggtacaacctcata

SEQ ID NO: 243682 - DNA, 1257 bp, Artificial Sequence
  Description of Artificial Sequence: Synthetic coding sequence
atggctaagctcctgcagccacctcccaagttcttgccttcagaatggcacatagctaataaaaaccagtaccaccgagccgacgcccaacggagtaggtctgagcggctggttgcggagtcccagagactagtggacgagatcgagaaaacaacaaggaaaagtcaatccgacgttaataagaagctcgagcaacgtctggaagaggtccagttttggaaaaaagaactggatgacaagctggagcagctggtcaacgtgaccgatgacctacttatttacaagataaggttagagaaagccctcgaaaccctcaaggagccgctgcacattacagaaacctgcctggcctaccgagaaaagaggattggcatagacctggttcacgacaccgtcgaacatgagctgatcaaagaggctgagataattcagggcatcatggcccttctgacacgaacactcgaagaagccagtgagcagatccgtatgaacaggagcgccaagtataatctggaaaaagaccttaaggataagttcgtggctctgaccatcgacgacatttgtttctctcttaacaacaactcccccaacattaggtatagtgagaacgccgtaagaattgagcccaacagcgtttccttggaagattggctagacttctccagcacaaacgtggaaaaggccgacaagcagcggaataattcacttatgctaaaggcgctggttgaccgcatcctttcccagactgctaatgatcttcgaaagcagtgcgatgtggtggatacagctttcaaaaacggactgaaggacacaaaggacgctagggacaaacttgctgaccacctggccaaggtgatggaggagatcgcgagtcaagaaaagaacatcaccgccctggagaaggcgattctggaccaggaaggccctgccaaggtggctcatacaagactcgagactaggacacaccgccctaatgtcgaactctgcagagacgtggctcagtaccgccttatgaaggaggttcaggaaattacccataacgttgctcgactaaaagagaccctggctcaggcccaagccgagctcaaggggctccaccgacggcagctcgcactgcaagaggaaatccaggtgaaagagaacaccatctatatcgatgaagtgttgtgcatgcagatgcgtaaaagcattcccctgcgggatggcgaggaccatggagtatgggcgggagggcttcgtcctgacgcagtatgctag

SEQ ID NO: 243683 - DNA, 819 bp, Artificial Sequence
  Description of Artificial Sequence: Synthetic coding sequence
atggctttactcacccgcaccctcgaggaggcatccgagcagataagaatgaatagatctgccaagtacaacctggagaaggacctcaaggataaattcgtggcactcacaatagacgacatctgttttagtctgaataacaactcccccaacatccgctattccgagaatgcagtcagaatagagcccaatagcgtaagtttagaggattggctcgacttctccagtaccaacgtcgaaaaggccgataagcagaggaacaattcacttatgctgaaagcccttgttgacagaatcctatctcaaaccgcaaacgatttgagaaagcaatgtgatgtggtggataccgctttcaaaaacggcctgaaggatacaaaagatgcccgagacaaactcgctgatcacctggccaaggtgatggaagagatcgcatcccaagaaaagaatatcacggccctcgaaaaagctatcctcgaccaagaagggcctgctaaggtagcacacacccgacttgagacaagaacccatcggccaaacgtggaactctgccgggatgtggcacaatacaggctgatgaaggaagtacaggaaatcacacacaacgtggcacgtctgaaagagaccttagcacaggctcaggccgagttaaaaggcctccatcggcgtcaacttgctttgcaggaagagatccaggtgaaggagaatactatctacatcgacgaagtgctttgtatgcagatgagaaagtctatccccctccgtgacggtgaagatcacggtgtttgggctggcggactccgacccgatgctgtctgctag

SEQ ID NO: 243684 - DNA, 1473 bp, Artificial Sequence
  Description of Artificial Sequence: Synthetic coding sequence
atggagagagtggggtgtacactgactaccacctatgcacaccctcgtcccacacccacaaactttctgccagcgatctctacgatggcttccagttatcgcgatagatttccccattccaatctgactcattcactgagtctgccatggcgaccaagtacatattacaaggtagcatccaactctccatctgttgccccatactgcactagaagccagcgggtctcagaaaataccatgcttcctttcgtgtccaacaggaccacgtttttcactcggtatacacccgacgactggtacagaagtaatctgaccaattatcaggaaagcaatacttctcggcataatagtgaaaagcttagagtggatacgtcacggctgattcaagacaaatatcagcagacacgcaaaactcaagccgatactacccagaatcttggcgagagggtgaacgacatcgggttttggaagagcgaaattatccatgaattggacgaaatgataggggaaaccaacgcactcacagacgtgaaaaagagactagagcgagcgttgatggagacggaggcccctctccaggtggctcgtgagtgtttgtttcaccgggagaagcgaatgggcattgatttagtacacgacgaggtggaagcacagttactgaccgaagttgacaccattctatgttgccaggagagaatgaaactccatctggacaaggccatcgcacagctggctgccaatagagctagccagcatgagctagagaaggacctcagcgataagcagacagcctatagaatcgatgacaaatgccaccaccttaggaacactagcgacggcgtgggctattttaggggcgtggaaagagtggacgccaccgtttctgttcctgaatcatgggctaaatttacagatgataatatcctacggagtcagtcagaacgcgcagcctcggctaaactgagagatgatatcgagaatctgctggttgtcaccgccaacgagatgtggaatcagtttaacaaggtgaatctaagttttacgaacagaatcgccgaaaccgctgatgcaaaaaataaaattcaaacacatctcgcgaaaaccttgcaggaaatcttccaaactgagatgaccatagagtcaatcaagaaggccatcaaagacaaaactgcgtttctaaaagtggcccagacgcgcctagatgaaagaacccgtcggccaaacattgagctgtgcagagacatggcccagctccgcttggttaatgaggtgcatgaagtcgatgatacaattcagacactgcaacagaggctgcgggacgccgaggacactttacagtctttagtacacattaaagccactcttgaatacgatctggccgtcaaggctaactcgctttacattgaccaggaaaagtgtatgagcatgaggaaatcttacccaaacactctgcgcctagtgggattttgttag

SEQ ID NO: 243685 - DNA, 1473 bp, Artificial Sequence
  Description of Artificial Sequence: Synthetic coding sequence
atggagcgtgttggctgcactctcactaccacctatgcccatccaagaccaacaccaacaaatttcctgcctgcgatttcaacgatggcaagttcttacagggaccgattcccacattccaatctgacacacagcctctccctgccatggcggccttctacttattataaagtcgccagtaattcaccctctgtggctccctattgcactcgatcccagagggtatctgaaaatacgatgctaccatttgtgtctaatcggaccactttttttacccgctacacgcccgatgactggtacaggtcgaatctcacgaactaccaggagagtaacacaagccgtcataactcagaaaaattgcgggtggatacctcacgtctcattcaggacaagtatcagcagacaagaaagactcaggccgacactacccagaatctgggcgagagagtgaatgacattggattctggaagtcagagattattcacgaacttgacgaaatgatcggagagacaaatgcgctaacagacgtgaaaaagaggctggaaagggctctgatggagactgaggcccctctgcaggtcgccagagagtgcttattccatcgagagaaaagaatgggaattgatctggttcacgatgaagttgaggctcagctgctgacagaggtggacaccattctgtgttgtcaggaacgcatgaagctccatttagacaaagctatcgctcaactggcggctaatagagcttctcagcatgagctggaaaaagacttaagtgacaaacagaccgcttaccgtattgatgacaagtgtcaccacctgcgcaacacctcagatggtgtggggtattttcggggagtcgagcgggtggatgcgaccgtgagtgttccagagtcttgggcaaaattcactgatgataacattctgaggtctcagtcagagagggcagccagcgcaaaacttagagatgacattgagaaccttcttgtagtaactgccaatgagatgtggaatcaatttaataaggttaatctttccttcacgaaccgcattgcagaaaccgccgatgctaaaaacaaaattcagacccatctagccaaaacgctgcaggagatatttcagacagaaatgacaattgaatcgatcaagaaagccattaaagataaaaccgccttcctgaaggttgcccagacaaggctggacgagcgcaccagacggcctaacatcgaactgtgtcgcgacatggcacagctgcgcctcgtcaacgaggttcacgaagtggacgataccattcaaacccttcaacaaagacttcgcgacgcagaggatacactgcagtcattggtgcacatcaaggccacactggaatatgatctggctgtgaaggctaacagtctatatatagatcaagaaaagtgcatgtcaatgagaaagagctaccctaatactctacggcttgtgggtttctgttag

SEQ ID NO: 243686 - DNA, 444 bp, Artificial Sequence
  Description of Artificial Sequence: Synthetic coding sequence
atggagagagtgggctgcactctcacgactacctacgctcatccacgtcctactcctacgaactttctgcccgcaataagtacgatggcttcaagctacagagaccgctttccgcacagtaacttgacacattctctctccctgccatggaggccctcgacatattataaagtggcctctaatagcccatcagtggccccatattgcacacggtctcagagggtttctgagaacacaatgttgcccttcgtgagtaaccggacgacattctttactaggtatactccagacgactggtataggagtaatctcacaaattatcaagaaagcaacacctcaagacacaacagtgagaaactcagagttgacacttctagactgatccaggacaagtaccagcagacccgtaagacccaagcggatacaactcagaacttagggtag

SEQ ID NO: 243687 - DNA, 423 bp, Artificial Sequence
  Description of Artificial Sequence: Synthetic coding sequence
atggagagagtagggtgtacgttaaccactacatacgcgcacccccgaccaactcctacgaactttttgccagctatcagtactatggcctcaagctatagagaccggttcccgcacagcaacctcactcatagtttgtcactgccttggaggccatcaacgtattataaagtcgcctctaattctcccagcgtggcgccttactgcaccagatcacagcgggtctctgaaaacacaatgctgcctttcgtcagcaacagaacgacatttttcacccgttatacgcctgacgactggtataggagcaacctgaccaactaccaggaatcaaacactagccgacataattctgagaagctcagggtggatacgtcaagactaatccaggataaataccagcaaacaaggaagacacaagcatag

SEQ ID NO: 243688 - DNA, 249 bp, Artificial Sequence
  Description of Artificial Sequence: Synthetic coding sequence
atggaacgcgtgggatgcacactaaccacaacttatgcccatcccagacctacccccacgaattttctccccgcaatctcaacgatggcatcgtcctatcgggacaggttccctcattcaaaccttactcatagcctctccctgccatggcggccatctacttactataaggtggcttcaaacagcccctccgtggcaccctattgtacaaggagccaacgggttagcgagaacactatgctaccgtag

SEQ ID NO: 243689 - DNA, 2514 bp, Artificial Sequence
  Description of Artificial Sequence: Synthetic coding sequence
atggagccggcaccttctgaagtaaggctcgccgtacgcgaggccatacatgccctcagctcatcagaggatggaggacacattttctgcactcttgagagcttgaaacgctatctgggcgaaatggaacctccagccctgccacgagagaaggaggagttcgcctctgctcatttttcccctgtcctgcggtgcctcgccagtagactgtcacccgcttggttggagctcttgccccacggcagattggaagagttgtgggcctcatttttcctggaggggccagccgaccaggctttcctcgtgctgatggagaccatagagggtgctgcgggacccagttttaggctcatgaagatggctcggctcctcgcccgatttttgagagaagggaggctcgcagtactgatggaggcacagtgccgacaacaaactcagcccggatttatcttgctgcgcgagactttactcggcaaagtcgtggccctgcccgatcacctcggcaatcgtctacagcaagaaaacctcgctgaatttttcccccaaaactatttccgtctgttgggcgaggaagtcgtgcgcgtgcttcaagcggtggtcgattccctgcaaggcggtctcgacagttctgtgagttttgttagccaggtgttgggaaaggcctgtgtgcacggtcggcaacaggaaatactgggcgtgcttgtcccccgtttggctgcgctgactcaggggagttatctccaccagagagtgtgttggaggctcgtagaacaggtcccagaccgggctatggaagccgtactgactggactggttgaagcagcgctcggccctgaagtgctcagtagactgctcggcaacctcgtcgttaagaataagaaagctcagtttgtcatgactcagaaactgttatttcttcagagcagactgacaaccccaatgctccagagtcttcttggacacctagctatggattcgcagaggcgtcctctgttgttgcaggtgttgaaggaattgctggagacctggggctcctcctctgcaattagacacacacctcttcctcagcagagacacgtgagcaaggctgtgcttatctgtctggcccagctgggggagcctgaactgcgagatagccgagatgagctgctggctagtatgatggccggagttaagtgccgtttggattcatctttacccccagttagacgtcttggtatgatcgttgccgaagtggtgtcagccaggatccaccccgaaggcccacccctgaagttccagtacgaagaggatgaactgtcgctggaactgctggctttagcttctcctcagcctgccggagatggagcttccgaagccggaacctcactggttcccgctacagcagagcctcccgcagaaactcccgcagagattgttgatggtggcgtcccacaagcacagcttgccggaagtgattccgatcttgacagtgatgatgagttcgtgccgtacgacatgtcgggtgacagagagttaaagagcagcaaggctcctgcatatgttagagattgcgtggaagccctaacaaccagtgaagacattgagcggtgggaggctgcactgcgcgctctggagggactcgtctatcgaagccccacagccacaagagaggtaagtgtagagctcgctaaggttttactgcatctcgaagaaaaaacgtgtgtggtaggtttcgccggacttcgccaaagggcactagttgctgttactgtcacggaccccgcaccagtcgccgactacttaacatctcagttttacgctctcaattattctctgaggcagcggatggacattcttgacgtcctgacattagcagcccaggaactgagtcggcctgggtgtttgggcagaactccacagcctgggtcaccgtcccccaataccccatgcctccctgaggcagcagtgtcacagcctggatctgctgtcgcttctgactggcgggtagtggtggaggagaggatcagaagtaagacccaacgccttagtaagggaggacctcggcaggggccagcgggatccccatctaggtttaactcagtggccggacacttctttttccccctcctccagcgctttgacagaccccttgtaacattcgatctgctgggagaagaccagctggttttagggagactggctcataccttgggcgcactcatgtgtctagccgttaacactacagtggcggtggcgatgggcaaggcactgctcgagttcgtatgggcactccgatttcacatcgacgcttatgtgcgccagggcctgttaagtgctgtctccagtgtgctgctgagcctacctgcagccaggcttctcgaggatctgatggatgaactgcttgaagcccgaagttggcttgcggacgttgccgagaaagatcccgatgaggattgtaggactctcgccttaagagctctccttctccttcagcgactgaaaaaccggcttcttcccccagcctccccatag

SEQ ID NO: 243690 - DNA, 1083 bp, Artificial Sequence
  Description of Artificial Sequence: Synthetic coding sequence
atgatggccggtgtaaagtgtcgcctggatagtagtctgccacctgtccgtcgactggggatgatcgtcgcagaagtggtttctgccagaattcatcccgaggggcctcctctcaagtttcaatatgaggaggacgagctctctctcgaactcctggctctcgcctccccccagcccgctggagacggtgccagcgaagcaggaacatcactggtgcctgcgacggcggaaccccctgccgaaacaccagccgagattgttgatggtggggtccctcaggcgcagctggccggaagcgacagcgatctcgatagcgacgacgaattcgtcccatatgatatgtctggcgatagggaactgaagagctcgaaagcgcctgcctatgtgcgtgattgcgtggaggttctcgatgtacttaccctggctgcccaagagcttagtcgcccaggatgtctgggccgtacaccgcaacccggaagtccaagcccgaatacgccatgtctccccgaagccgctgtttcgcagcccggatccgcagtggcttccgactggcgggtcgttgtggaggaacggattaggtccaagacgcagcggctgagcaaagggggacctcgtcagggtcccgctggaagcccttccaggttcaacagcgtggccggtcacttctttttcccactcctacagcgtttcgatcgacccctggtaactttcgacctcctcggtgaggatcaactcgtgctgggcagactggcacatacgttgggggctcttatgtgccttgccgttaataccaccgtcgctgtcgccatgggaaaggccctgcttgagttcgtgtgggccttgagatttcacattgatgcctatgttcggcaaggtctgctcagcgcagtgagttcagtactcctcagcctgccggctgcacgactgctagaggacctcatggatgagttgctggaggcaagatcttggctggctgatgtggccgagaaagaccctgatgaagactgccgcacattggccttgcgagccctccttctgctgcagagactgaaaaatcgcttgctgcctccagcaagcccatag

SEQ ID NO: 243691 - DNA, 3270 bp, Artificial Sequence
  Description of Artificial Sequence: Synthetic coding sequence
atggctgtttttgacactcctgaagaggccttcggagtcctacgccctgtgtgcgtgcagctgactaagacacagactgtcgaaaacgtggagcaccttcagacgcgcctgcaggcagtctcagacagcgccttgcaggaactccagcagtacatcttattcccactgagattcaccctgaaaaccccagggccaaagcgtgaaagacttattcagagcgtggtcgaatgtcttacctttgttctgagctccacgtgtgtgaaagagcaggaactgctgcaggaactctttagtgagctgtcagcctgcctgtattctcccagtagccagaagcccgctgcggttagcgaggaactgaagctggcggtcatccagggactttccacgttaatgcattctgcttacggtgatatcattcttaccttctacgaaccatcaatactccccaggttaggcttcgccgtttctttgctactgggacttgccgagcaggaaaagtctaagcagattaaaatcgcagccctcaaatgtctccaggtgcttctgctgcagtgcgactgccaagaccatcctcgtagtctcgatgaacttgagcagaagcaactgggtgatctcttcgcctcatttcttccaggcatcagcactgccctgacccgtctcatcacaggcgatttcaagcagggacatagcatagtggtgtcctcccttaagatattttacaaaacagtttctttcatcatggccgacgaacagttaaaaagaatatccaaggtgcaagctaaacccgcagtggagcaccgtgtggctgaacttatggtctatcgcgaagctgactgggtgaaaaagaccggagacaagctgacaattctgatcaaaaagataatcgagtgtgtcagcgtgcaccctcactggaaggtgagacttgagctcgtggagctggtggaagatctgctgttgaagtgttcccagagcctcgtggagtgcgccggtccgctactcaaggccctggttggactggtgaacgatgagtccccagagatccaggcacaatgtaataaggtgctgcggcactttgcagatcagaaggtggtggtcggaaataaagctttggccgacatcctgtctgaatcactccattctctcgcaacttcattacccaggctgatgaattcccaggacgaccaggggaagttcagcaccctctcgttgctgctcggctatttgaaactgttgggccctaaaatcaattttgtgctgaactcagtggcacatctgcaaaggctcagcaaggcactgattcaagtcctagaattggatgttgctgacataaagattgtggaggaaaggcgctggaatagtgatgatctgaatgcttctccgaaaacgtccgccacccagccatggaatagaatccagcgacgctatttcagatttttcacggatgagcgtatttttatgctcctgcggcaggtgtgtcagctcctggggtactacggcaatctctatcttctcgttgaccattttatggaactttaccaccagagcgtcgtgtaccgtaaacaagcagccatgatcctgaatgaactggtgacgggggcagctggacttgaggtagaggacctgcacgagaaacacatcaaaacaaaccccgaagaactcagggagatagtcacgtctatccttgaggaatacacatcgcaggagaactggtatctggtgacctgcctggagacagaagaaatgggtgaggaacttatgatggagcatcccggattgcaggctatcacctccggcgagcacacttgccaggtcacatctttcctcgctttctctaagccaagcccaacaatctgtagcatgaactctaacatctggcagatttgtatccagctcgagggtataggacaatttgcctacgccttaggcaaagatttttgcctgctgttaatgtcggctctctaccctgttcttgagaaagctggagatcaaactctgcttatcagccaggtggccaccagtaccatgatggacgtttgcagagcgtgcggttatgactcacttcaacacctcattaaccagaatagcgactacctggtgaacgggatcagcctgaacttgcggcacctcgctctgcacccccacacccccaaagtgttggaggttatgttgcggaacagcgatgccaacctgttaccgctggtagcggatgtcgttcaggatgtgctcgctactttggaccagttctacgacaagcgggctgcaagtttcgtgtccgtgctgcatgccctgatggcagccttggcccaatggttccccgacactgggaatctgggccacctgcaggagcagagtctgggcgaagaggggtctcatttgaatcagagacccgcagccttggaaaaatctacaaccaccgcagaagatatcgagcaattcctgcttaattatctgaaagaaaaggatgtagctgatgggaatgtgtcggattttgacaatgaggaagaagaacagagtgttcctcctaaagtggacgagaatgatacgcgccctgatgtggaacctcccctcccacttcagatccagattgccatggatgtgatggagagatgcatacatctgctctcggacaagaatctacagataagactgaaagtgctggacgtcctagatctttgcgttgtggtgctgcagagccataagaatcaactgttgccccttgcacaccaggcctggcctagtctcgttcaccggctgacccgggacgcgcctttggctgtgcttcgggctttcaaggtgctgcgcactttaggcagtaagtgcggcgattttctgaggtctcggttctgcaaggacgtgctgcccaaattggcagggagcctggtcacccaggcccctatttccgctcgagccggacccgtttattcacacacactagctttcaagcttcagctggccgtcctacagggactggggccactgtgtgagcggctggatctcggagaaggcgatctgaacaaggttgcggacgcttgcctgatctacctctccgtgaagcagcctgtgaagctacaagaggcagcaaggagcgttttcctgcacctgatgaaggtcgaccctgattcaacgtggtttctgctgaacgagctgtattgccccgtacagttcacacccccacacccgagtctgcaccctgtgcaactacatggcgcatccgggcagcagaacccatacacaaccaacgtcctacaactgttaaaggaattacagtag

SEQ ID NO: 243692 - DNA, 3270 bp, Artificial Sequence
  Description of Artificial Sequence: Synthetic coding sequence
atggcagtcttcgatacccccgaggaggcgtttggtgtattacgtccggtgtgtgtccagctgacaaaaacccagactgtggagaatgtggagcacttacagacgaggctccaagcggtgtctgactcagccctccaggagctgcaacaatacatcttgtttcctctccgctttaccctgaaaacacctggtccaaaacgcgagagactcatccagtctgtggtcgagtgcctgacatttgtcttatccagcacatgcgtcaaagagcaggagctactccaagagctgttcagtgagttgagcgcatgcctctactcccccagctcacaaaaacctgccgcagtaagcgaagagctgaagcttgccgtgattcaaggtctgagcacgttgatgcattctgcctatggcgatatcatactcaccttctacgaacctagtattctaccacggctcggattcgcagtctctcttctccttggtctggctgagcaggagaagagcaaacagatcaagattgcggctctcaagtgtctccaagtccttctgctgcagtgcgattgtcaggaccaccccagaagcttggatgaacttgaacagaagcagctaggagatctcttcgcatcatttctgcccggaatctcaacagccctcactcgactgataaccggggactttaaacagggtcactcaattgtggtcagtagtctgaaaatcttttataaaactgtctcttttattatggccgatgagcaattaaagagaatatctaaggtgcaagcgaagcccgcagttgaacatcgagtggctgagttaatggtgtaccgggaggctgactgggtgaaaaaaacaggggataagctgacgatcctgataaagaagatcattgaatgtgttagcgtccacccacattggaaagtgcggcttgagctcgtggaattggttgaagatttgttgctgaaatgttcgcagagtttggtcgaatgtgcgggaccactgttaaaagccctcgttggattagtcaacgacgaaagccccgagatccaggctcagtgtaacaaggtattgaggcacttcgctgaccagaaggttgtggtgggaaataaggcactggccgatatcctgtctgaaagccttcactccctagctacttcattaccgagactgatgaatagccaagatgatcagggaaaatttagcacactgtcattgttgttgggctatctaaaactactcggacctaagatcaatttcgtgcttaactcagtcgcacaccttcagagactaagtaaggcactgattcaggtacttgaactggatgtcgcagatatcaagatcgtggaggagcgcagatggaatagcgatgatctgaacgcatctccaaagacatcagctacccagccctggaatcgtatccagcgcagatacttccgcttttttaccgacgagaggattttcatgctgttgcgtcaggtttgccagctcctaggttactatggaaatctttacctcctggtagatcatttcatggagctttatcaccagagcgttgtgtaccgtaagcaagcggcaatgattctcaatgaactggtgaccggcgctgctgggctggaagtagaagacctccacgagaaacacattaagacaaacccggaggaactgagggaaatcgtcacctctattctggaagagtacacgagccaagaaaattggtaccttgtcacttgcttggagacagaagaaatgggggaggaactgatgatggagcatcccggtctccaggccataacaagtggggagcacacatgtcaagttacctcattcctggccttctccaagcctagccctaccatttgcagtatgaacagcaacatctggcagatttgcatacaattggaaggaatcggtcagttcgcctacgcgctgggcaaagatttctgtttgttactcatgagcgcactttatccggtcctcgagaaggctggtgaccagactctacttatatctcaagtagctacttccactatgatggacgtgtgccgcgcttgtggttatgacagtctgcagcatttgatcaatcagaactctgattatcttgtgaatggcattagtctcaatctgaggcaccttgcgctgcacccacacaccccgaaagtactggaggtgatgctgcggaactccgacgctaacttactgcccctggtcgcagatgttgtacaagatgtgctggctaccttagatcagttttacgataagcgcgctgcaagttttgtatccgttctgcatgctcttatggccgctttagcccaatggttccccgatactggtaatctgggtcacctgcaggagcagtccctaggtgaggagggaagtcacttgaatcagagacctgccgctctagaaaaatccacgacgactgctgaggatatagagcagttcctactcaactacttgaaggaaaaggacgtcgccgatggcaacgtgagcgatttcgacaacgaggaggaggaacagtccgtaccgccaaaggtggacgaaaacgacactcgcccagacgtcgagcctcctctgcctttgcagatacagattgcgatggacgtcatggaacgctgcatccacttactgtcagacaagaacctgcagatacggctgaaagtcctggatgtcctggacctctgtgtggtcgttttacagtcccataagaaccagctcctgccattggctcatcaggcttggccatcgctagtacataggctaacccgcgatgctccactagcagtcctgcgagccttcaaggtcctgcgaaccttagggagcaagtgtggcgacttcctgcgttctaggttttgcaaggacgttctgcccaagctggctggttcccttgtgacgcaagcacccatctctgccagagctgggccagtgtactcccacaccctggccttcaaattgcagctagccgtcttgcagggcctgggacctctttgcgaacgcctggatctcggagagggtgacctgaataaggtagcagatgcttgtctcatatatctatccgtgaaacagccagttaagctgcaagaggccgcacggtcagtcttcctacatctgatgaaagtggacccagattcaacttggttcctgctgaacgagctttattgccccgttcagttcaccccgcctcacccatctctgcatcctgtgcagcttcatggggcatccggacagcagaacccatataccacgaatgtcttgcagctcctcaaggagctgcaatag

SEQ ID NO: 243693 - DNA, 3270 bp, Artificial Sequence
  Description of Artificial Sequence: Synthetic coding sequence
atggctgtattcgatacaccagaggaagcattcggagtgctgaggccagtgtgtgtgcaactgacaaagactcaaactgtcgaaaacgtggagcatttgcaaaccaggctgcaggctgtgtccgattcagctctgcaagaactgcagcagtacatactgttccccctccgttttacactgaagacacccggacctaaacgggaacgtctgatacaatcagtagtggaatgtctgaccttcgtcctgtcatccacttgcgtgaaggagcaggaactgctacaagagttgttcagcgaattgtccgcttgcctttactcgccttccagtcagaagccagcggcagtgtccgaagaactgaagttggccgtaatccagggcctgagcacattgatgcatagcgcctacggcgacattatcctgacgttttatgagcctagcatcttgcccaggctggggtttgccgtgtccctgcttctcggtctggccgagcaggagaagagtaaacaaatcaagattgcagccctaaagtgcttgcaggtacttctgctacagtgcgactgccaagaccatcccaggtcactggatgaactggagcagaagcagctgggggatctgtttgcaagttttttgcccggaatcagtactgcccttacgagactcatcacaggagacttcaagcaaggacatagtatcgtcgtaagcagcctaaaaattttctacaagaccgtgtcctttatcatggctgacgaacagttaaaacggatttctaaggtccaggcaaagcccgctgtagagcaccgggtcgccgagctcatggtgtaccgagaagctgactgggtcaaaaagacaggcgataaactcacaattttaatcaagaaaatcatcgagtgtgtgtctgtgcacccccattggaaagtgcggctggagttagtggagctggtagaggacttactgctcaagtgttctcaatctctggtcgagtgtgcaggcccactgctgaaagccctggtcggactcgtgaacgatgagtccccagaaattcaggcacaatgcaacaaggtgttacgccatttcgctgatcagaaggtcgtcgttgggaacaaggctctcgctgacatcctgagcgagtctctccactccctcgccactagtttgcctcggctaatgaactcccaggatgatcaaggcaaatttagcacgctgagcctcctgttgggctacctcaagctactaggtcccaagattaatttcgttctaaatagcgttgcacacttgcagcgcctgtctaaggcacttattcaggtcctcgagctcgacgtagccgacattaagatcgtggaggaacgaagatggaattcagatgaccttaacgcttctccaaaaacaagcgccactcagccatggaaccgtatccagagaagatactttagattttttacagatgaacggatcttcatgttgctcagacaagtgtgccaacttctgggctattacgggaatctgtacttgttagtggatcacttcatggagttgtatcaccagtcggtggtctataggaaacaggcggctatgattctgaacgagcttgtgactggcgctgccggacttgaggtggaggatctgcatgagaagcacattaagacgaatcctgaagagctgagggagattgttaccagcatcctggaggagtatacgagccaagagaactggtacttggtgacctgtctggaaaccgaagagatgggcgaggagctgatgatggaacatccaggtcttcaggcgataacctccggcgaacacacctgccaggtgactagttttttagcattttcaaagccaagtcccaccatttgtagcatgaatagcaacatatggcagatttgtatccagctggaaggcattggtcagtttgcatatgccctcggcaaggatttctgtctgctgctaatgagcgcattatatccagttcttgaaaaagctggggaccagactctcctgatttctcaagtggccactagcacaatgatggacgtgtgtagggcctgtggatacgatagcctccagcacttgataaatcagaattctgactacctggtcaatggcattagtctgaacctacgccacttagctctgcatccgcataccccgaaagtgctggaggtcatgcttcgcaattcggatgctaacctgctccctcttgtggctgacgtagtacaggacgtgctggctaccctcgatcaattctacgataagcgggctgcaagctttgtaagcgtgctgcatgcattaatggcagcactggctcaatggttcccagacaccggaaacctgggccatttgcaggagcagtccctgggggaggagggctcacacctgaaccagcgcccagccgctctggagaaaagtaccaccacagctgaggacatagagcagttcctgctcaactaccttaaagaaaaggatgtggccgatggcaacgttagcgacttcgacaatgaggaggaggaacagagtgttccgccaaaggtggacgaaaatgacacacgcccagacgtagaacctccgttgccccttcagatccagattgctatggatgtgatggagaggtgtattcacctgctttcggacaagaaccttcaaattaggctcaaggttcttgatgtcttagacctctgtgtagtggtcctccagagccataaaaaccaactactgcctcttgcacatcaggcatggccttctctcgtccatagactcaccagagatgccccactggctgtgttgagagcgtttaaagtcctacggacactgggttccaagtgcggggatttcctgaggtcccggttttgcaaggacgttctgccaaagttggctggttcattggttacacaggcacctatttcagctcgtgccggtcccgtgtattcccatactctggcctttaagttacagcttgccgtgctccaagggctaggcccactctgtgaacgcctggacctgggtgagggggacctcaacaaagttgccgacgcctgtctcatctatctgagcgttaagcagcctgtcaagttgcaagaagcagcacggagtgtttttcttcatcttatgaaagtggacccagacagtacgtggtttctcctgaacgaattgtactgccctgtccaatttaccccacctcatcctagtctgcatcctgttcagctgcacggtgccagtgggcagcagaacccttacaccacaaacgtcctacagctcttgaaggaacttcagtag

SEQ ID NO: 243694 - DNA, 1527 bp, Artificial Sequence
  Description of Artificial Sequence: Synthetic coding sequence
atggagctggactctgccttggaagccccatcgcaggaggactctaacttaagcgaggagctcagccatagcgcttttgggcaagcgttctcgaaaatactccattgtttagctagacctgaagccagacgtggcaacgttaaagacgccgttcttaaggacctgggggatcttatcgaggccacggagtttgatcggctttttgaaggaacgggagcgagactgagagggatgccagaaacgctgggacaggtggcgaaagcactggagaagtatgctgccccaagcaaggaggaggagggcggaggcgacggacatagtgaggccgcagaaaaggccgctcaggttgggttgcttttccttaaattgctggggaaggtcgaaaccgccaaaaactcactggtgggacccgcttggcagaccggactgcaccacctggccggacctgtgtacattttcgcaatcactcactccctggagcagccatggaccacccctcgcagccgcgaggtcgccagagaggtgctaactagtttattgcaagtgaccgagtgcggaagcgtggccggattcttgcatggcgagaacgaggacgaaaaaggtcgtttgagcgtcatcctaggcctgcttaagcctgatctttataaggaaagttggaaaaataatcctgcaatcaaacatgttttcagctggactctgcagcaggttacaaggccgtggctctctcagcaccttgaacgtgtattacccgcatcgcttgtgattagtgacgattaccagactgagaataagatattgggcgtgcattgcctgcatcatattgtgttgaacgtccctgctgcagacctgctgcaatataacagagcacaagtgttgtaccatgccatttccaaccatctctacactccagaacaccaccttattcaggccgtcctgctgtgtttacttgatctgtttcctatcctcgaaaagacattacactggaagggagacggggcacggccaaccacacactgtgacgaggtcctgaggctcatccttactcatatggagccagagcaccggctgctgctgcggaggacatatgctaggaatctgcctgccttcgtaaacagacttggcatactgacagtgcgacacctcaagcgcctagagcgggtgataattgggtatctcgaagtgtacgacgggccagaggaggaggccaggttgaagatactggaaaccctcaaactgctcatgcagcatacatggcccagggtctcttgtcggttggtggtgctgctgaaggccctgctgaaactgatttgcgacgtggcacgtgatccaaatctgacaccggagagtgttaagagcgcacttctccaggaagccacagattgcctgatccttctggataggtgctcccaggggagagtcaaggggctgctggcaaagatcccgcagagctgcgaagacagaaaggttgtcaactacatcagaaaggtccagcaggtctcagaaggggcaccctataatggaacttag

SEQ ID NO: 243695 - DNA, 1527 bp, Artificial Sequence
  Description of Artificial Sequence: Synthetic coding sequence
atggagcttgacagtgcactcgaggccccttcgcaagaagattctaacctgagtgaggagttatctcatagcgcattcgggcaggcatttagcaagatcctgcattgcctcgccaggcctgaagctaggcgtggtaatgtcaaggacgctgtgcttaaggatctaggcgacttgatcgaggccactgaattcgatagactgttcgagggcacgggcgcacgtctacggggtatgcccgaaacactgggacaagtcgccaaggctctagaaaaatatgctgctccttctaaggaagaagaaggcggaggggacgggcactccgaggctgccgagaaagctgcccaggtaggcttgttatttctcaagttgctcggtaaggtagaaaccgccaaaaactcccttgttggaccggcttggcagactggattgcaccaccttgcgggaccagtgtatatcttcgctatcactcattccttggagcaaccttggactactcctaggagcagagaagtagcacgcgaggtgctgacaagcctgctacaagtaaccgagtgcgggtccgtcgccggatttcttcacggcgagaacgaggacgaaaaaggcaggttaagcgtgatcctcggtcttctcaaaccagatctctacaaagagtcatggaagaacaacccagccatcaaacacgtttttagctggactctgcagcaggtgacccgaccatggctttcccagcaccttgagagagtccttcccgctagccttgtaattagcgatgactatcagaccgagaacaaaatcctgggcgtccattgcctccaccatattgttctgaacgtgcctgccgctgacttgcttcagtacaaccgagcacaggtattataccacgccatcagcaatcacttgtacacaccggagcatcacttgattcaggcagtcctgctatgcctgttggatctctttccaattctggagaaaaccctgcattggaaaggagacggggctcgtcctaccacacactgcgatgaggtactcaggctaatactgactcacatggaacccgaacatcgattgcttctgcgcaggacctatgccaggaaccttccagcgttcgtgaacagactaggcatactgacagtcaggcatttgaagcggttggaacgggtgatcattggatatcttgaggtgtacgatggcccagaagaggaggcaagactgaagatccttgaaaccctcaagctgttaatgcagcatacttggccacgggtctcctgtcggcttgtagtgttgctgaaagccctgctcaagctgatatgtgatgtggcccgtgatcctaaccttactccagagagcgtgaagtccgccctgctgcaggaggcgacagactgtctcattctactggatagatgttcccaaggtagagtgaaaggactcctcgccaaaattcctcaatcttgtgaagaccgcaaagtcgttaattacatcagaaaagtgcagcaggtgagcgaaggagccccttacaacggtacctag

SEQ ID NO: 243696 - DNA, 1494 bp, Artificial Sequence
  Description of Artificial Sequence: Synthetic coding sequence
atggaattagacagcgcactcgaggccccaagtcaagaggacagtaatctaagtgaggaattaagccacagcgcctttggccaggcgtttagtaaaattttgcattgtcttgctcgaccagaggctaggcgaggcaacgtgaaagacgccgtactgaaagatctcggagatctgattgaagcaaccgaattcgatcgtctgtttgaaggaactggcgcaagactccgcggaatgccggagactctggggcaggtggcaaaagcgttagaaaagtacgctgctcctagcaaggaagaggaaggcggaggagatggacattctgaggcggcagagaaagcggctcaggtaggattgttgttcctgaagcttttgggcaaggtagagaccgctaagaactctcttgtgggcccagcttggcaaactggtcttcaccatttagcaggtccagtatacatcttcgccatcactcactctctagaacagccatggaccactcccaggtccagggaagttgctcgcgaagtgctcactagcctgctgcaggtgaccgaatgtggaagcgtggctggcttcttgcatggtgagaacgaggacgagaagggacggctttccgtaatcctgggcctcctgaagcccgacctgtacaaggagtcttggaaaaataaccctgcaattaaacacgtcttcagctggacactacagcaggtcacacgtccttggctgtcccagcatctcgaacgcgtgttgccagccagcttagtgatcagtgatgactaccagaccgaaaacaagatcctaggcgtgcattgcctccatcacatcgttctcaatgtacccgcagccgacttgctgcagtataaccgagcgcaagtcctctaccacgccatctccaatcatctgtatacaccagaacatcacctgatacaagctgtgctactgtgcctgctcgacctctttcccattctcgaaaagaccctccattggaagggggatggagccagaccaaccacacattgcgacgaagtcctgagattaattcttacccatatggaaccagaacaccggctgctgctgaggcgcacctacgcgcgaaatttgcctgcctttgtgaaccggttggagcgcgttatcatcggttatctggaagtttacgacggcccagaagaagaggctcgactgaaaatcttagagactctgaaacttcttatgcaacatacctggccacgggtctcttgtaggctcgtagtgctgctgaaggccttgttgaaactgatatgtgacgttgccagagatcctaacctgacccctgagtctgtgaagtccgcccttctgcaggaagccaccgactgtttgatcctgctcgatagatgcagtcaggggagagtcaaggggttgctggcaaaaattccacagtcctgcgaggatcgcaaggtcgtaaattatattcgaaaagttcaacaggtaagtgagggcgcaccatacaatgggacgtag

SEQ ID NO: 243697 - DNA, 306 bp, Artificial Sequence
  Description of Artificial Sequence: Synthetic coding sequence
atggagttggactccgctttagaggcacctagccaggaagacagcaacctctccgaagaattatcacatagcgcattcggacaggccttttccaagatcctgcattgcttggcaagacctgaggcacgcagaggcaacgtcaaagacgctgtgctgaaagatctcggtgacttgattgaggccacagaattcgatcggctgttcgaagggactggagccagactgcgtggaatgcctgaaactctggggcaggtcgccaaggccttggagaagtatgctgccccttcaaaagaggaggagggctag

SEQ ID NO: 243698 - DNA, 2424 bp, Artificial Sequence
  Description of Artificial Sequence: Synthetic coding sequence
atgcccagggctcccaggtgcagggccgtgcgatcgttgctgaggagccactaccgagaggtgttgccacttgctacttttgttcgacgtctaggcccacaggggtggagacttgtccagcgcggagatccagccgcatttagggcgcttgtggcccagtgtcttgtgtgcgtcccttgggatgcacgaccacctccggcagccccaagctttagacaagtatcttgtcttaaagaactggtggccagggtcctgcagcgtctgtgcgaacggggagctaaaaacgtccttgcattcgggttcgcattgctggatggggctcgcggtggccctcctgaggcatttactactagtgtgcggtcttacttacccaacaccgtcacagacgccctgcgaggatcgggggcttggggtttactactccgcagggtgggggacgacgtgttggtgcatctactcgcccgatgtgccctttttgtgttggtggccccaagctgcgcataccaagtatgcggtcctccactgtatcagctcggagcggcaacacaagctcgcccaccgccacatgccagtggacccaggaggcgcctggggtgcgagagagcatggaatcactcagttcgcgaagcaggagtccccttgggactcccagcacctggcgcacggaggaggggaggatctgcaagtcgctctctgcctctgccaaagcgtcctcgcaggggagctgctccagaacccgaaagaacccctgtgggtcaggggagttgggcccaccctggacggactcgaggaccctccgaccgcggtttttgtgtagtatcgccggcaagacccgctgaagaggccacctccctggaaggggctctgtcggggactcggcattcgcatccttctgtcgggcgtcagcaccatgccggacctcccagcacttcaagaccacccagaccctgggataccccctgtcctcctgtgtacgccgagacaaaacatttcctctatagtagcggagataaggaacagcttcgacctagcttcttactgagttccctccggcctagcctcacaggcgctcgcaggctcgtggaaacaattttcttagggagtaggccctggatgccaggaactccaaggcggctccccagactgccacagcggtattggcagatgagaccactgttcttggagctcctaggcaatcacgctcagtgcccctatggggtcctgttaaagacacattgcccccttagggccgctgtgactccggcagctggagtgtgcgctcgtgaaaagccgcaaggttcagtggctgctccagaggaggaagacactgacccccgacgtttggtgcaacttctgcgacaacacagttctccgtggcaggtatatgggtttgtgagagcatgccttagaaggctggtccctcccggactttggggcagccggcacaacgagaggagatttttgaggaatacaaaaaagtttatttctctcggtaagcacgccaagctctctctgcaggaacttacttggaagatgtccgttcgagattgtgcgtggctgcggcgaagcccgggagtggggtgtgtgcccgctgccgaacataggctaagggaggagatccttgctaaattcctgcactggttaatgagcgtgtacgtggtggagctgttgaggagctttttctacgtcaccgagacgacctttcagaagaatcggctgtttttctacagaaagtctgtctggagcaagttgcagagtatcggtatcaggcaacatcttaaacgcgtccaactgcgggagctcagcgaagctgaggtgcggcaacatagagaagcccgacctgctcttttgactagtaggttgaggttcatcccaaaacctgatggattgcgacctattgtgaatatggattatgtggtaggcgctcgtacttttcgcagggaaaaacgagccgaaaggttgacctcacgcgtgaaggcactgttttcggtattaaattacgagcgagcccgacggcctggtctgctgggggctagcgttcttggcctggacgacatccatcgcgcttggagaacatttgtgcttcgggtcagagcacaggatccccctcccgagttgtatttcgtcaaagtggatgtgacaggagcctacgatacgatccctcaagacagacttactgaagtgattgccagtataattaaacctcagaacacttactgtgttcgaagatacgccgtcgtgcagaaggccgctcacggacatgtgagaaaggctttcaaaagtcacgtcctgcgacccgttccaggggatcctgctggtctgcatcctttacatgccgcattacagccagtcctacggagacatggcgagcaggctgtctgcggagactcagctggtcgggcagcgccagccttcggcggatag

SEQ ID NO: 243699 - DNA, 3399 bp, Artificial Sequence
  Description of Artificial Sequence: Synthetic coding sequence
atgcccagggcgccaaggtgcagggccgttaggtctctcttgcgttctcattatcgggaggtcctgccccttgccactttcgtgcgccgactcggccctcaaggatggaggctggtccaacgcggagatccggcagcgtttcgggctcttgtggcccagtgcttagtttgcgtgccctgggacgcgcgtcctcccccagcagccccatctttcagacaggtcagttgtctgaaagaattggtggctagggttctgcagcgcctgtgtgagagaggagctaagaatgtgctggcttttgggttcgccttgttggatggggcaaggggaggtcctccagaggctttcactacgtctgtgagatcttaccttcccaacactgtcaccgatgcactgaggggaagtggcgcatgggggctactgttgcgtcgggtcggtgacgacgtgctcgttcatctgctggctcgctgtgctctctttgtgctggtagccccaagttgcgcttaccaggtgtgcggccctcctctgtatcagctcggcgcagcaacccaggccaggccccctcctcatgcgtctggccctcgcagaaggctgggatgtgaacgcgcatggaaccactcggtcagggaggctggagtgcctctggggttacccgctcctggagctagacgtcgtggcggaagtgcttccagatcccttcccctccccaagcggccaaggaggggcgcagctcccgagccagagcgtacccccgtcgggcaagggagctgggcccacccaggtagaaccagagggccttcagacaggggcttttgtgtggtatcaccagcccgtcctgctgaggaggccacctcactagagggcgcattgtctgggacccgtcattcacacccttcagtagggagacaacaccatgccggaccaccctcaaccagcaggccacccagaccttgggataccccatgtcctccagtatacgccgagacaaagcatttcttatattccagtggcgacaaggaacagttaagaccgtcatttctcctcagtagtctgcgaccctctcttactggcgcacgccgactggtcgagaccatattcctgggcagcaggccatggatgccagggacccctaggaggctacccagactgccccagcgatactggcagatgcgtcctctcttcttggagctgttgggcaaccacgctcaatgcccctacggtgtgctcctcaaaactcactgccctctgagagcagccgtcacacccgctgccggagtctgcgcaagggagaaaccccagggctccgtcgcagcccctgaggaagaagacacagaccccaggcgcctcgtccaactcctgcgtcagcacagctcaccatggcaggtctacggtttcgtgcgcgcttgtctgagaaggctggtgccacctggactttggggaagtcgacacaacgagcgtcgttttctgcgaaacacgaagaagttcatttcattggggaaacatgctaaactgagtctgcaggagttaacgtggaagatgagtgtgagagattgcgcctggttgcgcaggtctcccggagtaggttgtgtgccagcagcagagcataggctccgtgaggagatcctcgccaaatttctccattggttaatgagtgtgtacgtggttgagcttttgcgctcttttttctatgtgacagaaacaactttccagaagaatcgattgttcttttaccgcaaatcagtctggagcaaactacagtccattggaattagacagcacttgaaaagagtgcagttacgggaactgtctgaagccgaagtacgccagcacagggaggcacggccagccttgctaacatcgcgcttaaggttcatcccaaagcctgatgggctgcggcctatcgttaatatggattatgtggtcggtgctaggaccttccgcagggagaagagggcggagcgcctgacaagccgcgttaaggcactgttttccgtgctgaactatgagcgtgctcgaagacctggtctgctgggcgcatccgtactcggcttggacgatatccatcgagcctggcggacctttgtgctcagagtcagagcacaggacccgcctcccgaactctacttcgtgaaggtcgatgtgaccggggcttatgataccattccccaggaccgcctgactgaggtcatcgcttccatcatcaaaccgcaaaatacttattgtgtcagacgatacgccgttgtgcagaaggccgcacatggccacgtgcgcaaggcattcaaatcccatgtgtcaactcttaccgacctgcagccctatatgagacaatttgtcgcgcacctgcaggagacttcgccactgcgtgatgcagtcgtgatcgaacaatcttcatccctaaacgaggcctctagcggtttatttgatgtgtttctgaggttcatgtgtcatcacgcagtgcgcatcagagggaagagctatgttcagtgccagggtattcctcaggggtccatcctctcaacattgctgtgtagcctctgttatggcgatatggaaaacaagttatttgctgggattaggagggacgggcttctcctccgcctggtggacgactttcttctcgttacgccacatcttactcatgccaaaacctttctccgcactttggtgcgcggagtgcctgagtatggttgtgtggttaatctgcggaaaacagtggtgaattttcccgttgaagacgaagcccttggcggaactgctttcgtccagatgcccgctcacggattgttcccttggtgcggtctcttgttggacacacggaccttagaggttcaatccgactacagtagttatgctcggacctctatccgcgcttcgcttactttcaatcgcggtttcaaggccggtcggaacatgcgcaggaaactctttggagtcctgcgcctcaagtgtcattcactcttcctggaccttcaggtcaattcacttcagacagtttgcaccaatatttacaagatcctcctcttgcaagcctatcgtttccacgcttgtgtcctgcaactcccattccatcagcaggtgtggaaaaatcccacatttttcctccgggttattagcgatacggcctccttgtgctatagcatcctgaaagcaaagaacgccggaatgtcactgggggctaaaggagcagcaggacccttgccgtccgaggcagttcagtggctatgccatcaagctttcctgctgaagttgacccgccacagagtgacgtatgttcctctgctgggttcactccggaccgcgcagacacagttgtctaggaaactgccgggtacaaccctcactgcactggaagcggctgccaatcctgctctaccatccgacttcaaaacaattctggattag

SEQ ID NO: 243700 - DNA, 3210 bp, Artificial Sequence
  Description of Artificial Sequence: Synthetic coding sequence
atgcccagggctccgaggtgtcgggctgtccgttcacttctccgctcccactaccgggaggtcctgcctctggcaaccttcgtgagacgactgggaccgcagggctggaggctggttcagcgaggtgatcccgcagcattcagagcccttgtcgctcaatgtttagtatgcgtcccgtgggatgccagaccccctccagccgcaccaagtttcagacaagtgtcttgtctgaaggaattagtggctcgggtgctacagcgcctgtgtgagcgaggggctaaaaatgtgctcgcattcggatttgccttattagacggggcacgaggaggtccacctgaagcgtttaccaccagcgtcaggtcctatctccccaatactgtcacagatgccctgaggggctccggggcttggggactactgctcagacgcgtgggcgacgatgtcctggtgcatctgctggctcgatgcgccctgtttgtcctagtggccccatcatgcgcataccaggtgtgtggccctcccctgtaccaactgggcgctgcaacccaggctcgcccaccgccacacgctagtggccctcgtaggcgcttggggtgtgagcgtgcctggaatcatagcgtacgagaggctggcgtacctcttgggttacctgcccctggtgcccgtagacgcggtgggagcgcatctcggtcccttccactgcctaagcggcctcggagaggggctgccccagaaccggagcgaactccggtaggtcagggatcttgggctcatccgggtaggacaagaggcccatcggatagggggttctgtgtggtctcaccagcacgcccagccgaagaagccacaagtctggaaggcgctctatctggcactcggcactcacacccatccgtcggaagacagcaccatgcaggaccaccgagcacttctcgcccaccgcgaccctgggatactccgtgccctcctgtatatgctgagacaaaacacttcctgtacagcagtggcgacaaggagcagttaaggccctcctttctgctctcctccctgaggccatctctgacgggcgcaagaagattggtggaaaccatattcttaggcagccggccatggatgccagggactcctcggaggctacctcgcttgcctcagcgatactggcagatgcgcccactgttcctggaactgcttggtaatcatgcccaatgtccatatggagtgctcttaaagacacattgccctttacgggctgccgtgactccagccgcaggcgtgtgcgctcgcgaaaaaccccaggggtcagtcgccgctcccgaggaagaagacaccgacccaagacgcctggtgcagctcctgagacagcattcatctccttggcaagtctacggcttcgtcagggcctgcctgcgacgtctggtcccacccggtctctggggttcccgccacaacgagcgacggtttcttcgcaataccaagaaattcatcagcctcggcaagcacgccaagctatcactgcaggagttaacttggaaaatgagtgtccgtgactgcgcctggctgaggcgctctccaggggtgggttgcgtgccggcagcggagcaccgcctgcgggaagaaattcttgcaaagttccttcactggctgatgtccgtttatgtagtcgagttactgcgctcgtttttttatgtgacggagactaccttccagaagaaccgattatttttctacagaaaaagcgtgtggagcaagttgcagagtataggtatcaggcaacacctcaaaagagtccagttgcgagagctgagcgaagcagaggtgcgacagcatagggaggccagaccagctctgttgactagccgtttgagatttattccaaagcccgatggactgcgccctatcgtaaatatggactatgtggttggagcccgtacgtttcgcagggaaaagcgggcagagcgactaacctcccgggtgaaagctctgttttccgtgctaaactacgaaagggcccgacggcctggtctcttaggtgcgagtgttcttgggttagatgacatccatcgtgcatggcgaacgttcgtccttagggtaagagcccaggatccaccacccgaactgtactttgtgaaggtagacgtgaccggggcatatgacactattcctcaggaccgactgacagaggtgattgcctccataatcaaaccccagaacacatattgtgtgagacgttatgcggtcgtgcagaaggcagctcatggtcacgtgagaaaggccttcaaaagccacgtctctacgctgacagatcttcagccatacatgcgccaattcgttgcacacctccaggagacctcgcctttgagagacgctgtggttattgaacagtcttctagtctcaatgaagcttcaagtggtcttttcgatgtgttcttgagattcatgtgccaccacgctgtgcgcatccggggtaagagttatgttcagtgccaggggatacctcaaggcagcatactgtctaccctgctttgttctctctgttatggggatatggaaaacaaactgtttgctgggataagacgcgacggtctgctgctgagactggtcgacgactttcttctagtgaccccccacttaacacatgctaagacgtttctgtcgtacgcgaggacaagcatacgcgcatcgctcacttttaatagagggtttaaggctggacggaatatgcgcaggaaattgtttggggtgttacggctgaagtgtcactccctattcctggacttacaggtaaatagccttcagacagtgtgtacaaacatatataaaattttgctcctgcaggcctataggttccacgcctgcgttctgcagttgccttttcatcagcaagtctggaaaaacccgactttttttctgcgtgtcatctcagacaccgcatccctctgctacagcattcttaaggccaaaaacgctgggatgagtctcggcgctaaaggggcagcaggccctcttccctccgaggctgtccagtggctctgtcaccaggcctttctcctgaagcttacgagacatagggttacttatgtccccctgctcggctctctcagaaccgcgcaaacccagttaagtcggaaactccccggaacgacactgactgcactggaagcagcagccaacccagccctgccgtctgattttaaaactattttggattag

SEQ ID NO: 243701 - DNA, 2424 bp, Artificial Sequence
  Description of Artificial Sequence: Synthetic coding sequence
atgccaagagctccccgatgccgcgctgttaggtccctgttgagatcacattacagggaggtcctgcccctcgctaccttcgtccggagactgggacctcagggctggagacttgtgcagcgtggagatcctgcagcattcagagctctggtcgcacagtgcctcgtgtgcgtgccgtgggacgccagaccacccccagccgctccctcttttcggcaggtgtcatgccttaaggagctggtagcacgggtgctccagagactgtgtgaacggggtgccaagaacgtactggcatttggcttcgccctcctcgacggtgccagaggcggacctcctgaagcgttcaccacctccgtgcgtagctacttgcctaatacggttacagacgcgcttagggggagtggagcctggggtctgctcctcaggcgcgttggtgatgatgtgctcgtgcaccttttggccaggtgcgcgctgtttgtattggtggctccatcttgtgcctatcaggtgtgtggtccaccgctgtatcaacttggtgctgctacgcaggctagacccccaccacatgccagcgggcctcgcaggagactgggctgtgaacgggcttggaaccacagcgtgcgggaggcaggagtaccccttggcctgcctgccccaggcgctcggagaagaggtggctccgctagccgcagtctccctctgccaaagcggcctcggagaggtgctgcaccagagccagagagaacccccgtgggccagggaagctgggctcacccaggccgaacgcggggaccttccgatagaggcttttgtgtcgtgagcccagctcgacctgccgaggaggctaccagcttggaaggcgctctttccggcacgcgccacagccatcccagcgttgggaggcagcaccacgccggacctcccagcacaagtcggccaccacggccttgggacacgccttgtcccccagtatatgccgagacaaaacacttcctttattcatccggtgacaaagagcaactaaggccttcttttctgctgagctccctccggccatccctgactggagctagaagactggttgaaacaatcttccttggcagccgcccttggatgcctggcactcccagaaggttgccacgactcccccagcgatactggcagatgaggcccctatttctggaattgctcggcaatcacgcccagtgcccttacggcgtgctgctcaagactcattgcccgctacgggcagccgtaactccggctgccggagtgtgcgccagggagaagccgcagggctctgtggccgcacccgaagaggaagatacggatcctagaaggttagttcagttgcttcgccagcactcttcgccctggcaagtctatgggttcgtccgagcatgcctgcgaagattagtgccacccggactttggggatcaaggcataatgagcgcagattcctgcgaaacactaaaaaattcatctcgctcggcaagcacgctaaacttagccttcaggagttgacctggaagatgtctgttcgcgattgtgcatggttaaggcggtcacccggagtgggctgcgtgccggctgctgagcacagactgagagaggaaattctggcaaagttcctgcattggctgatgtcagtgtatgtggttgaattgttgcgctcatttttttacgtgacggagaccacattccagaagaaccgcctcttcttctataggaagagtgtctggtccaagttgcagagtattgggatcaggcagcaccttaaacgggtgcaattgagggagctgagcgaggccgaggttaggcaacacagggaggcaagaccggctttgcttacaagccgcctgaggtttatccctaagcctgacgggttacggccaatcgtgaatatggattacgttgttggcgctagaacctttagacgggagaagcgcgctgagcgactgacatcaagggtgaaagccctgttttccgtcctgaactatgagcgggctcgccgacctggtctcctcggcgctagcgtgctcggtcttgacgatattcatcgggcttggcgcaccttcgtcctgcgagtcagagcacaggatcccccaccggagctgtacttcgtcaaggtggacgtcacaggcgcatacgatacaatccctcaggatagattgacagaggttattgcatcaatcatcaaacctcagaacacctattgcgtcagacgctacgctgtggtacagaaagccgcacatggacatgtcagaaaggcgttcaagtcgcacgttctgcgcccagttcccggtgaccctgccggtctgcatcctctccacgccgctctgcagccggtactgagaagacatggagaacaggcagtctgtggagactctgctggccgtgctgccccagctttcggagggtag

SEQ ID NO: 243702 - DNA, 372 bp, Artificial Sequence
  Description of Artificial Sequence: Synthetic coding sequence
atgatgttgccgaagccgggaacttactatttgccctgggaagtcagtgccggtcaggtgccagatggcagtaccttaaggaccttcggcagactgtgcctgtatgacatgatccaaagtcgcgtgaccttgatggctcagcacggaagcgatcagcatcaagtgcttgtgtgtaccaagctagtcgagccctttcatgctcaggtgggaagtctctacattgtactgggtgaactccagcaccagcaggaccggggaagcgtggttaaggcgcgtgtgctcacttgtgtcgaaggaatgaatctacctctcctcgaacaggctatccgagagcagaggctttacaagcaggagcggggaggctcacagtag

SEQ ID NO: 243703 - DNA, 369 bp, Artificial Sequence
  Description of Artificial Sequence: Synthetic coding sequence
atgcttcctaaacccggtacctactatttgccttgggaagtctctgccggacaggtcccagatggttctacattacgcacctttggacgactctgcctgtacgatatgatacagtcccgcgttaccctcatggcacagcacggaagcgaccaacatcaggtgctggtgtgtaccaaactggtggagccgttccacgcccaagtgggcagcctgtatattgtgttgggcgagctgcagcatcagcaggacagaggctcagtagtaaaagcgcgtgtgctgacatgtgtggagggcatgaacctgcccctgttagagcaggcaattcgtgaacagcgactctacaaacaagagcgcggaggaagccaatag

SEQ ID NO: 243704 - DNA, 5514 bp, Artificial Sequence
  Description of Artificial Sequence: Synthetic coding sequence
atgggagcaatgacccagctgctggctggagtgtttctcgcgttcctggctctggcgactgaaggaggcgtgctgaaaaaggtcatcagacataagcgccagagtggagtcaatgcaacccttccagaggagaaccagccagtggtcttcaatcatgtttataacatcaagttgccggtaggatctcaatgcagtgtggacttggaatcggcctccggtgagaaggatcttgcccctccctccgagccttccgaaagcttccaggaacatacagtcgacggcgaaaaccagatcgtctttacgcaccggataaacatccccagaagagcttgcggttgcgcagcggctcccgacgtcaaagagcttttgtctcggttagaggagttggagaatctggttagttccctgcgggaacaatgtacagccggagcgggatgttgcttgcagcctgcaacgggcaggctggatacacgcccattttgctccgggagagggaatttctcgaccgaaggctgtgggtgcgtctgtgagccgggatggaaggggcctaactgtagcgagcctgaatgccccggaaattgccaccttaggggcaggtgcatcgatggccagtgtatctgcgatgatggtttcaccggagaagactgcagtcagctggcttgcccctccgactgtaatgatcagggcaaatgcgtcaatggagtgtgtatctgctttgaggggtacgctggagcagattgctcccgtgagatttgcccagttccgtgttctgaggaacacggaacctgtgtcgacggactttgcgtatgccatgacggatttgccggagacgactgcaacaagcctctctgtctgaacaattgctacaatagaggcaggtgcgttgaaaatgagtgtgtgtgcgacgaagggtttactggtgaagattgctcagaactaatatgccctaacgactgttttgataggggcagatgtattaatggaacatgctactgtgaggaaggatttaccggcgaggactgcggaaagccaacttgcccccacgcctgtcacactcaggggagatgcgaggaggggcagtgcgtttgtgacgagggcttcgcaggggtggactgcagcgagaagcgctgccccgctgattgccacaacagggggagatgtgtggatggacggtgcgagtgcgatgacggatttaccggtgctgactgtggcgaattaaagtgccccaatgggtgttccgggcatggacggtgcgtaaacggacagtgcgtttgtgacgaaggatatacgggcgaggattgttctcagctaaggtgcccaaatgactgtcacagcaggggtcgttgtgtggaaggcaagtgtgtgtgtgagcaggggttcaagggttacgattgcagcgatatgagctgccccaatgattgtcaccagcacggccgatgcgtcaatggcatgtgtgtttgcgacgatggatacaccggggaggactgtagagatcgacagtgcccccgagactgctcaaacaggggcctctgcgtggacgggcaatgtgtgtgtgaggacggatttactggccctgactgcgccgaactttcttgcccaaacgattgccacgggcagggacgctgcgtcaacggacagtgcgtctgccacgaaggcttcatgggaaaagattgcaaagaacagcggtgtccctcagactgccacggccagggtcgatgtgtggacgggcagtgcatctgccacgaggggttcactggattggattgcgggcagcacagttgtccgagcgattgcaacaatcttggccaatgcgtgtccgggagatgcatatgcaatgaaggctacagcggggaagactgcagtgaagtctcccccccaaaagacttagtggttacagaggtgactgaagaaacagttaatctggcctgggacaacgagatgagggtgacagaatacctcgttgtctacacccctacccacgaaggaggtttggagatgcaattcagagttcccggagaccagacctcaactatcatacaagagctggaacccggtgtggaatactttattagagtgttcgcaatactggaaaataagaaaagtatccccgtctccgccagagtggccacctatctgccagcaccagaaggccttaagttcaaaagcattaaagagacatcagttgaagtggagtgggaccccttggacattgcttttgagacttgggagattatctttcggaacatgaacaaggaggacgaaggagaaatcaccaaatctttgcgcagacccgagacctcctacagacagaccggtctggcacctggacaagaatatgaaatttccttgcacatcgtcaaaaacaatacccgcggtccgggattaaagagagtcaccactacccgattagatgcccctagccagatcgaagttaaagatgttactgatactacagctttgatcacttggttcaagcccctcgctgagatagacgggatcgagctgacatatggcatcaaagatgtgcctggggatagaacaaccattgatctgactgaagacgaaaatcaatacagcattggaaacttgaagcccgacactgagtacgaggtgtcactgatctcacgtaggggggacatgtcttccaacccagcgaaagaaacattcacaaccggcttggacgctccacgaaatttgcgccgagtgagccagacagataacagcatcacattggaatggagaaatggcaaagctgcaatcgatagttatcggattaagtatgctcccataagtgggggtgaccatgccgaggttgatgtgccaaagtctcaacaggcaacaaccaaaaccaccctcacagggctgcgtcctggaacagaatatggcatcggcgtgtcagctgtaaaagaggataaagaatccaacccagcaactatcaatgccgctacagagctcgacactcctaaggatctccaagtgtcagaaacggccgagaccagtctcacactgctgtggaagacccctctggcaaaattcgatagataccggctcaactactcccttcccacaggacagtgggttggcgttcagctgcctaggaataccacatcttatgtgcttaggggtctggaaccgggtcaggagtacaatgttcttcttaccgccgagaagggtcggcataagtccaagcccgctcgggtgaaagcttctaccgcaaaggaacccgagattggcaatctcaatgtcagtgacattacaccagagtctttcaacctcagttggatggccaccgatggcatcttcgagacattcacaatagagattatcgattccaatcgcctcctggaaacagtggagtacaatattagcggtgctgaacggaccgcacacatctccggactgcccccatcaactgacttcattgtatacctgtccggactagcaccgtctatcaggacaaagactatctccgccacggctaccactgaggctctgcccctactggaaaacttgacaatatccgacataaatccctacgggtttaccgtgtcctggatggcctctgaaaacgccttcgacagctttctggttacagtcgttgacagcggtaaactgctcgaccctcaggaattcaccctttcaggcacccagaggaaactggaattgagggggttaattaccggaatcgggtacgaggttatggtgtctggattcacacaggggcatcagactaagcctttacgagccgagatcgttacagaggcggaaccagaggtggataatttactcgtgtccgatgccacaccagatggtttccgcctaagttggacagcggacgagggtgttttcgataattttgtgttgaaaattcgcgatacaaagaagcaatccgagccgctggaaatcaccctcctggcccctgagcgtacccgcgacatcactggcttgagggaggcgactgagtacgagatcgaactgtatgggatcagtaaggggaggagatctcaaactgtgtctgccattgcaaccacagccatgggaagtccaaaagaggtcatcttctctgacataaccgagaactcagctacggtgagctggcgcgctcccaccgctcaggtggagtcttttcggattacctatgtccccatcactgggggaacaccaagcatggttaccgttgatggtacaaaaacacaaaccagattggttaagttaatcccgggagtggagtacctggtgtcaataatcgcaatgaagggatttgaggaatctgaacccgtctccggctctttcaccaccgccttggacgggccttcggggttagtgacggcaaacataactgacagcgaggccctggctagatggcaacccgctatagccactgtcgacagttatgtgatttcctacaccggcgaaaaggtgcccgagatcacccggaccgttagcggtaacaccgttgagtatgcccttaccgatctcgagcctgccactgaatatactctgaggatctttgctgagaaaggaccgcagaaatcctctactattacagccaagtttacgacggatcttgactcaccaagggatctcacagccacagaggttcaatccgagaccgcccttctgacctggcgccctcccagggcctctgtgaccgggtatctcctagtttacgagtctgtggatggaaccgtcaaagaagtcatcgtcggacctgacaccacgtcatatagcctcgccgaccttagtccttccactcactataccgcgaaaattcaggcactgaacggtccgctccgctccaacatgatccaaaccatcttcacaaccatcggactgttgtaccctttcccgaaggactgctcccaggccatgctgaatggtgacactacttccggcttatacaccatatatctcaatggagacaaggctgaggcattggaggtcttctgcgatatgacctctgacggcggtggttggattgtattcttacgacgcaagaacggacgagaaaatttttaccagaactggaaagcctatgctgccggttttggagacagaagagaagaattttggctcgggctggataatctcaacaagattaccgctcagggccagtatgaactgcgcgtcgacctacgcgatcacggcgagactgcatttgcagtgtatgataaattcagcgtcggggatgctaaaactcgctataagctaaaggtggaaggctattctggaactgcgggtgactcaatggcctatcataatggccgtagtttctcaacctttgacaaagacactgattccgcgatcaccaattgtgcactgtcctacaagggggctttctggtaccggaactgccacagggttaaccttatgggcaggtacggggataataatcatagccagggagtgaactggtttcattggaagggacacgaacactccatccaatttgcagagatgaaactcaggccaagcaatttcagaaacctcgaggggaggcgcaagcgcgcttat

SEQ ID NO: 243705 - DNA, 4695 bp, Artificial Sequence
  Description of Artificial Sequence: Synthetic coding sequence
atgggcgctatgactcagctgttggcaggcgtgttcttggcttttctggctctggctaccgagggtggcgtgctcaagaaggtaattcgacacaaaaggcagtccggggtgaacgcaacactgcctgaggaaaatcagccagttgtgtttaaccatgtttacaacattaagttgcctgtaggcagtcaatgcagtgtggatctggaatcagctagtggagaaaaggatctcgcaccaccgtccgagccaagcgagtcttttcaagaacatacagtcgatggcgaaaatcaaatcgtgtttacccatcgaatcaacatccccagaagggcctgtgggtgcgccgctgctccagacgtcaaagagttgctctctcggttggaagagcttgaaaacctggtgtcaagcctgcgagagcaatgcaccgccggtgcagggtgctgcttgcagccagcgactggcagactggatacccggccattttgtagtgggagaggaaactttagcaccgaggggtgcggctgcgtatgtgaaccaggatggaagggccctaactgctcggaaccagagtgtcctggtaattgtcatctaagaggacgctgcatcgatggccaatgcatctgtgatgacggctttacaggagaggattgcagtcagttggcttgtccctctgattgcaatgatcaaggaaagtgcgtgaatggggtctgcatctgtttcgagggatacgccggagccgactgctcccgtgagatttgtcctgtgccttgctctgaggagcatggcacctgtgtcgatggcctctgtgtgtgtcacgacggatttgctggggatgattgtaacaagcctctttgcctgaataactgttataatagaggtcggtgcgtcgagaatgagtgcgtctgtgacgagggctttacaggtgaggactgttccgagctcatctgtccaaatgattgcttcgatagaggccgatgcatcaacgggacttgctactgtgaggaaggctttaccggagaggactgtggcaaacccacttgcccccacgcctgccacacacaaggtcgctgcgaagagggacagtgtgtatgcgacgaggggtttgctggagtggattgttccgagaaaaggtgtcccgcagactgccacaaccggggaagatgtgtggacgggagatgcgagtgcgacgacgggttcactggggcagactgcggagaacttaaatgccctaatggctgtagtggtcatgggcgatgcgtgaatgggcagtgcgtgtgcgatgaaggatataccggggaggactgctcccagctgaggtgtcccaacgactgccatagtcggggaaggtgtgtggaggggaaatgcgtttgcgagcagggattcaagggctatgattgctctgatatgtcatgtccgaacgactgtcaccagcacggcaggtgcgtaaatggaatgtgcgtgtgcgatgacggctatactggcgaagattgccgggaccgtcagtgccctagagattgttccaaccgcggactctgcgtagacggccaatgcgtctgcgaagatggattcaccggaccagactgtgcggagctctcttgccctaatgactgccatggtcagggcaggtgtgtaaatggccagtgcgtgtgtcatgaaggctttatgggaaaggattgtaaagagcagcgttgtcccagcgactgccatgggcagggtagatgcgtggacggacaatgtatctgtcatgaaggcttcacgggcctcgattgtgggcaacacagctgcccttccgattgcaacaacctgggccagtgcgtgagcgggcgatgtatctgtaatgagggttattctggagaagattgctccgaggtgagcccccctaaagatctggtagtgaccgaggtcacggaagaaaccgtcaatcttgcctgggacaacgagatgagagtgacagaataccttgtggtttacaccccaacccacgaggggggtcttgagatgcagtttcgggtgcctggtgatcagacgagtacgatcatccaggaactggagcccggtgtcgagtactttattagggttttcgccatcttggaaaataagaagtctatccctgtatcagcacgcgtcgccacctatctgcctgctccagagggtctcaaatttaaaagcattaaggagaccagtgttgaggtcgaatgggatccactggatatcgcgtttgagacatgggaaattatattccggaatatgaataaagaggatgaaggtgaaattaccaagtctctgcgccgaccagagacctcctatcggcaaacgggactggccccaggacaggaatatgagatctcactccacattgtcaagaacaacactagaggtccaggcttgaaacgggttactactacacgcctcgatgcaccctcccagattgaagtgaaggatgtgaccgacacaaccgccctgatcacctggtttaaacctctggcagagattgatggcatcgagctcacctacgggatcaaagatgtacctggtgacagaaccaccatagacctcacagaagatgaaaatcagtactctatcggcaacttaaagccagacactgagtacgaggtgagtctgatcagtagacgcggagacatgtccagcaaccccgcaaaagaaactttcacaacagggttagatgcacctcgtaatctgcgccgagtttcgcagacagataattccatcactctagaatggaggaacgggaaggccgctattgattcttatcggatcaaatacgcaccaatctctggtggagaccacgctgaagtggatgtgccaaaaagccagcaagcaacgacgaagaccacactcactggcctcaggcccggaaccgagtacgggatcggcgtttcagccgtcaaggaagacaaggagtctaacccagccacaatcaatgccgctactgaactcgacactcccaaggatctccaagttagcgaaacggcggaaacctcccttaccctgctttggaagacgccattagcaaagttcgaccggtacagactgaattatagccttccgaccggacaatgggtgggagtccagctgcccagaaacacaacctcatatgtgctgagggggctggagccgggacaggaatataatgttcttttaaccgccgagaaaggtagacataaatctaagcctgccagagttaaggctagcacagcaatgggctcccccaaagaggtgattttctcagacattacagaaaattcggcaaccgtctcttggcgagccccaactgcccaggtagagtcttttcgcataacctacgtccctatcaccggcggaactccaagtatggtcactgtggatggaacaaaaacacagacgagactagtaaagcttatacccggtgtcgagtatctggtgtcaattattgcgatgaagggcttcgaggagagtgaacccgtgagtggcagtttcaccactgccctcgatggtccctccggactggtcaccgctaatattacagacagcgaggctcttgctagatggcaaccggcaattgccacggtagactcatacgtgatctcttatactggcgagaaggtccccgagattactcgcaccgtatctggcaatacggttgagtatgcactgacagatctcgaacctgccactgagtacacattgcggatctttgcggagaagggacctcagaaaagttcaactatcacagcgaagttcacaaccgatctcgacagcccaagagacctcaccgctacagaggtgcagtccgagaccgctcttcttacttggcggcctccgagagctagcgttacagggtacctgctcgtgtacgagagcgtcgatggcaccgtaaaagaggtcatcgtgggcccagatacaacatcctacagcctcgcagatttgtccccttcgactcactacactgcgaagatacaagctctcaacggccctctgagatccaatatgatacagactatctttactactatcgggctcttatatcccttccccaaggactgtagccaagcgatgctcaacggggataccactagtggactatatacgatttatctgaacggcgacaaggctgaggccttagaggtcttctgtgatatgaccagcgatggtgggggatggatcgtctttctgcggagaaagaatggccgagagaatttttaccagaactggaaagcctatgccgcagggttcggggacagaagggaggaattctggttaggcttggataacctcaacaagattacggctcaaggccagtatgagcttcgcgtggacttacgcgatcacggggaaactgcgtttgccgtctacgataagttctccgtgggagacgcaaaaacacgctacaagctgaaggtcgagggctatagcggaacagccggtgacagtatggcctaccacaacggtagaagctttagtactttcgacaaggacaccgatagtgccattaccaactgcgccctcagttacaaaggggcattttggtaccggaactgtcatagggtaaatctgatgggacgatacggggacaataaccactcacagggcgtcaactggtttcactggaagggccatgagcattccatccaattcgccgagatgaaactgagaccctccaatttccgaaacctcgagggcaggcgaaagcgcgcttag

SEQ ID NO: 243706 - DNA, 4968 bp, Artificial Sequence
  Description of Artificial Sequence: Synthetic coding sequence
atgggagcgatgacccagcttcttgccggagtgttcctcgccttcctggctctggctactgaaggaggtgtactgaagaaagtaatcaggcataaacgccagtccggcgtaaatgcaactctcccagaagaaaatcagcctgtagtcttcaatcacgtctacaatatcaaactgccagtggggtcacagtgttccgtggatctggaatctgcttcaggagagaaggatttggctccccctagcgagccctccgaatccttccaagagcacaccgtcgatggcgagaatcaaatcgtgtttacgcaccggataaacattccaagaagagcctgtggctgtgccgctgccccagacgtaaaggagctgctgagcaggctggaggaactggaaaatctggtgtcgtctttacgggaacagtgtacagccggagcgggttgctgtctgcagcctgccactggaaggctggacactagacccttctgcagcggtcggggaaatttcagtactgaggggtgcggatgcgtatgtgagccaggttggaagggtcccaattgcagtgaacctgagtgtcccggtaattgccatctccgaggaaggtgcattgacggtcagtgtatttgcgacgatggcttcactggggaggactgttcacagctggcctgcccttctgattgcaacgaccaggggaagtgcgttaatggggtctgcatctgtttcgaaggctacgccggtgccgactgtagccgcgaaatctgtccagtgccttgttctgaggaacacggcacatgcgtagatgggctgtgcgtgtgtcatgacggttttgcaggggacgactgcaataagcctctctgcctcaataactgttacaatcgaggacggtgtgtcgagaatgagtgcgtttgtgatgaagggttcacaggagaggactgcagtgagttaatatgccccaatgactgcttcgaccgcggtcggtgcattaacgggacctgctattgcgaggagggattcacaggggaggattgcggcaagcctacgtgccctcatgcatgccacactcaggggaggtgcgaagaagggcagtgtgtgtgcgacgaaggttttgcgggtgtggattgttccgagaagcggtgccctgccgactgtcataatcggggtcggtgtgtagacggacgttgcgaatgcgatgatggctttacaggggctgattgcggggaactcaagtgcccgaacgggtgctctggccacgggaggtgcgtaaacgggcagtgtgtgtgcgacgaaggctatactggcgaggactgtagtcaactgcggtgcccaaacgattgccatagtaggggaagatgtgtggagggcaaatgcgtctgtgagcaggggttcaagggttacgattgttccgacatgtcttgccccaatgactgccaccagcatggtcggtgcgttaatgggatgtgtgtgtgcgatgatggttacaccggtgaagattgccgagatcgccagtgtcctcgtgactgttccaacaggggtctctgcgtggacggtcagtgcgtctgcgaggacggctttactggtccagactgcgctgagctgagctgtcctaacgattgccacggacaaggaaggtgtgtaaacggacagtgtgtatgccatgagggattcatggggaaagactgcaaggagcagagatgtccttctgactgccatggacagggtcggtgtgtagatggccagtgcatttgtcacgaaggcttcactggccttgactgtggtcaacatagttgcccatccgactgcaataatcttggccaatgtgtgtccggtcggtgtatatgcaacgaggggtatagcggcgaggattgctccgaggtgtcaccacccaaggaccttgtggtgacggaggtgacagaagagacagtgaatctggcctgggacaatgagatgcgggtgactgaatatctggtcgtgtatacaccaacacacgagggagggctggaaatgcagtttagggttcctggcgaccagacttctaccatcatccaagagctggagccgggtgtagaatattttataagagtgttcgccatactggagaataagaaatcaattccagtttctgctagagtggccacatatctgccggcacctgaagggctgaaattcaaaagcatcaaagagacttcagtggaggtcgagtgggatcccttagacatcgcgttcgagacctgggaaatcatttttcgcaacatgaacaaggaagatgagggcgaaattaccaagtccctgagaaggcccgagacctcctaccgccagaccggcttggcccctggccaggagtatgagatttctctccacatcgtgaagaataatacgagggggccaggcctgaagcgtgtgaccaccaccagactggacgccccttcgcaaattgaagtaaaggatgtaaccgataccacagcgctgattacctggtttaaaccgctggccgagattgacggcattgagctcacctacggcataaaagacgtgcccggagatcgtacaacaattgacctgacagaggacgagaatcagtatagcatcgggaacctcaagcctgataccgagtacgaggtgtctctgatttccagacgcggagatatgtcatcaaatccagctaaggagacctttactaccggactggacgccccacggaaccttaggcgcgtcagtcagacggacaacagcattactcttgagtggcgcaatggcaaggctgccatcgactcctatcgcataaaatatgcacccatcagcggaggagaccatgcagaagttgatgtcccaaaaagccagcaggccaccaccaagactacgctaaccgggttgcgcccagggacggaatatgggataggcgtgtcagcagtgaaagaggataaggaatccaaccccgcaactataaacgccgctaccgagcttgatacccccaaagatttgcaggtgtccgagaccgccgaaacaagcctgacgttactttggaagacccctctggctaagttcgatcggtatcgactgaattattcccttccaacagggcagtgggttggggtccagctgcctaggaacactacaagttatgtgcttcgtggcctggagccaggacaggagtacaacgtcttgctaacagcggagaaaggaaggcataagagcaaacccgctagggtaaaagctagtacagaggccgaaccggaagtagacaacctactggtgagtgacgctacaccagacggattcaggctgtcctggaccgcggatgagggggtgttcgacaatttcgtcctcaaaatccgagacaccaagaaacagtcagagcctctggagattacactgttagcacctgaacggacgcgcgatattaccggactcagagaggctacagagtacgaaatagagctctacgggatttccaagggaagacgctcacagactgtgtcagccattgctacgactgcaatgggcagtcctaaggaggtgatcttctctgacatcacggagaattctgccacggtgtcttggagggcccctactgcccaggttgaaagcttcagaattacatacgtccctattaccgggggtacgccctccatggttactgtggacggaacaaaaacacagacccgactggtgaaactcattccgggtgttgaatacctggtctccataattgctatgaagggatttgaggagagcgagcccgtctcagggagtttcaccactgccttggatgggccttccggtctggtcacagctaatatcaccgattccgaagcactggccaggtggcagcccgctatcgctaccgtggacagttatgttattagctataccggggagaaggtgcccgaaatcaccaggacagttagcggaaacaccgtggaatacgctttaaccgatctggagcccgcaactgaatacacgctaagaatctttgccgagaagggtccgcagaaaagctccaccattacagcgaagttcactactgacctagactcccccagggacctgactgcaaccgaagtgcagtcagagacggccctgctcacctggcgaccgccaagggccagcgtgacgggctacctcctcgtctacgagtcagttgacggaacagttaaggaagttattgtgggacccgatacgacttcctactcccttgccgatctgtccccctccactcattatacggccaagatacaggccttgaatggccctctccgttctaatatgattcaaacaatctttacaacgatcggccttctctaccctttcccaaaggactgttcccaggcaatgctgaacggagatactacgtcaggtctgtatacgatctatctgaacggcgataaggctgaagccctcgaagtcttttgcgatatgacttccgatgggggagggtggattgtattcctcaggagaaagaacgggagggagaacttctatcagaattggaaggcatacgccgctgggttcggtgacagacgtgaggagttctggctcgggctggataatcttaataagattaccgctcagggacagtatgagcttcgcgtggacctgcgtgatcacggcgaaaccgcctttgcagtgtacgataagttctcggtgggagacgctaagactagatataaactcaaagtggagggctacagcggcacagcaggggattctatggcatatcataacggtcgaagcttctccacattcgacaaagacaccgattccgccattactaattgcgctctctcctataagggcgcattttggtacagaaattgccacagggtgaacttaatgggcagatatggggataataaccactcacaaggagttaactggttccattggaaaggacatgaacacagtatccagttcgccgagatgaaattgcgcccaagcaacttcagaaatctcgaaggtcgcaggaagcgcgcttag

SEQ ID NO: 243707 - DNA, 6605 bp, Artificial Sequence
  Description of Artificial Sequence: Synthetic coding sequence
atgggggcaatgacacaactactggcaggagtgtttctcgcctttctagcgctggctactgagggaggagtcttgaagaaagtcattcggcataagcgtcagagcggggtcaatgccactctgcccgaggagaatcagcctgttgtgttcaatcatgtctataacattaagctgcctgtcggatcacagtgctctgtcgacttggaaagcgccagtggcgaaaaagacctagcaccacctagcgaaccttctgagagctttcaggaacatacagttgatggtgagaaccagatcgttttcactcatagaatcaatatcccaaggagagcttgcggctgtgcggctgcccctgatgtgaaggagctattatcacggttggaagagctagagaatctggtgtcttccttgagagagcagtgcaccgcgggagcaggatgttgtctgcagccagctacaggtagactggacacacgccctttctgttccgggaggggcaatttttctactgaagggtgtggctgcgtatgcgagcccggttggaaggggccaaactgcagtgaaccagaatgtcctgggaattgccacctacgcggtcgctgtatcgatggccagtgtatctgtgatgatggctttactggtgaggactgctcgcagctcgcctgccccagtgattgcaatgaccaaggaaagtgtgtgaacggggtgtgtatttgttttgaggggtacgcaggagccgattgttcccgggagatatgccccgtcccctgtagtgaagagcatgggacatgtgtggatggtctttgcgtctgccatgacggctttgcaggagatgactgtaataaacccttgtgtttgaataattgttataaccggggtcgctgcgtggaaaatgaatgcgtgtgtgatgaggggttcacgggagaggattgtagtgagcttatctgtcctaacgattgtttcgatcggggacgatgcataaacggaacttgctactgcgaagaaggcttcaccggggaagattgtggcaagccaacgtgcccacatgcatgtcacactcagggccgatgcgaagaaggtcagtgcgtgtgcgatgagggatttgctggggtggactgcagtgaaaagcggtgtcccgcagactgtcataacagagggcgatgcgtcgacgggagatgtgagtgtgatgacggatttacaggagccgactgcggggagctaaagtgtcctaatggctgttcgggccacggacggtgtgttaacggccagtgcgtctgcgacgaaggttatacaggagaagactgcagtcagctgcggtgccctaatgactgtcatagccgcggtcggtgtgtcgagggaaagtgtgtttgtgaacagggattcaaaggttatgattgttcagacatgtcgtgcccaaatgactgccaccaacatgggaggtgtgtcaacggaatgtgcgtttgcgatgacggttacaccggagaggattgccgcgatcgccagtgtccacgagactgcagcaaccgaggcctgtgcgttgacggccagtgcgtttgcgaggacgggttcactggccctgactgcgccgaattgtcttgccccaacgactgccacggccaagggagatgtgtgaatggtcaatgtgtatgccacgaaggattcatgggcaaggattgcaaggagcaaaggtgcccttccgactgccatggacaggggagatgcgtagacggacagtgtatttgtcacgaagggttcaccggcctagactgcgggcagcactcttgcccgagcgactgtaacaatcttggccagtgtgtttcagggagatgcatctgcaacgagggatacagtggagaagattgttccgaagtgagccctccaaaggaccttgtggtcacggaggttaccgaggaaacagtgaacctcgcctgggacaacgagatgcgggtgaccgagtacttggttgtctacactcctactcatgaagggggactggagatgcaatttagagtccccggagatcagacttctacaatcatccaggagctggagcccggagtggaatatttcattcgggtctttgccatcctcgaaaataagaaaagtattccagtgtcagcaagggtggcaacttacctgccagctcctgaagggctgaagtttaaaagcattaaggagacatcggtcgaggttgagtgggatccccttgatattgcgttcgagacctgggagatcatcttccgcaatatgaacaaggaagatgaaggagagataacaaagtcacttcgtcgtcctgagaccagctacaggcagacaggtctggcaccgggacaggaatacgaaatctctctgcacatagtgaaaaacaacacccggggaccgggtctgaagagagtgactaccacacgcttggatgccccatcacaaatcgaagtaaaggacgtcaccgacaccacagcactaatcacctggtttaaacccctcgctgaaattgatggaatcgaactgacttacggcattaaggacgtccctggtgacaggacaaccattgatctgacagaggatgaaaaccaatatagtattggcaaccttaaaccggacaccgagtatgaagtgagtttaatatcacgaaggggcgatatgtctagtaatcctgctaaggagacgtttacgaccggactggatgcaccaagaaacctgcggcgtgtttcacagactgacaactcaataacactggaatggcgcaatggtaaagccgctatcgattcatatcggattaagtatgcacctatttccggaggcgatcatgctgaggtggatgttccaaaaagccagcaggctacaacgaagaccaccctgacaggtttgagacccggtacagaatatggtatcggtgtcagtgcagtcaaagaggataaggagtctaatccggctaccattaacgcagcaactgagcttgatactcctaaagacctgcaagttagtgaaacggctgaaacgagccttactctgttgtggaagacccccttggctaagtttgatcgatacagactgaactactcactgcctactgggcaatgggtcggggtgcagcttccgagaaacacaacaagttacgtgctgcgagggttggaaccgggacaggaatacaatgtgctgctcacagctgagaagggaaggcataagagcaagccggctcgagttaaggcttccactgaacaagcgccagagctagaaaacctgactgtgacagaggtgggctgggatggcctaagattaaattggaccgccgcagaccaggcttatgagcactttatcattcaggtgcaagaggcgaacaaggtggaggccgcacgaaatttgaccgtcccaggcagcctgagggccgtggacataccagggctcaaagctgctactccatataccgtctcaatttatggggtgattcagggataccggactcccgtactgtcagctgaggcctcaaccggcgagacaccgaatctcggagaagtagtggtggccgaggtcggctgggacgccctaaagctcaactggacagccccagagggcgcttacgaatatttttttattcaggtccaggaagctgacacggtcgaggcggctcagaatttaaccgtgcccggtggcctgcggagtactgatctcccaggcctgaaggccgctacacattacactatcaccattagaggggtgacccaggacttttccaccaccccgctgtctgtggaagttctgacagaagaggttccagatatgggaaatctgactgtaacagaggtgtcttgggatgctttaagactgaactggaccactccagatggtacttacgaccagtttactattcaggtgcaggaagccgatcaagtcgaagaggcccataaccttaccgtccctggatccctaaggtctatggagataccaggacttcgggcagggacaccttataccgtgactctgcatggcgaagtgcggggacacagcacacggcctttggccgtggaggtggttacggaagacctgccacagcttggcgacttagccgtttctgaagtggggtgggatgggttgcgcttaaactggacagcagccgataatgcctatgagcacttcgtgattcaagtgcaggaagtaaataaggttgaggccgcacagaacttgactcttcccggatctttgcgggcagtggacattcctggcttggaggcagccacaccctaccgtgtctccatttatggagtgatccggggataccggacgcccgtgctctccgccgaagcctccaccgccaaagaaccagagatcggaaatctgaatgtatccgatatcactccggaaagttttaatctttcttggatggccacggatggtatctttgaaacattcacaattgagattattgacagcaatagactgctagaaacagtcgagtacaatatatccggcgctgagaggactgcccacatcagcggcctgccgccttccacggactttatcgtttacctttcaggactggctccaagcattagaactaaaaccatatctgccactgcaaccacagaagccttaccactactagaaaaccttactattagcgacattaacccatacggcttcaccgtgagctggatggcctcagaaaatgcatttgattcattcctggtcacagtcgttgattcaggcaaactgctggacccccaagaattcactctatcggggacacagcgtaagcttgaactgagaggactgattacaggcattgggtatgaagttatggtttctgggtttacccagggacaccagaccaagcccttgagagcggagatcgtcaccgaggcagaacccgaagtcgataacctgctggtgagtgacgccacacctgatggtttccgcctaagctggacagccgacgagggggttttcgataactttgtactgaaaatacgggatacaaagaaacaatcagagccattggagatcacactcctggcccctgaaagaacaagggacatcacagggttgcgagaggcgaccgagtacgagatcgagctgtacggcatcagcaaagggcgacgcagccaaaccgtcagcgcaatagccactactgctatggggagcccaaaagaggtgattttttccgacataactgaaaactctgctactgtgtcatggagagcacccactgctcaggtggagagtttccgcattacatacgtgcctattaccggcggaactccatcaatggttactgtggacggaacgaagacgcagacccgcctggtgaaattgatcccgggagttgagtatttagtttccattatcgcgatgaagggattcgaggagtccgaacccgttagtggtagcttcaccaccgcccttgatggcccttctggcttagtcacagcaaacatcacagattcagaggctcttgcgagatggcagcctgcaatcgccactgtggacagttacgtgatatcctacactggcgagaaggtgcctgaaatcactcgaacagtttccggaaataccgtggagtacgcactgactgatttagagcccgcaacagagtacactcttcgaatatttgctgaaaaaggtccacaaaaaagctcgacaatcaccgctaagttcaccacagacctggattcccctcgggacctgacagctaccgaggtccagtctgaaacggcacttctgacctggaggccgccacgcgcttctgttaccgggtatctgctggtgtatgagagcgtcgatggcactgttaaggaagtgatcgttggcccagacaccacgtcctacagtctcgcggacctctcaccatctacccattataccgccaagatacaggcactcaacggccctctccggagtaacatgattcaaaccatttttactaccattggtctgctttacccattcccaaaagactgcagccaggctatgcttaatggcgataccacaagcgggctgtatactatctatcttaatggcgacaaagccgaggccctcgaagtattttgtgatatgacatctgacggtggcggttggatcgtgtttctgcgcaggaaaaacgggagagaaaatttttaccaaaattggaaggcgtatgctgcgggttttggagataggagagaggaattttggctcggtctggacaacttgaataagattactgcccagggccagtatgagttgcgtgttgatttgagagatcacggtgagacagccttcgccgtctatgacaaattttcagtcggcgatgccaaaactagatacaaactgaaggtcgagggttattcaggaaccgccggagacagcatggcctatcataacggacgttccttttctaccttcgacaaagacactgacagtgccatcactaattgcgcgctgagctataaaggggctttttggtaccgtaactgtcatcgggtgaatctgatgggaaggtatggagacaacaatcactctcagggggttaactggtttcattggaagggacacgagcactccatccaattcgccgaaatgaagctccggccatcgaattttcgcaatcttgaagggaggagaaagagggctta

SEQ ID NO: 243708 - DNA, 3240 bp, Artificial Sequence
  Description of Artificial Sequence: Synthetic coding sequence
atgggcgctatgactcagctgctggccggagtgttcctggccttcctggcactggcaacggagggtggcgtgctcaaaaaagtgatcaggcacaagcggcagtctggggtcaacgctactctgcccgaagagaaccagcctgtggtgtttaaccacgtgtataatatcaaactgcctgtggggtctcaatgcagcgtggatcttgaatccgcgtcaggcgagaaagaccttgccccacccagcgagccgagcgaatcatttcaggagcacacagtggatggcgagaaccagatcgttttcacacaccggatcaatatcccaagacgggcatgcgggtgcgccgcagctccggacgtcaaagaactgctgtcccgcctcgaagaactggaaaatctcgtaagttcactccgggagcaatgtacagcaggtgccggttgctgtttacaacccgctaccggtcgactggacacgcgccctttctgcagtggaaggggaaatttcagtactgaagggtgcgggtgcgtttgcgagcctggctggaagggaccgaactgctcagaaccagaatgccctggcaattgtcatctgcggggtcggtgtatcgatggccagtgtatctgtgacgatgggttcacaggcgaggactgctctcagctggcctgtccctccgattgtaacgatcaaggcaaatgcgtgaacggagtgtgcatctgtttcgaaggatacgctggtgccgactgttctcgtgagatttgccccgtaccatgcagtgaagaacatggcacctgtgtggacggcctgtgcgtgtgccatgatggcttcgccggtgatgactgtaataagccgctatgcctcaacaactgctacaatcgcggtcggtgcgtggagaacgaatgcgtgtgcgacgagggattcactggggaggattgctctgagctaatctgtccaaatgattgctttgacagggggagatgtatcaatggcacttgctactgcgaggaggggttcactggggaagactgtggaaaacctacttgcccccatgcatgccacactcagggcagatgtgaggaaggccaatgcgtgtgcgatgagggctttgctggcgtagattgctcagaaaaaaggtgtcccgctgattgtcacaacaggggaagatgcgtggacggtcggtgtgagtgcgacgacggctttaccggtgctgactgcggcgaactgaagtgccccaacgggtgttccggtcatggccgatgtgtgaatggtcagtgcgtatgtgatgagggatacactggggaggattgtagtcagctcagatgcccaaatgactgccactcacggggacgttgcgtcgaggggaaatgtgtctgcgagcagggctttaagggctacgattgtagcgatatgtcctgccctaatgactgccaccagcacgggaggtgtgtgaacggaatgtgcgtatgtgacgatggctatacgggagaggactgccgggatcgccagtgcccgagggactgtagcaatagagggctatgtgtcgatggccagtgcgtctgtgaggatggctttacaggtcctgattgtgcggagctgagttgccccaacgattgccacggacagggacgctgtgtcaatgggcagtgtgtttgtcacgagggctttatggggaaagattgtaaagagcaaaggtgcccctccgactgccacgggcaggggaggtgcgtggacgggcagtgcatctgccatgagggctttactgggctagattgcggccagcactcttgcccatctgattgcaacaacctagggcagtgtgtctccggtaggtgcatttgtaacgagggttatagcggagaggactgttctgaggtttctccaccaaaggatctggttgtgactgaagtaacagaggagactgtcaatctagcttgggacaacgaaatgcgagtgacagaatacctggtggtttacacaccgacacacgaaggagggctagaaatgcagttccgcgtgcccggagaccaaacctcaacaataattcaggagctcgagccaggcgtcgaatacttcatacgcgtgttcgcaatcctcgagaataaaaagagcatcccagtgagcgccagagtggcaacatacctgcctgcacctgaaggtttaaaatttaaatcaataaaggagaccagcgtggaagtggaatgggatccactagatattgctttcgagacctgggagataatcttccggaatatgaacaaagaggacgaaggagagatcaccaagagtctgcgtcgccctgaaaccagttaccgtcaaactgggttagccccaggacaggagtacgagattagtctccacatcgtgaaaaacaataccagaggacctgggttgaagagggttaccactacacgccttgacgctccctcccagatcgaagtgaaggacgtaaccgacactacagccctgatcacctggtttaaacctttggccgagatcgacgggatagaactcacttatgggatcaaggatgttccgggagataggacgactatcgatctgacagaggacgagaaccaatatagcataggtaacttgaaaccagacaccgagtatgaggtgtctctgatcagccggaggggcgacatgtctagtaatcctgccaaggagaccttcacaacgggcctggacgcccctcggaacctcagaagagtgtcccagaccgacaattcaataactctggagtggcggaacgggaaggcagctatcgactcataccgcataaaatacgccccaatcagcggaggggatcatgcggaagtggacgtgccgaagagccagcaggccaccactaaaactattacggctaaattcacaacagacctggatagccccagagatttaacagccacggaagtgcagtcagagaccgcgcttctgacctggcgtcctccacgagcgtcagtcaccgggtatttgcttgtctatgaatccgtggacgggactgtgaaggaagtgatcgttggccctgacacaacgagctactccttggccgatctgtctccccctagtctgttcctgcactttatacagcagaaacccgagaaacagtattgctttcattttaaagacatgatcaacattattaatataatcatgatgatgatgatgatgaagaccaaggattttagtagggatctttccttccagaacatctccgggcagtacctgattgttttttttttttag

SEQ ID NO: 243709 - DNA, 279 bp, Artificial Sequence
  Description of Artificial Sequence: Synthetic coding sequence
atgggggctatgacccaactccttgctggcgtattcctggcctttcttgccctcgccactgaaggcggtgtgttgaaaaaggtgatacgacacaagagacagtctggagtgaatgccactctgcccgaagagaaccagcctgtcgtattcaaccatgtatataacatcaagctgccagttggctcgcaatgttccgtggatctcgaaagcgcttccggggagaaagatttggctcccccatcggagccctctgagtctttccaggaacacactgtgtag

SEQ ID NO: 243710 - DNA, 5240 bp, Artificial Sequence
  Description of Artificial Sequence: Synthetic coding sequence
atgggtgccatgacacaattgctggcaggcgtttttctggcctttcttgcgctggcaactgagggcggtgtcctgaagaaggtgattagacataaaagacagtctggggtcaacgctactctcccagaggaaaatcagcccgtggtgttcaatcacgtgtataatatcaaactccctgtcggctctcaatgctctgttgacttagaatcagcttctggagaaaaagacttggcccctccttccgaaccctcagaatcattccaggaacataccgtcgatggcgagaatcagatcgtttttacccatcggatcaacataccgagacgagcttgcggttgtgcggcagctcccgatgtgaaggagttacttagcaggctggaagaactggagaatctggtgtcttcgctgcgcgagcagtgtactgccggagccggatgctgtttgcagcccgcaacaggcagattggacacccgcccattttgctctgggcgaggaaacttctctactgaaggttgcggctgtgtttgcgaaccgggatggaaaggaccaaattgcagcgagccagaatgtcctggtaactgccatctccgaggcaggtgtatcgatggacaatgcatctgtgatgatggatttacaggggaagactgctctcagctggcatgtccaagtgactgcaatgaccagggaaaatgcgtgaatggcgtgtgtatctgcttcgagggctacgccggtgcagactgctcacgagaaatttgccctgtaccatgcagtgaagagcatggcacctgcgttgacggcctttgcgtgtgccatgatggttttgcgggagacgattgcaataaaccactgtgtctaaacaactgctataaccggggtaggtgtgtagaaaatgagtgcgtgtgcgatgaagggtttacaggagaggattgcagtgagctaatatgccctaacgattgttttgataggggcaggtgcattaatggcacttgctactgtgaagaagggttcactggggaggactgcggtaagcccacctgtcctcacgcctgtcatacgcaagggagatgcgaggaaggtcagtgtgtgtgtgacgaggggtttgctggtgtcgactgttcagaaaagagatgccctgccgattgccacaatagaggcaggtgcgtcgacggaaggtgtgaatgtgacgatgggttcacaggcgctgactgcggcgaactcaagtgtcccaatggctgttccgggcacggaagatgcgtcaatggtcaatgcgtgtgtgacgaagggtataccggcgaggattgcagtcagctgcgttgtcccaatgactgccattccagggggaggtgcgtggaggggaagtgcgtgtgcgagcagggattcaaaggttatgactgcagtgatatgtcatgccctaatgactgccatcagcacgggagatgcgtgaatggtatgtgcgtgtgtgacgacggctacactggggaggactgtagggaccgacagtgcccacgggattgcagtaatcgcggtctctgcgtcgacggacagtgtgtgtgtgaggacggattcactgggcctgattgtgccgagttatcatgtccgaacgattgccacggccaaggacgctgcgtgaacgggcaatgcgtgtgtcatgagggctttatgggcaaggattgcaaagaacaaagatgtccttccgattgccatgggcaggggaggtgcgtcgatgggcagtgtatttgtcatgaggggttcactgggctggactgcggacagcactcctgccccagtgactgcaataaccttggacagtgcgtttccggccgatgcatatgtaacgagggatacagcggagaggattgttccgaggtgagtccacctaaagacctcgtggttacggaggtgactgaggaaactgtgaatctggcatgggataacgaaatgcgggtgacagagtacctggtggtttacacgcctacccacgaggggggtctggaaatgcagtttcgggtccctggcgatcaaacctcgaccatcatccaagagctggaacccggtgtggagtattttatacgtgtgtttgccattctggaaaataagaaatctattcccgtgtccgcacgcgttgccacttacttgcctgctccagagggacttaagtttaaatctataaaagaaacttcggtggaggtcgaatgggatccccttgacattgcgtttgagacttgggaaatcatcttcagaaatatgaataaggaagacgaaggcgagatcacaaagtcacttcgacgtcccgagactagctaccgccagaccggcttggcaccgggacaggaatacgagatttccctgcacatcgttaagaataacacccgaggacccggattaaaaagggtgaccacaacccggttggatgctcccagccagattgaggtaaaggacgtgacagataccacggctctaatcacctggttcaaaccacttgctgagattgacggtattgagcttacatacggcattaaggacgtgcctggagacagaactaccatagacttgacagaggatgaaaatcagtactctattgggaatctaaaacccgacaccgaatacgaggtttccctgatctccaggaggggagatatgagcagcaatcctgctaaggaaactttcacgaccgggctggacgcaccccgtaacctccgcagggtgtcccagaccgataatagcattacgctggagtggaggaacggcaaagccgctatcgacagctatcgtatcaagtatgctccaatcagtggcggagaccacgctgaggttgacgtgcctaaatctcagcaggcgactaccaagacaacacttactggactccggcctgggactgagtacggaatcggcgtctccgccgtcaaggaagacaaagagagcaaccctgctactattaacgccgctaccgagctggacacacctaaggacctccaagttagtgagacggccgagacttccctgactctgttatggaaaacaccgttggcgaagttcgatagatataggttaaattatagcttgcccaccgggcagtgggtaggcgttcaactccctagaaacactacaagttacgttctgcgcggacttgaacccggacaggagtataacgttctcctgactgccgagaagggtcgtcacaagagtaagcctgctagggtgaaggcttctaccgcgaaggaaccagagatcggcaaccttaatgtgtctgatattactccggagtcctttaatctgtcttggatggctacagatggtattttcgagacgttcactattgaaatcatcgattccaaccgcctcctagaaacggtagaatataacattagtggggctgagagaactgcccacattagtggattgccgccatccacagattttattgtgtatctttcaggtctcgcacctagcattcgcacaaagactatttctgcaacagctactactgaggcggagcctgaggtggataacctcctggttagcgatgctacgccggacgggtttaggctgagctggaccgccgatgagggcgtgttcgataactttgtcctaaagattcgtgatacaaagaagcaaagcgagcctctggagatcactcttttggcgcctgaacggaccagagacattacgggccttagggaggccaccgagtatgagatcgagctgtacggcatcagcaaaggtagaaggtcccaaactgtgagtgcaatcgcgaccacggctatgggctctcccaaggaggtaatttttagcgatattaccgaaaactctgccaccgtgtcctggcgagcaccaacggctcaggtggagagtttccggattacatatgttcctataaccggaggtactccaagtatggtaacagtcgatgggacgaagactcagactagactagttaagctaattccgggtgtggaatatttggttagtattatcgctatgaaaggcttcgaggagagtgaaccagtcagtggctcttttaccaccgcgctggacggaccttcaggcctcgttaccgccaacatcaccgacagcgaggccttggctcgctggcagccagcaattgcaactgtggattcatacgttatatcctacactggtgagaaagtaccagaaatcactagaaccgtttctggtaatacggtggaatatgctctgactgacctggagcccgcaactgaatatacacttcggatttttgcggaaaagggaccgcagaagtcttccaccattacagctaagttcaccacagacctggatagccctcgggacctcaccgccacggaggttcaaagtgaaactgccctgctcacctggaggccgcctagagcaagcgtaactggctatttgctcgtttatgaatccgtcgatggaacagtcaaggaagttatcgtgggcccagacacgaccagttattcgctggctgacctgtcaccctccactcattacaccgccaagattcaagcactcaacggacccctacgctccaacatgatacagacaatattcaccactattggcctgctatatccatttccaaaggattgttcacaggcgatgcttaacggcgacacaacttctggactatatactatctacctcaatggtgacaaggcggaagccctggaagtcttctgcgacatgacctccgatggtggagggtggattgtgttccttcgaaggaagaacggacgggaaaatttttaccaaaattggaaggcttacgccgctggctttggtgatcgcagagaagaattctggttgggtctcgataacctcaacaaaattaccgctcaaggccagtatgagctgcgcgttgatttacgggaccatggggaaacggcgtttgccgtctacgataagtttagtgtgggggatgccaaaacaaggtacaagctgaaagttgagggatattccgggaccgccggtgactctatggcttaccacaacggtcggtccttctccacattcgataaggataccgattccgcaattaccaactgcgctctgagttacaagggggcattctggtatcgcaactgtcaccgggttaatctgatgggtcgatacggggacaacaatcactcccagggagttaactggttccactggaaagggcatgagcatagcatacagttcgctgagatgaagctgcgaccatctaacttcagaaatctggaaggcagacgtaaacgggcata

SEQ ID NO: 243711 - DNA, 5516 bp, Artificial Sequence
  Description of Artificial Sequence: Synthetic coding sequence
atgggcgctatgacccaactcctggcaggtgtgttcctggcattcctagccctggcgacggagggcggagtgctgaagaaggtcatccggcacaagcgccagtctggcgtgaatgccaccctgccggaggagaaccaaccagtggtgttcaatcatgtatataatatcaaactgcctgtcggatcacagtgctccgtagatcttgagtcagctagcggtgagaaagacctcgctcctcctagcgagccttccgagtcctttcaggaacacactgttgacggtgaaaaccagattgtattcacccatagaatcaacataccaagacgggcatgtggatgcgcagccgctccagacgtaaaggagctgctaagtaggctggaggagctggaaaacctagtaagttccctgcgcgagcagtgcacggcgggagcaggatgctgcttacaaccggctacgggcagactagacacccgcccattttgttctggacgcggaaattttagtacggagggttgcgggtgcgtgtgtgaacctggctggaaaggtcccaattgttctgagcctgagtgcccaggtaattgtcatttaaggggaaggtgtatcgatggccagtgtatctgcgacgacggctttaccggggaagactgcagtcagctggcctgtccatccgattgcaacgatcagggcaaatgtgttaacggggtgtgcatttgtttcgagggctatgcaggagctgattgctcacgggaaatctgtcctgtgccttgctcagaggaacacgggacctgtgtggatgggctgtgcgtatgtcacgatggattcgctggagacgattgcaacaaacccctctgcctaaataattgttacaatcggggacggtgcgtggaaaatgaatgtgtgtgtgacgagggctttactggagaagattgcagcgaactaatatgtccaaacgattgcttcgaccgtggtcggtgcattaatggaacctgttactgcgaagaaggcttcacgggagaagattgcgggaaacccacatgtccacacgcctgtcatacgcagggcagatgcgaggaaggccagtgtgtgtgtgacgagggcttcgccggtgtggattgctctgagaagagatgccctgccgattgtcataatagggggcgttgtgtggacgggcgatgtgaatgcgacgacggcttcaccggagcagactgcggtgagctgaagtgcccaaatgggtgttcaggccatggcaggtgcgtcaacggacagtgtgtgtgtgatgagggctacaccggtgaggactgttctcagttgcggtgtccaaacgattgtcatagtcgaggccgttgcgtcgagggcaagtgcgtgtgtgagcaggggtttaagggatacgactgtagcgatatgtcttgcccaaatgattgccaccaacacggcagatgcgtgaacggtatgtgtgtttgcgatgatggctatacaggggaagattgcagggaccggcagtgtcccagggattgcagtaaccggggactatgtgtggacggccaatgcgtgtgcgaggatggttttactggacccgactgtgccgaactcagctgtccaaatgattgtcatggacagggcagatgcgtgaacgggcagtgtgtgtgtcacgaaggctttatgggcaaagattgcaaggaacaacgctgtccctcggattgccatggtcagggcagatgtgtggatggacagtgtatttgtcacgaaggctttacaggacttgactgcggtcaacatagctgcccttctgattgtaacaatctaggtcaatgtgtgtccggacgctgcatctgcaacgaaggttatagcggcgaggattgcagtgaggtgtcacctccaaaagatctggtagtgaccgaagtgaccgaggaaacggtcaatttggcctgggataacgaaatgcgggtgactgaatacctcgtagtttacacacctacccatgagggaggcttggagatgcaatttcgggtgccgggagaccaaacttctaccattatccaggaactggaacctggggtggaatatttcattagggttttcgcaattctggagaataagaagagtatccctgtttcggctcgggtcgcaacatacctgccagccccagaaggcctaaaattcaaaagcataaaggagacatctgttgaggttgaatgggatcccctcgatatcgcattcgagacatgggagataatattccgcaacatgaacaaagaggacgagggagagatcactaaaagtctgaggagacctgaaacaagctacaggcagacgggactggccccagggcaggagtacgagattagtctgcatatcgtgaaaaacaacacccgcggtcccggacttaagagggtgaccactacgaggttagacgccccttctcagattgaggtaaaggatgttactgatacgacagcactcattacgtggttcaagccacttgcagaaatcgatggaatagaacttacgtacggcatcaaggacgttcccggtgaccggaccaccattgacctgactgaggacgaaaatcagtactctattggcaacttgaaaccggacaccgagtacgaagtgtcgttgatcagccgcagaggagacatgtcttctaacccagcgaaggagacttttaccacaggtttggatgccccaaggaatctgcgccgagtgtctcaaaccgataacagtatcacactggaatggcgcaacggaaaggctgcaattgacagctaccgcatcaaatacgcccctatctccggcggagatcatgccgaagtggatgtgccgaaaagtcagcaagccacaacaaagaccaccctaacaggcctgcggcctggcactgagtacggtatcggcgtatccgcggttaaggaggacaaggagagcaacccagcaaccattaacgcagcgactgagctggacactccaaaagacctgcaggtgtcagaaacagcggaaactagcctgactctcttatggaagacgcccttggcaaagtttgatcgctaccgcctgaattattcactgcccaccgggcagtgggttggagtccaactgcctcgcaacactacttcatatgtcctcagaggactggagccaggtcaggagtataacgtgttgctgaccgccgagaaggggaggcacaaaagcaagcctgctcgtgttaaagctagcaccgccaaggagcccgagattggcaacctaaacgtttctgatatcactcccgaaagttttaatttgtcctggatggctacagatggcatcttcgaaacgttcacaattgagattatagacagcaacagactgcttgagaccgttgaatacaacattagcggtgccgaacgcaccgcgcacatcagcggcctgcccccaagtacagactttatcgtgtatttgtccggcctggccccaagcataaggacaaagactatatccgcaacagccaccacggagcccaaaccccaacttggcacactgatctttagcaacataaccccaaagtccttcaacatgtcatggacaacgcaagcgggactgtttgcgaagatagtgattaatgtatccgacgctcactccctccacgagagccagcaattcacagttagcggggacgccaaacaggcccacatcactgggctggtagagaacacaggatacgatgtcagtgtggccggaactacactggcaggtgacccgactcgcccactcaccgcatttgtgataacagaagccgagcccgaggtggataacctcctagtgtctgatgccacccccgatggttttcggctttcgtggaccgcggacgaaggagtgtttgacaattttgttctgaagattcgcgataccaagaagcagtctgagccactcgaaatcacactgctggcgcctgagcgcaccagagatatcaccggtctccgcgaggctacagaatacgagatagaactctatggcatcagcaaggggaggcgatcacagaccgtgagtgctatagccaccacagccatgggatcaccaaaggaggttatattcagcgatatcaccgagaattcagccacagtgtcatggcgggcacctacagctcaggtggaatccttcaggattacgtacgtgccaatcacggggggaacaccttcaatggtgactgtggacgggacaaagacccaaactagactcgtgaagctgatcccaggcgtggaatatctcgtgtctattattgctatgaagggcttcgaagagagcgagccagtttctggaagtttcacgactgcattggatggaccttctgggctggtcacagccaatattacggactcagaagctctcgcaagatggcagcctgccattgctaccgtggattcctacgtaattagctacaccggagagaaagtgcccgagatcactcgaacagtttccgggaacactgtagaatacgccttgacggacttagagccggctactgagtatactctgaggatctttgccgagaaaggaccccagaagtcttctactatcactgctaagtttacaacagaccttgacagcccacgggatctgaccgcgactgaagttcaatctgaaaccgccctgcttacttggagaccccctcgcgcatctgtcacaggttacctgcttgtgtacgaaagcgtggatggcaccgtaaaagaagtcatcgtggggccagacactacatcatactcccttgcagacttgtccccaagcacgcattacaccgcaaaaattcaggcactgaacgggcctctgaggtcaaacatgatccagacaatctttaccactatcgggttgttgtacccctttcccaaggactgttcacaggctatgttgaacggagacacaacatccggactctatacaatttatctcaatggtgacaaagcagaggccctggaagtgttctgcgatatgacaagtgacggcggaggatggattgtgttcctgcggagaaaaaatggcagagagaacttttaccagaattggaaagcctacgccgctgggttcggcgatagacgcgaggaattctggctaggactagataatttgaacaaaatcactgcccaggggcagtatgagttaagagtggacctcagggatcacggtgagacggcgtttgcggtttacgacaagttttccgtcggagatgccaagacccgctataagctcaaagtggaaggatactcaggcactgccggtgacagcatggcctaccataacggacggagcttctccactttcgacaaggataccgacagcgccatcactaattgcgccttatcgtataaaggcgcattttggtataggaattgccacagagtgaacctgatgggtaggtacggtgataacaatcactcgcagggggttaattggtttcactggaaggggcacgagcactcgatccagttcgccgagatgaaactacgcccttcaaacttccgaaacctggagggcagacggaagagagccta

SEQ ID NO: 243712 - DNA, 4077 bp, Artificial Sequence
  Description of Artificial Sequence: Synthetic coding sequence
atgggagcggatggggagaccgtagtgctgaaaaatatgcttatcggcattaatctgatcctattagggagcatgatcaagccatccgagtgtcaactcgaggtaaccacagagagagtgcagagacagagcgtggaagaagaaggtggaattgcgaactacaataccagctccaaggaacagccggtagtctttaaccacgtgtataacattaacgttcctctggataatctttgtagctccggcttagaagcatctgctgaacaggaagtcagtgcagaagatgagacactggcagaatatatgggacagactagcgatcatgaatcccaagtcacctttacacatcgcataaatttccccaagaaggcctgcccatgtgcgtccagcgcacaggtcctacaggaactgctgtcacgaattgagatgttggagagggaagtgagcgtactccgggatcaatgtaacgcaaactgctgccaggaatccgctgcaacaggtcaactcgactatatcccacattgtagtggacacgggaatttcagcttcgagtcctgtgggtgtatttgcaatgaggggtggtttggtaagaactgttctgagccatattgtcctttggggtgttcctctcgaggagtgtgtgttgatgggcagtgcatatgtgatagcgagtacagcggcgatgattgcagcgaactgagatgccccaccgactgctcttcccggggactgtgtgttgacggcgaatgcgtttgtgaagagccatacaccggggaagattgcagggagctacggtgccctggcgactgtagcgggaagggccgatgtgccaatgggacctgcctttgcgaagagggctatgtgggggaagactgtggacaacggcagtgcctgaacgcctgtagcgggcgtggccagtgtgaggaggggttgtgtgtgtgcgaagaagggtaccaaggtcctgactgcagtgcagtagcaccgcctgaggacctacgtgtcgccggtatctctgaccggtccattgaactggaatgggacggccctatggccgtgactgaatacgtcatctcctatcagccaaccgcccttggtggtttgcagcttcaacagcgagttcccggtgactggtccggggtgacgattactgagttagagccagggctgacttataacatcagcgtgtacgctgttatctccaacatactgtctcttcctataaccgcaaaggtagctacccacctttcaacccctcagggcttgcaattcaagacaatcacggagacaacggtcgaagtacagtgggaacccttctccttttcatttgacgggtgggaaatcagtttcattccaaagaacaacgaagggggagttatcgcccaggttcccagcgatgtgacgtccttcaatcagaccggcctaaagcccggagaggaatatatcgtgaacgttgtggccctcaaagagcaggcaaggtccccacccacttctgcttccgtatctactgtgattgacggtcccacccagattctggtccgggacgtgagtgacaccgtcgccttcgtggaatggatcccaccgcgtgcaaaagtcgactttatactgcttaagtatggcctggtgggaggggaaggagggagaacaacattccggctccagcctccactctcccagtactcagtgcaagccctgcgccctggtagcagatatgaagtttctgtaagtgcggtacggggtaccaacgagtccgactctgctactactcagtttaccacggagattgatgccccaaaaaacctgcgcgtcggatctagaaccgcgacctccctggatcttgagtgggacaactcggaagctgaagtgcaggagtacaaagtcgtgtatagcacactggccggagagcaatatcacgaagtcctcgtcccacgcggtatcggtccaactacccgtgccacacttacagatctcgtacctggaactgagtatggcgtaggaattagcgcagttatgaactcacagcagagcgtccctgcaaccatgaatgcaaggaccgagctggatagccccagggatctcatggtaaccgcttccagtgaaacatcaatatcactcatttggacaaaagctagcggcccaattgatcactatcggataacctttactccttccagcggcattgcttccgaagtgactgtgccaaaagaccgtacaagctatacactcacggatttggaacccggagccgagtatataatctccgtgaccgccgagcgcggtaggcagcagtcactggaatccacggtagatgcattcaccggcttcaggcccatcagccacctgcacttcagtcacgtgacgtcctcttcagtaaacatcacctggtccgatcctagtcctccagctgaccggctcatcctcaattattccccacgagatgaggaagaagagatgatggaagtgtccctcgacgctacaaagcggcatgccgtgctgatggggcttcaacctgccacagaatatatcgtgaacctggttgcagtgcatggaacggtgacatctgaacccatcgtgggctctatcaccaccgggattgacccacctaaagatatcactatatcaaatgtgaccaaggactctgtgatggtctcttggtccccgcctgtggctagttttgactactaccgagtgagctacaggcccacccaggtgggtaggttggatagttccgtggtgccaaatacagtgaccgaatttacaataacgaggctcaaccccgcaaccgagtatgaaatctccctgaacagcgtccggggaagggaagagtccgaaagaatctgtacactggttcacacagcaatggataaccccgtcgaccttattgccacaaacatcacccctaccgaggctctgctacagtggaaagctccagtcggagaagtcgaaaattacgtcatcgtgctcacccacttcgcagttgccggtgagacaatattggtggacggggtgtcagaagaattccgtttagttgacttgttgccatctacccactatacagcgaccatgtacgctacaaacggaccattaactagtggaacgatttcaaccaacttctcaactctgctcgacccaccggctaaccttactgcatcagaggtgactagacagagcgccctgatcagctggcagccacccagggcagagatagagaactatgtgcttacctacaaatccactgatggttcccggaaagaactgatcgtggacgctgaagacacttggattagactggagggccttctcgagaacactgattacaccgtgctgcttcaggctgctcaggacacgacatggagctcaatcacatccacggcgttcactacaggaggtcgggtgtttcctcatccacaggactgcgcccagcatctgatgaatggcgacacattatcaggcgtctatcccatttttctgaacggtgagcttagtcagaaattgcaagtctactgcgacatgaccactgatgggggaggttggattgttttccagcgcaggcagaacggccagacagacttctttcggaaatgggctgactatcgagtggggtttgggaacgtcgaggatgagttttggcttgggctcgataacattcatcggatcacttcccagggcagatacgagctgagagtggatatgagggatgggcaagaagccgcttttgctagttatgacagattctccgtcgaagatagccggaatctttataaattgagaatcggcagctataacggaaccgccggtgatagcctgagctaccatcagggtaggccatttagcaccgaagatagagacaacgatgttgcagtgaccaactgcgccatgtcctacaagggtgcatggtggtacaaaaactgtcaccggacaaacttgaacggaaaatacggggagagtcggcatagtcaggggattaattggtatcattggaagggtcacgagttctcaataccattcgtcgagatgaagatgaggccatataaccatcggcttatggcagggaggaagcggcagagtctgcagttttag

SEQ ID NO: 243713 - DNA, 3807 bp, Artificial Sequence
  Description of Artificial Sequence: Synthetic coding sequence
atgggagccgatggagaaacagtcgttctcaagaatatgttaatcggtatcaacctgatactgctgggctcaatgatcaaaccaagcgaatgccagctcgaagtcaccaccgaacgtgtgcagcgccagtcagtcgaagaggaggggggaatcgcaaactataataccagcagcaaagagcagcccgtggtgttcaaccacgtttataacatcaatgtgcctttagacaacttatgcagttctggattagaggcgtccgcagagcaggaggtgagcgctgaagatgaaactttagccgaatatatgggacaaacgagtgatcacgaaagtcaggttaccttcactcatcgaataaatttccccaagaaggcttgcccatgcgcttccagtgcgcaagtgctgcaggaactactgtccagaatcgagatgctcgagcgcgaagtatcggttctccgggaccagtgtaacgctaattgctgtcaggaatcagccgctactggtcagctggattatatcccacattgttctggacacggcaatttcagctttgaaagctgtggttgtatatgtaatgaaggctggttcgggaagaactgttccgaaccttactgccctctgggctgcagctccagaggggtctgcgttgatggccagtgcatctgcgactccgagtactcgggcgacgattgtagtgagctcagatgccctacagattgctcctccaggggtctctgtgtggatggtgagtgcgtgtgcgaggaaccttatactggggaagattgtcgcgaactcaggtgccccggagattgcagtggcaaaggccgatgtgcaaacggcacatgtctttgtgaggaagggtatgttggtgaggattgcggccaacgacagtgtctcaacgcctgctccggacgagggcagtgtgaggagggcttgtgcgtctgcgaggaagggtatcagggacccgactgctctgccgtggctcctccggaggatctgcgcgtcgccggaatttcggaccgatccattgaactcgagtgggacgggcctatggcggtcaccgaatacgtaatctcataccagccaactgcgctcggcggtcttcagctgcagcagagagttcccggagattggtcaggcgttacaattacagagcttgagccgggactgacctataatatctctgtgtatgctgtgatctctaacattctatctttaccgattacagcaaaagtcgccactcacttgagtactccacaggggttgcagtttaagacaatcaccgaaactaccgtcgaggtgcagtgggagccctttagcttttcatttgacggctgggagatttcctttatccccaagaacaacgaaggcggtgtgattgcgcaggtccccagcgatgtgaccagctttaaccagaccggcctgaagccaggcgaagaatacattgtcaacgttgtagccttgaaggagcaggctagatctccccctacgagtgccagtgtgtcaactgtgatcgacggaccaacgcagatcttggtgagggacgtgtccgacaccgttgctttcgtggagtggatccccccacgggcaaaagtggattttattcttctgaaatatgggcttgtggggggagaaggaggcagaactacattccgtctgcagccaccactttcccagtactcggtgcaggccctgaggccgggtagcagatatgaagtgtccgtaagcgcagtgaggggaacgaacgagtccgattccgccaccactcagttcaccacggagatcgacgcacccaagaatctgcgagtaggctccaggaccgcaacgtctctggacctggagtgggataattcagaagcagaggtccaggagtacaaagtcgtttactctactctggccggagaacagtatcatgaggtgttagtgccacggggtatcgggccaacaacgcgcgcaaccctcactgatttagttccaggaactgagtatggagtgggaatctcagccgttatgaactcccaacagtccgtgcccgctacaatgaacgccaggacggaactggactcccctagagatctgatggttactgcctctagcgagacctccatcagcctcatatggacaaaggccagcggccctattgatcattatagaattactttcactccgtcatctggcattgcaagcgaagtgacagtgcctaaagaccgcacatcctacactttaacagacctggaaccaggtgcggaatacatcatatctgtgacagccgaacggggaaggcaacaatctctcgagagtacagtcgacgcatttacaggaattgatccaccaaaggacattacaatcagcaacgttacaaaagattcagtgatggtctcatggagtcctcctgtggcttcgttcgattattaccgagtctcttatagaccaacacaggtggggaggctagattcctccgtggtgccaaacaccgtaacagaattcactattacgaggctaaacccagctacagagtacgagatctctctgaactccgttcggggtagggaagaatctgaacgcatttgcactctggtgcataccgccatggacaatccggtcgatcttatcgcgacgaacattacacctaccgaagctttgctgcagtggaaggccccagtgggtgaggtagagaattacgtgattgtcttgacccacttcgccgtagctggcgagaccattcttgttgacggggtcagcgaagaattccgcctcgttgatctgctgccaagcacccactacactgctaccatgtatgccacaaacgggcctctgacatcaggcacaatcagtacgaacttctccaccctcttagacccaccggcaaacctgacggctagcgaggtaactaggcagtctgcattgatcagctggcaaccccctagggccgaaatcgaaaactacgtcctgacgtataaatccaccgacggttcccggaaggaattgatagtggatgccgaggacacatggataagactggagggacttctggaaaataccgattacacggtgctgttgcaggctgctcaggatacgacctggagcagcatcacaagcactgcgtttacaacaggtgggagagtattcccacacccgcaggactgtgctcaacatctgatgaacggggacaccctctctggcgtgtacccgatttttctgaacggcgaactcagtcaaaaattgcaggtgtactgtgacatgacaactgatggcggagggtggatcgtgttccagcgcaggcaaaatggacaaactgatttctttcggaagtgggcagactatcgggtcggcttcgggaacgtcgaagatgagttctggttgggcctggacaacatccataggatcacttctcaaggccgatacgaactgcgggtggatatgagagacggccaagaggcggcattcgcatcatacgatcggttttccgtcgaagactcgcgaaatctgtacaagcttagaatcggtagttacaacggaacagcgggtgattcattgagctaccaccagggccgtccattctcaactgaggatcgggacaatgacgtagctgtaaccaattgcgccatgtcctacaaaggcgcttggtggtacaaaaactgccatcggaccaatctgaatgggaagtacggcgagtcacggcattctcagggtattaattggtatcattggaaaggccatgaattctcaataccctttgtcgagatgaaaatgcgcccatataaccaccgacttatggctggcagaaaacggcagagcctgcagttttag

SEQ ID NO: 243714 - DNA, 4077 bp, Artificial Sequence
  Description of Artificial Sequence: Synthetic coding sequence
atgggggcagacggagaaaccgtagtgcttaagaatatgctaatcggcataaatctgatcctcttggggagtatgataaaacccagtgaatgtcagctggaagtgaccacggagagggtccagagacagagtgtggaggaggagggaggaattgctaactataacaccagcagtaaggaacagcccgtagtcttcaaccacgtctacaatatcaacgttcctttagataatctatgctcctccggattggaggcaagcgccgaacaggaggtgagcgccgaagacgagacactcgcagagtacatgggccagacaagtgaccatgaatcccaagtcacctttacgcaccgtatcaacttccccaaaaaggcatgcccctgtgcctcgtccgcacaggttctgcaggaactcttgagcaggatcgagatgttggagagggaggtgtcggtgctgcgggatcagtgcaacgctaattgctgccaagagagtgctgcaacggggcagctggactatatacctcactgctcagggcacggcaatttcagttttgagagttgtggctgcatttgcaacgagggatggttcggcaaaaattgttctgaaccttactgcccgttaggatgctcaagcaggggtgtctgcgtggacggtcagtgtatttgtgacagcgagtactccggggacgactgcagcgagcttaggtgtccaaccgactgcagtagtagaggcctctgtgtggacggagaatgtgtgtgtgaagaaccttataccggcgaggattgcagggagcttcgctgtccgggtgactgctccggtaaggggcgttgtgcaaacggcacctgtctgtgtgaggagggctacgtgggagaggattgcggccagcggcagtgcctcaacgcctgcagtggcagagggcagtgtgaggaaggactttgcgtgtgcgaggaggggtaccagggtccagactgttctgcagttgccccaccagaagatctgagagtcgccggtatatcagaccgctcaatagagcttgaatgggacgggccaatggcggtgaccgaatatgtgatttcttatcagcccacagccctgggcggactgcagctgcaacagagggtccctggtgattggagcggagtcacaatcactgagctggaacccggactcacctacaacatcagtgtatacgctgtcatatcgaatattcttagcctacccattacagcgaaagtggcaacacacctgagtacaccccaggggttgcagtttaagaccatcaccgagaccaccgtggaggtgcagtgggaaccattctcgtttagctttgacggttgggagattagtttcatccccaaaaacaatgagggcggagtgatcgcgcaggttcccagtgacgtgacatcctttaatcagaccggtctcaaaccaggagaggagtacatcgtgaatgtggtggctctgaaagaacaagcaagaagccctccaacttctgcgtcagtgtcgacggtcatcgatggtcctactcagatcctggtgagagacgtgagtgatacagtcgcattcgttgagtggattcctccaagggcgaaagtggattttatcttgctgaagtatgggctggtcggaggagaagggggacgcaccacattccgcctgcaaccccctctgagccaatatagcgtccaggcactaagaccaggatctagatatgaagtcagcgtttctgctgtccgtggtacaaacgagtccgatagcgcaaccacccagtttacaacagaaatcgatgcacccaagaacctgcgggtgggctccagaacggctacaagcctggaccttgaatgggataacagtgaggctgaggtccaggaatataaggtggtttacagcacattggccggtgagcagtatcatgaggtgctggtgcccagaggaattggtcccactacacgcgctacactcaccgacctggtgcccggaacggagtatggagtaggcatctccgcagtgatgaacagtcagcagagcgtgcccgctacaatgaatgctcggactgagctggactctcctagagatctgatggtgaccgccagtagtgagacctctatctccctcatttggaccaaagccagcgggcctattgaccactaccgcattacttttactcctagcagtggcatagcaagcgaagtaactgttcctaaagacagaacaagctatacactaaccgacctggagcccggtgccgaatacattatctctgtgacggccgagcgtggccgacagcagtctctggagtctaccgttgacgcctttaccggtttccgtccaatttcccatctacacttctcacacgtgacctcgtcaagcgtcaatatcacatggtcagatcctagcccgcctgcggatcggctgatccttaactattcccctagagatgaagaggaagaaatgatggaagtctccctggatgctacgaaacgccacgcggtactcatgggattgcagcccgctaccgagtacattgttaatctcgtcgctgtgcacggtactgtcacaagtgagccaatagttggctcgatcactactggtattgatccccctaaagacataacaatttcaaatgtaacaaaggactctgtcatggtgtcctggtcccctccagtggcaagtttcgattactacagagtgagctaccgacccacacaagttggcagactcgactccagcgtggtgccaaatacggtgacagagtttacaattacaagactgaaccccgctacggagtacgagatcagcctcaattccgtgcgtggaagagaagaatccgaaagaatctgtacactcgtccataccgccatggataatccagtggacctgatcgctaccaacattacacccacagaggccttgcttcaatggaaagcacccgttggcgaagtggagaactatgtgattgtgctaactcatttcgcggtggcaggtgagacaattctcgtcgacggcgtgtccgaggagttccgactggtggacctgctcccgtcaactcattatacggccacaatgtatgcaaccaacggccctctaacaagtgggaccatcagcactaatttctcgactctgctagatcctccagccaatttaaccgcttcggaagtcacacgtcagtcggccctcattagctggcagcccccaagagccgagatcgaaaattatgttctcacctataagtcaaccgacggcagccggaaagagctgatcgtcgatgccgaggatacctggattagactagaaggcctgttagagaacactgactacactgtactgctgcaggctgcacaggacaccacatggtccagcattacatctaccgcttttacaacgggcggacgcgtgttcccccacccgcaagattgcgctcaacatctgatgaacggcgacaccctttcaggcgtgtaccccattttcctgaatggcgagctttctcagaaacttcaagtgtactgtgacatgaccacagatggcggaggttggattgtatttcaacggcgtcagaacggccagacagacttctttagaaagtgggctgactaccgagtggggtttggcaacgtcgaagacgagttttggctagggttggacaatatccataggataacgtcccaaggtagatacgagctgagagtcgacatgcgcgatggtcaggaggcagcatttgcctcatatgatcgatttagtgtcgaagactcacggaatctgtataaattgcgaatcggcagctacaacggaacggcaggggactctttgtcatatcaccagggaaggccattttccaccgaagaccgggacaacgacgtcgcagtcacaaactgcgctatgtcatacaagggagcctggtggtataaaaactgtcaccgaacaaatctgaatggcaaatacggagaaagccgccacagccaaggcatcaattggtaccactggaagggtcatgaattttctattccgtttgtggagatgaagatgcggccttacaaccacagattgatggcgggaagaaagcgccaatctttgcaattctag

SEQ ID NO: 243715 - DNA, 534 bp, Artificial Sequence
  Description of Artificial Sequence: Synthetic coding sequence
taaattaactttcccaaaaaagcttgtccctgtgcaagcagcgctcaggtgctgcaggaactgctctcacgcatcgagatgctcgagcgtgaggtcagcgtgcttagggaccagtgcaatgctaactgttgccaggagtcagctgcaacagtcgccccacctgaggacttacgagttgcaggcatcagcgataggagcattgaactagaatgggatggtcccatggctgtgactgagtacgtaatttcctaccagcccacagccctggggggtctgcagttgcagcagcgcgtccctggagattggagcggagtcaccattaccgagcttgagccgggactgacctataacatttcagtttacgctgtgatttccaatatcctatctctgcctataacagcaaaagtcgctactcacctttcaacacctcaaggattacagttcaagaccatcacagagacaacagttgaagtacaatgggagccgtttagcttctcctttgatggctgggaaatatccttcatccccaagtag

SEQ ID NO: 243716 - DNA, 12669 bp, Artificial Sequence
  Description of Artificial Sequence: Synthetic coding sequence
atgatgccagcccaatacgcactgaccagcagcctggtgctgctggtgctattgagcactgctagggccggtccctttagttcacgctctaacgtcacactccctgccccaagacccccaccccaacccggaggccataccgttggtgccggtgtgggcagtccctcgagtcaactctatgaacacaccgtggaaggaggggaaaagcaggtggtgtttacacacaggatcaacctacctccctcgacaggatgcggttgcccacccggtactgagccgccagttctagcaagcgaagtgcaggccctccgggttaggctagagatcctcgaggagcttgtcaaagggcttaaggaacagtgtactgggggatgctgcccagcaagtgcccaggcagggaccggacaaaccgacgtccgaaccctatgctcacttcatggagtgtttgatctctcccggtgtacctgttcttgcgagcccggttggggtggacccacctgttcagatcccaccgatgccgaaatccccccttcctctcccccatctgccagcggcagttgccccgatgactgtaatgaccaggggcgatgtgtgcggggacggtgtgtctgctttccaggctatactggcccttcctgcggatggccatcgtgccccggagactgtcagggacgcggtagatgtgttcagggcgtctgcgtgtgtcgggctgggttcagcggcccagactgttcacagaggtcctgcccaagggggtgttctcaacggggacgctgtgagggtggtcgttgcgtgtgtgatcccggttatacaggcgatgattgtgggatgagatcttgccctcgcggatgcagtcagagggggagatgtgaaaatggcaggtgcgtctgcaatccagggtacgccggtgaggactgcggagttcgcagctgccctagaggttgtagccagcgaggcaggtgtaaggatgggcgatgcgtttgtgaccctgggtataccggcgaggactgtggaacgcgctcttgcccatgggactgcggagaaggaggtcggtgcgtggacggacgctgtgtgtgctggcccggatacaccggagaggactgttcaacccggacatgccccagggattgtaggggcagaggcagatgcgaggacggcgaatgcatatgcgacaccggttacagcggcgatgactgtggggtacggtcttgtcccggagactgtaatcagcgtgggcgatgtgaggatggaaggtgcgtgtgctggcctggatatactgggaccgattgcgggagtagggcatgccccagagattgtcgcggtagaggcagatgcgaaaacggggtctgtgtttgcaatgccggttatagcggggaagactgcggtgtgcgctcgtgccctggagactgtagaggcagagggagatgcgagagtggtcgctgcatgtgctggcccggatatacagggagggactgtggaaccagggcgtgtcccggagactgccgcggaaggggacgatgcgttgacgggagatgtgtttgtaaccctggctttacaggagaggattgtggatcacgacgctgcccaggtgactgtaggggccatggcttgtgcgaggatggggtgtgcgtatgtgatgcgggttactccggcgaagattgctccacccgttcgtgccctggagggtgccgcggacggggacaatgcctcgacggtaggtgcgtttgcgaggatgggtacagcggcgaggattgtggagtgaggcagtgccccaatgactgtagccagcacggtgtgtgccaggatggggtgtgcatctgttgggaaggttatgtgtctgaagattgctcaattcgaacttgtccaagcaactgtcatggtcgaggacgctgcgaagaggggaggtgtctctgtgatccgggatacaccgggcctacatgtgctacaagaatgtgccccgcagattgtcggggacgtggcaggtgcgtgcagggggtttgtctctgccacgtgggttacggcggagaggactgtggacaagaggagccaccggctagcgcttgtcccggtggttgcggacccagggaactttgtcgcgcaggtcagtgcgtctgcgtggaaggtttccgcggaccagactgtgccatccagacatgcccaggcgactgtcgtggacggggagaatgtcatgacgggtcttgcgtgtgcaaggacggatacgcaggtgaggactgcggtgaggaagtgcctacgatagaaggcatgcggatgcatttactggaggagacaaccgtgagaaccgaatggacacctgctcctgggccagtcgatgcatatgagatccagtttatccctaccacagaaggagcaagtcccccttttactgcacgcgttccctcatccgcatccgcgtatgaccagcggggattggcccctggccaggaataccaagtgacagtgcgagctcttagagggactagctggggactgcctgcctctaagacgataactactatgatcgatggcccacaagacctgagagtcgtggcggtgactcccacaacgctcgaattggggtggctcagaccacaagcagaggtagaccgtttcgttgtgtcctacgtgtccgctgggaatcagcgtgttcgactggaagtgccacccgaggccgacggaaccctgctaacagacctgatgcccggtgtcgaatatgtggtgaccgtgaccgcagaacggggaagagccgtgtcctacccagctagtgttagggccaacactggctcctctcctcttggtctgctgggcacaacggacgagcctccgcctagcggcccttccactacccagggcgctcaggccccactcctgcagcagcgcccacaagagcttggagagctgcgagtgctgggaagagatgagaccggtaggctccgtgtagtgtggacggctcaaccggacacgtttgcttatttccagctccgcatgcgcgtgccagaaggacctggtgcccacgaggaggtgctccctggcgatgtgcgccaagccctggtgcctcctcctcctcccggaaccccttacgagctgtcattgcatggtgtaccaccaggaggaaaacccagcgaccccatcatctatcagggcattatggacaaggatgaggagaagcctggcaagtcatccggtcccccaaggctaggagagcttacggtgacagaccgaacaagtgattcgttactgttacgttggacagttccggagggagagtttgattccttcgtgatccagtataaagaccgggacggccagccacaagtcgtgcccgtggaggggccacagagaagtgcagtcattactagcttggatccgggacggaaatataagtttgttctttacggtttcgtcggaaagaaacgccacggccctctcgttgccgaggctaagattcttcctcaaagtgatccttcgcctgggactccaccacatctgggcaacttatgggtgaccgaccccaccccagactctttgcacctgtcttggaccgttccagaaggtcaattcgatacatttatggtccagtaccgggatcgggatggaagaccccaggttgttccggtggaaggacccgaacggtcatttgtggtctcgtcattagaccccgaccataagtaccgctttactctgtttggcattgccaataagaagagatacggaccactgaccgcagatggcacgaccgcccctgagcgcaaagaagaacctccacgacccgagtttctggagcagccactgttaggtgaactgaccgtcaccggggtgactcccgattcgctaaggttaagctggacagtggcccagggtccattcgactcattcatggtccaatataaagacgcccaagggcagccacaggcagtgcctgttgctggcgacgagaatgaagtgacagtgcccggattagacccagatcggaaatacaaaatgaatctgtatgggttacgcggaagacagagagtcgggccagagtcagtggttgctaagacagcaccgcaagaggacgtggatgagaccccgtcccctaccgaactggggacggaagctcctgagtctcccgaagaacctctgctaggcgaactgacggtgactggaagcagtcctgattcactttctctgttctggaccgtgccacagggatctttcgactcctttaccgtgcaatacaaggatcgcgatggacgccctcgggcagtgcgcgttggcggaaaggaaagcgaagtgactgttggagggctggaacctgggcacaagtataagatgcatctgtatggactgcacgaggggcaaagagtgggccctgtgagcgctgtgggtgtcacagccccacaacaagaggaaacgccacccgcaaccgaatccccattggaaccgcgactaggtgagttgaccgtcacagacgtcaccccaaacagcgttgggctgagttggactgtgcccgagggtcagttcgattccttcattgtgcagtataaggataaggatggccaaccacaggtcgtgcctgtggccgcagatcagagagaggtcaccgtttataacttggagcccgagcgtaagtataagatgaatatgtacgggctgcatgatggacagagaatgggccctctctcagtggtaatcgtcactgccccactgccacccgctcctgctactgaggcctctaagccgcctttagaacccagattaggggagctgaccgtgacggacattacccctgattctgtgggattgtcctggacagttccggaaggcgaatttgactcctttgtagtccagtataaagaccgcgacggacagccccaggtcgttcctgtggctgctgaccagcgagaagttactattcctgatctagagcccagcaggaagtacaagtttttgttgtttggcattcaagacggaaagcggaggagcccagtctctgtggaagccaaaaccgtagctagaggggatgcttctccgggagcgcctccccgacttggggaactgtgggtgaccgatcctaccccagatagcctgaggttatcttggaccgtgccggagggccaattcgactcgtttgtggtgcagtttaaggacaaggacggtccgcaggtcgttcctgtcgaagggcacgagagaagcgtcaccgtgactccactagatgccggtcggaaatatagatttctgctgtacggcctgcttgggaagaaaaggcatgggcctttaacagccgacggaactaccgaggctcgctccgccatggacgataccggcacaaagaggccacccaaacctcgcctcggtgaagaactccaggtgaccacagtgacacagaactctgttgggttgtcttggactgtgcccgaaggccagttcgattccttcgtagttcagtacaaagatcgggacggccagccacaagtggtgccggtggagggcagtctccgggaggttagcgtcccaggtctggatcccgcacaccgatacaagttgctcctctatggcctgcaccacggaaagcgagtgggacccatttcagcagtcgccattaccgctggaagagaggagacggaaaccgaaaccacagcccctaccccacctgcacctgagccacatctgggagaattaacagttgaagaggcaaccagccacacccttcacctgtcctggatggttacagagggggagttcgacagctttgagatacaatacaccgatagagacggccagctgcagatggtccgcattggcggtgacagaaacgacatcaccctctcaggactggagtctgatcatagatacctcgtcaccctgtacgggttcagtgacggcaagcacgtgggccctgttcacgtagaagcactgacagtgcctgaggaagaaaagccttcagagcctccaacggctacccctgaacctcccattaagcccagattaggcgagttgacggtgactgatgccacccctgattctctgtcactgtcttggaccgtgccagaagggcagttcgatcattttctggttcagtaccgtaacggagatgggcagcctaaggccgttagagtgccaggccatgaggagggcgttactattagcggtttggaacctgaccacaaatataagatgaacttatatgggtttcatgggggacagcgaatgggccctgtcagcgttgtcggagtgaccgcggctgaggaggagactcccagtcctactgagccatctatggaggcccctgaacccgctgaagagccactgctgggagagctaacagtgacaggatcatctcctgactctctatccctatcttggaccgttccacaaggaaggtttgattcattcaccgtccagtacaaggaccgggatgggaggccccaggtggtcagagtgggaggcgaagaatcggaggttactgttggcggacttgagcctggaagaaaatataaaatgcacctgtacgggctccacgaaggtcgacgtgtgggtcctgtgagtgctgtcggtgtgactgccccagaggaggaatcccctgatgccccactggccaagttacggctggggcagatgacagtccgcgacattacctctgattctctgagcttgtcctggacagtgccagaagggcagttcgaccacttcctggttcagttcaagaacggcgatggccaaccaaaagccgtcagagtgccagggcacgaggacggggttactatctcgggcctcgagccagaccacaagtataaaatgaacctatacggatttcacggaggccagcgggttggtcctgtaagcgctgttggcctcacggcacccggtaaagacgaggagatggccccagcttctactgaaccccctacccccgaaccgccaatcaaaccccgactggaggagttgactgttacagacgcaacaccagactcactgtccttgagttggaccgtcccagagggacagttcgatcacttcctggtgcagtacaaaaatggggatgggcaaccaaaggccactagagtgccgggacatgaggaccgagtcactatctctggtctcgaacccgataacaagtacaaaatgaacttatacggattccacggaggacaaagagtgggccctgtcagtgctataggggtaacagcggcagaagaggaaactcctagccctaccgagccttccatggaagcaccagagcccccagaggaacccctcctcggcgagctgaccgtcaccggaagcagtcccgacagcctgtcgctgtcttggaccgttccccaaggcaggtttgacagtttcactgtgcagtacaaggatcgtgatggcaggcctcaggtggtgcgggtggggggagaggaaagcgaggtcacagtgggcggactggaacctggcaggaaatacaagatgcacttgtatgggctgcacgaggggagacgcgttggcccagtctctacggtgggggtcacggctcctcaggaagacgtagacgagactccttccccgaccgagcctggcacagaggcaccagagccaccagaggagcctctgcttggcgagctgactgtgacaggcagctctcccgattccctgtccctttcttggaccgtgccgcagggtcgattcgattcgtttacagtgcagtacaaggatcgcgatgggaggccacaggcagtgcgggtgggcggacaggagagcaaggtcaccgtgagaggactcgaaccaggcaggaagtacaagatgcacttgtatggcttgcacgagggtaggaggcttgggccagtaagtgccgtgggagttaccgaggacgaggccgaaacaacccaggccgttccgactatgacacctgagccacccataaagcctcggctcggggagctcacaatgacggatgcaacaccggattctttatctctgagctggactgttcccgagggccagtttgaccactttttggtgcaataccggaatggggatggacaacctaaggccgtcagagtgcccggacacgaggatggagtcaccatctctggcctcgagcccgatcacaagtacaagatgaatttgtatgggtttcacggagggcagagggtagggccaattagcgtgataggcgtcacagccgcagaagaggaaaccccttctcccaccgagctttcgaccgaagcgcctgagcctcccgaggaacctctgctcggagagcttaccgtgactgggtcttctccagactctctaagtctcagttggaccataccacaaggccactttgatagcttcaccgtgcagtataaggatcgtgatggtagaccacaggtcatgcgagtccgcggagaggagagtgaagtcaccgtgggcggactggaacccggaagaaaatataaaatgcatctgtacggactgcacgagggcaggcgcgtcgggcctgtgtcgactgttggcgttacagttcctactacgacaccagaaccccctaacaagcccaggctgggagagttgacagtcactgatgcaactccggactcactgagcctctcgtggatggtgcccgagggacagtttgatcactttctggtgcagtatcggaatggggacggccagccaaaggtagtacgagtgcctggacacgaggatggcgttacgattagcggtttagagcctgaccataaatacaaaatgaacctgtacgggtttcatggcggacagcgggtcggccctatatcagtgatcggcgtgaccgcggcagaagaggaaactcccgcacccacagagccgagcaccgaggcacccgagcccccagaagagccacttctgggagaattgacagtaacgggatcatcccccgactcattgtccctttcctggacaatcccccagggcaggtttgattccttcaccgttcagtacaaggatcgggatgggaggccgcaagtcgtccgcgtccgcggagaagaaagcgaagtcactgtaggagggctggaacccggatgcaagtacaagatgcacctttacgggctccacgaaggacagagagtcgggccagtgagtgccgtgggcgtgaccgtgcctacgatgactcccgaaccgcctatcaagccaaggctcggtgaactgacagtgaccgacgcaacacctgacagtctgagtctatcttggatggttcctgaaggccaattcgatcattttctggttcagtatagaaacggagacgggcagccgaaagccgtcagggtgcccggacacgaggacggtgtcactataagtgggctggaacctgaccacaaatacaaaatgaacctgtacggattccatggcggtcagagagtgggcccagtgtcggcgataggggtgacagaggaggaaacccccagtccaactgagcccagcaccgaggccccagaggccccagaggagccactccttggcgaactgactgtgaccggcagttcacctgactcactctcattgtcgtggaccgttccccagggccgatttgattcattcaccgtccagtacaaagaccgcgacggtcagccacaagtggtccgagtgcggggagaggaaagcgaggtcacagtcggaggactggagccaggcaggaaatacaagatgcatctatatggcctgcacgaagggcagcgtgttggcccagtgtcgactgtggggatcactgctcccctgcccacgcctctccctgtggagccacgcctgggcgagctggctgtggcggctgtgacctcagatagtgtcgggctgtcctggacagtcgcccaaggccctttcgattccttcctcgttcagtatagggacgcccaaggacagccacaggcagtgcctgtctccggcgaccttcgggctgtagcagtgtcagggctcgaccctgctcgcaagtataagttcctgttattcggtctgcagaacggcaaacgacatggcccagtgcccgtggaagccaggactgcgcctgacaccaaaccttccccacggctgggagaactcacagtaacagatgctacaccagactctgtggggctgtcttggactgttcccgaaggggaattcgatagttttgtggtacagtataaggacaaggacggaaggctgcaggtcgtccctgtggctgccaaccaacgcgaagtgacggtccaggggctagaaccatctcgcaagtatcggtttctactctacggtttgtccggtcggaaacgactcggccctatctcagcagattccacaaccgcgccactcgagaaggagctccccccacatctgggtgaactgaccgtagctgaggaaacaagtagtagcctacgcctcagttggaccgtcgcccaaggccctttcgactcctttgtggtgcaataccgggacacagatggccaaccacgggctgtgcccgttgccgcagaccaaaggaccgtcacagtggaagacctggagccaggtaagaaatacaagtttctcctgtacggtctgctggggggtaagagactcggacccgtttccgccctcgggatgaccgccccagaggaggacacgccagctccggagctagccccagaagccccagaacccccagaagagccacgattaggtgttctcactgtgacagacaccacacctgatagcatgcgtctatcgtggtcagtggctcaggggccattcgacagttttgtcgtgcagtacgaagatacaaacggccagccacaggcactgcttgttgacggggaccagagtaagattttgatttccggcttggagcccagcacaccctaccggtttttgctgtacggtctgcacgagggcaagagattgggacccctgtcggccgaaggaacgactggattagcaccagctgggcagaccagtgaagagtccaggccaagactttcacagttaagcgtgacagacgtcacaacctcctctttgcgactcaactgggaagccccaccgggagctttcgacagtttcctactgaggtttggcgtgccgagccctagtactctggaaccccaccctagacccctccttcaacgcgagctgatggttccagggactcggcatagcgcagtgttacgcgatcttaggtctggtaccctgtacagtctgactttgtacggcctgcgcggtcctcacaaagcagacagcatacagggcaccgcacggacattatcccctgtgctcgagagtccaagggatcttcagttcagcgagatcagagaaaccagcgccaaggtaaactggatgccaccgccttctcgcgctgactcattcaaagtctcttaccagttagccgatgggggagagccccagtctgtacaggtggacggccaagctagaacccagaagctccaggggctgattcctggagccaggtatgaggttaccgtagtgagcgtaaggggttttgaggagtctgaacctctgaccggctttcttactaccgtgcccgacgggcctacccaacttagagctctcaatctgacggagggctttgcagtgctccactggaaacctccccagaatcctgtcgatacctacgatgtccaggtgactgcacccggtgcaccgccactgcaggcagagaccccgggatcagccgtagactaccccctgcacgatctcgttttgcataccaactacaccgccaccgtaagaggactgcgcggtccgaatcttacaagccctgctagcattaccttcacaaccggacttgaagccccaagagacctggaggctaaagaggtcacgccacgcaccgccttactgacctggaccgagccacctgtgcgcccagcaggttacctgctcagcttccacaccccgggaggacagaatcaagagatcctgctgcccggaggtatcactagtcatcagctgcttggacttttcccaagcacatcctacaatgcacgcctccaagccatgtggggccagagcctgctgccccctgtctcaacttcctttacaacaggtgggctgagaatcccattcccacgcgactgcggagaggaaatgcagaatggcgcaggtgcaagtcgcacgtctaccatatttttaaatggcaaccgggaaagaccactgaacgtgttctgtgacatggagacagatggtggcggttggcttgtctttcaacgtagaatggacggacaaacagacttctggcgagattgggaggactatgctcatggattcggaaatatctccggggagttttggctgggaaacgaggccctgcacagcctgacccaggctggagactattccatgagagtagatctgcgggctggcgacgaagctgtctttgcccaatatgactccttccacgtcgatagcgcggcagagtactacaggttacacctggaggggtaccacggcactgctggtgacagcatgagttaccattctggaagcgttttcagcgctagagacagagaccctaatagtctgcttatttcctgtgcggtgtcatacagaggagcatggtggtacaggaattgccattatgccaacttgaacgggctatacggcagcactgtagaccatcagggcgtctcatggtatcattggaagggctttgagttcagtgtcccttttactgaaatgaagctcagacccagaaacttccgcagccctgccggtggcggatag

SEQ ID NO: 243717 - DNA, 6449 bp, Artificial Sequence
  Description of Artificial Sequence: Synthetic coding sequence
taagctgaagaggaaacaccatccccgaccgagccgagcatggaagccccagaacccgctgaggagcctctgctcggtgaactgactgtgaccggctcctctcccgactccttgagcttgtcatggacggtcccgcagggcagatttgacagtttcaccgtccagtacaaagatcgcgacgggaggccccaggttgtgcgcgtggggggagaagaatccgaggttacagttggaggcttggagccaggccgaaaatacaagatgcacctgtacggtttacacgaagggagaagggtggggccagtatccgcagtaggagtcactgcccctgaggaagagtcccccgatgctcccctcgccaagctgcggctaggccagatgaccgtgagagacattactagcgactcgttgtctttgtcttggaccgtccccgaggggcagttcgatcacttcctcgtgcagttcaagaacggggatggccagccaaaggccgtccgtgtcccagggcacgaagacggtgtcacaatctctggactagagcctgaccacaagtataagatgaacctgtatggattccatggtggtcagagggtgggccctgtgtctgccgtgggcctgacagctcctggcaaggacgaggagatggctcccgcttcgacagaacctccgacccccgagcctcctattaagcccagactcgaggaattgacagtaaccgacgccactcccgatagcttatccctctcttggactgtccctgaaggacagtttgatcacttcctcgtgcagtacaaaaacggagacggccagccaaaggcaaccagagttcccggtcatgaggatagagtaactatctctggactggaaccagacaacaagtataagatgaatttatacggcttccatggaggccagcgagtcggaccagtctccgcaataggggtaaccgccgcagaagaggaaacgccatcccctaccgagccttctatggaggcaccggagcccccagaagaacctctgctgggggagttaacagttacaggctcgagccccgattccctgtccctgagctggaccgtgcctcaagggagatttgactcattcaccgtgcagtacaaggacagggacgggcgaccccaggtggtgcgggtgggcggtgaggaaagcgaggtgaccgtgggaggtctcgagcccggaaggaaatataaaatgcatctgtacggcctgcatgaagggagacgggtcggtccggtgagtaccgttggtgtgactgctccgcaggaggacgttgatgagacaccgtcccccacagaacctgggactgaggctcccgagcctccagaggagccactccttggggaacttactgtcacgggtagcagtcccgattctctttctctgagctggacagtacctcagggtcgattcgattcattcacagtgcagtacaaggaccgggacggaaggccgcaggctgtacgcgtcggcggacaagagagcaaggtgaccgtcagaggtctcgagcctggtcgcaaatacaagatgcacctctatggactgcatgagggcagaagactgggcccagtctccgccgtgggtgtgaccgaagacgaagcagagaccacccaggctgtcccgaccatgactcctgaacctccaatcaagccacggctgggagagctgaccatgaccgatgcgactccagatagtttgtccctgagctggactgtccccgaaggtcagttcgatcattttcttgtccagtatcgcaatggtgacggccagcccaaggcggtgagagtgccaggacacgaggacggggtaactatctctggtctggagcctgaccacaaatacaagatgaatctgtatggttttcacggtgggcagagggttggccctattagtgtgactggagtgacagccgctgaagaggagactccatcccctacagaactgagcaccgaggcgcctgagccacccgaggaaccccttctgggtgagctcacagtcacagggtcctcgcccgactctctcagcctgtcctggacaataccacagggacacttcgacagctttaccgttcagtataaagacagagacggcagaccccaggtgatgcgggtgagaggcgaggagtccgaagttaccgtgggaggtctggaacccggacggaagtacaaaatgcacttgtacgggctacatgaaggccgaagagttgggccagtgtcaactgtgggtgtcaccgtgcccaccactacacctgagccacctaacaaaccgaggcttggtgagctcacggtgactgacgccacccccgactcactgtccctgtcctggatggtgcccgagggccagtttgatcattttctggtacagtaccggaacggggacggccaaccaaaagtggtgcgagtgccgggtcacgaggatggggtaactatcagtggactggagccggatcacaagtataagatgaacctgtacgggttccatggtggccagagggttggcccaatctccgtgatcggcgtaactgccgcagaggaagagacaccagcccctaccgagccaagtacggaggcgccagaacctccagaggaacctttgctgggagaactaacagttacagggtctagccccgacagtctttcgttgagttggacgatacctcagggcaggtttgattcctttaccgtgcaatacaaggatcgggacggcagacctcaagtcgtgagagtacgcggtgaggagtctgaggtaaccgtgggaggtctcgagcctggctgtaaatataaaatgcatctctatggactgcatgaagggcagagagtgggccctgtgtcggctgtgggcgtgacagtcccaaccatgacccctgaacccccaatcaaacctcgactgggagaactcactgtcaccgatgcaactcccgattcacttagcctttcctggatggttcccgaaggccagttcgaccacttcctagtccagtaccgaaacggcgacgggcagccgaaggctgtccgtgtaccgggtcacgaggacggcgtgactatctcaggcttggaaccagaccacaaatataagatgaacctttatggcttccacgggggacaacgcgtcggcccagtttctgcaatcggcgtgaccgaagaggaaacaccttcccctactgagccctcgaccgaggcgccagaggcccctgaagaacccttgctcggcgaactgaccgtcaccggctcctcacccgacagtctgtcgctgtcatggacagtgccccagggtagatttgactcctttacagttcagtacaaggaccgggatggccaacctcaggtcgttcgagtccgaggcgaggaaagcgaggtcaccgtcggcggtctggagcctggacgaaagtacaagatgcatctgtacgggctccacgaaggccagcgcgtcggcccagtttccactgtgggcattacagctcctctgccaacacctctgcctgtcgaacctcgcttaggagagctggcggtggccgctgtaacaagcgattccgtaggtctctcttggaccgtggcccaggggccatttgacagctttttagtgcagtatcgggacgctcaaggacaaccccaagcagtgccagtgtcgggggacctgcgggctgtcgctgtgtctggtcttgatcccgctagaaagtacaagttccttctcttcggcctccagaacggtaagcgtcatggaccagtccccgtggaagcccgtactgctcctgatacaaagcctagtccaagactgggcgaattgacggtgaccgacgctaccccagatagcgtgggtctgtcctggaccgttcccgagggcgagtttgattcgttcgttgtccagtataaggataaggacggcagacttcaggttgtgcccgtggcagccaaccagagggaggtaaccgtccagggacttgagccatcaagaaaatatcgctttctgttatacggactttccggcagaaagcgtctgggcccaatctccgctgattctacaacagctccactggaaaaggagctaccccctcatctcggcgaacttactgttgcagaggaaacttcaagtagcttacgattgagctggactgtcgcccaagggccatttgactcctttgttgtccaatatagagacaccgacgggcagccccgagctgtccccgtggcagcggaccaacgcactgtcactgtcgaagacctggagcccggaaaaaagtataaatttcttttatacggtttgctggggggaaaacgtctggggccagtatctgccttggggatgaccgcccctgaggaagatacacccgcaccggagctagctcctgaagctccggaacccccagaggaaccaaggctgggggtccttactgtgactgatacaacaccggacagcatgaggctttcttggagtgttgctcaaggtccgtttgactctttcgtcgtacagtacgaggatacaaacggacagccacaggccctgctggttgacggcgaccaaagtaaaatcctcataagcggcttggaaccgtcaaccccatacaggtttctgctgtatggactccatgaaggcaaacgattggggcctcttagtgctgagggcacaaccggcctggcccctgctgggcaaacaagcgaagagtcccgaccacgcctctcccagctgagtgtaaccgacgttacaacatcctcactgcggctgaactgggaggccccacctggtgcctttgattcgtttttactacgctttggggtcccttctccctccactctggagccacatccaagacctctcttgcagagagaactgatggtgcctgggactcgacatagcgccgtgctgcgagatctacgtagcggaacgctgtattcactgaccctgtatggcctgcgaggaccgcacaaggctgactctattcagggtactgcacgcacactctctccagtcttggagtctccacgggatctgcagtttagcgaaatcagggaaacgtccgcaaaggtaaattggatgccccctccctcacgggctgattcatttaaggtttcatatcaactggcagacggcggagaaccccagtccgtccaggtagacggacaggctcgcacccagaaactgcagggactcatccctggagctcgttatgaggtcactgttgtgtccgtccgcggatttgaggaatccgagcccctcaccggtttcttaacaacagttccagatggtcccactcaattgagagccctgaatctcactgagggctttgccgtgctgcattggaaaccaccccagaaccctgtggacacttacgacattcaagttacggcacccggtgctccacccctgcaggctgagacccccggtagcgcggtagactacccacttcacgacctggtgctgcacacaaattatacagccactgtgcggggactaagaggccctaacttgacctcaccggctagcatcacttttaccaccgggcttgaagcaccaagggatttagaagccaaagaggttacaccacggacagctcttctcacttggaccgaacccccagtgcgcccagccggttacctactgtctttccacactcctgggggacagactcaggaaatcctgctccccggtgggataacatcccaccagctgctggggttgtttcctagtacttcttacaatgctcggttacaggccatgtggggccagtccctgcttccaccagtctcgacatccttcactacaggcggtctgagaatcccttttccacgggactgcggcgaggagatgcagaatggagcaggcgctagtcgcaccagtaccatcttcctgaacggcaaccgggagcgtcctcttatagttttctgtgacatggagaccgatggcggaggctggttggtgttccagaggcggatggacgggcagactgatttttggagggactgggaggattacgctcatggcttcgggaacatctctggggagttctggctcgggaatgaggcgcttcattcgctgacacaggccggtgactactcaatgagggtcgacctgagagccggagacgaggcggtgtttgctcaatacgacagtttccacgtcgacagtgcggcagaatactatagactccatttggaaggataccacggtactgcgggagactccatgtcctatcattcggggtctgtgttcagcgcgagagaccgagacccaaattctctgctgatatcatgcgccgtgtcataccggggtgcatggtggtataggaactgccactatgccaatcttaatgggctgtatggctcaaccgtggatcaccagggtgttagttggtaccattggaagggcttcgagttctcggtgcccttcacggagatgaaacttaggccgagaaatttcagatctcccgcaggcggtggcta

SEQ ID NO: 243718 - DNA, 27 bp, Artificial Sequence
  Description of Artificial Sequence: Synthetic coding sequence
atgatgcctgcgcagtacgccttgtag

SEQ ID NO: 243719 - DNA, 27 bp, Artificial Sequence
  Description of Artificial Sequence: Synthetic coding sequence
atgatgcccgcacagtatgccctctag

SEQ ID NO: 243720 - DNA, 9890 bp, Artificial Sequence
  Description of Artificial Sequence: Synthetic coding sequence
taatcaagtcccctgggtctgcttggcactactgatgaaccgccaccctcaggaccctccactacccaaggagcccaggctccgctgttacagcagaggccccaagagctgggggaactgcgcgtcctgggcagagacgagaccggcagacttagggtcgtctggaccgcccagccagacaccttcgcctattttcagctgagaatgagagttcccgagggacctggggctcatgaagaagtgttgccaggtgacgtgagacaggcgctggtcccacccccaccccctggaacaccttacgagctgtccctgcatggcgtccctccaggcggtaagccatcagatcctattatatatcaagggattatggataaagacgaagagaagcccggaaagagctctggccctcctcgcctgggcgagctcacggttaccgatcggacttcggacagtctcctgctgcgctggaccgtgccagaaggagagtttgatagctttgtgatccaatataaagatagggatggacagccacaggttgtgccagttgagggaccacagcgatctgctgtgatcacctctttggaccctggaagaaaatacaaatttgtgctctacggatttgtaggaaaaaagagacatggacctttggtggcagaagctaagatccttcctcagtccgaccccagccctggcaccccaccacatctcggtaacctgtgggtgacagaccctaccccggattctttacacctgtcatggacagtacccgaagggcagtttgatacgtttatggtgcagtatagagacagagatgggaggccacaggtggttccagtggaagggccagaaaggagctttgtggtttctagtctggacccggaccacaagtaccggttcaccctatttgggatcgctaataaaaaacgatacggccctctgacagccgatggaacaacagcccctgagagaaaggaagagccacccagacccgagtttctcgaacaacccctgctgggcgagctaaccgttacgggggtgacacctgattccctacgcttgtcttggacggtagcccagggcccatttgatagttttatggtgcagtacaaagatgcccaggggcagccccaggccgtgccagttgctggagacgaaaatgaggtgaccgtgcccggtttagatccggaccgaaagtataagatgaacctatacggcctgcggggaaggcagcgagtcggcccagaatccgtggtagctaagacagccccacaggaggacgtggacgaaaccccatcgccgactgaactcggtacagaagcaccagagtctccagaagaacccttgctgggcgagcttactgttaccggctccagtccagatagcctgtccctattttggacagtgccacaaggatctttcgacagttttactgtccagtacaaggaccgagatggaagacctcaggctgtgagggtgggtggcaaggaaagtgaagtgaccgtgggtggacttgagccaggccacaagtataagatgcacctgtacggtctgcacgagggacagcgggttggcccagtgtctgctgttggggtcaccgcccctcagcaggaggaaactccccctgccaccgagtctccactggaacccaggctgggagaactgactgtgacagatgtcacccctaattccgtagggttgtcttggaccgtcccggagggtcagtttgattctttcatcgtccaatacaaggacaaggatggtcagcctcaggtggtgcctgtcgccgcagatcagagggaagtcactgtatataacctcgagcctgaacggaagtacaagatgaatatgtacggcttacacgacggacaacggatggggcctttatctgtggtcatcgtgacagcgccattgccccctgccccagccacagaggcaagtaagcctcccctagagcctcggttaggtgaactgactgttactgatattacacctgactcagtcggacttagttggactgtaccagaaggagaattcgacagcttcgtggtgcagtataaggatcgagacgggcagccccaggtggttccagtggcggcagatcagcgtgaggtgactattcctgaccttgaaccatcccggaagtacaaatttcttctgttcggtatacaggacggtaagcgcaggtcgccggtttccgtggaagccaaaaccgtggctaggggagatgcttcccctggagcccctcctaggctgggtgaactgtgggtgacagaccctaccccggatagtctgcggctatcttggactgtgccagaaggccaatttgattcattcgtggtgcaattcaaagacaaagacggcccacaagtggtgcctgtggaagggcatgaacgcagcgtaacagtaacgcctctggatgccggacgaaagtataggttcctcctgtacggcctgctcggaaagaaacgacacgggccactcactgccgacggcaccactgaggcccgatccgcaatggacgacactggaactaagcgcccacctaaacctcgattaggggaagaactccaggtgactactgtgacacagaacagcgtcgggctgtcttggacagtgcctgaaggacagtttgactccttcgtggtccaatacaaagatcgagatggacagccccaggtcgttcccgtcgagggcagccttagggaagtttctgtgcctggacttgacccagctcaccgatataagttgctcctctatggactacaccacggcaaaagagttggcccaataagcgcagtggctattacagccggaagggaagagacagagactgagacaacagccccaacgcctcctgcccctgagcctcacctcggcgaactcacagtcgaagaggccacctcccacacccttcacttgtcctggatggtgacggagggagagtttgactcctttgagatccagtatacggaccgtgacgggcagctccaaatggtccgcattgggggagacaggaacgacatcaccttgtccgggctggaatccgaccaccggtatctagttacactctatggcttcagtgacggaaagcacgtggggccagtccacgtcgaggcccttactgtccctgaggaggaaaaaccttccgaaccaccaaccgcgactccagaacccccaattaaaccaagactcggagaactcacagttacggatgccacaccggactcgctctcactctcctggaccgtgcctgagggtcaatttgaccattttcttgtccagtatcggaatggagacggccaaccaaaggctgtcagagtccccggacacgaagagggtgtgaccattagtggacttgagcccgaccacaagtataagatgaatttgtatgggttccatggcggacagcggatgggacccgtgtctgtcgtgggagtgactgctgctgaagaggagacaccttcccctactgagcccagcatggaggcgccagaacccgcagaagaaccgcttctaggggagctaacggtgaccggctcctcgcccgattctttgagtctctcgtggacggtgccacaagggagattcgacagctttaccgtgcaatataaggatcgcgatggcagaccgcaggttgtgagagtgggcggtgaggaaagtgaagtcacggtcggaggtttggagcccggtaggaagtacaaaatgcatctctacggcctgcatgagggtcggagggtgggccctgtcagtgcggtgggagttacagccccagaggaggaaagtcccgatgccccattagctaagctgaggctgggccagatgactgtgcgggacattactagtgattccttgagcctgtcctggactgtgcccgagggacagttcgaccattttctggtgcagttcaagaacggagatggccagccaaaggctgtgcgagtgcccggacatgaagatggagttactatctctggtctcgaaccagatcataagtacaaaatgaatctttacggcttccacggtggccaacgggttggtcccgttagcgcagtaggtctgactgctcccggaaaggatgaggaaatggcacctgcctccacagaaccccctactcccgagcctcccataaaaccaaggttagaggaattgactgtcactgatgccacaccagattctctgtccctctcatggactgtgccagagggccaatttgaccatttcctggttcagtacaaaaacggtgatgggcagcctaaagccaccagggtgccagggcacgaggatcgggtgacaattagcggcctggagcccgacaacaaatacaagatgaacctgtacgggttccatggaggtcagagggtcggcccagtctctgctatcggcgtgactgccgctgaagaggagacaccatcaccgaccgaaccaagtatggaggcccctgagccgccagaagagccattgctgggcgaactgaccgtgaccgggtcctctccagacagcctgagcctctcgtggaccgttccccaggggcgattcgattcttttacggtgcagtataaagatagggacgggcgaccccaggtggtccgcgtcggcggagaggaatctgaggtgacggtgggtggtttggagcctgggcgaaagtacaagatgcacttgtacggcctgcacgaaggacggagggtcggtccagtgtcaactgtgggcgtgacagcaccacaggaagacgtggacgagaccccatcccctacggagccgggaaccgaggcacccggacccccagaagagcctctgctgggtgaactgactgttactggctctagtcccgattcactttcactgtcttggacagttccgcaagggagatttgatagttttacagtgcaatacaaggaccgtgacggccgaccccaggcagtgcgtgttggcggacaggagagcaaggtgactgtaagaggtcttgaacctggtcggaaatacaaaatgcacctgtacggactgcatgaaggcaggcgcctggggccagtgtctgccgtgggtgtgaccgaggacgaagcagaaactacgcaggcagtgccaactatgacacctgaaccaccaattaagcctcgtctcggcgagcttaccatgacagacgcgacacctgactccctatcactttcatggaccgtgccagaaggccagttcgatcattttcttgtccagtaccgcaatggggatggccagccaaaagctgtgcgtgtgcccggtcacgaggacggagtcaccatttcagggctggaaccagatcataagtataagatgaacttgtatggctttcacggcggacagcgcgtcgggccaatctcagtcattggcgtgacagctgcagaggaagaaacgcccagccctacagagttgagcaccgaagcgccagagcctcctgaggaaccgcttttgggcgagttgactgtaactggcagctcccctgattcactgagccttagttggactatacctcagggccacttcgactcattcaccgtgcagtataaagaccgcgatggccgtccacaggtgatgcgcgtcaggggggaggaaagcgaggttacagtggggggactggagcctggtcggaagtataaaatgcacctatacgggctgcacgaggggaggagagttgggccagtatctaccgttggagtgacagtccctaccacaacacctgagcccccaaacaagccaagactgggagaactcacggtgacagacgccactcccgacagtctgagcctctcttggatggtgcccgagggccaattcgaccactttttagtccaataccgaaacggtgatggacagcccaaggtggttagggtacccggtcacgaggatggagtgacaatctccgggctggaacctgatcataaatataaaatgaatctttatggctttcatggtggccagagggttggacccatatctgtaattggagtcaccgctgctgaggaggaaacgccagcgcctaccgagccatccacggaagctccggaaccacccgaggagcctctcctgggtgaactgaccgtgacaggaagctctcccgactcattgagccttagctggacaataccacaggggagattcgattcttttactgtacaatacaaagatcgggacgggcgtccccaggtggtgcgggttcggggtgaagagagtgaggtcaccgtgggcggacttgagcctggctgtaaatataaaatgcatctatacggacttcacgaagggcagagagttgggccagtgtcagccgtcggcgtcactgttccaacgatgacccctgagccacctataaaacctcggttaggtgaattgaccgttactgacgcgacccctgactccctctctctttcctggatggttccggaagggcagttcgaccatttcctggtccagtacaggaatggtgatggacaacccaaagcagttagagtcccaggccatgaggacggggtgacaattagcggcttggaacctgatcacaaatataaaatgaatctctacggctttcacggaggtcaaagggtgggacccgtctcagccattggcgtcaccgaggaggaaactccctccccgactgagccctcaacagaagcccctgaggccccagaggagccactcctgggtgagctcactgtgactggttcttcaccagacagtctgtccctgtcctggacggtccctcaggggcgttttgattcatttaccgtccaatacaaagaccgtgatggacagccacaggtggtgcgcgttcgtgtggaagagtcagaggtgaccgtgggaggattggagcctggtaggaaatacaaaatgcatctttatggtttgcatgaaggacagagggtgggtccggtgtccaccgtgggcatcactgcaccactgcccacacctctgcccgtggagccaagactcggcgagctcgctgtggctgccgtcacaagtgattcagttggacttagttggacagttgctcagggccctttcgacagttttctagtgcagtatagagacgctcagggtcaaccccaggccgttccagtcagtggcgacctacgggctgtggccgtgagcggtctagatcccgcacgaaagtacaaatttctcctgttcggtcttcagaatggcaaacgtcacggcccagttcccgttgaagccaggaccgcaccagataccaagccgagccccaggctcggtgaacttaccgtcacggatgccacccctgacagtgtgggtctgtcatggacagtcccagagggggagttcgattcttttgtagtgcagtataaggataaggacggacgactccaggtggtccccgtggcagctaatcagagggaggtgacagttcagggccttgaaccgtcgaggaagtaccggttccttttatatggactctcaggacgcaagcgactcgggccaattagtgcagattcgacaaccgccccactcgaaaaggagttgccaccacaccttggagaactgaccgtagccgaggagacatcttcttccctgcgtctcagctggacagtggcccaggggccttttgactcatttgtcgtccagtaccgggacacagacggtcagcctcgggctgtgcctgtggccgctgaccagaggaccgtgaccgtggaggacctggaaccagggaaaaagtacaagttcttactgtacgggctgctggggggaaagaggctgggcccagtgagcgccttggggatgaccgcacccgaggaggatacacctgctcccgagctggctcccgaagcccctgaaccgcctgaagagcccagactgggagtgttaactgtaacagacaccactcccgacagtatgagactcagttggtcagtggctcagggtcccttcgatagctttgtcgttcagtatgaagacactaacgggcagccacaggcgttactggtggatggagaccaatccaaaatcctgattagtggtctggagccgtccactccctacagattcctgctctacggactacacgaaggcaaacgattgggccctctgtctgcggagggtacaactggcctcgcgccagcgggtcaaacatccgaggaatctcgcccaagacttagtcagctttctgtcacagatgtcacaactagctccctccgtcttaactgggaggctcctccgggagctttcgattcctttctgctaagattcggggtcccatccccctctactctggagccacatcctcggccactcctccagagagaactaatggtgcccggtactcggcattctgctgtgctgcgcgatttgcgctccggcaccctttatagtctaacgctatacggtttgcggggaccacacaaagctgacagcatccagggcactgcaaggaccttgtcaccggtgctggagtccccaagggacctgcagttcagtgagattcgcgagacaagtgcgaaggttaactggatgcctccccctagccgcgcagactcatttaaggtgtcttaccagttggccgatgggggagaaccccaatctgtgcaggtcgacggacaggccagaacccaaaaacttcagggattgattcccggagctagatacgaggtgactgtcgtaagcgtacgaggattcgaggagtctgagcccctgacaggcttcctcacaacggtacctgatggaccgactcagcttcgggctctcaacctgacggaaggctttgcagtactgcactggaagccacctcagaatccagtcgatacatatgatgtccaggtgactgctcccggtgcccctcctctccaggccgaaacccctgggagtgctgtcgattacccccttcatgaccttgtcttgcacaccaactatacagccactgtacggggacttagaggacctaacctcacatccccagcatcgatcacatttaccaccggcctggaggcgccaagagacttggaggccaaggaagtgacaccgagaacagcactgttgacatggacagagccacctgtgaggcccgctggatatctgctgagctttcacacacccggtggccagaatcaggaaattttgctcccgggaggaattacgtctcatcaactcctggggctgtttccttccacctcctataacgctcgtctccaggcaatgtgggggcagtctctcttacctcctgttagtactagttttaccacaggaggcctgaggataccttttccacgcgactgtggcgaagagatgcaaaatggagcgggtgcatccaggacctcaaccatcttcttgaacggcaacagagaaagacccctaaatgtgttttgcgacatggagacagacgggggtggttggctggtctttcagcgccgaatggacggtcagaccgacttctggcgtgattgggaggactatgcccacggtttcggtaacatttcaggtgaattctggctcggcaacgaggcactgcactccctgacccaggctggagactacagtatgcgagttgatctgagagccggagatgaggccgtgtttgcacagtacgattcctttcacgtcgactcagctgcggaatactaccgattgcacttggaggggtatcatggtaccgccggtgacagtatgtcctaccactctgggagcgtgttctcagcccgagatcgagacccaaactctctgttaatcagctgtgccgtgtcttaccgtggggcatggtggtatcgcaattgtcactatgcaaatttaaacgggctgtatggatctaccgtggaccaccagggtgtgtcatggtaccactggaagggcttcgagttctccgtgcctttcacagaaatgaagctccgcccaagaaactttcgttcgcccgcaggaggtggtta

SEQ ID NO: 243721 - DNA, 12669 bp, Artificial Sequence
  Description of Artificial Sequence: Synthetic coding sequence
atgatgcctgctcagtacgctctcacctcttctctggttctcttggtgctgctgtccactgctcgggctggccctttctccagccggtcaaacgttaccctgccggcacctagacccccaccccaacctggcggtcataccgtgggcgcaggcgtaggaagtccatcctctcagttatacgagcacaccgtggaaggcggagagaagcaagtggtttttacacaccgcatcaacctgccgccaagcactggctgtggctgtcccccaggcaccgagccccctgttctggcaagcgaggtccaggcactcagagtgcggttagagatattggaggagctggtgaagggcctgaaagagcaatgcacgggaggctgttgccccgcatccgcacaggctgggaccggccagactgatgtgcgtactctgtgttccctccacggggtcttcgatttgtcccgctgcacttgttcttgtgaacctggctggggtggccctacatgttccgacccaacagacgctgagataccaccctctagcccgccttcagcaagcggctcttgccctgatgattgtaatgaccaggggagatgcgtgcgtggcagatgcgtgtgtttcccagggtatacaggccctagctgtggttggcccagctgtcccggagactgccagggtcgcggacgttgcgttcagggagtgtgtgtctgtagagccggattctcaggcccagattgttcccagcgaagttgtccaaggggctgtagtcaaagaggacgatgcgaaggagggcgatgtgtatgtgaccctgggtacaccggtgatgattgcggtatgagaagctgccccaggggatgctcccaacgtgggcgttgtgagaatggcaggtgcgtgtgcaacccagggtacacgggtgaagactgcggagtgcgatcttgtcccagaggctgtagtcagagagggaggtgtaaggacggccgatgcgtctgcgatcccggttacaccggagaagactgtggtacgcggtcatgtccctgggattgtggtgaaggaggacgctgtgtcgatggtaggtgcgtttgctggcccggatataccggtgaggattgctccacacgcacatgcccaagagactgcagaggcaggggtcggtgtgaagacggagagtgcatttgcgacaccgggtacagcggtgacgattgcggagtgcgatcctgtccaggtgactgtaatcagagaggtaggtgcgaggatggacgatgcgtttgctggcctggctacacggggactgattgcgggtccagagcatgccctcgagattgcagaggaaggggtcggtgcgagaatggcgtatgtgtgtgcaacgcgggatattccggggaggactgcggggtgcggagttgtcccggagattgtaggggtagaggtcggtgtgaaagcggccgatgtatgtgctggcccggatacacaggacgcgattgcggcactcgtgcttgccctggggattgccgtgggcgtggcaggtgtgtggacgggcgttgcgtatgcaatccaggcttcaccggcgaagactgtggctcccgccgttgcccaggggactgccggggacacggcttgtgtgaagacggagtgtgtgtgtgcgacgccggatacagtggagaggactgttccactcgcagctgtcccggagggtgtcgagggaggggccagtgtctcgatggaaggtgtgtttgcgaagacggatatagtggtgaggattgcggagttagacagtgccccaacgattgtagccaacacggcgtctgtcaagatggtgtgtgtatctgttgggagggttatgtgtcagaagactgctcaattcggacgtgccccagcaactgtcatggcaggggccgatgcgaggagggaagatgtttatgcgaccccggttacaccggaccgacctgcgccactcggatgtgcccagcagactgtagggggagggggagatgtgtccagggggtgtgcctctgccatgtcggttacgggggagaagactgcggtcaggaggagcctcctgccagcgcatgcccagggggatgtggacctagggagctgtgtcgcgctggtcagtgtgtgtgtgtcgaagggttccgaggacctgactgtgccatccagacatgccccggagactgccgcggaaggggtgagtgtcacgacggtagctgtgtgtgcaaagacgggtacgcaggagaggattgcggggaggaggtgcctaccattgaggggatgcggatgcacttgttggaggagaccacagtgaggactgaatggactcccgctcctggaccagtggatgcttatgagattcagtttatcccaaccaccgagggggcttcaccccctttcacagcacgcgtcccatccagtgcaagcgcttacgaccagcggggacttgcacctggacaggagtaccaggtaactgtccgagccctgagaggtacctcttgggggttacccgcaagcaaaacaatcacaacaatgatcgatggcccacaggatctcagagtggtcgcagtgacaccgacaacgcttgaattggggtggctgcgcccacaggcagaagtagatcgattcgttgtgagctacgtcagcgctggcaaccagcgagtgcgtctggaagtgccaccagaggcggatggcacactgctcacggacctgatgcccggagtggagtatgttgtgacggttacagccgagcggggacgagcagtgagctatcctgcgtccgtaagagccaacaccggaagcagccccctcggcctgctgggcactactgacgaaccccctccatctggcccaagcactacccaaggtgcccaagccccacttctgcagcagagacctcaggagctgggagaactgcgtgtgttgggtagagacgagaccggtcggttgcgcgtggtgtggactgcccagcctgacacattcgcctacttccagcttaggatgagggtgccggaggggccaggggcacacgaggaggtactccccggagacgtacgccaggcattggtcccccctccccctccaggaacgccttatgaattgagcttgcacggagtgcctcctggaggtaagccctccgatccaattatctaccaggggattatggacaaggatgaggagaagcctggcaagtcttcgggccctcccagactaggggagttaaccgttaccgaccgaacgagtgatagtctgctgctgcgatggacggttcctgagggggaatttgattcttttgtgatacagtacaaagaccgggacggacagcctcaagttgtgcctgttgagggcccacagagatccgcggtgatcacatccctggacccgggacgcaagtataagtttgtcctctatggtttcgtagggaaaaaacggcacggaccattggtggcagaagccaaaattctgccccagagcgatccttccccagggactccacctcggctaggcaatctatgggtgacagacccgacacccgacagcctgcaccttagctggaccgttccagaaggacagttcgatacgttcatggttcaatacagggacagagacggccgacctcaggtagtccctgttgagggcccagagcggtcattcgtggtaagttctctggatcccgatcataaataccgctttacacttttcggaatagcgaacaagaaacggtacggtcctctgaccgcagacggaactaccgctcccgagcgcaaagaggaaccccctagaccagagttcttggaacagccccttctgggggaattgaccgtgacaggggttactcctgattcactccgcctgtcttggactgttgcgcagggaccattcgatagtttcatggttcagtacaaggatgcccagggccaaccacaggccgtccctgtcgcaggagatgagaatgaagttacggttccaggactggatcctgataggaaatataaaatgaacttgtacggtctgcgaggtcgccagcgggttggtcctgaaagcgttgtggcgaagactgccccacaggaggatgtggatgaaacaccttccccaaccgaactagggaccgaggcccctgaaagccccgaggaacccctgctcggcgaactgactgtcacgggatcctcccccgactcactgtcgctgttttggacagtcccacaaggtagcttcgactcattcactgtccaatacaaggatcgcgatgggaggccaagggcagtgagagtcgggggaaaagaaagtgaggtgaccgttggcggtctggaacccggtcataagtataagatgcatctgtacgggttgcatgaagggcagagggtcgggccagtctctgcagtaggcgtgacggcccctcaacaggaggagacaccccctgcaaccgaaagtcccctggaaccacgcttgggcgagcttaccgtgacagatgtcaccccaaattccgttggattgagttggaccgttcctgaagggcagttcgactctttcatcgtgcagtataaggataaggatggccagccgcaagtggtaccagtggccgctgatcagcgagaagtgactgtctacaacttggagcctgagcgcaagtataagatgaacatgtatggattacatgacggacaacggatgggaccgctgagtgtcgtaattgtgaccgcaccccttccgcctgcaccagctactgaagcctcaaaacctcctctggaacctcggctgggcgagctgacggtgaccgacataacaccagatagcgtgggtctctcttggaccgttcctgaaggagaatttgatagcttcgtcgtgcagtataaggacagagatggacagccccaagtggtgcctgtcgccgctgaccagagagaggtaactattcctgatctggagcctagcagaaagtacaagtttcttcttttcggcatccaggatgggaaaaggcgctcccccgtctctgtcgaggctaagacggttgctaggggtgacgctagcccaggagcccctccaaggctgggagagctctgggttacggaccccacccctgatagtctgaggctgagttggacagtccccgagggtcagttcgattcctttgtcgtgcaattcaaagacaaggacggcccacaggtagtgcccgtcgagggacacgagagaagcgttaccgtaacccctcttgatgcagggcgtaaataccgatttctcctttatggactgcttggtaaaaaaaggcacgggcctctcacggccgatgggactaccgaggctcgaagtgcaatggacgacaccggaactaaacggcctcctaaaccaagactaggcgaagaacttcaggtgacaaccgtaacacaaaattcagtcggcctgagctggacagttccggaggggcaatttgacagtttcgtggtgcaatataaggatcgggacgggcagcctcaagtggtgccggttgagggctcacttagggaggtgtctgtgccaggactggatccagcccatcgctataaactcctgctgtacggcttacatcacggcaaacgggtcgggccaatcagtgccgtcgctattacagccggaagagaagaaaccgagactgagaccaccgctccgactcctccagcacctgagccccatctgggagaacttaccgttgaagaagcaacatcccacacactccatctgtcatggatggttaccgaaggggaattcgacagctttgaaattcagtacaccgatcgcgatggtcagttacagatggtaaggataggtggtgatcggaatgacattaccctgtctggcttggagagcgaccaccgctatctcgttactctgtatggcttttccgacggtaaacatgtgggccctgtgcatgtcgaagcactgactgttcccgaggaggagaagccctctgaacctcccacagccaccccggaacccccaatcaagcctcgcttgggggagctgacagtgaccgatgccactccggattctctgtctctgtcatggaccgtgcccgaaggacagtttgaccattttctggtgcagtatcgaaatggtgacggacagcctaaggctgtgcgggtaccagggcacgaagaaggcgttaccatttcgggcctcgagcctgatcacaaatacaagatgaacctgtacggtttccacggtggccaacgtatgggtcctgtatcggttgtcggagtcaccgccgctgaggaggaaacccctagtcctacagaacccagtatggaagccccagaaccagctgaggagcccctgctgggcgagttgactgttaccgggtctagcccggacagtctgtctctctcctggacagtaccccaggggagattcgacagtttcactgtacagtataaggaccgcgacggccgtccacaggttgtccgggttggaggcgaagaatcggaggtgacagtgggagggctcgagccaggacgaaagtataaaatgcacctgtatgggttacatgaagggcgtagagttgggccagtttccgcggtgggcgtgacggcccctgaagaggagtctcctgacgcccctcttgccaagctgaggctaggtcaaatgactgtgcgagacattacctccgactcactctccctcagttggaccgttcccgagggccaatttgatcactttctggtgcaatttaaaaatggtgatggccagccgaaggcggtgcgcgtacctggtcacgaggacggggtgacaatcagtggccttgagccagatcacaagtacaaaatgaatttgtatggtttccatggcggacagagggtgggcccagtgtctgctgtgggacttaccgccccagggaaggacgaagagatggcccctgcaagtacagagccgccaacgcccgaacctccaatcaagcccagattggaggagctgactgtcaccgatgccaccccggacagtctgtccctatcatggactgtgccagaaggtcagtttgatcacttcctggtgcagtataagaatggggacggacagccgaaagctacacgagtcccaggacacgaggatcgggtcaccatctccggactggaaccagacaataagtacaaaatgaacctgtacggttttcacggcggtcagcgtgtcggacctgtctctgccattggcgtcacagccgcagaggaggaaaccccctcccctaccgagccctctatggaagcacccgagcctcccgaagagcccttgctcggagagttaaccgtgactggttccagcccagactcgctttctctgagttggaccgtcccacagggacgctttgatagtttcactgtgcaatacaaggaccgtgatggtcgtccccaagtcgttcgcgtcggaggagaggaaagcgaggtaaccgttgggggactcgaaccgggaagaaagtataagatgcacctgtacgggctgcacgaagggagacgcgttggtccagtgtctacagttggggtaactgcaccgcaggaagatgtagacgagaccccctctcccaccgagccaggcacagaagcccctgaaccgccagaggagcctctcctgggcgaactgacagttactggctcctcccccgacagcctgagtttgtcatggaccgtgccccaaggacggttcgactctttcactgtgcaatataaagatcgagatggacgccctcaggccgtaagggtgggtgggcaggagtccaaggtgactgtcagaggcttggaacctgggcgaaagtacaaaatgcatctctacggcctacatgaggggagacgactcggcccagtgagcgccgtgggcgtgacagaggacgaggctgaaactacgcaggcggtacccaccatgacacccgaaccaccaattaaaccaagactgggcgaactgactatgaccgacgcaacgcccgactcgctgtctttaagctggaccgtgcctgagggtcaattcgaccacttcctggtgcagtacaggaatggtgatggccagccaaaggccgtgcgtgtccccggacatgaagatggcgttaccatctctgggctggagcccgaccataagtataagatgaacctctacggattccatggaggccagagggtcggccctatcagtgttatcggagtgaccgcagcagaggaggaaactccttctcccacagagctttcaacagaggccccagaacctcccgaggaacccctcctcggtgaattgacagttactgggagctcgcccgactctctatccctcagctggaccattccacaaggccattttgactccttcacggtgcagtacaaggaccgggatggtaggccacaggttatgcgagttcggggtgaggagagcgaagtcacagttgggggactggagccaggccgaaaatataaaatgcacctgtacgggctgcatgagggaagaagggtgggccctgtgtccaccgtgggcgtgacggtcccaactacaaccccagaacctccaaataagccaaggcttggcgagctgaccgtcaccgacgctactcccgacagtctgtcccttagctggatggtgcctgagggccagttcgatcatttccttgtgcaataccgcaatggtgacggccagcccaaggtcgtccgggtgccgggacatgaagatggagtgacgatctcaggtctcgaacccgaccataagtacaaaatgaacctgtatggattccacggcggtcagagggtcggaccgatctcagtaataggcgtgaccgcggcagaagaggaaactcccgctccaacagaaccgagcactgaagccccagagcctcccgaggaacccctgctcggcgaactgaccgtcaccgggtcaagtcccgatagtctgtccctgagttggacaataccccagggacgcttcgactcttttaccgtgcagtataaggaccgtgacggtcggccacaggtagtgcgcgtgcgaggggaggagtccgaggtgaccgttggcggactggagccaggctgtaaatataaaatgcatctctacggcctacatgagggccaacgagttgggcctgtgtcagccgtgggggtcaccgtgcctacaatgacccctgaaccccctatcaagcctaggctgggggagttgacggttaccgatgccacaccagacagcctctcactgtcttggatggttcccgaggggcagttcgaccactttctggttcaatacagaaacggggatggtcagccgaaggccgtgagggtgcccggacacgaggacggggttaccatctcgggattagaacccgatcacaagtacaagatgaacctgtatggttttcatggcggacagcgggtgggacccgtgagcgctatcggagtcacagaggaagagactccttcccccaccgagccctcaaccgaggcacccgaggccccagaggagccgctgctgggggaattgacggtgactggttcatcaccagactcactatcattatcctggaccgtcccccagggacggttcgacagcttcaccgttcagtacaaggacagagacggtcaaccacaggtggtacgagtcagaggcgaggagtccgaggttacagtcgggggactagagcccggaaggaaatataaaatgcacctgtacggtctgcatgaaggccaacgcgtgggtcccgtgtccacagttggtatcaccgctccactgcccacacccctccccgtggagccacggttgggagaattagcggtggctgccgtgacttcagactccgtggggctctcctggaccgtggcccagggtccctttgacagctttcttgtgcagtacagggacgctcaaggccagccccaagcggtccctgtatccggggacttgcgggctgtcgcagtctcagggttggatcctgccaggaaatacaagtttctcctgttcggcctgcagaacgggaaaaggcacggccctgtgcccgtggaggcccgaactgccccagatacgaaaccatccccaagactcggggagctgacagtgacggacgcaaccccagactccgttggcctgtcctggaccgtgcctgagggcgagtttgacagcttcgtggtgcagtataaagacaaggacggccgattgcaggtggtgccggtggctgcaaaccagcgtgaagttactgtacagggtctcgaaccgtcccggaagtaccgcttcctgctgtatggactgagtggaagaaagagacttggccctatctccgccgactcaaccacagcaccattagagaaggaactgccgcctcacttgggggaactgactgtggctgaagaaactagttcgtcattaaggttaagttggaccgtggcccaggggccattcgacagcttcgtggtgcaatatcgcgatactgacggacaacccagggcagtgccggtagccgcagaccagaggactgtcacggttgaggacctggaacccggaaagaaatataagttcctcctgtacggtctactgggcggaaaacgtttgggtcctgtgagtgctttggggatgactgccccagaagaggatacccccgctccggagctggcccctgaagctcccgagccgcctgaagagcctcggctgggcgttttgaccgttacagatactacacctgacagcatgcgattaagttggtctgtcgcccaggggccatttgactccttcgtagttcagtatgaggatacaaatggacagccacaggctttgcttgtggacggcgatcaaagcaaaatccttatttcaggactagaaccttccactccctaccgctttctgctgtatggcctgcacgagggaaagcggcttgggccattgtctgcagaggggactacggggctggccccagccggtcagacctcagaggagagccgtcccaggctgtctcagctgagtgtcacggatgtgacaacatcttctctccggcttaactgggaggctcctccgggtgcctttgacagcttccttctgagattcggagttccttctccctccaccctggagccccacccccgaccacttctgcagcgggaactgatggtcccgggtactagacattccgccgtcttacgcgacctgcggtctggcacgctctactctctgacactgtacggcctgcgcggtcctcacaaagccgactccattcagggcaccgccaggacactgagtcccgtgttagaatctccccgtgatctgcaattttccgaaattcgcgagacaagtgccaaggtgaactggatgcccccacctagcagggcagattcattcaaagtttcctatcagttggcggacggcggagagccccagtcagtccaggtggacggacaggctcgcactcaaaaactgcaaggactcatccctggcgctaggtacgaggtgacagtcgtttccgtccggggatttgaagaatcagagccattaactggttttctgactacggtgcctgacgggccaacacagctgagagccctgaacctgaccgagggtttcgcagtgctgcattggaagcccccacagaacccagtagatacctacgatatccaggtgaccgctccaggcgcacctcccctacaggcagagactcccggatctgctgtagactacccattacacgacttggttctgcacacgaactacacagcaactgttcgcggactccgaggcccaaaccttacttctccagccagcatcacattcacgacaggcctagaggctcccagggatctcgaagctaaggaggtgaccccacggaccgccctgctgacgtggactgagccgcctgtccgccctgcgggatacctgctatccttccatactcccggaggacagacccaagaaatcctgctacccggagggatcacgtcccaccaacttttgggccttttcccaagcacctcttacaacgctaggctgcaggctatgtggggccaaagtctgctgcctcctgtgtccacctcgttcaccactggagggctgcgcatacccttcccccgtgattgcggcgaggaaatgcaaaatggagccggtgcctcacgaactagtactatatttctgaacggtaatcgagaaagaccactcatcgttttctgcgacatggagaccgacggagggggatggcttgttttccagcggcgaatggatggtcagacagatttttggcgcgactgggaggattatgcccatggctttggaaatatttctggcgagttctggttaggcaatgaagcactccattccctcacccaggcaggggactactctatgagagtggacctgagagcaggagatgaggcagtattcgctcagtacgatagctttcacgtggattcagccgctgagtattaccggctccatttagaaggctaccatggaactgcgggtgattcgatgtcttaccattctggcagcgtgtttagcgcaagggaccgcgatcccaattcattgttgatttcctgcgcagtatcctacaggggggcatggtggtaccggaactgccactacgccaacctgaatggcttgtatgggagtaccgtggatcaccagggagttagctggtatcattggaaaggttttgagttttcggtaccgtttactgagatgaagctgcgccctaggaacttcagatcccccgctggcggaggttac

SEQ ID NO: 243722 - DNA, 27 bp, Artificial Sequence
  Description of Artificial Sequence: Synthetic coding sequence
atgatgcccgcacagtatgctctctag

SEQ ID NO: 243723 - DNA, 1905 bp, Artificial Sequence
  Description of Artificial Sequence: Synthetic coding sequence
taaagctcccccctggggctcctcggcacaaccgatgaacccccacctagcgggccttccacaacacagggggcacaagcccctcttttgcagcagcgtcctcaagagctgggagagctcagagtgctgggtagggatgaaaccgggaggttgcgggtggtctggactgcacaaccggacactttcgcctacttccagctgcgtatgagagtgccagagggaccaggcgcacacgaggaggttctgcccggagacgttaggcaggcgctggtgccaccacctcctccgggaactccttacgaactctcgctgcacggggtgccccctgggggaaaaccttcagaccccatcatctatcaggggatcatggataaagacgaagagaaacccggtaagtcaagcggaccccctaggcttggggaacttacagtgactgatcgtaccagtgacagcctgctactaaggtggacagtgccagagggagagttcgatagcttcgtgattcagtataaggatcgcgatggacagccacaggttgtccctgtggaggggcctcaacggtcggccgttatcacgagcctcgatcccggacggaaatacaaattcgtgctgtatggttttgttggtaagaagcggcatggacccctagtcgcagaggccaaaatccttccccaatccgacccaagtccgggaacccccccaaggctggggaacctctgggtgacagatccaacccccgattctctgcacctaagctggactgttcctgaaggccagttcgatacatttatggtgcagtacagagatagagacgggcgtccacaagtggtgcccgtggaagggccagagaggtcttttgttgtgtctagtttggatccggatcacaaatatcgttttactttgtttggcatcgcaaataaaaagaggtatggacctctcactgcggatggcactaccgcccctgaacgaaaagaggagcccccaaggccagaattcttggaacaacctcttctgggagagctcacagtgactggagttacgcccgactcgctaagactctcctggacggtggcccagggaccctttgattccttcatggtgcagtataaagatgcccaaggacagccgcaggcagtgcctgtggctggagatgagaacgaggttacagttcctggacttgatcctgaccgcaaatataagatgaacctctatgggctccgcggacgccagagggtggggccagagtcagtcgtggcgaagacggcccctcaggaagatgtggacgagactccaagcccaaccgaactgggtacagaggcaccagagtctcccgaagagcccctgcttggtgagttgaccgtgacgggcagctctcctgattccctctcactgttttggactgtgccccagggcagcttcgactcattcacagtgcaatataaggatagggacggacgccctagggccgtccgtgtgggaggaaaggagtctgaagtgacggtcggcggattagaacccggtcacaaatacaaaatgcacctttacggtctgcatgagggccagcgtgtcggtccagtgtccgccgtgggagttacggctccgcagcaggaggagactcctcctgccacagagtcacctctcgagccaagactgggagagctcacagtcaccgacgtgacccctaattctgtgggacttagctggaccgtgcctgagggccaattcgacagtttcatcgtccagtataaggacaaggacggacagccccaggtggtgccagtcgccgcagatcagagggaagttacggtgtataacctcgagccggaaagaaagtacaaaatgaatatgtatgggctccacgatggacagcgtatgggacccttatccgtggtgatagtcacctag

SEQ ID NO: 243724 - DNA, 27 bp, Artificial Sequence
  Description of Artificial Sequence: Synthetic coding sequence
atgatgcccgcacagtatgccctgtag

SEQ ID NO: 243725 - DNA, 12668 bp, Artificial Sequence
  Description of Artificial Sequence: Synthetic coding sequence
atgatgccggcacagtatgctctaacttcctcgctggtgctcctggtcctgctgagcacagctcgcgctggcccattttcttcccggtccaacgtaacactcccagcgccacgacctccgccacaaccgggtggacacacagtgggcgcaggcgtcggtagcccatcctcacaactgtacgagcacacagtggaaggaggcgaaaaacaggtcgttttcacacatcgcatcaacctgccgccttccactggctgcggctgcccacctggaaccgagcctcctgttttagcctcagaggtgcaggcattgcgggtaaggctggaaattctggaagagttggtcaaaggcctgaaagaacagtgtaccgggggttgttgtccggcaagcgcccaagcgggaacgggacaaaccgatgtcagaactctgtgctcattgcatggcgtcttcgatctgtcccgttgcacctgcagttgtgaacccggatggggcggtccgacctgtagcgacccaactgatgcagaaattcctccctcctctccaccctctgcctcgggcagttgtcctgacgattgcaacgatcaggggagatgcgtcaggggacgctgcgtctgctttcctgggtacaccgggcctagttgtggctggccgagctgccccggtgattgccaaggtcggggtagatgcgtgcagggcgtttgcgtctgcagagccggattctccggacccgattgttcccaacgaagttgcccacgcggatgttcccaaagaggcagatgcgagggcggtaggtgcgtctgcgaccctggctatacgggcgacgactgtggtatgcggtcgtgcccacggggatgctctcagcgagggaggtgtgaaaatgggaggtgcgtgtgtaacccaggatatacaggagaagactgcggggtacggtcatgtcctcgtggctgctcgcagcgcggacgctgtaaggacgggagatgcgtttgtgacccaggctatacaggtgaggactgtggaacccgatcttgcccctgggactgtggagaaggtggcagatgcgtggatggacgctgcgtttgttggcctggttatacaggagaagactgttcaactaggacgtgcccccgtgactgcagggggagggggaggtgtgaagatggagaatgtatctgtgacaccggttactctggagatgattgcggagtgagatcatgccctggagactgcaatcagagagggaggtgcgaggacggacgctgcgtgtgttggcccggttacacaggaacggactgcggttcacgggcttgtcccagggattgtagagggagggggagatgtgaaaacggcgtgtgcgtgtgcaacgccggatacagcggtgaagactgtggggtgcgatcgtgcccaggggattgcagaggcagaggcagatgcgagtccggaaggtgtatgtgctggcccggttataccggtcgggattgcggtacacgggcatgtccaggcgactgccgaggcaggggtagatgtgtggacgggaggtgcgtgtgcaaccctggctttaccggggaagactgtgggagtcgcaggtgccccggtgactgtagaggacacggactgtgcgaggatggcgtgtgcgtgtgtgacgccggttattcaggggaggactgctctactaggtcctgtcctggcggatgtagaggccgtgggcaatgcctggacggcagatgtgtctgtgaagacggctacagtggcgaggactgcggggtgcgtcagtgccctaatgactgctctcagcacggagtgtgtcaggacggggtgtgtatatgttgggagggctacgtgtctgaggactgcagtattaggacgtgcccgtctaattgccatggccgagggaggtgtgaagagggcaggtgcctctgtgacccaggctataccggcccaacttgcgcaacgagaatgtgcccagctgattgccgagggaggggaaggtgcgtgcagggcgtgtgtctttgtcacgtcgggtatggaggcgaagattgcgggcaggaggagccacccgcaagcgcgtgtcccggtgggtgtggtcctagggagctgtgtcgggcagggcaatgtgtctgcgtcgaaggcttcagggggccagattgtgccatacagacttgccctggcgattgcagaggaaggggcgaatgccacgacggctcatgtgtgtgcaaggacggctatgcaggggaagattgtggggaagaggtgccaactatagaaggcatgagaatgcatttgttagaggagactaccgtgcgcacagaatggactcccgctcccggacccgtggatgcatacgagatccaatttatacctaccacggagggagcctcgcccccattcacagcccgagtcccttcgagtgctagtgcctatgatcagcggggactggctccaggacaagagtaccaggtcaccgtccgggctctgaggggcacaagctggggtctaccagccagtaagacgatcaccaccatgatcgacgggccacaggatcttagggtcgtggccgtgaccccgactaccctcgagctggggtggctgcgaccccaggcagaagtcgataggttcgtcgtgtcgtatgtgagcgccggtaaccagagagtcagacttgaagtgccccctgaagccgacggcactctcctgaccgaccttatgccaggagtggaatatgtagtgacagtgacagcggaacgcggacgagccgtgtcctatccagcgagcgtgcgagccaacaccggcagtagtccacttggactcttggggaccaccgacgagccccctccatcaggaccctccacaacgcagggagcccaggcgccacttctgcaacagcggcctcaagagctgggcgaactgcgcgtcctgggacgcgacgagaccggcagacttcgcgtcgtgtggaccgctcagcctgatacgttcgcatactttcaactccgtatgagggttccagagggcccaggagcacacgaggaggttcttcccggagacgtgcggcaggcacttgtacccccaccccctcccggtacgccctacgaactgagccttcacggagtcccacctggtggcaagccatccgacccaatcatttatcaaggaatcatggacaaagatgaggaaaaacccggtaagtccagcggcccacccaggttaggcgaactcaccgtaaccgacaggacatctgattcattactcttacgctggaccgtgccagagggagagtttgactcctttgtgattcagtataaggatcgggacggtcagccacaggtggtgcccgtggaggggcctcagcgcagtgcagttatcacttctctggatcccggacgcaagtacaagttcgttttgtacggcttcgtggggaagaagagacacggacccttggtcgcggaagctaaaattttgcctcagagtgatccttcgccaggtactccccctagactgggcaatctgtgggtgaccgatcctacacccgattcgctccatctctcatggactgtgccagaagggcagttcgacacgtttatggtgcagtatcgggatagggatggaagaccccaggttgtaccggttgaaggaccggagagaagttttgtcgtcagctctcttgacccggaccataagtataggtttacgcttttcggtatcgcaaacaagaaacggtatgggccactgactgcagacgggactactgcgcctgagcggaaggaggaacctccacaccccgagtttctggaacaaccactgctaggagaactgacagtgacaggggtgactcccgattctttgagactgagctggacagttgcccagggcccatttgacagttttatggtgcagtacaaagacgcacagggccagccgcaagccgttcccgtggctggcgacgagaacgaggtgaccgtaccagggctggacccagatagaaaatacaagatgaacctgtatggcttacgagggagacagagggtgggtccagaaagtgttgtggccaaaaccgctccccaagaggacgtggatgaaaccccgtctcccacggagctgggtacggaagcaccagaatctcctgaagaaccactcctgggagaattaaccgtaactggaagctcacctgattcactgagcctcttttggactgtgccacagggatctttcgattcttttaccgtacagtataaggaccgcgatggcagacctagagctgtgcgggtcggaggcaaagaatctgaagtgacagtggggggactcgagccgggtcacaaatataaaatgcacctgtacggactgcacgaaggccagagggtgggcccagtgagtgccgtgggcgtgacagcgccacagcaggaagagactccaccagctaccgagagtcccttggagccacgcctgggagagctgactgtaacggatgtcacgcctaattcggtgggcctctcctggactgtgcccgaggggcagtttgatagcttcatcgtccagtataaggacaaagatggtcagccgcaagttgttcctgttgccgcagatcagagagaggtgacagtgtacaaccttgagccagagaggaagtacaagatgaatatgtacgggctacatgacggtcaaaggatgggaccactctcagtggtaatcgtgaccgcccctttaccaccagctccagccaccgaagccagcaaaccacctctggaaccccgactaggcgaattaactgtgaccgacattacgccagatagcgtgggcctgagctggaccgtgcctgaaggcgagtttgatagctttgtggtccagtacaaagaccgagacggtcagcctcaggttgtgcctgtcgccgcagatcagagagaagtgacgattccagacctcgagccttcccggaagtataaatttcttctgttcggaatccaggacgggaaacggagatctccagtgagcgtcgaggccaagaccgtggctcgcggagacgcatcacccggtgctccccctaggctcggcgagctgtgggtcaccgacccgacgcctgattccctccgcctttcttggaccgtgcctgagggccagtttgattcctttgttgtacagtttaaagacaaagacggacctcaggtggtccccgtcgagggccacgagaggtctgtgaccgtcaccccgctggacgccggtcggaagtacagattccttttatatggacttctgggcaagaagcggcacggtccactcacagcagatggtactaccgaggcacgttctgcaatggatgacactggtacgaaaagacctccaaaacccaggctcggtgaggagttgcaggttaccactgtcacccagaactctgttggtctctcttggacagttccagaaggccagtttgactcgtttgtagtacagtacaaggatcgggatggccagcctcaagtggtccccgttgaagggagcctgagggaggtgtccgtgcccggactcgaccctgctcaccggtacaagctgctgctgtatggactccatcacgggaagcgcgtgggccctatctccgccgttgctataacagctggtcgggaggagacagaaactgagacaactgcgcctactcccccagcccctgaaccgcatctcggcgagttgacggtcgaggaggccacctcacacactctacatctgtcctggatggtcactgaaggggagttcgatagcttcgaaatccagtacactgatagggatgggcaacttcagatggtcaggatcgggggagacagaaacgacatcactttgagtggtctggagagtgaccaccggtacctggtgaccctctacgggttctccgacggaaagcatgtcggccctgtgcacgttgaggcactgactgtccccgaggaggagaagccatccgaaccaccaacagctactcccgaaccaccaatcaaaccacggctcggggagttaacagttacggatgcgaccccagatagtctgtctttgagttggaccgtgccagaggggcaatttgatcacttcctggtgcagtatagaaacggagacggacagcccaaggccgtgcgcgttccaggacacgaagagggcgtgacaatttcaggactggagcctgaccacaaatacaaaatgaatttgtacggcttccatggcggtcagcgcatgggcccagtgtctgtcgttggtgtaactgccgctgaggaggagactccgtcccctaccgaaccttcaatggaggcccctgagccagccgaagaacctctgctcggggagttaacggtcactggatctagccctgactcccttagcctttcttggactgtgcctcaaggaaggtttgactccttcactgtgcagtataaggaccgtgatggccgtccacaggtggtgagagttggaggggaagaaagtgaagtgaccgttggcggacttgagcctggccgtaagtataaaatgcacctgtatggtcttcacgagggccgacgggtggggcctgtgtctgccgtgggggtgacagctccagaggaagagagccccgacgccccactggccaagctgagacttggacagatgaccgtcagagacatcacgtctgactccctaagcttaagttggactgttcctgaaggtcaattcgatcactttctggtacagtttaagaatggagacgggcagcccaaagccgtccgtgtccctggccatgaagatggggtcacaatctcaggcctcgaaccagaccataagtacaagatgaacttatatggctttcatggtggacaacgcgtcggcccagtatccgctgtaggcctgactgcccctggcaaagatgaggagatggctccggcatcaaccgaacccccaacacctgaaccacccattaaacctagactggaagaacttaccgttaccgatgccacccctgattctttatcactgtcttggacagtccccgaagggcaatttgatcatttcctggtgcagtataagaatggcgacggccagcctaaggccactcgggtccctggccacgaggaccgggtgaccatcagtgggctcgagcctgacaacaaatataagatgaacctatatgggttccatggcggacagcgggtgggccctgtctccgcaatcggggtcacagccgcagaggaggagaccccgtcccctaccgagccctctatggaggcaccagaaccacctgaggaaccactgcttggggagttgaccgtgaccggatcctccccggattcgttgtcacttagctggaccgtgccacaaggacgctttgattcattcactgtccagtacaaagatcgcgacggtcgtccacaggtggtgagggttggcggagaagaaagcgaggtgacagtaggcggactggaacccggacgcaagtataaaatgcacctgtacggactacatgaaggacgtcgcgtggggcctgtctctacagtaggagtgacagccccacaagaggacgtcgacgaaacaccatcacccaccgagcccggaactgaggcgcctgaaccccctgaggagcccctcctcggggagctgactgtgactgggtcaagccctgattcgctgtccctgtcttggactgtcccacagggcaggttcgactcattcaccgtgcagtataaagaccgggatggacgtccacaggccgtgcgcgtaggcggtcaggagtcaaaagtgactgttaggggcctggaacccggtagaaagtataaaatgcacctgtacggactgcacgagggccgtcgcctgggtcccgtgtctgccgttggggtcaccgaggacgaggccgaaactacacaggctgtgcctactatgactccagagccccctatcaagccaaggctaggggagctcaccatgactgatgctacaccagactctctctccctttcttggacggtccccgaagggcaatttgaccatttcttagtacagtatagaaatggcgacgggcagcctaaagctgttcgggtacctgggcatgaagatggggtaacaatctccggtctggagccagatcacaagtacaagatgaatctgtacggcttccatgggggtcaaagggtgggccctatttccgtaattggggtgacagccgcagaggaagaaacaccgtctccaactgagctctcaacagaagcccctgaacccccagaagagccacttcttggcgaattgactgttactgggtctagccctgatagcttgagcctgagctggacaatccctcagggtcacttcgactcctttaccgtccagtacaaagacagagatggaaggcctcaggtgatgagggtgcgaggcgaagagtccgaagtaaccgtaggaggactcgagcccggtagaaagtacaagatgcacctctatgggctccatgaggggaggcgggtgggtccagtgagcacagttggcgttactgtgccaactactacccccgaaccacctaataaacccaggctaggtgaactgaccgtgaccgacgccactccggattctttatcgcttagctggatggtgcccgaagggcagttcgaccatttccttgtccagtataggaacggtgacggccagccaaaggtggtgagagtacctggccacgaagatggggtgaccatctccggacttgaacctgatcacaaatacaaaatgaacctctatggttttcatggcggacaaagagtgggacctatatcagtgatcggggtcacagctgctgaggaagaaacaccggcacccacggagcctagcactgaggcgcctgagccaccagaggaaccacttctaggcgagctgactgtgacgggcagcagccctgactctcttagtctgtcttggacgattccacagggtcggtttgattctttcacagtgcagtataaggatagagacgggcgaccccaggtggtgagagtgagaggcgaagaatcggaagtgacagtcggcggactggagccgggttgtaagtataagatgcacttatacggtttacatgagggccagcgggtgggccctgtgtcggccgtgggggtgaccgttccgaccatgacaccagagccaccaattaaacctcgcctcggcgagctaactgtaacggacgccacgcctgattctctctcgttatcttggatggtgcctgaaggacagtttgaccacttcctcgtccagtatagaaacggagacgggcagccaaaggcagtgagagtgcctggacatgaggacggcgtaactatcagtggcctcgaacccgaccacaagtataagatgaatctgtacggtttccacggtggccagagagtaggtcctgtatcagccatcggcgtgaccgaggaggaaacaccctcacctactgagccttctacagaggcacctgaggccccagaggagccacttctcggcgagttaacagtgaccgggtccagccccgacagcctgagtcttagctggacaatcccccagggccgtttcgactccttcacagtgcagtataaagatagagacggtcagccacaagttgtgagggtgcggggagaggagagcgaggtgaccgtgggaggactggaaccaggcaggaaatacaagatgcacctctatggcctgcacgaaggtcagagagtgggtccggtgagcacagtcggtatcacagcaccgcttcccacgcccctacctgtggagcctagattgggtgagctggctgtggccgcagtaacctctgacagcgtgggactgtcgtggaccgttgcccagggtccattcgactcattcttggtgcagtatcgcgatgcccagggccaaccacaagccgtgccggtgagtggagaccttcgtgctgtggccgtgagtggtctggacccagccaggaagtataaatttctacttttcggtctacaaaatgggaaacgacacggaccggtccccgtggaggcgagaaccgctcccgacactaagccgtctccgcgtctgggcgagctgactgtcaccgatgcaactccagacagcgttgggctatcttggacagtccctgagggggaattcgattctttcgtggtgcagtacaaggacaaagatggaaggttacaagtggtgccagtggctgccaatcagcgcgaagtgactgtgcaggggctcgagcccagcagaaagtaccggtttcttttatatggactatccggcaggaaacggctggggcctatctctgccgactccacaaccgccccactcgagaaagagttgccaccccacctcggggagttgactgtcgccgaagaaactagttcatccttgcggttgagttggacggtggcccagggaccattcgattctttcgtagttcaataccgggatacagacgggcagcccagggctgtgccggtggccgcagatcaacgcaccgtgacagttgaagatctggaacccggtaagaagtacaaatttctgttgtacgggcttcttggcggaaagaggttgggacccgtgtcagccctgggaatgaccgcgccagaagaagatacacctgctcccgaattagctcccgaggcacccgaacctcccgaagagcccaggctcggagtgctgaccgtcactgatacgaccccagattccatgcggctttcttggtccgtagcccaagggccttttgactccttcgttgttcagtatgaagatactaatggccagccacaagctctcctggtggacggcgatcaatccaaaatactgatttcagggctggaacctagcaccccctatcgatttctgctttacggcctgcacgaaggcaaacggctaggtcctttatccgctgagggcactacggggctcgcacctgcaggccaaacttcagaggagtcacgtcccaggctgtctcagctgtccgttacagacgtgacaacaagctccctgcggctaaattgggaagccccacctggcgcatttgattccttcctcttacgttttggagttcctagcccctccacgctagagccccaccctcgaccactgctccagcgcgagttaatggtgcctggaactcggcattctgccgtcctccgagacttacgttctgggactctctactccctgacactgtacggattgagagggccacacaaagccgattcaattcagggaaccgcccgaaccttgtcccctgtcttagagtcacctcgagacctgcagttctctgaaataagggaaacctccgcaaaggtcaactggatgcccccaccttccagagccgacagcttcaaggtgtcgtatcagctcgctgatggcggtgaacctcagagcgttcaagtggatgggcaggcaagaacacagaagctccaggggcttataccaggcgcacggtacgaggtgaccgtcgtgtctgtgaggggctttgaggagtctgaaccactgacaggctttctaacaacagtgcccgatggtccaacccagctgagagcacttaacctcactgagggcttcgctgtgctgcattggaaacctcctcaaaacccagttgacacttacgacattcaagtcactgccccaggtgcgccaccacttcaggcagaaactccaggttccgcagtcgactatccgctccacgatttagtgctccacaccaattatactgcaacagtgagaggattacggggtcccaacctgacttcccctgcgagcatcactttcaccacaggtctggaggcgcctagggaccttgaggcgaaggaggtcactccgcgaacagcactgttgacttggacagagccacctgtgagacctgccggttacctcctctcatttcatacgcctggcggtcagacccaggagatcttactaccaggaggcatcacttctcaccaactgcttgggctatttcctagcacctcatataacgccaggttacaggctacatgggggcaaagcctgctgccacccgtcagtacgtccttcacaacaggaggattgcggatcccattcccacgtgattgtggcgaagaaatgcagaatggagccggtgccagcaggacgtcaactatctttttaaatggcaacagagagaggcccctgaatgtcttctgtgacatggaaaccgatggtgggggatggctggtgttccaaaggcgcatggacggccaaaccgacttctggcgagactgggaagactatgcacatggtttcgggaatatttccggcgaattctggcttgggaatgaggcactccacagcttgacacaggctggtgactatagtatgcgtgtagacctccgagccggtgatgaggctgtatttgcacagtacgattccttccacgtggacagcgcagcagagtactatcgcctacacttagagggatatcatggaactgccggtgatagtatgagctatcattccgggtccgtgtttagcgcccgagatcgggatccaaacagcctgcttattagttgcgccgtttcttatcggggagcctggtggtatagaaactgccattacgctaacctgaacgggctctatggctctaccgtagatcatcagggtgtgtcttggtatcactggaagggattcgagttcagcgttcccttcacggagatgaagctgagaccgagaaactttcgttcacccgcaggaggcggtta

SEQ ID NO: 243726 - DNA, 27 bp, Artificial Sequence
  Description of Artificial Sequence: Synthetic coding sequence
atgatgcccgcacaatacgccttgtag

SEQ ID NO: 243727 - DNA, 6842 bp, Artificial Sequence
  Description of Artificial Sequence: Synthetic coding sequence
atgatgcccgctcagtatgctctcacctcaagtctagtgttactcgtgctgcttagtacggcaagagccggtcctttctcatcaagatccaacgtgacactgcccgctccccgtccgcctccacagcccggaggtcatactgttggggcaggagtgggctccccctcgagccaactctacgagcacacagtagagggaggcgagaagcaggtagtctttacccatcgcatcaatctcccacctagtactggatgcggttgtccacccggaaccgagccaccagtattggcttcagaggtccaggctctccgagtgcgattggaaatcctggaagagctggtgaaggggctgaaagaacagtgtaccgggggttgttgccctgcatccgcccaggccggtacgggacaaaccgacgtcagaacactgtgcagcctgcatggggtgtttgacctctctagatgtacttgtagctgcgaaccagggtgggggggacctacatgctcggatcctactgacgcggaaattccaccgtcgagtccacccagtgcgtcgggaagctgtcctgacgattgcaatgatcagggcagatgcgtgcgcggtagatgcgtatgcttccccggatacaccggcccttcctgtgggtggccatcttgccccggagactgtcaggggcgtgggaggtgtgtgcagggcgtatgtgtgtgccgcgctggatttagtgggccagactgctcacagaggtcttgtccaagaggctgctcacagcgcggaaggtgtgaagggggtaggtgtgtttgtgacccaggttacacaggagacgattgcggaatgcgatcctgtcccagaggctgctctcagcgcggaaggtgtgaaaatggtcggtgcgtgtgcaacccaggatacaccggtgaggactgcggagtgcgcagctgcccccgaggctgctctcagcgtggcagatgtaaggacgggaggtgtgtgtgtgacccaggctacactggggaagactgcggaacaaggtcatgtccctgggactgtggggaggggggtcggtgtgtggacgggcgatgtgtttgttggcctggatacaccggagaggactgtagcactcgtacctgcccaagagactgccgtggtaggggccgttgcgaagacggcgagtgcatatgtgacacaggctactccggtgatgattgtggtgtgaggagctgcccgggagattgcaatcaacgagggcgatgtgaggacggtcggtgcgtctgttggcctggctatacaggcactgactgtggctcccgcgcttgccccagagattgtcggggacgcggtcggtgtgagaacggggtatgcgtttgcaacgccggttacagtggggaggactgcggggtgaggagctgtccgggagattgcaggggccgaggcaggtgcgagagcggtcgctgtatgtgctggcccggatacactgggcgtgattgtggaacgagagcctgccctggggattgtcggggacgtggacgatgcgtggatggcaggtgcgtgtgtaaccccggttttacaggcgaagattgcggttcccggagatgtcctggtgactgtaggggccatggattgtgcgaagatggggtgtgcgtgtgcgacgcaggctattccggggaagattgctctactcggtcgtgcccgggaggttgccggggacgcggacagtgtctcgacgggcgttgtgtgtgtgaggacggctatagtggagaagattgcggcgtgcgccagtgcccgaatgattgctcacagcacggagtgtgtcaggacggggtctgcatatgctgggagggctatgtgtctgaagattgttctataagaacttgtccaagtaactgccatggccgaggcaggtgcgaagaaggcaggtgtctgtgcgaccccggttacactgggccaacgtgtgcaacaaggatgtgcccagctgactgtcgcggtaggggtcggtgcgtccagggagtgtgtctctgccacgtcggttatggaggcgaggactgtggccaggaggaacccccagcaagcgcttgccctgggggatgtggacctcgtgaactgtgtagggccggacagtgtgtgtgcgttgaaggtttccgaggcccagattgtgctatacagacttgtcccggtgactgcagaggacgcggtgagtgccacgatggctcatgcgtctgcaaggatggctacgccggagaagactgcggtgaggaagtccccacaattgaagggatgcggatgcatcttctcgaagagaccacagtccggacggagtggacacccgcaccaggaccagtagatgcttacgagattcagtttattccaacaacagaaggcgcttcacctcctttcactgcaagagtgccctctagtgcatcagcctatgaccaaaggggtttggcgcctgggcaggaataccaggtcaccgtacgcgctttaaggggaacatcctggggcttaccagcttccaagacgatcactacgatgatcgacggtccacaggatctgcgcgtagtcgctgttacacctactaccttagagctcgggtggctgaggcctcaagccgaggttgacaggtttgtagtgtcctacgtctcagctggaaaccagcgcgtgcgcttagaagtgcctcctgaggccgatggcactctactgaccgacttgatgcccggtgtggagtatgtggtaactgtcaccgccgaacggggtagggccgtttcttaccccgctagcgtaagggccaacaccggtagtagccctctgggtttgctaggaaccacagacgaaccccctccaagtggaccatccacaacccaaggagcgcaagcaccactcctgcagcagcgtccccaggagctcggcgagcttcgggtgctagggagagacgagactgggcgactcagagttgtgtggaccgcccagccggatacctttgcttatttccagctgcgcatgcgagtgccagaaggacccggagcacacgaggaggtgctgccaggcgatgtgagacaggccctggtgccacctccccctccaggtactccatacgagttgtccctccatggagttccgccaggaggcaagcccagcgaccctattatttatcagggaattatggacaaagatgaagaaaagccgggaaagtcatcagggccaccgagactcggggagctaactgtgacagacagaacttccgattctctgcttctcaggtggactgtcccagagggcgaattcgactccttcgtgattcaatacaaagaccgcgatggccagccacaggtcgtccctgtggaaggaccacagagatcagctgtaatcacttccttggatcctggtcggaagtataagttcgtcttatacgggttcgttggcaagaagcggcatggtccgctggtcgccgaggccaagatcttacctcaatctgatccgagtcccggaacgcctcctcatctaggtaatttgtgggtgaccgatcccacccctgattctctccatctgagttggaccgttccggagggccagtttgatactttcatggtgcagtatagagacagagacggtaggcctcaggtcgtgccagtcgagggacccgagcggagttttgtagtcagtagcctcgatcccgaccacaaatataggtttactctatttgggatagcaaacaaaaagcgctatggcccactaacagccgacgggactacggcgcctgaacggaaggaagagccccctagacccgagtttttggaacagcctcttctgggcgagcttacggtaactggagtgaccccggattccctcagactttcatggaccgtcgctcaggggccattcgactccttcatggtccagtacaaagacgctcaggggcagccacaggctgtgccagttgccggagatgagaatgaagttaccgtaccgggtctggaccccgatcgcaagtacaaaatgaacctgtatggtttgcggggtcgacagcgcgtgggccctgaatcagtagtggccaaaactgctccacaggaggacgtggacgagacaccttccccgactgaactcggcacagaggcacccgaaagccctgaagaaccgctcttgggagagttaaccgtgaccggatcttcaccagatagtttaagtctcttttggactgtgccccaaggtagtttcgacagctttacagttcagtataaagatcgggatggtcggcctcgggctgtgcgcgtgggcggtaaggaatctgaagtgacagtgggcggtctggaacccggacacaagtacaaaatgcatctgtacggtctgcatgagggacagagggtgggaccagtgtctgcagtgggagtgactgcaccccagcaggaagagacccctccggctactgagagcccactagagcctcgactgggggagctgacagttacagacgtgacgcccaacagcgtgggcctatcttggacggttccagagggacagtttgatagcttcatcgtgcagtataaagacaaagacggacagccccaagtggtccccgtcgccgctgatcagcgagaggtgacagtgtacaatctagagcccgagaggaagtataagatgaatatgtatggcctgcacgatgggcagcggatgggcccactgagcgtggtgatcgtcaccgctcctctgccccctgcccctgctactgaggccagcaagccacccctcgaacccagattgggggagttgacagtgactgatattaccccagatagcgtgggactatcctggacggtgccagagggcgaatttgatagctttgtcgtacagtataaagacagggacggtcagcctcaagtggttcctgtcgccgctgatcagagggaggtgaccattcctgatctggagccaagccgcaagtataaattcctgctatttggtattcaagatggcaagaggcggtcacccgttagtgtcgaagccaagacagtggctcgcggagacgcctcacctggtgcaccccctaggctaggcgaactgtgggtgactgaccctacaccagattcactccgcctgtcgtggacagtgcccgagggtcagtttgacagctttgtggtgcagttcaaggacaaagatgggccacaagtggtgcccgttgaaggccacgaaagatccgtgacagtcacgccgctggacgctggcaggaaataccgtttcctgctgtacgggctgctagggaagaagcggcacggacctttaaccgccgacggaacaaccgaggctcgctcagccatggacgatacaggaacaaagcgtccaccaaaaccaaggctcggcgaggagctccaggtgactacggtcactcagaattctgtaggtctgtcgtggacagttccagaagggcagttcgatagctttgtcgtgcagtataaggatagggatggtcagccccaggtcgtcccagtagagggatctcttcgcgaagtcagcgttccagggcttgatccagctcataggtacaaactcctgctgtatgggctgcaccatgggaagcgggtgggaccaattagtgccgtcgctatcaccgccggacgggaggaaacagagaccgagacgactgcgcctacacctcccgctcctgagccccacctgggtgaactcacagtggaggaggcgacctcccacaccctgcacctgagttggatggttacggagggggagtttgattccttcgaaattcaatataccgatagagatggccaactgcaaatggtaaggatcggcggtgatagaaacgacattacactgagtgggctggaatccgatcacaggtacctggtgaccttgtacgggttttcagatggaaaacatgtgggccctgtgcacgtggaggccctgactgtgccagaagaagaaaagccctctgaaccacctaccgcaacacctgaaccacccatcaagccgagattgggagaactcaccgtcacagacgctacacctgactccctcagcttgtcctggactgtccctgagggacagtttgaccatttcttagtccagtatagaaatggagatggccagcccaaagcagtgcgggttcctggccacgaggaaggtgtaaccatcagcggacttgaaccggatcataagtacaagatgaacctttatgggttccacggtggccagaggatggggcctgttagcgttgtgggggtgacggccgctgaggaggagacaccatccccaacggaacccagcatggaggcccctgagcccgcagaggaacctttgttaggtgagctgaccgtaaccggttcctctccagactctctgagcctgtcctggactgttccccaggggagatttgatagctttactgtccaatataaggacagggacgggagaccacaggtcgtgagggtgggcggtgaggaaagcgaagtaactgtggggggtttagagccgggacgaaagtacaagatgcacctctacggcctccacgaaggacgcagggtgggacccgtcagtgcagtgggcgttaccgcaccggaagaggagtccccagacgcgccactggcgaagttgcgactcggacagatgacagtccgggacatcacctccgatagtctgtccttgtcatggactgtgcccgagggccagtttgatcacttcctggttcaattcaaaaacggggacggacagccaaaagctgtgagggtgcctggtcatgaagacggggtgaccatctcgggcctagagcccgatcacaaatacaaaatgaacttgtacggcttccacggcggacagagagttggacccgtaagcgccgtgggcctgaccta

SEQ ID NO: 243728 - DNA, 2022 bp, Artificial Sequence
  Description of Artificial Sequence: Synthetic coding sequence
atgaggctttcctggagtgtggctcaggggcctttcgattcgttcgtggttcagtacgaagacactaacggacagccacaggcccttctggttgacggagaccagtcaaagattctgattagcgggctggagccctctaccccttaccggtttctgctgtacggtctgcatgaggggaagaggctggggcctctttctgcggaaggaactactggccttgcaccagcaggacaaactagcgaagaaagcaggccgaggctgagccaactgagcgtcacggacgtgacgacaagctcgcttaggctgaactgggaggcacccccaggcgcttttgattctttcctgcttcgcttcggagtacctagcccgtccacccttgaacctcaccccagacctctgttgcagagggaacttatggtcccgggaaccagacattccgcagtgctgcgtgaccttcgttctggaactctgtactcactgaccttgtacggcttaaggggccctcacaaagctgactcgattcagggcactgctcgtactctgtcgccagtactcgaaagcccaagagacctacagtttagcgagattcgtgagactagtgcaaaagtcaattggatgccacctccttcacgcgcagattcctttaaggtgagctaccagctggccgacggtggagagcctcagagcgtgcaagtggacggtcaggccaggactcagaagctgcaaggcctcattcctggcgcaagatatgaagtgaccgtggtgtctgtaagaggatttgaggaaagcgaaccactcactgggtttctgacgactgtgccagatgggccaacacagctcagagctcttaacctgacggaaggatttgcggtgttgcactggaagccccctcagaaccccgtcgacacctatgacattcaagttactgccccaggtgcccctcccctgcaagcggagacacctggaagcgcagtcgactaccctttacatgacctggtgctccacacgaattatacagccaccgtgcgaggactccggggacccaacctcacatcaccagcgtccatcacctttaccactgggctggaggctcccagggatctagaagcgaaagaagttaccccaagaacagccctgctgacttggactgaaccacccgtgaggccagcaggctacctattaagtttccacactcccggtggacagacccaggaaatactgctacccggtggcataacaagtcaccagctgctcggcctcttcccatctacctcatacaatgcgaggctgcaggcaatgtgggggcaatcactccttccccctgtgagcacgagcttcacaactggcggtctcagaataccctttcccagggactgcggagaagaaatgcagaacggagccggagcctccagaaccagtactatcttcctcaatggcaaccgagaacggccactgatcgtgttctgtgacatggaaaccgacggtgggggatggctggtcttccagaggcgaatggacgggcagaccgacttttggcgcgactgggaggactacgcacatgggttcggtaacatatcaggagagttctggctcgggaacgaggcacttcacagtctgacgcaggcaggagactacagcatgcgtgtggatctgcgtgcaggagatgaagctgtttttgcacagtacgattcctttcacgtggactccgcagccgaatactacaggcttcatctcgaggggtaccacgggaccgctggagacagcatgtcctaccattcaggaagcgtgtttagcgccagggacagggacccaaattccttgctgatctcctgcgccgtgagctatcgcggagcctggtggtaccgaaattgccactacgccaatctgaacggtctgtacggctcaactgtcgaccaccagggagtctcctggtaccattggaagggatttgagttctccgtgcctttcacagagatgaagctcagacctagaaacttcaggtcaccggcaggcggaggctag

SEQ ID NO: 243729 - DNA, 654 bp, Artificial Sequence
  Description of Artificial Sequence: Synthetic coding sequence
gcacctggcaaagatgaggagatggcgcctgcaagtacggagcccccaaccccagagccccctataaagcctagactggaggagttaacagtgaccgacgccactcccgatagtttatcactctcatggaccgtgcctgagggtcagtttgaccacttcctggtgcagtataagaatggggatgggcaacctaaggccaccagagtgcctgggcatgaagaccgcgtgaccatcagcggcctcgagccagacaacaaatataagatgaacctgtatggcttccacggaggacagcgagttgggcctgtctccgcgattggggtgaccgccgcagaagaggagaccccctccccaaccgagcccagcatggaagcccctgagccgccagaagagccactgttgggagagcttaccgtcaccggaagctcacctgacagcctgagcctgtcctggacagtgccccaaggaagattcgacagctttaccgtgcagtataaagatcgagatggacgccctcaggtcgtacgcgtgggaggcgaggagtctgaggtgacagtggggggtcttgaacccggaagaaagtacaagatgcatttgtacggcttgcatgagggtagaagggtaggtccggtaagcactgttggggtcacctag

SEQ ID NO: 243730 - DNA, 12729 bp, Artificial Sequence
  Description of Artificial Sequence: Synthetic coding sequence
atgatgcccgctcagtacgcattaacttccagccttgtattgttggtactgttaagtacggccagggcgggtccatttagcagtagaagcaatgttacactaccagctcctagaccccctccccagccaggcggtcatacggtgggcgcaggcgtggggagcccatccagccagctctacgaacacacagtggagggcggagagaagcaggtggtctttactcaccggatcaatttgcctccaagcacaggatgcggctgcccccctggaacggaacccccagtgctggcgtcagaggtgcaagccttacgagtcaggttggaaattttagaagagctcgttaaaggattgaaggaacagtgcaccgggggatgttgtccagcctctgcacaagctgggactgggcagactgatgtccgaacactttgctccctgcacggagtctttgatctgagcagatgcacttgctcttgtgaaccagggtggggtggcccaacctgttctgatcccactgacgctgaaataccaccaagcagccctccctccgctagcggcagctgtcccgatgattgcaatgaccagggaagatgcgtgcgagggagatgcgtttgtttccctggttatacagggccatcttgcggctggccttcgtgtcctggcgactgccagggccgtggaagatgcgttcagggggtctgtgtctgcagagcaggcttttcagggcctgattgctctcagcggagctgtcctagagggtgttcacagcgcggacggtgcgagggcggaagatgtgtctgtgaccctggctataccggcgatgattgcggcatgaggtcatgccctagagggtgttcccagagggggaggtgtgagaatgggagatgtgtctgcaacccaggatataccggcgaggactgtggcgtcagatcctgtccacgtggatgcagtcaaaggggcagatgcaaggacggccgatgtgtttgcgatcccggatacacaggcgaggattgtggcacgaggtcctgtccctgggattgtggggaaggcggaaggtgcgtggacggccgatgtgtgtgctggcctgggtacaccggggaggactgttccacccgcacctgccccagggattgtcggggtcgcggacgatgcgaagatggagagtgcatctgcgacactggctattccggagacgattgcggcgtaagaagctgtccaggtgattgtaaccagaggggcaggtgcgaagacggcaggtgcgtgtgttggcccggttacaccggaaccgactgtggatcaagggcctgccccagggactgtagggggagaggaaggtgtgagaatggcgtgtgcgtctgtaacgcgggttattccggcgaggactgcggtgtgagaagctgccccggagattgtagggggagaggcaggtgtgaatctggaagatgtatgtgctggcctggatatacaggccgagactgcggaacgcgggcatgccccggagactgccggggacgaggtcggtgcgtggacggtagatgcgtctgtaaccctgggttcaccggcgaggactgcggcagtcgccgttgtcccggagactgccggggacacggtctctgcgaggacggcgtgtgcgtctgcgacgcagggtacagcggggaagactgctctacccggtcctgccctggagggtgcagaggacgcggacagtgcctggacgggaggtgtgtttgcgaagacggatactccggggaggattgtggggtgcgtcagtgccccaacgattgttcccagcacggagtctgtcaggacggcgtctgcatctgctgggagggttatgtcagcgaagactgcagcatcaggacttgtccatccaactgtcatgggagaggccgttgcgaagaagggaggtgcctctgtgaccctggatacactggccctacatgtgccacccgaatgtgcccagccgactgccgcggacgtggcaggtgtgtgcagggtgtgtgcctgtgtcacgtaggctacgggggagaagactgtggccaggaagaaccacccgcatcagcatgccctggcggatgcggcccacgggagttatgtcgcgctgggcaatgcgtgtgcgtggaaggtttcaggggaccagactgtgcaatacagacatgcccaggcgactgtcgcggtagaggggagtgtcacgacggcagttgtgtctgcaaggacggttatgctggcgaagactgtggagaggaggtgcccaccatcgaggggatgcgcatgcacctcctggaagaaacaactgtgcgaaccgaatggactcctgctcctggtccggtggatgcctacgagatacagttcattcctaccacagagggtgcatcccctccatttactgcaagagtccctagttctgcgagtgcatatgaccagaggggccttgcacccggacaggagtatcaggtgaccgtacgtgcactgagagggacctcctgggggctgccagcaagcaaaacaataacaactatgatcgatggaccccaggaccttcgagtggtagctgtgacacctactactctggaactgggttggctgagacctcaggcggaagttgaccggttcgtggtgtcttacgtgtccgctgggaaccagcgcgtccgcctggaggtccctccagaggctgatggcacactgttaactgatctgatgcctggcgtggagtacgttgtgaccgtgactgctgagagaggcagagctgtgagctacccagcaagtgtgagagcgaataccggcagttcaccactgggtttactaggcacaaccgacgagccgccaccaagcggcccttctacaacccaaggggcacaagccccacttttgcagcagcggcctcaagagctgggagaattacgcgtcctgggtcgtgatgagaccggccgattgcgtgtggtgtggacagcacagcctgacacgttcgcctattttcagctgcggatgcgggtgccagaaggtcctggggctcacgaggaagtgttaccgggagatgtcagacaggccttggtgccccctcctccgccaggaacaccgtacgagctcagcctgcacggggtgcctccgggtggcaagccatctgaccccatcatttaccaggggataatggacaaggatgaggaaaagcctgggaagtccagcggccctccccgtcttggcgaactcacagtgactgacaggaccagtgattcattgctgttgagatggacggtccccgaaggtgaattcgatagctttgtgatacagtacaaagatcgggacggccaaccccaggtggtacccgtagagggacctcaaagatccgccgtgatcacttccctagacccaggaaggaaatacaaattcgtgctgtatggcttcgtcggcaagaaaagacacggccctttggtcgcggaggctaagatcctacctcaaagcgatcccagtcccggaactcctcccagacttgggaatctgtgggtcaccgatcccacacctgattccctccatctgagctggacagttcccgaaggacaatttgacaccttcatggttcagtaccgcgatcgagatggaaggcctcaggtcgtcccggtggaaggacctgaacggtctttcgtcgtcagttcgttggatccagatcataaatacaggttcactctgttcggtatcgctaacaagaagaggtatggtcctctgacggcagacgggaccaccgcccctgagcgaaaagaggagcctcctcggcctgagtttctagagcagcccttactaggcgaacttacagtcacaggtgttacaccagacagcttaagactcagttggactgtggctcagggcccattcgacagcttcatggtacaatacaaggacgcccagggtcaaccgcaggccgtccccgtcgcaggggatgaaaacgaagtcacggtgcctggactggaccctgacagaaagtacaaaatgaacctctacgggctgcgcggaaggcagagagtcggccctgaatctgtggttgccaaaaccgccccacaggaagatgtggacgagacaccatcacctactgagctgggaaccgaggccccagaaagtcccgaggagccgctactgggggagctcactgtgactggcagctctcccgattctctgagcttgttttggaccgtcccacagggaagctttgattcatttaccgtgcaatataaagaccgcgatggccgtcccagagcagttagagttgggggaaaagagtctgaagtgacagttggtgggctggaacctgggcacaaatacaagatgcatttatatggtctccacgaaggccaacgcgtgggtccagtgtccgctgtgggcgtgactgcccctcagcaggaggagacaccccctgccaccgagagtccactggagcctaggctgggagagctgaccgtcactgatgtgacccctaattccgtgggcttgtcttggacggtgccagagggccagtttgattcctttattgtacaatacaaagacaaagacggccagcctcaggtcgtgccagtggcagcagaccagagggaagttaccgtgtataatttggagcctgagagaaaatataaaatgaacatgtatggactgcacgacgggcaacggatggggccattatccgtggtcatagtgaccgctcctctccctccagccccagctactgaggcctccaaaccgcctctggaacccaggttgggtgaattgacggtgaccgacatcactcccgactcggtgggactcagctggaccgtgcctgaaggtgagttcgacagtttcgtcgttcagtataaggaccgggacgggcagccgcaggtggtgcctgtggccgctgatcagcgggaagtgacgattcccgatctggagccttccaggaaatacaagttcctcctctttggcatccaggacgggaaaagacggagcccagtcagcgtcgaggccaaaactgtcgccagaggggatgccagccctggcgcacctccacgtctgggtgaactttgggtgactgatcccactcccgacagcttgagactttcttggactgttcctgaaggccaatttgactcttttgtggtgcaattcaaggacaaagacggaccacaagtcgtgcccgtggaaggtcacgagcgttccgtaaccgtgaccccattggatgcaggcaggaagtatcgcttccttctgtatggacttctgggtaaaaaacggcatgggccattgaccgcagatgggaccactgaagccagaagcgctatggacgacaccgggacgaaaaggccccctaaaccacggctgggggaggaactgcaagtaacaactgtcactcagaatagtgttggacttagctggacggtccctgagggtcagtttgatagctttgtggttcaatacaaggaccgggacgggcaaccccaagtagtgccggtggagggctcattacgagaagtatcggtacccggactcgaccctgcccatcgttataaattgctcctctacggtctgcatcatggtaaaagggtcgggccaatcagcgccgtggctatcaccgcgggtagagaagagacagagaccgaaacaactgctccgacacctcccgctcccgagcctcatctgggagagctgaccgtggaagaggccacctctcacactctgcacctgagctggatggtgaccgaaggcgagttcgacagttttgagatacagtataccgaccgcgatggtcagctccagatggtgaggatcgggggtgataggaacgacatcaccctcagcggccttgagagtgatcaccgatacctcgtaacactctacggcttttctgacggcaagcacgtgggacccgtacatgtggaagctctcaccgtccctgaagaggaaaagcccagtgaacctcccacagccacacctgagccaccgatcaaacccaggctaggggaattgacagtcacagacgcgactccagactctctgtccttgtcttggactgtgcccgaaggacagttcgatcacttcctagtgcagtatagaaatggcgacggacagcctaaagcagtcagggtgcccggacacgaggagggcgtcacaatcagcggcctagaaccggaccacaaatataaaatgaatctgtacggatttcatgggggacaacggatggggccagtgagtgtcgtcggcgtgacagccgcagaggaggagacccctagcccgacagaaccaagtatggaggcacccgagcctgctgaagagccgctgctaggagaattaacggtgactggttccagccctgattctctaagtctctcttggaccgtgccacaggggaggtttgactcctttacagtgcaatataaggacagggacggcagaccacaggtggtccgggttgggggtgaggaaagcgaggttacagttgggggactagagcccggaaggaaatacaaaatgcacttgtatggcctgcacgagggaagacgcgtcggccctgtctctgctgtgggcgtgaccgcaccggaagaggagtccccagacgcccctctcgcaaagctgagattggggcagatgacagtgcgcgatatcacatccgactcgttgagcttatcatggaccgtccccgaaggccagtttgaccatttcttagtgcagttcaagaatggcgatggacaaccgaaggctgtccgcgtcccaggtcatgaggacggggtgacaatcagcggccttgaacctgaccataaatacaagatgaatctgtatggctttcacggcggacagcgggtgggacccgtttcagcagtgggtctgaccgcacccggtaaggacgaggagatggccccagcctccacagaacccccaaccccggaacctccgatcaagccccgtctcgaggaactgaccgtcaccgacgcgactcccgattctctgagtctgtcttggacggtgcctgagggtcagtttgatcacttcctcgtccagtataagaacggggacgggcagcctaaagccaccagggttccgggacatgaggaccgcgtgactatcagcgggctggagcccgataacaagtacaaaatgaatctgtatgggtttcacggtggtcaaagggtggggcctgtgtcagccatcggagttaccgccgctgaggaagagacaccctccccaacggaaccttcgatggaggctcccgaaccaccagaggagcccctgctcggcgagctgaccgtgacagggtcatcgcccgattctctaagccttagctggactgtgcctcaaggacgttttgattccttcactgtgcagtataaggatcgcgacggcagaccccaggtcgtgcgggtcggcggagaggagagcgaggtgacagttgggggtttggagcccggtcggaaatacaaaatgcacctctacgggctgcacgagggtcgtagggtgggcccagttagcactgtgggtgtcacagcacctcaggaagatgtggacgaaacaccgagtccaaccgaaccgggtacggaagcgcctgaaccaccagaggagcctcttctaggcgaactcactgtcacaggctccagtccggactcactcagcctgagttggacagttccccaaggccgattcgactcatttaccgtccagtataaggacagagatgggagacctcaggccgtgcgagtgggtgggcaggaatcaaaagtgacagtgcgaggactagagccgggacgcaagtacaaaatgcacctgtacgggcttcacgaaggacggagactcgggccagtaagcgcagtaggcgtcactgaggatgaggccgagacgacacaggccgtgccgacaatgacccccgagcccccaatcaagcccagactgggtgaattaacaatgacagacgcaacccctgacagtttaagcctgagctggactgtgcccgagggccagtttgatcatttcttggtgcaatatcggaatggcgacgggcaacctaaagcggtcagagtgcctggccacgaggatggcgttacgatctctggactcgagcctgatcacaaatacaagatgaatctgtatggattccacggaggtcagagggtggggcctatctcagtgatcggtgtaactgcagccgaagaagaaactccgagcccaactgagctgtccactgaggcgcctgagcctcccgaggagcctttgctcggggagttgacggtgacagggtccagccctgattcattgtcattgtcctggactatcccccaagggcattttgatagtttcacagtgcagtacaaagatagagacggtcgccctcaagtgatgagagtccgaggtgaagaatcagaggtgaccgtgggagggttggaacccggacgcaaatataagatgcatctgtatgggctccatgaaggacgacgggtgggtccagtatccacagtgggagtgactgaagatgaggccgagaccacacaagcggttcctactacaaccccagagcccccaaacaaacctcgccttggcgaattgacagtgactgatgctacgcccgactcactctctctgagctggatggtgcctgagggccaattcgaccactttctcgtacagtatagaaatggagacggccagcctaaggtggtgcgtgtgccaggacatgaggatggagttacaatcagtgggctcgaaccggaccacaagtacaaaatgaacctctacgggttccacgggggtcagagagttggtccaatcagcgtcattggggtaaccgccgctgaagaggagacacctgcaccaacagaaccatccactgaggcccctgaaccgcctgaggaacctttgctgggtgaattgaccgttacagggtcttctcccgactctctctccctcagttggaccatcccgcaaggcaggttcgattcattcacagtccagtacaaagaccgcgacggtagacctcaggtggttcgggtgagaggagaagaatcggaggttactgtgggcggactcgaacctgggtgtaagtacaagatgcatctctacggcctgcacgagggtcagcgggtaggacccgtttccgccgtgggggtgacagctcctaaggatgaagccgaaacaacacaggccgtgcctaccatgacacccgaaccgcctataaaaccgcgacttggagagctcacagtgaccgatgcgacgccagactccctgtctttaagctggatggtgcccgagggccagtttgaccatttcttagtccagtatcgaaacggcgatggtcaacccaaagccgtgcgcgtcccaggtcacgaggatggcgtgacaatttccgggctggagcctgaccacaagtacaaaatgaacctgtacgggtttcacggtggccagagggtaggacctgtttcagcaatcggcgttaccgaggaagagaccccctcccccactgagcctagtaccgaggcacccgaagccccagaagagccactgctgggtgagctgaccgtgacagggtcatctcccgattctctttccctgtcttggacggtcccccaaggccgattcgacagttttactgtgcaatacaaggatcgggacgggcagccccaagttgtcagagtgcgcggagaggagtcagaagtcactgtggggggattggaacctggaaggaaatataagatgcatctgtacggactacatgaggggcagagagtaggacccgtgtcaacggtgggtatcacggcccctctcccaaccccactcccggtagagcctcggctgggggagctggccgtcgccgctgtgacttccgacagcgtaggtctcagttggaccgtggcccagggcccttttgatagcttccttgtacagtacagggatgcccagggacagccacaagccgtgccagtgtcaggagatctgcgcgctgtagctgtgtctggcctggatcctgctcgcaaatacaagtttttactgtttggtctacagaacggcaaacgccatggaccagtcccagtcgaggctcgcaccgctcctgataccaaaccgtccccaaggctcggggaactgaccgtcacagacgcaacccccgattccgtgggcctcagttggactgtgccagagggggagtttgatagcttcgttgtccagtataaagataaggatggcagactacaagttgtgccagtggctgccaaccaacgtgaagttactgtccagggtctggaacccagccgcaagtatcgatttctgttatatggtctgtcaggcagaaaacgtctgggacccataagcgccgactccactacggcaccgctggagaaggaactgcctcctcaccttggagagctcacagttgccgaggagacaagttccagcctgaggctgtcctggacagtggctcagggtcccttcgattcatttgtggtccagtacagggacaccgatggacaacctcgggctgtgcctgtggccgcagatcaacgcacagtgacagtagaagacctggagcccggaaagaagtacaagttcctgctctatggcctgctggggggaaagcggctaggtcctgtcagcgctctgggaatgacagccccagaggaagacactccggcaccagagctggctccagaagctcccgaacctccggaggaacctaggctgggcgtgcttaccgtcactgacaccacacctgactccatgagactctcttggtctgtggcgcaagggccattcgacagcttcgtggtacagtatgaggatactaatgggcagccccaggccctgttggtagacggagaccaaagtaaaatcctgatttccggactcgagccttcaacgccttatcgctttctcctctatgggctgcatgagggcaagcgcctggggcctctcagtgccgaagggacaacagggttggcaccggcaggtcagacctcagaggaatcacgtccccgtctgagccagctgtctgtgaccgacgtgaccacctcgtcattgaggctgaattgggaggcaccccctggggcattcgattcctttctcctccgcttcggtgtgccttccccctcaacactggaaccacaccctagacccctgctgcagagggagctcatggtgccaggaaccaggcacagcgctgtgttgcgagatcttaggtctggcacgttgtatagtttgaccctctatggccttagaggtccccacaaagccgattcgattcagggcaccgcaagaactctgtcccccgtcctggagagccctcgcgacctgcagttcagcgaaattagagagacaagcgccaaagtaaattggatgcctccaccctccagagctgactcttttaaagtctcgtaccagcttgccgatggaggggaacctcagagcgtgcaagtggatgggcaagcacgcacgcaaaagttgcagggactgattccaggtgcgcgttatgaggtcacagtggtctcggtgcggggttttgaggaaagcgagcccctgaccggatttttgaccacggtccctgacggaccgacgcagctgcgagccctgaacctgacggaagggttcgctgtactccattggaagccacctcagaatccagtggatacgtatgatattcaggtcacagctcccggtgccccacccctccaggccgagactccaggaagtgcagtcgactatcccctgcatgatttagtccttcatacaaactatactgccacggtcaggggtcttagaggcccaaatttaaccagtccagcctccattacctttaccacagggttagaagctcccagagacctagaggctaaagaagtcacccctagaactgcattgctcacctggactgaaccacccgtgcgaccagcagggtacctgctgtccttccacaccccaggaggtcagacccaagagatactcctgcctggcggaattacctcccaccaactgctggggctcttcccttcaacttcctacaatgcgaggctgcaggccatgtggggacagtctcttctcccgcctgtgtccacttcgttcaccacgggcggattgcggattccgtttcctagggactgtggagaggagatgcagaacggtgctggagcgtcccgaacatcaaccatcttccttaatgggaaccgggaacgtccgctaattgtgttctgcgatatggagaccgacggcggagggtggctcgttttccagaggcgcatggatggccagacggacttttggcgagactgggaggattatgctcatgggttcggaaacatctcaggagagttctggctcggcaacgaggccctccactccttgactcaggcgggagactattctatgcgcgtagatctcagagctggtgacgaggctgttttcgcccagtacgattcattccacgtggactctgcagcggaatattaccgactgcacctggagggataccacgggaccgctggagattctatgagctatcacagcggttcagtcttcagtgcgcgtgatagagacccaaacagtctcctgatttcctgcgctgtctcctatagaggcgcttggtggtatcgcaattgccattatgctaatctgaacggactctacgggtccactgtggatcaccagggcgttagttggtaccactggaaaggattcgaatttagtgtacctttcaccgaaatgaagctgagaccacgcaacttccggtcgcctgccggaggcggttat

SEQ ID NO: 243731 - DNA, 12729 bp, Artificial Sequence
  Description of Artificial Sequence: Synthetic coding sequence
atgatgcctgctcagtatgcccttacgagtagccttgtactcctcgtattactctctacagcaagggccggaccattttcttcgcggagtaatgtaacactgcccgcaccgaggccgccaccccaaccaggcggtcacacagtcggggctggcgtgggctccccctcttcccagctgtacgagcacaccgtggaaggaggcgagaaacaggtggtgttcacgcaccgtattaacttgccgccttccactggctgtggctgtccacccggaacggagcctcccgttctcgccagcgaggttcaagccctgagggtccgtctggagatactggaggagctcgttaagggactaaaggaacagtgcactgggggatgctgccctgcctccgcccaggctggaactggccagaccgatgtacgcacactttgcagtctacacggggtgtttgacttgtcgcgatgtacttgttcctgtgagcccggatgggggggtccaacttgttcagatcctactgatgctgaaatccctccatcatccccgccttcagcctctggttcgtgtcccgacgattgcaatgaccaaggcaggtgcgttaggggcagatgtgtatgttttcccggatataccggtccttcttgcgggtggccaagttgtccgggtgattgtcagggaagagggaggtgtgtccaaggggtgtgcgtctgtcgagcgggattctcaggcccagactgttctcagcgctcgtgtccaagaggctgctcccaaagaggcaggtgcgagggcggaaggtgcgtatgcgatcctgggtacacaggcgacgactgcggcatgagatcttgccctagaggatgttcccaaaggggtcggtgcgaaaacgggcgttgtgtctgtaacccaggctatgctggcgaggactgcggggtgagaagctgtccacgtggctgttcacagcgaggtagatgtaaggacggcagatgcgtgtgtgatcccggttataccggagaggattgcggtacgcgctcctgtccttgggattgcggagaaggcggacggtgtgtggatggaaggtgtgtttgctggcccggttatactggtgaggattgctccaccagaacctgtccaagagattgtcgcggaaggggcaggtgcgaggacggcgagtgtatctgtgatactggatactctggggacgactgcggcgtcagatcctgtccaggagattgcaatcaaagagggcgatgtgaagacgggaggtgcgtgtgttggcccggttatacaggaactgactgtggatcccgggcatgcccgagggattgtagggggagaggcagatgcgaaaatggtgtgtgtgtgtgtaatgctggatattcgggggaggattgtggggttcgcagttgtcccggtgattgccgaggacggggtcgatgcgagtcaggtcgctgcatgtgttggcccggatatactggacgggattgtggtacaagagcatgtccaggagattgcagaggccgtggtcggtgtgttgatggtcgttgtgtttgtaacccaggcttcaccggcgaagactgtggcagcagacgctgtccaggggactgtagaggccacggactgtgtgaggacggcgtctgcgtctgcgatgcgggttattctggcgaggactgcagcacgcggtcgtgccccggaggatgtcggggacgcggacagtgtctggacggcaggtgcgtctgcgaggacgggtatagcggcgaggattgtggcgtccgtcagtgtcccaatgattgctcacagcatggagtttgccaggatggcgtctgcatttgttgggagggctatgtctcagaagactgttctataagaacctgtccttcaaactgtcacggcagggggcgatgcgaggaagggagatgcttgtgcgaccccggatacaccggtcctacgtgcgccactaggatgtgccctgccgattgcagaggcaggggcagatgcgtgcaaggtgtttgtctctgccatgtggggtatggcggtgaagattgtgggcaggaggagccacccgcaagcgcctgtcctggagggtgcggccctagggaattgtgccgagctggacagtgcgtttgcgttgagggatttcggggacccgattgcgcgatacaaacatgtccaggcgattgtagaggcagaggagagtgtcacgatggcagttgtgtgtgcaaagatgggtatgccggagaagactgtggtgaggaggtcccaaccatcgaaggtatgaggatgcacctgttagaagaaactactgtgagaactgaatggaccccagcccctggtcctgtggacgcctacgaaattcaatttattccaacaactgagggggctagcccaccctttaccgcacgcgtcccctcaagtgcgagcgcctacgaccagcggggtctggcaccaggccaggagtaccaggtcactgtgcgcgcactgcgaggcacctcctggggcctgccagcctctaagactatcacaaccatgatagacggtcctcaggacctacgggtggtggctgtgactcctacaacactggaattgggatggctgcggccacaagcggaggtggatcgattcgtcgtgagctatgtctctgccggaaaccagcgagtgcgcctggaggtaccaccagaagcagatggcaccctgctgaccgatttgatgccaggagtggagtacgtggtcactgtcacggccgaacgcggaagggccgtgagctacccagccagcgtgagagcaaacacaggaagctctcctcttggactgcttggcacaactgatgagccccctcccagcggcccaagcacaacccagggtgcccaggctcctttattgcagcagaggccccaggagctgggggaactgcgcgttctgggcagagacgagacaggacgattgagggtggtctggacggctcaaccagatacttttgcatactttcagctcagaatgcgcgttcccgaaggccctggcgcacacgaggaggtcctcccaggggacgtgcgtcaagccctggttcctcctcccccacccggtacaccatacgagctcagcttgcacggcgttccaccagggggaaaaccgagtgatcctatcatctaccaaggaattatggacaaggacgaagaaaagccgggtaaatcttctggtccacctcgtctaggggaactcacggtgacagacagaacatcagactcactgctcttgcggtggactgtgccagagggagagttcgatagtttcgttatccagtataaggatcgtgatgggcagccccaggtagtcccagttgagggtcctcagagaagtgcagtgatcacttcccttgatcctggcagaaaatataagtttgttctctacggattcgttggcaagaagagacacggtcccttggtggccgaagctaaaatcctgcctcagtctgacccatcccccggaacaccccctcacctgggaaatctgtgggtgacggatcccaccccagacagcttacacctgtcctggactgtcccggagggccagttcgatactttcatggtgcagtacagagacagggacggccgacctcaggttgttcccgtagaaggacccgagaggtctttcgtggtgtcttccctggaccctgatcacaagtatcgcttcaccttgtttggaatagcaaataaaaagagatatggacccctcactgcagatggcaccacagcccctgagcggaaggaggaaccccctagaccagaatttctggaacagcccctgttgggggagctgaccgtgaccggagtgaccccggactctctccgactgagctggacagtagctcagggcccatttgattcgtttatggtccagtataaggacgcccaggggcagcctcaagccgttcctgtcgcaggcgacgaaaacgaggtcacagtacctggcctggatcctgaccgaaagtacaagatgaatctttacggcttacgtggccgacagagagttggtccggagagcgtggttgccaaaacggctccacaagaagacgtggacgagactcccagccccactgaactgggcacagaagctccagaatctcctgaggagcccctccttggggaactcacagttaccgggtcctctcccgacagcttaagtctgttttggaccgttcctcagggctcttttgacagcttcacagtgcagtataaggaccgagatggacgtccacgtgcggttcgggtcggaggcaaagagagtgaggtgacggtcggcggtttggagcccggacacaagtacaaaatgcacctctacgggttacacgagggccaaagagtggggcctgtaagtgccgtgggggttactgcgccacagcaggaagagacccctcctgccaccgagtcaccactggagcccagactgggggagctgactgtgacagacgtgactccgaacagcgtcgggcttagttggactgtgccggagggccagtttgattcttttattgtgcagtataaagacaaagatgggcagccccaggtagtgccagtagccgctgaccagcgggaagtgaccgtctataacctggaaccagagagaaaatacaaaatgaacatgtacgggctccacgatggtcagagaatggggccattgtcagttgtcattgtgaccgcgccactacctcctgcacccgctacagaagcatccaaaccacccctggagcctagactcggggagctgacagtgaccgacatcactcccgattctgtgggtttgtcctggactgttccagagggggaattcgactctttcgtggtgcagtataaagaccgggacgggcaaccgcaagtggtgccagtggcagccgatcagagagaagtgaccattcccgatctcgagccatccagaaagtacaagtttctcttattcgggatccaggatggaaagcggcgaagtcctgtgtctgtcgaagcgaagaccgtcgcacgcggtgacgctagcccaggagcacccccacgattgggggaactttgggtgacggatcctacacccgactcactgcgactcagttggactgtgccggaaggccagttcgacagtttcgtggtacagttcaaggacaaggatggaccccaggtggtgcccgtcgaaggacacgaaaggagtgtcaccgtgactccactggatgcgggtagaaagtaccggttcttgctttatggattacttggtaaaaaacgccacggccctctgacagcagacggcaccactgaggccagatcagccatggacgacacggggacaaaacgaccacccaaaccacgcctgggggaggaacttcaggtgacaacagttacccaaaacagcgtgggtttgagctggactgttcctgaagggcagtttgacagttttgtggtacagtacaaggaccgtgatggccagccccaagtcgtgccagtggagggtagcctcagagaggttagcgtccctgggctggacccagcccaccggtacaaactgttactgtatggtctgcaccacggcaaaagggttggcccaatttctgcagtcgccataaccgcaggacgagaagagacagagactgagacaaccgcacctacacctccagcccctgaaccacaccttggagagctgaccgtggaggaggccacatcacatactctgcacctgtcttggatggtgaccgagggggaatttgatagcttcgaaattcaatacaccgacagggacgggcagttacagatggtacggataggtggcgacagaaatgatataacgctctcaggccttgaaagtgaccaccggtacctcgtaactctatacggtttctctgatggcaaacatgtgggcccagtacatgtcgaagcactcaccgtgcccgaggaggaaaagccatccgaacccccaaccgccactccagagccaccaattaagccaagacttggtgagctaacggtaacagacgccactcccgactcgctgtccctcagctggacagtcccagaaggccagtttgatcattttcttgtgcagtaccggaatggcgacggccagcccaaggccgtcagggtacccggacacgaggaaggggtgacaatctcgggccttgagcccgaccacaaatataaaatgaatctgtacggcttccacgggggacaacggatgggacccgtgtcagtcgtaggcgtgaccgccgcagaggaagaaacgcccagcccaaccgagcctagcatggaagctcctgaacctgcggaagaaccactccttggagaactgaccgtgactgggtcatcaccagactcactctccctcagttggaccgtgccacaaggtagatttgatagctttaccgtgcagtacaaggatagagatgggagacctcaggtcgtgcgagtgggcggagaggagtcagaggtcacggtcgggggactggaaccagggcgaaagtataaaatgcacctgtacggtttgcatgaaggaagacgcgttgggcctgttagcgccgtgggagtgacagccccagaagaagagtctccagacgccccactcgctaaactccgactgggccagatgactgtccgtgatataacctccgattccctcagtctcagttggacagtgcccgaaggacagtttgaccacttcctggtgcagttcaagaatggggacggccagcctaaggccgtaagagtgccagggcacgaagatggcgtgactatcagtggactagaacctgatcataagtacaaaatgaatttatacggtttccatgggggacagcgggtaggacctgtgagtgccgtggggttaaccgcgccaggtaaagacgaggagatggctcccgcaagtaccgagcctcctactccagagcctcctatcaagcccaggctggaggagctgactgtgaccgacgcaacaccagactctctgtctctgtcctggactgtgcccgaaggtcagttcgaccattttctggttcaatacaaaaacggggatggacagcctaaagctacgagggtgccaggccacgaggatcgagtgacaattagcgggttggaaccagataacaagtacaagatgaatctgtatggattccacgggggtcaaagggttggcccagtctccgccattggggtgactgcagctgaggaggagaccccatccccaacggagccgagcatggaggctcccgaaccccctgaagaacccctattgggagagctgacagttaccggatcaagccctgattctttatccctctcgtggactgtgcctcaaggcaggttcgatagctttacagtccagtataaggaccgcgacggccgaccacaggtggtgagagttggcggagaagaaagtgaagtcaccgtgggtggcctggagcctgggcgtaaatataaaatgcacctgtacggcctgcacgagggcagacgggtcggccctgtgtccactgtgggggtcaccgcaccacaggaagacgtagatgaaacaccatcccccaccgagcccggaaccgaagccccagaacccccagaggagccattgttgggcgagcttactgtgaccggcagctctcccgactcactgtctctctcatggacggttccgcaggggcgatttgactctttcacagtacagtataaggaccgtgatggacgcccacaggccgttcgagtggggggtcaggaatcaaaggttaccgtccgagggctggaaccgggaagaaaatataagatgcacctgtatgggctgcacgaaggcagacggctcgggccagtctccgctgtcggcgttactgaggatgaggcagagacaacccaggcagtacctactatgacgcccgaacctcccatcaagcctcgcctaggagagctcactatgacggacgcgactcccgactctctatcattgtcctggacggtgcccgaaggccaattcgaccatttcctggttcagtaccgcaacggggatggccagcccaaagcagtgcgggtgcctggccatgaggatggcgtgaccatcagcggccttgaaccggaccataaatataagatgaacctctatggatttcatgggggtcaacgtgttggcccaataagtgtgatcggggttacagcagccgaagaagagacaccttcgccgaccgagctcagcactgaggcccctgagccgccagaagagccgctcctgggggagctgactgtgaccggctcaagtcccgatagcctatccttgtcatggaccattccacagggtcatttcgacagttttacagttcagtataaggaccgggacggcagaccgcaagtgatgagggtgcgcggtgaggaaagcgaagtgacggttgggggactggagccagggaggaagtacaaaatgcacctgtatggattgcatgagggcagaagggtcggtcccgtgtcaaccgtgggtgtaacagaggacgaggcagaaaccacccaggctgtaccaacaaccaccccagaaccgccaaataagcctcgacttggggagctgactgtcacagacgccacacccgactcccttagccttagctggatggtgcctgaagggcagttcgatcatttcctggtgcagtataggaacggcgatggacagcccaaagtagtgcgcgtcccagggcacgaggacggtgtgacaatcagtgggctcgaacccgaccacaagtacaagatgaatctttatggatttcacggcggacagcgcgtgggaccaattagtgtaattggggtgacagcagcggaggaggagacccccgctcctactgagcccagcacagaggcccctgaaccacctgaagagcccctactgggcgagctgaccgtgaccgggagctcaccagattcattatctctcagctggactatacctcaggggcgattcgactccttcaccgtgcagtacaaagatcgggatggacgacctcaggtagttcgcgtcagaggcgaagagtccgaggtgacagtgggcggactcgagcccggttgcaagtacaaaatgcacctgtacggcctccatgagggccagcgggtcggacctgtgtccgcagtgggcgtcaccgccccaaaagacgaggctgagaccactcaagccgtacccactatgacgcccgaaccacccataaagcctagactgggcgagctgactgtcactgacgcaaccccggacagcctctctctgagctggatggtacccgaggggcaatttgatcattttctagtgcaataccgtaatggcgacgggcagcctaaggctgtcagggtccctggtcacgaggacggcgtgaccatatctggcttagagcctgatcacaaatacaagatgaacctgtatggatttcacggcggacagagagtgggtcccgtttcagcaatcggggtaacggaagaagagaccccttcacccactgaaccatccaccgaagcacctgaagctccagaagaaccccttcttggggagctgaccgtgacaggaagtagcccggatagtctttcactgagttggaccgtacctcaggggagatttgacagcttcacagtgcaatataaggatagagacgggcagccccaagtggtccgagtgcgcggagaagaaagtgaagtcacagttggaggactagaacctggacggaagtataaaatgcacctgtacggcctgcacgaagggcagcgggtgggtcccgtatcaacggtcgggatcacggcacccttgcccaccccactgccagtggaacctcggcttggagagctggcagtagccgcagtcactagtgattccgtggggcttagttggaccgtagcacaaggaccttttgattcgttcctcgttcaatatcgggacgcccaagggcagccacaagccgtgccagtttctggtgacctgagggccgtcgcggtgtcggggctagaccctgctaggaagtacaagttcctgctattcggactgcagaatggcaagcgccacggacctgtgcctgttgaagcccgaacagccccagatacaaaacccagcccgagactgggcgaattgacagtaaccgacgctacgcccgactcggtgggcctgtcttggactgtaccagagggggagttcgacagttttgtggtccaatacaaggataaagatggacgcctccaagtggtgccagttgccgctaatcagcgtgaagtcaccgttcagggcctcgagccttctagaaagtaccgcttcctgctgtatggattgagtggcaggaaaaggctcgggccaatcagtgctgactctacaactgccccactcgagaaagaactgcctccgcacttgggcgagttaactgtggctgaagaaacttcgtccagtctcagattgtcatggaccgtggcccaggggccattcgattctttcgtggtgcagtaccgagacacagatggccagcctcgggcagtgcctgtggctgctgaccagcgcactgtgaccgttgaagacctcgagcccggaaagaagtataagttcctgttatatggactgttaggtgggaagaggctcgggcctgtcagtgcccttggtatgactgcaccagaagaagacaccccagcccctgagttagcccctgaggcgccagagcctcctgaggagccaaggctgggggtactcactgtgaccgatacaacaccggattctatgaggcttagctggagcgtggctcaaggtccatttgattcctttgttgtgcagtatgaggatacgaacggacagcctcaagctctgttagttgatggagaccagagcaagattctcatctcaggtctggaaccaagcacaccctacagatttttgctttacgggttacatgaagggaaacggctgggccctctttcagccgaagggactacaggtctcgctccagctgggcaaacctccgaagagagcaggccgaggttgagccaactgtctgtcactgacgtaaccactagttctctcaggctgaattgggaggcacctccaggcgcattcgatagttttctgctccggttcggtgtgcctagtccatcaaccctggagccccatcctcggccactcctgcagagagaactgatggtaccaggaaccaggcacagcgcagtacttagagatcttaggtcgggcaccctatactctctcaccctttatgggctgcgtggcccacacaaagctgatagcatccaggggacagccagaaccttatccccagttctggagtctccaagggacttacaattctccgaaataagggaaacgagtgcaaaagtcaattggatgccccctccgagcagagcggatagcttcaaagtgtcttaccagttggcggatggaggtgagccccagagcgtgcaggtcgacggtcaagcgcgtacccagaagctgcaggggttgatccccggtgccaggtacgaggtgaccgtggtgagcgtgcgaggttttgaagagtctgagccactgactggattccttactacggtaccggatggcccaacccagttgcgcgctctcaatctgacagagggatttgctgtgctccattggaagccacctcaaaaccctgtggacacatatgacgtgcaggttaccgccccaggggctccgccacttcaagccgaaaccccaggaagtgcggtggattacccattgcacgatctggtgctgcatactaactacacggccactgttagggggctgcgcggtcccaatctaacctcacccgcatcaatcaccttcaccactggacttgaggctcctagagaccttgaagccaaggaggtgaccccccgaactgcgctgttgacctggacagaacctccagtgcggcctgctggttaccttctcagtttccatactcccggagggcaaaatcaggagattcttcttcccggaggaattaccagccatcagctccttgggcttttccccagcacgtcttacaacgcacggcttcaggccatgtgggggcagagtctgttgccacctgtgtccacctcctttactactgggggtctcagaatcccttttccacgggattgcggagaagaaatgcagaatggcgcaggggcttcgagaactagtaccatcttcttaaacggtaacagagaacggcctctgaatgttttctgcgacatggaaacagacggtggcggttggcttgtgttccagaggaggatggacggccaaacagatttttggagggactgggaagactacgctcatggatttggcaacatatccggcgaattttggctgggaaacgaggcattgcactctcttactcaggcaggcgactattcaatgcgggtggacttgcgggcaggagatgaggccgtctttgcccagtatgatagttttcatgtagatagcgcggctgagtactaccggctccacttagaaggctaccatggcactgcgggtgactcaatgtcctaccactcagggtcggtttttagcgcacgagacagagaccccaattctctgctgatctcctgcgccgtttcctaccgaggagcctggtggtaccgcaattgtcattacgccaatctgaacggcctttacggcagtactgtggatcaccagggggtttcctggtaccattggaagggatttgaattcagcgtgcccttcacagaaatgaagctgagaccgaggaacttccgatcgcccgctggaggtggttat

SEQ ID NO: 243732 - DNA, 843 bp, Artificial Sequence
  Description of Artificial Sequence: Synthetic coding sequence
atggtcactgaaggtgaatttgactcattcgagatccagtataccgatcgcgatggtcaattacagatggtgagaatcggcggagatcgcaacgacatcactttgtctggccttgagtccgaccaccggtacctggtaaccctgtacggctttagcgacggcaaacacgtcggacccgtgcatgttgaagcactgactgttccggaagaggaaaagccttccgaaccaccaacggcgaccccagagccccctattaagccccgactcggggagctcactgtaaccgatgctacccctgattcactttcactgagttggacagtgcccgaaggacagtttgatcatttcctggttcagtatagaaatggcgacggtcaaccaaaggcagtgagagtcccgggtcacgaggagggagttacaataagtgggttggaacccgatcacaagtataagatgaacctctatggttttcacgggggtcaaagaatgggccctgttagtgtggtgggggtcacagcagcagaggaagaaacaccctcccccaccgagccctcaatggaagccccagaacctgcggaggaacccctgcttggtgagctgacagttacaggttcatcaccggattccctgtctctgagttggaccgtcccccagggacgttttgactcctttaccgttcagtataaggatagagatggaagaccgcaggtagttcgggttggtggtgaggagtccgaggtcacagtgggaggactcgagcctggcaggaaatataagatgcacctctatggattgcacgaaggcaggagggttgggcctgttagcgcagtgggcgtcacgtag

SEQ ID NO: 243733 - DNA, 12729 bp, Artificial Sequence
  Description of Artificial Sequence: Synthetic coding sequence
atgatgcccgctcagtacgcgctaacgtccagtctggtgcttctggttctgttaagtacggctcgagccggtcccttttctagcagaagcaacgtaacgcttccagcccctagacctcccccacaaccaggcggtcacactgtaggggcaggcgtgggctctcctagctctcagttgtacgaacacacagttgaagggggtgagaaacaagtcgtttttacccaccgcatcaatttgccacccagtactggatgtgggtgtccaccgggaacagaaccacctgtgctggcttcggaggtgcaggccttgcgcgtgcgcctcgaaatactagaagaactggtgaaaggtctcaaggaacagtgcacagggggatgttgcccagctagcgcccaggccggaacaggacagactgatgttcgtacactctgctccctacatggcgtttttgacctaagcaggtgtacctgctcttgtgagccaggatggggtggccctacttgtagcgatcccacagacgctgagattcccccttctagcccgccaagtgcttctgggtcatgccccgacgattgtaacgaccagggaaggtgtgtacggggtcggtgcgtgtgttttcctggttacacgggcccaagctgcggttggcctagctgcccgggagactgccagggcaggggcagatgtgtgcagggggtatgcgtttgtagggccggtttttcaggtcccgattgctctcaaagaagctgtccacgcggttgctctcagaggggccgatgtgaaggtggaaggtgcgtgtgcgatcccggatacacaggcgatgattgtggcatgcgatcctgccctagggggtgcagccagcgcggacggtgcgagaacggccgttgcgtgtgcaacccgggttataccggtgaggactgcggagtaagatcgtgtccacgcggatgctcccaaaggggcagatgtaaggacggacgttgtgtgtgtgaccctgggtacacaggtgaggactgtgggacaagaagttgcccgtgggactgcggggagggtggtcgatgcgttgatgggagatgtgtttgctggcctggatatacgggagaagattgctccacacgcacgtgtcctagggattgccggggacgagggagatgcgaggatggagagtgtatctgtgataccggttatagcggagacgattgcggggtgcgcagctgtccaggagattgtaaccagcgaggcaggtgtgaggacggccgatgtgtctgctggcctgggtataccggcacagactgcggcagccgagcctgtccccgagactgccgcggaagagggaggtgcgagaacggagtttgtgtttgcaacgctggctactctggcgaggattgtggggtccggagttgtcccggtgactgtcggggacggggaagatgcgagagtggacggtgtatgtgttggccagggtatacaggccgtgattgtggtacaagggcttgtccaggggattgccgcggacgtggccgatgcgtagacgggagatgcgtttgtaacccgggatttactggagaagattgtggcagcaggcgttgtcccggagattgccgcggtcatggcttgtgtgaggatggcgtatgcgtctgtgatgctggctactccggcgaagactgctccactcggagctgccctggaggatgccgcggtcgagggcagtgcctggacggccgatgcgtctgcgaggatggctactcaggcgaagattgtggtgtacgccagtgccctaatgactgttctcaacacggggtttgccaagacggagtttgcatctgctgggaaggatacgtgtctgaggactgttctatacgcacttgtccgtctaattgtcacgggcgaggcaggtgcgaggaggggagatgtctttgtgaccccggatacaccggtcctacttgtgccactcgaatgtgtcccgcagactgccgcggtcgcggtaggtgcgtgcagggggtgtgcttgtgccacgtgggctacggcggagaagactgtggccaggaggagccgccagcatcagcctgcccaggcggttgtggcccaagggaactctgtagagccggtcagtgcgtttgcgtcgaaggattcagaggccctgactgcgccattcagacttgcccaggtgattgtagaggcagaggagagtgtcacgacgggtcctgtgtgtgcaaggatggctatgccggtgaagattgcggagaagaggtccctaccattgaagggatgcgtatgcacctgttggaggaaaccacggtgagaacggagtggaccccagcccctggccctgttgatgcatacgagattcagttcattcctaccacagaaggagcctcccccccattcactgctagggttccgtcatcggcctccgcctacgaccagcggggtctggcaccagggcaagagtaccaggtgactgtgagagccctgcgcggaacgtcttgggggttgccggcaagtaaaaccatcacaacaatgatcgatggcccacaggacctgcgcgtcgtagcggtcacccccacgacactggagctgggatggttgagacctcaggctgaggtcgatcgcttcgtcgtgtcctacgtgagcgcaggtaaccagcgtgtgaggctggaggttcctcccgaggccgacgggacactgctcactgatttgatgcccggagtggagtacgtggtgacagtcaccgccgagagaggccgtgcagtctcctatcccgcatcagtaagagctaacaccgggtcctctcctttagggttgctggggaccactgatgagcccccaccaagcggtcccagtacaactcagggagctcaggcaccccttctgcagcaacggcctcaggagcttggcgagttgcgagtgctcggcagagacgaaaccggacgcttaagggtcgtctggacagcccagcctgatacttttgcgtacttccagcttagaatgcgggtccccgaagggccaggtgcccatgaggaggtactgcccggagatgtgcgccaggctctggtccccccaccgcctccaggaacgccctacgagctttcgctgcatggcgtgcctcccggagggaaaccgagcgaccccattatctaccagggaattatggacaaagatgaggagaagccaggaaagtcctccggaccgcctcgacttggagagctgacagtgaccgatagaaccagtgatagcctgcttctgagatggaccgtgccagaaggggaattcgactccttcgtgatccagtacaaagacagagatggccaaccacaagtggttcccgtcgaagggcctcagcgctcagccgttatcacatcactggaccctggtcgcaagtacaagtttgtcctgtacggattcgtgggcaagaaacggcacggcccattggtggcagaagcaaagatcctccctcaatcagacccctctcccggaacgccgccaagactcggtaatctgtgggtgacagatcccactccagacagtctgcacctctcttggactgtcccagaggggcaattcgatacgtttatggtgcagtatcgggaccgcgatggaaggccccaggttgttccggtggaagggccagaaaggtcctttgtagtgtcatctctggacccagatcacaagtaccggttcacccttttcggaatcgccaacaagaaaaggtacggacccctaactgccgacggaactacagcgcctgagagaaaggaagagccacctcaccctgaatttctagaacagccgcttctgggcgaactgacagttacaggcgtgactcccgacagcctgagactgtcatggacagtggcccaaggaccattcgatagttttatggtccagtacaaggacgcgcagggtcaaccacaggccgtgcccgtggctggcgatgaaaatgaggtgacagtgcccggtctggatcctgaccgaaaatacaagatgaacctgtatgggctacggggtcggcagagagttggcccagagtcagtggttgctaaaactgcccctcaggaggatgttgatgagacaccctccccaaccgaactgggaactgaagcccctgagtctccagaggagccgctgttgggcgagcttactgttacaggctccagccctgattccctttctctcttctggacggtcccgcagggtagtttcgattctttcacagtgcaatacaaagacagagacgggaggccgagggcagtgagagtgggtggcaaagaaagcgaagttacagtgggtggcctggagcctggccacaagtacaagatgcacctgtatggactgcacgaaggccagcgcgtgggtccggtgtccgctgtgggagttaccgcaccacagcaggaggagactcctcccgcaacagagtctccacttgagccacgcctgggagagttgacggtgaccgatgttactcccaacagcgtgggcctgagctggaccgtgcctgagggacagtttgacagttttatagttcaatacaaagacaaagatggacagccccaggtcgttcccgtcgccgcagaccaaagggaagtcactgtttataatcttgagccagaaagaaagtataagatgaacatgtacggcctccacgacgggcagagaatgggcccactttccgtcgtgattgtcaccgcaccactgcccccagccccagccacagaggcatctaaaccgccactcgaaccccgactgggggagctgacagtcacggatatcacaccagactcagtgggcctctcctggaccgtgcccgagggcgagttcgactccttcgtggttcagtacaaagatagggacggccaacctcaggtcgttccagtcgctgcagaccaaagagaagtcacaatccccgatctggagccttcccgcaaatataagttcctgctgtttggaatccaggatggaaaacgcaggtcccctgtgagcgtggaggccaaaaccgtggctcggggagacgcctctcccggtgcgccacccaggctaggagaactgtgggttacggaccctactcctgactccctgcgactctcttggaccgtccctgaaggacagttcgacagctttgtcgtgcagttcaaggacaaggacggacctcaggtggtgcccgtcgaagggcatgagcgctcagttacagttacaccacttgacgcgggaagaaagtataggtttttgctgtacggcctcttaggaaagaaacgccacggaccactgactgcggatggcactacggaagcacggtccgctatggatgacaccgggactaagcggccaccaaagccacgactaggcgaagaattacaagtaactaccgtaactcagaatagtgtcggactgtcctggactgtacccgagggccagttcgactcttttgttgtacagtataaggatcgtgacggacagccccaggtagttccagtggagggcagtctgcgagaggtcagcgtgcccggacttgaccctgcgcacagatacaagctcctgctctacgggctgcatcacggaaaacgggtcggaccaatttccgcagtggccattacggctggacgcgaagagaccgaaactgaaactactgcaccgacacctccagcaccagagccacatttgggtgaactgactgtcgaggaagccacgtctcacactttgcatctctcatggatggtgactgaaggggagttcgattctttcgagattcaatacacagatagggatgggcagctccagatggtccgcatcggcggagatcgcaacgatattacactatcgggtctcgaatcggaccaccgttacctcgtcacgttgtatgggttcagcgatggaaagcacgtcggacccgtccacgtcgaagccctgactgtgcccgaagaagaaaagccttctgagccccctacagccactcctgagcctccaataaagccccgactaggagaattgacagtgaccgacgcaacacctgattccctgagtctaagctggacggttcctgaaggacagttcgaccattttttggtgcaatatcggaacggcgacgggcagccgaaggcagtgcgcgtgccaggacacgaggagggcgtcaccatctccggtcttgaacctgaccacaaatataagatgaacttatacggttttcatggcggtcagcgcatgggtcccgtctcagtggtgggcgtgactgcagccgaggaagagaccccatctcctacagaaccatctatggaggctcctgaacccgcagaagagcccctgcttggagaactgaccgtgaccggatcatcaccagattccctaagcctttcgtggactgtgcctcagggacggttcgatagctttacagtgcagtataaggatagagacggcaggccacaggtggtgagagtcgggggtgaggaaagtgaagtaacagtgggcggactggagccgggacggaaatataagatgcatctctacgggctgcacgaggggaggcgggtggggcctgttagcgccgtcggagtgacagctcccgaggaggaaagtcccgatgcacccctagccaagcttcgcctcggccagatgacagtgcgcgatatcacttcggattctctgagcctgtcttggacagtacctgaaggacagtttgatcattttttagtgcaattcaagaacggggatggtcagccaaaagccgtcagagtccccggtcacgaggacggtgtgactatctctgggttggagcctgaccacaagtataagatgaacctttacggattccatggcggtcagcgggtgggccctgtaagcgcagttggcttgacagcacctggaaaagatgaggaaatggctcctgcatccaccgaacctcctacaccagaaccacccatcaaacccagactcgaggaactgacggtaacagacgcgacccccgattctctgtctctgagttggactgtgcccgaaggacagtttgaccacttcttggtacagtataagaacggagatgggcagcctaaggctaccagagtgcctggccacgaagaccgggtgacgattagtggcctagagcccgataataagtataagatgaacctgtacggcttccacggaggccaacgcgtgggtcccgtttccgccatcggcgtaaccgccgctgaggaagagaccccaagccctacagagccatctatggaagctccggagcccccagaggagccactactcggtgagttaacagtgaccgggtcttccccggattctctgtctctctcttggacagtgccacagggacggttcgattcctttaccgtgcagtacaaagaccgggatggcagaccccaggtggtgagggtaggcggagaggagtctgaagtaacagtgggcggactggaacccggtcgcaagtacaagatgcatctgtatggcctgcatgaggggagacgtgtgggccctgtgagcactgttggcgtaaccgctccgcaagaagacgttgatgaaacaccctctcctacagaacctggaactgaggcccctgagcccccagaggagcccctgttgggagaactaaccgtgaccggaagctcgcctgattccctctctctatcttggacagtccctcaggggagattcgacagtttcaccgttcagtacaaggacagggacggtcgccctcaggccgttcgtgtcggcggacaggagagcaaagtcaccgtacgcggtcttgaaccagggaggaagtataaaatgcatttgtatggcttacacgaggggaggcgcttgggcccagtctctgctgtgggagtaacagaggatgaggcagagactacacaggctgtccccaccatgacaccggagcccccaatcaagcccaggctaggcgagctcaccatgacagacgcaacaccagactcccttagcctgtcctggacagtgcccgaagggcagtttgatcactttctggtacagtatcgcaacggtgatggacagccaaaggcagttcgggtccccggacatgaggatggcgtcaccatatctggcctcgagccagatcacaagtacaaaatgaatctttacggcttccacgggggtcagcgggtgggaccaatcagcgtgattggggtgaccgctgctgaggaggaaactccaagcccgacagaattgtccactgaagcgcctgagccgcctgaggagcccctcttaggggagctgacagtaaccggttcatctcctgactctctgtcactcagttggaccattccccagggacacttcgactccttcactgtccagtataaagacagggatggacggcctcaggttatgcgagtgaggggagaggaaagcgaagtcaccgtggggggtctcgaacccggacgaaaatacaagatgcacctctacggattacatgaaggccgacgcgtgggtcccgtcagtaccgttggtgtgacagaagatgaagccgaaactacccaggcagttcctaccaccacaccagaaccgccaaataaacccagactgggggagctgaccgtgaccgacgccacaccggatagtctgagcttgtcatggatggtgccagagggacagttcgaccacttcctggtacaataccgcaacggagacggacagccaaaggttgtgagagtgccaggtcatgaggacggtgtaaccatcagtggcctggaacccgaccacaagtataagatgaacctatatggatttcatggcggacagcgcgtagggcctatcagcgtgataggggtgaccgctgcagaggaggagactcccgcaccgaccgaaccctcgacagaggcgcctgagcctccagaggaacctttgcttggggaactgacagtcacaggttctagccccgactcactgagcctgagctggactatccctcagggaaggttcgactcatttactgtgcagtataaagaccgcgacggtagaccccaggttgttcgcgtccggggagaagagtcggaagtgacagtaggaggcctagagcctggctgcaaatacaagatgcacttgtacggtctgcatgaaggccaacgggttggcccagttagtgccgtgggagtgaccgcgccaaaagatgaagccgaaaccacccaggcagtccccaccatgacgcccgagccgccaataaaaccccgacttggtgagctgacggttacagatgcgactcccgattctctctcccttagttggatggttcccgaggggcagttcgaccactttctcgttcagtatagaaacggggatggtcagcctaaggctgtgcgggtaccaggccatgaggatggggtgactatcagcggcttagagccggatcacaaatacaagatgaacctgtacggtttccacggaggacagcgcgtcggaccggtatccgcgattggcgttacagaggaggagaccccctctcccactgagcctagcaccgaggcccctgaagcacccgaggaacctctcctcggcgaactcacagtaacgggatcttcccctgactccttgtccctgagctggaccataccccagggcagatttgattcttttactgtgcagtataaagaccgagacggacagccacaagtggtcagagtgcgtggggaggaatccgaggtgactgtagggggactggagccgggaagaaagtataagatgcacctgtacggcctgcatgaagggcagcgtgtaggtccagtcagcaccgtaggtatcaccgccccactgcccaccccactgccagtggaacctcgacttggagagctcgccgtggcagcagttacctccgattccgtcggcctgtcgtggactgtggcgcaaggtccattcgactccttcctggtgcagtaccgcgacgcccagggccagccccaggcagtgcccgtgtctggggatttgcgagccgtggcggtttccggtttggaccccgctcggaaatacaaattcttgctttttgggttacagaatggcaagcgacatgggcctgtgcctgttgaggcgcgtacagctcccgacaccaaaccgtcaccgagactcggggaattaacagtgaccgatgccactccagacagcgtgggcttaagctggacggtaccagaaggtgagtttgactcattcgtagtgcagtacaaagacaaggacggtcggttgcaggtcgtgcccgtggccgcaaatcaaagagaagtcactgtgcagggcctcgaaccaagccggaaatatagatttcttctttatggactgagtggcagaaaaaggctaggcccaattagcgctgattcaaccaccgcgcctctggagaaggaattgccaccccatctgggcgagctcactgtagcagaggagacatcaagttccctccgcttaagttggaccgtcgcacaggggccttttgattccttcgttgtccagtacagagacacagacggccaacccagagccgtgcctgtggccgctgatcagaggacggtaacagtcgaggatctagagccgggtaagaagtacaagtttctgttatacggtcttcttggcggaaagaggttgggtccggtatctgcactggggatgaccgcccctgaggaagatacccccgcaccagagctcgcccctgaagccccagagccaccggaggaacctagactcggggttctcacagtaaccgacacaacacctgattcaatgcgcctatcttggtccgttgcccaaggtccttttgattctttcgtcgtacagtatgaggatactaacggccagccccaggctttgctggtggacggtgatcaatctaaaatcctgataagtggtctggaaccttccacaccttaccgcttcctgttgtacggtctgcacgagggcaagcgcctcggccctctgtccgcggagggcactacaggcctggccccagccggacagactagcgaggaatctaggccacgactgtcacagctgagtgtcactgacgtgacgacgtccagtctgagactgaattgggaagcacctcccggtgcttttgactcttttctcctacgtttcggagtgcccagtcccagtaccctggagccacacccacgacccctgcttcagcgagagctgatggttcctggcacccgccatagtgctgttttacgagatctccgctcaggaaccttatatagtctcacgctgtacggtttacgtggaccacacaaagctgactcaatacaaggaacggcaagaacgctctctcctgttctggagtcccccagagacctgcagttcagtgaaattcgagaaacgagtgcgaaggtgaattggatgcccccaccgtcacgcgcagactcctttaaggtgagctatcagttggccgacgggggtgagccccaatcagtgcaggttgacggtcaagcgaggacacagaagctccagggtttaataccgggtgcgcgttatgaggtaacggtggtgtctgtgcgtggctttgaggaaagtgaacccctgacaggatttctgactaccgtgccagatggcccaacccaactacgtgccctgaatctcaccgaggggtttgccgtacttcattggaagcctccccagaatccagtcgacacgtacgacattcaagtcactgccccaggagctccgcctctccaagctgagacccccggttccgccgtagactatcccttgcacgatttggtgttgcataccaattacacggccaccgtacgcggactgcggggaccaaacctgactagtcctgcatcgattacatttacaacaggcttggaggcaccacgtgatctggaagctaaggaagtaacgcctcgtacagccttgctaacttggacagagcccccagtccgcccagcgggatacctcctctccttccacactccaggaggccagacgcaggagatcctgctcccagggggaatcactagtcatcagctcctcggcctttttccgagtacttcctacaacgctaggctccaggctacgtggggccagtcactgcttccacctgtgtctacatcctttaccaccggtgggctcaggatcccttttcccagagactgcggggaagagatgcagaatggcgctggcgcttcccggacatccaccatcttcctgaacggaaaccgggaacgaccccttaacgtgttctgtgacatggaaactgatggcggaggatggcttgtcttccagcggagaatggacggtcagactgatttctggcgggattgggaggactatgcacacggtttcggcaatatcagcggcgaattttggctgggcaatgaggctcttcactcactgacccaggctggcgactattccatgagagtggatttgcgcgctggggacgaagcagtctttgctcagtacgacagttttcacgtggattcagccgcagaatactaccgactccacctagagggataccacggcactgcgggagacagcatgtcatatcattctggtagcgtcttctctgccagggatcgcgatccaaacagcctccttatttcctgtgccgtcagttatcgaggtgcatggtggtaccgaaactgtcactatgccaacctcaacgggttatacgggtctacagtggaccaccaaggcgtgtcgtggtatcactggaagggcttcgaattttccgtgccgttcaccgagatgaaactgaggccccgaaatttccgttctcccgcagggggtgggtat

SEQ ID NO: 243734 - DNA, 2022 bp, Artificial Sequence
  Description of Artificial Sequence: Synthetic coding sequence
atgcgcttatcttggagtgtggcgcagggcccattcgactcctttgtggttcagtacgaagacacgaacgggcagccacaggctctgctggtagatggcgaccagtcaaagatcctgataagcggcctagaaccaagcactccttaccgtttcttactatatggcctccacgagggcaagcggttgggaccactttcagctgaagggaccacaggcctggcccctgctggccaaactagtgaggaatctcgaccacgactttctcagctgtccgtcaccgatgtgacaacttcctctctgaggctcaactgggaggctccacccggtgcttttgactccttcttgttgcgattcggcgtgcccagcccttcgacattagaacctcatcccagaccactcctgcagcgagaactgatggtccccggtacaagacactctgcagtgttgcgtgatctgagaagtgggactctctactccctgacattgtacgggttacgcggacctcataaagccgacagcatccaaggcactgctcgaaccctgagtcccgtgctggaatccccacgggacctgcaatttagtgagattagggaaaccagtgcaaaagtgaactggatgcctcctccatccagggcagactcctttaaagtctcttatcaactcgcagacggcggtgaacctcagagcgttcaggtcgacggtcaagcaaggacacaaaagctacagggccttattccgggagccaggtatgaagtcacagttgtcagtgtgaggggttttgaggagagcgaaccgctaactggattcctcactactgtacccgatgggcctacacagttaagggcattgaacctaacagaaggattcgctgtattgcactggaagcctccccagaaccccgtcgatacgtacgacgtgcaggtgacagcaccaggcgctccgccacttcaagctgagacacctgggtcagctgtggactatcccttgcatgatctggttctccacaccaattatacagccaccgttagaggactgcggggacccaacctcacctctccggcaagcattacattcaccaccggcctggaagctcctagggatcttgaagccaaggaagtcaccccccgaactgcactgcttacatggaccgagcccccagtccgaccggctggttacctgctcagcttccatacacctggaggccaaaatcaggagatcctgttaccgggtggtatcacgtcccaccaactcctgggcctgttcccttccaccagttacaacgcgaggttgcaagctatgtggggtcagtccttgttaccacctgtttccacctcttttactaccggtggcctgagaatcccatttcccagggactgtggcgaagaaatgcaaaacggtgcaggtgcttcccggacaagcaccatatttcttaacggcaacagagagcgtccactcaacgtcttttgtgacatggaaaccgacggcggtggatggcttgtgttccagcggaggatggacggccaaactgatttctggagagactgggaggattatgcgcatggctttggcaatatttctggggagttctggttgggcaacgaagccttgcacagcctaacccaggcaggggattactccatgagggtggatctccgggcaggcgatgaggctgtgttcgctcagtacgactcttttcacgttgactcagccgcagagtattacagactgcacctggaaggctaccacggaactgcgggtgattcaatgagctatcacagcggatccgtgttctccgccagggacagagacccaaactcactgcttatttcctgtgccgtctcttaccgcggtgcctggtggtaccgcaactgccactacgcgaacttgaacggtctatacggatctacagtggaccaccagggcgtgtcgtggtaccattggaagggcttcgagttctctgtgcctttcacagagatgaaattgcgtcctcgcaatttcagatcccccgctggcggtggatag

SEQ ID NO: 243735 - DNA, 654 bp, Artificial Sequence
  Description of Artificial Sequence: Synthetic coding sequence
gcaccgggaaaggacgaagagatggctcctgccagtaccgagccaccaacacccgaaccacctataaagcccaggctggaagagctgacagtgacagatgctacccccgacagtctgagcctgtcatggacagttcccgagggtcagttcgaccactttctggtccagtataagaacggggacggtcaacccaaggccacccgggtgccagggcacgaggaccgcgtgactatttctggcctggaacccgacaacaagtataagatgaacctgtacggctttcacggcggacagcgtgtcggccctgtctcagcgatcggcgtgacagccgctgaagaagaaacaccttcacctaccgagcccagcatggaggccccagaacccccagaggagcctctcctcggggagctgacagtcaccggctcaagcccagactcactctccttatcctggacggtcccacagggacggttcgattccttcactgttcagtacaaggaccgagacggcagacctcaagtagtgcgcgtcgggggagaagagtccgaggtcactgtcggcggattggagcccggtcgtaagtacaaaatgcacttgtacggcctccacgaagggcgtcgcgtcggacccgtatctacagtgggagttacatag

SEQ ID NO: 243736 - DNA, 942 bp, Artificial Sequence
  Description of Artificial Sequence: Synthetic coding sequence
accgaaccaggcacagaagcccctggcccaccggaagaacccctgctcggggaactcacagtgacagggtcctcacctgattcactgtcgctgagctggactgtacctcaaggaagattcgactctttcactgtgcagtacaaggaccgagacggaaggcctcaagctgttagagttggcggtcaggaatcaaaggtgactgtgagaggtctcgaacccggaagaaagtacaaaatgcatctatacgggttgcatgagggtcgaaggttagggcctgtctcagccgtcggcgttactgaggatgaggctgagacaacacaggctgtgcctacaatgacaccagaaccgccaatcaagcccagacttggagagctcaccatgactgacgcaacaccggacagcctgtctctaagttggacagtcccggaggggcagtttgatcacttccttgtccagtatcgcaatggcgatggacagccgaaggccgtaagggtgcctgggcacgaggatggagtgaccataagtggtctggagccagaccacaaatataaaatgaatctttatggttttcacgggggacaacgggttgggccaatatcagtaatcggtgtcaccgccgctgaggaggagaccccttcgcccacggagttatccaccgaggccccagaacctcccgaagaacccctgttgggcgaactgaccgtgacaggcagttcccccgactctctcagtctcagctggaccattcctcaggggcactttgacagttttacagtgcagtacaaggatcgggatggtcggcctcaggtcatgagggtgaggggagaggaatccgaagtgaccgtgggtgggttggaacctggtcgcaagtacaagatgcatctgtatggtctccatgaaggcaggagagtgggccctgtgtctaccgtaggggtcacttag

SEQ ID NO: 243737 - DNA, 942 bp, Artificial Sequence
  Description of Artificial Sequence: Synthetic coding sequence
atgaccccagaacccccaataaagcctcgtttgggcgaactgactatgacggacgctacaccggattcactctcactgtcttggactgtacctgaggggcagtttgaccactttttagttcaataccggaatggcgatggacagcctaaggcggtacgggtaccaggtcatgaggatggcgttactatctccgggctggagcctgaccacaagtacaagatgaatttgtacgggttccacggaggtcaaagagtgggtcccatatcggtgaccggggtcacagccgctgaagaggagacgccttccccgactgagctgtctacggaagctcctgaaccgccagaggaacctctgctgggtgagctgacagttaccgggagcagccctgacagcttgagcttgagttggacaattccccagggtcactttgactcctttaccgtgcaatataaggatcgagacggtagaccccaagttatgagagtaagaggtgaggaatccgaagtgacagtaggcggactcgagccaggtcgcaaatataaaatgcatttgtacggtttacatgagggtaggagagtgggacctgtttccaccgtgggcgtgaccgcccctgaggatgaagaggaggagaccccggctcctaccgagccttccaccgaagccccagaacccccagaggaacctttactgggcgagctcacggtgacaggcagctctcctgactctttaagtctttcatggaccataccccagggaaggtttgacagctttaccgtccagtacaaggatagagatggacgcccacaggtcgtacgggtaaggggcgaagaatccgaggttaccgtggggggattggaacctgggtgtaagtacaagatgcatctctatgggcttcacgagggccaacgagtgggacccgtctctgccgtgggtgtcacttag

SEQ ID NO: 243738 - DNA, 1281 bp, Artificial Sequence
  Description of Artificial Sequence: Synthetic coding sequence
gcaggtgaggactgcggggaggaggtccccacaattgagggcatgaggatgcatctgctggaggagactacagtccggactgagtggactcctgccccaggtcctgtagacgcgtatgagatccagttcatacccaccaccgagggggcttctccacccttcaccgccagagttccgagctcagcttcagcatacgaccagcggggtttagccccagggcaagagtaccaggttacagtgcgcgcattgcgcggaaccagctggggtctgcccgcttctaagactatcactactatgatcgacggaccgcaagacttgagagttgtggctgtcacccccactacattggaattaggatggctgcgcccacaggccgaagtggatagattcgtggtgtcatacgtgtccgctggaaatcagagggtccggttagaggtccctcccgaggccgatgggacgttgctaacagatctcatgcccggagtagagtacgtggtgactgtgactgccgagagaggacgggctgtgtcatacccagcttcagtacgcgctaatactggtagctctccactgggccttctggggacgacggacgagcccccaccttcgggcccatctactacccaaggggcacaggctccgcttcttcagcagaggccccaggagctcggagaactgcgcgtgctgggcagggacgagaccggcagactgagagtggtctggacagctcagcccgacacatttgcctactttcaactgcggatgcgcgtgcctgagggcccaggtgcccatgaggaggttctgcccggtgatgtcagacaagcattggtcccccctccaccaccaggaaccccatatgagctctcactccacggagtgcctcccggaggcaagcctagtgatccaatcatttaccagggaattatggacaaagatgaagagaaaccaggaaagtctagcggcccaccacgcctgggagaactgacagtgaccgaccgcacgtcagactccctgctccttcgctggacagtgccagagggggaattcgattcatttgtaatacagtacaaagaccgcgacgggcagccccaggtggtccctgtggaagggccacagcgatcagcagtcataacatctctggatccagggcgtaaatataagtttgttctgtacggtttcgtgggtaagaagaggcatggaccactggtcgctgaagccaaaattttgcctcagagtgacccatcccccggaacccctccacatctcggaaatctatggtag

SEQ ID NO: 243739 - DNA, 2598 bp, Artificial Sequence
  Description of Artificial Sequence: Synthetic coding sequence
ctgtatgggctgcggggtagacagagggtggggccagagtctgttgtggcgaagaccgctccccaagaagatgttgatgagactccttcccctaccgagctcgggactgaggcgcctgagtcccccgaggaacccctcctgggagagctcaccgtgactggatcttcccctgatagcctttccctgttttggacagtgccccagggatcattcgactcattcactgtgcaatataaagaccgcgacgggcgtcccagggcagttcgggtgggcggaaaggagagtgaggttacagtgggcggtttggaaccagggcataagtacaaaatgcacctatacggccttcacgaggggcagcgagtgggacctgtcagcgctgtcggtgtgaccgcaccccagcaagaggaaaccccgcctgccacagagagcccgctcgagccacgtttgggcgaattaacagtgacagatgtaacaccaaatagtgtgggcctttcttggacagtgccggaggggcagtttgacagttttatagtgcaatataaggataaagacggacagcctcaagtcgtacctgtggctgctgaccagcgtgaggttactgtctacaacctggagccagaacggaaatataagatgaacatgtatggcctacacgatggtcagcgtatgggtccactttcagttgttattgttacagcgccactgccccctgcccctgccacagaggctagcaagccccctctggagccaaggttgggggaactgaccgtgaccgatatcacgccagattccgtggggttgagttggacagtgcctgagggcgaatttgactccttcgtcgtccaatacaaggacagggatggtcaacctcaggtggtgcccgtcgcggcagaccaacgcgaagtgacaatccccgacctcgaaccgagtcgtaagtataaattccttctgttcggtatccaggatgggaagaggcgctcccccgtaagcgtggaagctaagactgtggccagaggagacgcctctcctggtgctcctcccaggttgggagagctgtgggtgacagatccaaccccggacagcttacggctgtcttggactgtgcccgaaggtcagttcgattccttcgtcgttcagttcaaagataaggatggtccacaagtggtgccagtggaaggacacgagcgaagcgtaaccgttaccccactggatgctggcaggaaataccgattcttactgtacggtctccttgggaagaaaagacacggacccctgaccgcggatggtacgacagaggctagatccgcgatggatgacaccggaacaaaaagaccaccgaagcctaggcttggtgaggaactgcaggtgaccacagtaacgcagaattccgtcgggctcagctggactgttcccgagggacaatttgatagcttcgtcgtccagtataaggatcgggacggtcaaccccaggtagtgcccgttgagggctctctccgggaagtctccgtccctggtctggatccggcacatcggtacaagctattgctctacgggctacaccatggcaagagggtcgggcctatcagcgcggtggctatcacagccggacgggaagagaccgaaaccgagaccacagcccctaccccacccgctcctgagccccatcttggggaactcactgtagaagaggccacctcacacacacttcacctgtcctggatggtgactgagggggagtttgattcatttgaaatccaatacacagatcgagatgggcaactacagatggttagaataggcggagacagaaacgatatcaccctgagcggactggaaagcgatcatcggtacctggttacattatatggtttctccgacggcaagcacgtggggcctgtgcatgtcgaggccctcacagtgcctgaggaagaaaagccctccgaaccgcctactgcaacccccgagcccccaatcaaacccagactgggcgaactgacagttaccgatgccacgcctgacagcctgtcactctcatggacagttcctgaaggtcagtttgaccatttcctcgtgcagtaccgaaatggtgacggccaacccaaggctgtcagggtgcccggtcatgaagagggcgtaactatcagtggcttggaacctgaccacaagtataaaatgaacctgtacgggttccacgggggtcagcgcatggggccagtatcagtggttggggtcacagcagctgaagaggaaactccatcccctacagaaccctccatggaagcacctgaacctgccgaagaacctctgctgggggaactcacagtgacaggaagctccccggatagcctgagcctatcctggaccgtgccacagggaagatttgacagtttcactgtacagtacaaggatagagatggaaggccacaagtggtcagagttgggggagaggagtctgaggtaacggttggagggctcgaacctgggagaaaatataaaatgcacttgtacggactgcacgaaggcaggcgcgtcggccctgtaagtgccgttggcgtgacagctccagaggaggaatcccccgatgcccctttggcatag

SEQ ID NO: 243740 - DNA, 5208 bp, Artificial Sequence
  Description of Artificial Sequence: Synthetic coding sequence
atgtctgtgtcccgaactatggaggacagctgcgagctagatttggtctatgtgacggaacgaataatcgctgtaagttttcccagtactgccaatgaagaaaacttccgttctaacctgcgcgaggtcgcacagatgttgaagtccaagcacggcggaaactacctgcttttcaacttgtccgaaagaagacctgatatcaccaagctgcatgccaaagtgctggaattcggatggcccgatcttcacacaccagcactggaaaaaatctgctccatctgtaaagctatggacacctggttaaacgccgacccccacaatgtggtagtattacacaataagggcaatagaggtcgcattggtgtagtaattgccgcatatatgcattacagtaacatttccgcatccgccgaccaggccttagacaggtttgccatgaagaggttctacgaggataaaatcgtgcctatcggtcaaccgtctcagcgtcggtatgttcattacttttcgggactcctttccggttctatcaaaatgaataataagccccttttcttacatcatgtcatcatgcacggcataccaaacttcgagtccaagggcggttgcaggccattcctgcgtatataccaggccatgcagcctgtctatacctcaggcatctataatatccctggggattcccagactagtgtgtgtatcacaattgaacccggactgttactgaagggggatatactgcttaagtgctaccacaagaaattcagatcacccgcacgtgatgtaatcttccgagtgcagttccacacctgcgccatccatgacctcggcgtcgtttttgggaaggaggatctcgatgatgcttttaaagacgataggttccctgagtatgggaaagtcgagttcgttttctcctacggacccgaaaaaatccagggcatggagcaccttgaaaatgggccaagcgtgtccgtggattacaataccagcgacccactcatcaggtgggacagctatgataatttttcaggacatagggatgatgggatggaggaggtcgtgggccacacgcagggaccacttgacggatccttatatgcaaaagtcaagaaaaaagattctcttcacgggtctactggagccgtaaatgcgacaagacccaccctctcagccaccccaaaccacgtggaacatactctttctgttagctcagactccggcaactccactgcaagtacgaagactgataaaacagacgagccagttcccggtgcgagcagcgcgacagctgctctctcacctcaggaaaaacgggagttggatagactcctgtccggtttcggcctggagcgggaaaagcagggcgcaatgtaccatacgcagcacctgcgtagtcgtcctgctggaggtagtgccgtgccctcaagcggcagacacgtggttccagctcaggtccatgtcaatgggggagcactggcttcagagagggaaaccgacattcttgacgatgagctacctaatcaagatggacactccgccggaagtatgggcacgctgtcttccctcgacggcgtgactaatactagcgagggaggctatccagaggctctgtcccctttaacaaatgggctggataagagctatcctatggagcccatggtgaacggcggaggctatccctatgaaagcgcatcgcgagccggtccagcccatgctggtcacacagctcctatgaggccttcttatagtgcccaagaaggattagccggatatcaacgggaaggccctcatcccgcatggcctcagcctgtgacaacctcacactacgctcatgacccctcaggcatgttcaggagccagtcttttagcgaggccgagccacaactgcctccggctccagtacgcggtggcagctctcgggaggccgtccaacgaggactcaatagctggcagcagcagcagcaacagcaacaacagcctcgccctccaccacgccaacaggagagggcacacctcgagagtctggtcgcatctcgcccatctccccagcctctcgccgagacccctatcccgagcctgcccgaatttccacgtgcggcatctcagcaggaaatcgagcaatccattgagactctgaatatgctgatgctcgatctggagccggctagcgcggctgctcccttgcataagagtcagagcgtgcccggtgcatggcctggcgcttcccccctatccagccagcccctgagtggctcttcaaggcagtcccatccacttacgcagagcaggtccgggtacattccatctggccatagcctcggcacgcccgagccagccccaagggccagtctggaaagcgtcccacccggaagatcttactccccctacgattaccagccttgcctggccggacccaaccaggatttccatagtaagtcgcccgcaagctcttctcttccagcctttctgcccaccacccattcaccaccagggcctcagcaacctcccgcatcccttcctggactcactgcccaaccgctactgtcacccaaagaggccacgtctgatccctctagaacacccgaggaggagccgctgaatctggagggactagttgctcatcgagttgcaggcgtgcaggcccgagagaaacagccggcagaaccgccagcccctctccgacggagggccgcatccgacggccagtacgagaatcagtcgccagaggcgacttcccccaggagcccgggagtgagatctcctgttcaatgcgtgtcacccgagttggcacttacaatcgccttgaaccctggaggcaggcctaaagaaccacacttgcactcgtataaagaagcgtttgaagagatggaggggacatccccctccagcccccctccgtccggcgtcagatcacctcctggactcgctaaaacacccctgagcgctcttggactcaaaccgcacaacccagccgacatcctgttacaccccaccggggtgactcgccgaaggatccagccagaggaagacgaggggaaagtagtggtgcggctgtctgaggagcctagatcttacgttgagagcgtggctcggaccgcagttgccggtcccagagcgcaggacagcgaacctaagagttttagtgccccagcaacccaagcctacgggcatgagatccccctgcggaacggtactttaggcggttcttttgtgtccccttcaccactttcaactagctcgcctattctgagtgctgattctacttcagtgggaagctttccctctggggagtcctcagaccaggggccacgcactcccactcaaccgctgctggagagcggcttccgcagtggcagtctcggccagccatcacctagtgcccagaggaattaccagtctagcagcccactaccaacagtgggaagctcctatagtagccctgactattccctacaacacttcagtagtagccctgaatcacaagcacgggctcagttttcagttgccggtgtgcatactgtgcccggttcccctcaggcaagacataggacagtgggtacaaatacccctcctagtccaggcttcgggtggagagctataaatccatccatggctgctcctagcagtcctagtctatcccaccaccaaatgatgggtcctcctggaactggcttccatggatctacagtgtcctctccacaaagtagcgcagctaccacacctgggtccccctccttatgcagacaccctgccggtgtttaccaagtgtctggactgcataataaggtggccactactcctggctcgccttctctggggagacaccccggagcgcatcagggcaatctcgcgagtgggctccattctaatgccattgcatcaccgggatcgcccagcctcggtcggcacctggggggatcaggaagtgtggttccaggctcaccctgcctggatcgccacgtcgcctacgggggttattcaacgcccgaggatagaaggccgaccctctcacggcagtcctccgcaagcggctatcaagccccttcaactccctcgtttccggtgagccctgcctactatcccggattgagctctccagctacctccccctctcctgatagcgccgcatttcgacagggtagcccgacgccagcccttccagagaagcggcgaatgtctgtgggcgatcgggcaggaagcctcccaaactatgccacgattaacgggaaggtcagctcacctgtcgcgagcgggatgagctccccctctgggggatctaccgtctcctttagccacacactacctgatttttctaaatactccatgccagacaatagccccgaaacccgcgctaaggtgaagtttgtccaggacacaagcaagtattggtacaaacccgagatctctcgagaacaggcaatcgccctcctgaaggatcaggagcccggagccttcatcatcagggatagccatagcttcaggggggcttatggactcgcaatgaaggtctcctctccccctcctacaatcatgcagcagaacaagaagggcgacatgactcacgaattggtgagacactttcttatcgaaaccgggcctcggggagtgaagctcaaaggatgccccaacgaaccaaacttcggatctctgagtgcactagtctaccagcattcaattatcccactggcgcttccatgcaagctggtgatccccaacagagatcccacagatgaatcgaaagatagttccggaccagctaacagcaccgccgacctgttaaaacaaggtgcagcttgtaacgtactcttcgttaacagtgttgatatggagagcctcacggggcctcaggctatttccaaagccacctccgagaccttggccgcagatccaacccctgcagccaccatcgtgcattttaaagtcagcgctcagggaatcactctaactgacaaccagagaaagctgtttttccgcagacactaccctctgaatactgtaactttctgcgacttagacccccaggagcgtaagtggatgaagaccgagggcggtgcccctgccaagctgtttggcttcgtggcacggaaacaaggatcaaccacggataatgcatgccacctgtttgccgaactcgacccaaaccagccagcatccgccatcgtcaattttgtgtccaaggtaatgctgaatgcaggccagaaaagatac

SEQ ID NO: 243741 - DNA, 1251 bp, Artificial Sequence
  Description of Artificial Sequence: Synthetic coding sequence
atggtgccctttcaacagcgcaaggattgtgtgttagagggttctactagagtgactccttctgtacagcctcatttacaacccatcaggaatatgtcggtgtcgagaacgatggaagacagttgtgagctagatttagtttacgtcaccgaacgcattatcgctgtcagcttcccatcgactgccaatgaagaaaacttcagatccaatttgagagaagttgcacaaatgcttaaatcaaaacacggtgggaactatcttctattcaatcttagtgagcggagacccgacattaccaagctgcacgctaaagttttggagttcgggtggccagatctgcatacaccagccctcgaaaaaatttgtagcatatgcaaggctatggatacttggttgaatgcagatccacataatgtggtcgtgcttcataataagggcaatagggggagaattggagtggttatcgccgcatatatgcattacagcaacatatccgcatcagccgaccaagccctggacagattcgccatgaagagattctacgaggataagatagtacccatcggccagccaagtcagcgtcgctatgtccactacttcagcgggctcttatctgggagcattaaaatgaataataaacccctcttccttcaccatgtaatcatgcacggaattcccaacttcgaaagcaaggggggttgccgccctttcctgaggatttaccaggccatgcagcctgtgtacacctctgggatatataatattcccggtgattctcagacctcagtgtgtataacaatcgaacccggactgctgctaaagggggatattttactgaaatgctatcataaaaaattccgctctcccgcacgggatgtgatcttccgagtgcagttccatacctgtgccatccacgacttgggtgttgtttttggtaaggaagatcttgatgacgctttcaaagacgaccgttttcctgaatacgggaaagttgagttcgtcttctcttacggccctgagaagatccagggcatggagcatcttgaaaacggccctagcgtgtcagttgactacaatacatcagacccactgattcgatgggatagttacgataatttcagtggccacagggacgacgggatggaggacggtaacaagcaaaacactaatagtcagagtatcgggtctatctccggaggtttagaagaccagtatacttggccagatacacattggccttctcaatcctag

SEQ ID NO: 243742 - DNA, 312 bp, Artificial Sequence
  Description of Artificial Sequence: Synthetic coding sequence
atgtccgtgagccggaccatggaggattcctgtgagctggaccttgtgtatgtgacagaaagaattattgccgtgtcgtttccttccacagccaacgaggagaactttagaagcaacctgcgggaggtggcccagatgttgaaatctaaacacggcggtaactatcttctcttcaacttgagtgaacgccgacccgacattacaaagttacatgccaaggtgcttgagttcggatggcccgatttacacaccccagccctggagaaaatctgtagtatctgcaaggcaatggacacctggctgaacgcctag

SEQ ID NO: 243743 - DNA, 5144 bp, Artificial Sequence
  Description of Artificial Sequence: Synthetic coding sequence
atgagcgtgagcagaacaatggaggacagctgcgaactggatcttgtttatgttaccgagcgtattattgcggtgagttttccatccactgcaaacgaagagaacttcagaagcaacttgcgagaagtggcacaaatgcttaagtccaaacacggcggtaactacctactgtttaatttgtctgaacgacggccagacattacaaagctgcacgccaaggttttagaatttggttggcctgaccttcacacccctgctcttgagaagatttgcagtatttgtaaagccatggatacctggctaaacgctgatccacataatgtggtggttctgcataacaaagggaatagaggccgaatcggggttgttatcgctgcttatatgcattacagcaacatctccgctagtgcagaccaagccctagatagatttgccatgaaacgtttttacgaggacaaaatcgttcctatcggccagccttcccaaaggcggtatgttcactacttcagcggactactgtccggcagcatcaagatgaataataagccacttttcctccaccacgtgattatgcacggtattcccaactttgagtcaaaaggaggatgtagaccattcctgcgcatctatcaggcaatgcagcctgtgtacacttctgggatttacaatatacccggtgatagccagactagtgtgtgtatcacaatcgaaccaggactgctactgaaaggagacatcctgctgaagtgttaccacaagaaattcaggtcacccgcacgcgacgtgatcttcagagtgcaattccacacctgtgccatccacgatctgggggtggtgttcggtaaagaagatttagacgacgccttcaaggatgacaggtttccagagtacggaaaagtggagtttgtcttttcctacggccctgaaaagatccaggggatggagcatctggagaacgggccaagcgtctccgtggactacaatacttccgatccactgattaggtgggattcctacgacaacttctccggacatagagatgacggtatggaagaggtggttggccacactcaggggcctttggacggctccctttacgctaaggtaaagaaaaaggacagcttgcacggcagcaccggggctgtaaacgctacacggcctaccctaagcgctaccccaaatcatgttgaacacacattgtcagttagtagtgacagcggcaattcaaccgcctccaccaagacagataaaactgatgaacccgtcccaggagcctcttccgcaaccgctgcattgtcaccgcaagaaaaaagggagctggacagattgttgagcggatttggcctcgagcgggaaaagcagggtgctatgtaccacactcagcacttgcgaagtcgcccagctggtgggagcgcagtcccatccagcggccgtcacgtagtgccggcacaggtccatgtcaatggcggagccctggccagtgagcgggaaacagacattctcgatgatgaattacctaatcaggacgggcactctgccggatctatgggcactctctccagcttggatggagtaaccaacacaagcgaagggggttaccctgaagcattatcgcctctgactaatggcctggacaaatcataccccatggaaccaatggtgaacggaggaggctacccttatgagtccgcatcccgcgcaggcccagcccatgctggacacacggcccctatgaggccatcctactcggcccaggaggggttggccggttaccagagggagggccctcatcccgcttggcctcaacctgtaactacttcacactatgcccatgaccccagcggcatgtttagatcccaatccttcagtgaagcagagccccaattgccccctgccccagttcggggaggcagctctagagaggccgtccagcgtgggttaaattcatggcagcagcagcagcagcaacaacagcaacccagacccccaccgaggcaacaggaaagggcccatttggagtctctggtggcatctagacctagtcctcagcccctcgcagaaaccccaatcccgtctctcccagagttcccaagagctgcatcccaacaggagatcgaacaatccattgagaccctaaatatgctaatgctcgatctcgagcctgcttctgcagctgccccacttcacaagagccaaagcgtccctggggcatggcctggcgcttctcctctttcttcgcaaccactttcagggtcctcacggcagtcacatcccctcacacagagccggtctggctacattccctccggccattctctgggaacacccgagcccgctccgagagcgagcctcgagtccgtgccgccagggaggagctacagcccatacgattatcagccatgtctcgcagggccaaatcaagatttccattcgaagtctccggcatcatcatcccttccagccttcctgccaactacccacagccctcccggaccccagcagcctcccgctagcctcccaggtctcaccgctcagccgttgctctccccaaaagaggcaacctctgaccccagtagaacacccgaggaggagccactgaacctcgagggactggtagctcaccgagtggccggtgtgcaagcacgcgaaaaacaaccagccgaacccccagcaccactgaggaggcgcgctgcaagtgacggccaatatgaaaatcagagtcccgaagccacctcccccagaagccctggggtgagaagtcctgtgcagtgcgttagccccgagctggccctgacaattgctcttaaccccggaggaaggcctaaagagcctcacctgcacagttataaagaggctttcgaggagatggagggcacgtcaccgagtagcccccctccttctggagttagatctccgcctggcctggctaagacacctctatctgccctcggattgaagccgcataacccagctgacatactcttgcatccgactggggagccgaggtcatatgtagaatcagtggctagaactgcagttgcgggtcctcgtgctcaggacagcgaaccaaaatccttctccgcgcctgccactcaagcctacggccacgagatccccctccgaaacgggacgctggggggatcttttgtctcaccatctcctctctctacttcatctccaatcttgtccgccgatagcaccagcgttgggagctttccaagcggggagtcctcggaccagggcccacgcaccccgacacaacccttactggagtcaggctttagatcaggttctctcgggcagccctccccttccgcacagcgaaactaccagagttcatccccactgcccactgtaggatcgtcctacagctcaccggattacagtcttcagcacttctccagcagcccggaatcacaggccagagcgcagtttagtgtggccggtgtgcacacggtccccggatcccctcaggctcggcaccgaaccgttggcacaaacaccccccctagcccgggatttggctggcgtgccattaatccaagcatggctgcaccgtctagcccttcattatcccatcaccagatgatggggccacccggtaccggctttcatggcagtaccgtttcctccccacagtcctcagccgctacgactcctggttccccctcactatgccgccacccggcaggcgtatatcaggttagcggcctccataacaaagttgctaccaccccaggatccccctcactcggacggcatcctggtgcccatcaggggaatctggcctctggactacactcaaatgccattgcatcaccaggatccccgtctctgggtaggcatctgggcggatctggctctgtcgtcccgggaagtccttgcctggaccggcacgtagcatacggtggctactctacacctgaagaccggaggccaaccctgtcgaggcagtcttcagccagtggctaccaagcccctagtacgcctagcttcccagtcagtccggcatactatcccggacttagtagtccagccacctcgcccagcccagatagcgctgcattccgccagggctctccaacccccgctctccccgaaaagaggcggatgtccgtgggtgatagggcgggaagcttgccaaactacgcgacaatcaacgggaaagtcagttcccctgtggcgagcggtatgagcagcccctcgggcggaagtacagtctctttctcccacaccctccccgacttttctaagtattcaatgccagacaattctcctgaaactcgtgcaaaagtaaagtttgtgcaggacacgagtaagtattggtacaaacctgagatcagtcgggagcaggctattgctctgctcaaggaccaggagccaggtgccttcattattagagattcacacagtttcagaggcgcttacggcctggcaatgaaggtgtctagtcctccacccaccattatgcagcaaaataaaaagggcgatatgacgcatgagcttgtgagacacttcctgattgaaacgggacctaggggcgtgaagctcaagggatgccctaatgaacctaactttggtagtttgtctgccttagtctaccaacattccattatccctctggcactcccttgtaaactcgtgattcctaatcgagatcctactgacgaatctaaggattcttccggacccgctaatagtacagcagatctgctcaaacagggggcagcctgcaacgttctgttcgtaaacagtgtcgacatggagtctctgactgggccacaagccatctccaaggcaacgagtgagacgctggcagctgatcccacacctgccgctacaattgttcatttcaaagtttccgcccagggtattactcttactgacaatcagcggaagctgtttttcagaagacactaccctctgaacacagtcaccttctgcgacctcgaccctcaggagcggaaatggatgaaaactgagggaggggcacccgcaaagctgttcggatttgtggccaggaagcaggggtcaaccaccgataacgcctgccacttgttcgcggaactcgaccccaaccaacccgcaagcgcaatcgttaatttcgttagcaaggttatgctgaacgcgggtcagaaacggta

SEQ ID NO: 243744 - DNA, 186 bp, Artificial Sequence
  Description of Artificial Sequence: Synthetic coding sequence
atgtctgtctccagaaccatggaagacagctgcgagcttgacctcgtttatgtgaccgagcggattattgctgtgtcgtttccttccaccgcgaacgaggagaattttcgaagtaacctgcgcgaggtggctcagatgctgaagtctaaacacggcggaaattacctcttattcaatctgagttag

SEQ ID NO: 243745 - DNA, 75 bp, Artificial Sequence
  Description of Artificial Sequence: Synthetic coding sequence
atgtcagtgtcccggacgatggaagactcgtgtgaattggatctcgtatacgttaccgagagaattatcgcttag

SEQ ID NO: 243746 - DNA, 4338 bp, Artificial Sequence
  Description of Artificial Sequence: Synthetic coding sequence
atggaagaggggcacgggctagatttaacctacatcacggagagaataattgcagtgtcatttccagctgggtgtagcgaggagtcatatctccataatctccaggaggttacgagaatgctcaaatccaaacatggcgataattatctggttctcaaccttagtgagaagcggtatgacctcactaaactaaatcctaaaatcatggacgtaggctggccggagcttcatgccccaccgctcgacaaaatgtgcaccatctgcaaagcccaggaatcctggctcaactctaacctgcagcacgtggtggttatccactgtaggggcggaaagggccgaatcggcgtggtcattagctcatacatgcactttactaacgtatcagcatccgctgatcaggcactggatcgctttgctatgaagaagttctacgatgataaagtgtcagcccttatgcaacctagccagaagcgctatgtacaatttttgtctgggcttctgtcaggttcggtgaagatgaatgcctcaccactgtttctgcacttcgtcatcctgcatgggactcccaattttgataccgggggtgtgtgtcgccctttcctaaaactgtaccaggccatgcagcctgtgtatacctctggaatctataatgtgggccctgagaatccttctaggatctgtatcgtcatcgaacccgctcagctgctgaaaggcgacgtgatggttaagtgttaccataaaaaatataggagcgccacccgggatgttatcttcaggctgcaatttcacaccggggcagtccagggctatgggttggtgtttggcaaggaagacttggacaatgcttctaaagatgaccgatttccggattacgggaaagtagagctcgtattttctgctaccccagaaaaaatacagggaagtgaacacctctacaacgaccatggcgtgatcgtggattacaacaccaccgaccccctgataagatgggacagttacgaaaacttgtccgctgacggcgaggtgcttcacacccaaggacccgtggatgggagtctgtacgcgaaagtgcgtaaaaaatcatccagcgaccctggcatccctggcggaccacaggcaattcctgcaaccaattccccagaccacagcgaccacacactctccgtgtcgagcgactctggtcattctacagcttctgctcgaactgacaaaactgaggagagactagccccaggcactcgacgcggtctctcagcccaggaaaaggctgagctcgaccagctgttaagcggcttcggattggaagatccagggtctagccttaaggagatgaccgacgcgagatccaagtactctggaactcgccatgttgtccccgctcaagtgcacgtgaacggcgatgctgccctgaaggaccgcgagactgacatcctcgacgatgaaatgccgcatcacgacctgcacagtgtagactccctgggaaccttaagttcctctgagggtccgcagtctgctcatctcggtccctttacctgccacaaatcctcccagaatagtctgctgtctgacggctttggttccaatgtaggcgaagacccacagggcactctcgtccccgacctcggtttaggaatggatggcccttacgaacgcgagcgcacgttcggttccagagagcccaaacagcctcagccactgctgaggaaaccttctgtatccgcccagatgcaggcttacggacaatcatcatacagtacccagacttgggtgcgacagcaacaaatggtcgttgcccaccagtattctttcgcccctgatggcgaggctcgcctggtgagtcgctgtcctgctgacaacccgggactagtccaggcccagcccagagtacccctgacccccacccgcggtacctcttctcgggtcgcagtgcagagaggggtcggtagtgggcctcatccccctgatacccagcagccatcgccatccaaagcattcaaaccccgttttcctggcgatcaggtggtgaatggagccggacccgagctctctacagggcctagccccggatcacccacactagatatcgaccagtctatcgagcagctgaacaggcttatactggaactggatccgactttcgagccgattccgacccacatgaatgccctgggatcccaggctaacggaagtgtgagccccgatagcgtgggaggaggattgcgcgctagttcaagactgcctgataccggagaagggcctagcagggctacagggcgtcagggcagcagtgccgagcagcctctgggcggacgattaagaaagttatccctgggccaatatgataatgacgctggcggacagctccccttctccaagtgcgcatggggtaaagctggcgttgactacgcacctaatttgccccctttcccatcacctgccgacgttaaggagacaatgacaccaggatatccacaggaccttgacatcatcgacggtcggatcctgtcttctaaggaatccatgtgtagcaccccagcttttccggtgtcccccgagaccccctatgtaaaaaccgctctgagacatcctcccttcagtcctccagaacctcctctgtcttcacccgcatcacagcataagggagggagagagcccagatcctgtccagaaaccctgacccatgctgtcggaatgtctgagagtcctatcggacctaagagcaccatgctgcgggctgacgcctcttcaaccccttctttccagcaggccttcgcttcctcgtgcacaatatcatccaacggccctgggcagcggagggaatcatcgagtagcgctgaaagacagtgggtggagtccagccccaagccaatggtgagcctgctcggttctggccgtcccactgggtcccccctgagcgccgaattctctggcacgcgcaaggactcaccagtgcttagctgctttccaccttcagagctgcaagcaccgtttcactcacatgagctaagtctcgccgaacccccagatagcctggcaccaccaagcagtcaagctttcctcggcttcggcaccgccccagtcggttccggtctcccacccgaggaagaccttggagcactgttagccaatagccacggggcatcacctacaccaagtataccgctcaccgccacgggcgctgccgacaatggcttcttgtcccacaactttctgacagtggcccctggccacagctctcatcattctcccggattgcaagggcagggagtgaccctgcccggacagccacccttacccgaaaagaagagagcttccgaaggtgaccgcagcttaggctctgtgtcccccagcagttccggttttagcagtcctcatagcggctccaccatttccattccctttcctaatgtgctgcccgacttttcaaaagcctccgaggccgcatcgccactccccgattcgccgggagacaagctggtgattgtgaagttcgtgcaggacaccagtaagttttggtataaggccgacatttcccgcgaacaagctatcgctatgttaaaggataaggagccgggatcctttattgtaagggattcccattcctttagaggtgcctatggcttggcaatgaaagtcgcgactcctccaccttccgttctgcagctgaataagaaagcaggtgatctggcaaatgaactcgtccgccattttttaatcgagtgcactcccaaaggagtgcgtctcaaagggtgcagcaacgagccctacttcggcagcttaacggctctcgtctgccagcacagcataactccattagctctgccttgtaaattgctcattccagagagggatccattagaggaaattgccgagtcaagccctcagaccgccgctaacagcgcagccgaattattaaaacaaggcgctgcttgtaacgtgtggtatctaaattctgtcgagatggagagcctgacgggacaccaggctatccagaaggctctgtccatcactcttgttcaagagcctcccccagtgtctactgtcgtgcattttaaggtctctgcccagggtatcactctgacagacaaccagcgcaagctgttcttcaggcgccattatcctgtgaactccgtgattttttgcgcattagatccccaggatagaaagtggatcaaggacggaccttccagcaaagtgttcggttttgtcgcaagaaagcagggctctgcgactgataacgtgtgtcatctatttgccgaacatgatcctgaacaacctgccagtgctatagtgaactttgtcagtaaagttatgatcgggtcacccaagaaggtgtag

SEQ ID NO: 243747 - DNA, 3618 bp, Artificial Sequence
  Description of Artificial Sequence: Synthetic coding sequence
atggaggagggacatgggctggatttaacctacattacagaaaggattatcgccgtctctttcccagccggatgttccgaagagtcttatcttcataatctacaagaggtcacgcgtatgctcaaaagcaaacacggtgataactacctggtcctcaatctgagtgagaaacgctacgatttgaccaagctcaatccaaagattatggacgtagggtggcctgaattgcacgcacccccactggataaaatgtgtacaatttgtaaggcccaagaaagctggctaaattctaatctgcagcatgttgtggtgatacactgccgtgggggtaaaggcaggattggagtcgtgatcagctcttatatgcactttaccaatgtgtccgcatcagccgatcaggcgctggatcggttcgcgatgaaaaagttctacgatgataaggtgagtgccctgatgcagccatcccagaaaaggtacgtccagttcctgagcgggttgcttagcggctcagtgaagatgaacgcaagtccactcttccttcactttgtgatactgcacggtacccctaatttcgacaccggcggagtgtgccgcccattcctcaaactttatcaggccatgcagccagtatatacgtccgggatatacaatgtgggacctgaaaacccctcaaggatctgcattgtcatagagcctgctcagctgctcaagggggatgtcatgatgccccaccacgacctgcacagcgtggatagccttgggactctctcatccagcgaggggcctcaatctgcccatctgggcccattcacctgtcataagtcaagtcaaaattctcttctgagcgacgggttcgggagtaacgtcggtgaggatcctcagggcaccctggtgcctgacttgggcctgggaatggatggcccatatgagagggagcggacgttcggttctcgggagcccaaacagcctcagcccctgctccgtaagccatccgtgagcgcccaaatgcaggcttacggccagtccagctactccactcagacatgggtcaggcagcagcaaatggttgtcgcacatcagtacagctttgcccctgacggagaggcacgcctagtctcccggtgccccgctgataaccctggactggttcaggcgcagcctagagtaccactaactcctacacgtggtaccagttcgcgagttgccgtccagcggggagtgggcagtgggcctcatcctccagacacccaacagccctcaccaagcaaggctttcaaacctcggttccccggagaccaggtcgttaatggggctggcccagaattgtctaccggaccttcacctggcagtccaaccctggacattgatcagagtatcgagcagctgaatagacttatcctggaattagacccaaccttcgaacccatacctactcacatgaacgcgctgggcagtcaggcaaatggatctgtatccccggatagcgtgggtggcggtctaagagccagttcaagacttccagataccggggagggccctagcagagccacaggtagacaaggatcaagcgccgagcagccacttgggggtcgcttgaggaaactgagtctgggacagtacgataacgacgccggtggacagctacctttctctaagtgcgcatggggtaaggcaggcgtcgactatgctcccaatctcccaccattccctagccccgctgatgtgaaggaaacaatgacacctgggtacccgcaggacctggatattatcgatggtcgtattctcagcagcaaagagtcaatgtgcagcacaccagcattccccgtttctcccgagacaccttatgtgaaaaccgcgctgcgacaccctcctttctctccacccgaaccaccactttcctcccctgcgtcacagcacaagggagggagggagccacgctcatgccctgagaccctgacccatgccgtgggaatgtcagaaagcccaatagggcctaagagcaccatgctgagagccgacgctagctccactcctagttttcagcaagcatttgcgagctcttgcacgatctcttcaaatggacctgggcagcgacgggagtctagttcatctgctgagcgacagtgggtcgagtcatctcctaagcctatggtttcattactcggatcgggcagaccaaccggatctcccttgtcagcggagttcagcggaacccgcaaggatagtcctgttctgtcatgtttccctccgtcagaactgcaggctccgttccattctcacgaattgtcactggctgaaccacccgactcccttgctcccccatcctcacaggccttcttaggttttggaaccgctccagtgggcagtggactgcccccagaagaagatctcggtgctctgctggccaattcccacggggctagtccaacgcccagtatccccctgaccgccaccggcgctgcagacaacggctttctatctcacaactttctcaccgtggcccctggccacagtagccatcactcccctggccttcaagggcagggcgtgaccctccccggacaacctcctctacccgaaaagaagcgtgccagtgagggcgacaggtctctcgggagtgtgtccccctctagcagtggatttagttcaccacatagcggaagcacgatttcaatccccttcccaaatgtgctccccgatttttctaaggcttccgaggccgcttccccattgccggacagccccggagataagctggtcatcgtcaagttcgttcaggacaccagcaaattctggtataaggcagatattagcagagaacaggcgatcgccatgctgaaggataaggagcccggatccttcattgtgagagactctcattccttccggggagcttacgggttggccatgaaggtggccacaccaccacccagtgtgctgcaactgaacaaaaaggccggtgaccttgcgaacgagctggtgagacacttcctcattgagtgcaccccgaagggagttcgcctgaagggatgctccaacgagccctactttggatctcttactgctcttgtctgccagcactctattacacccttggcgctgccatgtaagttactgattccagagagggacccgctcgaggagatagctgagtcctctcctcagacagcggctaactccgccgcagagttgttaaaacaaggggctgcgtgcaacgtgtggtatctcaattccgtcgaaatggagagtttgaccggacaccaggctatccagaaagcactgtctattactctagtccaggaacctcctcctgtttcaacagtcgttcatttcaaagtaagcgcccagggcattacactcacagacaaccagcgtaaactcttctttagacgccactatcctgtgaactccgtcattttctgtgcactggatcctcaggatcgcaagtggataaaggatggcccatcgtcaaaagtcttcggctttgtcgcccgaaaacaagggagtgccactgacaatgtgtgtcacctttttgcagagcacgatccggaacaaccagcctccgcaatcgtaaatttcgtctccaaggtgatgataggatcgcccaaaaaggtttag

SEQ ID NO: 243748 - DNA, 4338 bp, Artificial Sequence
  Description of Artificial Sequence: Synthetic coding sequence
atggaagagggccatgggttagacttgacctacataaccgagcggatcatcgcggtatcttttcctgccggatgcagcgaagagtcttacctacataatctgcaggaagtcacccgtatgctgaagtccaaacacggcgataattacctcgtactgaatctcagcgagaaacgctacgatctgactaagttgaatcccaagatcatggatgtcggctggcccgaactccacgcaccgccactggacaagatgtgcaccatctgcaaggctcaggaatcctggctcaacagcaatctgcagcacgtggtggtcattcattgccgagggggaaaaggcagaataggggtggttatttcaagctacatgcacttcacaaacgtctcagccagtgccgaccaggcccttgaccgattcgcaatgaagaagttctatgacgacaaggtcagtgctcttatgcaaccgagtcagaaacgctacgtccagttcctgtcaggactcttgtccgggagcgtgaaaatgaacgccagtcctctattcttgcattttgtgattttacacggcaccccgaacttcgacactggaggcgtctgtaggccatttcttaagctgtatcaggccatgcaaccagtgtacaccagtggaatctacaacgttgggcctgaaaaccctagtcgcatctgtattgtgattgaaccagcgcaattgttgaagggcgacgtgatggtaaaatgttatcataagaaataccgcagtgcgactcgggacgtaattttcagacttcaatttcataccggtgcggtgcaaggctacgggttggtctttggcaaggaggatctcgacaacgcttccaaagatgacaggttcccagattatggtaaggttgaactcgtattttccgccacaccggagaaaatccaggggtcagaacatctgtataacgaccatggggtgattgtggattacaatactacggatcccctgatcaggtgggattcatacgagaatctcagcgcggatggcgaagttctccacacgcagggaccagtggacggctcactgtatgccaaagtaagaaaaaaaagctcctccgatcccggaattcccggaggccctcaagccatcccagccacgaatagccccgaccatagtgaccacacactcagtgtgagctccgattcaggtcattccaccgcgtccgctcgtaccgataagacagaggagcgcttggcccctgggacaaggcggggtctctccgcccaggagaaggccgagcttgaccagctactgtctggcttcggactcgaagaccctggttcttcgctcaaggagatgactgatgccagatccaagtactccgggacgagacatgtggtcccagcacaggtgcatgttaatggggacgccgctctgaaggatagagaaacggacattttggacgacgagatgccacatcacgatctccactctgtggacagcttaggcaccttgtctagcagtgagggcccacaatccgcccacttagggcctttcacatgccacaaatcgtctcagaacagtctattaagcgatgggttcggatccaacgtgggcgaagacccccaaggtacgctggtgccagatttaggacttgggatggatgggccttacgaaagagagaggacattcggtagtagggagcccaaacagcctcagccattactccggaaaccgagcgtgagcgcacaaatgcaggcctacgggcaaagttcttatagcacacaaacctgggtaaggcaacagcaaatggtcgtggctcatcagtactccttcgctccagacggggaagccaggctggtttccagatgccctgccgataaccccggtctggtgcaggcacaacctagagtgccactgactcctacaagaggtacatccagtagagtggccgtgcagcggggagtgggtagtggaccgcaccccccagatacacagcagccgtctccttctaaagcgtttaaacctaggttccctggagatcaagtcgtgaacggcgcagggccagagttatccaccgggccatctcccggaagtccaaccctagatatagatcagtctatcgaacagctgaatcgcttgatccttgagctcgatccaactttcgaaccgatcccaacacatatgaatgcactggggagtcaagccaatggatccgtctcccccgactctgtcggcggtggactccgcgctagctcccggttacctgatactggagaaggccctagtcgcgcaaccggccgtcaaggctccagcgctgagcaacctctgggcggtaggctacgcaagctatccctgggacagtatgataatgacgcgggtggacagctgcctttctcaaaatgtgcatggggaaaagctggagtggattatgctcccaacctccctcccttccctagtccagcagatgtgaaggaaacaatgacacctggctacccacaagacctggatattattgatggccgaattctgtcttcaaaggagagcatgtgctcaacccctgcctttcccgtcagccctgagaccccatacgtgaagaccgcattacgtcatcccccatttagcccaccggagccgccactttcaagcccagcaagtcagcacaaaggcggacgtgaacctcgatcctgccccgaaactctgactcatgctgtaggaatgtctgagtcaccaattggaccaaagtctaccatgttgagagccgacgcatcctcgacacccagctttcagcaggcttttgcctcttcctgcactatcagctccaacggaccaggccagcgtagggagagctctagcagcgccgaacggcagtgggtggaaagcagccccaaacccatggttagcttactcgggtcagggcgtcccaccggatcacctttgagcgccgagttcagcgggacccgcaaagattcccctgtgcttagttgttttccaccatcagaattgcaggccccattccattctcatgaactctccctggccgagccccctgacagcctagcccctccctccagtcaagcctttttgggtttcgggaccgcgcctgtcggttcagggctcccccctgaagaggatctaggagccctgctagccaacagccacggggcatcgcctactccatccatccctctcacagcaacgggagcagcggataacggctttctttctcataattttctcacggttgcaccgggtcatagctcacatcactctccagggcttcagggacagggagtcaccctgcctggccagcctcccctgcccgagaagaaacgcgcaagcgagggtgaccggtcactgggaagcgtgtctccctccagtagtggatttagctcgccacattccggtagtactatcagtatcccatttccaaatgtgttgcccgacttctcaaaagcatctgaagcggcttctcccctgcccgactcccctggagacaaactggtaattgtcaagtttgtccaggatacgagcaagttttggtataaggctgacattagtagagaacaggcaatcgccatgctgaaggataaggaaccaggatcgttcattgtccgagatagccacagcttccgcggagcctacggtttggcaatgaaagtggctaccccgcctccatccgttttgcagctaaataagaaagcaggcgatctcgccaatgagctggtgcggcattttctgatcgagtgtacgcctaaaggtgtccggctgaagggctgctcaaatgagccctatttcggatctctcacagctttagtatgccagcattcgatcacccccctggctctcccgtgcaaacttctcattcctgagcgcgaccccttagaagagatcgccgaaagctccccccagacggccgcaaatagcgcagcggaactacttaaacagggggcagcatgcaacgtgtggtacttaaattccgtagaaatggagtccctgacgggccaccaagctatccagaaggccctcagcatcactttggtgcaggagccaccaccggtttccactgttgtgcactttaaggtgtccgcccagggcattaccttgactgacaaccagcgtaagcttttttttagacgacactacccagtgaattccgtcatattttgcgcactggacccacaggataggaaatggataaaggatgggcctagcagtaaggtgttcgggttcgtagccagaaagcaaggctcagcaacagacaatgtgtgccatctttttgctgagcatgatccagagcagcctgctagcgccatcgttaactttgtctctaaagtgatgataggctcccccaagaaggtatag

SEQ ID NO: 243749 - DNA, 327 bp, Artificial Sequence
  Description of Artificial Sequence: Synthetic coding sequence
atggaggagggtcacggcctggacctgacttacattaccgagaggattattgctgtatcgtttcccgctggatgcagcgaggagtcatacctccataacttacaagaggtaacacgcatgctgaaaagcaaacacggggacaactatctggtgctcaacctctcggaaaaacggtatgacctgacaaagctgaaccccaaaatcatggatgtgggctggccggaactgcacgcacccccactcgacaagatgtgcactatttgcaaagcccaggagagctggctaaactctaatctccagcatgtggtggtgatccactgtcgctag

SEQ ID NO: 243750 - DNA, 417 bp, Artificial Sequence
  Description of Artificial Sequence: Synthetic coding sequence
atggaggaggggcacggtctggacctgacctacatcaccgagcgcataatcgctgtgtcattcccagcaggatgtagcgaagagtcttatttgcataacttacaggaggtgacacgcatgcttaagagtaagcacggtgataattacctggtacttaacctgtctgagaaacgatacgatctgacaaagctgaacccaaaaattatggatgtgggctggcctgagctgcatgccccacctctggacaaaatgtgtacgatctgcaaagcgcaggaatcatggttaaacagcaacttgcagcacgttgtggtcattcactgtaggggaggaaaaggcaggataggcgtggtgattagttcgtacatgcatttcaccaatgtgagcgcctctgcagaccaggcgctggatagattctag

SEQ ID NO: 243751 - DNA, 753 bp, Artificial Sequence
  Description of Artificial Sequence: Synthetic coding sequence
atggaggaaggacatggcctcgacctcacctatattacagagcgtattatcgcagtgagcttccctgcaggatgcagcgaggagagctatcttcacaacctacaagaggtgacaagaatgctaaaaagtaagcacggagacaactacttggtgctaaacctaagcgagaagagatatgacctgaccaaattgaaccccaaaatcatggatgtcggctggcctgaactgcacgcccctcccctggacaagatgtgtactatttgtaaagctcaagagagctggctaaacagcaacctccagcacgtggtcgtgatccactgcagaggcggaaagggtcgcatcggtgtggtcatttcgagctacatgcacttcactaacgtgagcgcctcagccgatcaggcgttagatcgctttgccatgaagaagttttacgacgacaaggtgagtgccctcatgcagccgagtcagaaacggtatgtgcagtttttgagtggactgttgtccggctccgtgaaaatgaacgcatcccctctattcctgcattttgtaattcttcatggtacacctaatttcgataccgggggagtgtgtagacccttcctgaaactgtatcaggctatgcagcctgtatatacatcaggcatttataatgtgggtcccgagaatccaagccgaatctgtatcgtcattgaacccgcacagctactgaagggcgatgtgatggtgatgaattataatatcgccaacatttag

SEQ ID NO: 243752 - DNA, 753 bp, Artificial Sequence
  Description of Artificial Sequence: Synthetic coding sequence
atggaagagggccacggcttggacctaacctatatcacagaaaggattatcgctgtgtcatttcccgcaggctgttctgaagaatcatacctgcacaatctgcaggaagtgacaagaatgttgaaaagtaagcatggagacaactacctggtcctcaatctcagtgagaagcgatatgacctgacaaagttaaaccctaaaatcatggatgttgggtggcctgaattgcacgcccctcccctggataagatgtgcacgatctgcaaggctcaggaaagctggctgaactcaaatttacagcacgtcgtggtgatccattgccggggaggaaagggaaggataggcgtggtgataagcagctatatgcacttcacgaatgtatcagcctccgccgaccaggccttggatagattcgctatgaagaagttctatgacgataaggtctccgcattgatgcagccgtctcagaaaagatacgttcagttcctcagtggattgttatcaggtagcgtgaagatgaatgctagcccactgttcctgcactttgtgatcctgcatggaacacccaactttgacaccgggggtgtgtgtaggccctttctgaaactctaccaggccatgcaacctgtgtatacaagtgggatttacaacgtcggacccgagaatccttccagaatttgtatagtgatagaaccagctcaactgctgaaaggagatgtgatggttatgaactacaacatcgccaatatctag

SEQ ID NO: 243753 - DNA, 3816 bp, Artificial Sequence
  Description of Artificial Sequence: Synthetic coding sequence
agccaagcactcaacgagagaatgaactggctttgcagaaatcaggaccctaaccctccacctcagccagaagagctcactagttccttgcacgcctttaaaaacaaagccttcaagaagtcaaaggtttgcggggtttgtaaacagatcatcgatggtcaaggaatctcttgcagagcctgtaagtactcatgtcataaaaaatgtgaggcgaaagttgtgattccgtgtggtgtacaagtgcggctggagcaggccccagggagttctactctgagctctagcctgtgcagggacaaacccctgcgtcccgtgatcctttcgccaacaatggaggaggggcacgggctggatctgacgtatattacagagaggatcattgctgtcagttttccggctggctgtagcgaggagtcttacttgcacaaccttcaggaagtgactcgtatgttgaagtcgaagcacggcgataattatcttgtcttgaacctttctgagaagagatacgatctgactaagcttaaccccaaaatcatggatgtcggttggcctgagctacatgccccaccgctggacaagatgtgtactatatgcaaggcacaagagagctggctaaatagtaacctgcaacatgttgttgtaattcactgtcgtggtgggaaagggaggatcggtgtggtcatcagttcttacatgcattttacaaacgtgtccgcatccgctgatcaggcactcgacagatttgctatgaagaaattctatgacgacaaagtgtctgcgctcatgcagccgtctcagaagaggtacgtccagttcctgagcgggctgctgtccggctcagtgaaaatgaacgccagcccgttgtttctgcattttgtcattctgcatggcacgccaaactttgacactggcggagtgtgcagaccttttctgaaactctaccaggcaatgcagccagtctacaccagcggcatttataacgtgggccctgagaacccatcacgcatttgtatagtcattgagcccgctcaactcctcaaaggcgatgtcatggtgaaatgctatcacaaaaagtaccgatctgccacccgcgacgtcatatttagactgcagttccacactggcgctgtgcagggatatggccttgtgtttggtaaggaagacctggacaacgcctctaaagatgaccggttccccgattatggcaaggtcgaactcgtgttcagcgcaacgccagaaaagatacagggcagcgaacatctgtacaacgaccatggagtcatagtcgattataatactacagaccccctgatccgatgggacagctacgaaaacctctctgctgatggagaggtcctgcacacgcagggcccagtcgatggctcactctacgcaaaggtgcgaaaaaagtcttcatccgatcctggaatccctggaggaccgcaagccattccagcaacgaattcccctgatcactcagatcacaccttgtcagtgtcatccgattctggccactctaccgcctccgcaaggacggataaaactgaagagagactggcaccaggcacacggaggggcctctccgcccaggaaaaggctgagcttgatcagctgctatctgggtttggactggaggatcccggaagttctctgaaggagatgaccgacgctcggagtaagtattccgggactaggcatgttgtccctgcacaggtacacgtaaatggagatgccgcacttaaagacagagaaacagatattttagatgatgaaatgccccaccacgaccttcacagcgtggacagcctgggtacgctttccagcagtgagggcccacagtccgcccatctaggcccattcacttgccacaagtcctcccaaaattctctgctctccgatggattcggatccaacgtgggtgaagacccacaaggcactctcgtgcctgacctgggactcggtatggacggcccttacgagcgggaacggactttcggcagcagggagccaaagcagccacagcccctcctcaggaagccaagtgtcagcgcccaaatgcaggcctatggtcagtcctcttactcgacccagacttgggtgcgacagcagcaaatggtcgtggcacaccagtactccttcgcaccggatggtgaggcgcgtcttgtgtcacggtgtccggctgacaatcctggcctcgtgcaggcgcagccccgagtgccattgacccctacacggggtacgagctctcgagtggctgtgcagcgcggagttggctcaggccctcacccccctgacacgcagcaacctagtcccagcaaagcctttaagcccagatttcctggagaccaggtggtgaacggtgctgggccagaactatcaacaggaccttcgcccggaagcccaaccctggatatcgatcagagcattgagcagcttaaccggctgattctagagctcgatcccaccttcgaacccattccgactcatatgaacgcgttaggatcccaggctaatggttccgtgtccccagatagtgtcgggggaggactccgggcttcctcacgccttccggacactggtgagggtcctagccgggctaccggcaggcagggctctagtgcagaacagccgctgggcggaagactgaggaagctgtcgctcggccagtatgataacgacgcgggaggccagctcccattcagcaaatgcgcatggggaaaagctggtgtcgattatgccccaaatcttccaccctttccaagcccggctgatgtgaaagagactatgacccctgggtaccctcaggatctagacatcattgatgggagaatcctgagctcaaaggaatccatgtgctctaccccggctttccccgtcagcccggagacaccttatgtgaagaccgccttgcgccatcctcctttctcccctccagagccccctctgagcagtcctgcctctcagcataaaggaggacgcgagccgaggagctgcccagagacactgactcacgccgtcggcatgagtgaatcacctattggtccaaagtccactatgctaagagccgatgcgtcaagtaccccctcattccagcaggcttttgctagtagctgtaccatctctagcaacggccctggtcagcggagagaatcctctagcagtgccgaaagacagtgggtcgagagctcgcccaagcccatggtctcacttctcggcagtgggaggccaaccggctcaccgctgtccgctgagttcagtggaacacgaaaggattctccagtactgtcatgctttccacccagcgaactgcaggctccgtttcacagtcacgaactttctctcgccgagcccccagactccctagcgcctccatccagccaggcatttctgggattcggaacagctccagtcggtagcggactcccacctgaagaggacctgggagcccttcttgcaaatagtcacggggcttctcctacaccttctatacccctaacagctacaggcgcagccgacaacgggttcctcagccataactttttgactgtggccccagggcattcaagccatcactcccctgggttgcagggtcaaggcgtcacactgcctggccagccacctctcccagagaaaaaacgagccagcgaaggagatagatcgctcggatcagtttccccgagctccagcggcttctcctccccgcacagtgggagtacgatcagcatccctttcccaaacgtgttaccagacttctctaaagcatctgaagcccctaccttctatcagaccagtaaaccagacatcccaggcccttag

SEQ ID NO: 243754 - DNA, 2760 bp, Artificial Sequence
  Description of Artificial Sequence: Synthetic coding sequence
atggacggcccatacgagcgggaacgaactttcggatcccgtgagcccaaacagcctcagccactgctgaggaaacccagtgtctcagcccagatgcaagcctatggccaaagtagctactctacccagacttgggtgcggcagcagcagatggtggtcgcccaccagtactcctttgctcccgatggcgaagcacgtctggtgagcaggtgcccagctgacaatcctggcctcgttcaggctcaaccccgagtccctctgaccccaacccgcggaacatcctctcgggttgccgtgcagaggggcgtcggatcaggaccccacccacccgacacacagcagccttcaccctccaaggcatttaaacccagatttccgggtgatcaggttgtgaacggggctgggcctgagctaagcacgggcccaagcccgggtagccctaccctggatatcgaccagagcattgaacaactgaacaggctgatccttgagctggatcctactttcgaacccatcccaactcatatgaatgccctcggaagccaggcgaacggctcagtcagtcccgactccgtgggtggcggactgcgcgcttccagccgactgccggacaccggtgaaggcccatcaagggcaactggtcggcagggttcgagcgccgagcagccactggggggacgcctgcgaaaactgagccttggccagtacgataatgacgccggtgggcagctgcccttctctaagtgcgcctggggcaaagccggagtggactacgcacctaatctaccccctttcccatcgccggcagacgtgaaagagactatgacccccggatacccccaggacctcgacatcattgacgggaggatcctgagtagtaaggagtctatgtgttctacccccgcttttccagtgtcacctgagactccttatgtgaagaccgcactgcgacatccccctttctctcctccagaacccccactatcctctcctgctagtcagcataaaggcggacgggagcccagaagctgtccagaaaccctcacacacgccgtgggaatgtctgagtcgccgatcggccctaaatcgaccatgttaagggccgacgcaagctccaccccgtcatttcagcaagcatttgcatcttcatgtactatttcctccaacggacctggacagcgtcgcgagtcctcttcctcagcagaacgccagtgggtcgagagctcccccaaaccaatggtctctctgctgggctctggtcggccaaccggttccccacttagcgcagagttcagtggcaccagaaaggattctcctgtcttatcctgcttccctccttcagaactccaggctccgttccattcccatgaattgagccttgctgagccaccagacagcctggctccccctagctcccaggcattcctgggctttggcacagcaccagtcggctcaggtctgcccccagaagaagacctcggcgcactcctggcgaactctcacggggcttcgccaacaccctctattcccctgaccgccaccggcgctgccgataatgggtttctcagtcataacttcctgacagtagctcctggccactcctctcaccactcacctgggcttcagggtcagggagtgaccctgccgggacagcctccattaccagagaagaaacgggcatctgagggtgatcggtccctggggtccgtctctcccagttcaagcggcttttcttccccacactccggaagcaccatctcaattccttttcccaatgtgctcccggatttctcaaaagcatcagaggccgctagtccactgccggactctccaggcgacaagctagtaatcgtgaagtttgttcaggatactagtaaattctggtataaggccgatatttcccgggagcaggctatcgccatgttgaaagacaaagaacctggatccttcatcgtgagggacagtcactctttcaggggcgcttacggcctcgctatgaaggttgccactccgccaccatcagtcctgcagctgaacaagaaggcgggtgacctggcaaacgaactggtgagacactttctcatagaatgcaccccaaagggggtcaggcttaaagggtgcagtaacgaaccttattttgggtccttgaccgccctggtttgtcagcacagtatcacacccttggccctcccatgtaagctgttaatccctgagagggatccactcgaagaaattgccgaaagttctcctcagacagcagcaaacagcgcagcagagcttctcaaacagggcgcagcttgcaatgtctggtatttgaattcagtcgagatggaatctctcaccggacaccaggccattcagaaagcactgagtattacgctcgtgcaagagccaccgcctgtgtcaaccgtcgtacactttaaggtgtccgcccaaggaattacactgacagacaaccagcggaagctgttttttcgacgccactaccctgtgaattcagtaatcttctgtgccctcgaccctcaggatagaaagtggatcaaggacggtccctcctcgaaagtgttcggatttgtggcccgaaagcagggcagtgcaacggacaacgtgtgtcacttgtttgctgaacacgacccggagcagcctgctcgggaaagtcaacgccataggggggctagagatgggcctcacgaggccatgcctcgacgccactctggctcacctgcaaacgtgctgttcgaactcatcggacaagtttag

SEQ ID NO: 243755 - DNA, 2148 bp, Artificial Sequence
  Description of Artificial Sequence: Synthetic coding sequence
atgagccaagttatgtcttctccgctcctagccggaggacacgccgtgagtctcgcaccctgcgacgaaccgagacggacactacacccagctcccagccccagcctgccgccacagtgttcatattataccaccgaggggtggggggcacaggctctgatggccccagtgccatgtatggggcctccaggaagactccaacaggcccctcaggtcgaggctaaggccacatgcttcctgccgagtcccggagagaaggctctgggcactcctgaagatctcgacagttacatcgattttagtctggaatcactcaaccagatgattctggaattggacccgactttccagctcctcccccctggcacaggaggctctcaggcggagttggctcagtcgacaatgtctatgcggaaaaaggaggagagtgaggcactggacatcaaatatatcgaggtaactagtgccagaagtaggtgccacgatggcccacagcactgctcctctccctcagtgaccccaccattcggcagtctcaggtccggcggactgctgcttagtagggatgtgccacgtgagacccgatcctccagtgagagtctgatcttctcaggaaaccagggcaggggacaccagcgaccccttcccccttccgagggcctgtcacccaggcctccaaacagtccctctatttctataccctgcatgggttctaaagcctctagtccccacggcttagggtctccgctcgtggcgagccctagactcgagaagagattaggcggtctggctccacagagggggtcaaggatttcagtcctgagtgccagtcctgtctctgatgtaagctatatgtttggatcttcccagtcgctgctccatagctcaaattcctcccatcagtctagcagccggtccctggaatccccggctaactcatccagctccctgcattcgttgggcagtgtttctttatgtacacggccatccgatttccaggccccaagaaacccaacactgacgatgggccagcccagaactccccactctcctccccttgccaaagagcacgcctctagctgccccccttcaataacaaattccatggttgacatacccatagtgttgattaacggttgccctgagcccggatctagcccaccgcagcggaccccgggtcaccagaacagcgtccaacccggagcggcttcccccagcaatccttgtcccgcaacccgaagtaactcgcagacattgtccgacgctccttttaccacttgcccggaaggcccagctcgcgatatgcagccaaccatgaagtttgtgatggacacatcaaaatactggttcaaacctaatattacccgggaacaagcgatcgagttgttaaggaaggaggagccaggtgcatttgttatacgagactcttcttcctaccgcggatctttcggcctggctctcaaagttcaggaggtccccgcatccgctcagtctagaccaggagaggacagtaacgacctgattaggcattttttgattgagagtagtgccaagggtgtccacctgaagggcgctgacgaagagccttattttggttccctctcagcttttgtgtgccagcatagcatcatggctctggccctgccctgtaagttgactattcctcagcgcgagctgggaggcgcagacggagcctctgattctacagacagtccagcttcgtgccaaaagaagtccgccggttgccataccctatacctttcaagtgtgtcagtggagacattgactggcgcacttgccgtccagaaggccatctccacaactttcgaaagagacatcctcccaacccctactgttgttcacttcaaggtgacagaacaggggatcaccctcaccgacgtgcagcggaaggttttctttcgacggcattatcccctcaccactttgagattttgtggaatggacccggagcagcggaagtggcagaaatactgcaagccctcttggatctttggattcgtggcaaagtcccagaccgaaccccaagagaacgtgtgtcacctttttgcagaatacgatatggtgcaaccagcatctcaagtgattgggctagtgaccgctctccttcaggatgcagaaaggatgtag

SEQ ID NO: 243756 - DNA, 2148 bp, Artificial Sequence
  Description of Artificial Sequence: Synthetic coding sequence
atgagccaagtcatgtcttctccactgctggctggcggtcatgccgtctctctggccccttgtgatgagccgagacggaccctccacccagccccatctccatctctacctccccagtgctcttactatactacggagggttggggcgcacaggcactgatggcccctgtcccttgtatgggcccacctgggcgtctccaacaggccccacaggtggaagctaaagctacctgctttctgccatcgcccggtgagaaagctctgggaactcctgaggatctggacagctatatcgatttttcactagagtcgttgaatcagatgatcctcgaactggaccctacttttcagctgctgcctccaggtactggcggaagtcaggccgaactggcacaaagcactatgtccatgcggaaaaaggaagagagtgaagccctagacatcaagtacattgaggtcacctccgctcggagtagatgccatgacgggcctcagcattgttcttccccctcggtgactccgccttttggttcactgcgatccggtgggctgctgttgagtagggacgtgccccgtgagactcggagtagttcagaaagtcttatttttagcgggaatcaggggaggggccatcagcgcccactcccacccagcgaggggctgagccctcggcctcctaactccccatcaatcagtatcccttgcatgggatccaaagcatcctccccacacggactgggctctccactggtggcctctcccaggctggagaaacgactgggaggactggcgcctcagcggggaagtagaataagcgtgctgagtgctagtccagtatctgatgtatcttacatgtttggctcaagtcagagcctgttgcatagcagtaactcttcccaccaatctagtagccgctccttagagtctcctgccaatagctctagctccctccatagcttaggctcggtgagtctgtgcactcgcccttccgattttcaagcgcctaggaatcccaccctgaccatggggcagccacggacgccgcactctccgcctcttgccaaggaacatgctagctcatgtccaccgtctatcacaaattcaatggtagacatccccatcgtgctgatcaacggctgtccagaacctggaagcagtccgcctcagcgcacacctgggcatcagaatagcgtccagccaggtgccgcatcaccttcaaacccttgccctgccacacggtctaatagccagaccctgagcgacgcgccttttacaacttgtcctgagggacccgctcgcgatatgcagccgaccatgaagtttgtgatggataccagcaagtattggttcaaacctaacatcacacgagaacaggcaatcgaattgcttcgcaaggaagaacccggagcgtttgtgattagagatagcagcagttaccgagggagcttcggtctagcactgaaagttcaggaggttcctgcttccgcccaatccaggcctggcgaagattcgaatgatctgatacgccattttctcattgagtcatccgccaaaggggttcatctgaaaggagccgacgaggagccttattttgggtcactatcggcatttgtgtgtcagcactcgatcatggcccttgcattgccatgtaaactgaccattccccaacgagagctcggaggagctgatggcgctagtgactccactgatagtccagcctcctgtcagaaaaagtccgcaggttgccacacattgtacctcagttcagtgtctgttgagactctgaccggggctcttgccgtgcagaaagccatttctaccacattcgaacgcgatatccttcctactcccacagttgtgcattttaaggtcactgagcaagggatcaccctcaccgatgtgcagcgcaaggtcttttttcgtaggcactacccactcaccaccctgcgtttttgtgggatggatccagaacagaggaagtggcaaaagtattgcaaaccaagttggatctttgggttcgtggcaaaatcacagacggaacctcaggaaaacgtgtgtcacctgttcgctgaatatgacatggttcaacctgccagccaagtgatcggcttggttaccgcactgcttcaagacgccgaacgcatgtag

SEQ ID NO: 243757 - DNA, 387 bp, Artificial Sequence
  Description of Artificial Sequence: Synthetic coding sequence
atgcgccctgtccccgtgaggggggtacattctctccatcccagaccattcggtggaccagtctctttgccctggctgcgcacaggtcgctgccgctggggcctgggcctatacagacagcccagtctgctgccagaagagatttgcggagtctttttcagaagacattatcctttgacaactctgcgattctgcgggatggatccagagcaaagaaagtggcagaaatattgcaagccctcctggattttcggctttgtcgctaagtcccagacagagcctcaggagaacgtgtgccacctctttgcggaatacgacatggtccagcccgctagtcaggtcatcggactggttactgcgctactccaggatgctgaacgtatgtag

SEQ ID NO: 243758 - DNA, 4230 bp, Artificial Sequence
  Description of Artificial Sequence: Synthetic coding sequence
atgaaatcttccggcccagttgagaggctgctgagggcgttgggccgtagggacagttccagagctgcttcgaggcctcggaaggccgaaccacacagtttcagggaaaaggtttttcggaaaaagccgcctgtgtgcgccgtctgtaaagttactatcgacggtacaggtgtttcatgtcgggtctgcaaagtcgctacgcaccgaaagtgtgaggccaaggtgaccagcgcttgccaggcactacccccagttgagcttcggcgaaacaccgcccctgtgcggcgtatcgaacacctgggaagtactaagagtttaaaccactcgaagcagagatcgactctgccgaggtcattctcactggacccacttatggagcgaagatgggatctcgatctgacatatgtgacggaaagaatcttagccgctgcatttccggctcgcccagatgaacagagacatagggggcacctccgcgagctggctcatgtactacagagtaaacaccgggataaatacctgctgttcaatttatccgaaaagcggcacgaccttactcgtctcaatcccaaagttcaagacttcgggtggccagagcttcacgccccaccacttgataaactgtgctcaatttgcaaagcaatggagacctggctcagtgccgatccgcaacacgttgtcgtcctgtactgcaaagggaataaggggaagctgggggttatcgtgtcagcctatatgcactactccaaaattagcgctggcgcagaccaggccctggcaaccctcacaatgcgcaagttttgtgaggacaaggtggctacggagcttcaaccttctcagcggagatacatctcttacttctccggcttgttgagcgggtcaatccgcatgaatagctcccctttgttcctgcattatgtcttaattccaatgctgcccgcatttgagcctggtacaggctttcaacccttcctcaagatttatcagtccatgcagttagtgtatacctctggagtttaccacatcgcgggaccgggtccgcagcaactttgtatctctctggagcctgccctcctgctgaaaggggacgtgatggtcacttgctaccataaagggggtcggggtacagaccgaactcttgtgtttcgggttcagtttcatacatgcactattcacgggccacagttaaccttccccaaagatcagctggacgaagcttggaccgacgagcggttcccatttcaggcctcagtcgagtttgtgttcagttcctcacctgagaagatcaagggcagcacaccaagaaacgacccctcggtgtccgtcgattataacactacagaacccgctgttaggtgggattcctatgaaaattttaatcagcatcacgaagacagtgtcgatggtagtctgacacacacaagaggccctcttgacggatccccatatgcacaagtgcaacgacctcccaggcaaacacccccagctccctctccagaacccccacctccacccatgctgtccgtctcttcagactccggccactcttcaaccctgaccacagagccagcggctgaatctccaggacgacccccacccacagccgcagagcggcaggagctagaccggcttttggggggatgcggcgtcgcttcgggcggacgcggagctggccgagaaacggccatactggatgacgaagagcagccaaccgtgggcggtggcccacaccttggggtatacccgggacatagaccgggattatcacggcactgctcttgccgccaaggttacagagagccatgtggcgtcccaaacggtggttactatagacctgaaggcaccttagaaagaaggcgcttagcatatgggggatacgaagggtccccccaaggatacgctgaggcatcaatggaaaaacggcgactgtgccggtcactgtctgaaggactgtatccctaccctcctgaaatgggcaagcccgctacaggagacttcgggtaccgcgcacccggataccgggaggtggttatccttgaggatcccggtctccctgcattgtacccatgtcctgcctgcgaagagaagctcgctctgccaacagccgcactctatggcctgcgtttggaacgagaggccggtgagggatgggcatcagaagctgggaagcctctcttacacccagtcaggcctggtcatccccttcctttgctgctgccagcctgtggccatcaccatgctcctatgcccgactactcctgcttgaagccacccaaggccggtgaggaaggccacgagggctgcagctacactatgtgtcccgagggtcgttatgggcatccaggatacccagccttagtgacctacagctatgggggtgctgtacccagctattgtccagcatatggtcgcgtcccacatagttgcggctctcccggagaaggcagaggctacccctctcctggagctcatagtcctcgggctggctccatctccccaggaagtcccccatacccacaatcaaggaagctgtcttatgagatacctaccgaggaaggtggggatcgatatcccctccctggacatctagccagcgccggtcctctggccagtgcggagagcttagagccggtgtcatggcgcgagggccctagcggacatagcacattgcctaggagcccaagggatgcgccttgcagcgcctcatcagaactgtctggaccatctactccactgcataccagctcaccagtgcagggcaaagagtccacacgccgtcaagacacccgcagccctaccagtgcacccactcagcgcctgagtcctggagaggccctgcctccagtgtctcaggctggtaccggcaaagcacccgagctacccagtgggagcgggccagagccgcttgcaccatccccagtttcccccacattcccaccatcatctccgtcagattggccgcaagagagatcccccggtggacactcagacggtgccagtcccagaagcccagtccccaccaccctgcccggactgcgccacgcgccatggcagggacccaggggaccacccgattctccggatggatcccctcttacaccggttccttctcagatgccgtggttggtggctagccctgaaccccctcagtcttcccccactccagcattcccccttgcagcgagttatgataccaacggacttagtcagccgcctttgcctgaaaagcggcacctcccgggtcctggccagcagccaggtccctggggtcccgagcaggcgtcttcccccgcacggggtataagccaccacgtgacattcgctccccttctcagcgacaacgttccccagactccagagccccctacccaagaatcgcagtccaacgtgaaattcgtccaggatacctcaaaattctggtacaagccccacctctcacgagaccaggccatagctctcctcaaggataaggatccgggagccttcctgattagagacagccatagcttccagggggcatacggcctggctttgaaagttgctactcctccgccatcagcacagccatggaagggggatccggtagaacaactggttaggcacttcctcatcgaaacaggccctaaaggagtcaaaattaagggatgtccctccgagccttattttggctctctgagcgccctggtatcccaacactccataagtcctatttcactgccttgttgcctccgcatcccctccaaagaccctttggaagagacaccggaggcccctgttcctaccaatatgtcgaccgccgcagaccttctaagacagggggcagcatgctcagttctgtacctgacctctgtggaaacagagagccttactggaccccaagccgtcgccagggcatctagcgctgccttgtcctgctcgcctaggccaacccccgcagtggtacacttcaaagtgtccgcccagggcattacactgaccgataatcagagaaaactcttctttcgtcgccactatccagtcaattcaatcacattttcatccaccgacccgcaagaccgtcggtggaccaacccagatgggaccactagtaagatatttggattcgtggctaagaagccaggatccccatgggagaacgtttgtcacttatttgctgaactggatcccgatcagcccgctggtgccatagtgacttttattactaaggtactgctgggccagaggaagtag

SEQ ID NO: 243759 - DNA, 4260 bp, Artificial Sequence
  Description of Artificial Sequence: Synthetic coding sequence
atggatggagggggagtttgcgtgggcaggggagatctgttatcttctccccaggcccttggccagcttttgcgcaaggagagccgccctcgtagggccatgaagcccaggaaggctgaacctcacagtttcagggagaaggtgttccgcaaaaagccaccagtttgcgcagtgtgtaaggtaactatcgacggcactggggtgagctgcagagtctgtaaggtggccactcatcgcaagtgcgaggccaaggttacgtcagcgtgccaagcattaccaccagtggaactccgcaggaatactgccccagtgcggaggattgaacacctcggctctactaagtcactaaaccacagtaagcagcgctcaactttgcctaggtcattttctctggatccactgatggagcgcaggtgggatctcgatttgacatacgttactgagagaattctcgctgcagccttccctgccagacctgatgagcagaggcacaggggccatctcagagagcttgcccacgttttacagtccaagcaccgggacaagtatctgctctttaacctctcagaaaagcggcacgacttaacccgcctgaacccaaaggtgcaggacttcggttggcctgagttgcacgccccacccctcgataaactttgctccatatgcaaggctatggagacctggctcagcgccgacccacaacatgtagtggtgctatattgcaagggaaataaaggcaagctgggtgttatagtcagtgcctacatgcattactctaaaatcagcgctggtgccgatcaagccctggctacccttaccatgcgtaagttctgtgaggacaaggtggcaaccgaactccaacctagccagcgacggtatatatcttactttagcggactgctctccggatccattcgcatgaactcgagccctctgttcctgcactacgtgttgatccctatgctccctgcattcgaacccggtacaggattccagcctttcctgaagatctaccaatccatgcagcttgtttacactagcggggtgtatcacattgctggacccggacctcagcaactatgtattagcctggagccagcactgttacttaagggtgatgtgatggtgacttgttaccataagggcggacgcggtactgataggacgcttgtgtttcgcgtgcaattccacacatgtactatacacggccctcagttgacgtttccaaaagatcagctggatgaagcatggaccgatgagcggttccctttccaggcgtccgtggagttcgtcttcagctcctcaccagagaaaatcaaaggttccactccacggaacgatccaagtgtgtcagtggattacaatactacggaacctgctgtgaggtgggactcttacgagaatttcaatcagcaccatgaagatagcgtggacggaagcttgacccatactcggggaccactagacgggtcaccttacgcccaagtccagagaccacctagacagacccctccggctcccagtcctgaaccaccgcctccgccaatgctgtctgtgtcgagcgatagcggccattctagcactctcacaaccgagcctgcagctgaatctccaggaaggcctccccctaccgccgctgagcgtcaagagctggaccgcttactgggcggatgcggggtggccagtggtggcagaggtgctggtagagagacggcgatccttgacgatgaggaacagcctaccgtcggcggtggccctcaccttggcgtttaccctgggcaccgacccggactcagccgccactgtagttgtagacagggctatagggaaccttgtggcgtgccaaatggcggatactatcggccagagggcaccttagagcggaggcgccttgcgtatggtggatatgagggatctccccagggttacgcagaagctagcatggagaagcggagactgtgcagaagtctctcggaggggctctatccgtatcctccagagatgggaaagccagccacaggggacttcgggtatcgagccccaggctacagggaagtcgtgatccttgaggatcccggactgccagccctgtatccatgcccggcttgtgaggaaaaacttgctctgccaactgcagctctctatggtctgcggctggaacgcgaggcgggtgaaggctgggcctcagaagccggtaaacccctcctccatcccgtgcggcctggccaccctctgcctcttttgctgccagcttgtggccaccatcacgccccaatgcccgactactcctgtctaaaacccccaaaggccggtgaagagggccacgaagggtgctcttatactatgtgccctgagggcagatacgggcatccaggataccccgctttggtcacgtatagctacggtggagccgttccaagctactgcccagcatatggaagagttccccactcctgcggctcacccggtgaaggcagggggtaccccagccctggcgctcactctcctcgagccggttctatttcacccggaagccctccttatcctcagagccgtaagctaagttatgagatacctaccgaggaagggggagaccgatatcccttgcccggacacctggcaagtgcgggtccgctggccagtgccgagagtttggagccagtgtcatggagggaaggcccaagcggccattcaaccctacctcgctctccacgggacgccccatgttcggccagttcagaattgagtgggccttcaacgcccctgcacacgagttcccccgtccagggtaaggaaagcacacggagacaagatacgcgaagtcccacctccgcgccaacacagagattatctccaggagaggccttaccccctgtcagtcaagctggaaccggcaaagcaccagagctccccagtgggagcggacccgagccattggcgccttcccccgtgtccccaacctttcctccatccagtccttctgactggccccaggagcgcagtcccggtgggcactctgatggcgcttctccgagatccccagtgccaaccacattgcctggactgagacacgcgccatggcaggggccaagaggaccccctgactcccccgatggaagtcctttaacacccgtaccatctcaaatgccgtggctggttgcgtcaccagaacccccacagtcaagccccaccccagcattccctttggccgcttcttacgacacgaacgggttatcacagcctccactgccggaaaaacggcacctccccggtcccggacaacagcctggaccctggggtcctgagcaggcatcaagccccgcacgtgggatctcccaccacgtgacatttgcgcctctgcttagcgacaatgtgccccagacccctgaacctcctacccaagaatcccaatctaacgtcaagttcgtccaggatactagcaaattttggtataaaccccacctgtcccgggatcaggctatagcgttactcaaggataaagatcctggcgctttcctcatccgagactctcactcctttcagggggcttacggactggctctaaaggtagctaccccccctcccagcgcccagccctggaaaggcgatccagttgaacagctagtccgccacttcctgatcgaaacaggacctaaaggggtgaagatcaagggttgtccatcggagccttacttcgggagcctgtcggccctggtcagtcagcactcgatctcacccatctccctcccatgctgtttacggattccttcgaaggatcctttagaagaaacccctgaggcacccgtgcccacaaatatgagcacggccgctgaccttttgagacagggagccgcatgttcagtgctttatctaacatctgtagagaccgagtcgctgactggacctcaagccgttgctagggcctctagcgccgctctctcctgcagcccacgccctacccctgccgtcgttcacttcaaggtgtcagcccagggcatcaccctcacggacaatcagcgaaaactgttctttagaaggcattaccctgtgaacagcataacattttcttccaccgatccccaggatagacgatggacaaaccctgacgggactacttctaaaattttcggctttgtagcgaaaaagccgggttctccgtgggagaacgtatgtcatctgtttgcagaactggacccagatcaacctgcgggagcaatagtaacgttcattacgaaggtgctcctggggcaacgaaaatag

SEQ ID NO: 243760 - DNA, 3858 bp, Artificial Sequence
  Description of Artificial Sequence: Synthetic coding sequence
atggagcgaagatgggaccttgatctgacctacgtcactgagaggattcttgcggcagcctttcccgctcggccagacgaacagaggcacagggggcatcttagagaactggcccacgtgcttcaatctaagcacagggacaaatatctgctgttcaacctgagtgaaaagcggcatgaccttacccgcctcaacccgaaggtgcaggatttcgggtggccagagctccacgcacccccattggacaaactttgcagtatttgcaaggctatggaaacctggctttcggccgacccccaacatgtggtggtcttatactgcaagggcaataaggggaagctaggcgtcatcgtgtctgcgtacatgcattatagcaaaatctccgctggagccgatcaggccctagcgacactgaccatgcgaaagttctgcgaggataaggtggcgactgaactgcagccatctcagagaagatatatttcctactttagcggtcttctatcaggatccataagaatgaacagctcaccgctgttcctgcactacgtgctcatcccaatgcttccagccttcgagcctggaactggctttcagccatttctgaaaatttaccaatctatgcagctggtttacacatccggagtctatcatatcgcaggccctggccctcagcaactttgcatctcactcgaacccgctctgctactgaagggcgacgtgatggtaacttgctatcacaaaggcggtaggggaacagatcgaaccctcgtcttcagagtacagttccatacttgcacaatacacggaccacaacttacattccctaaggatcaacttgacgaggcatggaccgatgagcgattcccttttcaggcttctgtggaatttgtcttcagtagcagccccgagaaaattaaaggatcgacaccacggaacgacccttccgtgtccgttgattataatacgaccgaacccgcagtccgctgggattcatacgagaatttcaatcagcaccatgaggacagcgttgacggaagtctgactcacactcgtgggcctcttgatggcagcccttacgcgcaagtgcagcgcccacctagacagactcccccagctcccagcccggaaccgccaccaccccctatgttgtcagtgtcctctgacagtggccatagtagcactttaaccacagaacccgctgcagaaagcccagggcgacctccgccaaccgctgctgagcggcaggaattggatcggctgttggggggatgcggcgtcgcatctgggggacgtggcgctgggagagagactgccatactggacgacgaggaacagcctaccgtcgggggtgggcctcatctgggcgtgtatcctggtcaccggccaggcttgtcgcgacactgttcctgccgtcagggctatcgagaaccctgcggggtccctaatggagggtactacagacctgaaggcaccctggaacggaggcgactggcatacggcggttatgagggcagtccacagggatatgcggaggcttctatggagaaaaggcgactgtgtagaagcctatccgaagggttatatccataccctcctgagatgggaaagcccgctaccggggacttcggttatagggctccaggataccgggaagtagtgatcctggaagaccccggattgcctgctctgtacccttgccctgcttgcgaggagaagcttgcactccccaccgccgcactgtacgggttacgtttagagagagaagccggtgagggctgggccagcgaggccggaaagccactgctccaccctgttcgaccaggccacccactacctttactgctgcccgcatgcgggcatcaccatgccccaatgcccgattatagctgcctgaaacctcccaaggccggagaagagggtcacgagggttgttcttacacaatgtgtccagaggggaggtatggacaccctgggtatcccgcactggtcacatattcatacggtggcgctgtaccaagttactgcccagcatacgggcgtgtgccacattcttgcggatcacccggagaaggtcgtggatatcctagtcccggagcccattcaccccgtgctggaagcatcagtcccggttcaccaccctacccacagagccggaaactgtcttacgaaatccccacagaagagggaggagataggtatcccctgcctggacatctcgcgagcgctgggccattggcttctgcagagagtctcgaaccggtgagctggcgcgaagggccatctggccactcaactctccctcgttcacctcgtgacgcaccttgttctgcttccagcgaactgagcggaccatccacccccttgcacacctcctcacccgttcagggtaaggagagtacaaggcgtcaggatactaggtcccctacatccgccccaacgcagcggttaagcccaggcgaagctctgcctcccgtgtctcaggccggaacggggaaggcccctgaactgccaagcggcagtggacccgagcctctggctccttcccccgtcagcccaacctttcccccatcctctcctagcgactggccacaggaacgctctccaggaggccacagcgacggtgccagccccaggagccccgtgccaactactctgcctgggctcagacatgccccatggcaagggccaagaggcccacccgacagcccagatgggtcgccactgactccagtcccaagtcaaatgccctggctggttgcttcccctgagccacctcaatctagccccacacctgcgttcccactggccgcatcatacgacacaaacgggctgagccagccacctctcccagagaaacggcacctccccggacctggacagcagcccggaccgtgggggcctgaacaagcttcgtcccccgctcggggtatctcacaccacgtgacatttgcacctctcctgagcgataacgtgccacaaacccccgaaccacctactcaggaatcccagtccaacgtgaagtttgtgcaggacacttccaaattctggtacaaaccacaccttagtagagatcaagcaatcgcccttcttaaggataaagacccgggtgcctttcttatcagggatagtcattccttccaaggagcttacggccttgctttgaaggtggccaccccacccccatccgctcagccatggaaaggtgatcctgtggaacagttggtgcgtcatttcctcatcgaaacgggacctaaaggggtcaagatcaaagggtgcccatctgagccctactttgggtctctaagcgctctggtgtcacaacacagtatctcacccatcagtctgccttgttgcctcaggatacccagtaaagaccccctggaggaaacacccgaggccccagtcccgacaaacatgtccaccgccgctgatttgctgcgccagggggctgcctgttccgtcctttacctgacgagcgtggaaacagagagcctgactggacctcaagccgtggcgcgagcaagcagtgctgcattgtcgtgttcgccacggcctacaccagccgtcgtccattttaaggtcagcgcacagggaatcacgcttactgacaatcaacggaaactctttttcaggagacactatccggttaattcaataaccttcagctctactgatccccaagaccggagatggacaaatccagatgggactactagcaagatttttggcttcgttgccaaaaagcctggctcaccatgggaaaacgtgtgtcacctctttgcagaattggacccggaccagccagccggtgctatcgtcacatttattaccaaagtcctgttagggcagcggaaatag

SEQ ID NO: 243761 - DNA, 2346 bp, Artificial Sequence
  Description of Artificial Sequence: Synthetic coding sequence
atgaaatcatcagggcctgttgagcgccttctccgagccctcggcagaagagattccagtcgggctgcaagccgtccacgaaaagctgaaccccactcatttcgtgagaaggtatttaggaaaaagcctccagtttgtgctgtatgtaaggtcactatcgacggcacgggcgtgtcttgccgcgtgtgcaaggtggccacacaccgtaagtgtgaagcaaaggttacgtctgcctgtcaagctctcccccctgttgaactacggaggaatacagccccagttcgaagaattgaacatttaggatccacaaagtctctcaaccactccaagcagcggtcaacgctccctcggtcattctcgctcgaccctctcatggaacgaagatgggacctcgatctcacatacgtaaccgagcgtattctcgcagcagccttcccagcacggcctgacgaacagcggcacaggggccacctccgcgagctcgctcacgtgctccagtccaaacacagggacaagtatctcctgtttaacttgtctgagaagcgccacgatcttacccgattgaacccaaaggtgcaggatttcgggtggcctgagctgcacgctccgcctttggataaattatgctccatttgtaaggccatggagacatggctttctgctgacccgcagcacgtcgtcgtgctttactgtaaagggaacaaaggaaagctgggagttatcgtgagcgcttatatgcattactccaaaatcagtgcaggagccgatcaggctctggctactctgactatgcgaaaattctgcgaggacaaggttgctactgaactacagccaagccagaggcgctacatctcatacttttccggactgttgtccggcagcattagaatgaactcctccccacttttcctgcactacgtattgattccaatgctgcctgcgttcgagccgggtaccggttttcagccgttccttaagatctaccagagcatgcagctggtgtacactagcggcgtgtaccacattgccggacctggcccacagcagctgtgtatctcgctggagcccgcacttctgctgaaaggagacgtgatggtcacctgctatcacaagggagggaggggaacagaccgaaccctggtgttcagagttcagtttcatacatgtaccatccatggtccacagctgacatttccgaaggaccagctcgacgaggcgtggaccgacgagcgatttccatttcaggcctcggtcgaattcgtctttagcagttcaccggaaaagataaaaggcagtacccccaggaacgaccctagcgttagcgtggattataacactaccgagcctgcggttcggtgggattcctacgagaacttcaatcagcaccatgaagactctgtcgatggtagtctcacccacacacgcggtccactggatggtagtccctacgcacaggtccagaggccccctcgtcagactccccctgcaccaagccctgagccccctccacctcctatgctgtctgtcagtagcgactccgggcacagttcaaccctgactaccgagccagcagctgagagccctggaaggcccccacccactgctgccgaaagacaggaactcgatcgcctgcttggaggttgtggagtggcctccgggggaaggggcgcaggacgggaaaccgccatcctggacgacgaggagcagccaacagtaggcggaggcccacatttgggcgtctatcctggccacagaccagggttgtcaaggcactgctcttgtaggcagggatacagagaaccatgcggagtgcccaatggcggatactaccgacccgaagggacactggagaggcgacggctcgcctacgggggatacgagggctccccgcagggctacgctgaggcttcaatggagaaacggagattgtgccggtcgctgtccgaaggcctttatccatacccccctgaaatgggtaagccagccaccggcgactttggctacagggcctcgagcgccgcactatcatgcagcccgagacctactccggctgtcgtacatttcaaggtcagcgctcagggcattactcttacagataatcaacggaagctcttctttagaaggcactaccctgtgaattccattacttttagctcgaccgacccccaggataggcgatggaccaatccagatggaaccacctctaaaatcttcggctttgtggccaagaagccaggttccccatgggaaaatgtgtgtcatctgttcgctgagctggaccccgatcagccagctggcgcaatcgtgaccttcatcacaaaagtgttgctgggccaacggaagtag

SEQ ID NO: 243762 - DNA, 4200 bp, Artificial Sequence
  Description of Artificial Sequence: Synthetic coding sequence
atgaagtcctcagggccagtagaacgcttgctgagagcactgggacgtagagactcctctcgtgccgcttcccgccctcgtaaagccgagcctcactcttttcgggagaaggtgttccggaaaaagccgccagtgtgtgccgtgtgcaaagttacgattgatggtactggggtttcatgccgtgtctgcaaggtggccacccatcgaaagtgcgaggcgaaagtcacatccgcatgtcaggcccttcctcctgtggagctccggaggaatactgccccagtcaggagaatcgagcacttgggttctaccaaaagcctaaaccacagcaaacaacggtcaactcttcctcgttctttcagtctagacccgctgatggagagaagatgggacctcgacctcacatatgtaacagagaggattctagctgcagcctttcctgcacgcccagatgaacagcggcacagaggccacctgagagagctggctcacgtgctgcagtctaagcatagggacaagtacctgctatttaatctgtcagagaagcggcacgaccttaccaggctaaatccgaaagtgcaggattttggatggcccgaactgcacgccccacctctggataaactgtgttcaatctgtaaggctatggagacctggcttagcgcggacccgcagcacgtggtagtgctgtactgtaaagggaataagggtaaactgggcgtcatagtatcggcatacatgcattattccaagattagtgccggagcagatcaggcacttgccacacttaccatgaggaagttctgtgaggataaggtggctacagaattacagccatcacaaagacgttatattagctatttctcagggctgttgtcaggctcaatccgaatgaactcctctcctctatttttacactacgtccttatcccaatgttacccgctttcgagccaggaaccggattccagccttttctcaagatctatcagtccatgcaactcgtgtacacgtctggtgtgtatcatatagcgggtcctggcccacagcaactctgcatctctctggaacccgctcttctccttaagggtgacgttatggtgacatgttatcataaaggaggtcggggaactgacagaacgcttgtgttcagagttcagtttcatacatgcactatacatgggcctcagctcaccttccccaaagaccagttggacgaggcgtggacggacgaaagatttccttttcaggcatcagtggagtttgttttctcaagttctcccgaaaaaatcaagggatctacgcccagaaacgacccatctgtgagcgtcgattataacaccaccgaaccggcagtgaggtgggactcatatgagaattttaaccagcatcatgaagatagcgttgacggctcactgactcacactcgtggccctttggacggtagtccatacgcccaggtgcagagacccccaaggcagacccccccagcaccgagccctgaaccgcctccaccacctatgctgagtgtgtcttccgactctggccatagttcaactttgacaactgaaccagccgctgaatcccccggacgaccaccccctacggcagcggaaaggcaggagctcgatcggcttctaggcggttgtggggtggcctccgggggtcgaggcgcaggacgcgaaaccgccatcctcgacgatgaggagcaaccgaccgtgggaggcggtcctcatctaggcgtgtacccgggacaccgccctgggctgagccgacactgcagctgcagacagggatatcgcgaaccttgtggggtccctaatggcggatattatcgtcccgagggaacactggaacgtcggagactcgcttatggcggatacgagggttcacctcaggggtatgcggaagcaagtatggagaaaagaaggctgtgccgttccctgtccgagggtctgtatccttacccacctgagatgggaaagccagcaacaggtgacttcggctaccgggctccagggtacagggaggtggtgattctggaggatcctggattaccggcactgtacccttgccccgcttctttgtacggcctgcggcttgaacgtgaggcaggcgagggatgggcctcagaagccggaaaacccctgctccaccctgttaggccgggtcatcctctccctctgttgctgcccgcttgcggacaccatcatgcccctatgcctgattacagttgtctaaagccaccgaaggccggtgaagaagggcacgagggctgctcgtacactatgtgtcctgagggcagatacggccatccgggatatccagccttagtgacatacagttacggaggagctgtaccatcttattgccccgcttatgggcgtgtcccacactcctgtggaagtccaggagaagggaggggatacccaagtccaggggctcactcaccgagggcaggtagcattagtccgggaagtccaccttatccccaatctaggaagcttagctacgaaatacccaccgaagaggggggtgaccggtatccgctcccaggccatctcgctagtgccggacccctggcctccgccgaaagtcttgagcctgtctcatggagagaaggacccagcgggcatagcacactgccgaggagtcctagggacgcaccttgttccgcctccagcgagctgtccggcccatctactcctctccacactagctctccagtccaggggaaagaaagcacccgtaggcaggacactcgttccccaactagcgctccaacgcaacgactatctccaggcgaagcgctgccacccgtgagccaagccggaaccggcaaagcccctgagctgccatcggggtcaggcccagagcctcttgcaccttcacccgtgtctcccaccttcccaccaagctcacctagcgattggccccaggaaaggtcacccggaggacactcagatggggcttcacctcgaagcccagtacccacgactctccccggactaagacacgccccatggcagggacccagggggcctccggattccccagacggctcacctttaacgccagttccaagccagatgccttggctggtcgcctcccccgagccaccacagagtagccctacccccgctttccctctcgctgccagctacgataccaacggcctgtcccagccaccactacctgaaaaacggcaccttcctggtcccggacaacagcctggcccttggggcccagaacaggcgagctcgccagcgcgtggaatctcccaccatgttacctttgcccctctgctttctgataatgttcctcagacaccagaaccgccaacccaggagtctcaaagcaatgtgaaatttgttcaggacacttccaagttttggtacaagccacatctatcgcgggaccaagctattgctttgttgaaggataaagaccctggggctttcctgatacgcgacagtcattccttccagggcgcttacggactggcactgaaggtcgcaactcctccaccttcagcgcagccttggaagggcgaccccgtggaacagttggtgcgtcactttctgattgagactgggccaaagggcgtgaaaatcaaaggatgcccgtccgaaccatacttcggtagtctttccgctttggtgtcccagcacagcatcagccccatcagcctgccatgttgccttagaattccaagtaaagatccactagaggagacaccggaggcaccagtccctacaaacatgagtacggccgctgacttgctgcgccagggcgctgcgtgttccgtgttgtatctcacaagcgtggaaactgagagcttaaccggaccgcaggcggtggcccgagcttcaagcgctgcattgtcctgttccccaaggcctacacccgcagtcgtacactttaaggtgagcgcccaagggatcacactgaccgacaatcagcgcaaattattttttcgtagacactatccagtgaacagcatcacattttcaagtaccgatccccaggatcgacgctggaccaacccagatgggactacatctaagattttcggattcgtggctaaaaaacccggatccccatgggagaatgtgtgtcacctctttgcagagctggacccagatcagcccgctggagctatagttacctttatcaccaaagtgcttctcggacagagaaaatag

SEQ ID NO: 243763 - DNA, 567 bp, Artificial Sequence
  Description of Artificial Sequence: Synthetic coding sequence
atggattgccggaagatggctcggttttcctatagcgtgatctggataatggccatatctaaggtcttcgagctcggtttagtggccggactagggcaccaggagttcgcacggccaagtcggggttatttagcgtttagggatgattcaatttggcctcaggaggagccagcaattaggcctaggtcgtctcagcgcgtaccaccaatgggtatccagcactcaaaagaactgaacaggacctgttgcctgaacggtgggacatgcatgctgggctcattttgcgcctgcccccctagcttctatgggaggaattgcgagcacgacgtgcggaaagagaactgcggctctgtgccgcatgatacctggctccctaaaaaatgctcgctgtgtaaatgctggcacggccaacttagatgtttcccccaggcatttctcccgggatgcgatggacttgtgatggatgagcacctggtggctagtcggacccccgagcttcccccatctgccagaacgacaaccttcatgctcgtgggtatttgtctgtctatacagagctattactag

SEQ ID NO: 243764 - DNA, 519 bp, Artificial Sequence
  Description of Artificial Sequence: Synthetic coding sequence
atggctatctcgaaggtgtttgagctgggtctcgtcgcaggcttagggcatcaggagttcgctcggcctagtcgcggatatttagcctttcgcgacgactctatatggcctcaggaggaacctgccattcgccctaggtcatctcagagagtgccgcctatgggtatccagcattctaaggaactgaacaggacatgctgtctcaacggcggaacttgcatgctagggagcttctgtgcgtgcccgccttcattttacggtcggaattgcgaacacgacgtgcgcaaagaaaattgcggatctgttccacatgacacttggctgccgaagaagtgctctctctgtaagtgttggcatggccagttgaggtgcttcccccaagccttccttcctggctgcgatggtctggtcatggacgagcacctagtggcctcccgcacccccgagcttccaccttccgctagaactacaacctttatgttagtgggcatctgcctctcgattcagtcttactactag

SEQ ID NO: 243765 - DNA, 645 bp, Artificial Sequence
  Description of Artificial Sequence: Synthetic coding sequence
atgggtgcggctcactcagccagtgaggaggtgagagaactggaaggtaagactggcttctcgtcagatcaaatcgagcagcttcatcgaagattcaagcaactgagtggggaccagccgactatcagaaaggagaattttaataacgtgccagacctggagctgaatccgattcgaagtaaaattgtgcgggcattttttgacaaccggaacttgcgaaagggaccttccggtctagcagatgagattaacttcgaggatttcctgacaataatgtcatattttaggcctatcgataccacaatggatgaggagcaagttgagctctcccggaaagagaaactgaggttcctgtttcacatgtacgactctgactcagacgggcgtatcaccctcgaagaataccggaacgtggtcgaggagcttctgagcggcaacccccacatagaaaaggagagcgctcggtcaatcgctgacggagccatgatggaggcagcgagtgtttgtatgggacaaatggagcctgaccaagtatacgaaggcatcacttttgaggactttttgaaaatctggcagggaatagatatcgagacaaagatgcatgtgaggtttttgaatatggagacaatggccctgtgccactag

SEQ ID NO: 243766 - DNA, 804 bp, Artificial Sequence
  Description of Artificial Sequence: Synthetic coding sequence
atgagacccagaagcggacctactcggaatcccaggttgagggcatttgctggggtgcctactcgcggacggactaggggccagtcacggagatgcgctgcggaagcatccgccggacccgagcgcgatgctcgtccgggtgctcctgccgcagggaccatgggtgccgcacatagcgcttcagaggaagtgcgcgagcttgaggggaaaaccggattcagttctgaccaaatcgaacagctccaccggagatttaaacagttgtcaggagaccagccaaccattcgtaaggagaattttaacaacgtgccagatttagagctgaatcccatcaggtcaaagatagtcagggccttctttgataatcgaaatctgcgcaagggcccttctggccttgcagacgagattaacttcgaggacttcctgactatcatgagctactttcgacccatcgataccacgatggacgaggagcaagttgagttatctcggaaagaaaaactcagatttctttttcacatgtatgactcagattccgacggacgcattaccctggaagaatacaggaacgtggtcgaagagctcctgtctggtaatccccacatcgagaaggagagtgcacgaagcatcgcagacggtgccatgatggaggccgcaagtgtgtgcatgggacagatggagcctgaccaggtatacgaaggcataacatttgaagacttcctgaaaatttggcaggggattgacattgagacgaaaatgcacgttaggttcttaaatatggagactatggcattgtgccactag

SEQ ID NO: 243767 - DNA, 564 bp, Artificial Sequence
  Description of Artificial Sequence: Synthetic coding sequence
atgggggctgcccactctgccagcgaagaggtcagggagctggagggaaagactggcttcagttcagaccagatcgaacagttgcatagaagattcaaacagctcagtggggaccagcctaccattagaaatctgcggaaggggccatctggactggccgacgaaattaacttcgaggatttcttgacaatcatgagctatttcaggccaatcgatacgactatggatgaagaacaagttgaactgtcccgcaaggagaaactacgctttttatttcatatgtacgattcggattctgatggtaggatcactctcgaggaatataggaacgtggttgaggaactgctttccggcaacccacacatcgagaaagaaagcgcaagatccatcgccgatggcgctatgatggaggccgcatcagtgtgcatgggacaaatggagcccgatcaggtctatgagggtataactttcgaagacttcctaaaaatttggcagggaatcgatatagagaccaaaatgcacgtgaggtttctgaacatggaaaccatggctttgtgtcactag

SEQ ID NO: 243768 - DNA, 1266 bp, Artificial Sequence
  Description of Artificial Sequence: Synthetic coding sequence
ttgaatctcgaagttaagtttaaaaaaatgggtctgggccatgagcaaggttttggagcgccatgcctgaagtgcaaagagaagtgcgagggtttcgagcttcacttctggcgaaagatttgtcgaaactgcaagtgcggtcaagaggagcacgatgttctgttaagtaacgaggaggaccgtaaggttggtaaactctttgaagacactaagtatacaacacttatagccaaactaaaatctgacggtatccctatgtacaagcgcaatgtgatgatccttaccaatcctgtcgctgctaaaaaaaatgtcagcattaacactgtgacgtatgaatgggccccaccagtgcagaaccaggccctggcacgccaatacatgcaaatgctacctaaagaaaagcagcccgtggcaggcagcgaaggggcacagtacaggaagaagcagcttgcaaagcagctgccagcccacgaccaagacccatctaaatgtcacgaactgtctccacgcgaagtgaaggagatggagcagtttgttaaaaaatataagtcggaggcattaggggttggggacgtgaagctgccttgcgaaatggatgctcaaggcccaaaacagatgaacatcccgggaggtgataggtctacccccgctgccgttggggctatggaagacaagtctgccgagcacaagcgcacacagtacagctgctattgctgtaagttgtctatgaaggaaggtgatccagccatttatgcggagcgcgctggatacgataaactgtggcatcccgcttgctttgtttgttctacgtgtcacgagctgctggtcgatatgatctacttctggaaaaatgaaaagctgtactgcgggcgacattactgcgattctgaaaaacccaggtgtgcagggtgcgacgaattaatttttagtaacgagtatacccaagcagagaaccagaactggcacttaaaacatttttgctgctttgattgcgactctattttggccggagagatctacgtgatggtcaacgacaaaccagtttgtaagccctgttatgttaaaaatcatgctgttgtatgtcagggctgtcataatgccatcgatccggaggtgcaaagggtcacttacaacaatttttcatggcatgcgtctacagagtgctttctttgctcatgttgtagcaagtgccttatcggacagaaattcatgcctgtagaggggatggtattttgctcggtcgagtgtaaaaagcggatgtcttag

SEQ ID NO: 243769 - DNA, 1266 bp, Artificial Sequence
  Description of Artificial Sequence: Synthetic coding sequence
atggatttagaaaacaaggttaagaagatggggctcggacacgaacaggggtttggagctccttgcttgaagtgtaaagaaaaatgcgaaggcttcgagctgcacttctggagaaaaatttgccgaaactgtaagtgtggtcaggaggaacatgatgtacttctcagtaacgaggaagacagaaaagtaggcaagctgtttgaggacactaagtatacaacactgattgccaaacttaagtcggatggcattcccatgtacaaacggaacgttatgattttgacgaacccagtagcagccaagaagaacgtcagcataaacaccgtaacctacgaatgggcgcctccggtgcagaaccaagcgctggcacgccaatacatgcagatgctacccaaagaaaagcagcctgttgccggaagcgagggagcccagtatcgaaagaagcaactggcgaaacagctacccgcacacgaccaggacccctcaaaatgtcacgagctaagcccacgcgaggtgaaggagatggagcaattcgtaaagaagtacaaaagcgaggccttgggtgtcggtgatgtcaagctgccttgcgaaatggacgcccaaggtcccaagcagatgaacatccctggaggggatagaagcacccccgctgccgtcggagccatggaagacaaaagtgctgagcataaaaggacacagtattcttgctattgttgcaagctctccatgaaggaaggggaccccgcaatctatgccgaaagagccggatacgacaaactgtggcaccctgcctgcttcgtgtgcagcacttgccacgagctacttgtggatatgatctatttctggaagaatgaaaaactctactgcgggcgtcattattgcgatagcgagaaaccaaggtgtgcgggatgcgacgagctcatttttagcaacgaatacacccaagccgagaatcaaaactggcatctgaaacacttttgctgttttgactgtgacagcatcctggctggcgaaatctatgtcatggttaatgacaagccggtatgcaagccttgctatgtgaagaaccatgcagtggtgtgtcagggatgccataatgcgatcgatccggaggtacagcgggtcacctacaacaacttttcatggcacgcaagcactgagtgtttcctatgctcttgctgctctaagtgtttaattggccagaagtttatgccagtggagggcatggtattctgctccgtcgagtgcaaaaagcgaatgtcctag

SEQ ID NO: 243770 - DNA, 1239 bp, Artificial Sequence
  Description of Artificial Sequence: Synthetic coding sequence
atggggctggggcatgagcagggctttggcgctccatgcctgaagtgtaaagaaaagtgcgagggattcgaattacatttctggcggaaaatttgtcggaactgtaaatgcggccaggaagaacatgacgttttgttgtctaatgaggaagatagaaaagttggcaagctgttcgaggacaccaagtacacgaccttaatagcgaaattaaaatccgatgggattccaatgtacaaaaggaacgtaatgattcttaccaacccagtggccgctaagaaaaatgtcagtataaatactgtcacctatgagtgggccccaccggtccagaaccaggcattggccagacagtacatgcagatgctgcccaaagagaagcaaccggtggctgggtccgagggagcacagtatcggaaaaagcagctggccaagcagttgccagcacacgatcaggatcccagcaagtgtcatgaactctcgccacgagaggtgaaggagatggagcagttcgtcaagaagtacaagtccgaggctctgggagtcggagacgtgaagttaccttgtgagatggacgcccagggcccaaaacaaatgaacataccgggtggggatcgttccacacccgcagccgttggtgctatggaagacaaaagcgccgagcataaacggacccagtacagctgctactgctgtaaacttagcatgaaggaaggggatcctgctatttacgccgaacgagccggttacgataaactgtggcacccggcttgtttcgtctgctctacctgccacgagctgttggttgatatgatttatttctggaagaatgaaaagctgtattgcggacgccactattgcgactcagagaaacctaggtgcgccggatgtgatgagcttatttttagcaatgagtacacccaggcagaaaatcagaattggcatctgaaacatttctgttgctttgattgcgatagtattctcgccggtgagatttatgtgatggtaaatgacaagcctgtgtgtaaaccctgctacgtgaaaaatcacgccgtcgtgtgtcagggctgtcataacgccatcgaccccgaagtgcaacgggttacgtataataatttctcctggcatgcctcaacggaatgcttcctgtgttcctgctgttccaagtgtctgatcgggcagaagtttatgcctgtggaaggtatggtgttctgcagtgtcgaatgtaaaaaaaggatgagctag

SEQ ID NO: 243771 - DNA, 540 bp, Artificial Sequence
  Description of Artificial Sequence: Synthetic coding sequence
atgaaagaaggagatcctgccatttatgccgagcgcgcaggctacgataagttatggcacccagcctgctttgtatgtagcacctgccacgaattgctggtggacatgatctatttttggaaaaatgaaaagctctactgtggcaggcactattgcgacagcgagaaacccaggtgtgccggatgcgatgagctcatcttttcaaacgaatacacgcaggccgagaaccagaactggcatttgaagcatttttgctgttttgactgcgactccattctggcaggagagatctatgtaatggtgaacgacaagcctgtctgcaaaccatgttatgtgaagaatcatgccgtcgtgtgccagggctgccacaacgctatagatccggaggtgcagcgggttacctataacaacttcagctggcacgcatcaaccgagtgttttctctgcagctgttgttccaagtgtctgatcggacaaaagttcatgcctgtggaagggatggttttctgctccgtggagtgcaaaaaaaggatgtcctag

SEQ ID NO: 243772 - DNA, 804 bp, Artificial Sequence
  Description of Artificial Sequence: Synthetic coding sequence
atgggtgccaggcaaatccagaccagctcgagtcaaacctcacccgaagaggctatgggcacacccaggatccagcacctgcttatcttgctggtgctgggcgctagtcttcttacatccggcttagagttatactgccagaagggcctctctatgaccgtcgaagcagaccctgcaaacatgttcaactggactaccgaagaagtggaaacctgcgacaagggcgctttgtgccaggagactatcttgattatcaaggcaggcaccgagaccgccattttggctaccaaaggatgcatcccagagggagaagaagctattacaatcgttcaacactcaagccctcccggtctgatcgtcacatcttactccaactattgtgaggactctttttgcaatgacaaagactctttgagccagttctgggagttttccgagaccaccgcctccaccgtaagcacaaccctgcactgccctacatgcgtggccctcggaacatgcttctctgccccaagtctcccatgtcccaacggcactaccagatgttatcaagggaagttggaaattactggcggaggcattgagagctcagtcgaagtgaagggatgtacagccatgatcggctgtcgactcatgtcaggaattctagccgtgggcccaatgttcgttcgggaagcctgcccccaccagttactgacacagccccgtaaaaccgaaaacggcgctacttgcctgcccattccagtgtggggcctgcaactcttgctgcctctgctgttgccatccttcatccatttctcatag

SEQ ID NO: 243773 - DNA, 789 bp, Artificial Sequence
  Description of Artificial Sequence: Synthetic coding sequence
atacagacctcgtcttcccagacaagtccagaggaagcaatgggcacccccaggatccagcacctgctcatcctcttggtgttgggtgcttccctgcttacttcagggcttgagttgtactgtcaaaagggcctgagcatgaccgtggaggcagaccctgccaacatgttcaattggacgaccgaggaggttgagacttgcgacaagggcgctttgtgccaagaaacgattttgatcatcaaggccggaactgaaaccgcaatcctcgctaccaagggatgcatcccagagggagaagaagctatcacaatcgtgcagcactcatctcctcctggtctcatcgtgactagctactccaattactgtgaagattctttttgcaacgataaagatagccttagtcaattttgggagttctctgaaaccactgcaagcactgtatccacgacactacactgcccgacctgtgtagcacttggaacctgtttttctgctccctcattaccctgcccgaatggtacgacaagatgctaccagggaaaacttgaaatcacaggcggaggtatcgagagctctgttgaagtgaaagggtgcaccgccatgattggctgccggctaatgtccggtattctggcggtcgggcctatgttcgtgagagaggcttgtccccaccaactgctgacgcagccccgaaagacagaaaatggtgccacctgcctgccaataccagtgtggggcctgcagctcctgctgccattattactgcccagttttatccatttcagttag

SEQ ID NO: 243774 - DNA, 750 bp, Artificial Sequence
  Description of Artificial Sequence: Synthetic coding sequence
atggggacccctagaatccagcacctgctcatccttttggtgctgggcgcttcgctgctgacttcaggactcgagttatattgccagaaggggttgagcatgacagtggaggctgatcctgccaacatgtttaactggacaacagaggaagtggaaacatgtgataaaggtgccctgtgtcaggagacaatcctgataataaaggctggcaccgagacagccatcctcgccactaagggatgcattccagagggagaagaagccattacgatagtgcagcattcgagtccgcctgggctcattgttacttcctattcgaactactgtgaagatagcttttgcaatgataaggattctctaagtcagttttgggagttttcagagacgactgcctcaaccgtgagtaccacgctccactgtccaacatgcgtggctctcggtacctgtttctctgctccatccctcccctgtcctaatgggacaaccaggtgttatcagggaaagttggagatcactgggggtggcattgagtcttccgtggaagtgaaaggttgcaccgccatgatcggctgtagactgatgagcggcattctcgctgtgggcccaatgtttgtccgcgaggcctgcccccaccagctgctcactcaaccacgcaagaccgaaaacggcgctacctgcttgcccattcccgtgtgggggctgcagctcctgcttcctctgctgttaccatcttttatacacttcagttag

SEQ ID NO: 243775 - DNA, 804 bp, Artificial Sequence
  Description of Artificial Sequence: Synthetic coding sequence
atgggcgctcgccagattcagactagtagtagccagacaagccccgaagaggctatggggacacctcgcatccagcacttgctgatattactggtactcggcgcttcgctactgacatccggtctcgagctgtattgccagaaggggctcagtatgacagtggaagccgacccagcaaacatgtttaattggacaactgaagaggtggaaacatgtgataagggtgctctgtgccaggagaccatcctcattatcaaagcaggaacggagaccgcaattttagccaccaagggatgtatccccgagggagaggaggcgatcactatagtgcagcatagcagcccccctgggctaatcgttacatcttatagtaactactgcgaggattccttctgtaacgataaggatagcctttcccaattctgggagtttagtgagacaaccgcttctaccgtttctactactctgcattgtcccacctgcgtagccttgggcacctgtttcagtgccccatctctgccttgcccaaacggtactactcgctgctatcagggaaaactggagatcacagggggaggtatcgagtctagtgtggaggtgaaggggtgcactgccatgataggttgtagactgatgagcggcatactggcggtgggacccatgtttgtgagggaggcgtgcccccaccaactgcttacacagccacgcaaaaccgaaaacggcgcaacttgcctgcccatccctgtgtgggggctgcaactcctcctgcctttgctcctccccagctttattcacttctcctag

SEQ ID NO: 243776 - DNA, 2823 bp, Artificial Sequence
  Description of Artificial Sequence: Synthetic coding sequence
atgattagtgcccactgtaacctacgtctgctttgttcttctgacagctcagcctcggcctcccaagtggctggaactacagaagtggtggaaaatcttgttactaacgataattctcctaacatccctgaggcaatcgaccgcctgttttctgatattgccaatataaaccgggagagtatggcagaaattacagatatccagattgaagagatggccgtgaacctctggaattgggcgttgaccattggaggcggatggctagtgaatgaagagcagaaaattcgcttacactatgtagcctgcaagctgttgtccatgtgcgaggctagtttcgctagcgagcagtccatccagaggctcatcatgatgaatatgagaatcgggaaggagtggctggatgccggaaacttcctgatagccgatgagtgttttcaggcagcggtagcttctctggagcagttatacgtcaagctcatacagcggagtagtccggaggccgacctaaccatggagaagattactgtggagtctgatcactttcgagtgctgtcataccaggccgaaagtgccgtggctcaaggggacttccagagagcctcaatgtgtgtgttacagtgcaaagatatgcttatgcgactgccgcagatgaccagcagtctgcatcatctttgctataatttcggcgtagaaacacagaaaaacaataaatatgaggaatcgtccttttggctgtcgcagagctacgatataggtaagatggacaagaagagcacgggcccagagatgttagcgaaggtgctccggttattagccacaaactacctggattgggacgacacaaagtactatgacaaggctcttaacgcagtaaatttagccaacaaggaacatctgtcaagccccggactattccttaaaatgaagattctactgaagggggaaacctccaatgaagaattacttgaggctgtcatggagatattgcacctggacatgcctctggacttttgtcttaacatcgccaaactgctgatggatcacgagagggaatctgtcggatttcattttctcaccattatccatgagcgattcaagagttctgaaaatatcggaaaggtgctgatccttcataccgatatgctattgcagcggaaagaagagctgttagcgaaagagaagatcgaggaaattttcctggctcaccagacaggtcgccaactgacagccgaatcgatgaattggctccataatattctgtggagacaggctgcaagcagcttcgaggttcagaattatacggacgctctacaatggtattactatagcctgcgcttttactcaacggacgagatggacctcgacttcaccaagctccagaggaatatggcatgctgctaccttaatttacaacagctagacaaagctaaggaggccgttgccgaagctgaacgccacgaccccagaaacgtgttcacgcagttttacatttttaaaattgcagtcatagagggaaattccgagagggctttgcaggcaattatcaccctggaaaatatcctgacggatgaagaatccgaggacaacgaccttgtggctgagaggggttctcccactatgttgctttctcttgctgcacagtttgctctcgaaaacgggcagcagattgtcgctgaaaaggccctggaatatctcgctcagcactcagaggaccaggaacaggtcctgacagctgttaagtgcctgctgcggttcctgttgcctaagatcgcggagatgccagaaagcgaagacaaaaaaaaagagatggataggctcctcacatgcctcaatagggcattcgttaaactctcccagcccttcggcgaagaggcactgagcttggaaagtagggccaacgaggcacaatggtttagaaagaccgcttggaacctggccgtgcagtgtgataaggatcccgttatgatgcgagagttcttcatcctgtcctataagatgagccagttttgccccagcgaccaagtgattctgatagctcggaaaacctgtctattaatggccgtggcggttgacctggagcaggggcgaaaagcttccaccgcattcgaacagactatgtttctgtctagagcactggaagaaatccagacttgtaatgacattcataactttttaaaacagacaggaacattctctaatgacagctgcgagaaactgctgctgctatatgaattcgaggtgcgggctaaactgaacgaccccctgttagaaagcttcctggagtcagtgtgggagctgcctcatctggagaccaagacctttgagactattgccattattgcgatggaaaagcccgctcactaccctctgatagcgctcaaggcacttaaaaaggctctgcttctctacaaaaaggaagagcctattgatatttctcaatatagtaaatgtatgcacaatctggtcaacctgagcgtccctgacggagcaagcaacgtggagctgtgccccctggaagaggtgtggggctactttgaagacgctctgagccacatctcacgaacaaaggactaccccgagatggagatcctttggctgatggtgaagtcttggaacacaggtgtcttgatgttcagtaggtcaaagtacgcctcagcagagaagtggtgtggactcgccctgaggttcctaaatcatctgacaagcttcaaggagagttatgaaacccaaatgaatatgctttattcgcagctagtcgaggcattgagcaacaataaaggccctgtatttcacgagcatggctattggagcaaaagcgactag

SEQ ID NO: 243777 - DNA, 1848 bp, Artificial Sequence
  Description of Artificial Sequence: Synthetic coding sequence
atggagatcctgcacctagatatgccacttgacttttgtctgaatatcgctaagctgttgatggatcacgaacgggagagcgtgggcttccactttctgaccatcattcatgaaagattcaaaagctcagagaatattggcaaagtactgatccttcataccgacatgcttctccagagaaaggaggaattactggctaaagagaagatcgaagaaatcttcctcgcccaccagaccggtcggcagctgacagcagagtcaatgaactggctacacaacatactctggaggcaagctgcatccagtttcgaagtgcagaactatactgatgctctccagtggtactattattcactcagattctattcaaccgacgagatggacttggactttaccaagcttcagcgtaacatggcttgctgttaccttaatctccagcagctcgataaagcaaaggaggctgtagcagaagccgagcgccacgaccctcgtaacgtgtttactcagttttatatctttaaaatagccgtaatagaggggaatagcgaacgggcactacaggcaatcattactctggagaatatcttgaccgatgaagagtctgaggataacgacctggttgccgaacgcggaagtcctaccatgctgctgtccttggcagcccagttcgcattggagaacggacagcagatagtggcagaaaaggctctcgagtatttagcccagcacagtgaggaccaggagcaggtgctgaccgccgtcaagtgcctgctccggttcttgctgcctaaaatagcagaaatgccggaaagtgaagacaagaagaaggagatggacaggttgctgacatgtctgaaccgggcatttgtgaaacttagccaacccttcggtgaggaagccctgagcttggagtctcgggcaaacgaggctcagtggttccgcaagaccgcctggaatctggctgtgcagtgtgacaaagaccctgtgatgatgcgggagttcttcatacttagctataaaatgtcccaattctgccctagtgaccaagtgattcttatcgcgaggaaaacctgcctgttgatggcagtcgccgtggacctggaacaaggtcgcaaggctagcactgccttcgaacagacgatgttcctcagtcgcgcattggaagaaatccaaacctgcaacgatatacacaattttcttaaacagaccggcactttctccaatgacagttgtgagaagcttctgcttctctatgagtttgaggtccgggctaaactaaacgacccccttctggagagtttccttgagtccgtgtgggagttgccccatctggagaccaaaacattcgagactatagcaatcatcgcgatggagaagccagcccactatcccttgattgccttaaaggcgctgaagaaagccttgctgctttacaaaaaggaagagcctatcgatatctcacagtattcaaagtgcatgcataatctcgttaacttgtcggttccagacggtgcttcaaatgtggagctgtgcccgttagaggaagtgtggggctattttgaagatgcactgagtcatattagtcgcaccaaggattacccagaaatggagatactgtggctgatggtcaagagctggaataccggagtcttgatgttttcacgctcgaagtatgccagcgccgaaaaatggtgtggactggctctgcgcttccttaatcatcttactagcttcaaagagtcttatgaaacccagatgaacatgctgtacagtcagctggtcgaggcactgtctaacaacaaaggcccagtttttcatgaacatgggtactggtctaagagcgactag

SEQ ID NO: 243778 - DNA, 2778 bp, Artificial Sequence
  Description of Artificial Sequence: Synthetic coding sequence
atggacaatgatgacttcttcagcatggactttaaggaggtggtggagaacttagttactaacgacaactctcccaacattcctgaagcgatagaccggttattctccgatatcgcaaatattaatcgcgagagcatggccgaaatcacggacattcagatagaggaaatggctgtgaacctgtggaattgggcattaaccattgggggaggttggttggtcaacgaggagcaaaaaatacggctgcattatgtcgcctgtaagctgctgtcaatgtgcgaggccagttttgctagtgaacaaagcattcagaggctgatcatgatgaatatgagaatcgggaaagagtggttggacgcaggaaattttctgatcgccgacgagtgttttcaagccgctgtcgccagcctggagcaactctatgtcaagctgattcagagaagttcacctgaagcagatctgaccatggaaaagataaccgttgagagcgaccacttcagggtcctgtcatatcaagccgaatcagctgtggcacagggggactttcagagagcctctatgtgtgtgttgcagtgtaaagacatgctgatgcgcttgcctcagatgacaagctctctgcatcacttgtgttataacttcggggtcgagacacagaaaaataataagtatgaggagtctagtttctggttgtctcaaagctatgatatcggaaaaatggataaaaagtctacaggccctgagatgctagcaaaagtactgagactcctggcaacaaactatcttgactgggacgataccaaatactacgataaggcactcaatgcagtgaacctcgcgaacaaggaacacctgtccagccccggactctttctgaagatgaagatcctgctcaaaggcgaaacctcaaacgaggagctactggaagcagtgatggaaattctccatctggatatgcccctagacttttgcctcaacatcgcaaaactgttgatggaccacgaaagggaaagcgtgggatttcacttcctgactattatccatgagagattcaaatccagcgagaatatcggtaaagtcttgattctgcacacagacatgctattacagcgcaaagaagagctcctcgcaaaggagaaaatcgaggagatcttcctggcccatcagacaggcaggcagttaacagccgaatccatgaactggctgcataacatcctttggcgtcaggccgcttcttcattcgaggtgcaaaactacacggatgccttgcaatggtattattactccctcagattttactcaaccgacgagatggacttagatttcactaagctccagcggaacatggcctgctgctatctaaacctacaacagcttgacaaagccaaggaggccgttgcggaggcggagcgtcacgatcccagaaacgtgttcacccagttctacatttttaagatagccgtcattgaggggaactctgagagagccctgcaggctataatcaccctggaaaacattcttactgatgaagaatcagaagacaatgacctcgtcgcagagagagggtctcctactatgcttttgagtctcgcagcacagttcgcccttgagaatggacagcagatcgtggcagagaaagccctggaatacctggctcagcatagcgaagatcaggagcaggtgttgaccgccgtcaaatgcttgcttcgctttttgctccctaagatagctgaaatgcccgaatcagaagataaaaaaaaagaaatggacaggctgcttacttgtctaaaccgggcattcgtgaagcttagtcagccttttggcgaggaggcgctttcactcgagtccagggccaatgaagctcagtggtttaggaaaacggcttggaacctagcagtccagtgtgacaaggatcccgttatgatgcgagagtttttcatactttcttataagatgtcccagttctgcccatcagatcaggtgattctgatcgcgaggaagacttgcctgttaatggctgtcgccgtcgacttagaacagggccgaaaggccagcacagctttcgagcaaaccatgtttctgtccagagcactggaggaaatacagacatgtaacgatatccataacttcctcaagcagactgggaccttttccaacgactcttgcgagaaactccttctcctgtacgaatttgaggtccgagccaaactcaatgatccgctgttggaatcttttcttgaaagcgtctgggagttacctcatctagagaccaagaccttcgagacgatcgcgatcatagccatggaaaagcctgcccactacccacttattgccttgaaggctttaaagaaggccctgcttctgtacaagaaagaggagccaatagacatcagccagtactcgaagtgtatgcataacctcgtgaacctctctgtcccagatggggctagcaatgtggagctgtgccctctggaagaggtctggggctactttgaggatgcgttgtcccacatttcaagaacaaaagactaccccgagatggagatattgtggctgatggtcaaaagttggaataccggtgttttaatgttctctcgatctaaatatgcctctgcagaaaagtggtgtggcctcgcgttaagattcctgaaccacttaacatccttcaaagagtcctacgagacccagatgaatatgctctatagccagctggtggaagcactgtcgaacaataaggggcctgtcttccacgagcacggctactggtctaagtcggactag

SEQ ID NO: 243779 - DNA, 2823 bp, Artificial Sequence
  Description of Artificial Sequence: Synthetic coding sequence
atgattagcgcacactgcaatttgaggctcctgtgctcttccgacagctcagccagcgcctcccaggttgccggaacaacagaggttgtagagaacctggttacgaatgataactcccccaatatacccgaagctatcgaccggctgtttagcgacatagccaatattaatagagagtctatggctgaaattaccgacattcagattgaggagatggctgtcaacctgtggaactgggccttgacgattggaggcggatggctggtcaacgaggaacagaaaatcaggttgcactatgtggcttgtaaattattgagcatgtgcgaggcaagctttgccagcgaacagtccatccagcgattgatcatgatgaatatgagaattggcaaagagtggctggatgccggaaactttctcattgcggacgagtgcttccaggccgctgtggcaagtctcgagcagctgtatgtaaagctgatccagcgaagttcccccgaagccgatctgactatggaaaaaatcaccgtagagagcgaccatttcagggtgctctcatatcaggcagaatccgccgtggcacaaggagacttccagagggcatctatgtgcgtcttgcagtgcaaagatatgctaatgcgccttcctcaaatgacgtcctctctgcaccatttgtgctataattttggcgttgagacacagaaaaacaacaagtatgaagagagttctttctggctgagccaatcatacgatatcggaaagatggacaaaaagagtacaggccctgaaatgctggccaaggtgcttcgtttgctggccacaaactacctggattgggacgataccaaatactatgacaaagcccttaacgccgtgaacctggcaaacaaggagcacctgagcagccccggtctcttcctgaaaatgaagatccttctgaagggggagacatctaatgaggaactgctggaagcagtgatggagattctgcacttggacatgcctctcgatttttgcctcaatatcgccaaacttctgatggatcatgaacgggaatcagtcggatttcatttcctcaccattatccacgaacggtttaaaagctctgaaaacattgggaaagttttaatattgcatacagacatgctgctgcaacgtaaagaggagttgcttgccaaagaaaaaatcgaggaaatttttctcgcccaccagaccggacgccagcttacagctgaatccatgaattggctccataacattctctggaggcaggccgcaagcagttttgaagtgcagaactacacggatgccttgcaatggtactattatagcctgaggttttattcaaccgacgagatggacttggattttaccaaactgcagagaaacatggcctgctgttatctgaaccttcaacagctggacaaagccaaggaggccgttgcagaggccgagcgacacgatccccgtaacgtcttcacccagttttacattttcaagatcgcagttatcgaggggaatagtgaacgggcactccaggctatcatcacattggaaaacattctgaccgatgaggagagcgaagataacgatctggttgcggaacggggatctccaaccatgttgctctctctggccgcacagtttgcactcgagaatgggcagcagattgttgctgaaaaggctttggaatatttggcacaacattctgaggaccaagaacaagtgttgactgccgtaaaatgcctcctgcgtttcctgctgccaaaaatcgctgaaatgcccgagtcagaggataagaaaaaagagatggataggctgttgacttgcctaaatcgcgcttttgtgaagctcagtcagccttttggcgaggaggcactctctctggagagccgcgctaacgaggctcaatggtttcggaagacagcctggaatttggcggtgcaatgcgataaagacccagtaatgatgcgggaattctttatccttagctacaagatgagccagttttgcccatccgaccaagtgatactgattgcccgaaagacttgtctgctgatggcagtcgctgttgaccttgaacagggcagaaaagcctctaccgctttcgagcagacaatgttcttatcacgagctctggaggaaatccagacttgtaacgacatacataacttcctgaagcagacagggaccttttcaaatgacagctgcgaaaaattactccttctgtacgagtttgaagtgagagctaaattaaacgacccactattggaaagctttcttgaatccgtctgggaactcccccacctggaaaccaaaacctttgagaccatagctatcatcgccatggagaagcccgctcattatccccttattgccctgaaggccctgaaaaaggccttactactgtacaagaaggaggagccaattgacatcagccagtattcgaaatgcatgcataacttggtcaatctgagcgtgccggatggcgcaagcaacgtcgaactgtgtccactggaggaggtctggggttactttgaagacgcactgagccacatcagtaggactaaagattacccagagatggaaatcctgtggttgatggtgaagagctggaacactggcgttcttatgtttagcaggagcaaatacgcctctgccgagaaatggtgcggtttggcgctgcgattcctgaatcaccttactagttttaaggagtcctatgagacccagatgaacatgctgtactcccagctcgtggaagcgctctctaataacaagggccctgttttccatgagcatgggtattggtccaaatctgactag

SEQ ID NO: 243780 - DNA, 372 bp, Artificial Sequence
  Description of Artificial Sequence: Synthetic coding sequence
atgatggcaaatcacctggttaagcccgacaacaggaattgcaaacggcctcgcgagttggaaagtccagtgcccgatagcccacaactgagtagcctaggtaaatccgacagctcttttagcgagatcagcggcctcttctacaaagatgaagccttggaaaaggatcttaacgatgtctcaaaagagattaacctgatgctgtctacctacgccaagctcctcagcgaacgcgctgctgtggatgccagctatattgatgagattgatgaactcttcaaagaagcaaacgctatcgagaattttctgatccaaaagagggaatttctgagacagcgcttcactgtcatcgcaaacaccctgcacagatag

SEQ ID NO: 243781 - DNA, 372 bp, Artificial Sequence
  Description of Artificial Sequence: Synthetic coding sequence
atgatggcgaaccacttagtcaaacccgacaataggaactgcaagcgccctcgagagctagaaagcccggtgcccgactcaccacagctgtcaagcttaggtaaatcagactcctcgttcagcgagatttctggcctgttctataaggacgaggctcttgaaaaggacctcaacgatgtttcgaaagagataaatctgatgttatccacatatgctaagctgctcagcgaacgcgctgcagtggacgcctcttatattgacgagatcgacgagcttttcaaggaagctaacgccatcgaaaatttcctcatccagaagagagaatttctccggcaacgattcacagtcatcgctaataccttacatcgatag

SEQ ID NO: 243782 - DNA, 1059 bp, Artificial Sequence
  Description of Artificial Sequence: Synthetic coding sequence
atggcgctcaggccggaagacccctcctctggattccgtcatagtaatgtcgtggcctttatcaatgagaaaatggccaggcataccaaggggccagagttctaccttgagaatatcagtctgtcatgggagaaggtagaggacaagttgcgggctatactggaggacagtgaagtgccctcggaagtgaaagaggcttgcacgtggggatccctggccctgggcgtacggttcgctcataggcaagctcagcttcagagacaccgcgtcaggtggctacatggattcgcgaaattgcataagagcgcagcccaggcccttgcttcagacttgaaaaaactacgagaacaacaggagaccgaacgaaaggaggccgcaagccgccttcgcatggctcagacatcattagttgaggttcagaaagagagggataaagagctggtgtccccccacgagtgggaacaaggcgcaggatggccaggactggctaccgctggaggggtgtgcacggaaggcgcagctgaggaggaagaagaggcagctgtcgcagccgctggcgctgcgggtgggaaaggggctgaagaagagcagcgaggctgctggcgtctttggctacccttgtggcgaccctggttgccactctggcgtcttggccttcctccttggagacccagcagcccaacctggaggccaggtctgccaccatggaggcctcagcgaagctggcgggaatcttcatgcagctccctcgagatgttaatccgcaagtccacccccatcggcggaagacgtagagagatcagcggacgttcaaaacagccccatctcatttccctcgagcctagaaccccaggaccggagcctcaccagaacctctttcttagcagctccctgcctcacactcatacacacactcaagccctgtttccaccatctcaaacctatcctctgtatcctctgcacaagcaacaatcgcaacaccagtttcggctgtcttgcctgcccacgggccgtcctcttattctggcctgtggtcttatgggcggacctaccgagtag

SEQ ID NO: 243783 - DNA, 1059 bp, Artificial Sequence
  Description of Artificial Sequence: Synthetic coding sequence
atggccctccgcccagaagatccttcctctggattcagacactccaacgttgtggccttcatcaatgagaagatggcccgtcacacgaaaggaccggaattctacctggagaatatctctctgtcctgggagaaagtggaggataagctgcgtgccatcttggaggatagcgaggtaccgtctgaggtgaaggaagcctgcacctgggggagcctagcactgggtgtgcggttcgcacacagacaggcccaactacaacgccacagagtcagatggctgcacggctttgcgaagttgcacaaatcagccgcacaggccttggcgtccgatttgaagaaactgcgggagcagcaagagacagagcgcaaggaggccgctagccgactaagaatggcccaaacatccttagtcgaagtccagaaggagagagacaaggagctcgtgtcccctcacgagtgggagcagggcgctgggtggcctggattggcgactgctggcggtgtgtgcacggaaggtgctgccgaagaagaagaagaggcagctgtggccgcagctggagccgcaggcggaaagggggctgaggaggaacaacgaggttgctggcggctgtggctcccattatggcgaccttggcttcccttgtggagactgggactgcccccatggcggccaagcagtccgacctggaggcctggtctgccaccctggcgtcctcagaggagctggagagagtcatcatgttcatcacttgaaatgctgattcgcaaaagtacgcctattgggggacgtcgcagagaaatcagcggtagatccaagcagcctcatctgatatcactggagcctaggacccctggtccagagccgcatcaaaatctgttcctctcaagtagtcttccacacacccacacccacactcaggctttatttccacctagccagacctaccctttatatcctctgcataagcagcagagtcagcaccagttccggctgtcctgcctgccaaccggacgcccattaatccttgcctgcggcctgatgggtggcccaactgaatag

SEQ ID NO: 243784 - DNA, 1230 bp, Artificial Sequence
  Description of Artificial Sequence: Synthetic coding sequence
atggccctcaggcctgaggatccctctagtggattccgccacagcaacgtggtagcttttattaacgagaagatggccagacatactaaaggtccagaattctacctggagaatatttctctgagctgggagaaggtggaggataagctccgggctatcctcgaggatagtgaggttccttctgaggtgaaggaggcttgcacttgggggtctctggccctgggcgtacgttttgcacaccggcaggctcaactgcagagacaccgtgtcaggtggttgcatgggtttgccaagctgcacaagagtgcagcccaggccctcgcctcggacctaaagaaacttagagagcagcaggagacggagcgcaaagaggcggcatccagattaagaatggcacagacatccctggtggaagttcagaaggagagagacaaggagctggtctctccacacgaatgggagcagggggcagggtggccgggattggcaacggccggtggggtttgcaccgagggtgcggctgaggaggaagaggaggcagctgtggccgctgcaggagctgccggaggcaaaggtgccgaggaagagcagcgcgacgtggaggtggtggccgctccagtggaggcgatggccccacccgtggaggcaggcgctgcccctatggaaacccagtttccgcacgtggaggctcgggcagcctcaatggaaacaactgagaaattggagcggatcttgctacaactactgggagacgctgatcaggaaaaatacacctactggggccaaaaagaaggtgatctccggtctgtggagacagccacatcttacttttccggaaccaccaatccctggtctcgggctagctctgagccactccctgtccagctccctgcgagttactcttattcatattctagcccgttttcatctttttctgacattccaacgatttcacctccccaggccacagttaccgcacctgtgcctccacagttaccctctgactgggaggccttcgacacgtccctgtggtcagacggcggacctcatcgaatcgatcatcaggagcacccaagggatcgcagatactcggagccacatcaacagcgcccacctgtatataggagacccggtgattgggattgcccatggtgcaacgctgtcaacttcagccgcagggatacctgttttgactgcggcaagggaatctggctgcagaagccacattag

SEQ ID NO: 243785 - DNA, 939 bp, Artificial Sequence
  Description of Artificial Sequence: Synthetic coding sequence
atggcactgaggccggaggatcctagctctgggtttcggcacggcaacgttgtcgcgtttatcattgaaaagatggcgaggcacactaagggacccgaattttactttgagaacatatccctctcatgggaggaggttgaggataagctcagggcgatcctggaggactccgaggtaccatccgaggtgaaggaagcctgcacctgggggtccttggccctgggcgtgcgttttgcccacagacaaggacagctgcagaatagacgcgttcaatggctgcagggatttgccaaactccataggtcagcggcactcgtcctggcctcgaacctgaccgaactaaaggaacagcaggagatggagtgtaatgaggccacgtttcaacttcagttgactgagacatctctggccgaagtgcagcgggaacgagacatgttgaggtggaagttattccatgccgagttagcacccccacagggccaagggcaggccaccgtctttcctggtctcgccaccgccggtggggactggactgagggggctggagaacaggaaaaggaagccgtggccgctgccggagccgctggcggtaagggcgaggaacgatatgctgaagcagggcctgcaccagccgaggtgctccagggccttggcggaggtttcagacagcccctgggggcaattgtcgcaggcaagttgcacctttgcggagctgagggagagcgtagtcaggtgtccacgaattcccatgtgtgcctgctgtgggcctgggtccattccttaacgggggcttcatcatgccctgccccatatctcatacacatcctgattccaatgccttttgttaggcttttgagccacacgcaatatacacccttcacctcaaaaggacacaggactgggtccaattcggacgcattccaattaggcggactgtag

SEQ ID NO: 243786 - DNA, 4494 bp, Artificial Sequence
  Description of Artificial Sequence: Synthetic coding sequence
atgtcccgggctgtgcgccttcccgtgccctgtcctgtgcagctcgggacattgcgcaatgattcactggaggcccaactgcatgaatatgttaagcaagggaactacgtcaaagtgaaaaagattcttaagaaggggatctacgtggacgcggtaaacagcctggggcaaacagctctgttcgtggccgcacttttaggactgagaaagtttgttgacgtgctggtggactacggaagtgatcctaaccacaggtgttttgacggctctacgcctgtacacgcagcagcattcagcggaaaccagtggatcctgtctaagttacttgacgctgggggagatttgcggcttcacgacgaacgtggacagaacccaaagacctgggcactgaccgccggtaaggagaggtctactcagatcgtggagttcatgcagcgctgcgcttcacatatgcaagccataatccagggatttagctacgacctgctgaaaaaaatcgacagcccacaacgactggtctattcccccagctggtgtggtgggctcgtgcagggtaacccaaacggatcccccaaccggctcttgaaggccggtgtcatcagcgcccagaacatttacagctttggtttcgggaaggcaatgccatggtttcaattctacctgaccggggctacgcagatggcctatctcggcagtcttcccgtgatcggcgaaaaagaggtgattcaggctgacgacgagcctacgttctcattcttcagcggcccttatatggttatgacaaatttagtgtggaatgggtcaagagtaaccgtaaaagaactcaacctgcccacccatcctcactgtagtcgattgaggctggcggatctactgatcgccgagcaggagcattcttctaagctgcgacatccgtacttgcttcagctgatggccgtgtgtctgtcacaggacctggagaaaactcgcctcgtgtacgaacgcattacaattggcaccttgtttagcgtgctccacgaacgtcggtcgcaattccctgtgctgcatatggaggtgatcgtacacctgttgcttcagatttctgacgcactgcgatacctccacttccagggcttcatacaccggtctctgtccagttacgcggtgcacattatctcacctggcgaggctaggctgactaacctcgaatacatgctggagtcagaggaccgcggagtccaacgtgatcttacccgcgtacccctgccgacacagctgtacaattgggccgcacccgaggttattctccagaaagccgcaactgttaagtctgatatctacagcttctcaatgattatgcaggagattctcacggatgatattccctggaaaggacttgacggttctgtggtcaagaaggctgtagtgagcggaaactacctagaggcggacgtcaggctaccaaagccttattacgatatcgtcaaatccgggatccatgtgaaacagaaggaccgcactatgaaccttcaggatatcagatatatcctcaagaacgatctcaaagatttcacaggtgcccagagaacccagcctaccgagtcgccacgcgtgcagagatacggactacaccctgacgtgaacgtgtatctgggccttacctccgaacacccccgtgaaactcctgacatggagataatcgaactaaaggaaatggggagtcagcctcattcgccgcgtgtgcattccctgttcacagaagggaccctggacccgcaggcccctgatccctgcctcatggctagagagacccaaaatcaggatgccccatgccctgcgccattcatggccgaggaggcgagctcaccctccacaggtcagcctagtctgtgttccttcgaaattaatgagatctatagcggttgcttaatacttgaggacgatattgaggaaccacccggtgccgcaagcagtctagaggcagatggacctaatcaggtggacgaattgaagtcgatggaagaggaactagacaaaatggagagagaggcttgctgtttcggcagcgaagacgaatccagcagtaaagccgaaacagagtattcatttgacgactgggattggcaaaatggttccctgagcagtctgtccctcccagagagcacgagggaagccaaatctaacctcaacaacatgtcgaccaccgaggagtatctgatcagcaagtgcgtgctggatctcaaaataatgcagacaatcatgcacgagaatgacgacaggttgcggaatattgaacaaattctcgacgaagtggagatgaaacagaaggagcaggaggagcgaatgtctctctgggccacctccagggaatttacaaacgcttacaaattgccactcgccgtcgggccaccttctctcaattacattccaccggtgttacaactttcaggcggacaaaaaccagacacaagcggtaactaccctaccctccccaggtttcctcgaatgcttccaacactttgtgatccagggaagcaaaacaccgacgagcagtttcagtgtacccagggagctaaggattccttggagacatccaggatacagaacacatcttcccagggaaggcctcgggagtccaccgcacaggccaaggctactcagtttaactccgctctcttcacactgagctcacatcgccaaggaccgtccgcgagtccatcttgtcactgggattcaacccggatgagcgtcgagcctgtttcttccgagatttataacgccgagtctaggaacaaggacgacggcaaggtccatttaaaatggaagatggaggtgaaggagatggcaaaaaaggcagcaaccggtcaactgacagtgccaccatggcacccacagtcttccttgacactggagtccgaggccgaaaacgagcctgatgctttattgcagccgccaatccgttctccagagaacacagactggcagagagtgatcgagtatcaccgtgagaacgatgaaccgcgaggcaatggaaaatttgataagaccgggaacaacgattgcgattccgatcaacacggccgacaaccccgacttggaagcttcacatcaattcggcatccatcccctagacagaaagaacagcccgagcactcggaagcttttcaggcttcctctgacacgcttgtggcagtcgaaaagagctactcccaccagtcgatgcaatcaacctgcagcccagaaagctcagaagatattacagatgagtttctgacacctgacggcgaatatttttacagctctactgctcaggagaacctggccctcgaaacgagtagccccatagaggaggattttgagggcatccagggcgcatttgcacagcctcaggtgagcggcgaggagaaatttcagatgcggaagattcttggcaaaaatgccgagatcctaccacgctcccaatttcaaccagttagaagcactgaggacgagcaggaagagacctccaaggagagcccgaaggagttaaaggagaaggatattagtctaacagatatacaagacctctcaagcatatcgtacgagcccgattcttcttttaaagaagcctcctgtaaaacccccaagattaatcatgcccctacatcggtgagtacccctctgtcccccggaagcgtctcctccgccgctagtcagtataaagactgtctggaatcgatcacatttcaggtcaaaaccgagtttgcttcatgttggaactcccaagagttcatccagactttgtctgacgacttcatctccgtccgggagcgggctaagaagcttgactccttattaaccagcagcgaaacgcccccatctagactgaccggactcaaacgcctatcgagcttcattggagccggatccccttctctggtgaaggcttgcgatagcagcccgccacatgcaacacagagaagatcgttacctaaggtagaagcgttctctcagcaccatatcgacgagctcccaccaccttcccaagagttactggacgacattgagctgttgaaacaacagcagggctcatctactgtgcttcatgaaaacacggcctctgacggcggaggaactgcaaatgaccaacggcatttggaagaacaggagacggattccaagaaagaagactcaagcatgcttctgtcaaaggagaccgaggacttaggtgaagatacggaacgggcacattctacgttagacgaggacctggagcggtggcttcagccacccgaagagtcagtggaactgcaagatcttccaaagggaagcgagcgcgagactaatatcaaagaccagaaggtgggcgaagaaaagagaaagagggaagacagtataacacccgagagacggaagtccgagggtgtgttgggtacctccgaagaggacgaactgaagtcctgtttttggaagcggctgggctggagcgagtcttctaggatcattgtgctagatcagtcagacctgtcggactag

SEQ ID NO: 243787 - DNA, 4356 bp, Artificial Sequence
  Description of Artificial Sequence: Synthetic coding sequence
atgagtcgggctgtccggttgcccgtgccctgtccagtgcagctggggactctcagaaacgattccctggaagcacagctgcacgaatatgttaaacaggggaactacgtgaaggtcaagaagattctgaagaaagggatctatgtggacgcagtgaactctttgggccaaaccgccctgttcgtggctgccttgctcgggcttaggaagttcgtcgacgtgttggtagattacggctctgatcctaaccacaggtgcttcgatggcagcacccccgtgcacgccgcagcattctcggggaatcagtggattttgagcaagttactggatgctggtggagatcttaggttgcatgatgaacgaggccaaaaccctaaaacatgggctctgaccgcagggaaagaaaggtcaactcagatcgtggaatttatgcaaagatgtgcttcacatatgcaggcaatcatccagggctttagctatgatctgctgaagaagatcgacagccctcagcgtctcgtctacagcccttcatggtgtggcggactcgtccaaggtaaccccaatggctcccctaaccgactcctgaaggcaggggtcatatctgctcagaacatttacagcttcggctttggtaaattttacttgactggcgcaacgcaaatggcctacctggggtctttgccagtcattggagagaaagaggtgatacaagccgacgatgagccgacattcagtttctttagcggcccttacatggtgatgacaaacctcgtgtggaacggttcccgcgtgaccgtgaaggagctaaatttgcctacacatccacattgtagtcgtcttcgcctcgctgacctacttatcgccgaacaagagcactcttcgaagctgaggcacccctaccttttacagctcatggccgtctgcctgtcacaagatctcgagaaaaccagactcgtgtatgaaaggatcaccatcggaaccctattcagtgttcttcacgaaagacgctcacagtttcccgtgttgcatatggaagtgatcgtccacttgctgctgcagatttcagacgcactgaggtacctgcactttcagggcttcatccatagatccctctcatcatacgccgtccacataatttctcctggagaagcacgcctgactaacctggaatacatgctggagagcgaggacagaggagtgcagagggaccttacgagggtcccattgccaacacaactgtacaactgggccgctcctgaggttatcctccaaaaagcagctacagtgaagagtgacatttacagcttttcaatgataatgcaagagatccttaccgatgatatcccatggaagggcttagacggatctgtggttaaaaaagccgttgtctctggcaattatctcgaagccgacgtgcgcctgccaaagccctactatgacattgtcaagagtggtattcatgtcaagcagaaagatagaactatgaatctgcaagatatccgctatatcctgaaaaacgatcttaaagactttaccggagcacagagaacccagcctaccgagtctcccagggtccagaggtatgggctccaccccgacgttaatgtctatctcggacttacaagtgaacaccctcgggagacaccagatatggagataattgagcttaaagaaatggggagccaaccccattcccccagagtccattctctgttcactgagggaacgttagacccacaagcccctgacccctgtctgatggctcgtgagactcagaaccaagatgcaccctgtcccgcacccttcatggctgaggaagcttcgagtccctccaccggccagccctccctttgctcatttgagatcaatgaaatttactcaggatgtctgatcctggaggatgacatagaagaaccacccggtgccgctagcagtttggaagccgacggccctaaccaagtagatgaacttaagagcatggaggaggagttggacaaaatggagagggaggcgtgctgcttcggaagtgaagacgagtcatcgtcaaaggctgagacagaatattccttcgacgactgggattggcagaacggtagcctttctagcctatccctgccagaaagtacacgggaagcgaaaagtaacctcaataatatgtccaccactgaagagtatctaatctccaaatgcgtgctcgatctgaaaataatgcagacaatcatgcatgagaacgacgataggctgagaaatatcgagcagatcctggacgaggtggagatgaaacagaaggagcaagaagaaaggatgagtctctgggccaccagcagggaatttaccaacgcctacaaactccccttggctgtggggcctcctagcctgaactacatcccaccagtgctgcagctctcaggcggacaaaagcctgatacctcggggaattacccaactcttccaagatttcctcgcatgctaccaaccctctgtgaccccggtaagcagaacaccgacgaacaatttcaatgtacacagggtgctaaggactcacttgaaacctctcggatccagaacacatcctcacagggcagacccagagaatcgacagcccaggccaaggcaacacagttcaactctgccctcttcacgctttccagccaccgccaaggaccgtcagcgagtccttcctgccactgggactctacgagaatgagcgttgaacctgtgtcttctgagatctacaatgctgagagtagaaataaagatgacgggaaagtacacctgaagtggaagatggaggttaaggagatggcaaagaaggccgcaaccggacagctaactgtgcctccatggcatccacagtcgtccctgactctggagagcgaggccgagaacgaacctgacgccctgctccagccacccattaggagtcctgagaacaccgattggcaacgtgtgatcgagtatcaccgggaaaacgacgagcctcgcggaaatgggaaatttgacaaaactggcaataacgactgtgactcagatcaacacggaagacagccaaggttgggcagtttcacatccatacgacacccgtccccgagacagaaagagcaacccgaacatagcgaagccttccaggcatcttctgacaccctcgtagctgtcgagaagagctattccacgagctctccgatcgaagaggactttgagggaattcagggtgcatttgcgcagccccaggtttcaggcgaggagaaatttcagatgagaaagatcctgggaaagaatgccgaaatactacctagatctcagttccagcccgtgaggtctactgaagatgaacaggaggaaacatccaaagagagtcccaaggagctcaaggagaaggatatttctctcacagatatacaggatctcagctccatctcatacgagcctgattccagtttcaaggaagcctcctgcaagacgccgaagatcaatcatgcccctacctcggtttcaacgcccctttcccccggttcagtgtccagtgccgctagccagtacaaagactgtttggaatctattacttttcaggtcaagaccgaattcgcctcttgctggaatagccaggaatttatacagacactgtccgacgattttataagcgtaagggaaagggctaaaaagcttgattcccttttgacatcttccgaaacgccaccaagccgacttaccggtctcaagaggttgtccagttttataggggcaggctctccttcacttgttaaggcctgcgactcctccccaccccatgcaacacagcgcagatcccttccaaaggttgaggcattcagtcagcaccacatcgacgagttaccccctccgtcccaagaattactggacgacattgaattactcaagcagcagcagggctccagcacagtgctgcatgagaacactgcctccgacggcggaggtacagctaatgatcagaggcacctcgaggagcaagaaaccgatagcaaaaaagaagacagcagcatgcttctgtcaaaagaaactgaggacctcggagaggacacagagcgagctcactccacgttagatgaagatctggaacggtggcttcagccaccagaagaatccgtcgagctccaggatctgccaaagggcagtgagcgcgagaccaatattaaagatcagaaagtcggagaggaaaaacgaaaacgcgaagactccataacccctgaaaggaggaagtctgaaggagtgcttgggacgtcagaggaggatgaactcaaaagctgcttctggaagcggctcggatggagcgagtcaagccggattatcgttctggaccagagcgatctatcagattag

SEQ ID NO: 243788 - DNA, 4476 bp, Artificial Sequence
  Description of Artificial Sequence: Synthetic coding sequence
atgagcagggccgtgcgcctgcctgtgccctgtcccgtgcaactgggcactctccgaaatgactctcttgaagcccagctccacgagtacgtgaaacaaggcaactatgtaaaggtcaagaaaatcctgaaaaaaggaatctacgttgacgctgtcaattcgctcgggcagaccgctctgtttgttgctgccctgctgggactccggaaatttgttgatgtgctggtggactacgggtcagatcctaatcataggtgcttcgatggttcgactcctgtccatgctgcagccttcagcggcaatcagtggatacttagcaagctgctggacgcgggaggcgatttgagacttcatgatgaacgcggacagaatccaaagacttgggcattgaccgctggaaaggaaagatcaactcagatcgtagaatttatgcagcgctgcgcaagccacatgcaggcaatcatacaggggttcagctatgatttgctcaagaaaatcgattctcctcagcgacttgtttacagtcctagctggtgtggcggtctggtgcagggcaatcctaacggatcccctaacaggcttctcaaggccggtgtaatctccgcccagaatatctactcatttggattcggcaaattctatctgactggtgccacacagatggcctacctggggagcttaccagtaatcggagaaaaggaggtgatccaggcggatgatgaacccactttctcgtttttctctggtccatatatggtgatgaccaacttggtgtggaacggaagccgcgtaacagtgaaggagctaaaccttcccactcatcctcattgttcacggctgcgtctggccgacctgttgatcgcggagcaagagcacagcagtaaactgcgtcacccatatctcttgcagctaatggcagtttgtttaagccaggacctagagaagactagactcgtctacgaacgcatcaccattggaaccctgttttcagtgcttcacgaaaggcgctctcaatttcccgtcctgcatatggaggtcatcgttcatctgttactgcagatttctgatgccctacgttatctgcacttccagggctttatacacagatctctgtccagctacgctgtgcacattatttcgcccggagaagcccgactgaccaatctggaatatatgctcgagtctgaggaccgaggcgtgcaaagggacctgacaagggtgccactgcccacccagctgtataattgggcagccccagaggtcattttgcagaaggccgctactgtaaaatccgatatatactcattctctatgattatgcaagaaatccttaccgacgatattccttggaagggactggacggcagcgtggtcaagaaagctgttgtaagcgggaactatctcgaggccgatgtgagactgccgaagccctactatgatattgtcaaatctgggatccacgtaaagcagaaagatcggaccatgaaccttcaagacattagatatattctcaaaaacgacctgaaagatttcactggcgcacagaggactcagccaacggagagcccgcgtgttcagaggtacggccttcaccccgacgtgaatgtctatctgggtcttacttccgaacatccccgagaaactccagatatggaaatcatcgagctgaaggagatgggatctcagccacactctcctcgcgttcatagtctgtttactgaagggacactggatccccaagctcccgacccctgcctgatggccagagagacacaaaaccaggacgctccatgcccagcaccctttatggctgaggaagcatcttcgccttcgactggacagccgtctctgtgttcgtttgaaatcaatgaaatctacagtggctgtcttatcttagaggatgatatcgaggaaccacctggcgcagccagctctctcgaagccgacggtccaaaccaggttgacgagctgaaatctatggaggaagaactggataaaatggaacgcgaagcatgttgtttcggttcagaggacgagtcttcatctaaggccgaaaccgagtacagcttcgatgattgggactggcagaacggctctctgagctccttgagtctaccggaatcaacccgggaggccaaatctaatctcaataatatgagcactacggaagagtatctgatcagtaaatgtgtgctcgacttgaagatcatgcagactatcatgcacgagaatgatgatcggctcagaaatattgagcagatcctggatgaagtcgaaatgaaacagaaggagcaggaggaacggatgtctttgtgggcgacaagccgcgagttcaccaatgcgtataagctgcctttggccgtggggccaccctctctgaactatatcccaccagtcctccaactttctgggggacagaagccagatacaagcgggaattaccccacactaccccgattccccaggatgctacctaccctgtgtgatccaggcaagcaaaataccgatgagcagttccagtgcacacagggggcaaaggattctcttgaaacttccagaattcagaacacctcttcccagggcagacccagagaaagcacagcccaagcaaaggctacacagttcaatagcgcccttttcactttgtcttctcaccgccagggccctagtgcttctccaagttgtcattgggattcaacaaggatgtcagtagagcccgtctccagtgagatctacaacgcagagtccagaaacaaagatgacggaaaggttcatctgaagtggaaaatggaggtgaaggagatggctaagaaagccgctaccggccagctgacagtcccaccttggcatcctcagagttccctgacactcgaatccgaggcagagaacgagccggacgcactactgcaacctccgatcagatcacctgagaacacagattggcagagggtgatcgagtaccacagagaaaatgacgaaccaaggggcaatggcaagttcgataagaccgggaataacgattgcgatagcgatcaacacggacgacagccgcgtctcggctcctttacttctattaggcaccccagcccacgacagaaagagcagcctgagcacagcgaggctttccaggcctcctccgacactttggtggccgtggaaaagtcctattcacatcagtcaatgcagtctacctgcagccctgagtctagtgaggatatcaccgacgagtttctgacaccagacggagagtacttttactcctccactgcgcaagaaaacctggccctagagaccagctcaccaattgaggaggactttgagggcattcagggggctttcgcccagccgcaggtcagcggcgaagagaaattccagatgcggaagatcctgggaaagaacgccgaaatcctaccccgtagccaattccagccagtgcggtcaacagaagacgagcaagaggagacttctaaggagtcaccaaaggagcttaaagaaaaggatatttctttgacagatatccaagacctgtcttccatctcttacgagcctgatagtagcttcaaagaagccagctgtaaaacgcccaaaatcaaccatgcaccaacgtctgttagcacacccctctcgcctggctcggtctcctccgctgcatcccagtataaggattgcctagagtctatcacctttcaggttaaaaccgaatttgcttcttgttggaactctcaggagttcatccaaactttgagcgatgattttatctcggtccgggagagagccaaaaagctggattctttgctgacaagttctgaaactccacctagtcggctgaccgggctgaagcgcctgtcgagcttcattggagctggcagccccagtctggtcaaagcctgcgacagttcaccacctcacgccacccagagacgcagcctgcctaaggtggaagcttttagtcagcaccacatcgacgaactgccacccccatctcaagaattattagatgacatagaacttcttaagcagcagcaaggctcttccaccgtgctgcatgagaatacagcatccgacggaggaggtaccgcgaatgaccaacgtcacctagaggagcaagagaccgactccaaaaaggaagattcctccatgttactgagcaaggagactgaggatttaggagaagacaccgagcgggcacacagcacattggacgaggatctggagagatggttgcagccaccagaagaatcagtggaattgcaagatctgccgaaggggagcgaaagagagacaaatatcaaagaccagaaggtgggagaggaaaagaggaaacgggaagactccattacacccgaacggaggaagtccgagggcgttcttgggacgtcggaagaggatgaattgaagagttgcttttggaaacggcttggctggagcgagagcagccggatcatcgtgctggaccaatcggacctctctgactag

SEQ ID NO: 243789 - DNA, 8370 bp, Artificial Sequence
  Description of Artificial Sequence: Synthetic coding sequence
atgcccagcgatgccaaggactcagtcaatggagacctgctacttaactggacgtctctgaagaacatactgagcggcctcaacgcttccttcccactccacaacaatacgggctcaagtacggtgaccacatctaagtccataaaagaccccaggttgatgagaagggaggagtcaatgggcgagcaatcttctactgccggactgaacgaagtgctgcagttcgagaaatcgtctgacaatgtgaactcggagataaagagtaccccaagtaatagcgcctcatcctcggaagttgtgcctggtgactgcgcggtcctgaccaacgggcttgacaccccttgtttcaaaactagcgtaaacgacagtcagtcctgggcacataacatgggcagtgaagactacgactgcatccctccgaataaggtgacaatggctggccaatgcaaagatcagggaaacttctccttccccatcagtgtgtctaacgtagtctctgaagtggagaaccagaaccactccgaggaaaaagctcagagggctcagcaggagtctggaaacgcctacacgaaggaatattcaagccatatcttccaggacagccaatcatcagatctgaagacgatctatcagactggatgccagacgtcaaccgtgttccccctaaaaaaaaaagtgtctatcgatgaatatctccagaacacgggcaaaatgaagaatttcgcggatctcgaggacagctcaaagcatgaagaaaaacagacttcatggaaggaaatcgataacgattttacaaacgagaccaagatatcacctattgacaactacatcgtgttacaccaggagtacaaggagtccgaaagccacaatagtttcggtaaatcctgcgacaaaatccttataacacaggaactggaaatcactaagtcctctacaagcactataaaagacaaggacgagttagatcaccttgccctggagtggcagattacaccgtctttcgagtccctttcgcagaaacatcctcagcacagtgtcgagtacgagggaaacatccatacatcactggctattgctcaaaaactgatggaactaaagcttggcaaaatcaaccagaactatgcttctattatcactgaagccttccctaaacctaaggacattcctcaggccaaggaaatgtttatcgatacagtgatcagctcgtacaacatcgaaaccgctcatgattcttcaaattgcagcatcacaagagaacacatatgtgtccatcgtaaaaacgagaacgagcctgtgagcctggaaaatattcagagagactataaggaaactgcttacgtggaggacagagggcaggaccacaatttgttctgcaattcacagctttctaacgacatttggttaaacgtgaactttaagaagcagactgaccgtgagaaccagaatgaggccaaggaaaacagtgcttcttgcgttgagaataatattgagaatatatacggcgataaaaaacaagactcgcataccaacgagaactttagcaacattgatgaaaaagaggataagaattaccataacatcgaaatcttaagttccgaggaattttctaccaaatttaatctgatctgcagggaagacaacgcagtgtccgccgctaccgcacttctagagtcagaggaagatacaatctctgcagtgaagcaaaaggacaccgaaaatactgggcgttccgtggaacaccttgcttcgactacattccctaagacagcgagtagcagcgtttgcgtcgcctcaaatgcggcaatccaaatagcatcggccaccatgcctgccctttcccttaataatgacgaccaccaaatttaccagttcaaggagacatgcagctccgagagtcccgattttggattgttggtcaaacatcgagtgtcagattgcgaaatcgataccgataaaaataagagtcaggagtccttccaccagtcgataaatgagaacctcgtcttgcaaagcatagagctagaatcagaaattgaaatcgaactggaggactgcgacgatgcctttattttccaacaggatacccacagtcatgaaaatatgctttgcgaagaattcgtgacttcatataaggctcttaagagtcgaattagctgggaaggattgttagccttggacaatggggagatggaggtcctggaatcaacaaccggaagagaaaactcagaccagcattactccaaggagtccaattacttttactccagtacccagaacaacgagaccgaactgacaagccctatactcctaccagacctgcagatcaaaatcaccaatatcttccggcctgggttctctcccaccgccgactctcttgccctgaaagacagtttctgcacccacgtcaccgaagccaccaagccagagattaacaaggaggacggggaaattctggggttcgatatctatagccagcctttcggggagaacgcagactacccatgcgaggataaagttgataatattaggcaggagtcaggtccagtgagcaacagtgaaatcagccttagctttgacttgtccagaaataccgatgtaaatcacactagcgagaaccagaatagcgagtccttattcactgaacctagcaacgtgaccactatcgatgacggatcccgatgtttttttaccaagtcaaaaacggactacaatgacaccaaaaacaaaaaagaagtggagtccaggatttctaagagaaaactccatatctcttcgcgggaccaaaacatcccacataaggacctccgacgacacaaaatctatggccgaaaacgcagactgacttcccaagacagctcagagtgcttttccagccttagtcagggcagaatcaagactttttcacagtctgaaaaacacattaaatctgtgctcaacattctgagcgacgaagcaagtctatgtaagtctaaatgcttgtcccggaaactagacaaagctgtcgtccacctgaagaaagctcacaggagggtgcatacatctctacagttgattacgaaggtcggcgaagagcgtaagggtcctctccctaagagctatgcaattatctgcaacaatttttgggagagttgcgacttgcaggggtatagcagcgtctcccaaaggaaatattactcaaccaagcattttagcagcaagcgtaaatacgacaaacggaggaaaaagagggcccctaaagccgacatctccaagtctctcactcacgtatccaaacataagtcctacaagactagcggtgaaaaaaagtgtcttagccggaaaagcatggccagcagcgtttccaaatcccaccccacaacatcacacatgggtgagttttgtaatcaggagcacccagaatcacagttgcctgtgtcttctacatctcagagcacctcacagagcgtgtactacaattcttccgtgagtaacccctccctttctgaggagcaccaaccattttctggtaaaactgcctacttgtttagtccggaccattctgacgagaagctaatcgaaaaagagaatcagatcgacacagcctttctgtcaagcacctcaaaatatgagaaactggagaagcacagcgcgaatcataatgtaaaagatgctacaaaagaaaacagttgtgacgctaacgaagtaatcaacgagtccaactctgtcagcttgtcatgcattaaggagaatattaatagttctacaggtaacgactgcgacgctacgtgtatcggccacactaaggctaagacggacgtgcttatttccgtattggactccaacgttaaacactttctcaatgacctgtaccagcagggaaatctcatcctttctgattgtaaaagaaatctcgaagtaaaatggacggatcccatcgagcgccctaaacaaaacattataaccggcaactttctaatgggccctttaaatctcacacttattgccagcaagaagtatagcattccacagttgtctgctgccgctgtgacagactcagagggggagtcttccaaatcctatctggacaagcagcggatcttaaccgtagactcctttgcggcaagcagcacagttccacattgcgagcaaagctgtagggaaaaggagctgctgaagaccgagcagtgctcctctggaaactgccttcacaccgatggcaatgagaccaatgtgacagagaattacgaactcgatgttgcatccggtacagaggaggataagagttatggagagaacatcgttgaactgagcagcagtgacagttccctactcctgaaggataacgtgaagggctctagctctgaaacttgtatcgtaaagaaagataccgaagaccgcataacatggaaggttaaacaggccgaaaaggctaaagattccgtctataagcgatcaatgacggaagggtcaaccgtcaacacagaatataagaatcagaagaatcagatttctgaagagagctgcctaaatgagaagatcattactacgaatctgattgatagccatctttctacaaaaaacacaactacagagtcggtacccctaaagaacaccgtaagcaaccccttgaacaagcgggagaaaaagggagagataaaagtaagcaaggactcacagtcagatttgactctgcactccgagatcgcttacatatccaaacccggtatcctcggcgtgaatcatacccccatcctgccggcacactctgagacgtgtaaagtccctacacttctgaagaagcccgcttcatatgttagcgattttaaagaaaaacactgcagcgctaatcatactgccctgatcgctaacctaagtcagattctgcagcgcgctgatgaagcctcgtcccttcagatactgcaggaggagaccaaggtttgtctgaacattttgccactattcgtggaggcttttgagcgtaagcaggaatgctcagtggagcaaatcctcatctcacgggagctgcttgtggatcagaatctgtggaacaactgtaaacacaccctgaagccatgtgctgtggacaccctcgtggaactgcaaatgatgatggaaacaatacaatttatcgagaacaaaaagcggcatctggagggggaaccaacactccgcagcctactgtggtacgacgagacattatacgccgagctactcggcaagcctcggggtttccagcaacagtctaatttttatcccggattccaagggagactcaaatataatgccttctgtgagctgcaaacctatcacgaccagctcgtggagctgctcgaagagaccaaaagagagaaaaacagttattatgtctttctaaaatacaagcggcaggtaaatgagtgcgaggcgattatggaacactgctcagactgtttcgattttagcttgtccgtgccatttacttgtggagtaaacttcggagattccttggaggacctggagatcttgaggaaatcaacacttaagctcattaacgtgtgcggtgacagtccaaaagttcactcctacccaggaaagcaggatcacctctggatcataatcgaaatgattagttccaaggttaacttcatcaagaataacgaggccgtcagggtgaagatctctctatatggcctcgagcacattttcttcgatgccgctaaaaatctcgtctggaaagagagaacccagtcctttagtaaaaagtacagccagaagaaagatgaagaacgtctgcttagggtcaataagtgtgcctttagtaaactccagaagatttacgacactctctcaaaagacctgaacaacgagcccattagcccaatagggctcgaggaggacaccattatcgcaagccgcaaaagcgatcaccccataaatgaagccaccataagtattgagaacagtaagtttaactcaaatttactcgctcaccccgatatttgctgtatcagcgaaattttggatcaagcagaatttgctgacctgaagaaattacaagatttgacccttcgctgtacagaccatttagaaattctgaaaaaatatttccaaatgctccaggacaataatatggacaacatttttatcacagaagaaaatgtcctggatgtggtgatcaatcacagtcacgaagccataatactgaagccagaggccattgagatgtatatagaaattgtgatggtttccgaaaccatacacttcctcaaaaacagcatcgccaagaagctggataagcagcgcttcaggggtatgttgtggttcgatctgtccctcctgcccgaactggtgcagtgccaggagaagatggcatcattcagcttcctgaaggataatagcaccgatgtgtgcctgtggaaggtgatcgaaaccgctgtatccgagctgaagaaggatctggacataatatgcaagtataacgaagccgtcaactgctcctacgccatccacctgctctcgcgggaactgcaggaactgtcagaaatcaaaaaactgctgaaaaaatctaaatatttcatcagcacctacatcgactttgtcccatacatcgcgagcatcaattatggttcaactgtcaccgaacttgagtataactacaaccaattttcaacgctgctgaaaaacgtgatgagtgctccaagaaaagatttgggcaagatggctcacatcagaaaggtaatgaaaacgatcgagcacatgaaaatgatctgcacaaaaaacgctgagctcacaatcagcttttttctctgccagatgctgtacaacaggaggaagatactgcaactgaagagaaaagagaaaatgaacatacacatagtgaaaccaggggagaacaataataaattcagtatatctacaatgttaccgcctgtgtccgaatgcataaataaaaatatcagtaattcttctaaaaaacgccctagtaccgtggacaagtgcgaggatagccaggagcagcagcaggacactaccgttagctcttgtaagaagctgaaagtagatatgaaggatgtcacaaagatcaacagggagaaggccacatttaaacaccctcgtacaacaggatcacacccaaagtccgagaataagatcgtgccctcaagctgtgattctctgaaaaggaaccacttgacccctaaaaaagtagaaatgcagagatctcttccgggaagcctgttaccactggagaaccccaaagacacttgcgccagcaagagtgagtcgaagattgacttaactgtgagcagcgatcactttagtggtcagcaggaaaacctgaacagtatgaaaaaacgcaacgtcaatttttctgcagcggagaccaagagcgacaagaaggattgcgccgctttcgctatctgtgatcaaaagagtgtgcatggcactttcagtccagatcacgggacgttactccagaagttcctcaaaaatagcccagatcctactcagaaatcctgcctgtctgacattaaccctgaaacagatgtgtccctcgtgcctgatgcctccgtgcttagcaagcctattttttgtttcgtgaaggacgtccatccagacttggagatgaatgacaccgtcttcgagctccaggataatgacatcgtcaatagctctatcaaaaacagttcgtgtatgacctctcctgagccaatctgtatccagaacaagattcccacactccagatcaacaagctccaacctactgagaccgagtccgaagacaagtacatgaaggacacattgaaccctaacaccgtccatacatttggcgcttcaggacatatcacactgaacgttaaccagggggcagagtacagcctctccgagcagcagaatgacaagaattcaaaagttctgatgcaaaatgccgctacctactggaacgaacttccacaatccgcgtgcaatccaacctacaacagcagtgagcacctctttggaacctcttatccatacagcgcatggtgcgtgtaccaatatagcaattccaatggaaacgcaattacccagacttatcaggggataactagctatgaggtgcagcctagtccctctgggctcctcactacggtggcatcaactgcgcagggtacccactccaaccttctctactcccaatacttcacttactttgcaggtgagccccaggctaatgggttcgtgcccgtaaacggatactttcagagtcagattcccgcatccaactttaggcagcccatattttcacaatatgcctcacaccagcctctgccccaggcaacttacccatatctccctaaccgctttgtgccccctgaagtgccgtgggtgtatgccccttggcatcaggagagctttcacccaggccattaa

SEQ ID NO: 243790 - DNA, 1233 bp, Artificial Sequence
  Description of Artificial Sequence: Synthetic coding sequence
atggttcttaaagccgaacatactagatctccttccgccactctgccgtccaatgtgccaagttgtcgatctctgtcatcctctgaggacggaccttctgggccatcgtcactggccgacggtggtctcgcacacaacctgcaggactccgttagacacagaatcctctacctgagtgagcagttacgcgttgagaaagctagcagggatggaaacaccgtgtcgtacctgaagctggtcagcaaggccgatcgacaccaggttccgcacattcagcaggcctttgaaaaagtgaaccaacgggcttctgccactattgcccagatcgagcacagactgcatcaatgccaccagcagctgcaggagctggaggaaggatgcagacctgagggactgctcctcatggccgaatccgatccagcaaactgcgagcctccaagtgagaaagcattgctctccgagccccctgagcccggtggagaagatggacccgtgaatctgcctcatgcaagtcgtccatttatccttgagagcagatttcagtctttgcagcaaggcacctgtctagagactgaagacgttgcccagcaacaaaatttgttgctccaaaaagttaaagctgaactggaagaggctaagcggttccacatctcgctgcaagagtcctaccatagtcttaaagagcgaagtcttacagacctacagctgctgctggagagcctccaggaagagaagtgccggcaagccttaatggaagagcaggtgaatgggaggctgcagggccaactaaacgagatctataacttgaagcacaacttagcgtgttccgaagagcgaatggcatatttaagctacgaacgcgcaaaggaaatttgggaaatcacggagacattcaagtcccggatttcaaaacttgaaatgctgcagcaggtgacccaactcgaggcagccgagcacttacagagtcggccacctcaaatgctgttcaagttcctttccccaagactttctctggccacagtcctactcgtattcgtttccacgctgtgtgcctgtccctcaagcctaatctcatccaggctgtgtacttgtactatgctgatgttaattggcttgggggtcctggcatggcaacgctggagagcgatccccgcaactgattggcaggaatgggtccccagccgatgcagactctacagtaaagactctggacctcctgcagacggaccttag

SEQ ID NO: 243791 - DNA, 1233 bp, Artificial Sequence
  Description of Artificial Sequence: Synthetic coding sequence
atggtactcaaggccgaacatacacgcagccccagtgccacacttcccagcaacgtcccttcttgcagaagtttgagtagcagcgaggacgggccatccggaccctcttcgctagctgatgggggactggctcacaacctgcaagacagcgttcgccatcgtattctgtatttgtctgagcagttgagggtcgagaaagctagtcgcgatggaaatacggtttcctatctgaagttagtgtcaaaggcagaccggcatcaggtgccccacatccagcaggcctttgagaaagtaaatcagcgcgcttcagctaccattgctcaaatcgaacaccgattacaccaatgtcatcagcaactgcaggagctggaggagggctgtcggccagaggggctgttgctgatggctgagagcgatccggctaactgcgagcccccttccgagaaggccctgcttagtgaaccccctgagcccggtggcgaagacggtccagtcaatttgccacacgcctctcggccattcattttggaaagccgatttcagagcctacaacagggcacatgcctggagactgaggatgtggctcagcagcagaatctcctgctgcaaaaggtaaaggcggagctggaggaggctaaacggtttcacattagtctccaagaaagctatcactccctgaaagaacggagcctgacggatctccagctgctgctggagtcgctgcaggaggagaagtgccggcaggctctgatggaagagcaagtgaatggacgtctgcaggggcagctgaacgaaatatacaacttgaaacacaatcttgcttgtagtgaagagagaatggcttatctgtcatatgagcgggctaaggaaatttgggagatcacagaaactttcaagagcaggatctcaaaattggagatgctgcaacaggtgacccagctagaggccgctgaacatctacaatcacgtcccccacagatgttgttcaagttcctgtcccccagactttcattggcaacggtcctgctggtgtttgtgtctacactgtgtgcctgcccctcttcattaattagctcccggctgtgcacctgcacaatgctgatgttgatcggcctcggggtgctggcttggcagcgctggagagcgatcccagctaccgattggcaagagtgggtcccctccaggtgtcgcctgtattctaaggatagtggtccacccgctgatggcccatag

SEQ ID NO: 243792 - DNA, 945 bp, Artificial Sequence
  Description of Artificial Sequence: Synthetic coding sequence
atgcggccagagggctcattaacgtatagagtgccagagcggctaaggcagggattctgtggcgtgggaagggctgcccaagccctggtctgcgcatccgctaaagagggcactgcttttagaatggaagcagttcaggaaggcgctgctggtgtggaatccgagcaagccgctctcggagaagaggcagtgctactgctggatgacatcatggccgaagtcgaggttgtggctgaagtggaggtggtggccgaggaggagggcctagttgagagaagggaggaggcccagagagcccagcaggccgtacctggcccaggcccaatgacacctgagtcggccccagaagaacttctggctgtgcaggtggaactcgaacctgtaaacgctcaggcgcgtaaggccttcagccggcagcgcgagaagatggaacgacgccgaaaaccccacctagacagaagaggggcagtcatccagtctgtgcccggtttttgggccaacgttattgctaaccatcctcagatgtcagcattaatcaccgacgaggacgaggacatgctgtcttacatggtctccctagaggtgggggaagagaagcacccagtccacctgtgcaagattatgctgtttttccgttctaacccctatttccagaataaggtgatcacaaaggaatacctcgtgaacattacggagtatagagccagtcacagtacgcccatagagtggtatccagattatgaagttgaagcgtatcgacggaggcatcacaattcttctctgaacttcttcaactggttctcagatcacaactttgccggatcaaacaagattgccgagatcctgtgcaaggatttgtggaggaaccccctgcagtattacaagcggatgaaaccccctgaggagggaactgaaacatcaggtgactcccagctgctgagctag

SEQ ID NO: 243793 - DNA, 927 bp, Artificial Sequence
  Description of Artificial Sequence: Synthetic coding sequence
atgaggccagagggaagcctgacctacagggtgcccgagcgcctgagacaggggttctgcggagtgggcagagctgcacaggctctcgtgtgcgcgagtgccaaagaaggcacagctttcaggatggaagcggtgcaggaaggcgcagccggagtcgaatcagagcaggcggctcttggcgaagaggccgttctactcctggatgacatcatggccgaggtggaggtggtcgctgaggaggagggcctcgttgaaagaagggaggaggcacagagggcacagcaagccgtgcctgggccaggtccgatgacccctgaaagcgctccggaagagctcttggccgtccaggtagagctcgaacctgtgaacgctcaggccaggaaggcattcagtaggcagcgcgaaaaaatggaaagacgccgtaagccacatttagaccgaagaggcgctgtgatacagtcagtgccgggattctgggccaacgtaattgccaaccacccacagatgtctgctctgatcaccgacgaagacgaggacatgctgtcttacatggtttctctggaagtcggcgaagagaaacacccagtccacctgtgtaagattatgctgttctttcggtcgaacccatacttccagaataaggtcattaccaaggagtacttagtgaatatcacggaatatagagcttctcattcaacgcctattgaatggtacccggactatgaggtggaggcctatcgcaggcggcatcacaactcatctctgaattttttcaattggttctccgaccacaatttcgcaggttccaataaaattgcagaaattctgtgcaaggatctatggagaaatccccttcagtattacaaacgaatgaagcctcctgaagaaggaaccgagacttctggcgacagccaactcctatcttag

SEQ ID NO: 243794 - DNA, 2097 bp, Artificial Sequence
  Description of Artificial Sequence: Synthetic coding sequence
atgatgcgcagccgctccaagagcccgagacggcctagccccaccgctcggggtgctaattgcgacgtggaactgctcaagaccacgaccagggaccgggaggagctaaagtgtatgctggaaaagtatgagagacacctcgctgagatacaggggaacgtgaaagtcctgaaatcggaacgggacaagatattcctcttgtacgagcaggctcaggaagagataacccggcttcgcagagagatgatgaaatcatgcaagtcccccaagagcaccacagcacacgccattctgcggagggtggaaactgagcgggatgtggccttcaccgacctgagacgcatgaccactgagcgggatagcctccgggagcgactgaaaatcgcccaggaaaccgcctttaacgaaaaagctcaccttgaacagcgtattgaggagcttgaatgcacagtccataatctggatgacgagcgaatggaacaaatgagcaacatgacccttatgaaagagacaatttcaacagtggaaaaggagatgaaaagcctggcgaggaaggctatggataccgagtcggagctgggcaggcagaaagctgagaacaacagtttgagactgctgtatgagaacacagaaaaggatctgtcggatacacagagacatctagcgaagaaaaagtatgagttgcaactaactcaagaaaagatcatgtgtttggatgaaaagatagacaacttcacaagacagaacattgctcagcgggaggaaattagtatactgggaggcaccctgaatgatttggccaaggaaaaagaatgcctgcaggcttgcttggacaaaaagtcagagaacattgccagcctgggagaatccctggctatgaaggagaaaaccatttccggtatgaagaacattatcgccgaaatggaacaagcctcacgccaatgtaccgaggcccttatcgtctgtgaacaggatgtcagcagaatgagacggcagcttgatgagaccaatgatgaactggcacaaattgcacgcgaacgggacatcctggcgcatgataacgataatctccaggaacagttcgctaaggcaaaacaggagaatcaggccctcagtaaaaagttgaacgacacacataatgaactgaatgatatcaaacaaaaggttcaggacactaaccttgaggtcaataagctgaagaatatccttaagtccgaagaaagtgagaataggcaaatgatggagcagctccgtaaagccaatgaagacgctgagaattgggagaacaaggcccgacagtcagaagcggataacaacacactcaagctcgagttgataactgctgaggctgaaggaaatcggctgaaggagaaagtggacagtctgaaccgggaagtggaacaacaccttaacgccgagcgcagctataaaagtcagatctcaaccttgcacaaatcagtggtaaagatggaagaagaacttcagaaggtgcagttcgagaaggtcagtgcactcgctgatctgtcaagcactcgcgaactgtgtattaaactcgacagctcaaaagaactgctgaacaggcagctggttgccaaagatcaggagatcgagatgcgggaaaacgagttagattccgcccacagcgaaattgaacttctgcgcagccagatggccaacgagcgcatttcgatgcagaacttggaggcacttctggtggcaaatcgggacaaggagtaccagagccagattgcgctgcaggaaaaagagtcagagatacagctcttgaaggagcacctctgtctcgctgagaacaaaatggcgatccaatccagagatgttgcccagttccggaatgtagtgacccagcttgaggctgacttagacatcaccaagcgtcagctcgggacggaaagattcgagcgggagcgagccgtgcaagagctacgcaggcagaactacagtagcaacgcatatcatatgtcttccactatgaaaccaaacactaaatgccacagccccgaaagagctcaccaccgctcacctgatagggggctggaccgctctctagaagaaaacctttgctatcgggacttttag

SEQ ID NO: 243795 - DNA, 2073 bp, Artificial Sequence
  Description of Artificial Sequence: Synthetic coding sequence
atgatgagaagccgctccaaatctcctaggcgaccatctcctaccgcccgtggggcaaattgcgacgtggaactcttgaagacaaccactagagaccgagaagaactgaagtgcatgttggagaagtatgagcggcatctagctgagatacagggaaatgtaaaggtgctgaaatctgagagggataagattttcctgctgtacgagcaggctcaggaagagatcaccagactccgcagggagatgatgaagtcctgcaagtccccaaagtccactacggcacacgcaatcctccgacgggtcgaaacggagagagatgtggcatttaccgacctgagaagaatgactaccgaaagggactcactgcgcgagcgattaaagatcgcacaggagacggccttcaatgaaaaggcccatctggaacagaggatagaggaactggagtgtactgttcacaacctggacgatgaacgcatggagcagatgtcaaatatgacactaatgaaggaaaccatttcgactgttgagaaagagatgaagagcctggctcggaaggccatggacactgaatcagagctaggacgacagaaggcagaaaacaacagtcttaggctgctatacgaaaataccgaaaaggatttgagtgacactcagagacacttagccaagaagaagtacgagctgcagttgacccaagagaaaattatgtgtctcgacgagaagatcgataattttaccagacagaatatcgcacaaagagaagagatttcaatacttgggggaacactcaatgacttggccaaagaaaaggagtgtctccaggcctgcttggataagaaaagcgaaaatatagcgagtcttggagaaagcctcgctatgaaggagaaaacgatttctggcatgaagaatatcattgctgagatggagcaagcatcaaggcagtgtactgaggctctgatcgtgtgtgaacaggatgtttcccggatgcggaggcaactggatgagacaaacgatgagctggctcagatcgccagagaacgcgatatattagcccacgacaatgacaacctgcaggaacaatttgctaaggccaagcaggagaaccaggcactgtcaaaaaagcttaatgacacccacaacgaactgaatgacataaaacagaaagtccaggacacaaacctcgaagtgaataagctgaaaaatatacttaaaagcgaggaaagcgagaacagacagatgatggaacagcttcgaaaggcgaacgaggatgcagaaaactgggagaacaaagccaggcagagcgaggccgataataataccttaaagctcgaactgattaccgctgaggccgaggggaaccggctgaaggagaaggtcgatagtctcaacagagaagttgaacagcaccttaacgccgagaggagttacaaaagccagatttctaccctgcataagagcgtggtcaagatggaagaggaattgcagaaggtacaatttgagaaggtcagcgccttggctgacctgtcctccacccgggagttgtgtattaagctggactcctcaaaagaactgttgaacagacagctcgttgccaaagatcaggagattgagatgcgtgagaacgaactcgattctgcccacagcgagatcgagctgcttcggagccagatggcgaatgaacgcatttctatgcaaaatttggaagcattactcgtcgctaacagagacaaagaataccagtctcagattgcattacaggaaaaagagagcgagatccagcttttgaaagagcacctttgcctggccgagaacaagatggcaattcagtcaagagacgtggcccagttccgtaacgtcgtcactcagctggaggctgatctcgacattactaagagacagctcggaacagaacgattcgagcgcgagagagcggtgcaggagctaagacgacaaaattactcttctaacgcctatcacatgtcatctaccatgaagcccaatactaaatgtcactcaccagaacgcgctcaccatcggtcccccgatcgcggtctggatcgcagtttggagtag

SEQ ID NO: 243796 - DNA, 2097 bp, Artificial Sequence
  Description of Artificial Sequence: Synthetic coding sequence
atgatgaggagtagatcaaagtctcctcgtagaccatcacccactgcacgcggtgccaactgcgacgtggagcttctcaaaacgacaacccgagacagggaggagctcaagtgcatgctggaaaagtacgagaggcacctcgccgaaatccaggggaacgtaaaagtcctaaaatcagaacgtgacaaaatttttcttctgtacgagcaagcgcaggaagagatcaccaggctgcgcagggaaatgatgaaaagttgtaagagtcccaagtccactaccgcgcatgccattctgcggagggtggaaaccgagcgggatgtggcttttacggatcttcgcaggatgaccaccgaaagggattctctgcgggagcgtttgaagatcgctcaagagaccgcttttaacgagaaagcgcatctagaacaaaggatcgaggaactggaatgcaccgtccataatctggatgacgagaggatggagcagatgagtaacatgaccctaatgaaggagaccatttcgactgtagagaaggagatgaaaagcctggccaggaaagccatggacaccgagagcgagctgggccgacagaaggctgagaacaactccctccgactgctctatgagaatacagaaaaagacctcagcgacactcagcgtcatttggctaagaagaagtacgaattgcagttgacacaagaaaagattatgtgcctggacgagaaaatcgacaactttaccagacaaaacatcgcacagcgggaagaaatctccatactaggtggcactctgaatgatctggctaaagagaaggaatgcttgcaggcctgcctggacaagaaaagcgagaacatcgcaagtttgggcgaaagcctggccatgaaggagaaaacgatcagcggtatgaagaacatcatcgccgagatggaacaggcgagccgacagtgcaccgaggccttaattgtttgcgagcaggatgtttcacggatgcgcagacagctggatgagactaatgatgagctcgcgcagatagccagggagagggacatcctcgctcacgataatgacaacctgcaggaacaatttgccaaagctaaacaagaaaaccaggcgctgagtaagaagcttaacgacacccataatgagctcaatgacatcaagcagaaagtccaggatactaatctggaagtcaacaaactcaaaaatatcctgaaatcagaggaaagcgagaaccgacagatgatggagcagttgaggaaagcaaatgaagacgccgaaaattgggaaaataaggcaagacagagtgaagcagacaacaacacactaaagctagaactgatcaccgcggaagcagagggcaacaggctgaaagaaaaggtcgatagcctaaaccgtgaggttgaacagcacctgaatgccgaaaggagctacaagagccagatttcaacactacacaagagcgtcgtgaagatggaagaagaactccagaaggttcagttcgaaaaggtgtccgctctcgccgatctgtcaagcactagagaactttgcatcaagttggattccagcaaagaactgctaaaccgccaactggtagccaaagaccaggaaatcgagatgagggagaatgaactcgattcagcccatagcgaaatagagctgttgcgctcacaaatggcgaatgagcgcatttccatgcagaatcttgaagccctactcgtagcaaatagagacaaagaatatcaaagccagatagccctgcaggaaaaagagagcgagatccagttacttaaggaacacctgtgcctggccgagaacaagatggccatccagtccagagatgtggctcaattccgcaatgtggtgactcagctcgaagccgatcttgacataacaaaaagacagctcgggactgaacgatttgagcgggagcgggcagtacaagagctgaggcggcagaattactcctcgaacgcttatcacatgtcctcaacaatgaagcccaataccaaatgtcactccccggagagagcacatcatagatctccggacaggggcttagatcgctctctggaggaaaatttgtgctatcgcgacttttag

SEQ ID NO: 243797 - DNA, 2097 bp, Artificial Sequence
  Description of Artificial Sequence: Synthetic coding sequence
atgatgcgcagtcggtctaagtctcccaggaggccttctcctacggcaagaggtgccaattgcgatgtcgagcttttgaaaaccacaaccagggacagagaagaattaaagtgcatgctcgagaaatacgaaagacacctggccgagatccaaggtaacgttaaagtacttaaatctgaaagggataagatctttctgctgtacgaacaagcccaggaagagattacgcgtttacgacgtgaaatgatgaagagttgtaagtcacctaagtcaactaccgcccacgccatcctgcgccgagtggagaccgagcgggacgtggcttttactgacctcagacgcatgaccacagaacgagattcacttcgggagcggctcaaaatagctcaggaaacagcgttcaatgaaaaggcccatctggaacaaagaatcgaagagctggaatgcactgtccataacctcgacgacgaaaggatggagcagatgtccaacatgacactgatgaaagaaaccattagtaccgttgagaaagagatgaagtccctggccagaaaggccatggatacagaatccgagctggggcgtcagaaagcagagaataacagtctgcgactactgtacgaaaacacagaaaaagacctctctgacactcagcggcacctggccaaaaagaaatatgagttacaactcacacaggagaagatcatgtgccttgatgagaagatcgataattttactcgtcagaatatcgcgcagagggaggaaattagcattttgggcggtacacttaacgatttggctaaggagaaggaatgccttcaggcgtgtctagacaagaaaagcgagaacattgcctcattaggcgagagtttggcaatgaaggaaaagaccatctcaggaatgaagaacattattgctgagatggaacaggcttcacggcaatgtactgaggccctcattgtgtgtgagcaggatgtctcccgcatgcggaggcagctggatgaaacaaacgacgaattggctcagatcgctagagagcgtgacatcctggcccacgacaatgacaaccttcaagaacagtttgctaaggcaaagcaggagaatcaagcattatcaaagaagttaaacgacacccacaacgagttaaatgatattaaacagaaagttcaagataccaatttggaagtgaacaaactgaaaaacatactgaaatccgaagaatcggagaatcggcagatgatggagcagctccgcaaggctaacgaggatgcagagaattgggaaaataaggccagacagtcagaagcagataataatactcttaagctcgagctgatcactgctgaggcagagggaaacaggctcaaagaaaaggtggacagtctgaatagggaggtcgagcagcatctgaacgcagaaaggtcgtacaagtcccaaatttcaacacttcataagagcgtcgtgaagatggaagaggagctgcagaaggtgcaatttgagaaagtatccgcactagctgatctctcatccacgagggaattatgtattaagctagattcgtccaaagagttgcttaacaggcaacttgtggccaaagatcaagagattgagatgcgggagaacgaactcgactccgcgcactccgagatagagctgctgcgctcccagatggctaatgagcggatcagcatgcagaacttagaggccctgctggttgctaatcgcgacaaagaatatcagagccagattgcactgcaagaaaaggaatcagaaattcaactgttgaaggagcatctctgcctggccgaaaataagatggcaattcagtccagggatgttgcccaattcaggaacgtggtcacccagcttgaggcggatctagatattacgaaacgtcaactcggcacagagaggttcgagagagagagggcagtccaagagttgagacggcagaattactcgtcaaatgcctatcacatgtccagtacaatgaagccaaataccaagtgtcactccccggaacgcgctcaccatcgaagcccagataggggactggataggagcttggaagagaacctctgctatagagatttttag

SEQ ID NO: 243798 - DNA, 2097 bp, Artificial Sequence
  Description of Artificial Sequence: Synthetic coding sequence
atgatgcgctcgagatccaaatcacctcgtcgcccttcaccaaccgctcgtggcgctaactgcgacgtggaactcctaaaaaccaccaccagggaccgggaggagctgaagtgcatgttagaaaagtacgagcggcatctagccgagatccaggggaatgtgaaggttttgaaatccgaaagggacaaaatcttcctgttgtatgaacaggcgcaggaggagattacaaggctgagaagagagatgatgaaaagctgtaagagccccaagtcaacgacagcccatgccatcctgcggagggttgagacagaacgagacgtagcgttcaccgacctgcgacgaatgacaaccgagagggatagcctacgggaacgcctcaagattgcgcaggagaccgcattcaatgagaaggctcatctggaacaacggatcgaggagctggaatgcactgttcacaaccttgacgatgaacgcatggaacaaatgtctaatatgaccttaatgaaggagaccatctctaccgtagagaaggaaatgaagtctctcgcgaggaaggccatggacaccgaatcagagctcgggagacagaaggcagagaacaatagtctgagactcctgtatgagaatacagaaaaagacctgtctgacacccaacggcatctggcaaagaaaaagtacgaactgcagctgacacaggagaagatcatgtgtctagacgaaaagatagacaatttcacaaggcagaatattgcacagagggaggaaatcagtatcctcggtggaacactgaacgatctggcaaaggagaaagaatgccttcaggcctgcttggacaaaaagtccgaaaatattgccagccttggggagagtcttgctatgaaagagaagactattagtggtatgaagaacattatcgccgagatggagcaggccagccggcagtgcacagaggccctcatagtctgtgagcaggatgtgagccgaatgcgacgccagttagacgaaaccaatgacgagctggcccagatagccagagagagggatatcctcgcccacgacaacgataaccttcaggagcaatttgcaaaagccaagcaggaaaaccaagcgctatctaagaaactcaacgacacacacaacgagctgaacgatatcaaacagaaagtgcaagacacgaacttagaggtaaacaagctcaagaacatcctcaagagcgaggaaagtgagaatagacagatgatggagcagctgagaaaggccaatgaagatgccgagaattgggagaataaagctcgacaaagcgaagcggataacaacaccttaaagttagagctcattactgctgaagccgagggcaaccgccttaaagagaaggtggattccttgaacagggaggttgaacaacacctcaacgctgaacgcagttataaatcccaaatctctacgctgcacaaatctgtggtcaagatggaggaagagctgcaaaaagtgcagttcgagaaggtgtcagctctggcagacctcagttccacccgggaactctgcattaaattagactcaagcaaagagctgctgaatcgtcaactggtggctaaggaccaagaaatcgagatgagagagaacgaactagactcggctcactctgagatcgagctcctgcggtcacagatggcaaacgagagaatttccatgcagaatttagaggcattgctggtggccaaccgggacaaggaatatcagagccagatcgctttgcaggagaaagagagcgagatccagctgctcaaggagcatctgtgcctcgctgagaataagatggcaattcagagtcgggatgtggctcagttccggaatgtagtcacccagctggaggcggacttggacatcacaaagcggcaactcggcacagagcgtttcgagcgcgagagggcggtccaagagctgaggaggcagaattactccagcaatgcatatcacatgtcctcaacaatgaaacccaatacaaaatgccactctccggagagggcccaccatcgttctccagaccgagggctggacagatccctggaggagaatttatgctatagggacttttag

SEQ ID NO: 243799 - DNA, 894 bp, Artificial Sequence
  Description of Artificial Sequence: Synthetic coding sequence
atgatgagatcacggtccaaaagcccacgcagaccctcccctacagccagaggcgctaactgcgatgttgagctgttgaagacaactacacgcgatcgcgaggagctgaagtgtatgctggagaaatatgagcggcacctagcagaaatccaggggaacgtcaaggtcctgaagtctgagcgtgataagatcttcttactctacgagcaggcacaggaggagatcacccgattgcggagggaaatgatgaaatcttgtaagtctcccaagtccacgacggcccacgccatccttagacgcgtggagaccgagcgagatgtcgcctttactgatcttcggagaatgaccaccgaaagagattcacttagagaacggctgaaaatagcccaggaaacagcatttaacgaaaaagcacacctggagcagcggatcgaagagctggaatgtacagtccacaacctcgacgatgagaggatggagcagatgagtaatatgacgttgatgaaggagaccatctcaacagtcgagaaggaaatgaagagcctagctcgaaaagccatggatactgagagcgagctgggacggcagaaggctgaaaacaatagtcttaggctgctctatgagaacactgaaaaggacttgtcagacacacagaggcacctcgcgaagaagaagtacgagctccagttaactcaggagaaaattatgtgtttggatgagaagatagacaacttcacacggcagaacattgcccagcgcgaggaaatctcgatcctgggcggaacgctgaatgatttggccaaagaaaaagaatgtctccaggcttgccttgataagaagagcgaaaacatcgcgtcactgggagagtccttggccatgaaaaccgtatattag

SEQ ID NO: 243800 - DNA, 1881 bp, Artificial Sequence
  Description of Artificial Sequence: Synthetic coding sequence
atggcaggcgaacggccacctcttaggggccctggccctggacctggtgaggttcctggggaaggacctccgggaccagggggaacgggtgggggacccggtagaggcaggcccagttcctatcgcgcacttcggtccgctgtgtcatccttggctcgcgtagatgatttccactgtgctgagaaaatcggtgccggatttttttctgaagtctacaaggttcgacacaggcagtcaggccaggtgatggtgctgaagatgaataagctccccagcaaccgcggaaacactctgagagaagtccagctgatgaacagactgcggcaccccaacatcctgcggtttatgggagtgtgtgtccaccagggacagctgcacgccttgactgagtatatgaatggaggcacacttgagcagctgctttcatcccccgaacctcttagctggcccgtgaggctgcacttggccctggacatcgcacggggactccgatacctccacagtaagggtgtcttccaccgagacctgacgagcaagaactgtctggtgcgcagggaagatcggggatttacagcggtcgtcggggattttgggcttgctgagaaaattcctgtgtatagggagggtgccagaaaagaaccactggccgtggtgggctccccttactggatggcccctgaggttcttaggggtgagctctatgatgaaaaggcggatgtgttcgcatttggaatcgtgctgtgcgaattgatcgccagagtgccagccgatcccgattatttgcccaggacagaagactttggcctggacgtcccagcattccggaccctggttggagatgactgtcctctaccctttctgctcctcgcgattcactgttgcaatcttgagcccagtacccgcgctcctttcactgagattacccaacatctagagtggatactcgaacagctgcccgagcctgctccactcacccgtactgccctgacccataaccaaggatcagtggcccgagggggtccaagcgcgaccttacccaggccggaccccagactcagtaggagtaggtcagacctgttccttccaccttctcccgagtcaccaccgaactggggcgacaatttgacccgggtcaatccattctcgttacgtgaggacctgcggggaggaaaaattaaactgctcgacaccccttcgaagcctgtacttccactcgtgccaccctcccccttcccttctacacagctgccacttgtgactacgccggagacattggtccaacccggaacgcctgccagacgatgccgcagtcttccctctagtcccgagctgccccgtcgtatggaaacggccctgcccggacctggcccaccagccgttggtcctagcgcagaagagaagatggagtgcgagggcagcagtccagagccggaaccacctggtcctgcacctcagctgcctctggccgtggcgactgataactttatatccacatgcagttctgcctcacagccatggtctcctcgctccgggccagtgttgaataataatccaccagcagtagtggtgaatagcccacaaggttgggctggggaaccgtggaatcgagctcaacattcactgcctcgcgctgctgcccttgaacgcactgagccgtcccctccccctagcgctccacgcgagcccgatgagggccttccctgccctggctgctgcctgggcccattcagcttcggtttcctgtctatgtgtccaaggccaacccccgcagtggcgcgatacaggaacctcaattgcgaagctgggagcctgttatgccatagggggcatcatgcgaaaccgcctacacctagcttgcagctgcctggggcacgcagctag

SEQ ID NO: 243801 - DNA, 474 bp, Artificial Sequence
  Description of Artificial Sequence: Synthetic coding sequence
agcgcccgagctgcggctctttctagaaacctgcagggtcagagacctctcccactcgctgtcgcgacagataactttatcagcacctgttcctcagcctcacaaccttggtcacctaggagcgggcctgtcctaaataacaacccgcctgccgtggtggttaactcccctcagggatgggctggggagccttggaatcgcgctcagcacagtctcccgagagcggctgcattagagcggaccgaacctagtccaccaccctcagccccaagagagcccgacgaaggcttgccgtgcccagggtgctgcttaggcccattcagttttggattcctgtccatgtgccctcgcccaacccccgctgtggccaggtacaggaatctgaattgtgaggcaggatccctgctttgccacaggggccaccacgctaagccacccaccccaagcctgcagctcccaggtgccaggtcttag

SEQ ID NO: 243802 - DNA, 1077 bp, Artificial Sequence
  Description of Artificial Sequence: Synthetic coding sequence
atggatgatgccacagtacttaggaagaaagggtatatcgtgggaatcaatctggggaagggcagttacgccaaggtgaagagtgcatactcagagagactgaagtttaacgtggctgtcaagatcatcgataggaagaaaacaccaactgactttgtcgaacggtttcttcccagagagatggatatactggcgaccgtcaaccatggctctatcatcaagacatacgaaattttcgaaacaagtgatggcagaatttatattatcatggagctgggagtccagggggacctattggagttcatcaagtgtcagggggcactgcacgaggatgtggctcgtaagatgttcagacaactgtcctccgccgtcaagtattgtcacgatctggacatcgtgcatagagatctgaagtgtgaaaacctgctgctggacaaggactttaatatcaaactatccgactttggtttcagcaagcggtgtctcagggactccaacggtcgtattatactaagcaaaacattctgtggtagtgcagcatacgccgctcccgaagtgctgcagtctattccataccagcctaaagtgtacgatatatggagtttaggtgtaatactgtacattatggtttgcggatccatgccctatgatgactctgatattagaaagatgctgcgcattcagaaagagcacagggtggatttcccgcgatccaaaaacctgacgtgtgagtgtaaagatctaatatatagaatgcttcagcctgatgtgtcccagcgactgcatatagacgagatcctcagccactcgtggctccaacctccgaaacctaaagccacctcctcagcatcattcaagagagagggtgaaggcaaataccgggcagagtgtaagctggatacaaagactggattgagaccagatcaccgccctgaccacaagttgggcgctaaaacacagcacagactacttgtagtgccagagaatgagaatcgcatggaggaccggctagccgaaactagtcgggcaaaagaccatcacatcagtggggctgaagtgggcaaagctagcacttag

SEQ ID NO: 243803 - DNA, 807 bp, Artificial Sequence
  Description of Artificial Sequence: Synthetic coding sequence
atggaggatttccttctttctaatggctaccaattggggaagaccattggggaagggacctactccaaagtgaaggaggcattcagtaagaagcatcagcgcaaagtcgctattaaagtgattgacaaaatgggcggacccgaggagttcattcagagattcctgcctagagaactccagattgtacgcaccctggaccataaaaacattatccaggtctacgaaatgttggaatccgcagatgggaagatttgcctagtgatggagctggccgaaggaggagatgtgtttgactgcgtcttgaatggcggacccctcccagaatctcgcgctaaagccctgttcagacagatggtagaagcaatccgttactgtcacgggtgcggagtcgcacatcgcgatctgaagtgtgaaaatgctctgctgcagggctttaatcttaagctgacggacttcggcttcgcgaaagtgctccccaagtctcacagggaactttctcagacgttttgcggctctactgcttacgcagcacctgaagttctgcagggcattccccatgactctaagaaaggcgatgtgtggagcatgggagtggtcctctatgtgatgctgtgcgcgtccctgcctttcgacgatactgacatccccaaaatgctgtggcagcagcaaaaaggcgtgtccttcccaactcatctgtcgattagtgctgattgccaggatctcctgaagagactattggaacctgacatgatccttagaccaagcatcgaagaggtctcctggcacccgtggctggccagcacatag

SEQ ID NO: 243804 - DNA, 987 bp, Artificial Sequence
  Description of Artificial Sequence: Synthetic coding sequence
atgggaaagggtgacgtgctggaggccgcacccacaactactgcctatcactctcttatggacgagtatggatatgaggtgggaaaagcaatagggcacggaagttacgggagcgtttatgaagctttctataccaaacagaaagtaatggtggctgtcaaaatcatttccaaaaaaaaagcatctgacgactacctcaacaaattcctccctagggagatacaagttatgaaggtgcttcgacataaatacctcataaatttctatcgggctatcgagagcactagtagagtgtatatcatcctggaactcgcacagggcggtgatgttcttgaatggatccagcggtatggcgcatgtagcgagccccttgccggaaagtggttcagtcagctgactctgggcatagcataccttcactctaagtctattgtccaccgagacctcaagctggaaaatctgctgctggacaaatgggagaacgtgaagatttcagacttcgggttcgccaaaatggttcccagcaatcagccagttgggtgctccccttcttatagacaggtcaactgtttctcacatctctcacagacatactgtgggtcattcgcctacgcttgccctgaaattctgcggggattgccttataaccccttcctcagcgacacatggtccatgggtgtgatactgtacacccttgtggtggctcacctaccatttgatgacaccaacctgaaaaagcttctccgagaaacccaaaaagaggttactttcccagctaatcacaccatcagccaggagtgcaagaatctcatactccagatgctgcggcaggccaccaaaagagccacgatactagatataatcaaagattcttgggtgctgaagtttcaacccgagcaacccacccacgaaatccgactcctggaagcaatgtgtcaactgcataacaccacaaagcagcatcagtccttgcagatcaccacatag

SEQ ID NO: 243805 - DNA, 1017 bp, Artificial Sequence
  Description of Artificial Sequence: Synthetic coding sequence
atgggtaaaggcgatgtgttggaggctgcccctaccaccaccgcgtaccactcgctaatggacgagtatggatatgaggtgggcaaggccattggccacggaagttatgggagtgtctacgaggcattctacacgaagcagaaagtcatggtggccgtgaagattatcagtaaaaagaaagccagcgatgattacctcaacaagttcctccctagagaaatccaggtcatgaaagtcctgagacacaagtacctaatcaatttttacagagcgatagagtccactagcagggtgtatattattctagaactcgctcagggaggcgacgtccttgaatggatccaaagatacggagcttgtagtgagcctcttgctggcaagtggttctcccagttgaccctgggtatagcgtatctgcacagtaaatctatagtgcatcggctgatgccctccctctcagccgcaggtagggacctcaaattggagaatttactgctagacaaatgggaaaatgtgaagatcagcgatttcggattcgcaaagatggtcccatcgaaccaacctgtagggtgctctccatcctatagacaggttaattgcttcagccatttgtcgcagacctactgtggaagctttgcttatgcgtgccctgaaatccttcgtggcttgccctacaacccttttctgagtgatacctggtctatgggggtgatcctctacactttagtagttgctcatcttcctttcgatgatacaaacctgaaaaagctgctgcgcgaaactcagaaggaagtcacctttcccgctaaccataccattagccaggagtgcaaaaacctcattctccagatgctaaggcaggccaccaagcgagcaaccattcttgacatcattaaagattcctgggtgctcaagtttcagccagagcagccaactcatgaaataaggctccttgaagccatgtgccagcttcataatacaactaaacaacaccagtcactgcagataaccacttag

SEQ ID NO: 243806 - DNA, 759 bp, Artificial Sequence
  Description of Artificial Sequence: Synthetic coding sequence
atgaaagttctgcgccacaaatatctgattaatttttacagagccatcgagagcacaagtcgtgtgtatattatcctcgagcttgcgcaaggcggtgacgtgctcgaatggattcagagatatggggcttgcagtgaacctttggctggtaagtggttcagtcagctgacactaggcatcgcttacctccacagtaagagcatcgtgcaccgcgacctcaagctggagaatctgctacttgataaatgggagaacgtgaaaatctccgatttcggctttgctaagatggtgccatccaatcaacctgtaggctgtagcccttcatacaggcaggttaactgcttctctcacctgtctcagacctactgtggctcctttgcatatgcttgcccagagatccttcggggtcttccttacaaccccttcctgtccgacacgtggagcatgggcgtaatactgtatacacttgtagtcgctcatctcccgttcgacgataccaatcttaaaaaattgctgcgggaaacccagaaagaagtgacgttccccgcaaaccatactatatcccaggaatgtaagaatttgattttgcagatgctacggcaagccaccaagcgtgctacaatcctggacatcatcaaggattcgtgggttttgaagttccaaccagaacagcccacccacgagatacggctgctcgaagcgatgtgccaactgcacaacaccaccaagcagcatcagagtttgcaaatcactacatag

SEQ ID NO: 243807 - DNA, 822 bp, Artificial Sequence
  Description of Artificial Sequence: Synthetic coding sequence
atgagcggagataaactgctctctgaactgggttataagctcggaaggactataggtgagggttcatattctaaagtcaaggtagcgacctcaaaaaaatacaaaggaaccgtggctattaaggtggtggaccgacgacgggctccacccgactttgtcaataagttcctccctcgcgagctgtctattctcaggggcgtgcgccatccccacatcgtgcatgtgtttgaattcatcgaagtgtgcaatggcaagctgtatatcgtaatggaagcagccgctaccgatctgctccaagctgttcagagaaatggtcgcattcctggtgttcaagctagagatctctttgcccagatcgctggcgcagttcggtacctccatgaccatcacctcgtccacagagacctgaaatgcgaaaacgtcttgctttcaccagacgagagacgggttaagctaacagattttggattcggaagacaggcgcacggttaccccgacctgagtaccacgtattgcgggtctgctgcctatgctagcccagaagttctgctcggcatcccttacgacccaaagaaatacgatgtgtggagtatgggggtggtgttatatgtaatggtcacagggtgcatgcccttcgatgactccgacattgctggtctgcctaggaggcaaaagagaggggtcctgtatcctgaaggtctcgagcttagtgagagatgcaaagcattgattgcggaactcttgcaattttcaccatcggcacgaccttctgccggacaagttgcccgtaattgctggttgagggcaggagactcaggatag

SEQ ID NO: 243808 - DNA, 822 bp, Artificial Sequence
  Description of Artificial Sequence: Synthetic coding sequence
atgtccggtgataagctcctctctgagttgggatacaaacttgggaggactatcggtgaggggagttacagtaaagttaaggtggccacctcaaagaagtacaagggcacagtggcaataaaggtagtggatagacgacgggctccacccgacttcgtgaataaattccttcctcgagaactgtccatcctgaggggggtccggcaccctcacattgttcacgtttttgaattcatcgaagtctgcaacgggaagttgtatattgttatggaagcagcagctacggacctcctgcaagctgtacagcgcaacggcaggatcccgggagtacaggcgagagatctttttgcccagatcgcaggcgctgtcaggtatttacatgaccatcatctggttcatcgggacctgaagtgtgaaaatgtgctgctctctcccgacgagagacgggtcaagcttaccgacttcggcttcgggcgtcaggcacacgggtatcctgacctctcgaccacatattgcgggtctgcggcttacgcctccccggaggtactgctgggcatcccgtacgaccctaaaaaatacgatgtctggagcatgggagtggttctgtacgtcatggtcacaggatgtatgccttttgacgactcagacatagctggattaccacggagacaaaaaagaggcgttctataccctgaagggctcgaattgtcagagagatgcaaagcattgatagctgagctcctgcagttctctccgtcagccaggcccagcgcagggcaggtggcgcgaaattgttggcttcgtgctggcgactctggctag

SEQ ID NO: 243809 - DNA, 6410 bp, Artificial Sequence
  Description of Artificial Sequence: Synthetic coding sequence
atgagtaggtcccggcatgctcgcccaagtcgtcttgtcagaaaggaagatgtgaacaagaagaaaaagaatagtcagctgcgtaagacaaccaaaggggcaaataaaaacgtggcatccgtgaagaccctgtccccaggcaaactaaaacaactgatccaggagcgcgatgtgaagaaaaagacggagcctaagccaccagtgccagtacgaagcctgctcactcgggcaggtgccgcaaggatgaacctggaccgcactgaagtcctttttcaaaacccagaatcgctgacctgcaacggcttcacaatggctctgagaagtacaagtctgtccaggcgtctgtcacagccaccacttgttgtggcaaagtccaagaaggtgcccctctctaaggggctagagaaacagcacgattgcgattataagatcctcccagcccttggggttaaacactctgaaaacgattcggtaccgatgcaggacactcaggtactgccggacattgagactctaatcggtgttcagaacccatccctcttgaagggcaagtcccaagagactacacagttttggagtcaacgagtcgaagactctaagataaacatccctacccattctggccctgcggcagaaatcctccccggacccttagagggtacacggtgtggagagggtcttttcagcgaggaaaccctgaacgacacctccggctcgcctaaaatgtttgcccaggacacagtttgtgccccttttccacagcgggctacacccaaagtgactagtcagggaaacccatctatccagctcgaggaactgggatccagggtggagagcttgaagttgagcgactcttacttagatcctatcaaatctgaacacgattgctacccgactagtagcctgaataaagtcatccctgatctaaacttacgcaactgtcttgcactcggcggttccacctctcccacctcagtgattaagtttctgcttgccggttcaaagcaggccacactcggcgcaaaacctgatcaccaggaagcctttgaggcgaccgccaatcaacaggaggtctctgacacaacaagttttctgggccaggccttcggggctatccctcatcaatgggagctccctggtgctgaccccgtgcacggggaggcgctcggagaaaccccagacctgcctgaaattcccggtgctatccctgttcaaggcgaagtattcggtactatcctggaccagcaggagacgctcggtatgtcgggcagcgtcgtacccgatctccctgtttttctgccagtgccccctaacccaatcgccaccttcaacgcaccatcaaagtggccggagccgcagagcactgtgagctacggactggccgttcaaggtgccattcagattctgcctttaggaagcggccatacccctcaaagctccagcaatagcgaaaaaaactcactgccacctgtgatggctatttcaaatgttgagaatgagaaacaagtgcatatctccttcctgcctgctaatactcaagggttccccctagctccagaaaggggactgttccatgcaagtttaggcatcgcccaactgtcccaggctggtccaagcaagtcagatcgcggatcttcacaggtcagcgtgaccagcacggtgcacgttgtcaacacaactgttgtcacgatgcccgtgcctatggtgagcacctctagcagttcttatacgaccctgctgcctacgcttgagaaaaaaaagcgcaagaggtgtggagtttgtgaaccctgccagcaaaagacaaactgtggagagtgcacatactgcaagaaccggaaaaactcacatcagatctgtaagaagaggaaatgtgaggagctcaaaaagaagccttccgtcgtggttcccctggaagtgatcaaggagaataaacggccacagagggagaaaaaacccaaggttctcaaggctgattttgataacaagccagtgaacggccctaagtcggagtctatggattacagccgctgcgggcacggggaagagcaaaagcttgaactgaatccacacaccgtcgaaaacgtgaccaagaatgaagactccatgacgggcattgaggtcgagaaatggactcaaaacaaaaaatctcagcttaccgatcatgtgaagggcgacttcagtgccaacgtgcccgaggcagagaagagcaagaatagtgaagtagacaagaagagaaccaagtctcccaagctgttcgtgcaaaccgtgcgaaacggaataaaacacgttcattgcctcccagccgagaccaacgtgagtttcaaaaaattcaacattgaagaattcggaaaaaccctggaaaacaatagctataagtttctgaaagacactgctaatcacaaaaatgcaatgagttcagttgccacagatatgagctgtgaccatctgaaaggccgtagtaacgtgctggtctttcagcaacccggttttaactgcagctccattccccattccagccactctatcataaaccatcatgcctctattcacaacgagggagatcagccgaagacacccgagaatatcccatccaaagagcctaaggatggtagccccgtgcagccatctctgctctccttgatgaaggatagaagattgacactggagcaagtggtggctatagaggcattgacccaattgtcagaagcaccatctgagaatagtagcccatctaaatccgaaaaggacgaggagagcgaacagaggacggcttccctcctcaactcctgcaaggcgattctgtacactgtgcgaaaggatctacaggaccccaacctgcaaggcgaaccacctaaactgaatcattgccctagcctggaaaagcagtcatcttgcaacaccgttgtattcaatggtcagaccacaacccttagcaattcacatatcaatagtgccacaaaccaagccagcaccaaaagccatgaatattctaaggtgaccaactcactgagcctcttcatcccgaaaagcaactccagtaagatcgatactaacaagagcattgcccagggaattatcacattggataattgctccaacgacctgcaccagttgcccccacgaaacaatgaggtcgagtactgtaaccaactgctggactctagcaagaaattggatagcgacgacctctcttgccaagacgccacccacactcagatcgaggaagatgtggcgacacaactgacacagctcgcgtcgatcattaaaattaactatataaaaccagaggataagaaagttgagtccacccctacatccttagtgacttgtaatgttcagcaaaaatataatcaggagaagggaacaattcagcagaagcctcctagctctgtgcataacaaccatggttcttctcttactaagcagaagaatccaacccagaagaaaactaaaagtacgccctcccgggatcgacggaagaagaagcccaccgtggtgtcttaccaagagaacgatagacagaagtgggagaagctgagctacatgtacgggaccatatgtgacatttggattgcctcaaagtttcagaactttggtcagttttgtccacacgacttccccacagtcttcgggaagatcagctcatccaccaaaatttggaagccactggcacagactcgctcaataatgcagcctaaaactgtgtttcctcctctgacccagatcaaattgcagagatatccagaaagtgccgaagagaaggtgaaggtcgaaccattggactctctgagtctgtttcatttgaagacagaatccaatggcaaggcattcaccgataaggcttacaacagccaggtgcagctcacggtcaatgcaaatcagaaggcccacccattgacacagccttcttcccctcctaaccagtgtgctaacgttatggcaggggacgatcagattcgtttccaacaggtggtaaaggaacagcttatgcaccagcgcttacccaccctgccaggcatctcacacgaaactccactccccgaatctgcattaacgttacgcaacgtgaacgtggtatgctccggcggtatcacagttgtgagcacaaagtccgaggaagaggtttgctcttccagctttggcaccagcgagttttctaccgtggacagcgcgcagaagaacttcaatgactacgccatgaatttctttaccaacccgacaaaaaacttggtatcgatcacaaaagatagtgagctgccaacctgcagctgcctagaccgcgtgatacagaaggataagggaccttactacactcacctcggtgctggacccagcgttgcagctgtcagggagattatggaaaacaggtacggccagaaggggaatgcgattcgcatcgagatcgtggtgtacacaggaaaggagggaaaaagctcgcatgggtgtccaatagcaaaatgggtgctgagacgctcctccgacgaagagaaggtgctttgtctggtgaggcaaaggaccggccaccactgtcccaccgccgtgatggttgtcctgataatggtttgggatggtatacctttgccgatggcggaccgcttatatacagagctgaccgaaaatctcaagagttacaacggccaccccacagacaggcgctgtaccctcaacgagaatagaacttgtacctgccaagggatagaccctgagacatgcggggcatccttttcttttggatgctcttggtctatgtacttcaatggctgtaagttcggtcggagccccagtccacgcaggtttaggattgatccatcatccccactccacgagaaaaacctcgaagacaacctacagagcttggcgaccagattggcccctatttacaagcaatatgcacccgttgcttaccagaatcaggtcgaatacgagaacgtcgcgagggagtgtaggttagggagtaaagagggcaggcccttctctggggtgacggcttgtcttgatttctgtgcccacccccaccgcgacattcataacatgaacaatggaagtaccgtggtgtgcacgctgacacgggaggataaccggtccctgggtgtgatacctcaggatgagcagctgcatgtgcttcccttatacaaactgtcagataccgacgagttcggttctaaggagggcatggaggccaagatcaaatccggagctattgaggtgctagctcccaggcgcaagaaacgaacatgtttcactcagcccgtgccccgtagcggcaagaagcgcgcagccatgatgactgaagtgcttgcacacaagattcgggctgtggaaaagaagccaatacctagaatcaagaggaagaataattcaacgaccacaaataattcaaaaccctcctcactgccaacgctgggcagcaacaccgaaacagtgcagcctgaggtgaaaagcgaaacagaaccacactttatactgaaatccagcgacaatacaaagacctactccctcatgccaagcgcccctcaccctgttaaggaagctagtccgggtttcagctggtctcccaagacagcctctgcaacgccagctccactgaaaaatgatgccaccgcgtcctgcggcttcagtgagaggagttcaacaccccactgtacaatgccgtctgggcgtctgtccggtgccaacgctgctgctgccgatgggcctggaataagccaactgggtgaggtggcccctcttcccactctgagcgccccagtaatggaaccccttattaattccgagccctcaactggagtaaccgaacccctcactccacaccagccaaaccaccaaccctctttcctgacaagtccacaggatctggctagttcaccaatggaggaagacgagcagcactctgaggccgacgagccacctagtgatgaaccactgtctgatgacccactaagcccagctgaagagaaactgccacacatcgacgagtattggtctgattcggagcacatcttcttagacgcaaatatcggcggtgttgccattgcaccggctcacggttctgtccttattgagtgtgcccgaagagagcttcacgccacgacccctgttgaacaccctaaccgtaatcaccctacccgcttgtctcttgtgttttatcagcacaagaatctcaataagcctcaacatggctttgaactgaacaaaattaaattcgaagctaaggaggccaaaaacaagaaaatgaaggcctctgagcagaaagatcaggccgctaacgaggggccagaacagagtagcgaggttaatgagctgaaccaaataccctcccataaggccctgactctgacccatgacaacgtggtaactgtctctccgtacgcactgacccatgttgcaggaccatacaatcactgggtcta

SEQ ID NO: 243810 - DNA, 330 bp, Artificial Sequence
  Description of Artificial Sequence: Synthetic coding sequence
atggctgaccgcctgtatacagagctgaccgagaacttgaaaagttataacggtcaccccacagatcgccgatgtacactcaacgagaatcgaacatgcacatgccagggcattgatcccgagacgtgtggggcaagtttcagcttcggttgtagctggtccatgtatttcaacggctgcaaattcggaaggagtccatctcccagacgcttcagaatcgatccctcatcccccctgcatacctactacgagcgcattaccaaaggtcggaacccagaaagacggtacatgaagcctgaacgcatcagcccgggacacgaagcgatgtag

SEQ ID NO: 243811 - DNA, 726 bp, Artificial Sequence
  Description of Artificial Sequence: Synthetic coding sequence
atgcagtgtttctcttttatcaagacaatgatgatactgtttaatctgttaatcttcctctgcggtgcagctctcctggctgttggtatctgggtgtccattgacggcgcatccttcctgaagatcttcggcccactgagtagctccgctatgcaatttgtgaacgtgggctattttctcatcgccgctggagtggtggtctttgcactgggctttctcgggtgttacggggcaaagaccgaatccaaatgcgccctggtcacctttttttttatcctgttgctcattttcatcgcggaggtggccgctgcagtagtggcactggtatacactaccatggcagagcactttctcaccctgcttgtcgtccccgcaataaagaaagattacgggtcgcaggaggactttactcaggtgtggaacacaactatgaagggcttaaaatgctgcgggttcacaaattatacagactttgaagattctccatattttaaggagaattctgcatttcctcccttttgttgcaacgataatgtgacgaatacagctaacgagacatgtacaaaacagaaggcccacgaccagaaagttgaaggatgttttaaccaactgctgtacgatattcgcaccaacgccgtcacagttgggggagtggcagcaggcatcggtggcctggagcttgcagctatgattgtgtcaatgtacttgtattgtaacctgcagtag

SEQ ID NO: 243812 - DNA, 702 bp, Artificial Sequence
  Description of Artificial Sequence: Synthetic coding sequence
atgtcatcatactttgtcaatcctactttccccggttccctaccctccggacaagacagttttctaggccagctgcccttgtaccaggcaggctatgacgctttaagaccctttccagccagttatggcgcttcttcgctgcccgataaaacttacacatcaccatgcttttaccagcagtccaatagcgtcttagcttgtaatcgagcctcttacgagtatggcgcttcttgtttctattctgacaaagatctctctggggcttcaccatcgggaagcgggaaacagcgcggacccggtgactacctgcacttttctccagagcagcagtacaagccagactctagctccggccagggtaaagccctgcacgacgagggcgctgatcggaagtatacaagtcctgtgtatccttggatgcaacgtatgaattcctgcgccggtgctgtctacggttcacatggcagaagaggcaggcagacgtatacacggtaccaaacattagagctggaaaaggaattccattttaacagatacctgacacgtagacggagaattgaaattgcgaatgcactctgtttgactgaaaggcagatcaagatttggttccagaataggcggatgaagtggaaaaaagagaacaaacttataaatagcacccaacccagcggcgaagattctgaggcgaaagcaggcgagtag

SEQ ID NO: 243813 - DNA, 918 bp, Artificial Sequence
  Description of Artificial Sequence: Synthetic coding sequence
atggccagggaggactcagtgaagtgtttgcgttgcctactctacgctctgaacctgctcttctggctgatgtccatctcagtactggcagtgtccgcatggatgcgcgattatttaaataatgtgctgacacttaccgccgagaccagggtcgaagaggcagtcattctcacttattttcccgtcgtccacccagtcatgatcgcagtgtgttgcttcctgatcatcgtgggtatgctgggatactgcggaaccgtgaaacgcaatctcctgctccttgcctggtactttggatccctgctcgtaattttctgtgtggagctggcttgcggagtgtggacttacgagcaagaactgatggtcccagtacaatggtctgacatggttacactgaaagcacgaatgaccaactacggcctgcctcgctatcgttggctgacccatgcatggaatttcttccagagggaatttaaatgctgcggggttgtttactttaccgattggctggaaatgacagaaatggactggcccccagactcttgctgcgtgagggaattcccaggatgcagcaagcaggcccaccaggaggacctcagcgacctgtatcaggagggctgtggtaagaagatgtacagttttctgagaggcacaaaacaattacaggtgctccgcttccttggtatcagtatcggcgtaacacagattctcgccatgatcctcacaatcaccctgttatgggcactatactatgaccgaagggaacccggaaccgatcagatgatgagtctgaagaacgacaactcccaacacttgtcctgtccgtcggtggagctcctcaaaccttctctgtcccgcatcttcgagcatacaagcatggccaactctttcaacacccattttgaaatggaggaactgtag

SEQ ID NO: 243814 - DNA, 339 bp, Artificial Sequence
  Description of Artificial Sequence: Synthetic coding sequence
atggccagggaggacagcgtgaaatgccttcggtgcctcctttacgcgctgaatcttcttttctggctcatgtctatctcggtgctggctgtctcagcgtggatgagggattacctgaacaatgtgttaacgctaaccgccgagactagagttgaagaggcagtgatactgacctacttcccagtcgttcaccctgtaatgatagcagtgtgttgttttcttattatcgttggtatgttaggctactgcggcactgtcaagcggaatctcctgctgctcgcctggtacttcggaagtctgctggtcatcttttgtgttgagcttgcttgtggtgtttag

SEQ ID NO: 243815 - DNA, 288 bp, Artificial Sequence
  Description of Artificial Sequence: Synthetic coding sequence
atggccagagaagattccgtgaagtgtctccgatgtctgctatatgccctgaacctgttgttttggctgatgtctattagcgtactcgctgtcagcgcctggatgcgcgactacctcaataacgtattgaccctaaccgcagaaactcgcgttgaggaagctgttatcctgacttattttcctgtggtacacccggttatgatcgcagtgtgttgcttccttataatagtggggatgctgggatactgcggaacagtgaagcgcaatctcctcctgttggcctggtag

SEQ ID NO: 243816 - DNA, 363 bp, Artificial Sequence
  Description of Artificial Sequence: Synthetic coding sequence
atggcccgagaggacagcgtaaagtgcctgagatgcctgctgtatgcactgaatttgctcttctggttgatgagtatatccgtcctggctgtctccgcgtggatgcgagattacctcaataacgtgctgacactgactgctgaaacacgagtggaggaggctgtgattctgacttactttcctgttgttcatcccgtgatgatcgctgtctgttgcttcctgataatcgtgggcatgctgggctactgcggcactgtcaagcggaacctgctgctgctggcatggtactttggttctctacttgtgattttttgcgtcgagctggcctgcggcgtgtggacatacgaacaggagctcatgtag

SEQ ID NO: 243817 - DNA, 444 bp, Artificial Sequence
  Description of Artificial Sequence: Synthetic coding sequence
atggccagggaagacagcgtaaaatgtttaaggtgcttactgtacgccctcaacttattgttctggctcatgtccatttccgtgctcgctgtctccgcctggatgcgtgactacctgaacaacgtgctgacccttacagccgaaactcgcgtggaggaagccgttatcctcacctactttcctgtggtgcaccccgtcatgatagctgtctgctgctttctcattatcgtcggcatgctcggttattgcgggacagtgaaaaggaatttactcctcctggcctggtatttcggctcattgctggtgattttttgcgttgagttagcgtgcggcgtctggacttacgagcaagagcttatggtccctgtgcagtggagcgatatggtgacactgaaagcccgtatgacaaattacggacttccaagataccggtggcttacttag

SEQ ID NO: 243818 - DNA, 885 bp, Artificial Sequence
  Description of Artificial Sequence: Synthetic coding sequence
atgccccgtggcgattctgaacaggtgcgctactgcgcccgtttctcgtacctgtggctcaagttctccttgatcatttattcaacggtattttggttgatcggcgctctcgttctgtctgttggcatctacgccgaagtagagcggcagaagtacaaaacacttgagtctgccttcctggcacctgccatcattctcattctgctcggggtcgtgatgtttatggtgtccttcatcggggtcctggcaagccttcgggacaacttatacctgctgcaggcgttcatgtacatattaggtatctgtctgataatggaactaatcggcggtgtggtggccctgacattccgcaatcagacaattgatttcctcaacgacaatatccgccgaggaatagagaactactacgacgacttagatttcaagaatataatggactttgtgcagaagaagtttaaatgctgtggtggcgaagactaccgtgactggagtaaaaaccagtaccacgactgctctgctccaggccctctagcttgtggcgtcccatacacatgctgtatcaggaacacaacggaagtagttaataccatgtgtggctacaagactatcgacaaagaaagatttagcgtgcaggatgtaatctatgtcagagggtgcactaacgcggttattatatggttcatggataattatactataatggccggaatcctcctggggatcttgctacctcagttcctaggggtcctcctgacactgttatacattacaagagttgaagacattatcatggaacattccgtcaccgatggtcttttaggccctggtgccaaacccagtgttgaagctgcagggacggggtgttgcctatgttaccccaactag

SEQ ID NO: 243819 - DNA, 582 bp, Artificial Sequence
  Description of Artificial Sequence: Synthetic coding sequence
atgggcagatttcgaggtggcttgagatgtataaaatacctgcttctgggtttcaacctgcttttttggttggcaggctctgccgtaattgccttcgggctgtggttccgatttggaggagctattaaagagctctcatcagaggataagtctccggagtacttctatgtagggctgtatgtactggttggagctggggctctgatgatggcagttggattctttggctgttgtggcgctatgcgagagagccagtgcgtgttgggatctttctttacctgtttgcttgtgatcttcgcggcagaggtgaccacaggggtgtttgctttcatcgggaaaggggtggctatccgccacgtgcagactatgtatgaagaggcctataacgattatctgaaggaccggggtaagggaaacgggactctgatcacctttcacagtaccttccagtgttgcggcaaggagtcttcagagcaagtccagccaacgtgcccaaaagagttgctggggcataagattttcggcatgatattctccatggtgttatgttgtgccatcagaaactcacgggatgtgatctag

SEQ ID NO: 243820 - DNA, 591 bp, Artificial Sequence
  Description of Artificial Sequence: Synthetic coding sequence
atgggtcgctttagggggggactacgctgcatcaagtacttactgctgggttttaacctactcttctggctggcaggatccgctgttatcgcgttcggtctgtggttcaggttcggcggtgcgattaaggaactgtccagcgaggataaaagtcccgagtacttttatgtagggctctacgttttggtcggagcgggagcactgatgatggctgtgggattcttcgggtgttgcggcgctatgcgggagtcccagtgtgtacttggttcggcaatcagacacgtccagacaatgtacgaagaagcatacaacgactacctgaaggatcgtggaaaggggaacggaacgctgatcacatttcattccaccttccagtgttgcggaaaagagtcctctgagcaggtccagccaacatgtccgaaggagttgctgggccacaagaattgcatcgatgaaatcgagactataatctccgtgaagcttcagctgattgggattgtcgggataggaatcgccggtctcaccatctttggaatgattttttccatggtgttgtgctgcgcaattaggaactctcgggatgtcatttag

SEQ ID NO: 243821 - DNA, 666 bp, Artificial Sequence
  Description of Artificial Sequence: Synthetic coding sequence
atggggaggtttcgcggtggtcttcgttgcatcaaatatctgctgcttggtttcaacctgctcttctggctggctggctcggccgtgatcgcgttcggactctggttccgttttggaggcgctatcaaagagctctccagcgaggacaagtctccggaatacttctatgtcggactttatgttcttgtgggggctggcgcactaatgatggctgtgggattcttcggttgctgtggcgcaatgcgagagagccagtgcgttttgggctcgttttttacatgtttgctggtgatctttgccgcagaggtgacaacaggggtgttcgcatttattggtaaaggcgtcgccattcggcacgtgcagaccatgtacgaagaagcatacaatgactacttgaaagaccggggaaagggaaatgggactctgatcaccttccactcaaccttccagtgttgcggcaaagagtctagcgagcaggtccagcctacttgtccaaaggagcttctagggcacaaaaattgcattgacgagatcgaaacgattatttccgtcaaactccagctaatcggtatcgtgggtataggaatcgctggcctgactatcttcggcatgatctttagtatggtgctgtgctgcgctattagaaacagcagggacgtcatatag

SEQ ID NO: 243822 - DNA, 564 bp, Artificial Sequence
  Description of Artificial Sequence: Synthetic coding sequence
ggtctacgttgtattaagtacctgctcttaggtttcaatctgcttttttggctggccggatctgcagttattgccttcgggctgtggttccgctttgggggagccataaaggagctttcctcggaagacaagagccctgaatatttctatgtgggtctgtatgtgctcgtcggcgcaggagccttgatgatggccgtaggcttctttggctgttgtggggctatgcgcgagtcgcagtgcgtcctgggaagcttcttcacatgcctccttgtcatctttgcggctgaggtcaccactggcgtctttgcattcatcggtaaaggggtggcaattcgtcatgttcaaacaatgtacgaggaggcttataacgattaccttaaggaccggggaaagggtaatggaacattgatcacctttcactccacctttcagtgctgtggcaaggagtcaagcgaacaggtacagcccacctgtccaaaagaacttctcggacacaagattttcggaatgatattttctatggtgctgtgttgcgccataaggaattccagggacgtcatctag

SEQ ID NO: 243823 - DNA, 762 bp, Artificial Sequence
  Description of Artificial Sequence: Synthetic coding sequence
atggggcagtgcggaattacctcctcgaaaaccgtgttggtcttcttgaatctgatattttggggcgcagctggaatattatgctacgtaggggcatacgtttttattacatatgacgactatgatcactttttcgaagacgtctacaccctgattcccgctgtggtaatcatcgcagtgggcgctctcctctttatcattgggcttatcgggtgttgtgccaccataagagagtcacggtgtggtctagccacattcgtgattattcttctgctcgtttttgtgacagaggtggtcgtagttgtgctggggtacgtgtaccgggctaaggtggaaaacgaagtcgatcgcagcattcagaaagtatacaagacttacaacggaactaaccccgatgccgcatcaagggctattgattatgtacagagacagctccactgttgcgggatccacaattattccgactgggagaatactgattggttcaaggagactaaaaaccagtcagtacccctaagctgctgccgggaaaccgccagtaattgcaacggatcccttgcccacccctctgatctgtacgccgagggatgcgaggcgctggtggttaagaagcttcaggaaataatgatgcacgtcatatgggcagccctcgcatttgcagcaatacagttgctcggaatgttatgtgcctgcatcgtgctctgtagacgatcccgtgatccagcttacgagttactgattacaggcggaacttacgcttag

SEQ ID NO: 243824 - DNA, 687 bp, Artificial Sequence
  Description of Artificial Sequence: Synthetic coding sequence
atggggcagtgcggcataacctcctcaaagactgtcctggttttcctgaacctcattttttggggggcagccggaattctgtgttacgtgggagcttacgtgtttattacatacgacgattatgatcatttcttcgaagacgtatacaccttgatccccgctgtcgttattatcgctgtgggcgcacttttgttcatcattgggcttatcggttgctgcgcaaccattcgcgaaagcagatgtgggctggcgaccgtggagaatgaagtcgatcgttcgattcagaaagtgtacaaaacatataacggcactaatcccgacgccgcttctagggccatcgactacgtgcagcggcagctccactgctgtggtatccacaactactccgattgggaaaacactgattggtttaaagaaacaaaaaatcagtccgtccctctttcctgttgcagagagacagcctccaactgtaacggctcattagctcacccctcggacttgtacgcggaagggtgcgaagcactggtggtgaagaagctgcaggagattatgatgcacgtgatatgggctgcgctggcattcgccgctatccagctgctcgggatgctgtgtgcctgtatcgttctatgtcgcaggtcaagagacccagcatacgagctgctgatcaccggcggaacctacgcatag

SEQ ID NO: 243825 - DNA, 651 bp, Artificial Sequence
  Description of Artificial Sequence: Synthetic coding sequence
atgtgggaaccaatgtcctccagcctgatgatgactatgaccacaagtctcaagatgtgtacaaggtcttccctattgttcattataggcttgattgggtgttgcgcgaccataagggaatccaggtgtggcttggctacctttgtaattatcctgttgctggtcttcgtgacggaggtcgtggtggtcgtcctgggatacgtgtatcgagccaaagtcgagaacgaagtggacaggagtatacaaaaagtttacaaaacctataacgggacgaatccggacgctgctagtcgcgctatagattatgtccagagacagctccactgctgcggaatccacaactactctgactgggaaaacacagactggtttaaagaaactaaaaatcaatccgtccccctaagttgttgcagagagaccgcttcaaactgcaatgggagccttgcccatccaagtgacctgtatgccgagggttgcgaggccctggtggtgaaaaagctccaggaaatcatgatgcacgtaatctgggcagccctggcctttgccgcaatccagcaactgctggggatgctctgcgcctgtattgtgctgtgcaggcgctctcgcgaccctgcctacgagttgctgatcacgggaggaacctacgcttag

SEQ ID NO: 243826 - DNA, 570 bp, Artificial Sequence
  Description of Artificial Sequence: Synthetic coding sequence
atgggacagtgtggcattactagttcaaaaacagtcttggttttcctgaaccttatcttttggttcgtgattattcttctgttagtgtttgttacagaggtagtggtggtcgtgttgggatacgtgtacagggctaaggtcgagaacgaagtcgacaggtctatccagaaggtgtataagacgtacaatggcacaaatcctgatgcagcctcacgggctattgactacgtgcagcgccagttgcactgctgtggcattcataactatagcgactgggaaaatacagattggttcaaagagactaagaaccagtccgtgcccttgtcttgttgccgcgagacagcatccaactgtaatgggtctctcgctcatccttcagacttatacgctgagggatgcgaagctctggtggttaaaaaactacaagaaattatgatgcacgtgatctgggcggctctcgcatttgctgcaatccagctgctgggaatgctgtgcgcctgtatcgtgctgtgcagaaggtccagagatcctgcctatgaacttcttatcactggaggcacatatgcctag

SEQ ID NO: 243827 - DNA, 633 bp, Artificial Sequence
  Description of Artificial Sequence: Synthetic coding sequence
atggtgtgcggaggctttgcatgttcaaaaaatgccttgtgcgctctgaatgtcgtctacatgcttgttagtctactgctgattggagtagctgcatggggaaaggggttgggactagtttcgagcatccacatcattggcggtgttatcgcagtgggcgtgttcttactgctgattgccgtagctggtctcgtgggagcggtcaaccaccatcaagtgcttctgttcttttacatgattattctgggactggtgtttatctttcagttcgtcatttcttgtagctgcctcgccataaatcgctccaaacagacagacgtgataaatgcctcctggtgggtgatgagcaacaagacccgggacgagctggagcggagctttgactgttgcggactgtttaatctcaccaccctatatcagcaggattacgacttttgcacagcaatctgtaagtcccagtctccgacttgccaaatgtgcggagagaagtttctcaagcattccgacgaggccttaaagatcttaggtggtgtgggactgtttttttcttttacagagatactcggagtatggctcgcgatgcgttttcgtaaccaaaaggaccctcgagccaatcctagcgccttcctgtag

SEQ ID NO: 243828 - DNA, 963 bp, Artificial Sequence
  Description of Artificial Sequence: Synthetic coding sequence
atgggtccctggagcagagtacgagttgccaaatgccagatgctggtgacttgcttctttatattactgctgggcctgtctgtggccactatggttactctcacttactttggtgcccattttgcggtgatcaggcgcgcatctctcgagaaaaacccctatcaagccgtgcatcagtgggctttttcagccggtctcagcctcgtcggactgttgacccttggagcggtgctcagtgccgctgccacggtccgagaggcccaggggctgatggccggtgggtttctgtgcttttcgttagcattttgtgcccaggtgcaggttgtcttctggaggttgcactccccaacacaggtcgaggacgctatgctggatacttatgatcttgtgtatgaacaggcaatgaagggcacatcacatgtgcgtcgccaggaactagccgcaatacaggacgtgtttttatgctgcggcaaaaaatcacccttctcccgtctggggagtactgaagcggatttgtgccagggcgaggaagcagcaagggaagactgtctccagggcatcagaagcttcctgagaacccatcaacaagtcgcgtcatcccttacatcgataggcctggcattaaccgtcagtgcgctcttattctccagctttctctggttcgctatccggtgtggctgctcactggataggaaagggaaatacacattgactcccagggcttgtgggcgacagcctcaggagcccagcctgctgcgttgcagtcagggcggaccaacgcactgcttacactcagaagcagtcgccatcggccctcgtggctgttcaggatctttgagatggctccaggaatctgacgctgcaccactcccactctcttgccaccttgctgcacaccgcgctcttcagggtcgctctcgaggcggattatctggatgtcccgagagggggctgagcgattag

SEQ ID NO: 243829 - DNA, 762 bp, Artificial Sequence
  Description of Artificial Sequence: Synthetic coding sequence
atgggaccttggtcaagggtgcgcgtggccaagtgtcagatgcttgttacatgctttttcattctgctcttgggcctgagtgttgctacgatggtgacactgacatactttggcgctcactttgccgtgattcgcagggcaagcctagagaaaaacccgtaccaagctgtacatcagtgggccttttcggctggattgtccctagttggccttctgaccctgggcgcagtactcagtgcagctgctacagtgcgtgaagcccagggcttgatggccggtggattcctgtgctttagtcttgcattctgtgctcaggtacaagtggtattctggcggctgcactctcctactcaggtggaagacgctatgctggacacttatgatctcgtgtatgagcaggcaatgaaaggaacgtctcatgtgcgccgacaagagttagcagctatccaggacgtgttcctgtgctgcggaaaaaagagtccgtttagtaggttggggtccaccgaggctgatctgtgtcagggcgaggaggccgcacgcgaagactgcctgcagggaatacggagttttctgcgtactcatcagcaggtggcgagttccctgacctcaattggcctcgctttaaccgtgtcggctctactcttttcttcgtttctctggttcgccattcggtgtggctgcagcctggatcgcaagggtaagtatacgctcactccacggtccccgggacagaagagcagatgggcacagtgggtaccttag

SEQ ID NO: 243830 - DNA, 525 bp, Artificial Sequence
  Description of Artificial Sequence: Synthetic coding sequence
atggcaatcggatttgttggctgcctcggcgcaattaaggaaaataagtgcttgctcctgacttttttcctgcttctgctgttagtgttcctcctggaggccacaattgcaatcttgtttttcgcctatactgacaaaattgaccgctacgcccagcaagatttgaaaaagggtcttcatctgtacggcacccagggaaacgtgggattgaccaacgcctggtccatcatccagacagactttcgttgttgcggggtgagcaactatactgattggttcgaggtgtacaatgctacacgagtccccgacagctgctgcctggagttcagcgagtcttgcggcctgcatgccccaggtacctggtggaaagcaccgtgttatgagacggtgaaggtgtggctgcaggaaaacttactggctgttggcatatttggcttgtgcaccgctctcgtccaaatcttgggattgacattcgctatgacaatgtactgccaggtcgtaaaagccgatacatactgcgcgtag

SEQ ID NO: 243831 - DNA, 717 bp, Artificial Sequence
  Description of Artificial Sequence: Synthetic coding sequence
atggccagagcttgcctgcaggccgtaaagtacctgatgtttgcttttaacctgctcttctggctcggaggatgtggggtgctgggcgttggtatctggttggctgccacccagggtagtttcgcaacattaagctccagctttccctctctgtcagcagccaatctgttaattattacaggtgcgtttgtgatggccattggattcgtcgggtgcctcggagccatcaaggagaacaagtgtttactgctgacgttcttcctgctccttctgttggtgtttctcttagaggctaccatcgccatactattctttgcgtacactgacaaaattgacagatacgctcagcaggacctgaagaaaggcctccatctttatgggacccagggcaatgtgggtctgactaatgcctggagcatcatccagacggacttcaggtgttgtggcgtcagcaactataccgactggttcgaggtgtataatgctactcgcgttcccgattcctgctgtttggagttttctgagtcttgtggcctacacgcacctggcacctggtggaaagcaccctgctatgagaccgtgaaggtctggttacaggaaaatctcctggccgtcggaattttcggcctgtgcacggcgttagtgcagattctgggactgacctttgctatgacaatgtactgtcaggtggtgaaagcagatacctattgcgcctag

SEQ ID NO: 243832 - DNA, 717 bp, Artificial Sequence
  Description of Artificial Sequence: Synthetic coding sequence
atggcgagggcatgtcttcaagccgtgaagtatttgatgtttgcttttaacctactattctggttaggcggttgcggcgtactgggggtaggcatctggctggccgctactcaaggttcattcgctacactttcatcaagcttcccttctctttcagccgctaatctgctgattataacaggtgctttcgtcatggccattgggtttgtcggttgtctgggagcaattaaggaaaataagtgccttctcctcacattttttcttcttctgctgcttgtcttccttctggaggcgaccattgccattctgtttttcgcgtacactgacaagatcgatcggtatgcccaacaggaccttaagaaaggcctgcacctctacggcactcagggtaacgtgggccttactaatgcctggtcgataattcagacagacttccggtgctgcggggtgtcaaactatacagattggttcgaagtttataacgccacccgcgtgcccgacagttgctgtttggaattttcagaatcttgtggattgcacgccccaggaacctggtggaaggctccatgctatgagacagtaaaagtctggctgcaggaaaatctattggctgtgggcattttcgggctctgtaccgccctggtgcaaattttggggctgacctttgccatgaccatgtactgtcaggtcgtgaaggctgacacctactgcgcttag

SEQ ID NO: 243833 - DNA, 717 bp, Artificial Sequence
  Description of Artificial Sequence: Synthetic coding sequence
atggccagggcttgtctgcaggccgttaagtacttaatgttcgcctttaacctacttttctggctgggcggttgcggcgtgcttggagtgggcatctggcttgccgctactcagggctcttttgcaactttgtctagctcctttccttctctaagtgccgcaaatctgctcattataactggagcattcgtcatggctattggatttgttggttgcctcggcgctattaaggagaataaatgcctgcttctcacgtttttcctcctcctgttacttgtgttcctgctggaggctactattgctatcctctttttcgcgtacactgacaaaatcgataggtatgcccaacaggatctcaagaagggcctgcatctgtatggaacacaggggaacgtggggttaacaaacgcttggtctatcatccagaccgatttccgatgttgcggggtgtctaactacacagattggttcgaagtctacaacgccaccagggtgcctgacagttgctgtttggagttctcagaatcatgtggtctacacgcaccaggaacatggtggaaggcaccctgctacgaaacggtcaaggtgtggctccaggagaatctgctcgcagtgggcattttcgggctctgtactgcactggttcagattcttgggctcacgtttgccatgactatgtattgtcaggtagtaaaagcggacacttactgtgcatag

SEQ ID NO: 243834 - DNA, 717 bp, Artificial Sequence
  Description of Artificial Sequence: Synthetic coding sequence
atggctagggcctgcctgcaggccgtcaaatacctcatgttcgcgtttaatctgctcttctggctcggcggatgtggagtactgggagtgggcatttggctcgccgcaacgcagggctctttcgcgacgctgtcttcttcatttccaagtctctcagctgccaacctgctcatcattaccggcgcatttgtcatggctatcggcttcgtcggctgtctgggagcaatcaaagagaacaagtgtttactactaactttctttctcctgctgctgcttgtgttcttacttgaagctacaatcgctatcctgttctttgcttataccgacaaaatcgaccggtatgcccagcaggacctcaaaaagggcctgcatctgtacggcactcagggcaacgtggggctgacaaacgcttggagtatcatacaaaccgacttccgttgctgtggagtgtctaattataccgactggttcgaagtctacaatgccacccgcgtccccgacagctgttgcctcgaattttcagagtcgtgcggccttcacgcaccaggtacctggtggaaggccccttgttatgagactgtgaaggtgtggctgcaggaaaatttgctggccgtgggcattttcgggctgtgcaccgctctggtgcagatcctgggcttgacctttgcgatgacaatgtactgccaagtggtgaaggcagatacctattgcgcgtag

SEQ ID NO: 243835 - DNA, 717 bp, Artificial Sequence
  Description of Artificial Sequence: Synthetic coding sequence
atggcaagagcatgcctgcaggcggtgaagtatctgatgttcgcctttaatttactattctggctaggcggatgcggcgtactgggtgtagggatttggctcgcggctacacaaggttccttcgccacgctctctagttccttcccctctctttctgcggcaaatctcctaattataacaggtgcatttgttatggccattggatttgttggctgtttgggggctatcaaggaaaacaaatgcctcctcctgacatttttcctgctgctgttactggtgttcctgttagaagccaccatagccattctgtttttcgcctacacggacaaaatcgatcggtacgctcagcaggatctcaaaaagggcctgcacttatacgggactcaaggcaacgtgggtctgacaaacgcctggtcaattattcagaccgacttcagatgctgtggcgttagcaattacacagattggttcgaagtgtataatgcaacaagagttccggattcatgttgcctcgagttcagtgagtcttgcgggttgcatgctcccggtacatggtggaaggccccatgctacgaaactgtgaaggtgtggctgcaggaaaatctgctcgccgtaggcatttttggtttgtgcactgcattggtccagattttagggcttacgttcgcaatgacgatgtactgccaggttgtcaaagccgacacctactgtgcttag

SEQ ID NO: 243836 - DNA, 774 bp, Artificial Sequence
  Description of Artificial Sequence: Synthetic coding sequence
atgacaccaagatccgccggaacttctgcgcacggcgctgagctgaaacgttgcggcatggcgcgagcctgcctccaggccgttaagtatctgatgtttgcctttaatctcctgttctggctgggcggatgcggagtcctcggcgtcggcatatggctcgcagccacacaggggtcgtttgctacactgagctcttctttcccctcgctaagtgcggcaaatctgcttatcatcactggcgcattcgtgatggccattgggtttgtcggctgtctgggagctatcaaggaaaacaaatgtctgttacttaccttttttttactgcttttactggtcttcctcttggaggcaactatcgctatcctgttcttcgcctataccgataagattgatagatacgcccagcaggatttgaaaaagggtctgcatctatatggtacccaggggaatgtcgggctcacaaacgcttggagtataattcagactgatttcaggtgctgtggggttagtaactacaccgactggttcgaggtttacaatgcaactagagttccggactcgtgctgcttagagttttcagaaagttgcggactccacgcacccggaacatggtggaaagctccctgctacgaaactgttaaggtgtggctccaggagaatctcctcgctgttgggatttttggtctctgcactgcgttagtccaaatcttgggacttacctttgccatgaccatgtactgccaggtggttaaggccgacacgtactgcgcctag

SEQ ID NO: 243837 - DNA, 717 bp, Artificial Sequence
  Description of Artificial Sequence: Synthetic coding sequence
atggcacgcgcttgtctacaggcagtcaaatacctgatgttcgcatttaatctcctcttttggctaggtggatgtggagttctgggcgtggggatttggctggccgcaacccaggggagtttcgcaactctctcttcaagtttcccatcacttagtgccgcaaacctgctgattattacaggagccttcgtgatggccataggctttgtcggatgccttggagccatcaaggagaacaagtgtctcctactgactttttttctcctgcttctcctggtcttcctgctcgaagctactatcgccatcttattttttgcctacactgacaaaatcgataggtatgcgcagcaggaccttaaaaaagggctacatttgtatggtacccagggtaacgttggcctgacgaacgcttggtccattatccagaccgactttcggtgttgtggggtctccaactacacggattggttcgaggtgtataatgccactagagttcccgactcctgctgtctggaattttctgagagctgcggcctccacgccccaggcacctggtggaaagccccatgctacgagactgtgaaagtttggctgcaggagaatcttttggctgttgggattttcggactgtgtacagcccttgtgcagatacttggcttaactttcgctatgacaatgtactgtcaggtggtgaaggcagatacatactgcgcctag

SEQ ID NO: 243838 - DNA, 525 bp, Artificial Sequence
  Description of Artificial Sequence: Synthetic coding sequence
atggccattggctttgtagggtgcctgggggcaattaaagagaataaatgcctactgttgacatttttccttttattattgctggtgttcctgttggaagccacaatagccattcttttttttgcctataccgataagatcgatcgctatgctcaacaagatctgaaaaagggcctccacttatacggaacccaaggcaatgtgggcctcaccaatgcatggtctataattcaaaccgattttagatgttgcggcgtgagcaattatactgactggttcgaagtgtataatgccacgagggtccccgactcctgttgcttagaattcagcgagtcttgtggcctgcatgcacccggaacatggtggaaagccccttgctatgagaccgtaaaggtgtggctgcaggagaatttacttgcagtgggcatctttggcctgtgcaccgctttagtgcaaatccttggtcttacattcgccatgaccatgtattgccaagtggtgaaagcagatacctattgcgcctag

SEQ ID NO: 243839 - DNA, 303 bp, Artificial Sequence
  Description of Artificial Sequence: Synthetic coding sequence
atggccattggtttcgtgggctgcttaggggcaatcaaggaaaataagtgcctgctgctcactttctttttgctgttgctgctggtttttctgctggaagcaaccatcgcaatcttgttcttcgcctatacagacaagatcgaccgttatgctcagcaggacctgaaaaagggattacacctgtatggtacccaaggaaacgtcgggctaacaaatgcctggagtatcatacagacggatttccgctgttgtggtgtctcgaactataccgactggtttgaagtatataacgccacccgttag

SEQ ID NO: 243840 - DNA, 480 bp, Artificial Sequence
  Description of Artificial Sequence: Synthetic coding sequence
atggcacgagcgtgtctacaagccgtcaaatacttgatgtttgccttcaatctgttgttctggctgggcggatgtggggtgctgggggtgggaatctggctcgctgctacccaaggaagcttcgctaccctgagctctagttttccttcactgtctgccgctaacctgctcattatcactggcgcttttgttatggctattgggtttgtgggctgcctgggagcgataaaggagaacaaatgtcttctgttgaccttctttctcttactgctactggtgttcctgttagaagccaccattgctatcctttttttcgcttatacagacaaaatcgataggtacgctcagcaggatctcaagaagggacttcatctgtacgggacgcaaggaaatgtaggcctgactaatgcctggtcaataatacagactgattttagatgctgtggtgtatctaattatacggactggtttgaggtgtag

SEQ ID NO: 243841 - DNA, 258 bp, Artificial Sequence
  Description of Artificial Sequence: Synthetic coding sequence
atggctcgcgcatgccttcaggccgttaaatacctcatgttcgctttcaatctcctgttctggctcggcggttgcggcgtgttaggagtggggatctggttggcagccacacagggttcattcgctacactgtcctctagctttccctctctcagcgctgccaacttactaattatcaccggcgcattcgtaatggctattggcttcgtggggtgtctgggtgcgataaaggagaataaatgtttactgctaacctag

SEQ ID NO: 243842 - DNA, 807 bp, Artificial Sequence
  Description of Artificial Sequence: Synthetic coding sequence
atgagtggcaaacattacaagggccctgaagtctcgtgttgtattaaatacttcattttcggctttaacgttatcttctggttcctggggattacgttccttgggatagggctttgggcctggaatgaaaaaggcgttctgtcaaacatttcctcgatcacagacctgggcggtttcgatccggtgtggctcttcctggtagtggggggagtgatgttcattctggggttcgccggttgtatcggagcccttagagaaaatacattcctgctcaaatttttctcagttttcctgggtatcatcttcttcctggaacttacagccggtgtgctcgccttcgtatttaaggactggattaaagaccagctgtatttctttattaacaataatatcagggcttatcgggacgatattgacctgcagaaccttattgatttcacacaagaatactggcagtgctgcggggcttttggggcagatgactggaacctgaatatctacttcaattgtacagattctaatgctagccgtgagcgttgcggcgtgccattctcttgctgtaccaaagacccagccgaggacgtaatcaatacccaatgtggttacgacgctagacaaaaaccggaagttgatcaacagatcgtgatttacaccaaggggtgcgtcccacagtttgagaagtggctgcaggacaacctaacgattgtggcgggaatctttattggcatcgccctcctacagatctttggaatctgcctcgcccagaacctggtctctgatatagaggctgtgcgggcaagttggtag

SEQ ID NO: 243843 - DNA, 594 bp, Artificial Sequence
  Description of Artificial Sequence: Synthetic coding sequence
atgtttatcttaggatttgccggatgcattggagcacttcgagaaaacacatttctactgaagtttttttccgtgtttcttgggataatcttttttcttgagctgactgccggagtcctggcatttgtctttaaggactggataaaggatcagttatatttttttatcaacaataacatcagagcataccgagatgatatcgacctgcagaacctcatcgacttcacacaggagtactggcagtgctgcggcgcttttggcgctgatgactggaatctcaacatttactttaattgcaccgacagcaatgccagccgggaacgatgcggcgtgccgttttcttgttgtaccaaagatcctgcggaagacgtgattaatacacagtgcggatatgacgcaaggcagaagcccgaggtggaccagcagatagtcatatatacgaaaggttgtgtgccccaatttgagaagtggctgcaagataacctgaccattgtcgcaggaatttttatcggcatcgccctccttcagatctttgggatctgtctggcccaaaacttggtaagtgatatagaggccgtcagagccagctggtag

SEQ ID NO: 243844 - DNA, 801 bp, Artificial Sequence
  Description of Artificial Sequence: Synthetic coding sequence
atggcaagccgtaggatggagactaagcccgtgataacctgcctcaaaaccttgctgattatctatagcttcgtgttttggaaagagaaggccgctggtttttgtggccgtcaggacgtggcaatggccctcattactggcgttattttactcgcagtgggtgtctggggcaaattgacattaggaacctacatctcgctcatcgctgaaaattcaacaaacgcgccatacgtgctaattggtacgggcacaacaattgtggtgttcggtttgtttggctgttttgccacttgccgaggctcgccctggatgcttaagctgtatgcaatgtttttgagcctggtgttcctcgcagaactggtggcaggtatatcaggttttgtcttcagacacgagattaaagatactttcttacgtacatacaccgacgcaatgcagacgtacaatggaaatgatgagagatcccgggcagtggaccatgtccagcggagtctgtcctgttgtggagtgcagaattatacgaactggtccacatctccatatttcctggaacacgggatccccccttcttgttgcatgaatgaaacagactgcaatccccaggacttgcataacctgactgtggccgcaaccaaggttaaccagaagggctgttacgacctagtcacgagttttatggagacaaacatgggtattatagcaggagtggcttttggtattgcttttagccagcttatcggcatgttgctcgcttgctgcctttctcgctttatcaccgccaatcagtacgaaatggtctag

SEQ ID NO: 243845 - DNA, 750 bp, Artificial Sequence
  Description of Artificial Sequence: Synthetic coding sequence
atggcctctagaagaatggaaacaaagcctgtgattacttgtttgaaaaccctgttgattatttactccttcgtgttctggattactggagtgatcctgttggcagtgggcgtgtggggtaaactcacgttgggtacgtatatctccttgattgctgagaactcgacaaacgctccctacgtgttgatcgggaccggtaccaccatcgtcgtatttgggttgttcggctgtttcgcaacatgtcggggatctccatggatgttaaaactgtatgcaatgttcctgagcctcgtgttcctggccgaattagtagcagggataagtgggtttgtgttccgccacgagataaaggacacattcctccgcacttacacggacgccatgcagacctataatggtaatgatgagagatcacgcgcagtcgaccatgtacagagatctcttagctgctgcggtgtgcaaaactatactaactggtccacaagtccttatttcttggaacacgggattcccccttcttgttgcatgaatgaaaccgactgtaatccacaggacctgcataacctgacggttgccgctacaaaagttaaccaaaagggttgttatgatttggttacgtcatttatggaaaccaatatgggcattattgcaggcgtggcgtttggcatcgccttctctcagcttatcgggatgttgctcgcctgctgtctgtcacggtttattaccgccaaccagtacgaaatggtgtag

SEQ ID NO: 243846 - DNA, 828 bp, Artificial Sequence
  Description of Artificial Sequence: Synthetic coding sequence
atggctaataggacagtctgtaacggccagggcagaagtcgcgacctcctccgcatcaagaatatcccgaacgcccctgggcatttcctcattgcgggtgtgggcggttcctcgagtcagggcagatctattgaggaggaagggaagactcacctgggaataacaggggtaattctattagccgtgggagtgtggggcaaactaacactgggaacctatattagcctgatagcagaaaattcaacaaacgcgccttatgtcttgatcgggacaggcacgacaatcgtggtgtttgggttatttggctgtttcgcaacctgccgaggttccccttggatgctgaaactgtatgcaatgttcttatctctggtgtttctagccgaattggtggctggtatttcagggttcgtcttcagacatgagatcaaggatacgtttctacggacttacactgatgctatgcaaacctacaatggtaatgacgaacgcagcagggctgtggaccacgtacaacggtccctgtcctgctgtggggtgcaaaactacaccaattggtctaccagcccatacttcctggagcatggcatacctccaagttgttgtatgaatgaaaccgactgtaatcctcaagacttacacaacctgacggtggcagctaccaaggtgaaccagaagggctgctatgatcttgtaacctctttcatggaaacaaatatgggaatcatagctggggtcgcttttgggatcgcgttctcccaactgatcggcatgctactcgcctgttgtctgagcaggtttatcacagcaaaccagtacgagatggtgtag

SEQ ID NO: 243847 - DNA, 672 bp, Artificial Sequence
  Description of Artificial Sequence: Synthetic coding sequence
atgataacaggcgtgattctactcgcggttggtgtttggggaaagcttacactgggcacatatatttctttaatcgccgaaaacagtaccaatgcgccttacgtactgattggaacgggaacaaccattgtcgtgtttggtctgtttggatgttttgccacatgtcgaggaagcccctggatgctgaaactatacgcgatgtttctatcactcgtgttcctggctgaacttgtggccggaatcagtggattcgtgttcaggcatgagatcaaagacacctttcttcggacctatacagacgccatgcagacttacaacggaaatgacgagagatcccgcgctgtagaccacgtccaacggagcctgtcttgctgtggagttcagaactataccaactggtcgactagcccgtatttcctagagcacggaattcctccaagctgttgcatgaatgaaacagattgtaatccccaagatcttcacaacctgaccgtggccgctacaaaggtcaaccagaaggggtgttatgacctggtgacaagcttcatggaaacgaatatgggcatcatcgctggggtggcttttggaatcgccttctcccagctgatcggtatgctgttggcctgttgcctgagccgcttcattactgcaaaccagtacgagatggtgtag

SEQ ID NO: 243848 - DNA, 714 bp, Artificial Sequence
  Description of Artificial Sequence: Synthetic coding sequence
atggcaggagtcagcgcctgtattaagtactcgatgttcacatttaactttctgttctggctgtgtgggattctcatcctggccctggcaatatgggtgcgggtgtccaacgacagtcaggctattttcggatctgaagacgtgggtagtagctcttacgtcgctgtggacattctgatcgccgttggggctatcataatgattcttggcttcttaggctgttgtggcgctataaaagaaagcagatgtatgctccttctgtttttcatagggctcctgctcatactgctactacaggtcgccactggcattcttggagcagtgttcaaatctaagtccgatcgcatagttaatgagactctctacgaaaatactaagctgctgagcgctacaggagaatctgaaaaacagtttcaggaggcgatcatagttttccaggaagaattcaagtgctgcggcctggtgaacggagccgcagactgggggaacaattttcagcactaccctgagctttgcgcctgcctcgacaaacagagaccttgccaatcctataacggaaagcaggtgtataaagaaacctgtataagcttcattaaggacttcctagctaagaatctgattatagttattgggatctctttcggactcgccgtaatcgagatcttgggcttggtgttcagtatggtgctgtactgtcaaatcggaaataagtag

SEQ ID NO: 243849 - DNA, 714 bp, Artificial Sequence
  Description of Artificial Sequence: Synthetic coding sequence
atggctggagtgagcgcttgtataaagtattccatgttcaccttcaattttctattctggttatgtgggattctgatcctggctctcgctatatgggtgagggtgagcaacgactcccaggccattttcggtagtgaggacgtgggaagcagctcatatgtggcagtcgatatcctgattgccgtgggggctattattatgatcctgggctttctgggctgctgtggggctatcaaagaatccagatgtatgctgctgctgttcttcattggacttctgttaatcctgctcttacaggtggccaccggtatacttggtgctgtgtttaagagcaagtccgacaggattgtcaatgagaccctctatgagaataccaagctgctttcggccacgggggagtcggagaaacagtttcaggaggccattatcgtgtttcaggaagaattcaagtgctgcggactcgtcaacggtgcggctgactgggggaataatttccagcactaccctgagctttgcgcttgtctcgataaacagcggccatgtcaatcttataacgggaaacaggtctacaaagagacctgcatctcattcataaaggacttcctcgctaagaacctgattattgtgattggcatctcatttgggctggcagttatcgaaatcttgggtctcgtgtttagtatggtcctatattgtcagatagggaataaatag

SEQ ID NO: 243850 - DNA, 714 bp, Artificial Sequence
  Description of Artificial Sequence: Synthetic coding sequence
atggccggagtgagcgcctgcattaaatacagtatgtttaccttcaattttctcttttggctatgtggcatcctcatcttagctctggcgatatgggtacgcgtttcgaatgattcacaggcaatcttcggatcagaggatgttggatcctcctcttacgtagctgtggacattcttatagctgttggagcaattattatgattctgggcttcctcggatgctgcggcgctattaaggagtctcgttgcatgttgctcttgttctttattggcctccttctgattctcctgctgcaggtggctaccggcatcttaggggcagtgtttaaaagtaaatcagaccggatcgtcaacgagactttatacgagaacactaagctcctctctgccacaggtgaatccgagaaacaattccaggaggctatcatagtgtttcaggaagaattcaaatgttgcggactcgtgaacggagccgcagactggggaaacaacttccaacattatccagaattatgcgcctgtctggataaacaacgaccttgtcagtcatataatggcaagcaggtgtacaaagagacctgcatttccttcataaaagatttcttagccaagaacttgattatagtgattggcatctctttcgggcttgccgtcatcgagattctcgggctggtcttcagcatggttctttattgccagattggtaacaagtag

SEQ ID NO: 243851 - DNA, 720 bp, Artificial Sequence
  Description of Artificial Sequence: Synthetic coding sequence
atggccaggggatgtctctgttgcctcaaatacatgatgttcctgttcaaccttatcttctggctttgtggatgcggcctgctcggagtgggaatttggctcagcgtgtcccaaggcaacttcgcaacattctccccatcgtttcccagcctcagcgctgccaacttagttatcgcaatcggcaccatcgttatggttacagggttcctgggatgcctgggtgcaattaaggagaacaagtgcttacttttatcattctttattgtccttctggtaatcctactcgcagaactgattttgctgatcctgttcttcgtatatatggacaaagtcaatgagaatgccaagaaagacctgaaagagggactgcttctgtatcataccgaaaacaatgtggggttaaagaacgcgtggaacattatccaggcggagatgcgttgctgcggggtgaccgattatacggattggtatcctgtgctcggggagaataccgtgcccgacagatgctgtatggaaaattctcagggttgcggcaggaatgcgacaacccctctctggagaaccgggtgctatgaaaaggtgaagatgtggtttgatgacaacaaacatgtgctgggcaccgtgggcatgtgcattcttattatgcagatcctgggcatggccttcagtatgacactctttcagcatatacatagaaccggcaaaaaatacgacgcgtag

SEQ ID NO: 243852 - DNA, 720 bp, Artificial Sequence
  Description of Artificial Sequence: Synthetic coding sequence
atggctagaggttgcttgtgttgcttaaaatatatgatgtttttatttaatcttattttttggctctgcggctgcggactcctaggagtcggcatatggctctcggtttcacaagggaatttcgccaccttctcgcccagttttccaagtctgagcgctgctaacctggtgatcgccatcggtacaattgtaatggtaaccgggtttctggggtgtcttggcgctatcaaggaaaacaagtgtctgctgttgtctttctttatagttttacttgtgatcctgctagctgaattaattttactgatacttttcttcgtctacatggacaaggtaaatgagaacgccaaaaaagatctcaaagagggcctcctgctctaccataccgagaacaatgtggggctcaaaaacgcctggaacatcattcaggcagaaatgaggtgttgcggagtgaccgattacactgactggtaccctgtcctgggcgaaaatacagtgccagatagatgctgcatggagaactcccaggggtgcggcaggaacgccacaactcctctgtggaggacaggttgctatgagaaagtaaaaatgtggtttgatgacaataagcacgtgcttgggactgttggcatgtgcatcttgataatgcagatattaggtatggcattctctatgacactatttcagcacattcaccggacaggaaagaaatatgatgcctag

SEQ ID NO: 243853 - DNA, 1044 bp, Artificial Sequence
  Description of Artificial Sequence: Synthetic coding sequence
atggcattgatgctgagtcttgttctgtcattgctgaaattgggcagtggacagtggcaggttttcgggcctgacaagcccgtgcaggccctggtcggagaagacgctgccttttcctgcttcctaagccctaagaccaacgccgaagctatggaggtccgcttctttcgaggtcagttcagctcagttgtgcacctgtatcgagacggaaaagaccagcctttcatgcagatgccgcaatatcagggtcgaactaagttagtcaaggattcaatcgccgagggtagaatctccttacgactcgagaatatcaccgtgctggatgccggactgtacggatgcagaataagctcacagtcctactaccagaaggcaatatgggagttgcaggtgagtgccctgggaagcgtccccctgatcagcatcaccgggtacgtggatcgagatatccagctcctgtgccagagttctgggtggttccccagaccaactgccaagtggaaaggacctcagggtcaggacttatcgacagacagtcggaccaatcgcgatatgcatgggctgtttgacgtggaaataagtctcaccgtccaggagaacgctggctccatcagttgttctatgcggcacgcacatctctcacgtgaagtagaatctcgcgtccagatcggagatacctttttcgaacctattagttggcatttggcgaccaaagtcttgggcatactctgctgcggcctgttcttcggcatcgttgggttgaagatcttctttagcaagttccagtgcaagcgcgaaagagaggcctgggccggagcactgttcatggtgccagcgggaaccgggtccgaaatgcttccacaccccgcagcatctttgctcctcgtcctggcctctagggggcctggcccaaagaaagagaaccctggtggaaccgggttggagaagaaggctcgcacaggaagaatcgagagacgcccagagacaaggtctggcggagattccggatcgagagacggatcacccgaggccttgaggttctag

SEQ ID NO: 243854 - DNA, 879 bp, Artificial Sequence
  Description of Artificial Sequence: Synthetic coding sequence
atgggggaaaagtccgagaactgcggcgtgccggaagacctgctcaatggtcttaaagtgacagacactcaggaggctgagtgcgcaggtccacctgtgccagatcctaaaaaccagcactcacagagcaaactactgcgggacgacgaagcccaccttcaggaggatcagggagaagaagaatgttttcatgattgctctgcgtcgtttgaggaagaaccaggcgcagacaaagtcgaaaacaagtcaaacgaggatgtgaactcaagtgagctggatgaagaatacttgatcgaactggagaaaaacatgagcgacgaagagaaacagaaaaggcgcgaggagtcaacccgcctgaaagaggaggggaatgagcagttcaaaaagggcgactacattgaagcggagtcttcttacagcagggctctggaaatgtgtcccagttgctttcagaaggagaggagcattctgttcagtaacagggccgctgctcgcatgaaacaggataaaaaggaaatggccatcaacgactgtagcaaggccatacaattgaacccgtcctacatccgcgctattctccgtagagccgagctttatgagaaaacggataagttagatgaagccctggaagattataagtcaattctggagaaggacccttccattcatcaagcgagagaagcatgtatgagactgcccaagcaaatcgaggagcggaacgaacggctgaaggaagagatgctgggtaaactgaaagacctgggaaatttagttttgaggccctttggactgtcaacagagaactttcaaatcaaacaggactctagcacaggttcatacagtattaacttcgtccagaaccccaataacaatcggtag

SEQ ID NO: 243855 - DNA, 2199 bp, Artificial Sequence
  Description of Artificial Sequence: Synthetic coding sequence
atggatgccgacaaagagaaggacttgcagaagtttctgaaaaacgtagatgaaatatccaacctgattcaggaaatgaatagcgacgatcctgttgtccagcagaaggcggtattagagaccgaaaagcgcctgttgttaatggaagaagatcaggaggaagatgagtgtcgtaccaccctgaataagaccatgatttcacctccccaaacagcaatgaagagcgctgaggagattaatagcgaagctttccttgccagtgtggaaaaggatgcaaaagaacgggctaagagaagaagggaaaacaaggtattggctgatgccctgaaagaaaagggaaatgaggcatttgcagaaggtaactatgaaactgcgattctccgctatagcgaggggttggagaagctcaaggacatgaaagtgctctacacgaaccgcgcacaggcatacatgaagctcgaggattatgagaaagccctggtggactgtgaatgggccctgaaatgcgatgaaaagtgtactaaggcctactttcatatggggaaggccaacctagcactgaagaactacagcgtgagccgggagtgttataagaaaatccttgagattaaccctaagttacagacgcaggtgaaaggctatttgaatcaggtcgatctgcaggagaaggcagatctgcaggaaaaggaggcacatgagctcctggacagcgggaaaaataccgcggtgacgactaaaaacctgctggaaaccctgagtaagcctgaccaaatccccctgttctatgccggaggcatcgagattctcaccgaaatgattaacgagtgcacagagcagaccctcttccgaatgcacaacggtttttccattatcagtgataacgaggtcatccgacgttgcttttcaaccgccggaaacgatgctgtcgaggagatggtgtgtgtgagcgttctgaaactttggcaggccgtgtgttccagaaatgaagagaaccagcgggtgcttgtcatccaccatgacagagccagactactggcagccctgctgtctagtaaagttctggctatccgccagcagtcatttgccctgctgctgcatttagcccaaacggaaagcggaagatctcttatcattaatcaccttgatcttacaagactgctggaagcgttagtgtcgtttctggatttttccgataaagaggccaacaccgcaatgggccttttcacagatctcgcactcgaggagagatttcaggtttggtttcaggctaatctgcccggtgttctgcccgcactgacaggtgtgctgaagaccgatcccaaagttagtagctcctcagccctctgccagtgtattgccatcatgggtaacctgtcagctgagcccactacacggcgacacatggccgcttgtgaagagttcggagatggctgcctttccctgttagccagatgcgaggaagacgtggatctcttccgagaggtgatatatactctgcttggcctgatgatgaatctgtgtctgcaagccccttttgttagcgaagtgtgggctgtggaggtgtcaagacgctgtctctcgctcctgaactctcaggatggcggtatcttgactcgggctgccggagttctgtctaggaccctcagttcttcattaaagatagtggaggaagccctgcgagctggcgtcgtcaaaaagatgatgaagtttctgaagactggcggagagacggcaagtagatacgcgatcaagattctcgctatctgcaccaacagctaccacgaagcaagggaggaagtcatcaggctagacaagaagctgagcgtgatgatgaaacttttaagcagcgaggatgaggtgttagtgggcaacgcggctctatgcctgggcaattgcatggaagtaccaaacgtggcatcatccctcctgaaaaccgatctcttgcaagtcttactgaagttagcaggctccgatacgcagaaaactgccgtgcaggtgaacgcgggtatcgctttaggcaaactgtgcaccgcagagccaagggtacctgccgagtccagccacctccaattcggcagagaatcagccgctcccgaggctctttcgcctaggagatgggaagagatgttccatatgttggtgttctccttgtcatccgttgatccacctccccctcctccccagacttgctatccatag

SEQ ID NO: 243856 - DNA, 324 bp, Artificial Sequence
  Description of Artificial Sequence: Synthetic coding sequence
atggacgcagataaggagaaggatcttcagaaattccttaaaaatgtcgacgaaatctccaatcttatccaggagatgaacagcgacgatcccgttgtacaacagaaagcagtattggagaccgaaaaaagactgctgttgatggaggaggaccaggaggaagatgagtgccgtacaaccctgaataaaacaatgatctctccgcctcagaccgccatgaagagtgccgaggagatcaactccgaggccttcctggcctccgtcgagaaggacgctaaagaacgtgctaagcgtcgtagggagaataaggtgctcgccgactag

SEQ ID NO: 243857 - DNA, 609 bp, Artificial Sequence
  Description of Artificial Sequence: Synthetic coding sequence
atggatgcggataaagagaaggacttacagaaattcctgaaaaatgtcgatgaaattagcaacctgatccaggaaatgaacagtgatgaccccgtggtgcaacagaaggccgtcttagagacagaaaaacgccttctcctgatggaggaagaccaggaggaggacgagtgcaggaccacattgaacaagaccatgatatctccaccacagactgctatgaagtcagccgaggaaatcaactcggaggcttttctggcctctgtggagaaagacgctaaggagagggccaagagacggcgagagaacaaggtgctggcagatgctttgaaggagaagggtaacgaggcttttgccgagggaaactacgaaaccgcaattttgcggtacagcgaagggctggagaaactcaaagatatgaaggtcctctacaccaatagagctcaggcctacatgaagctggaagactatgaaaaggcattagtggattgcgaatgggcattaaagtgcgacgagaagtgtacgaaagcctacttccacatggggaaagccaacctggctcttaagaactattctgtctccagagaatgttataagaagattctggaatag

SEQ ID NO: 243858 - DNA, 504 bp, Artificial Sequence
  Description of Artificial Sequence: Synthetic coding sequence
atggatgcggacaaagagaaggacttgcaaaagtttctcaagaatgttgacgagatcagtaaccttatccaggaaatgaatagtgatgacccagtggtgcagcagaaggccgttttagagacagagaagcgcctgcttctgatggaagaggatcaggaagaggatgaatgtcggaccacactgaataaaactatgatcagtcctccacaaaccgccatgaagagtgccgaggagattaatagcgaggcatttttagcatcagttgagaaggacgctaaggagagggctaaaagacgccgagaaaacaaggtgctcgcagacgcactgaaagagaaaggcaatgaggcatttgctgaaggaaactacgagacggcaatactccgctatagcgagggcctagagaagctgaaagacatgaaagtgctgtatacgaacagggcacaggcatacatgaaactggaagactatgagaaagctcttgtcgattgtgaatgggccttgtag

SEQ ID NO: 243859 - DNA, 2118 bp, Artificial Sequence
  Description of Artificial Sequence: Synthetic coding sequence
atggacgccgataaagagaaggatttgcaaaagttcttaaagaacgtggacgagatctccaatctcatccaggaaatgaatagtgatgatcctgtcgtgcagcagaaagcagttctggaaaccgagaaacgactgctgttaatggaggaagaccaggaggaggatgagtgcagaactacactaaataaaaccatgatctctccaccccagacagccatgaagagcgccgaggagatcaacagcgaggcttttttagcctcggtggagaaagatgcaaaggagagggccaagagacgcagagagaacaaggtcctggctgatgccctgaaagagaaaggcaatgaggcctttgcggagggcaattacgagactgcgattttaaggtacagtgaaggcctggagaaactcaaggatatgaaggtcctgtataccaatagggcacaggcttacatgaaattggaggattatgagaaagctctcgtggattgcgagtgggctttaaagtgtgatgagaagtgcacaaaggcgtatttccatatggggaaggctaatctcgccctcaaaaactattccgttagcagagagtgttacaaaaaaattcttgagattaacccgaagctgcaaacccaagtaaagggttacctgaatcaggtggacctgcaggagaaagctgacttacaagagaaggaggcacacgagttgctggacagcgggaagaatacagccgtaacgactaagaatctcttggagaccttatctaagcctgatcagattccacttttctatgctggagggatcgagatactgacggagatgattaatgagtgcaccgaacagaccctgttccgaatgcataacggattcagcattatcagtgacaacgaagtcattcggaggtgcttctcaactgccggaaacgacgccgtggaggaaatggtgtgtgtctccgtacttaagctgtggcaggcagtgtgcagccggaatgaagagaaccagcgtgtcctagtaatacaccatgatcgggcaagactcctcgccgctctgttatcttccaaggttctggccatcaggcagcaatcattcgcactgctgctgcatctggcccagacagagagtggcagatctctcattattaatcacctggatttaacccgcttgcttgaggccctcgttagctttctcgactttagcgataaggaggccaatactgcaatgggcctgttcactgacctggctctagaggagcgcttccaggtctggttccaggccaatctgcccggtgtgctgccagcactgacgggagtactcaagacagaccccaaagtaagcagctcctccgccttgtgccagtgcatagccataatggggaatctcagcgccgagcccaccacgagacggcacatggccgcatgcgaggagttcggagatggatgcttgtccctactcgccaggtgtgaggaagatgtcgaccttttccgcgaagtaatctacacactgctcggactgatgatgaacctctgtctgcaggcaccatttgtgtccgaggtctgggcagttgaggtctcacgtagatgtttgtcactgctgaactctcaagatggaggcatcttaactagggcagcaggggttctcagccgcacactatcttcttccctaaaaattgtcgaagaagctcttcgtgctggcgtggtgaaaaagatgatgaaattcctcaagacaggaggtgagaccgcctcacgatacgctattaagattcttgcaatatgcactaacagttatcacgaggcaagagaggaggtcatacggctcgacaagaagttatctgttatgatgaagttgctttcatcggaagacgaggtactagtcggcaacgctgctctctgtctcggcaattgcatggaagtccccaacgtggcgtcctctcttctcaagactgacctgttgcaggttctgctgaaactggcaggctcggacacccagaaaacggctgtccaggtgaacgccggaatcgcccttggaaaactgtgtaccgccgaacccaggttcgccgcacagctcagaaaactgcacggactcgaaattttgaatagcacaatgaaatacatatccgattcctag

SEQ ID NO: 243860 - DNA, 1143 bp, Artificial Sequence
  Description of Artificial Sequence: Synthetic coding sequence
atgttccgtctactctcatggagcttgggtagaggcttcctgcgtgctgcagggaggcgctgccgcggttgttcggcacgtttgctccctggactcgccggaggccctggaccagaagtacaggtccctccatctcgggtagcaccacacggcaggggcccaggcctgctgcctctgctcgccgcactcgcttggttttcacgccctgccgctgcggaggaagaagaacagcaaggagctgacggtgcggcagccgaagatggggcagacgaagccgaggctgaaattatacagctgctcaagcgcgcaaagctcagtatcatgaaagacgagcctgaggaagcagagctcatcctgcatgatgctttacggttagcctaccagacagataataaaaaagccatcacttatacctatgaccttatggccaaccttgccttcattcgcggacaactggagaatgcagagcaactattcaaggcaacaatgtcatacctccttgggggaggcatgaagcaagaagataatgctatcatcgaaatcagcttgaagcttgcgtccatatatgctgcacagaacaggcaggaattcgccgtcgcaggatatgaattttgtattagtacacttgaagagaaaatcgaacgtgaaaaagagttagccgaggatattatgtctgtcgaggaaaaggcaaatacacacctgctcctcggtatgtgcctcgacgcctgcgcaagatatttactgttcagcaagcaacctagccaggcccagcggatgtatgagaaggcactgcaaatctccgaggagatccaaggggagaggcatccccagaccattgtactgatgagcgatctcgccactactctggacgcccagggcaggtttgacgaggcatacatctacatgcaacgcgcaagcgacctggcgcgacagatcaaccaccctgagctccacatggttctgtccaacctcgccgctgtgctcatgcatagagagcgctacacccaagcaaaagaaatttaccaggaggcactgaaacaggctaagctcaaaaaggatgaaatctcagttcagcatatacgcgaggaactggccgaattgtccaagaagagcagacccctaaccaactctgtgaagttatag

SEQ ID NO: 243861 - DNA, 1143 bp, Artificial Sequence
  Description of Artificial Sequence: Synthetic coding sequence
atgttcagacttctgtcctggtccctgggccgtggatttttgcgcgctgccggaagacgatgtcgtggatgctccgcaagactccttcccggactggccggaggtccaggccctgaagtgcaggtccctccttcgcgtgtggccccacatggtcggggacctggccttctccctctcctggctgcgctggcctggttctctagacctgccgcagctgaggaggaggagcagcagggagctgatggcgctgcggctgaagacggcgctgatgaggccgaagctgagataatccagttgctcaaacgggctaaattgagcattatgaaggacgagcctgaggaggcagaactcattttgcatgacgcgctccgactggcctaccagaccgacaacaaaaaagccataacctatacctatgacctcatggcaaatctggccttcattaggggacagctcgaaaacgcagaacagctattcaaagctactatgtcctacctgctgggcggaggcatgaagcaagaagataatgccattattgaaatctccttaaaacttgcttccatttatgccgcacagaatagacaagagtttgccgtagccggatacgaattttgtatctcaacactggaggaaaagatcgagcgggagaaagagctggcagaggatataatgagtgtggaggaaaaggctaacacacacctgttactggggatgtgcttagatgcatgcgctaggtacttgttgttttcaaagcaaccttctcaggcgcagcggatgtacgagaaagccctgcagatttctgaggaaatccagggggaaaggcacccgcagactattgtcctcatgtcagaccttgccactaccctggatgcccaggggaggtttgacgaggcctacatttacatgcagcgagcatctgatttagccagacagatcaaccatcctgagttgcacatggtgctcagcaatttagccgctgtgctgatgcatcgggagagatatacacaggccaaggaaatatatcaggaggccctgaagcaggcaaaactaaaaaaggacgagattagcgtgcagcacattagggaagagctggcagagttgagcaaaaaatcgcgcccactgaccaattctgttaagctctag

SEQ ID NO: 243862 - DNA, 1506 bp, Artificial Sequence
  Description of Artificial Sequence: Synthetic coding sequence
atggcacagccccacacgaccagcgtaccttattttgcccgatcacccgcaccacccccacctagcaggagtggtgcccctcctcagccaccggctaccttgaggccaagcaggcgcaggaccaggccaccccgtccggctgaccgacgggatgcccctgccgactgtgcctacctgtggcggattctgactccaagaagggggagagccaggaggagcgacgttggtgccaggcatcgggcttgtgggagacgcgatgtgctgctctcccggcagggtccagctaaccctgagggagcgcgaagggtggttggcggtcaagaaagagtgtggccagctgtgcggcgaggccgaggcggttcaatgttcagactgctgagttggagcctgggaaggggattcctgagagccgctggccgtcgctgtcggggatgttctgccagactccttccaggtctcgccggaggtcccggacctgaagtgcaggttcctccttcccgggtggcaccccatgggagggggcctggactgctgcctctcctggccgcattagcgtggttttcccgccctgctgcggcagaggaagaagagcagcagggagctgatggagcagccgctgaagatggcgcagacgaagctgaagcggaaattatccagctgctgaagagggcaaaattatctatcatgaaggatgagcctgaggaagcagagctgatcttgcacgacgctttgcggctggcttatcagacggacaataaaaaagcaatcacctacacatatgatcttatggctaatctcgcgttcatccggggacagttggaaaacgccgaacagctgttcaaggcaaccatgagctacctgttggggggagggatgaaacaggaggataatgccattatcgagattagtctgaaactggctagcatctacgccgcacaaaataggcaggagtttgccgtggcgggttacgaattctgcattagtaccctggaggaaaagatcgagagagaaaaagagctggccgaagatatcatgtcagtcgaagagaaagcaaacactcacctgctgctcgggatgtgtctggatgcctgcgccaggtacctgctgttcagcaaacaacctagtcaagctcaaaggatgtacgaaaaggccttgcagattagtgaggagatccaaggcgagcggcatcctcaaactatagtgctcatgtctgatctggcaaccactctggacgcacagggcagatttgacgaagcctacatctatatgcagagggcctccgaccttgcacgccagatcaaccatccagagcttcatatggtgctcagtaacctggccgcagttttgatgcatcgcgaacgctacactcaggccaaagagatttatcaggaagccctgaagcaggctaaactcaaaaaagacgagatttccgtccagcatattcgcgaagaattggccgagctgagtaagaagtcaaggcccctgacaaatagcgtgaagctttag

SEQ ID NO: 243863 - DNA, 501 bp, Artificial Sequence
  Description of Artificial Sequence: Synthetic coding sequence
tgacaagaacgggtgtggcccgctgtgagacgcggtaggggcggaagtatgtttaggctcttgagctggtcccttggacggggatttctgagagcggcaggaaggcgttgtagaggttgctcggccagactgcttcccggactggctggtggtcccggtccagaggtacaggtgccacccagcagagtcgcccctcacggccgtggcccaggattgttgcctctcctcgccgcactggcctggttcagcagacccgcagccgctgaggaggaggaacagcagggagcagatggcgctgctgcagaggacggtgctgacgaggccgaggcggagatcatacagctccttaagagggctaaagtgcggaggctgagggctctgcgaccagctgagagaggtagcttatgtgagaggggtttgggcgtggcagcccactactccctcaggctggccgaagagtggatggaagcccctcgagtcaagctcccaagaatgtcctag

SEQ ID NO: 243864 - DNA, 3951 bp, Artificial Sequence
  Description of Artificial Sequence: Synthetic coding sequence
atggactctcaagaactgaaaactctgataaattattactgccaggaacggtactttcatcacgttttgctggtggccagcgagggcatcaaacggtacggaagtgatcccgtcttcagattctatcacgcgtatggaacgctgatggaagggaagacacaggaggccctccgggagttcgaggccattaagaataagcaggacgtgtccctttgctcactgctcgctttaatctacgcgcataaaatgtccccgaatcccgaccgggaggctatcctggagtccgacgccagagtgaaagagcagcggaaaggcgctggcgaaaaggccctgtatcatgcaggcctcttcctctggcatatcggacgtcacgacaaggccagagaatatatcgaccgaatgatcaagataagtgacggttccaaacaaggacatgtccttaaagcctggctcgacatcacccggggtaaggaaccgtatactaaaaaagctcttaagtatttcgaggaaggcctccaagatggcaatgatacattcgcgctgctgggaaaggcccagtgtctggagatgcgacagaactactctggggctttagaaactgttaaccagataatagtcaatttcccttctttcctgcctgcgtttgtaaagaagatgaagctgcagcttgccctccaggactgggaccagactgtagaaacagctcaaaggctactgctgcaggatagccagaatgtggaagcactcaggatgcaggctctctactacgtgtgtagagaaggtgatatcgaaaaagcctctaccaaactcgagaatctcggtaataccctggacgctatggagccgcagaacgcccagctcttctacaatattacgctggcttttagcagaacatgcggaaggtcccagcttatcctacaaaagatccagacacttcttgagcgcgcattctcactgaatcctcagcagtcagagtttgcgaccgaattggggtatcagatgattctgcagggacgtgtgaaagaagccttaaagtggtataaaacagcgatgaccctggacgagaccagtgtcagtgctctggtggggtttatccaatgccaactgatcgagggacagttgcaggacgccgaccagcagctggaatttttgaacgaaattcagcaatctattggcaagtccgccgagctgatctatcttcatgctgtgctggccatgaagaagaataagaggcaggaagaggtaattaatctcctgaacgacgttttagatactcacttcagtcagctcgaagggctgcctctcggcattcaatatttcgagaagctcaaccccgactttttgctggaaatcgtaatggagtacctttcattctgccccatgcagccagccagtccgggtcagcccctgtgtcccttattacgtcgttgcatttcagtgctggagaccgtggtaagaacagtaccgggacttctccaaaccgtgtttttaattgcaaaggtcaagtatttaagtggtgacatcgaagccgcattcaacaacctccagcattgtctggaacataacccctcatatgctgatgcccatcttctgctggctcaggtatacctgagtcaagagaaagtgaaactgtgctctcaaagccttgagctgtgcctcagctacgacttcaaggttcgcgattacccactctaccatctcataaaagcccagtctcaaaagaagatgggagagattgccgacgccattaagaccctgcatatggcaatgtccctccccggaatgaagcggattggcgcttcgactaagagtaaagataggaaaaccgaggttgacacctcacaccggctgagtatttttctcgaactaatcgatgtgcatcgtttaaatggagaacagcatgaggccacaaaggtcctgcaggacgctatccatgagttttcagggacgtccgaagaggtgcgtgtcacgatcgccaacgctgacttggcgctcgcccaaggcgatatcgagcgcgcattatcaatactgcagaatgttacggccgaacaaccctacttcattgaggcacgagagaagatggcggatatctatctgaagcaccgcaaggataagatgctatacattacttgctttcgcgagattgcagaacgaatggccaatccccgaagtttcctgctgctgggggatgcatatatgaacatcctcgaaccagaagaggctatcgtggcctacgaacaggctttgaaccagaacccaaaggatgggacccttgcttccaagatgggaaaggccctcattaagacccataactattccatggccatcacatactatgaagccgctctgaaaacagggcagaagaattatctatgctatgacctggctgagctgctcctcaagctgaagtggtacgataaggcggaaaaggtgttacagcacgcacttgcgcacgagcctgtgaacgagttaagcgcattaatggaggatggacggtgtcaggtcctgctggctaaggtttacagcaaaatggagaagcttggcgatgccatcaccgcactccagcaggcgcgtgagcttcaggctagggttctaaagagagtgcagatggagcagccagatgcggtgcccgcacagaagcatttagccgctgagatttgcgcagagatagcgaagcactctgtggcacagcgggattacgaaaaagctattaagttctacagggaggctctggtgcattgcgaaaccgataataagattatgctggagctcgccagactgtatttagcccaggacgaccctgattcatgcctgcggcagtgtgcgctcctgctgcaatcagaccaggataacgaagctgctacaatgatgatggcagacctcatgttcaggaagcaggattatgagcaggctgtatttcacttgcagcagctgctcgagaggaagcccgacaattatatgacgctgtcaaggctgatagatctgctgaggaggtgcgggaaacttgaggatgtcccaaggtttttctcaatggcggagaaaagaaatagccgagccaagctggaacccggattccagtattgtaaaggactctacctgtggtacactggtgagcccaacgacgctctgaggcattttaataaggccagaaaagaccgcgattgggggcaaaacgctctctataacatgattgaaatctgcctcaatccggacaacgagaccgtgggaggcgaagtctttgagaacctggatggtgatctgggcaatagtacagagaagcaggagtctgtgcagctggccgtgcggacagcagagaagctactaaaggagttgaagccacaaactgtgcagggacatgtgcaattacgtatcatggagaattactgtctgatggccactaaacaaaaatctaacgtggaacaggcacttaatacctttacagagatcgctgcttccgaaaaggagcacatccccgcacttctgggcatggccacagcctacatgattctcaaacagactccccgtgccagaaaccagctgaagagaatcgcgaaaatgaactggaatgcgatagacgctgaggaattcgagaaatcatggcttttgttggccgacatttacatacagtcagccaaatacgacatggccgaggatctgctcaagagatgtcttagacataatcggagttgctgtaaagcatacgaatatatgggctacataatggagaaagagcaagcatacactgatgctgccttgaattatgagatggcctggaagtacagtaatcgcactaatccagcagtaggttacaagctggcatttaattacctgaaagctaagcgctacgtcgattcaattgacatctgtcatcaggtattagaagcgcacccgacctatccgaaaatccggaaagacatcctagataaggccagagcgagtctgagaccctag

SEQ ID NO: 243865 - DNA, 765 bp, Artificial Sequence
  Description of Artificial Sequence: Synthetic coding sequence
atgatcgagatctgcctcaacccagataacgaaaccgtgggcggtgaagttttcgaaaacttagacggcgacctgggcaacagcaccgaaaagcaggagagcgtccaactggccgtgaggactgcagaaaagctcctgaaagaacttaagccacagacagtgcaaggacacgtgcagcttcgcattatggaaaattactgtctgatggctaccaaacagaaatcaaatgtagagcaagctcttaataccttcaccgagatagcagctagtgaaaaagagcatattcccgctctgttaggtatggctacagcctatatgatcctcaaacagaccccccgagccaggaatcaactcaaacgtattgccaaaatgaactggaatgcaatcgatgccgaggagttcgagaaatcgtggctactgctagctgacatttatatccagtccgcaaaatatgacatggccgaggacctcctgaaacggtgtctgcggcacaaccggtcctgttgtaaggcttatgaatatatgggatacataatggaaaaggaacaggcctataccgatgcagcgctgaactacgaaatggcttggaagtacagtaatcgcaccaaccccgcagtgggttataaactggccttcaattatctgaaggccaagcggtatgtggacagcattgatatctgccaccaggttttggaagcccaccccacctacccgaagatccgcaaagatatcttagataaagctagagcaagtttaaggccatag

SEQ ID NO: 243866 - DNA, 6077 bp, Artificial Sequence
  Description of Artificial Sequence: Synthetic coding sequence
atggacaatttcgccgaaggcgacttcaccgttgctgactatgccctgttagaggactgcccacacgtcgacgattgcgtctttgccgcagagttcatgtccaatgattatgtgagggtgacgcagctctattgtgatggagtcggcgtgcagtacaaggactatattcagagcgaaaggaacttggagttcgatatatgttcaatctggtgttccaaacccataagcgtgctgcaagactactgcgacgccattaagatcaacattttctggccccttctgttccagcatcagaattccagcgttatctctcgcctgcatccctgcgtggacgcgaacaattcgcgcgcttctgaaataaacctgaagaagctgcagcaccttgaacttatggaggatattgtcgatctcgccaaaaaagtagccaacgattcgtttctcataggaggcctactccggatcggttgcaagatcgagaacaaaattctcgctatggaggaagcgctaaattggattaaatatgctggagacgtgacgattctgaccaagttgggctccatcgacaactgctggcccatgctctcaatttttttcaccgagtacaaataccatatcacaaagatcgtgatggaagactgcaacctgcttgaggagctcaagacgcagtcttgcatggattgtatagaggagggggaattaatgaaaatgaagggaaacgaggaattctctaaagagagatttgacatcgcaattatctactatactagggccattgaatatcgccctgagaactatcttctgtatggcaatagagcactatgcttcttgaggactggacagtttagaaatgcccttggagacggcaagagagctactatcttaaagaacacatggcctaaagggcactatcgctattgtgacgcgctgtccatgctgggtgagtacgactgggcgttgcaggccaacattaaggcacagaagctgtgcaagaatgaccccgaaggtattaaggatctgatccagcagcatgtcaagttgcagaagcagatcgaagacctccagggccgaacggccaataaagatccaataaaggctttctatgagaatcgcgcttacacacctcgctccctgtccgcaccgatctttacaacttccctgaacttcgtggaaaaagagcgggacttccgaaagatcaatcacgaaatggcgaacggcggtaaccaaaatctaaaggtcgctgatgaggcgctgaaggtggatgattgcgattgccatcctgaattttctcctccaagctcccagcctccaaaacataaggggaaacaaaagtctcgcaataacgaatctgagaaattttctagtagcagcccgctgacgttgcctgcagatttaaagaatattctggagaagcagttctcaaagagcagtagggccgcacaccaagatttcgctaacatcatgaaaatgcttaggtctttaatccaggacggctacatggcactgctcgagcagagatgccgcagcgcagcccaggcctttactgagttgctgaacgggcttgacccccagaaaatcaaacagctgaatctggccatgattaactacgtgctggtcgtctacggactggccatctccctcttggggatcggccagcctgaggagctgagtgaggcagaaaatcagttcaagaggatcatcgaacattatcctagtgaaggcctggactgcctggcctattgtggaatcggcaaggtctatcttaagaagaaccggttcctggaagccttaaaccatttcgaaaaagctcgcacgctgatctatcggctgcccggagtgcttacatggccgacaagtaacgtgattattgaggaatcacagcctcaaaaaataaaaatgctcctggaaaagtttgtggaggaatgcaagtttcccccagtcccagatgccatttgttgctaccagaaatgccacggttattccaagatccagatctatatcaccgaccctgatttcaagggcttcatccggatcagctgctgccagtattgtaaaattgaattccatatgaactgctggaaaaagctaaagactacgacattcaatgataaaatagacaaggattttctgcaggggatttgcctgacaccagattgcgagggggtgatttctaagatcatcatcttttcgtccgggggagaggtcaagtgtgaattcgagcataaagtgatcaaagagaaggttcctcccaggccaatattaaagcaaaagtgtagcagtctggaaaaattacgactcaaggaggacaaaaaactgaagcgtaaaatacagaaaaaagaagcaaagaaactcgcccaagaacgaatggaggaggacctgcgggagagcaatccacccaagaatgaagaacaaaaggagacagtggacaatgtgcagaggtgccagttccttgacgatcggatccttcagtgtattaagcagtatgccgacaaaatcaaaagcggcattcagaatacagccatgttgttaaaggagttgttatcatggaaagttctgagcactgaagattatacaacatgcttttcttcgcggaatttcctgaacgaggcagtggactatgttatcagacatctgattcaggagaacaacagggtgaagacccggatctttctgcacgtgctctccgagctcaaagaggtcgagccgaaactggccgcttggatccagaaattaaattcattcggattagacgcaactggcacatttttctccagatatggcgcttcactcaagctattggacttttccattatgacttttctctggaacgagaaatacggacataagctcgacagtattgagggcaagcaacttgactacttcagcgagccagcttcactcaaggaagccagatgtttaatttggctcttggaagagcatcgcgataaattcccggcactgcatagcgctctggacgagttctttgacatcatggacagccgctgcacggttctgaggaagcaggactccggggaagcacccttcagttctacaaaagttaaaaacaagtctaaaaaaaagaagccaaaagactcaaaaccgatgctcgtgggaagcggcactacatctgtaacctcaaacaacgaaattatcacatcaagcgaggatcattcaaatcgtaattcagacagcgcagggccttttgccgtgccggatcatctgcggcaggacgtagaggagttcgaggcactgtatgaccagcattctaatgaatacgtggtgagaaacaagaagctgtgggatatgaatcccaagcagaaatgttcgaccctgtatgattacttttcgcagttccttgaagaacacggtcccctggatatgagcaacaaaatgtttagcgccgagtacgagttttttccagaggagacgaggcagatcctggagaaggccggaggactcaagcctttcctgctgggatgtcccaggttcgtcgtgattgacaactgtatcgcacttaagaaggttgcgtccaggcttaagaaaaagaggaagaaaaagaacatcaagactaaagttgaagagatcagcaaggctggcgaatatgtgagggtaaagttgcaactgaatcccgctgccagagagtttaaacctgatgtaaaatctaagcccgtgtctgattcatcatccgcaccagctttcgaaaacgtcaagcctaaaccggtttccgcaaatagcccaaagcccgcttgtgaggatgtcaaggccaagccagtcagtgataattcgtctcgccaggtctcagaggatggccagccgaagggtgtgtcctccaactcacctaagcccggatcagaagacgcaaattataagcgtgtgagctgcaattcacccaagcccgttctggaggatgtgaagcccacatactgggctcagtcccacctcgtgacaggttactgtacttatctgcctttccagaggttcgacatcacccagacacccccagcctacattaatgttcttcccggtctgccccagtacaccagtatttatacacctttagccagtctgagccctgagtatcagcttcccaggagtgtacctgtggtgcccagtttcgtggccaatgaccgggcagataagaatgctgccgcatatttcgaggggcaccacctgaatgcagagaacgttgccggacatcaaatcgccagtgagacacagattttagagggctctttgggcatcagtgtgaaatcacattgcagtactggcgacgcccatacggtcctgtcagagagcaaccggaacgatgagcactgcggaaacagcaataataaatgcgaggtgatcccagaaagcacctcggcggttacaaatattcctcacgtccaaatggtggctattcaggtctcatggaacatcatacatcaagaggtaaatacggaaccatataatccatttgaagagcggcaaggcgaaatctctagaatcgagaaagagcaccaagtattacaggaccagctgcaggaagtgtacgagaattacgaacagatcaaactgaaagggttggaagaaacacgagatctagaggaaaagcttaaacgccacctggaagaaaataagattagcaagacagaactcgactggttcctgcaagacttggaacgcgagataaaaaagtggcaacaggagaagaaagagatccaggagaggctgaagtcgctgaagaagaaaatcaagaaggtgtcaaatgcgagtgagatgtacactcagaagaatgatggaaaggagaaagaacatgagctacatttagaccagtccctagagatctcaaatacactcactaatgaaaagatgaagatcgaagaatacattaagaaaggtaaagaagactatgaagaatcccaccagcgcgcagtggccgctgaagtatcggtgcttgaaaactggaaggagtccgaggtgtacaagctacagatcatggagtctcaggccgaggccttcctgaaaaaacttggcctgatcagccgcgatcccgctgcatatcctgatatggagtctgacatacgcagctgggagctgttcctgtcaaacgttactaaagagatcgaaaaagcaaagtcacagtttgaggagcagattaaagcaataaagaacggctcacgtctttcagagttatctaaagtgcagatcagcgaacttagttttccagcttgtaacaccgtacatcccgagttactcccggaaagcagcggtgacgacggacaaggcctcgttacctcagcctctgatgttactggcaaccacgcagcactccaccgagacccctccgtgttctcggcaggggattccccaggagaggccccatcagccctcctgcctggtccccctcccggtcagcctgaggccacgcaactcacaggacccaaaagggcaggacaggccgcactgagcgagagatcccccgtagctgatcgtaaacaaccggtgccccctggaagagcagccaggagcagccagtctcccaaaaagccattcaactctataatcgagcatctctctgtcgtgtttccctgctacaattccaccgaacttgcagggttcattaagaaggtgcgctctaaaaacaagaactcactgagcgggctctctatcgatgagattgttcagagagtgactgaacacattttagatgaacagaagaagaagaagccgaacccaggcaaggataaaaggacttatgagccgtcatcagcaacaccagttacaaggagctcccaaggtagcccaagcgtggtagtggccccttcgcccaagaccaagggtcaaaaagccgaagacgtccccgtccgaattgccctaggcgcaagcagctgtgagatatgtcacgaagtcttcaagagcaagaatgttcgcgtgctgaagtgcggtcacaaataccataaaggctgctttaaacagtggctgaaaggccaaagtgcttgccccgcttgccagggcagggacctgctgaccgaggagagtcccagtgggagaggctggccttctcagaatcaggagctgccttcatgtagttccagata

SEQ ID NO: 243867 - DNA, 6077 bp, Artificial Sequence
  Description of Artificial Sequence: Synthetic coding sequence
atggacaacttcgctgagggcgacttcaccgttgcagactatgccctgttagaggactgcccacacgtggatgattgcgtctttgccgctgaattcatgtcaaacgactatgtcagagtcacgcaactgtattgcgatggggtgggagttcagtataaagactatatccaaagtgaacgcaatctggagttcgacatttgctcgatctggtgtagcaagcccattagtgtgttacaagattactgcgatgctataaagatcaacattttttggcccctcctgttccagcaccagaactcttcggtgatctcgagactgcatccatgcgtcgacgccaacaactctagagcatctgaaattaatctgaaaaaactgcagcatttagagttaatggaggacattgtggacctagcaaaaaaggtggcgaatgattcatttttgattggcggattgctgagaattggatgtaagatcgaaaataagatccttgccatggaggaggcactgaattggattaagtacgccggagacgtcaccatcctgacgaagttaggaagcattgacaattgctggcctatgctgtccatattctttacggagtacaaataccacatcactaaaatcgtgatggaagattgcaatctcctcgaggaactcaagacccagtcctgcatggactgtattgaggagggtgagctaatgaaaatgaaaggaaatgaagaattctccaaggagaggttcgacatcgctattatttactacaccagggctattgagtacagacccgaaaattacctcctctacggtaatagggccctgtgctttcttcggacaggccagttcaggaatgctttgggagacggaaagagagcgaccatactaaagaacacttggcccaaaggccactatagatactgtgatgctctgtccatgcttggcgagtacgactgggctctgcaggcaaacattaaagcccagaagctttgtaagaacgaccctgaaggcattaaagatctgatccaacagcacgtcaaacttcagaagcaaattgaggacctgcagggacgcactgccaataaagacccgataaaagcattctacgagaaccgcgcatatactccaagaagcttgagcgcgcctatcttcactacgagcctaaacttcgtcgaaaaggagcgggattttcgcaaaatcaatcacgagatggccaacgggggaaatcaaaaccttaaagtagcagacgaggcgctaaaagtagatgactgcgactgtcacccagaattttcccccccaagttcccagcccccaaaacataagggtaagcagaaatcgcgaaacaacgagtctgagaaattttccagcagcagcccgttaacgctgccagctgacctcaaaaatatcctggaaaaacagttttccaaaagctctagggcagctcaccaggatttcgcaaacattatgaaaatgcttcggagccttatccaggatggttacatggctttgctggagcaacgctgccggagcgccgctcaagcgtttactgaactccttaacggactggatccgcagaaaattaaacagctgaacctcgcgatgattaactatgtgctggttgtttacggattggccatcagcttgctgggtattgggcaaccagaggagctctctgaagccgagaaccaattcaagcggatcatcgagcattatccctctgaggggctagattgcctggcttactgcggcattgggaaagtgtacctgaaaaagaataggttcctggaggccctaaatcacttcgaaaaagccaggactttgatctatcgtcttccaggagtgctgacctggccgacatctaacgtcatcatcgaggagtcacaaccacagaagatcaaaatgttgctggagaagttcgtggaggagtgcaaattcccacctgtcccggatgcgatatgctgctatcaaaagtgtcacggatactctaagatacagatctacatcacagatccggatttcaaaggattcataagaatttcctgctgtcagtattgcaaaatcgaatttcacatgaactgttggaaaaaactcaagactactacctttaatgataagattgataaagactttcttcaagggatctgtctgacacccgactgcgaaggtgtcattagcaagattataatatttagctccggaggtgaggttaagtgtgagtttgaacataaagttatcaaagaaaaggtgccccctagaccgatcctgaagcagaagtgctcctccctagaaaagctcaggctcaaagaagacaagaagctgaaaagaaagatccagaaaaaggaggccaagaaacttgcccaagaaaggatggaagaagatctgcgcgagagtaaccccccaaaaaatgaagagcagaaagaaaccgtggataacgtgcaacgatgtcagtttctggacgataggatactgcagtgcatcaagcagtatgcagataagattaagtcagggatccagaataccgcaatgcttctaaaagagctgctttcatggaaggttttgtctacagaggattacaccacttgcttctcttccagaaactttctgaatgaagccgtcgactatgtgatccgccacctgatccaagagaacaaccgcgtgaaaaccaggatatttttacatgtcctttcagagctgaaagaggttgaacctaagctcgccgcatggattcagaaactcaattctttcgggctggacgccactggaacctttttttctagatatggcgcttcactgaaactcctggatttcagtataatgacatttctgtggaatgagaagtacggtcataaactcgactctatcgaaggcaagcaactcgattacttctcagagcctgccagtctgaaggaggctagatgcttgatttggctccttgaggagcacagagataaatttcctgctctgcactcagctctggatgagttttttgacattatggattctagatgtactgtgctccgcaaacaagatagcggagaagcgccattcagctctacgaaagtgaaaaacaagtcaaagaagaagaagcctaaagattccaagcctatgctagtgggcagtggcacaacctcggtgacctccaataacgaaatcattacatcctccgaggaccactctaaccggaatagtgattcagcgggaccttttgcagtgcccgatcatcttcgccaagacgtggaagagttcgaagctctctatgatcagcatagcaacgagtacgtggtgagaaataagaagctgtgggatatgaaccctaaacaaaagtgctctaccctttatgactacttttctcagtttttggaggagcatggtccactggatatgtcaaacaaaatgttcagcgccgagtacgagttctttcccgaagaaacgagacaaatacttgagaaggccggaggccttaagccatttctcctgggctgtccaaggttcgtggtcattgataattgtatcgcattaaagaaggtggcatcccggctgaagaagaagaggaagaaaaagaacataaagaccaaagtggaggagatcagcaaggcaggggagtatgtcagagtgaaactccaactgaatcctgccgctagggaattcaagcccgacgtgaaaagcaagccggtgtccgactcttcctccgcgcctgcgtttgaaaacgttaaaccaaaacctgttagcgctaattcacccaagcccgcttgcgaggacgtcaaagctaaaccagtgtccgataatagctcacgccaggtatctgaggatggccaaccaaagggtgtcagctccaacagccctaaacctgggtctgaagatgccaactacaagagggtctcttgtaatagcccaaaaccagtgctggaggatgtcaaacccacttactgggcacagagtcatctcgtgactggctattgcacctacctccctttccaacgctttgatattacgcagacaccccctgcatatattaacgtgctgccaggcctccctcagtatactagcatttacaccccccttgcatctctgagtcccgagtaccagctgccccgtagcgtgccggtcgtgccttcctttgttgctaatgaccgtgccgataaaaatgcagccgcttatttcgaaggtcaccacctgaacgcagagaatgtagccggtcatcagatcgcctctgagacccagattctggaaggatcactggggatcagcgttaaatcgcattgctcaacgggggacgcccatacagtcctctccgagagtaaccggaatgatgaacattgtggtaattccaataacaaatgtgaggttatacccgaatcaaccagcgccgtgactaatataccgcatgtgcagatggtggcaattcaggtatcatggaacattatccaccaagaggtcaatactgagccatataacccttttgaggagcggcagggggaaattagtaggatcgagaaggagcatcaggttttgcaggaccagcttcaagaggtttacgaaaactacgagcagataaaactgaaaggtctggaggagaccagggatcttgaggagaaacttaaaagacatctggaagaaaataagatctccaaaacagagttggactggtttcttcaggacctggagcgtgagatcaagaaatggcaacaggaaaaaaaagagattcaggaacgactcaaatcattgaagaagaagattaaaaaggtatccaatgccagtgaaatgtacacgcaaaagaacgacggcaaagagaaagagcacgagctacacctagaccaatcactcgaaatttcaaacacactgacgaatgagaaaatgaaaattgaggagtatatcaaaaagggcaaagaggactatgaggagtcccatcaacgcgctgtcgccgctgaggtgagcgtgttggaaaattggaaagaatccgaggtgtacaaattgcagatcatggaatcccaagccgaagcctttttgaaaaaactgggcctgatcagtagggacccagcagcctatccggacatggagtctgacatccgctcctgggagctgtttctgagtaacgtaacaaaggagatcgaaaaagcaaagtcacagtttgaggagcagatcaaagccatcaagaacggaagtagactgagcgaactgtctaaggtgcagatcagcgagctgtccttcccagcgtgtaataccgtgcatcccgaattgctcccagagtccagtggcgacgatgggcagggtcttgtaaccagtgctagtgacgtgacaggaaatcacgccgcactgcaccgcgatccaagcgtgtttagcgcaggagactctccaggggaggctccttctgcattattgccaggccctccacctggtcagcctgaggcaactcagctgacaggaccaaaaagggcaggacaggcagctctgagcgagcgctctcctgtggctgacaggaagcagcccgttcctccagggagggcagctcggtcatcacagagtcccaagaagccttttaatagtattatcgaacatctgagcgtggtcttcccctgttacaactccaccgagttggccggattcatcaaaaaggtccgctccaaaaacaaaaattccctgagcgggctgagcatcgacgagattgtacagcgggtgactgagcacatcttggatgagcaaaaaaagaagaagccaaaccccggaaaggacaaacgcacctatgagcccagctccgcgaccccagtaacgcggagcagtcaaggaagtcctagcgtcgtggtggcccctagcccaaagaccaaaggccagaaagcagaagacgtccctgtgaggatcgccttgggcgctagttcatgtgagatttgtcacgaggtctttaagtccaaaaatgtgagggtgctgaaatgtggccataagtaccacaagggttgcttcaaacagtggctgaagggacagtctgcctgtcccgcttgccaaggcagagatctgttaacagaagaaagtccctctgggagagggtggccgagtcagaaccaggagctgccctcgtgctcctctagata

SEQ ID NO: 243868 - DNA, 6077 bp, Artificial Sequence
  Description of Artificial Sequence: Synthetic coding sequence
atggataacttcgccgaaggagactttaccgtggcggactacgctttattagaggactgtccacacgtcgacgactgcgtctttgcagctgagtttatgtctaacgactacgtgagagtaacccagctgtattgcgatggcgtaggagtccagtacaaggactacatacagagtgagcgtaatttggagtttgatatttgttctatctggtgttctaaaccgatcagcgtgcttcaggattattgcgatgcaatcaaaatcaacattttctggcctctgcttttccagcaccagaactcatccgtcatctccagactccacccctgcgtagatgcaaacaatagccgtgcgtctgaaatcaatctgaagaagctgcagcacctggaattaatggaagacattgttgacttagccaagaaggtcgcaaatgacagttttcttatcgggggtctgctgaggattggatgtaaaatcgagaacaaaatcctagccatggaggaggcactcaattggatcaagtacgccggagatgttaccatcctgactaagctgggatcaattgataattgctggccaatgctgtctattttcttcacggagtacaaatatcacatcacaaaaatagtcatggaggactgtaatctgttagaggagctgaagacccagagttgtatggactgcatagaggaaggcgaattgatgaaaatgaaaggaaacgaagaatttagtaaggaacgatttgatatcgcaattatttattatacgcgggctatcgagtacagaccagagaactatctcttatacgggaacagagccctgtgtttccttaggactggccaatttcgtaacgccttgggcgacggcaagagagcgactattcttaagaatacttggcctaaaggccactacaggtattgcgacgcacttagcatgttaggagaatacgactgggctctgcaggctaacatcaaggcacagaaactgtgcaagaacgaccccgagggtattaaggacctcattcagcaacatgtcaagcttcagaagcagatcgaagatctgcagggtcggaccgccaataaggaccctatcaaagcattttacgagaatcgagcatataccccccgatcactgagcgcccctattttcacaacaagcttgaatttcgtcgagaaagaacgcgacttccggaagatcaatcacgagatggcaaacgggggaaaccagaatctgaaagtggcggatgaggccctaaaggtggatgattgtgattgtcacccggagttcagccccccaagctcgcaacccccaaaacataagggcaagcagaaaagccgaaataatgagagcgagaaattcagctcttccagccctctcaccctaccggcagacttaaaaaacatcctggaaaagcaattctccaaatcttcacgggcagcacatcaggactttgctaacattatgaaaatgctaagaagtctgatacaagatggctatatggcactgcttgaacagcgctgtcggagtgccgcacaagcctttaccgagcttctaaacggtttggatccccaaaagattaagcagctcaacctcgctatgatcaactacgtacttgttgtgtacggactcgccatttctctgcttgggattggccagcctgaagagctgtcagaagccgagaaccaattcaagaggatcatcgagcactaccccagcgagggtctggactgtctggcctactgtggcatcggcaaggtctatctgaagaagaatagatttctggaagccttgaaccactttgagaaggccagaacgttaatttatcgcctgcctggtgtgttaacttggcccacctccaatgtcattatcgaggagagccagcctcaaaagattaagatgttgctggagaaattcgttgaggagtgcaagtttcctcctgtgccagatgccatttgctgttaccagaagtgtcatggttattccaagatccagatctacatcactgatcctgacttcaaaggttttatccgcatctcttgttgccaatattgtaagatcgagttccatatgaactgttggaagaagctgaagacaacgacctttaacgataagatcgataaggactttctccaaggtatctgtctgactcctgattgtgagggtgttatctccaaaatcatcatcttctcctccgggggtgaagttaagtgtgaattcgagcacaaagtgattaaggagaaggttcctcccagaccgattttaaaacagaagtgttcgtcactggaaaagctgcggctgaaggaggataagaaactgaaaagaaagatccagaagaaagaggctaaaaagctcgcccaggaaagaatggaagaggaccttcgagagtccaaccctccgaaaaacgaggaacaaaaggaaactgttgataacgtgcagaggtgccagttcttggacgacaggattctgcagtgcatcaagcagtacgctgataaaattaaaagcggaatccagaatactgccatgctcctcaaagaactgctgtcgtggaaagtgttgtcaacggaggattacactacatgcttcagctcgcgaaatttcctcaacgaagcagtcgactacgtgatcagacacttaattcaagaaaacaacagagtaaagaccagaatcttcctgcacgttctgagcgagctcaaggaagttgagcctaagctggctgcctggattcagaaactgaacagctttgggctggacgccaccggtaccttcttctcgagatacggcgcatcgctgaagcttcttgatttctcaatcatgacattcctgtggaacgaaaagtacggccataagctggactctatagaaggaaaacaactggattactttagtgaacctgcatcattaaaggaggcaagatgcctaatctggctcctggaggaacacagggataaatttcccgctctccattcggcactggacgagttttttgacatcatggattcaagatgtactgttctgcggaagcaggactctggcgaggctcccttctccagcacaaaggtcaagaacaagtccaagaagaagaagcccaaggactctaagcctatgctcgtggggtcgggcaccacaagtgtcacaagtaacaatgagatcatcacttcttctgaggatcattcaaatcgtaactctgacagcgctggcccttttgctgttcctgatcaccttcggcaagatgtggaagagttcgaagcactgtacgaccagcactccaatgaatatgttgtccggaataaaaagctctgggatatgaacccaaagcagaagtgttccaccttgtatgattacttctctcaattcttggaggagcacggccctcttgacatgagcaataagatgtttagtgctgagtatgagttctttcccgaagagacccgccagatacttgagaaggcaggcggactgaagcccttcctcctgggatgcccaagatttgtggtgattgacaattgcatcgcgctgaagaaggttgcctccagattgaaaaaaaaaagaaaaaaaaagaatatcaaaaccaaggtggaagaaatttctaaggccggtgaatatgtgcgcgtgaagctccaattgaaccccgcagccagagagttcaaaccagacgtcaagtcgaaacccgtgtctgattcgtccagtgcccctgcattcgagaacgtgaagcctaagccagtctctgctaattcaccaaaacccgcatgcgaggatgtgaaggctaagcccgtcagcgataattcctcacggcaggtgagcgaggacgggcaacccaaaggagtgtcttctaactcgcccaagccagggagcgaggatgctaactataagagagtgtcctgcaactcccccaaacctgttctggaagacgttaagccgacctactgggcacaaagccatctggtgacgggatattgcacatatctgcctttccagcgcttcgatatcacacagactccccctgcctacattaacgtcctgccgggactgccccaatatacatccatctatacccctttggctagcctcagcccggaatatcagctcccccgaagcgtccccgtggtcccatcatttgtcgccaatgatcgtgcagataaaaatgctgctgcctacttcgaaggtcaccatctgaatgctgagaatgttgccggtcaccagatagcctccgagacccagattctggaaggttctctcggcatttctgtcaagtcacattgcagcaccggggacgcccataccgtcctatcagaaagcaacagaaacgatgaacactgcgggaattccaacaacaagtgcgaagtgattcctgagagcacgtctgcggtcactaatatcccacatgtccagatggtggccattcaggtctcctggaacatcattcaccaggaggtcaataccgagccatacaatccattcgaggaacgccagggggaaatatcaaggatcgaaaaagaacatcaggtcctgcaggatcagcttcaagaagtgtatgagaactacgagcagattaaactaaaaggactggaggagacacgggacttagaggagaaactgaagcgtcatcttgaggaaaataagattagtaaaaccgagcttgattggtttctccaggatctggaaagggagatcaagaaatggcagcaggagaagaaggagattcaggagagactcaaatctctgaagaaaaaaatcaaaaaagtgagcaatgcgtctgagatgtatacacagaaaaacgatggaaaagagaaagagcacgagctgcacctcgatcagtccctggaaattagcaataccctaactaacgaaaagatgaagattgaggagtatataaagaaaggcaaggaggactacgaggagagccaccagagggcggtggcagcagaagtgagcgtgctggaaaactggaaagagagcgaggtgtataagttgcagatcatggaaagccaggcggaagcatttctgaagaaacttggcctgatcagtcgcgaccccgctgcgtaccccgatatggagtcagacatccggagctgggaattgtttcttagcaacgtgacgaaggagatagaaaaagctaagagtcagttcgaggagcagattaaggccataaagaatggttcacggctgtccgagctgagcaaggtccagatctctgagctcagcttccctgcttgtaatacagtccaccccgagctgttacccgagagctccggcgacgacggtcagggactggtcacaagcgcatcggacgtgactggaaaccacgctgctttgcaccgtgatccttctgtcttctcagcaggcgattctcccggagaagcaccgagcgccctcctgcccggaccgcctcctggtcagccagaggctacacagctgactggtccaaagcgtgccggtcaggcagcgcttagtgaacgtagcccagtggcggatagaaagcaacctgtgcctcccggaagagctgctcgttccagccagtccccaaagaagcccttcaacagcatcattgaacatctgtcagtcgtctttccctgttataattccacagagcttgcgggattcatcaaaaaggtgaggagtaagaataagaactccctatccgggctatctattgatgagattgttcagcgcgtcacagagcacatcctggacgaacagaaaaagaaaaaaccaaaccccggtaaggataaaaggacctacgaaccatctagcgccaccccagtgacgagatcgagccagggtagtcctagcgtcgttgtggctccgtcacccaagaccaaagggcagaaggctgaagacgtgcctgttaggattgcccttggcgcaagctcatgcgaaatctgccacgaggtgttcaaaagcaagaatgtgcgagtactgaaatgtgggcacaagtaccacaagggctgtttcaaacagtggttgaaaggacagagcgcatgcccggcttgtcagggcagagatctactcacggaggaaagtcccagtggtcggggttggcctagccagaatcaggagttaccttcctgcagctcgagata

SEQ ID NO: 243869 - DNA, 3540 bp, Artificial Sequence
  Description of Artificial Sequence: Synthetic coding sequence
atggataactttgccgaaggtgatttcacagtggcagattacgccctcctggaagattgtccacatgttgacgactgcgtatttgctgcagaatttatgtccaatgattacgtgagagttacacaactctactgtgacggcgtcggtgtgcagtacaaggactacatccagagtgagcgcaatttagaattcgacatatgctctatctggtgttcgaagcctatctctgtcctgcaggactattgcgatgcaataaagatcaacatcttctggccactgttgtttcaacaccaaaacagttcggtcatcagccggcttcacccatgcgtggacgcgaataactctcgcgcttcagagatcaacctcaagaagctgcaacacctggagttgatggaggatatagtggacctggcgaagaaggtcgccaacgacagcttccttattgggggactcctaagaattgggtgtaagattgagaataagatattggccatggaagaagccctcaattggatcaaatatgccggtgatgtgaccattcttaccaagttagggagcattgacaactgctggccaatgctcagcatcttcttcacagaatacaagtatcacattactaaaattgtgatggaggattgcaacttgctggaagaactgaagacccagagttgcatggactgcatcgaggagggcgagttgatgaagatgaagggtaatgaggagtttagcaaagagagatttgatattgccataatctattacacaagagcgatcgagtatagaccagagaactaccttctgtacgggaatcgtgccctgtgtttcttgcgtacggggcagtttagaaatgccctcggagatggaaaacgcgcaacgattctgaagaatacctggccgaagggccattaccgctattgcgacgctttatctatgttgggcgagtatgattgggcactacaagctaacatcaaagcacagaagctatgcaagaacgatcccgaagggatcaaagatctaatccaacagcacgttaaactgcaaaagcagattgaggatctgcaggggagaaccgcgaacaaagaccccattaaggctttttacgagaaccgtgcatacacgcctcggtctctgagcgcaccgatatttactacatctctcaattttgttgagaaggagagagacttcaggaagatcaaccacgaaatggccaatggcggaaaccagaacctgaaagttgcagacgaggccctgaaggtcgacgattgtgactgccatccggaattcagccctcccagttctcagccaccgaagcataaaggcaagcaaaaaagccgaaacaatgaatccgagaaattttcttcttcatcccctcttactctacccgctgacctcaagaatattcttgaaaagcagttctctaagagtagcagagccgcacaccaggactttgccaacattatgaaaatgctgcgcagcctgatccaggacggatatatggccttactcgagcagcggtgtcgttcggcagcccaggctttcaccgaactcctgaacggcctggatccacagaagattaaacagttgaacttagctatgatcaactatgtgctggtggtttacggtcttgcaattagtctgctcggtatcggccagccagaggagctgtctgaagcggagaatcagtttaaacggatcatagagcactacccatctgaaggtcttgactgtctggcttactgtgggatcgggaaggtttatttgaagaaaaaccgcttcctggaggcactgaatcacttcgaaaaggccagaacgctgatctatcgcctgcccggagtgctcacatggcccacaagtaatgttatcattgaagagtcccagccgcagaagatcaaaatgctactggaaaagttcgtggaggaatgtaaatttccacccgtgcccgacgctatatgctgctatcagaagtgtcacgggtacagcaagattcagatctatataactgatcctgatttcaagggctttatccggatttcctgctgtcaatattgtaaaatagaatttcacatgaattgctggaagaaactaaaaacaaccacctttaacgacaaaatcgataaggattttcttcaggggatctgcctcacgcccgactgcgagggagtcattagcaagattatcatattttcctctggtggcgaggtgaaatgcgaattcgagcacaaagtgatcaaagagaaggtacctccgaggcccatacttaagcagaaatgctcgtctctcgaaaaacttcgacttaaggaggataaaaagctaaagcgcaagatccagaaaaaggaagctaaaaagctggcacaggagcggatggaagaggatctgagggagtccaatccgcctaagaatgaggagcaaaaggagaccgtggataatgttcagaggtgtcagttcctcgatgatcggattttgcagtgcattaaacagtacgctgacaaaatcaagagcggtatacagaacactgccatgctccttaaagaactgttgtcatggaaagtcctctctacagaggattatactacctgctttagttctcggaactttttaaatgaggccgtggattacgtgatcagacatttgatacaagagaacaatcgagtgaagacccggattttcctgcacgttctgtccgagttaaaggaggtcgagcctaaattagcggcatggattcagaagttgaattccttcggcctggacgccacgggtacattttttagtagatatggcgctagcctcaaactgctcgacttctcaatcatgaccttcctgtggaacgaaaagtatggacataaactggatagcatcgaggggaagcaactggactatttctccgagcctgcttccctgaaggaggctcggtgcctcatctggcttttagaagagcatcgcgataaatttccggcactgcattccgcactggacgaattctttgatataatggactcaagatgtactgtattgcggaagcaggacagtggggaagctccctttagttcaaccaaggtcaaaaacaagtcgaagaaaaaaaaaccaaaagatagtaagcctatgctcgtaggctcggggaccacaagcgtaacatcgaataacgagatcattactagctccgaggaccactccaacagaaatagcgacagtgccggacctttcgctgtgcccgatcacctacgtcaggatgttgaagaattcgaagcactgtacgatcaacactccaatgagtacgtggttaggaacaagaagctttgggacatgaaccctaagcagaaatgctccacactgtatgattacttcagtcagtttctggaggaacatggtccactggacatgtcaaataaaatgttctctgccgaatacgaattcttccctgaagagaccaggcaaatcttagaaaaagctggcggacttaagccattcctgctcggctgtcctcgattcgtcgttattgataattgcatcgctctgaagaaggtggcgtcacgtcttaagtag

SEQ ID NO: 243870 - DNA, 2343 bp, Artificial Sequence
  Description of Artificial Sequence: Synthetic coding sequence
atggataacttcgccgagggggactttaccgtcgctgattacgctctgctggaagactgcccacatgtggatgattgtgtctttgccgcagagttcatgtcgaacgactacgtacgagtgactcagttgtattgcgatggcgttggcgtgcagtataaagattacatccagagtgagcggaacttggagttcgatatttgctcgatctggtgttccaaacccatcagcgtactacaggactactgcgatgcgattaaaataaatatcttctggccacttctttttcagcaccaaaactccagcgttatttctcggctgcatccttgcgtggacgctaacaattcgcgcgcttctgagatcaacctgaagaagttacagcacctcgagctcatggaagatattgtggacctggcaaagaaagttgccaatgactcctttctcatcggaggtttgctgcgcattgggtgtaagattgagaacaaaattttggccatggaagaggcactgaactggattaagtatgcaggcgacgtgaccatcctgacaaagctcggcagtattgacaactgttggccaatgctaagtattttcttcacggagtacaaataccatatcactaaaatcgtgatggaggactgtaatttactggaagaactgaagactcaatcctgcatggactgtattgaggaaggggaactaatgaagatgaagggaaacgaggagttctccaaggaacgctttgacattgcaatcatatactacacccgggcaattgagtaccgcccagaaaattatcttctctacggaaatagagctctgtgctttcttaggacaggccagttcaggaatgcccttggcgatggaaagcgggctactatcctgaaaaacacatggcccaaaggccactataggtattgcgacgctctctcaatgctcggggagtatgattgggccctgcaagctaatataaaagctcaaaaactctgtaaaaatgacccagagggcattaaggatcttatacaacaacatgttaagctgcaaaaacagatagaagatttgcaaggaagaaccgccaacaaggatcctattaaagcattttacgagaacagagcctatacaccgagatctctctcagccccaatctttacgacctccctgaactttgttgaaaaagagagagatttccgcaaaattaaccacgagatggcgaatggcggtaaccagaaccttaaggtcgccgatgaggcgcttaaggttgacgattgcgactgtcaccccgaattctcacctccctcctcacaacctccaaagcataaaggtaagcagaaatcacgcaacaatgagtccgagaaattttcgtcaagcagccccctgactctccctgctgacctgaaaaacatcctggaaaagcagttctcaaaatctagtagagcagcacaccaggatttcgccaacataatgaagatgctgagatctctgatccaggatggatatatggccctacttgaacagagatgtcggtccgccgcacaagccttcaccgaactcctcaatggcctcgacccacaaaagataaaacagctgaaccttgcgatgattaattacgtgctcgtggtgtacggcctcgcaatctcgctgctcgggatcggccagcccgaagagctatctgaagctgagaatcagttcaagaggatcatagaacactatcctagcgagggattggattgtctggcctactgtggtataggcaaagtgtacctgaagaagaaccggttcttggaagccttgaatcactttgaaaaggccagaacccttatctatcgactgcctggagtgctgacctggcccacctcaaacgtgataatcgaagagagtcagccacagaaaattaagatgctccttgaaaagttcgttgaggaatgcaagtttcctcccgtgccagacgctatttgttgctatcagaagtgccacggatacagcaagattcagatctatatcactgatccagactttaaaggatttattcggatcagctgctgtcagtactgcaagatagaatttcatatgaactgttggaagaagcttaagacaaccacctttaacgataagatagataaagacttcttgcagggaatctgtcttacccctgactgtgaaggggtcatatccaagataataattttcagtagcgggggagaagtgaaatgcgagtttgaacacaaggtaatcaaggagaaagtgccgccacgcccaattctaaagcagaaatgcagtagcctggagaagttgaggctgaaggaggacaagaaactcaagcggaaaattcagaagaaagaagcctag

SEQ ID NO: 243871 - DNA, 1839 bp, Artificial Sequence
  Description of Artificial Sequence: Synthetic coding sequence
atgctgggcgagtacgactgggccttgcaggccaatattaaagcccagaagctgtgtaaaaatgacccggaaggaatcaaggacctgattcagcagcacgtcaagcttcagaaacaaatcgaagatctgcaggggagaacagccaataaagatcctattaaagccttttatgagaatagagcgtacactcctagatctttgtcagcaccaatcttcacaacctctctcaattttgtcgagaaggagcgcgactttcgaaagattaaccacgagatggccaacggcggaaatcaaaacctcaaagtggcagatgaagcactgaaggtggatgattgcgattgccatcccgagttctccccaccgagctctcagccccctaagcataagggcaagcaaaaaagtagaaataacgaatcggagaagtttagctccagttccccactgaccctgccggctgatctgaagaatatactcgaaaaacagtttagcaagtcctctagggccgcacaccaggactttgctaacattatgaagatgttgcggtcactgattcaggatggatatatggccctgctagagcagcgatgtagatcagcggctcaggctttcacggagctgcttaatggcctggacccacaaaaaatcaagcagttgaatcttgctatgattaattacgtgctagtggtgtatggccttgctattagtttactgggtattggacaacctgaagaactctcagaagccgaaaatcaatttaagaggattatcgagcactatccatccgagggccttgattgccttgcctattgcgggatcggcaaggtgtatctcaaaaaaaatcgcttcttagaagcactgaaccacttcgaaaaggcaagaactctcatctataggttacctggggtacttacgtggccaaccagcaacgttattattgaggagagccagccccagaagatcaagatgctgcttgagaagttcgtcgaagaatgcaagttccctcctgtcccagatgcgatttgttgttatcagaagtgtcatggatactctaagatacaaatctacatcactgatccagactttaagggctttattcgcataagctgctgtcagtattgcaaaattgaatttcacatgaactgctggaagaaactgaaaactactacctttaatgataagattgataaggacttcctgcaaggcatttgcctaactccagactgtgagggcgttattagtaagatcattatattctcttccgggggtgaggtgaagtgtgaattcgagcacaaagttattaaagaaaaggtgcccccacgccctatcctcaaacagaaatgctcaagcctcgagaaacttcgactcaaggaagacaaaaagctaaagagaaagattcagaagaaggaggctaaaaaactcgctcaggagcgcatggaggaggatcttcgcgaatccaatcctccaaagaacgaagaacaaaaggagaccgtcgataatgtacagcgctgtcagtttctggacgacagaattttgcagtgtattaagcagtatgcagataaaatcaaaagcggaatacagaatacggcaatgctgctgaaggaactgctctcttggaaggtgttatctacagaggactacaccacatgcttttcgtccagaaactttcttaacgaagctgtggactacgtaatcaggcatctgatacaggaaaacaacagggtgaagactcggattttcctgcatgtgctgtctgaactcaaagaagtggagcccaaactcgcagcttggatacagaagttaaacagcttcggcatgagtctttacatccctgagcagtag

SEQ ID NO: 243872 - DNA, 1842 bp, Artificial Sequence
  Description of Artificial Sequence: Synthetic coding sequence
atggatgccgtcctggcatgcagacttcgcggtagaggaaaccgcgtggcggctttacgccctcgtccaagacctggaggcagcgcgggaccgtcaccctttgccctcctctgcgctggcctctcacctgaacccagagctggagttggaagtgagtttcccgcttggtttctggggggaagcagccagcgccgaaatatggcccttctgggctcccgcgctgagcttgaggccgacgaggacgtgttcgaggacgccttggaaaccatctccatggctaaagagagcatgtatcatgccctggggtacagcacaattgttgtgctccaagccgtgttgacctttgagcaacaggacattcagaatggaatttctgctatgaaggacgcactgcagacatgccagaagtaccggaagaagtatacagtagtagaatccttttcatcattactgtcacgaggaagcctggagcaactcagcgaggaagagatgcacgccgaaatctgctacgcagagtgtcttctgcaaaaagcggcattaacattcgtccaggacgagaatatgattaattttatcaaaggaggcctcaaaatacgcactagctatcagatttacaaggagtgcctgagtatcctgcatgagatccaaaaaaataagctgcagcaggagtttttttatgagtttgaggggggagtgaaactggggtctggagccttcaaccttatgctctcactgctcccagccaggatcattaggctactcgagttcattggcttctctggaaatagagagcttggtttattacaattaagggagggcgctagtggaagatcgatgcgctccgccttatgttgcctgactatcctggccttccatacttatatatctttaatcctgggaaccggagaggtaaatgtcgcggaagccgaacgtctcttggctccgtttctgcagcagtttccaaatgggtcccttgtcctgttttatcacgccaggattgagctgctcaaggggaatcttgaggaggctcaggaagttttccagaaatgcattagtgtccaggaggagtggaagcaatttcaccatctgtgctattgggaactgatgtggatcaacgtatttcagcagaattggatgcaggcttactactactcagaccttctctgtaaggagtcaaaatggtctaaggctacctatgtgtttctcaaagccgctatattgtccatgctgcctgaggaggacgttgtggctactaacgagaatgtggttaccctgtttcgtcaggtcgattccctgaaacagcggatcgcaggtaaatcgatccctaccgaaaagtttgctgtgcggaaagcgagaaggtactctgcttctctgcccgcacccgtgaagctgatcttaccggctctggaaatgatgtatgtctggaacggatttagcattgttagcaagcgcaaagatctctccgagaatctccttgtgacagtagagaaggctgaggcagccctacaatctcagaactttaatagtttctccgtggacgatgaatgtctggtgaaattactgaaaggctgttgcttgaagaacttgcagaggcccctgcaagccgaactctgctacaaccatgtagtcgagtctgagaagctgctgaagtatgatcattacctagtcccttttacactcttcgagcttgcttcactatacaaatcccagggtgagattgataaagccatcaaattcctggaaactgctcgaaataactacaaggactatagtctagagtcacgactgcacttccgtattcaggcagccttgcacttatggcggaaaccaagcagcgattag

SEQ ID NO: 243873 - DNA, 1851 bp, Artificial Sequence
  Description of Artificial Sequence: Synthetic coding sequence
atggcacttctgggatctcgcgctgagctggaagccgatgaagatgtgttcgaggatgcgcttgagaccatcagtatctcatcgcattccgacatggccactagctccctgcattttgcgtcatgtgacacccagcaagcacctcggcagcgaggggcttctaccgtgtcttcgagtagcagtactaaggtggacctgaagagcggcttggaggagtgtgcagtggctttgaatttgtttctcagtaacaagtttacagatgctctggagctcttgcgcccatgggcaaaggaatcaatgtaccatgcacttggctactccacaatagtggtgctgcaggccgtgctcactttcgaacaacaagatattcagaacggaatctctgccatgaaagacgctctccaaacatgtcagaagtacaggaagaagtacaccgttgtcgagagtttctctagcctcctctctcggggaagcctggagcagctctccgaggaagagatgcatgccgagatttgttacgccgaatgtctgctccagaaggcagcccttacgtttgtccaggatgagaacatgattaatttcatcaaaggaggtctgaaaatacgaacttcttaccaaatttacaaggagtgcttgtccatcttgcacgagatacaaaagaataagctacagcaagaatttttctatgagtttgaaggaggagtcaagctgggcagtggcgcattcaacctaatgttgtccctcctgcccgcaaggatcattagattgctggagtttatcggattctctggtaaccgagaactgggactgctgcagcttagagaaggggcatcaggacgaagcatgaggagcgctttatgctgtcttaccattttggccttccatacttatatatcgttgattctgggaactggcgaggtcaatgtggccgaggcagaaaggctcctcgctccctttctacagcagttccctaacgggtctcttgttctcttctaccatgcaagaatcgagctcctgaaaggcaaccttgaggaagcgcaagaagtctttcaaaaatgcattagcgttcaggaggagtggaaacaatttcatcacctgtgttactgggagttaatgtggatcaacgtatttcagcagaactggatgcaggcatattattactcagatttactgtgcaaggagagcaagtggtccaaggcgacttacgttttcctgaaggccgcaatcttgtccatgctgcccgaggaagatgttgtggccaccaatgagaacgttgtcactctttttaggcaggtagacagtctcaagcaaagaatcgccggtaagtctatcccaacggaaaaattcgcagtcaggaaggcacgcaggtattcagcctccctgccagctccagttaagcttattctcccagctttagagatgatgtatgtgtggaatggattttctatcgtgagcaaaagaaaggaccttagtgagaacctgctagttaccgtggaaaaggcagaagcggctctgcagtctcagaattttaactctttctcagtggatgacgaatgcttggttaaattattgaaaggatgctgtcttaagaatctgcagcggccactccaagctgaattatgctataaccacgtcgtggaaagcgaaaagctgctgaaatatgaccattatctggtgcctttcacactgttcgaactcgcaagcctatacaaatcgcagggagagatagataaggccattaaattcctagagaccgccaggaacaattataaggactactccctggagtcaagactccactttcgaatccaggccgctttgcacttgtggcggaagccctcctctgattag

SEQ ID NO: 243874 - DNA, 2010 bp, Artificial Sequence
  Description of Artificial Sequence: Synthetic coding sequence
atggatgctgtcctggcttgtcgcttgagaggcaggggcaaccgcgtggcagctctacgcccacgtccccgacccggagggtcggcgggacctagtccattcgccctgctgtgtgcaggactgtcgcccgaacccagggcaggggtagggtctgaatttccagcctggtttttgggcggaagtagtcaacgcagaaatatggctttgcttgggagcagagctgagctagaagcagatgaagacgtgtttgaggacgctctggaaacgataagcatttcctcccattcagatatggccaccagctccctgcacttcgcctcttgtgacacgcagcaggcccctcggcagcgcggagcgagtactgtaagtagctcatcttccaccaaagtcgatctcaaatccgggctcgaggaatgcgcagtagctttaaacttgtttctatcaaataaattcactgacgcattggagctgttgaggccctgggcaaaagaatcaatgtaccacgctctggggtactccactatagtggtgctccaggcagtcttgaccttcgagcagcaggacattcaaaatggtatcagtgctatgaaagatgctctccagacctgccaaaagtaccggaagaaatatacagtggtggagtcattctcctctttactgagtcggggatccctggagcaactgagcgaggaagagatgcatgctgaaatctgctatgcagaatgcctgctacaaaaggcggctctgacatttgtccaagacgagaacatgataaatttcatcaaagggggactgaagataaggacgtcttaccagatctacaaagagtgtctatcgatcctgcacgaaatacagaaaaacaagctgcagcaggaattcttctacgaattcgaggggggagtgaaactcggcagcggggcattcaatcttatgttatccttgctgcctgctagaatcatccgacttctcgagttcatcggttttagtggaaacagggagctgggcctcctacaactgagggagggggcatctggtcgttctatgcgcagcgccctctgttgccttactattttagccttccatacatatatctcactcatattaggcaccggcgaggtgaatgtggctgaggccgaacgcctcctggccccatttttgcaacagttccctaacgtgaggtcagttttccaatctgctcaggaagtattccaaaaatgtattagcgtgcaggaagagtggaaacagttccaccacctgtgctattgggagctgatgtggattaatgttttccagcagaactggatgcaggcctactattattccgacctgttgtgtaaggagagcaagtggtctaaggccacctatgtttttctgaaagctgccattctaagtatgcttccagaggaggatgtcgtcgcaacaaacgaaaacgtcgtgactttgttccgacaggtggacagcctgaaacagcgaatcgccggtaagtcaattccgacagagaaattcgccgtccggaaggcgaggcgttacagcgcatcgctgccagcacccgttaaactcatccttcctgctttggagatgatgtacgtgtggaacggattctcgatcgtatcaaaacggaaggacctgagtgaaaatttactggtgaccgtagaaaaggccgaagctgcgttgcagtcacagaattttaattctttctcggttgatgatgaatgtctggtgaagcttctaaaaggctgctgcctgaaaaatctgcagagacctctccaggccgagctttgctacaaccacgtggttgaatccgaaaagctacttaagtacgatcactatcttgtgcctttcactttatttgaactggctagcctttataagtctcaaggcgaaattgacaaggccatcaaatttttggagacggcccgaaataattacaaagattacagtctagaatcccgattgcacttccggattcaggctgcccttcacctctggcgaaagccgtcatctgactag

SEQ ID NO: 243875 - DNA, 2049 bp, Artificial Sequence
  Description of Artificial Sequence: Synthetic coding sequence
atggacgccgttctcgcatgccgcttgcgaggtcgcggaaacagagtggcggcactcagacctcggccacgacctggcggaagcgcaggcccatcgcctttcgcgttactgtgcgccggtctttctcccgaacccagagctggcgtgggcagcgagttccctgcatggtttttgggcggaagctcgcagaggcggaacatggccctgctgggcagccgggctgagctcgaggctgacgaggacgtttttgaagatgccctcgagactatatctattagtagtcactctgacatggctacctctagcctgcacttcgcctcctgcgacacacagcaggcccctcggcagcggggtgcctccacagtttcgagctcaagctcgacaaaggtggacttgaagagcgggctggaagagtgtgccgtggcgctaaacctcttcttatctaataagttcacggacgcgctggaactgcttagaccctgggccaaagagtcaatgtatcatgcccttgggtactcaacgatcgtcgtgcttcaggccgtgttgacattcgaacaacaggatattcagaatggcatcagcgccatgaaggacgctctacaaacctgccaaaaatatcgcaagaaatacactgtggtcgaaagctttagctcacttctgtccagaggatccctcgagcagctctcagaggaggaaatgcatgccgagatctgctacgcagagtgcctccttcaaaaggcggcacttactttcgtgcaagacgaaaacatgataaatttcattaagggagggctaaagatcagaacctcatatcaaatttacaaggaatgcctttcaatattacacgaaattcagaagaataagctgcagcaggaatttttctatgaattcgagggaggggtaaaactcggcagcggagcttttaatctgatgctctctctgctgcctgccaggatcattcggcttctggagttcatcggctttagtgggaacagggagctgggcctgctgcagttgagggaaggagctagtgggcgtagcatgcgtagtgcactgtgctgtctgaccattttggcgttccacacttacattagcctgattctgggtactggagaagtgaacgtggccgaggctgagcgactgctggcaccattcctgcagcagtttccaaatggctctctcgttttgttttaccacgctaggatagaactccttaagggcaacctggaggaggcacaagaagtgttccagaaatgcatttcagtgcaggaggaatggaagcagtttcaccacctctgctattgggagctgatgtggatcaacgtgttccagcagaattggatgcaggcctactactattcggatctcctgtgcaaggagtcaaagtggtccaaggcaacgtacgtgttcctgaaggccgctattctgtcgatgctgcccgaggaggacgtggtggccacaaatgaaaacgttgttacccttttcagacaagttgattcattgaagcagaggatagcaggtaagtcgatccccaccgaaaaatttgcagtgcggaaggcgaggcgctactcagcttctctcccggcaccagtgaagcttatactgcccgcactggaaatgatgtatgtgtggaatggcttctccatagtcagtaagcggaaggatctgagtgaaaacctgctcgtgacggtcgaaaaagccgaagcagctttacagtcacaaaatttcaacagctttagcgtcgatgatgaatgcctggtcaagctgctaaaagggtgctgtctgaagaacctgcagaggcctctgcaggctgagctgtgttacaaccacgttgtggaatcagaaaagctgttgaaatacgatcattaccttgttcccttcacactcttcgaacttgcatccctgtataaatcccagggcgaaatcgataaagcgattaaatttctcgagaccgccagaaacaactataaagattattctctcgagtccaggctccattttaggatccaggcagcgctgcacctgtggcggaaaccttccagcgactag

SEQ ID NO: 243876 - DNA, 585 bp, Artificial Sequence
  Description of Artificial Sequence: Synthetic coding sequence
atggccttactggggagcagagcagagctcgaagccgacgaagacgtcttcgaggatgcactcgagacaatcagtatctcctcacattccgacatggcgacttcttccttgcattttgccagttgcgacactcagcaagctccacggcaacgcggagccagcaccgtatcttcgagctccagcacaaaggtagacctcaaaagcgggctggaggagtgcgcagtggcgttgaatctgtttctgagtaataagtttactgatgctttggagctcttgagaccatgggctaaagagtcgatgtaccacgcgctcgggtactccacaattgtcgtattgcaagcggtgttaactttcgagcagcaagacatccaaaatggaataagtgctatgaaagacgctctccagacatgtcagaaatatcgcaaaaagtacacagttgtcgaatcctttagctctcttctaagcaggggcagcctggagcagctgtcagaggaggagatgcatgcggagatttgctacgctgagtgcctgttacagaaggccgctcttaccttcgttcagagaatgtcattctaccccgcatag

SEQ ID NO: 243877 - DNA, 1164 bp, Artificial Sequence
  Description of Artificial Sequence: Synthetic coding sequence
atggagcagccaggacaggaccccaccagtgatgatgtaatggacagcttccttgagaagtttcagtctcagccatatcggggaggtttccacgaagaccagtgggaaaaagagtttgagaaggtgcccctctttatgagtcgcgctccttctgaaatcgacccccgtgaaaaccccgaccttgcatgcttgcagtctattatcttcgacgaagagaggtcccctgaggaacaagccaagacctacaaggacgagggcaatgattattttaaggaaaaagattacaaaaaggccgtgatatcctacactgagggactgaaaaaaaaatgtgccgaccccgacctgaatgcagtgctatacacgaaccgcgctgctgcgcagtattatctgggaaattttcgaagcgcacttaacgatgttaccgccgcacgaaagctgaagccatgccacctgaaggcaattattaggggtgcactttgccacctggaactcaagcactttgccgaggccgtgaattggtgcgatgaaggtctacagatagatgcaaaagagaaaaagcttttggagatgagggccaaagcggacaaactgaaaaggatcgagcagcgggatgttagaaaggccaacctaaaggagaaaaaggagaggaatcaaaacgaagccctgctccaggccatcaaagcccgaaacattcggctcagcgaggcagcctgcgaagatgaagacagcgctagcgaagggctgggtgagctgtttctggatgggctgagcaccgaaaacccacacggcgctcggttgtctcttgacggccagggaagactgtcctggccagtgttgttcttatatcctgaatacgctcagagtgactttatttctgcttttcatgaagatagcaggttcattgatcacttgatggtgatgtttggcgagaccccaagctgggacctcgagcagaagtattgccctgacaacttagaggtctacttcgaggacgaagaccgtgctgagctgtaccgcgttcctgctaagagcaccctgctccaggtgcttcagcatcagaggtatttcgtcaaggccctgacaccggcatttttagtctgtgtcggaagttcccccttttgcaaaaatttcctgaggggcaggaaggtctatcaaataagatag

SEQ ID NO: 243878 - DNA, 1515 bp, Artificial Sequence
  Description of Artificial Sequence: Synthetic coding sequence
atggccacgagagatgtggtcctgtcaagagtccccgaacaggaggaagaccgcacagtttcactgcaaaacgctgctgcaatctatgacctgctttcaattacactgggacgtagaggccagtacgtaatgttgagcgagtgcttagaaagggccatgaagtttgccttcggggagttccatctctggtaccaggtcgcactgagcatggtagcctgtggaaagtccgcctacgctgtctctcttctgcgggagtgcgtgaagctacgtcccagtgatccaaccgttccgctgatggctgctaaggtgtgtattggttccttgaggtggttagaggaggcggagcacttcgccatgatggttatctcgctaggtgaagaggccggagagttcctccccaaagggtacctcgccctgggcctgacctattctttacaggcgacagacgccacactgaaatcaaaacaggacgagctgcatcggaaggctctccagaccctggagagggctcaacagctggccccttcagacccccaggtaatcctctacgtatcactgcagctcgcactggtgagacagatctcaagcgcgatggagcagctacaagaggccctgaaagtgagaaaagacgacgctcacgcgctgcatttgctagccctgctgttctccgcccagaagcatcaccagcatgccctagacgtggtcaacatggccattactgagcaccccgagaatttcaacctcatgtttactaaggtcaagctggagcaagtcctgaagggcccagaagaagcactggttacatgccggcaggtacttcggctctggcagaccctttattcattttcacaactaggcggactggagaaggatggaagcttcggtgaagggctgactatgaaaaaacaaagtggcatgcatctgaccctacctgatgctcacgacgccgacagtggttctcgcagagcttcctctattgctgcgagccgcttggaagaggccatgagcgagttgacaatgccttcctccgtcctcaagcagggcccaatgcaactgtggacgactctcgaacagatctggctgcaagctgctgaactttttatggagcagcagcacctcaaggaggccggattctgtattcaagaagccgctggcttatttcctacctcgcacagcgtcctatatatgcgaggaaggttagccgaggtgaaaggcaatctggaagaagccaaacaactgtataaagaggctctgactgtgaatcccgatggcgttcgcatcatgcacagcctcggcctgatgctcagcaggctaggacacaaatccctcgcgcaaaaggtcctacgcgatgccgttgagcgacagagcacctgtcatgaagcctggcagggcctgggagaagtgctgcaggcgcagggccaaaacgaagctgccgtcgactgtttcctcaccgcactcgagcttgaggcaagtagtccagtgctgcctttcagcattatccctcgtgaactgtag

SEQ ID NO: 243879 - DNA, 2577 bp, Artificial Sequence
  Description of Artificial Sequence: Synthetic coding sequence
atggctgccaaaggagctcacggttcatatctcaaagtggagtcagaactggagagatgtagagcagagggtcactgggaccgcatgccagaacttgtgcgccagttgcagactcttagcatgcccggtggcggtgggaacaggagaggcagcccgagcgctgcattcactttccctgacaccgacgattttggcaaactcttacttgccgaggccctgctagagcagtgtctgaaggagaatcatgccaagataaaagattctatgccgttgctcgaaaaaaacgagccgaagatgtccgaggcgaaaaactaccttagctccatcttgaatcatggcagactaagcccacagtacatgtgtgaagccatgttgattctcggtaagttgcattatgtggagggatcgtaccgggacgcgataagtatgtatgctagagcagggattgacgatatgtcaatggagaataagccgctgtatcagatgcggttgctttccgaggcctttgtgatcaagggactgtcacttgaacgacttccaaacagcattgcctccagattccgtctgacggagcgggaggaggaagtgattacctgcttcgagcgcgcatcctggatcgcgcaggtttttctccaggaattggagaagaccacaaataactctaccagcaggcacctgaagggatgtcaccctcttgactacgaactgacatacttcctcgaggcagcgttgcagtccgcctacgtgaagaacctgaaaaagggaaacattgtaaagggcatgcgagaactccgggaagtactgaggacagtcgagacgaaagcaacccagaacttcaaggtgatggccgctaagcacctggccggagttttgctgcatagcctctccgaggagtgttactggagcccgctatctcatccccttccagagtttatgggaaaggaagagtcttcctttgccacccaggcactacgcaaacctcacctgtatgaaggggacaacctctattgcccaaaagacaacattgaggaggcactgcttctcctcctgatttccgaatctatggccacgcgcgacgtagttctgagtcgagttcccgaacaggaggaggatagaacagtcagcctccagaacgcggctgctatttatgacctgctgagtataacgctcgggaggcggggtcagtacgtgatgctctccgagtgtctagagagagccatgaagttcgcatttggagagttccatctgtggtatcaggttgctcttagcatggtggcatgcggcaagtcagcttatgcagtgtctctactccgcgagtgcgtgaaactgcggcctagcgaccccacagtgcccttgatggcagccaaggtgtgcataggttcccttcgttggttggaggaagctgagcacttcgcaatgatggttatctcactgggggaagaagctggcgaattcctgcctaaaggctaccttgccctggggctcacatatagcttgcaggcgacagatgcaacccttaagtcaaaacaggatgaactccatcgcaaagctctccagacacttgagagggcccagcagctggccccatccgatccccaagtgatcctctatgtaagtcttcagctcgctctcgttagacagattagctcggccatggagcagcttcaggaggcactcaaagtccggaaagacgacgcacacgccctccacctcctggcgctgctcttttccgctcagaaacaccaccagcatgctctcgatgtggttaacatggccatcaccgagcaccctgagaacttcaatctgatgtttacaaaagtaaagctcgagcaagtgttgaaagggccagaggaagcgctggttacatgcagacaggtattgcgcctctggcagacgctttactcattctcacagctgggcggactcgagaaagacggttcgtttggcgagggcctcaccatgaagaagcagtccggcatgcatttaactttgcctgacgcccatgatgccgatagcggttctcgccgagcttcctcaatcgccgctagccgcctggaagaggctatgagcgagctcaccatgccctcctccgtactcaagcagggcccaatgcagctgtggactaccctggaacagatctggctgcaagccgctgagctgtttatggagcagcaacacctcaaagaggcgggattttgcattcaggaagcggcaggccttttcccaacaagccactccgtgctgtatatgaggggacgccttgccgaagtaaaagggaatctggaagaggccaaacaactctataaagaagcattgactgttaacccagacggggtgaggataatgcatagcctcggcctaatgctgtccaggttaggccacaagagtcttgcacagaaggtgctgcgagatgccgtggaacgccagagtacatgccatgaagcttggcagggtttgggggaggtgctccaggcccaaggacagaacgaggctgccgtcgactgcttcctaaccgccctcgagctggaagcctctagccctgtgctcccattctccattatcccccgagaactgtag

SEQ ID NO: 243880 - DNA, 2058 bp, Artificial Sequence
  Description of Artificial Sequence: Synthetic coding sequence
aaaaaaaagatcaatttcttcaaaaagccccacagcctgtccttaagaaagaaacgcgaagaggaggtgattacgtgctttgagcgcgctagttggatcgcccaggtttttttacaagaactggagaagacgaccaacaattctacgagccgtcacttgaaagggtgtcatcccctcgattatgaactgacctatttcctggaagccgctctacaatcagcatacgtgaagaatctaaagaaggggaacattgttaagggaatgagagaactccgcgaagtcctacgcacggtagaaaccaaagccactcagaatttcaaagtcatggcggcaaaacacttagccggagtcctgctccattccctgagcgaggagtgctactggagtccgcttagccacccattgccagagtttatgggtaaggaggaaagttccttcgccacacaggcacttcgaaagcctcacctttacgagggtgataatctctattgcccaaaggacaacattgaggaagcactcttactcctgcttatttctgagtcaatggccacccgggatgttgtgttaagccgggtacctgaacaggaggaagacaggacagtgagtcttcaaaatgccgctgcaatctacgatttgctgtcgatcaccctcggtaggcgtggtcagtatgttatgttgtcagaatgtctggagcgagcaatgaagtttgcattcggcgagtttcatttatggtaccaagtggctctcagcatggtggcctgtggcaaatctgcgtatgccgtaagcttgctcagagagtgtgtgaagttgaggcctagtgatccgactgttccgctgatggcagctaaagtgtgcattgggagcctgcgctggcttgaggaggcggagcactttgcgatgatggtgatctctcttggcgaagaagctggagagttcctgccaaaggggtacctcgccttgggcctcacctatagcttgcaggctactgacgccaccctgaagtctaagcaggatgagttgcacaggaaagcccttcagactcttgaacgtgcccagcagcttgccccatcggacccgcaggtgatcttatacgtgagcctgcaactggccctggttcgccagatttccagtgcgatggaacagctgcaggaggcgctcaaagtccgaaaggatgatgcacacgccctgcacctcctggccctgctcttttcagctcaaaagcaccatcagcacgccctggatgtggtgaatatggctatcactgagcatcccgaaaatttcaaccttatgtttaccaaggtaaagctggagcaagtgttaaagggtcctgaggaagccctggtgacctgtagacaggtgctccggctgtggcagacactttattccttctcacagctggggggactcgaaaaagatggtagctttggtgaaggactgactatgaaaaagcagagcggcatgcacctcacgctccctgatgcacatgacgctgactcgggctccagacgggctagctcaatcgccgcatcaaggcttgaagaggccatgtctgaactcactatgccaagctccgtcctgaaacagggcccaatgcagctgtggacgactttggagcaaatctggctccaagcggctgagttgttcatggaacagcaacacctgaaggaggcaggcttctgcattcaggaagcagcagggctcttcccaacctctcatagcgttctgtatatgaggggtaggcttgccgaggttaagggaaacctggaggaggcaaagcagttgtataaagaggctctgaccgtgaacccggatggagtgcgtatcatgcacagtttaggactgatgctgtcgaggctgggccataagagtctcgctcaaaaagttctgagggacgccgtagaaagacaatccacttgccatgaagcgtggcagggattgggcgaggtcttacaggcccaggggcagaacgaggcagcggtggactgtttcctgacagctttggagcttgaggcgtcttcgcccgtactccctttctctatcattcctcgggaactttag

SEQ ID NO: 243881 - DNA, 441 bp, Artificial Sequence
  Description of Artificial Sequence: Synthetic coding sequence
atggctgccaagggtgcccatggatcctacctgaaagtggagtccgaactggagaggtgtcgagcagaggggcattgggacagaatgcctgagctagtcagacaactccagaccttaagtatgcccggaggcggtggaaataggagaggtagcccctccgctgcgttcaccttccccgacaccgatgattttggcaagctgttgctggcggaagctctgctggagcagtgcctcaaggagaatcacgcaaaaattaaagattctatgcctctacttgaaaagaatgagcctaagatgtcggaagcaaagaattatctgtcctcaattctcaatcacgggagactgtccggcttagctgttttgttgaggcttgtgagtaatagctgggctcaagccatcctactgctgcaaccacctgaggctttaggtctgcaggagtag

SEQ ID NO: 243882 - DNA, 1596 bp, Artificial Sequence
  Description of Artificial Sequence: Synthetic coding sequence
atgagctcagaaatggagcccctcctgctagcctggtcctattttcggaggaggaagtttcagctgtgcgccgacctgtgtacccagatgttggaaaaaagtccttatgaccaggcagcctggatcctgaaagctcgcgctctgacagagatggtctatatcgatgagatagacgttgatcaggagggcattgccgagatgatgttggacgagaacgcgatagcacaggtaccaagaccgggaacttctctaaagctccctggcaccaaccagactggcggaccttcccaggccgtcagacctataacccaagccggtcggccaattaccggcttcctcaggccaagcacccaatcaggaaggccaggcacgatggagcaggccatccggacaccacgtactgcttatacagcccgaccaattacttcctccagtggacgcttcgtgagacttgggacagcatccatgcttaccagccccgatggaccatttatcaatctgtcacgtctgaatttaaccaagtattcgcaaaagcctaaactggcaaaggccctgtttgagtatattttccaccatgagaatgacgtgaagacaatccatctcgaggacgtggtgctccacttaggcatataccctttcctccttagaaataagaatcacattgagaagaatgccctagacctcgcagccttgtctaccgaacactcccagtataaagactggtggtggaaggtgcagattggtaaatgttattaccggctcggaatgtatcgagaagctgaaaagcaattcaaatcagccctgaagcagcaagagatggtcgacacattcctgtatctagcaaaagtctacgtttctctggatcagcccgttactgcactcaatctgttcaagcagggccttgacaagtttcccggtgaggtcaccctattatgtggcatcgctagaatttacgaagaaatgaacaacatgagtagcgccgctgaatactataaggaagtcctaaagcaggacaacacccacgtggaagcaattgcatgtatcggctccaaccacttctacagcgaccagcccgagattgccctgaggttctataggcgactgttgcagatgggtatttacaacggacagttattcaataatctggggctgtgttgtttttacgcgcaacaatacgacatgactctcacaagttttgagagagccttgagcctagccgagaacgaagaggaggccgcagatgtctggtataacctgggccatgtcgctgtaggcataggagacaccaacctggcccaccagtgctttcgcctggctttggttaacaataataaccacgccgaggcctataacaatctggccgtcctagagatgcgcaaaggtcacgttgaacaggctcgcgctctgctgcaaaccgcttcttctcttgccccacacatgtacgagccgcactttaacttcgctacaatctcagataaaatcggggatttacagagatcatacgtcgctgcgcagaagtctgaagctgccttccccgaccacgtggatacacagcatctgatcaagcagctgaggcagcattttgctatgttatag

SEQ ID NO: 243883 - DNA, 636 bp, Artificial Sequence
  Description of Artificial Sequence: Synthetic coding sequence
atgagtagcgagatggaacccttgctgctggcgtggtcctattttaggcgaagaaagttccagttgtgtgctgacctctgcactcagatgctagagaaatcgccatacgaccagaaaattagttgggcttggtggcacgtccctgtgattcctgctacgtgggaagcggaggccggtgagcttctggagccaagaaaaagaagactccaacaggccgagattacccctctgtactcttccttggggaataagtcaaagactccttcacagaaagccgcatggatccttaaggcgagagctctcaccgaaatggtttatatagacgaaatagatgtggatcaggaggggatcgccgaaatgatgctggatgaaaatgccattgcccaggttcctaggcccggtacttcactgaaattacccggaactaaccaaaccggcggaccgagtcaagccgcaaatcacacaagttggaaaacacattacagatttccacaggctcaacacgccgaatggaaggcccgacattatggaaccggctatcagaacactcagaaccggttgcattctccaccttaccaccagcttctccgtaaaatctgccaggcgggaaatggcttccacgcatataaatcttag

SEQ ID NO: 243884 - DNA, 1518 bp, Artificial Sequence
  Description of Artificial Sequence: Synthetic coding sequence
atgtcctccgaaatggagcctttactgctggcgtggtcttatttccgaagacgcaagttccagctgtgtgcggacctatgtacacaaatgctagaaaaaagtccctacgaccaggccgcttggattctgaaagctcgtgccttaaccgagatggtctatattgatgaaatcgacgtggaccaagaaggaattgctgagatgatgctcgatgagaatgctatcgcccaggtgcctcgacctggaacatccctaaagctgccaggcaccaaccagaccggtgggcctagccaagcagttcgaccaattacacaggcgggacgaccgattaccggatttttgcgtcctagtacgcagtctggtcggcctggtaccatggaacaggcaatccgaacccctaggactgcatatactgccagaccaattacctcttcctctggaagattcgtccgcctggggaccgcatctatgttaacatccccagacggcccattcattaacctttccagactaaacctgaccaaatatagtcagaagcctaagttagctaaagccttgtttgaatatatattccaccatgagaacgatgttaaaacagccctcgatctcgcggctctgtctaccgagcatagtcagtacaaagattggtggtggaaggtgcagattgggaagtgttattatagacttggtatgtacagagaggcagaaaagcagtttaagagtgcccttaagcagcaagagatggtggatacatttttgtacctggccaaagtctacgtctcattggatcaacctgttaccgctttgaatctgtttaagcaaggcttggacaagttcccaggtgaagtgactctgttatgcggaatcgctcgcatctacgaagagatgaacaacatgagcagtgccgcagaatattacaaagaggtgctgaagcaggacaatacgcatgtcgaggcaatcgcttgtatcggtagtaatcacttttacagcgatcagcctgaaatcgctctccgcttttatagacggttgttgcagatgggtatctacaatggccaactttttaacaatctggggctttgttgtttctatgcacagcagtatgacatgaccttgaccagtttcgagagagcactctcactcgctgaaaatgaggaagaagccgcagatgtttggtacaacctggggcatgtggccgtgggtatcggtgataccaacttagcccaccagtgttttagattggccttggttaacaacaacaatcacgccgaggcctacaacaacctggccgtgctcgagatgcgtaagggccacgtcgagcaagctagggcccttctgcagacagcttcaagtctcgcccctcacatgtacgaaccacatttcaattttgcaaccatctcagacaaaataggtgaccttcagcggtcatacgtggccgctcaaaaatcggaggctgcatttccggaccatgttgatacccagcacttgattaaacagcttcgccagcatttcgccatgttatag

SEQ ID NO: 243885 - DNA, 1428 bp, Artificial Sequence
  Description of Artificial Sequence: Synthetic coding sequence
atgtcttccgaaatggaaccgctgcttctggcctggagctatttcaggcgcagaaaattccagctctgcgctgacctttgtacgcagatgctggagaaatcgccgtatgaccaagccgcttggattctgaaggcccgagcactgactgaaatggtatacattgacgagatcgacgttgatcaagaggggattgccgaaatgatgctggacgaaaatgctattgctcaggttccccgacccggtacaagtctgaagcttcctggaaccaaccaaacgggtggcccttctcaggcggtgagaccaattactcaggcaggccgacctataaccgggttcctccgccctagtactcaaagtggtcggcctggcacaatggaacaggccatccgcacaccaaggacggcctacactgctcgccctatcacctcatcttcaggtaggttcgtgcgcctcgggacagccctgttcgaatacattttccaccacgagaatgatgtgaaaacggccctggatctagctgctctgtcaacagagcacagccagtataaagattggtggtggaaagtccagatcggcaagtgctattatagattgggaatgtacagggaggccgaaaagcagtttaaatctgctctgaagcaacaggagatggttgatacgttcctctaccttgcaaaagtgtacgtttcgctcgatcagcctgtaacagccctgaatctttttaaacagggtctggataagttcccaggtgaggtcacattgttatgtggcattgcacgaatctatgaagagatgaacaacatgagcagcgcagctgagtactacaaagaagtcctaaaacaagacaacacacacgttgaagcaatagcatgtataggaagtaatcacttttacagcgaccagcccgagatagctctgcgattctacaggcgattgctacaaatgggtatctacaacgggcagctctttaacaacctggggctgtgctgcttttacgctcagcagtatgatatgaccctgacttcgttcgaacgtgctctgtccttagccgagaatgaagaggaggcggcagacgtctggtataaccttggccatgtcgccgtcggaattggggacaccaacctggctcatcagtgttttcggttggcactggtaaacaataacaatcacgccgaagcttacaacaaccttgctgtcctggaaatgaggaagggtcacgtcgagcaggcccgtgcccttctccagaccgccagctctcttgcccctcacatgtacgagccgcactttaatttcgcaaccatctcagacaagatcggcgacctgcagagatcctacgtggcggcacagaaatcagaggccgcattccctgaccatgttgatacccagcacctgatcaaacagttgaggcaacacttcgcgatgctctag

SEQ ID NO: 243886 - DNA, 753 bp, Artificial Sequence
  Description of Artificial Sequence: Synthetic coding sequence
atgtcatcggaaatggagccgctgcttcttgcttggtcttatttccgcaggagaaagtttcagctatgcgccgacctctgcacgcagatgctggaaaagagcccatacgaccaagagatgaataacatgtcctccgccgctgaatactacaaggaagtgctgaagcaggataacacacacgtggaggccattgcgtgcatcggcagcaatcacttctactcagatcagcccgaaatcgcgttacgtttctatcggcgtttattacagatgggaatctataatggccagctgtttaataacctgggactctgttgtttttacgctcaacagtacgatatgaccctaacttcatttgagcgagctttatctctcgccgaaaatgaggaggaagctgctgacgtgtggtacaatcttggccatgtggcggtagggataggagatactaaccttgcgcaccaatgttttcggctggcactcgtgaacaacaataaccatgccgaagcctacaataacctggccgtcctggaaatgcgcaagggccacgtggaacaggcccgagcattactacagaccgcgagcagtctggcgcctcatatgtacgagccacatttcaactttgcaacaatttcagataaaatcggcgacctgcagaggtcttacgtggcagcacagaaatccgaagccgcttttcctgaccacgtagatacacagcatctcattaaacagctgaggcaacactttgccatgttatag

SEQ ID NO: 243887 - DNA, 954 bp, Artificial Sequence
  Description of Artificial Sequence: Synthetic coding sequence
atgatcctgtcctacgaagtgattctgcatgctctcgaccttgccgcactctcaaccgaacatagtcaatacaaggactggtggtggaaagtccagatcggtaaatgttattataggttgggaatgtaccgagaagctgagaagcagtttaagagtgcactcaaacagcaggaaatggtcgatactttcttgtacctagccaaggtgtatgtgtcgctggaccagcccgtgaccgctctaaacctttttaaacaggggctggacaaattcccaggcgaagtcaccctgctgtgcggcatcgctagaatttacgaagaaatgaacaatatgagctcagctgcagagtattataaggaagttcttaaacaggacaacactcatgtcgaagcgatcgcctgcattggttccaaccatttctactctgatcagcccgagatcgctttgcgcttttaccggagattgctgcaaatgggaatctataatgggcaactgttcaataacttaggcctttgctgtttctacgctcaacaatatgacatgacccttacgtctttcgagagggccctgtccctcgccgaaaatgaggaggaagcagcagatgtatggtataatttggggcacgtggccgtcggaatcggagataccaatctcgctcatcaatgcttccgcttggccttagtcaataataacaaccacgctgaagcatacaataaccttgcagtgctggagatgcggaaagggcacgtcgagcaagctagggctttgctgcagaccgccagctcactagctccccatatgtacgagcctcacttcaacttcgcaactatttctgacaagattggcgatttgcagcgttcatacgtcgccgcacagaagagtgaggcagcttttcctgatcacgtagatacacagcatcttattaagcagctacgtcagcatttcgcgatgctgtag

SEQ ID NO: 243888 - DNA, 1548 bp, Artificial Sequence
  Description of Artificial Sequence: Synthetic coding sequence
atgtctagcgaaatggagcccttactgttggcgtggagctatttccggaggcgcaaatttcagctgtgcgctgacctgtgcacccagatgctcgagaaaagcccttacgaccaggagcctgaccctgaactgccagttcaccaggcagcgtggatcctgaaagccagagctctcaccgaaatggtgtacatagatgaaattgacgtggaccaggaaggcattgctgagatgatgctcgatgagaacgcaatcgcacaagtgccgcgaccaggtacatccctgaaactgcctgggaccaatcaaacaggaggcccatctcaggccgtgagaccgataacccaggcgggtcggcctataaccggcttccttcgaccctctacacagtccggccgaccaggtaccatggagcaagcaataagaactcccagaactgcttacacagcccgacccataacaagcagctctggcagatttgttagactgggcaccgctagcatgctcactagcccagacggaccatttatcaacctcagtagactaaaccttactaagtatagccaaaagccaaagctcgccaaagccttgtttgaatacattttccaccatgaaaacgacgtgaaaaccgcactagacctggccgctctgagtacagaacatagccaatacaaagactggtggtggaaggtacagatcggtaagtgttactaccgattgggaatgtaccgcgaggccgaaaaacagtttaaaagcgccctaaaacagcaggagatggtggatacttttctttacctggccaaagtctacgtgtctctggaccagcctgtaaccgcacttaacctttttaagcagggacttgataaatttcccggagaagtgacactcctgtgcggaatagccagaatatatgaggaaatgaacaacatgagtagcgccgctgagtactacaaggaggttctcaaacaggacaatactcacgttgaggcgatcgcgtgcattggctctaaccacttttattccgaccagccagagatcgcactacggttctacaggcgtcttctccagatgggaatttacaatggtcaactgttcaataacctcgggctctgctgcttttacgcacagcaatatgatatgaccctaacaagctttgaacgtgcattaagcctggccgaaaatgaggaggaagcagctgacgtgtggtataatctcggtcacgttgcggtcggcataggagacactaatctcgcccaccagtgctttcggctcgcattggtgaacaacaataaccacgcagaggcatataacaatctagccgtactagaaatgcgaaagggacacgttgagcaagccagagccctgctacagacagcatccagcttggcccctcacatgtatgaacctcactttaatttcgctacgatttctgacaaaattggcgatctccaaaggtcttacgtggcagctcagaaatccgaggccgctttcccagaccacgtcgacacccagcacttaatcaagcagctcagacagcacttcgccatgctgtag

SEQ ID NO: 243889 - DNA, 831 bp, Artificial Sequence
  Description of Artificial Sequence: Synthetic coding sequence
atgtaccgggaagctgagaagcaattcaaatccgctctgaaacaacaagaaatggttgatacctttctctatctagcgaaggtatacgtctccctggatcagcctgtgacagcgctgaacctgttcaagcagggactggacaaattccccggtgaagttacgctgttgtgcggtattgctaggatatatgaagagatgaataatatgagttccgcagcggagtattataaagaagtactgaagcaggacaacacgcacgtggaggccatcgcatgtataggcagcaaccatttttacagtgaccagcctgagatcgcgctccgtttctaccggaggctgctgcagatgggcatctacaacgggcagctcttcaacaacctgggcctgtgctgcttttacgcgcagcaatacgacatgacccttacctctttcgagagggcattgtctctcgccgagaatgaggaggaggcagctgatgtctggtacaatctggggcatgtggccgtagggattggcgatacaaatctggcccatcagtgctttaggttggccttagtcaacaacaacaaccacgccgaagcctacaacaacctggccgtgttagagatgcgcaaagggcacgtagagcaagctcgcgctcttctgcagaccgcatcaagtctggcccctcacatgtatgaaccgcactttaacttcgccacgatctcagacaagattggtgacttacagcgatcttatgtcgccgctcagaagtcagaggcggcattcccagatcacgttgatacccaacacctgatcaagcaactcagacagcacttcgcaatgctgtag

SEQ ID NO: 243890 - DNA, 348 bp, Artificial Sequence
  Description of Artificial Sequence: Synthetic coding sequence
atgtcatcgcctagtagcccatttcgtgagcagtcgttcttgtgtgctgcgggtgatgccggtgaagaatcccgcgtacaggtattgaagaacgaggttcgccgtgggtcgcccgtgctcctgggctgggtagagcaagcctacgccgacaaatgtgtctgtgggccttcagccccacctgcccctacccctccaagtctgtcccagcgcgtgatgtgcaatgatcttttcaaagtcaacccgttccaattgcagcagttccgcgctgatccgagtacggcctctctcctgctttgcccgggaggtttagatcataagctaaacttacgcggtaaggcctggggatag

SEQ ID NO: 243891 - DNA, 348 bp, Artificial Sequence
  Description of Artificial Sequence: Synthetic coding sequence
atgagttcgcctagctcaccttttcgggagcaaagtttcctctgcgccgcaggcgatgctggagaagaaagtcgcgtccaggtgctcaagaatgaggtgcgcaggggatctcctgtcctgctgggctgggtggaacaggcctacgcagataagtgtgtctgcggaccctctgcaccgccagcccctacccccccaagcctcagtcaaagggtcatgtgtaatgacctgttcaaggtcaatccctttcagttacagcagtttagggcagacccaagtaccgcaagtcttttactgtgtccgggtggcctggaccacaagttgaatctccgcggtaaagcctggggctag

SEQ ID NO: 243892 - DNA, 357 bp, Artificial Sequence
  Description of Artificial Sequence: Synthetic coding sequence
atggaagggggagcttacggtgccggtaaggcaggcggagcatttgacccttatacccttgttagacaaccacatactatcctcagagttgtatcttggctgttctccattgtcgtgttcggctcgattgtgaatgaggggtatctcaacagtgcaagtgagggggaagagttctgcatctacaacaggaacccaaatgcttgctcctacggcgtggctgtcggcgtgctggcctttctgacgtgtttgttgtacttagcgctggacgtttacttcccccagatatcatccgtgaaagaccgcaagaaggcagtgttatcagacatcggagtgtctgcatgggaaatgcattcttag

SEQ ID NO: 243893 - DNA, 1389 bp, Artificial Sequence
  Description of Artificial Sequence: Synthetic coding sequence
atggccgcacagagacggagtcttctccagtccgagcagcaaccctcctggaccgatgatctccccctgtgccacttaagcggcgtaggaagcgcgagtaacaggtcatacagcgccgatggaaagggcacagagtcccaccctccggaagacagttggctcaaattccgcagtgagaataattgcttcctgtatggtgtgtttaatggctacgacggcaatcgggttaccaatttcgtcgcacagcggctctctgcggaacttcttctgggacagctcaacgcagagcatgcagaggctgacgtgaggcgtgtcctattgcaggcctttgacgtggttgagcggtctttcctggagtccattgatgatgctctggccgagaaagctagcctccagtctcagttgccagagggagtccctcagcaccaactgcctccacagtaccagaaaatcctggaacgactgaagaccttggaaagagagatctctggaggcgcaatggccgtggtagctgtcttgctgaataacaagctgtacgtagcaaacgtggggacgaaccgagctctcttatgcaagagcaccgtagatggcctgcaagtcacacaactgaacgtggaccatacgaccgagaatgaggatgaattgttcaggctgtcccaacttggcctggatgccggaaaaattaaacaggtaggaatcatatgcggacaggagtcgactcgtcgtattggcgactacaaagtaaaatatggttacaccgatattgatcttttatccgccgctaagtctaagcctatcattgccgaacccgaaatacacggggctcagcctctagatggcgttaccgggttcctggtgctgatgtcagagggcctgtacaaagccctagaagccgcacacggcccagggcaggctaatcaagagatagccgctatgatagatacggagttcgccaaacagacgtcactcgacgctgtggcccaggccgtggtggatagagtgaagcgaattcactcagatacattcgcatctggtggtgagcgggctcgattctgcccgagacacgaggatatgactctgctggttaggaattttgggtaccctcttggggagatgtcccagcccacccctagcccagctcccgctgctgggggtagggtctatcctgtgtcagtcccctatagcagcgctcagtcgacgagtaagactagtgttaccctctcattggttatgccctcccaagggcaaatggtgaacggcgcacacagtgcgtctacactcgacgaggccacgcccaccctgacaaaggatccttctaggcccgcatccgatttaaccgccatccctcagtgccagctcaaccttctgggtagtctgacaccaggctag

SEQ ID NO: 243894 - DNA, 2082 bp, Artificial Sequence
  Description of Artificial Sequence: Synthetic coding sequence
atggctcaaggctcgcatcagatcgatttccaggtcctgcacgacctacgccagaaatttccggaagttcctgaggttgtcgtgagtagatgcatgctccagaacaataataatctcgacgcttgttgcgctgtgctgagccaggagtccacacgctacctatatggagagggagaccttaactttagcgatgacagcggtatatccgggttgcggaatcatatgacttccctgaatttagacctccagtcacaaaatatttatcaccatggaagagagggaagccgtatgaacggatctaggaccctcactcactcgattagtgacggacagctgcaggggggtcagtccaactctgagctcttccaacaagagccgcagactgcaccggcacaggtgccacagggcttcaacgtctttggcatgtctagcagctctggtgcgtccaatagtgccccacacctgggatttcacttagggagtaagggaaccagtagcctgtcccagcaaactcctcgctttaacccgatcatggtgacactggctcctaatatccaaactggcaggaacacccccacctctctccacatccatggggtgcctcctccggttctgaactcgccccaaggaaactctatatatattcgaccgtatatcactacccctggaggcacaactcgacagactcagcagcactccggctgggtgtcccagtttaatcctatgaatccgcaacaggtctaccaaccgagccaacccggtccctggacaacatgccctgccagcaacccactatctcacacctcttcgcagcagccaaatcagcagggccatcagactagccatgtatacatgccaatcagctcacctaccacgagtcagcctcccaccattcactcctctggatcgtcccagtcaagcgcgcattctcaatacaatatccagaatatcagcactggaccgcgtaaaaaccaaatagaaattaaactcgaacccccacagaggaacaactcatcaaagctccgaagttccggccctcgtacgtctagtacttctagttctgttaacagccagactctgaataggaaccagccaaccgtgtacatagcggcatctcctcctaatacagacgagttgatgtcccgctctcagccaaaggtgtatatcagtgccaatgcagcaacaggggatgaacaggttatgcggaatcagcccactctgttcatctctactaattcaggtgcctcagcagcctccaggaatatgagtgggcaggtgtcaatggggccagcctttattcaccaccaccctcccaagtcgcgagccataggcaacaattcagccacgagcccacgggtcgtggtcacccagcctaataccaaatacacctttaagataacagtttctcctaataaacctcctgctgtttcgcctggggttgttagccccaccttcgaattgacaaacctcctcaatcatcctgatcactacgtggaaaccgaaaacatacagcacctgaccgatcctacactggcacacgtggacagaatatctgaaactcgcaaactgtctatgggttctgacgacgcagcttatacccaggcattactagttcatcagaaagccagaatggagcgtctgcagcgggagctcgagattcaaaaaaagaaactggacaagctgaaatctgaagtgaatgagatggagaacaacctgacccggaggcggcttaaacggagcaacagcatcagccagattccttccctggaggaaatgcaacagctcagaagctgtaaccggcaattgcagatcgatattgactgtctgaccaaggaaatcgacctcttccaggcacgcggtcctcacttcaacccctccgccattcataacttctacgacaatattggttttgtcgggcctgtccccccaaaacctaaggaccagcggtcaatcattaagacacccaaaacacaggatacagaagatgacgaaggcgctcagtggaactgtacagcctgtactttcctgaaccaccctgccttaatacggtgcgagcagtgtgaaatgccacgccacttctag

SEQ ID NO: 243895 - DNA, 2082 bp, Artificial Sequence
  Description of Artificial Sequence: Synthetic coding sequence
atggctcaggggagccaccagatagacttccaggttttgcacgaccttcgccagaagttccctgaagtgccagaggtggtcgtgtctcgatgtatgttacagaataataataacctggacgcttgttgcgctgttctttctcaggaatctacccggtacctgtacggggaaggcgatctgaactttagtgacgattctggcatttcaggcctccgtaatcatatgacttctctaaacctggacctgcagtcccagaatatctaccaccacggtcgggaggggagtagaatgaatggttcccggaccctgacccattcaatcagcgatggtcagctgcagggaggacagagcaattctgagttgttccagcaagaaccccagacagcaccagctcaggtcccccagggatttaatgtgttcgggatgtccagctccagtggggcatctaattcggccccacaccttggcttccacctgggatccaaaggtactagtagtctgagccagcagaccccacgtttcaaccctatcatggtgaccctggccccaaatatccagaccggacgtaacaccccaacaagccttcacattcacggcgtgccgccaccagtcctgaactctcctcaagggaattcgatctatatacgcccttatattacaacaccaggaggcaccacaaggcagacccagcagcactccggctgggtttctcaattcaatccgatgaatcctcagcaggtgtatcaacctagccagccaggtccctggacaacatgtccagcaagcaacccgctgtcacatacctctagccaacagccaaaccagcaggggcaccagacctctcatgtgtacatgcccataagctcaccaactacgagccagccacctacgatacactcctccggaagcagtcaatcttcagcacacagtcagtacaacatacaaaatatcagcaccggccctcgaaagaaccagatcgaaatcaaacttgagcctccccagcgcaataactctagcaaactgcggtcctctggaccgaggaccagttccacgagttcttctgttaacagtcagacactcaaccgaaatcagcctacagtgtacatcgcggcatcccctcctaacaccgatgaattgatgtctcggtctcaacctaaggtatacatctccgcgaacgccgcaaccggcgacgagcaggtgatgcggaatcagcccaccctgtttatcagcacaaattcgggcgctagtgcagcctcaaggaatatgagtgggcaagtgtctatgggacccgcatttattcaccatcacccacccaaaagccgcgctattgggaataactcggccacctcacccagggttgtagttacccagccgaacacgaagtatacttttaagatcaccgtgagccccaacaaacctcccgcagtctccccgggtgtagtctcacccacgtttgagttaaccaatttgctcaatcacccagatcactatgtcgaaaccgaaaacattcagcatttaaccgaccctacactcgcacacgttgaccgcatatctgagactaggaagttaagcatgggatcagatgacgcggcttacacacaggccctgctcgtgcatcaaaaggccagaatggaaagactccagagagagctggagattcaaaaaaagaaacttgataagttgaaaagcgaagttaacgagatggaaaataacctaacacggagacgcttaaaacggtcaaatagcatcagtcagataccctcactcgaggagatgcagcagctgcgaagttgcaaccgacagctacaaatcgacatcgattgcttgaccaaagagatcgacctgtttcaggccagaggcccacacttcaacccctccgccatccacaatttttacgataacatcgggtttgtcggtccagtgccgcctaagcccaaagaccagcggagcattatcaagactccaaagacgcaggacactgaggacgatgaaggagctcagtggaactgtaccgcctgtacattcctgaatcacccagctctgatccggtgtgaacagtgcgagatgcctcgccacttctag

SEQ ID NO: 243896 - DNA, 1611 bp, Artificial Sequence
  Description of Artificial Sequence: Synthetic coding sequence
atggcacagggaagtcatcagatcgacttccaagtcttgcacgatctgcggcagaaatttcccgaggtgcctgaagtggttgtatcccgttgtatgctgcagaacaacaataacctggacgcgtgctgcgcagtgctgtcacaggaatccacacgttatttgtacggagaaggggacttgaacttctcggatgactcggggatttctggtcttaggaatcacatgacctctctgaatcttgacctgcaaagccagaatatttaccaccacggcagggaaggttcgcgcatgaacgggagcaggaccctgacccattctattagcgacgggcagcttcaagggggtcagtccaactctgaactgtttcagcaggaacctcaaacagcccctgcacaggtgccacagggcttcaacgtcttcgggatgtccagttctagcggcgctagtaacagcgccccacacctgggatttcatctgggaagtaaggggacatcctccttgagccagcaaacacctcgctttaatcccatcatggttactctggcccctaatatccaaaccggtcggaatactcctacttccctgcatatacacggagttcccccacccgttctgaattctccccaggggaactcgatctacattcggccatatataacgacccccggtggcacaactagacagacccaacagcacagcggctgggtctctcaatttaaccccatgaatcctcaacaggtctatcaaccatctcagcccggtccttggaccacctgtccagcatctaatcccctgtcccacacttctagtcaacagcctaaccaacaggggcaccagacaagccacgtttacatgccgatcagctcccccacaacgtcccagcccccaaccattcactcaagcggcagcagccagagctctgcccacagccagtataacatacaaaatatctctaccggtccaaggaagaaccagattgaaattaagctggagcctcctcaaagaaataactctagcaagctacgctcctctggccctcgaacttcttctacctcttcttctgtaaattctcagactctcaacaggaaccagccaacagtgtacatcgcagcctcccccccaaatactgatgagctgatgtcccgaagtcaaccaaaggtatatatttccgcaaacgcagcaaccggcgacgagcaggttatgcggaaccagccaacattgtttattagcacaaacagcggggcaagtgcagcctcccggaatatgtccgggcaggtatctatggggcctgcctttattcaccatcatccacctaaatccagagcaattggaaacaattctgctaccagtccgagggtggttgtcactcagcctaacacaaagtataccttcaaaataaccgtaagtcctaataaaccccctgcagtctcccctggagtcgttagtcctacctttgaactgaccaacctcctgaatcatcccgaccattacgtggagacagagaacatccagcaccttactgatcccactctcgcccacgttgaccggattagtgaaacccggaagttgtccatgggctcagacgacgcagcttacacccaggatatctag

SEQ ID NO: 243897 - DNA, 1986 bp, Artificial Sequence
  Description of Artificial Sequence: Synthetic coding sequence
atgcaaaataataataacctggatgcatgttgcgctgtgctttcacaggagtctacaaggtatctgtacggcgaaggagatcttaacttctcagacgattctggaattagcggcctgcggaaccacatgacaagcctaaatctggacttgcagagccaaaacatctatcaccacggaagagaagggagtcggatgaacgggtctcgaacccttacgcactctattagcgacggccagctgcagggtggccagagtaacagtgagctgttccagcaggaaccacagacggccccagcccaggtaccccaagggtttaatgtctttgggatgagttccagctccggagcaagcaattccgctccccacctgggttttcatctgggatccaaaggaacttcttcactcagccagcaaacccctcgtttcaatccaatcatggtgacccttgcacctaacattcaaaccggacgcaataccccgacaagtctgcacatccacggcgtgccccctccagtgctgaattcacctcaagggaactcaatctacattcgaccctacatcacaaccccaggcggaactacacgacagactcagcagcattccggttgggtgtcacaattcaatcccatgaatccccagcaggtgtatcagccttcccaaccagggccatggactacttgcccagcaagcaacccactcagccatacttcctctcagcagcctaaccaacaggggcatcagacaagccacgtgtacatgccaatctcgtcaccgacaacaagtcagcctccgacaatccatagcagcgggtcgtcacaatctagtgctcacagtcagtataatatccaaaacatttcaactggtccaagaaaaaaccagattgagatcaaattggagccaccccagagaaataacagtagcaaactccgcagctccggccctcggacctccagtacctcctctagcgtgaacagccagaccctgaacagaaaccagcctaccgtgtatattgccgctagtcctcccaacacggacgaactgatgtctaggagccagcctaaggtttacatctccgctaatgccgcaacgggggacgaacaagtgatgcgcaaccagccaactttatttatttcaactaatagcggagcctctgcagcctctcgaaatatgtccggacaggtgagtatgggcccagcatttatccatcaccatcccccaaaatcccgcgctataggaaacaattctgccacctctcctagagttgtggtaactcaacctaacactaaatatacatttaagattacggtttcaccaaacaaaccgccagcagtatcgcccggagtggtgagccccacctttgagttaaccaatcttctgaatcatcctgatcattacgtggaaactgaaaacatacaacacctgacggatcctaccctcgctcacgtggaccgcatctccgagacaaggaagctaagcatgggcagcgatgacgctgcctacacacaggccctgctggtgcaccagaaggctaggatggaacggctccagagggagctggaaatccagaaaaagaagctggacaagttaaaaagcgaagttaacgaaatggagaacaacctgacccgacggagactaaagcgcagtaattctatctcacagatcccctctttggaggagatgcaacagctgaggtcttgtaaccggcaactgcagattgatattgactgtttgaccaaagaaatcgatctgtttcaggcaagggggccacatttcaacccttctgccattcataacttctacgacaacattgggttcgttgggccagtaccccctaagccaaaggatcagcgctctataatcaagaccccaaaaacacaagacacagaagacgatgagggggctcagtggaactgcaccgcttgcacgtttttaaatcaccctgcgctcatcaggtgcgagcaatgcgaaatgcccaggcacttttag

SEQ ID NO: 243898 - DNA, 2082 bp, Artificial Sequence
  Description of Artificial Sequence: Synthetic coding sequence
atggcacaaggttctcatcaaattgactttcaggtgctccatgatctgcgccagaaatttccggaagtgcccgaggttgtggtctcgcggtgcatgctacagaataacaataacctagacgcgtgttgtgccgtcctcagtcaggagtctacaaggtatctttatggtgagggtgatctcaacttctctgacgacagcggaattagcggcctgcgaaaccacatgacttctttgaatctggatctacagagtcagaacatttatcaccacgggagagagggatccaggatgaatggatcccgtacattgactcactctatctcggacggacaacttcagggcggacagagcaacagtgaattgtttcagcaggaaccacaaaccgctccagctcaggtccctcaggggtttaatgtgtttgggatgtcaagcagctccggcgctagcaatagcgccccacatctaggattccatctagggtccaaaggtactagtagtctttcccagcaaactccacgcttcaaccccattatggtgactctggctccgaacatccagacagggcgaaacaccccgacctctcttcacatacacggtgtgcccccacccgtgctgaattccccgcaaggaaactccatctatataagaccctatattaccactcctggtggtaccactcgccagactcagcagcacagcggatgggtttcccagttcaatcccatgaatccccaacaggtttaccagccctcacagccaggcccatggactacctgcccagcaagcaacccactgtcgcatacctcttcccagcagcctaaccaacagggccaccaaacaagccatgtttatatgcccatttcctcacccacgacttctcaaccgcctacgattcactcttccgggagctctcagtcaagcgcacatagccagtacaatatccagaatatttccactggccctagaaagaaccagatcgagattaaattagagccacctcaacggaacaacagttcaaagcttagaagcagcggacctcgcacttcctcgactagctcctcggttaacagtcaaacactcaacaggaaccagcccaccgtgtacatcgcagcatctccacccaacaccgatgagctcatgagtaggtcacagccaaaggtttacatctcagcgaacgccgctactggggatgagcaggttatgagaaaccaacccactttatttatcagcacaaatagcggagcctcagccgctagtagaaatatgtctggtcaggtttccatgggaccggcttttattcaccatcatcctccgaaaagtcgggcaataggcaacaacagtgctacatcccctcgtgtggtcgtcacccagccaaacacaaagtacacatttaagatcacagtgtcaccaaacaagcccccagctgtgagtcccggtgtggtgagccccaccttcgagctgaccaacctgttgaatcatcccgaccattatgtggaaacggagaatattcagcaccttaccgaccccaccctggcacatgtggaccgcatatcggagaccaggaagctctcaatggggagtgacgatgccgcatatacacaggccttgcttgtgcaccagaaggcgaggatggagagattacaaagagagctagagatacaaaaaaagaagttggataagctcaagtccgaggtgaatgagatggagaacaatctcactcgacggaggttaaagcgatcaaacagtatttcccagatcccttcgctcgaagaaatgcaacaattgcgctcgtgcaacagacaactgcaaatcgacatcgattgcctgaccaaagagatcgatctcttccaagccagaggacctcacttcaacccatcggcaatccacaacttctatgacaatataggtttcgtcggacctgtgcctccaaagcccaaggaccagcgatctattattaagacccctaaaactcaggataccgaggatgatgagggtgcgcagtggaactgtactgcctgcaccttcctgaatcatcctgcccttattcgctgtgagcaatgtgagatgcctagacacttctag

SEQ ID NO: 243899 - DNA, 714 bp, Artificial Sequence
  Description of Artificial Sequence: Synthetic coding sequence
atgtcagacagcgacctcggagaggatgaaggtctcttgagcttagcgggtaaacgtaaacgaaggggcaacctgcctaaagagtcggtcaaaatcctgagagactggttgtatttgcatagatataacgcataccctagcgagcaggaaaagctttcattgtctgggcaaactaatttatcggtgctgcaaatttgtaactggtttatcaacgcccgaaggcggctgctgcccgatatgttgcggaaggacgggaaggaccccaaccagtttacaattagtcggagagggggtaaggcatctgatgttgcccttcccagaggctcaagcccgtcggtgcttgctgtgtccgtgcctgcacctactaatgtgctgagcttgtctgtatgttcaatgcccctgcactctgggcagggcgagaaacccgcagcccctttccccaggggagagctcgagagcccaaaaccgctggtgacacctgggagtacactgactctgctcaccagggctgaggcaggttctccaactgggggactcttcaatactccaccaccaacccccccagaacaggacaaagaagacttttcatccttccaacttcttgttgaagttgcgttgcaacgggctgctgaaatggagctgcaaaaacagcaggacccgtcactgcctctcttgcacacaccaattccactcgtgagcgagaacccccagtag

SEQ ID NO: 243900 - DNA, 714 bp, Artificial Sequence
  Description of Artificial Sequence: Synthetic coding sequence
atgagtgatagcgatctgggggaggacgaaggtctcctgtctcttgccggtaagaggaagaggcgcggtaatctccccaaggaatccgtcaagatcctgcgggattggctgtacctgcatagatataatgcctaccccagtgagcaagaaaagctgtctctgagtgggcagactaacctgtcagtactgcagatatgtaattggtttataaatgccagaagaaggctgctccccgacatgttgcgcaaagatggaaaggatccgaaccagttcaccatctccagacgcggaggcaaagccagtgacgtggctctccccagaggcagctctccgtctgtgttggccgtgtctgtgccagcgcctacgaacgttctctctctgtctgtctgttctatgcccctgcacagcgggcagggcgagaaaccagccgcaccgttccccagaggcgagttggagtctcctaaacctcttgtcactcccggatcaacactgacgttgctcactcgcgctgaagctgggagccctaccgggggactcttcaacacacctcctccaacacctcccgaacaggataaggaggacttttcttcgttccagctacttgtggaggtggccctgcagcgagccgctgagatggagctccaaaagcagcaggacccctccctgcccctattgcacaccccaatcccactggtaagcgagaatcctcagtag

SEQ ID NO: 243901 - DNA, 525 bp, Artificial Sequence
  Description of Artificial Sequence: Synthetic coding sequence
atgtctgacagtgacttgggcgaagatgagggcctcctgagcctggctggcaaacgaaagaggaggggcaacttacccaaagaatccgtgaagatacttcgagactggctttatctgcaccgatacaacgcatatccgagcgaacaggagaagctcagcctgagcggacagaccaacctatctgtgctgcagatttgtaactggttcataaacgccagacgaagactgcttcctgacatgctgcggaaggatggaaaagatccaaatcagttcacgatctcacgacgaggcggaaaggcaagtgatgtggcactccccagaggttctagcccatccgtattggcagtgagtgtgcccgctccaaccaatgtcctatcgctctctgtttgtagtatgcctctccattcaggacaaggagaaaagcccgctgcccctttcccacggggagagctggagagcccgaaaccgcttgtcacacccggatccactctgactttgctaactcgcgctgaagcaggatcgtag

SEQ ID NO: 243902 - DNA, 714 bp, Artificial Sequence
  Description of Artificial Sequence: Synthetic coding sequence
atgagcgattcagacctgggcgaagacgaaggcctactaagtctggcagggaagcgtaaacgcaggggaaacctccccaaagaatccgtgaaaatcctgagggactggttgtatctccatcgatacaatgcttatccatccgaacaagaaaagcttagtctaagtggccagactaacctgtcagtgctgcagatctgcaattggttcatcaatgctaggcgccgattgttgcctgacatgttgaggaaggacggaaaagatcctaaccagttcacgattagcagacgcggaggaaaagcatctgatgtcgcacttccgaggggttcatccccaagcgtgctcgccgtcagtgtacctgcccctaccaatgtgctttctcttagtgtatgttcaatgcctttgcactccggccagggcgagaagcctgcagccccttttcctaggggagaactggagagccctaaacctttggtcaccccgggatcgacactgacgctcctgaccagggcggaggctggaagcccaaccggcggactgtttaatacacccccacccacccccccagagcaggacaaagaagatttttcttcttttcagctcctggtggaagtcgcactgcagcgggcagcggagatggagcttcaaaagcagcaggatccctctctgccactgttacacactccgatcccactagtgtcggaaaacccgcagtag

SEQ ID NO: 243903 - DNA, 726 bp, Artificial Sequence
  Description of Artificial Sequence: Synthetic coding sequence
atggaggcagcagcagacggtcctgcggaaacccagtcgccagtcgagaaggatagcccagccaagacccaaagtcctgcacaggatacatccattatgagcagaaacaatgctgacactggcagagtgctggcgctgccagagcataagaaaaagagaaaagggaacttacctgctgagagcgtgaagatacttcgggattggatgtataaacacaggtttaaagcatacccttctgaggaggaaaagcagatgctgtccgagaagaccaacctgagcctgctccagatcagcaactggtttattaacgccaggcgtcggatcttaccggatatgctgcagcagcgaaggaacgaccccatcattggtcacaagacaggaaaagacgcccacgcgactcatctccaatccaccgaggcgagcgttcctgccaaatccggccctagcggaccagataacgttcagtctctgccattatggcctttaccaaaaggccagatgtcacgcgagaagcagcccgaccccgagtcagccccatcgcagaagttgaccgggattgcccagccgaagaaaaaggttaaggtctccgtgacctcaccaagctcaccagaactcgtgtctcctgaggagcacgcggacttttcatcttttctcctgctcgtcgacgccgcagtgcaacgggctgccgagctggagttagaaaagaagcaagagccaaatccctag

SEQ ID NO: 243904 - DNA, 726 bp, Artificial Sequence
  Description of Artificial Sequence: Synthetic coding sequence
atggaggccgcagccgatggaccagcagagacacaatctccagtggaaaaggatagtccagccaaaacccagtctcccgcacaggacacgagcataatgtcaagaaacaacgctgacaccggcagagtcctcgcccttccagaacataaaaagaaacgtaaaggcaatcttcccgctgagagtgtgaaaattctccgcgactggatgtacaagcacagattcaaggcctacccgtcggaagaagagaagcagatgctgtcagaaaagactaatttatctcttctgcaaatcagcaattggtttataaacgcacggagaaggatccttcccgatatgctgcagcaacgcagaaatgatccaattatcggacacaaaactggaaaggacgcacatgcaacccatctgcagtcaacagaagccagtgtgcctgcaaagtctggcccatcagggcctgataatgtgcagtccctgccactctggcccctgcctaaagggcagatgagtcgggaaaagcagcctgatccagaaagcgcaccgagtcagaaactaactggaattgcccagcccaaaaaaaaggttaaagtgtctgtcacctcgccgagttcacctgagctcgtgagtcctgaggagcacgctgacttcagctcgttcctgctgttggtcgacgctgctgtccagagagctgcggagctagagctcgaaaaaaaacaggaaccaaatccatag

SEQ ID NO: 243905 - DNA, 558 bp, Artificial Sequence
  Description of Artificial Sequence: Synthetic coding sequence
atggaggccgcagcagacggtcccgctgagacccagtcaccggtggagaaggacagtcctgccaaaacccagagccccgctcaggataccagtataatgtcaagaaataacgctgacactggaagggttcttgccttaccagagcacaagaaaaaaagaaagggcaacctgccagcagaatccgtgaagattctccgcgactggatgtacaagcataggttcaaggcatatccctctgaagaggagaagcagatgttatccgagaagacaaacctgtccctgctgagaatttctaactggtttatcaatgccaggagacgtattttacctgatatgctccaacaaagaagaaatgatccaattattggccataagacaggaaaggatgcacacgcaactcatttacaatcaacggaggcctctgttccggcaaaatcgggaccagtggtgcagactatgtataaggcttgtccatgtgggccatgccagcgtgctcggtgtcaggagagatctaaccaaatcaggtcaagaccgcttgctcggtcttccccagaatag

SEQ ID NO: 243906 - DNA, 558 bp, Artificial Sequence
  Description of Artificial Sequence: Synthetic coding sequence
atggaagctgccgctgacggacctgccgagacccagagccctgtagaaaaggacagcccagcgaaaacacaaagccccgcacaagacacatcaatcatgtctagaaacaatgctgacaccggcagggtcttggcactgcctgagcataaaaaaaagcgcaaggggaacctgccagcagaatcggttaaaatcttgagagattggatgtacaagcatcggttcaaagcttatccttccgaggaggaaaaacaaatgctttctgagaaaaccaatctgagtctgttaaggatttcaaactggtttattaacgccagacgtcggatactgcctgacatgcttcagcagcggagaaatgacccgatcattggccataaaaccggcaaagatgctcacgcgactcatttgcagtccaccgaggccagcgtgccggctaagtccgggcctgtggtacagactatgtacaaggcttgcccgtgcgggccatgccagagagcacgctgccaagagaggtctaaccagatcagaagccggcctctcgccaggagcagccctgaatag

SEQ ID NO: 243907 - DNA, 1773 bp, Artificial Sequence
  Description of Artificial Sequence: Synthetic coding sequence
atggcaggtgctgtgccaggagcgatcatggacgaggactattacggttctgcagcagaatggggggacgaagccgatggtggccaacaggaagacgacagtggggagggggaggacgatgccgaggttcaacaggaatgtctgcataaattttcaacgagagactatattatggaaccaagtattttcaatacactgaagaggtacttccaggcagggggtagccccgagaacgttatccagctgctttcagaaaattacactgccgtcgctcaaacggtgaatttactggctgaatggctgattcaaactggggtcgaacctgtgcaggtgcaggagaccgtcgaaaatcatcttaagtccctgctgatcaagcattttgacccgaggaaggctgattcgatcttcacagaggagggtgagacaccagcgtggctcgagcagatgattgcacataccacctggagggacctgttttataagctggccgaggcacaccccgattgcctgatgctgaactttaccgtgaaattgatctcagatgcaggataccaaggtgagatcacgagcgtgagtacagcctgccagcagctcgaggtgttctctagagtcttaagaacttccctggccaccattttggacggtggcgaagagaatctagagaaaaacttacctgagtttgcgaagatggtgtgccatggggaacatacatatctctttgcccaggccatgatgagtgtcctggcacaggaggagcaaggcggatctgctgtccgccgaatcgctcaggaggttcagagattcgcacaggagaaagggcacgacgccagtcaaattacattagccttgggtactgctgcatcgtatcccagggcatgccaagcgctcggggctatgctctcaaaaggcgctttaaacccagccgacattaccgtgctgtttaagatgttcactagtatggaccctccgccagtggaactgattagggtgcctgcgtttctcgacctgttcatgcagtctctcttcaaacccggagcccgtattaatcaggaccacaagcacaagtacatccatatcttagcttatgcagcttctgtagtggagacctggaagaaaaataagagggtgtcgatcaacaaggatgagctaaagtccacaagtaaagctgtagagaccgtacataatctgtgctgtaacgagaacaaaggcgcttctgaactcgtggcggaattgagtaccctctaccaatgtatcaggtttcccgttgtggctatgggcgtgctgaagtgggttgactggaccgttagcgaacccagatatttccaactgcagaccgatcacacacccgtccacctggcgctgctagacgagatttccacttgtcaccagctgttacacccccaggtgctccagcttcttgtgaagctgtttgagaccgaacattctcaactggacgtcatggagcagcttgagctgaaaaagactcttctggatagaatggttcaccttctgagtcggggttacgttctcccagtggtgagctacattcgcaagtgtttggagaaacttgatacagatatctcgctgattcgctatttcgtcaccgaggtcctggacgtcattgcacctccatacactagcgacttcgtccagcttttcctgcctattctggaaaatgactcaattgccggaaccattaagactgaaggcgaacacgatcctgtgaccgagtttatcgcccactgtaaaagcaacttcatcatggtgaattag

SEQ ID NO: 243908 - DNA, 1773 bp, Artificial Sequence
  Description of Artificial Sequence: Synthetic coding sequence
atggccggtgctgtgcccggagccataatggacgaggactactatggctccgcagccgaatggggagacgaggctgacggaggacagcaagaagacgactcgggtgagggagaagacgacgctgaagtgcaacaagagtgtctgcacaaattcagtacgcgggactacatcatggaaccttccatctttaataccttaaagcggtacttccaggcgggtggttctcccgagaatgtgattcagctgctgagcgagaattacacagctgtggcgcaaaccgttaatctactggcagagtggcttatccagactggagttgaaccagtccaggtccaggaaaccgttgagaatcatctaaagtccctgcttataaagcacttcgaccccagaaaggccgattccatttttacagaggagggcgagacacctgcgtggctggagcaaatgatagcccatacaacatggcgggatctgttctataagttagcggaagcccaccccgactgcctcatgctcaatttcactgtaaagttaatctccgatgcaggctaccagggcgagatcacttcagttagcacagcatgtcaacagctggaggtgttttcacgcgttctcaggacctcactcgctacaatccttgacggaggtgaagagaacctcgagaaaaacctgcccgagttcgctaaaatggtgtgccatggagagcacacctatctcttcgcgcaagcgatgatgagcgtactcgcccaggaggagcaggggggaagcgccgttcgcaggatcgcgcaggaggtgcagaggttcgcccaggaaaaaggtcatgacgcttcccagattacactcgctttgggcacagctgcttcttacccgagggcctgccaggccctaggggcaatgctctcaaagggcgcactcaaccctgccgacattaccgtcctgttcaagatgtttaccagcatggacccacctcctgtggagctgatccgggtgccagcctttctggacctgttcatgcagtctttgttcaagcccggagccagaatcaaccaggaccacaaacacaagtacatacacatcttggcctatgccgctagcgtggtagagacatggaagaagaataagcgcgtttctataaacaaggatgagctgaagtctacctcaaaggcagtggagacagtccacaatctgtgttgcaacgaaaacaagggcgcaagtgaattagtcgccgagttatccacgctgtaccagtgcatcagatttccagtagtggccatgggtgtactcaaatgggtggattggaccgtctccgagcccaggtactttcagcttcagactgaccacactcccgtgcacctagctctattggatgaaatctcgacttgtcaccaattgttgcaccctcaggtccttcagctcctcgtaaagctgtttgagactgaacactctcagcttgacgtgatggaacagctagagctaaaaaaaaccctcttggatcgaatggtccacttgttgtcaagaggctacgtgcttccggtcgtgtcctacatcaggaagtgtcttgagaagttggatacagatatatccctgatccgctactttgtgacagaggttctggatgtcattgctcccccatacacatccgactttgtgcagctgtttcttccaattttggaaaacgattcaattgccggtaccatcaagaccgagggagagcatgacccagtgacagaattcattgcccattgtaaaagcaattttatcatggtcaactag

SEQ ID NO: 243909 - DNA, 774 bp, Artificial Sequence
  Description of Artificial Sequence: Synthetic coding sequence
atgccagccagatgcgttgcagctcactgcgggaacacaaccaaatcaggaaagtccttgtttcgatttcctaaggacagagcagtccgcctgttgtgggaccggttcgtgcgcggttgtagggccgactggtacggcggaaatgatcggagtgtgatctgtagcgatcactttgctcctgcttgttttgacgtgagctctgttatccagaagaacttgcgcttctctcaacggctacgcctcgtggcgggagctgtgccgacgctgcatcgggttcctgccccagccccaaaaagaggtgaagaaggtgatcaggccggacggcttgacactcgcggagagctgcaggccgctaggcattctgaagcagccccaggccctgtgtcatgcacaaggcccagagccggtaaacaggcagcggcaagccagataacatgtgagaacgagcttgtacagacgcagccacacgcggataatccttcaaacacggttacatctgtgcctacccactgcgaagagggacctgtgcacaagtctacgcagatctccttgaagcgaccccgacatcggtcagtaggcatccaggccaaagtgaaagccttcggaaaacgcctgtgtaacgccaccacccaaaccgaggagctgtggtcacgcacaagctctctgttcgacatttactcttcagactcagagacagacacagactgggacatcaagtctgaacagtctgacctctcttatatggccgttcaggtcaaggaggagacctgttag

SEQ ID NO: 243910 - DNA, 498 bp, Artificial Sequence
  Description of Artificial Sequence: Synthetic coding sequence
atggagccccctaagatgaaccccgtagtagaaccattaagctggatgctcggtacatggttgagcgaccctccaggagccggaacgtaccccacattgcagccctttcagtatctcgaggaggttcacatctcccatgtcggccaaccaatgcttaatttctcgtttaatagctttcatccggatactcgcaaacctatgcatcgggaatgtggctttattcgcctgaaacccgacacaaacaaggtggcttttgtgtctgcccagaacactggcgtggtggaagtcgaggagggagaggtcaacggtcaagaactgtgtatagcatcccacagcatcgctcgtatctcctttgccaaagaaccccacgtagagcagatcacccgcaaatttcgactgaattccgaagggaaacttgagcaaactgtcagtatggccaccaccacacaacctatgacccagcacctacatgttacctataaaaaggtaactccttag

SEQ ID NO: 243911 - DNA, 1734 bp, Artificial Sequence
  Description of Artificial Sequence: Synthetic coding sequence
atggtaatttgctgcgccgcagtgaactgcagtaacaggcagggaaaaggcgagaaaagggccgttagtttccaccgatttccgcttaaagacagtaaacgcctcatccaatggctgaaggctgtccagcgtgacaactggactcccacaaaatactccttcctctgttcagaacattttactaaagacagtttctcgaaaaggctagaagatcaacatcggcttctcaaacccaccgcagtgccctcaatcttccatcttacggagaaaaaaagaggcgctggaggccatggacgcacgagacgaaaagatgcttccaaagctaccggtggagtgaggggccactccagcgcagcaacgtctaggggggctgcagggtggagcccctcgtccagcggtaaccctatggccaagcctgagtccaggagactaaaacaggcagcattacagggggaggccactccccgtgcagcccaggaggctgcatctcaggagcaggcccaacaagccttggagaggactcctggcgacggcttagccacaatggtggccggaagtcaagggaaagctgaagcttccgctacagatgcaggtgatgagtccgccacatcgagcatagaagggggagtaaccgacaaaagtgggatctcgatggacgacttcacccctcccggatctggggcatgcaagttcatcggcagtttgcactcctacagtttttcatctaagcacactagggagaggccatcggttccccgagagcctattgacaggaagcgactcaagaaggatgtcgagccgagttgctctggttctagcctcgggccagataaaggactcgcacagtccccaccaagcagctctctcacagcgacccctcagaagccatcgcagtcccctagtgcccctccggcagacgtgacacctaagccggctactgaagcggtccagagcgagcactccgacgcgtcaccaatgagtattaatgaggtgatcttgagtgcaagcggcgcttgcaagttgatcgacagtctgcattcatactgcttcagttccagacaaaataaatctcaggtgtgttgcttacgtgaacaggtagagaaaaaaaatggcgagctgaaatctctccggcagagggtgtctcgatctgatagtcaagtgaggaagctgcaggagaagctggacgaactgcgaagagtgtccgtgccctacccgtctagcctcctgagtccctcccgagagccccctaagatgaaccctgtggtcgagccacttagctggatgttgggaacctggctttcagatccacccggagcagggacctatcccaccctgcagccatttcagtacttagaagaagtccacatttcacatgttggacagccaatgttgaactttagcttcaattctttccatccggatacccggaaacctatgcaccgcgaatgtggctttattcgcctgaaacccgatactaataaggtggcctttgtgagcgcccagaataccggagttgttgaggtagaggagggcgaagttaatggccaggagctgtgcattgcctcgcacagcattgccaggattagctttgctaaagaaccgcacgtggagcaaatcactcgaaaattccggctgaattcggagggtaagttggaacagacggtgagcatggctacaaccacacaaccgatgacacagcacctccatgtcacttataagaaggtgaccccatag

SEQ ID NO: 243912 - DNA, 510 bp, Artificial Sequence
  Description of Artificial Sequence: Synthetic coding sequence
atgtctataaatgaagtcatcctgtccgcctccggtgcctgtaagctaatcgactccctgcattcctattgcttctccagtcgacagaataagtctcaggtatgctgcctccgagagcaggtggaaaaaaaaaacggagaactcaagtcgctcagacaacgcgtcagtcgctccgactcgcaggtaagaaaacttcaggaaaagctcgacgaactcaggcgggtctcagtaccctacccctcaagcctcctgtccccatcccgagaacctcccaagatgaacccagtggtagaaccgctatcgtggatgctcggaacttggctgtccgatcccccaggcgcaggcacttaccctacacttcaacctttccagtatctggaggaagttcatatttcacacgtaggacagcccatgctgaatttcagcttcaatagcttccatcctgacacgcgtaagcctatgcatagagagtgtggctttattcgcctgaagcccggtagcagcggctag

SEQ ID NO: 243913 - DNA, 1062 bp, Artificial Sequence
  Description of Artificial Sequence: Synthetic coding sequence
atgaaacgggatagctgggtgcccagcaaataccagtttctgtgcagcgaccatttcacaccagactcgctggatatacgctggggcattcggtatctgaagcaaacagctgtaccaaccatatttagcctccctgaggacaatcaagggaaagacccaagcaaaaagaaaagccagaaaaaaaaccttgaagatgaaaaggaagtttgtcctaaagctaaatctgaggaatcctttgttttaaacgaaaccaaaaaaaatatcgtcaacacagacgtgcctcaccagcaccccgagctgcttcactctagcagcctggtgaaacccccagccccaaaaacaggaagcattcagaataatatgttaactctaaatctggttaagcagcacactggcaaaccagagtcaacactcgagacttcagtgaaccaagatacaggtcgaggagggtttcacacttgttttgagaatcttaattctacaactatcacactcactacctccaacagtgagagcatccaccagagcctcgaaacccaggaggtattagaagttaccaccagccaccttgccaacccaaattttacttctaactctatggagatcaaatcggcgcaggagaaccctttcttattctcaacgattaatcagacggtggaggagttgaatacgaacaaagagtcagtgatagcgatctttgtacctgccgagaactcgaaacctagcgtgaattcattcatctcggcacaaaaagagacgacagagatggaagacacagacatagaagattctctttacaaggatgtggattacggaacagaggttctgcagattgagcatagttattgcagacaggacattaacaaagaacacctttggcagaaagtgtctaagttacattctaagatcacactgctggaactcaaggaacagcagactctgggacggttgaagagccttgaggcactgatacgacagcttaagcaagagaactggctgtctgaggagaacgtgaaaatcatcgaaaatcactttacaacatatgaagtaacaatgatctag

SEQ ID NO: 243914 - DNA, 1188 bp, Artificial Sequence
  Description of Artificial Sequence: Synthetic coding sequence
atgcccagatattgtgccgctatctgctgcaagaacagacgcggtaggaacaacaaggatcgcaaactgtctttttacccattccccctccacgataaggaacgactagagaagtggctgaagaacatgaaacgagacagctgggtgccctcaaaataccagtttctatgctcagaccactttacacctgacagcttggatattcggtggggcatcaggtacctcaagcagacagccgtgcccacaatcttctccctgcccgaggacaaccaaggtaaggatccaagcaaaaagaagagtcaaaaaaaaaacttggaagacgagaaagaagtgtgccctaaggctaagtcagaggaaagcttcgtgctgaacgagaccaagaagaatattgtcaatacagacgtcccgcaccaacacccagaacttttgcactcttcctccctcgtcaagccccctgctcctaagactggttctatccagaacaatatgcttacgctcaatctggtaaaacagcatacagggaagccggaaagcacattagaaaccagcgtgaatcaggataccggcaggggcggtttccacacgtgcttcgaaaacctcaactctacaacaatcaccctgacaacatccaatagcgagagcatccaccagagtttagagacccaggaggtcctggaggtcaccacttctcaccttgcgaaccccaacttcacttctaattctatggaaatcaagtctgctcaagagaaccctttcttgttcagtactattaaccagaccgtcgaggaattgaacacgaataaggagtccgttattgcgattttcgtccctgcagagaacagcaagcctagcgtgaatagcttcatctctgcccagaaggagaccaccgagatggaggatacagacattgaagactctctgtacaaggacgtggactatggaacagaggtcctccagatcgaacattcatactgtcgccaggacatcaataaggaacatctgtggcagaaggtgagcaagctgcactcgaaaatcacattactggaactgaaggaacagcagacactgggacgccttaaatcgctggaggcactgatcaggcagctaaagcaggagaattggcttagcgaggagaacgtaaaaattatcgaaaaccactttaccacttatgaagtgacaatgatctag

SEQ ID NO: 243915 - DNA, 669 bp, Artificial Sequence
  Description of Artificial Sequence: Synthetic coding sequence
atggtcaagtgctgttcagccatcgggtgcgcgagtcggtgtctgcccaactccaagcttaagggactcacatttcacgtatttcccactgatgagaacatcaaacgcaagtgggtcctggctatgaaacgacttgacgtcaacgcagcgggtatttgggagcctaaaaaaggagacgttctgtgttcacgccattttaagaaaaccgactttgaccgttccgctcctaacatcaaattgaagccaggcgtgattccttccatttttgacagcccctatcatcttcaggggaagagagagaaactccactgccggaagaattttacattgaagactgtccccgctacaaattataaccaccatctggtgggcgcatcgtcgtgcatcgaagaattccagagtcagtttatatttgagcatagctatagcgtgatggactctcccaaaaagctgaagcacaagctggaccacgtgattggggagttggaagataccaaggaatcactcagaaacgtccttgatagagagaaacggtttcagaagtctcttcggaaaacgataagagagctgaaggatgaatgtttgatctctcaggagaccgccaatcgtctagatacattttgttgggactgttgtcaggagtccatcgagcaggactatatctcctag

SEQ ID NO: 243916 - DNA, 99 bp, Artificial Sequence
  Description of Artificial Sequence: Synthetic coding sequence
atggtcaagtgttgcagcgctatcggatgcgccagcaggtgcctgcctaatagcaaactcaagggtctgacctttcacgtttttcccactgatgagtag

SEQ ID NO: 243917 - DNA, 243 bp, Artificial Sequence
  Description of Artificial Sequence: Synthetic coding sequence
atggtgaaatgctgcagcgccatcggttgcgcgagtagatgtcttccgaacagcaagctgaagggcttgacctttcacgtctttccaaccgacgagaatatcaagaggaagtgggttctcgctatgaagaggctggacgttaacgccgcaggcatttgggagccaaaaaagggagatgttctttgcagccgacattttaagaagacagacttcgatcggagtgctcctaacatcaagctgtag

SEQ ID NO: 243918 - DNA, 669 bp, Artificial Sequence
  Description of Artificial Sequence: Synthetic coding sequence
atggtgaaatgctgttctgccatcggttgtgccagccgatgcctacccaatagtaaactgaagggccttactttccatgtgttccctaccgacgagaatattaaaaggaaatgggtgctggccatgaagagactggacgtgaacgctgccggaatttgggagcctaagaagggagacgtgttatgctcaaggcattttaaaaaaaccgactttgatcggagcgcaccaaacattaagctgaagccaggcgtgattcctagtatctttgacagtccatatcacctccagggcaaacgcgaaaaattgcactgcaggaagaactttactctgaaaacagttcccgcaacaaattacaatcatcatcttgtgggagcttccagctgcattgaagagttccagagtcagttcatcttcgagcactcatatagtgttatggactcacccaaaaagttgaaacacaaactagaccacgtcatcggtgagctggaggatacaaaggagtctttgaggaatgtgctggacagggagaagcgcttccagaaatctctgcgcaaaacgattcgcgaactcaaagacgagtgcctaatctcccaggagaccgccaaccgcttggacaccttttgctgggattgctgtcaggagtctattgagcaagactacatttcatag

SEQ ID NO: 243919 - DNA, 825 bp, Artificial Sequence
  Description of Artificial Sequence: Synthetic coding sequence
atgcctaaatactgccgggcacctaattgctccaatacggccggaaggctcggagccgacaaccgtcctgtttctttctacaagtttccactgaaggacggtccaagactgcaggcctggcttcaacatatgggctgcgagcactgggtgcccagttgccaccagcacctttgctcagaacactttacaccttcctgctttcagtggcggtggggagtgagataccttcggccagatgccgtaccttccatcttcagccgcggaccacccgcaaaaagtcagcgcagaacacgcagcacacagaagcctgtgtcaccccctccccctttgcagaaaaataccccattgccccaaagccctgcaatacctgtaagcggcccagttaggcttgtggtgctggggccaacgagcgggagcccaaagactgtggctactatgctactcactccccttgcacccgcacctacaccagagcggagccaacctgaagtcccagcccaacaagcacagaccggcctgggccctgtcttgggggcattgcagaggcgggttaggcgcctgcagcgttgccaagagcgccaccaggcccagttacaggctctggagagactcgcccaacaacttcacggagaatctctgctagctagggcaaggagagggctgcagcgtctgactacggcccagactctagggccagaggagtctcagaccttcacaatcatttgcggaggtcctgatatcgcaatggttctggcacaggaccctgccccagccacagtcgacgcgaagcccgagctcctcgacacaagaatcccgtcagcatag

SEQ ID NO: 243920 - DNA, 825 bp, Artificial Sequence
  Description of Artificial Sequence: Synthetic coding sequence
atgccaaagtactgtcgggctcccaattgttctaatacagctgggagactcggcgcagataatcgacctgtcagcttttacaagttcccactaaaggatggccctcgactgcaggcttggctgcaacacatgggctgcgaacattgggtgccgtcatgtcatcaacatctatgctcagagcatttcacgccatcatgcttccagtggagatggggtgtacggtacttaaggccagacgctgtgccatccattttttctcgcggaccccctgctaagtcacagcgacgcacaaggtccactcagaagcctgtctctcccccacccccactgcagaagaacactcccttaccacaaagcccggctataccggtatcaggaccggtcaggttagtcgtgctcggccctacgagcggtagtccaaaaaccgtagctactatgctgctgacccccctcgcacccgctccaacgcctgagcgttcccaacccgaagtgcctgctcaacaggcgcagactggcctgggcccagtcttaggcgctctgcagcggcgtgtaaggcggttgcagcgatgccaggagaggcaccaggctcaactgcaggcactggaacgcctggcgcagcagctgcacggcgagtccctgctggctcgggcacgaaggggattgcagaggttgacgaccgcgcagacattagggccagaggagtctcaaactttcactattatctgtggcggacctgatatcgctatggtacttgcacaggatcccgctcccgcaaccgtggacgcaaagccagaattgctggatactcgcatcccttccgcttag

SEQ ID NO: 243921 - DNA, 390 bp, Artificial Sequence
  Description of Artificial Sequence: Synthetic coding sequence
atgcttctgacgcctctggctccagcacctactcctgagcggagtcagcctgaagtgccagctcagcaggcccagacagggctaggtcctgtgttaggggctctgcaaagacgcgtcagaagactccagcggtgccaggagcgccaccaggcccagcttcaagctctcgaacgcctggcacagcagttgcacggcgagtcactgctggccagggccaggagaggtctgcagcggttaacaaccgcccaaacactaggcccagaagagagccagactttcaccattatctgcggcggtcccgacatagccatggtcttagcacaggatccagcccctgcaactgtcgacgcaaaacccgaattgctggacacccgcataccaagcgcctag

SEQ ID NO: 243922 - DNA, 2712 bp, Artificial Sequence
  Description of Artificial Sequence: Synthetic coding sequence
atgaccagatcatgctccgccgtaggttgcagtacacgggacaccgttctgagcagagagcgaggcctgagttttcaccagtttccaacagacactatacagagatcaaagtggatccgcgcagttaacagagtagacccgagatccaaaaaaatttggattcctggtcccggagctattctgtgtagtaagcactttcaggaatcagatttcgaatcatatgggattaggcgcaagctgaaaaaaggtgcagtaccttctgtgtcgctttacaaaataccgcagggcgtgcatttaaaaggaaaagcgagacagaagattttaaaacaacccctccccgacaacagccaggaggtggccacagaagaccataactacagcctgaagacaccacttactattggtgcagaaaaactggccgaagtgcaacagatgctccaagtcagcaaaaagaggctaatttcagttaagaattaccgcatgattaaaaaaaggaagggcctgcgcttaattgacgcactggttgaggaaaaactcttgtcggaggagaccgagtgtctcttgagggcacagttctcagactttaagtgggagctttataattggagagaaactgacgaatactcagccgaaatgaagcaatttgcctgcacactatacctttgtagcagcaaggtgtatgactacgttcgcaagattctgaagctgccccattcttctatcctgcggacatggctttcaaaatgtcaacctagtccaggatttaactcaaatatattttcattcctgcaacgccgagttgaaaacggcgaccagttgtatcagtactgttccctgctgatcaaatcgatgcctcttaagcaacagttgcaatgggacccatccagccattcactacaagggttcatggacttcggtttagggaaactggacgccgatgagacgcctctcgcctccgaaaccgtgctgttaatggcggtgggcattttcggtcactggcggacgccattaggctatttcttcgtcaaccgcgcatcaggatatctgcaggctcagctgttgcgactaaccatagggaaactctccgacattggtataactgttcttgcagtaacgtcagacgcaacggctcacagcgtgcaaatggcaaaggctcttggcattcacattgatggcgatgacatgaaatgcacgtttcagcaccccagctcatcctcacagcagatcgcttactttttcgattcttgccacctgctgaggttaatacgaaatgcatttcagaattttcagtcaatccaatttatcaatgggattgcccactggcagcatctcgtggagcttgttgctctagaggaacaggagctcagtaacatggagagaataccatcgactctggcaaacctgaaaaaccacgtgcttaaggtgaatagcgcaactcagcttttttcggagtctgtcgcatcggccctcgaatacctgctgagcttggatcttccacccttccaaaattgcataggtacaattcactttctcaggctcatcaacaacttattcgatatctttaattcccgcaattgctacgggaaaggactcaagggacccttgctgcccgagacctactctaagattaatcatgtgctgatcgaggctaagacaatctttgtgacactgtccgacacttcaaataaccagattataaaaggcaagcagaagctgggttttttgggcttcctcctaaatgctgaatcgttgaaatggctctaccagaattatgtgtttcccaaagttatgccatttccttacctcctgacatacaaatttagtcatgaccacctggagttgtttttgaagatgctacgtcaggtgctggttacctcatcaagtcccacgtgcatggccttccaaaaggcatattacaaccttgagaccagatataagttccaggatgaggtgttcctctcgaaagtgtccatttttgacatctcgatcgctagacgcaaggatcttgccctgtggactgtgcagcgccagtacggcgtatcagtgacgaagaccgttttccacgaggagggcatctgccaggattggtcccactgctcactcagtgaagccttactggacttatctgatcaccggagaaatctgatctgttacgcaggttatgtggccaataagctatcagctctactcacctgtgaggattgcatcactgcactttacgctagcgatcttaaggcctccaaaatcgggagcctgctctttgtgaaaaaaaagaatggtctgcattttccctccgaatcactctgcagggtgattaacatttgcgagagagtggtgagaactcactcccgaatggcaatttttgaattagtgagtaaacagagagaactgtacctgcagcagaaaattctctgtgaattgtctggtcacattaatctgttcgttgacgtgaataagcatttgttcgacggcgaggtatgcgccataaaccattttgtgaagctacttaaggatattatcatctgcttcctgaatattagggctaaaaacgttgcgcagaatcccttgaagcaccattctgagagaaccgatatgaaaacgctcagccgcaaacattggtcttccgtgcaggattacaaatgttcttcgttcgccaatacatcttcaaagtttcgacacttgctcagcaatgatggctacccatttaagtag

SEQ ID NO: 243923 - DNA, 2712 bp, Artificial Sequence
  Description of Artificial Sequence: Synthetic coding sequence
atgacaagatcatgtagtgcagtaggatgctcaacaagggacacagtcctgagtagggaaagagggctgtccttccaccagttccccaccgacacgattcagcgctctaaatggattcgggcagttaacagggtcgacccacgcagcaagaaaatatggatccccggacccggagcgatcttatgctctaaacattttcaggaaagcgacttcgaaagctatggcatccgacggaaattaaagaagggcgcagttccgagcgtgtccctgtataagataccccagggtgtccacctcaagggcaaagccaggcagaaaatcctcaagcagcccctgcccgataactcccaagaagtggcaaccgaagaccacaattattctttgaaaaccccactgacaattggggctgaaaaactggctgaagtgcagcagatgttacaggtgagtaaaaagcgcctgatctccgtaaaaaattaccgaatgattaaaaaacggaaaggactccggttgattgacgccctggtagaggaaaaattgcttagcgaagagacggagtgtctgctgcgggctcaattttcagatttcaagtgggaactgtacaattggagagagactgacgaatactccgccgagatgaagcagtttgcgtgcacactgtatttgtgcagttctaaagtttacgactatgtccgcaaaatccttaagctccctcactcatcgatcctgaggacatggttgtccaaatgccagccctccccgggtttcaattcgaatatcttcagctttttacagcgaagggttgagaacggggaccagctgtatcaatattgctcactgctaattaagtccatgccgctgaaacaacagcttcaatgggacccgagtagccactctttacagggttttatggattttgggctagggaaactagacgctgacgagacgccactagctagcgagactgtgctgctcatggctgttggaatatttgggcactggcggacacccctcggatactttttcgtgaatagagcgagcggctatcttcaagcgcaactgcttcgcctgactatcgggaagctctctgatatcgggattaccgtcttggctgttacaagcgatgctaccgcacattcagtgcagatggctaaggctctgggtatccacatagacggggacgatatgaagtgcaccttccagcatcctagcagttcatcacagcagatagcctatttcttcgacagctgccacctgttgagactcataagaaatgcgttccagaactttcaaagcatacagtttattaacggtatcgcacactggcaacacctcgtggaattggtggccctggaagagcaggagttaagtaatatggaaagaatcccctctacacttgccaacctcaaaaaccatgtcctaaaagtaaactcagctacccagctgttctccgagagtgtggcctccgccctggagtatctgctgtctcttgatctccctcccttccagaattgcatcggaaccatccacttcctccgtctcattaacaaccttttcgatatcttcaactctaggaactgctacgggaaagggcttaaggggcctttgctgccagagacatactccaaaatcaaccatgtgttgattgaggcgaagacaatctttgtaaccctgtccgatacatcgaataaccagatcattaaagggaaacagaagctgggttttctgggctttctcttgaatgctgaatctctaaaatggctttatcagaactatgtttttccaaaagtgatgcccttcccttacctgctgacttataagttctcgcatgaccatctagagttatttctgaagatgctacggcaggttttggttacgagctcttcaccaacatgcatggcctttcagaaggcttattataacttagaaaccagatacaaattccaggacgaagtgtttctctccaaggtgtccatctttgacatctccatcgcccgacggaaagatctggccctttggacagttcagagacagtatggtgtgtcggtgaccaagaccgtgttccacgaggagggcatttgccaggactggtcccactgtagtttgtcagaggccctgctcgacctttccgaccataggaggaatttaatatgttacgctggatatgttgccaataagctatccgccttactgacttgtgaagactgcatcacggccctgtatgcgtcagatctgaaggcttccaaaattggctctctgctgtttgtaaagaagaaaaatggcctgcattttccgagtgagagcctatgcagggttatcaacatttgcgaacgcgtggtcagaacacattcaaggatggctatcttcgaactggtgtcaaagcagcgcgagctttacctgcagcagaagatcttgtgcgaactgagcgggcacatcaacttgtttgtcgacgttaacaagcacctctttgacggcgaggtgtgcgcaattaatcactttgtaaaacttctcaaggatatcatcatttgctttctcaacataagggccaagaacgtcgcccaaaatcccctgaagcaccattctgaacgaaccgatatgaaaaccctgtcgcgaaaacactggagcagtgttcaagactataaatgcagcagttttgccaatacttcctcaaagttccggcaccttttgagcaacgatgggtatccttttaagtag

SEQ ID NO: 243924 - DNA, 642 bp, Artificial Sequence
  Description of Artificial Sequence: Synthetic coding sequence
atggtacaatcgtgttcagcgtatggatgcaaaaacaggtacgacaaggataagccagttagcttccacaaattcccgctgactagaccatcactttgcaaggaatgggaggccgcagtccgcaggaaaaatttcaagcccaccaaatattcctccatttgttccgaacattttacccctgactgcttcaaacgcgagtgtaacaataagctgctgaaagagaacgcggtgccaactattttcttgtgcaccgaaccgcatgataaaaaggaggacctgctcgagccacaggaacagctgccaccgcctccactcccccctcccgtgtctcaagtggacgctgccatcggcctgctcatgccaccactccagactccggtgaacctgtccgtcttttgcgaccacaattacactgtagaagacaccatgcaccagcggaaacgaatccaccagctagagcagcaggtggagaaacttagaaaaaagttgaaaaccgcccagcagcggtgtcggcgacaggagaggcaactcgagaagctgaaagaagtcgtgcacttccagaaagaaaaagacgatgtgtcggagcgcggttacgtgattctccctaatgattatttcgaaattgtggaggtgcctgcatag

SEQ ID NO: 243925 - DNA, 162 bp, Artificial Sequence
  Description of Artificial Sequence: Synthetic coding sequence
atggtgcagtcttgttccgcgtacggctgcaaaaaccgctacgacaaggataaacccgtcagtttccataagaagaagatcttctggtcccaccgtaatagtttccctcacctcctctacagacttctgtttcccagactcatgctgctcctcgactactag

SEQ ID NO: 243926 - DNA, 687 bp, Artificial Sequence
  Description of Artificial Sequence: Synthetic coding sequence
atgccaaccaactgcgccgctgccggatgtgccacaacctataacaagcatatcaacatctccttccaccgctttccgctagaccctaagagaaggaaagagtgggttagattggtccggcgaaaaaatttcgtgcccggtaagcacacctttctctgctcaaaacactttgaggcaagctgtttcgaccttacaggacagacgcgtcggctgaagatggacgcagtcccgacaatcttcgatttttgtacccacattaaatctatgaaattaaagtcacgtaatttactgaaaaagaataacagttgctcacccgcaggtccttccaacctgaagtctaacatttcctcccaacaggtcctcctcgaacacagttacgccttccgcaatcccatggaggctaagaagcgcatcatcaaactggagaaggagatcgcctccctgaggcgtaagatgaagacctgtctgcagaaggagcggcgtgcgaccagaagatggatcaaagccacttgtctggtgaagaacctggaggctaacagcgtacttcctaaaggaacatcagaacatatgttgcccaccgcattatccagcctacccttggaggacttcaaaattctggagcaggaccaacaggacaagactctcttgtcactcaacctcaagcagacgaaatctacctttatttag

SEQ ID NO: 243927 - DNA, 720 bp, Artificial Sequence
  Description of Artificial Sequence: Synthetic coding sequence
atgcccaaatcctgtgccgcacgacagtgctgtaacaggtactcctctcgacgcaagcagttgaccttccacaggtttcctttctcccgtccagaactcctcaaggagtgggtccttaacatcggacgcggaaactttaaacctaaacagcacaccgtgatttgttcagagcacttcaggcctgaatgcttttccgcctttggaaaccgcaaaaaccttaagcacaatgccgtgccaacggtcttcgcctttcaggaccctacccaacaagtgagagagaacactgaccccgcttcagaaagaggaaacgcctcaagcagtcagaaggagaaggtactacctgaggccggagcaggtgaggacagccctgggaggaatatggatactgcattagaggaactccagctcccaccaaacgctgagggtcacgtcaaacaggtgtcccccagacggccacaggctacggaagcagtgggtcgtcctacaggcccagccggactccggaggacgcccaataagcagccaagcgaccactcctatgcacttctcgacctcgacagcctcaaaaaaaagctgtttctcaccctgaaagagaatgaaaagctcagaaaacggcttcaggcccaacgccttgtgatgagacgtatgtcctcgcgcctgagagcctgtaaggggcaccaaggactgcaagcacgcctcggtccagagcagcagagctag

SEQ ID NO: 243928 - DNA, 717 bp, Artificial Sequence
  Description of Artificial Sequence: Synthetic coding sequence
atgcctaagtcttgtgccgctcgccagtgctgtaatagatattcctccagaaggaagcagctgaccttccacagattcccgtttagtcgccctgaactactgaaggaatgggtgctcaatatcgggaggggcaactttaaaccaaaacaacataccgtaatctgtagcgagcacttcaggcctgagtgtttctcggcattcgggaatcggaagaacctgaaacataatgccgtgcccaccgtgttcgccttccaagaccccacccaggtccgggaaaacaccgacccggcaagcgagaggggcaacgcatcctcaagccaaaaggagaaagttcttccagaagccggagcgggtgaagacagccctggcagaaacatggataccgctctggaagaactgcagttacctcctaacgctgagggacacgtcaagcaggtgtcaccccgtcgaccccaggctacagaagcagtcggtcgtccgactggacccgctggactgcgtaggacacccaataagcagccatcagatcattcatacgctctgctcgacctcgactcattgaagaagaagctttttctgactctaaaggagaacgagaaattgagaaagaggctgcaggctcagcgcttggtgatgagacgcatgagttcaagattacgggcttgtaaggggcaccagggcttgcaagcgcgactgggtccggaacagcagtcttag

SEQ ID NO: 243929 - DNA, 528 bp, Artificial Sequence
  Description of Artificial Sequence: Synthetic coding sequence
atgcccaagtcttgtgccgctcgccagtgttgcaatcgttacagctctagaaggaaacagttgacttttcaccgcttccctttctcccggcctgagttgctgaaggagtgggtcttgaacattggcagaggcaatttcaaaccaaagcaacatacagtcatttgcagcgaacattttagacccgagtgcttctctgcctttgggaatcggaaaaacctcaaacataatgcggtgcctaccgtgtttgctttccaggaccccacacagcaggtgagagaaaacaccgatcccgcttctgagcggggtaacgcgtcaagtagccagaaagagaagacctcaccgtgccgctctcaggtgcttccggaagcaggcgctggcgaagactcccccggtaggaacatggacaccgccctggaagaactccagctcccgccaaatgcggaaggtcacgtgaaacaggccatgctgtttaacgtagaaaatggaacccccgcttcacgggaagcactatggctgtcagaggagtag

SEQ ID NO: 243930 - DNA, 732 bp, Artificial Sequence
  Description of Artificial Sequence: Synthetic coding sequence
atggagcatgcttttacaccactcgaacccctcctcagtacagggaatttgaaatactgcttagtgattctgaaccagccactcgacaattactttaggcacctttggaataaggctctgttacgcgcttgtgctgatggaggggcaaatcgtttatacgatattactgaaggcgagagagagtcgtttctccctgaattcatcaatggcgattttgactctattcgcccagaagtgagagaatattacgcaacgaaaggatgtgaactgatctctactccagatcaggaccacaccgacttcaccaagtgtctgaaaatgctgcagaaaaaaattgaggagaaggaccttaaggtggacgttattgtgacactggggggtcttgccggacgcttcgaccagatcatggcgagtgttaatacactgttccaggccacccacataacccctttcccaattattataatccaagaagagtccctcatctatctcctccagcctgggaagcatagactgcacgtcgacaccgggatggagggcgattggtgcggtctcattcctgtgggacagccttgtatgcaggtaaccactaccggattgaagtggaatcttaccaacgacgtcttagccttcggaaccctagtttcaacctccaatacgtacgatggctccggcgtcgtcacagtggagactgaccaccccctgctctggaccatggccattaagagttag

SEQ ID NO: 243931 - DNA, 585 bp, Artificial Sequence
  Description of Artificial Sequence: Synthetic coding sequence
atggagcacgcattcacccccctggagccgctgttgtctaccggaaacttgaagtattgtctggtaattctcaatcagccgctcgataactattttcgtcacctgtggaataaagcgctcttgcgggcttgcgccgacggaggcgctaacagactgtacgacattacagaaggggaacgagaaagctttttacctgaattcattaatggagatttcgattcgattcggcctgaagtccgggagtactacgcaactaagggttgcgagttgatctcaacccccgaccaagaccacacggattttactaaatgcctgaagatgctccagaaaaagatcgaggaaaaggatcttaagggcaagcaccgcctgcatgttgacaccggtatggagggagactggtgcggtctgatcccggtgggacagccttgtatgcaggtcacaacgacaggcctcaagtggaacctcaccaacgatgtgctcgcgtttggcaccctcgtgtccactagcaacacatatgatggatcaggagtggtaactgtggagaccgaccatccattactgtggaccatggctatcaagagttag

SEQ ID NO: 243932 - DNA, 375 bp, Artificial Sequence
  Description of Artificial Sequence: Synthetic coding sequence
atggtggacgtgatagtcacgctggggggtctggctggtcgcttcgaccaaattatggcttccgtgaacacgctcttccaggcgacacatatcacacccttcccgatcattataattcaggaggagagcttgatctacctcctccagccaggaaaacatcgtctccacgtagacactggaatggaaggggattggtgcgggctgattccggttggccagccgtgtatgcaggtgacaaccacagggcttaagtggaacttacggacatgcgactacacccgcactacatggatcgccaaggacaatccagtccccaggttgatccggttgatacggctgaaccacatttgcaaggtgcccctagcgatcaagtag

SEQ ID NO: 243933 - DNA, 504 bp, Artificial Sequence
  Description of Artificial Sequence: Synthetic coding sequence
atggaacacgccttcacccctcttgaacccctactttccacaggcaatttaaagtattgtctggtaattctgaaccagcctctggacaattacttccgccacctgtggaacaaagccctcctcagggcttgtgcagacggaggggctaaccgactgtatgatattacggaaggagagcgagaatcattcctgcccgagttcattaacggtgatttcgactctatccggcctgaagtcagggagtactatgctacgaagggttgcgagctgatcagtacacccgaccaggaccatacggattttaccaagtgtctcaagatgctccagaagaagatcgaagagaaagacttaaaagttgatgtcatcgtgacgcttggtggattggccggacgatttgaccagatcatggcgtccgtgaacaccctttttcaggctacacacataaccccattcccaattatcatcatacaagaggagtccttgatctacttgcttcagccctag

SEQ ID NO: 243934 - DNA, 693 bp, Artificial Sequence
  Description of Artificial Sequence: Synthetic coding sequence
atggcccaaggcttgatagaagtggagaggaaattccttccaggaccgggaaccgaagagagactccaagaactcgggggaactcttgagtatcgcgttacctttagggatacttactacgataccccagaattgagcctaatgcaagccgatcactggctgagacgaagggaagattccggttgggagctcaaatgtcctggagctgccggagtgctggggcctcataccgaatataaagagttaaccgcagagcccacaattgtggcccagctgtgtaaagtgctacgcgctgatgggcttggtgccggagacgtggcagccgtgcttgggcctctggggcttcaggaagtggcatcattcgtcaccaagaggagtgcttggaagctagtcctactgggtgctgatgaagaggagccccagctgagagtggatctggataccgccgattttggctacgcagttggggaggtggaggccttagtgcacgaggaggctgaggtccccactgccctggagaagattcacaggctgtcctctatgctcggtgtgcccgctcaggaaaccgcgccagctaagcttattgtgtacctgcagcgctttcgaccccaggattatcaaaggctgctggaagtgaactcttccagagagcgtcctcaggaaaccgaggaccccgatcactgtttgggctag

SEQ ID NO: 243935 - DNA, 693 bp, Artificial Sequence
  Description of Artificial Sequence: Synthetic coding sequence
atggcacaaggtctgattgaggttgagagaaagtttctgccagggccaggtactgaagagcgcctgcaggagctgggtggaactctggaatatcgagtgactttccgcgatacatactatgacactcccgagctctcactaatgcaggccgatcactggttgcggagacgtgaggacagcggttgggaactcaagtgtcccggagcagctggggtgcttgggccacataccgagtacaaggaactgaccgctgagccaactatagtggctcagctgtgcaaggttctccgcgctgatggcctcggggctggggacgttgcggcagtcctgggacctctcggcctccaggaggttgccagcttcgtgactaaacgcagcgcctggaaactggtgctgctgggcgctgatgaagaggagccacagctgcgggtggacttggatacagccgattttggctacgctgtgggtgaggtcgaagccctggtacatgaggaagcagaagtccctactgccctcgaaaagatacaccgtctgtctagcatgttgggggttcctgcgcaggaaactgcaccagccaaattaatcgtgtacctgcaacgctttaggccgcaggattaccagagactgctagaggttaactcctcccgtgagagaccacaggaaacggaagatccggatcattgtctgggctag

SEQ ID NO: 243936 - DNA, 372 bp, Artificial Sequence
  Description of Artificial Sequence: Synthetic coding sequence
atggcccaggggttaatcgaggtggagcgcaagttcctccctggtcctgggacagaggagcgtctacaagagctcggaggcactctggagtaccgtgtgaccttccgcgatacatattatgacacgcctgagctatctttaatgcaggctgaccattggttgaggaggcgggaggactctggatgggaactaaaatgtcccggagccgcaggggttttgggcccacatactgaatacaaggagctgaccgcagaacccactatagttgcacagttatgtaaagtgctaagggctgacggactaggtgcaggcgacgtagcggcagtcttgggacccttgggcctccaagaagtcgcaagctttgtcacatag

SEQ ID NO: 243937 - DNA, 2070 bp, Artificial Sequence
  Description of Artificial Sequence: Synthetic coding sequence
atgaaacctcctgcagcctgcgcgggtgatatggccgatgccgctagtccatgctccgtcgtcaatgatttgaggtgggatctgtccgcccaacaaattgaggaacgaacccgcgagctcatcgaacagactaagagagtgtatgaccaggtgggcacacaggaatttgaggatgttagctacgagtcaactctgaaagcactggcagatgtagaagtgacctacaccgtgcagagaaatattctcgactttccccagcacgtctcccctagcaaagatatccgcacagccagtaccgaggcagataagaagttgtcagagtttgatgtggagatgtctatgagagaggatgtctatcagcggatcgtatggctacaggagaaggtgcagaaggacagtctgagacccgaggctgctaggtacctcgaaagactcatcaagctgggtaggcggaacggcctgcacctgcccagagaaactcaggagaacatcaaacgaatcaaaaagaagctaagtctgctgtgtattgattttaataaaaatctgaatgaggacactacatttctcccattcaccctgcaggagctgggaggcttgccagaggacttcctgaatagtctagagaagatggaggacggcaaactgaaggttacattgaaatatcctcattatttcccactgctaaaaaagtgtcacgtgcctgaaacccgcagaaaagtggaggaggcgttcaactgtaggtgcaaagaagagaactgtgcaatacttaaggaactggtgaccctgcgggctcagaaatctcggcttttgggttttcacactcacgcggactatgtgcttgaaatgaatatggcaaagactagccaaactgtggccacctttttagacgagctggctcaaaagctcaagcccctgggagaacaggaaagggccgtcatactggagttgaagcgagctgagtgtgaacggaggggtctgccctttgatgggagaatccgggcatgggacatgcgatattatatgaaccaggtggaggagacaaggtactgcgtggaccagaatttgctaaaagaatacttccccgtgcaggtcgtgacccacgggctcctcgggatttaccaggagctgctgggactcgcatttcaccacgaagaaggcgcttcagcctggcatgaggatgttcgtctctacacagcacgggacgccgcttctggcgaggtagtaggtaaattttatctggacctctatccccgagagggaaaatatgggcacgccgcatgcttcgggctgcagccgggttgcctgcgtcaggacggcagtcggcaaatcgccatcgctgcaatggtcgctaactttaccaaacctaccgctgacgccccaagccttctgcagcatgacgaagtggaaacctacttccatgaatttggacatgtgatgcaccagttgtgctcgcaggctgagttcgcaatgttctcagggacgcacgttgaacgcgacttcgtcgaagcccctagccaaatgctcgagaattgggtatgggagcaggagcccctgctgcgcatgagccggcattatcgaaccggcagcgcggtcccccgtgaactgctagaaaagctgatcgagagccggcaagccaacaccggcttgtttaatctgagacagattgtcttggcaaaggtagatcaggctctgcacacccagacggacgccgacccggctgaggagtatgcacggctttgccaggagatcttaggcgtccctgccacacccggtaccaatatgcccgcaaccttcgggcatctggcagggggatacgatgcacagtattatggatatttgtggagcgaggtatactctatggacatgttccatacgcggttcaagcaggaaggtgttctcaattccaaggtcggcatggattataggagctgcatcttgaggccaggcggatcagaggatgcatccgcaatgctaagaagattcctcggtagagaccctaaacaggacgccttcctcctgagtaagggcctgcaggtcggtgggtgtgagccagagccccaggtgtgttag

SEQ ID NO: 243938 - DNA, 777 bp, Artificial Sequence
  Description of Artificial Sequence: Synthetic coding sequence
atgttttcgggtactcacgtcgaacgtgactttgtggaagccccttcccagatgcttgagaactgggtgtgggaacaagaaccactgctccggatgtcaagacattataggacaggttccgccgtgcccagagagctgcttgaaaagttgattgaaagccgtcaggccaacacaggccttttcaatttgagacaaatcgtgctagctaaagtcgatcaggccctacacacacagacagacgcagaccctgcagaggagtacgccagactgtgtcaggagattcttggagtgccagccacccctgggactaacatgcccgctactttcggtcatttagctgggggttacgacgctcaatactatgggtacctgtggagtgaagtttactctatggatatgtttcatactcgcttcaagcaggagggtgtattgaattctaagtttccacactatgaggtccgaccacttagacatgtgtcgctctgcctacccctgacgtggtgtgatcctggcagtgggcaaccccctgaatccctaacaaggaataggtggctgcctgctttgagagccggtcctgctctgccagggtgcaacatagcgcttgggtcactgcaagtgggtatggattatcgaagctgcatcctcaggccaggcggatcagaagatgccagtgccatgctgaggcgattcctgggcagggatccaaagcaggatgccttcctcctgtcaaagggtctgcaggtcggcggttgcgagccagagccacaagtttgctag

SEQ ID NO: 243939 - DNA, 738 bp, Artificial Sequence
  Description of Artificial Sequence: Synthetic coding sequence
atggatggtacccgaaccagcctggacattgaggaatatagtgatactgaggtacagaagaaccaggtgttgacactggaggagtggcaagacaagtgggttaacggcaaaacggcctttcaccaggaacaagggcaccaactactgaagaagcacctggatactttcttaaaggggaagagcggactgagagtgtttttcccactgtgcggtaaagcagtggaaatgaagtggttcgctgacagagggcacagtgttgtgggagtcgagatttcagagttgggcatccaggagttctttaccgagcagaatctgtcatacagcgaggaaccaataaccgaaatcccaggaactaaggtatttaagagcagctccgggaatattagcttgtattgctgcagtatcttcgatcttcctaggactaatattgggaaattcgatatgatttgggatcgtggggctctggtcgctattaatcccggagaccggaagtgctacgcggacacaatgttcagcctcctggggaaaaaattccagtacctgctgtgtgtccttagctacgacccgacaaaacatcctggaccccctttctatgtccctcacgcagaaattgagaggttattcggaaagatttgtaacattcgttgcttagagaaagtggacgcgttcgaagagagacacaagtcttggggcatcgactgcctcttcgaaaaactctatctgcttacagagaaatag

SEQ ID NO: 243940 - DNA, 519 bp, Artificial Sequence
  Description of Artificial Sequence: Synthetic coding sequence
atggagacgaggcccaggctgggggctacttgcctgctggggttcagttttctgctactggtgattagcagtgacggacacaatggtctggggaagggctttggcgatcacatccactggcgaacacttgaagatggtaaaaaggaggccgcagcctcaggcctccctttgatggtcattatccacaaatcttggtgcggtgcctgtaaagcattgaagcctaagtttgctgagagtactgagatcagcgagctcagtcataattttgtcatggtcaatcttgaggatgaagaagagcccaaagacgaagatttttcgcctgacggcggttacattcccaggatcctgttcctcgatcctagcggcaaagtccatccagaaatcatcaacgagaacggcaaccctagctataaatacttctacgtgtccgcagagcaggtagtccaagggatgaaggaagcacaagagagattgaccggcgacgcctttagaaaaaaacatctggaagatgaactttag

SEQ ID NO: 243941 - DNA, 1767 bp, Artificial Sequence
  Description of Artificial Sequence: Synthetic coding sequence
atggccagcaagaagagagaagtccagctccagacggtcataaataatcagagcctgtgggacgagatgcttcagaataagggactgacagtgatcgacgtgtatcaggcttggtgcgggccatgtcgcgctatgcaacctctgtttagaaaacttaagaatgaactaaacgaagatgaaatcctgcactttgccgtcgccgaagcagataatattgtgacactccaaccttttagagacaagtgtgaacccgtgttcctgttttccgtgaatggaaagatcatagagaagatacaaggagccaatgccccacttgtaaataagaaggtgatcaacttaattgacgaagagcggaagatcgctgcgggtgaaatggcaagaccacagtaccctgagataccactggtcgactccgactcagaggtgagcgaggagtccccttgcgaatccgtgcaggaattgtattctatcgcaatcatcaaacctgacgccgtcatttccaagaaggtgctggagattaaaaggaagattacaaaggccggattcatcatcgaagccgagcacaaaaccgttttaactgaggagcaagtcgtaaacttttacagccggattgccgaccaatgtgattttgaggaatttgttagctttatgacttctggtttaagctacatccttgtggtttctcaaggttccaaacacaaccctccctccgaagagaccgagccccagacggatactgagcccaacgaacgaagcgaggaccagcccgaggtggaagctcaggtcacccccggtatgatgaagaacaagcaagattctttacaagaatacttggagagacagcacctcgcacagctgtgtgatatagaggaagatgccgcaaacgtggccaagtttatggacgctttttttcctgactttaagaagatgaagtcaatgaaactcgaaaaaactctcgccctattgcggccaaatctctttcatgaaaggaaagatgatgtgttgaggattattaaggatgaagatttcaagatcctggagcaacgacaggtggtgcttagtgaaaaagaggcccaggcgctgtgtaaagagtatgagaatgaggattatttcaacaagctcattgaaaatatgacaagcggtccgagcctggcactggtcctgctaagggataatggcctgcagtattggaagcagctactgggccctagaacagtagaggaggcaatcgagtacttccccgaatcgttgtgtgctcagtttgcgatggactcactccccgtgaaccagctgtacggatctgactccctggagacagcagagcgggagattcaacatttttttccgttgcagtcgaccctgggattaatcaaacctcatgcaacttctgaacaaagggagcagatactgaagattgtgaaagaagcgggatttgatctgacccaggtgaagaagatgtttcttacgcctgaacagatcgaaaagatctaccctaaagtcaccggaaaggacttttataaagacctgctggagatgctgtccgtcggaccttcgatggtcatgattctcactaagtggaatgccgtggccgagtggagacgcttaatgggtccaactgacccagaagaggcgaaactattgtctcccgatagtatccgcgcacagttcggaatctcaaaactaaaaaacatagtgcatggggcttctaacgcctatgaagctaaagaggtagtcaacagactgttcgaggaccccgaggaaaattag

SEQ ID NO: 243942 - DNA, 1767 bp, Artificial Sequence
  Description of Artificial Sequence: Synthetic coding sequence
atggctagcaagaagcgcgaagttcagctgcaaactgtgattaacaatcagtccctgtgggatgagatgctgcaaaacaagggactgactgtcattgacgtatatcaggcctggtgtggtccgtgtagggccatgcaacctttatttcgcaaactcaaaaatgaactgaatgaggacgaaatactgcactttgctgttgccgaggcagataatatcgtgacacttcagccttttcgggacaaatgtgaacccgtctttctgttctcagtgaacggaaagattatcgagaagattcagggcgcaaacgcaccccttgtcaataagaaggtcatcaatctgatcgacgaagaacgaaaaatcgcagctggcgagatggcacggcctcagtacccagaaatcccgctcgtcgattcggactcagaggtctctgaagaaagcccgtgtgagtccgtgcaggagctatatagcattgccatcattaaaccagatgccgtgatttccaagaaggtcttggaaattaagagaaagattacaaaggccggtttcattatcgaagccgaacataaaaccgtattgacggaagaacaggttgtgaacttttactccagaatcgctgatcagtgcgactttgaagaatttgttagtttcatgactagtggtctctcctacatcctggtggttagccagggaagtaaacacaatcccccttctgaggaaacagagcctcagaccgacacagaacccaacgagcggtcggaggatcaacctgaggtggaagcccaggtgacccctgggatgatgaagaacaagcaagacagtctgcaggaatacctcgaaagacagcatctggcccaactgtgcgatatcgaggaggatgctgccaatgtggctaaattcatggatgcattttttcctgacttcaaaaagatgaagtccatgaagttagagaagactcttgccctccttcgcccaaatctatttcacgaacgtaaggatgatgtgctaaggattatcaaggatgaagattttaagatcctcgaacagaggcaggttgtgctgtcagaaaaagaggcacaggcactgtgtaaagagtatgaaaatgaagactactttaacaaactgatcgagaacatgacctcaggtcctagcctggccctggttcttctcagggacaatggccttcagtactggaagcagctgcttggcccaagaacagtggaggaggccatcgagtatttcccagaaagcctgtgtgcacagtttgccatggattccctccctgtcaatcagctgtacggtagtgacagccttgagacagctgaaagggagatccaacacttcttccccctgcaatccactttaggacttatcaagcctcatgccacctcagaacagagggaacagatactgaaaatcgtgaaagaggctggattcgacctgacgcaagtgaagaagatgttcttgacgccagagcagattgaaaaaatttatccaaaggtaacgggcaaagatttttataaagacctgcttgaaatgctgagcgtcgggccttcaatggtgatgattctgaccaaatggaacgcagtcgccgagtggcgacggctcatggggccaaccgacccagaagaggcaaagctactgtcccccgattcaattcgagcccaattcgggattagcaagttaaagaacattgtgcacggcgcatcgaatgcttacgaagcaaaggaagtggtgaaccgcttgtttgaagacccagaggagaattag

SEQ ID NO: 243943 - DNA, 681 bp, Artificial Sequence
  Description of Artificial Sequence: Synthetic coding sequence
atggaggccgacgcatccgttgacatgttttccaaggttctggaacatcagctactgcagaccactaagcttgtggaagaacacctggattccgaaattcaaaagttagaccaaatggatgaagacgaactggagagactgaaggagaaacgtctccaggctctgcgtaaagcccaacagcagaagcaagagtggctgagcaaggggcacggggaatacagggaaattcccagcgagcgggatttcttccaggaagtaaaagaaagcgaaaatgtagtatgtcacttctatcgtgattccaccttcagatgtaagatcctggatagacacctggcaatcctgagtaagaaacacctggagactaaattcctcaagctcaacgttgaaaaagccccattcctctgcgaacgtctccacattaaggtgattcccaccctcgccctgctgaaggacgggaagacccaggattacgtcgtggggttcactgacctgggcaacacagacgacttcacgactgagacactggagtggcgcctgggttcttccgacattttaaactattctgggaatttgatggagcccccattccagaatcagaagaaatttggcaccaattttaccaaacttgaaaagaagaccatccggggaaagaagtacgattctgacagtgacgacgactag

SEQ ID NO: 243944 - DNA, 408 bp, Artificial Sequence
  Description of Artificial Sequence: Synthetic coding sequence
atggaggcagatgcctcagttgacatgttctccaaagtgctggagcatcagctgctccagactactaaattagtcgaggagcacctggattccgaaatccagaagctggaccagatggatgaggacgaattggaacgactaaaagagaagcggcttcaggctctgaggaaggcacagcagcagaagcaagagtggttgtccaaggggcatggcgagtatagagagattccctccgagcgagattttttccaggaggtgaaagagtctgagaacgtcgtctgtcatttttatagagactccactttccggtgtaaaatactggatcggcacctcgcgatcttaagcaagaaacatttggagacaaagtttttgaaattgaatgttgagaaagcgccttttctgtgttag

SEQ ID NO: 243945 - DNA, 627 bp, Artificial Sequence
  Description of Artificial Sequence: Synthetic coding sequence
atgtcgcagaagtcattggctcctagattgaattcagtgccgtttggtcgcatggaagctgacgctagtgtggacatgttttcgaaagtgctcgagcatcaactgctgcagactaccaaactcgttgaggagcatctggactctgagatccaaaaactcgaccagatggatgaggacgagttggaacgtctgaaggagaagaggctgcaggcgcttaggaaggcacagcagcagaaacaagagtggctgagcaaagggcatggcgagtaccgggaaattccatctgaaagggacttttttcaagaagtaaaagagtcagagaacgttgtctgccacttttaccgtgattccacattccgctgtaaaatattggatcgacacttggcaatcctctccaaaaaacacttagaaacaaagtttttaaaactgaacgtggaaaaagcaccctttctttgcgagcgccttcatattaaagtcatacccacactggccctgctcaaagacgggaaaactcaggattacgtggtcgggtttactgatctcggaaataccgatgattttaccactgagacactcgaatggagactggggtccagtgacattctaaactatcgctggtggccttag

SEQ ID NO: 243946 - DNA, 1017 bp, Artificial Sequence
  Description of Artificial Sequence: Synthetic coding sequence
atggccgcaatggctgtggcgctgagaggattgggcggaagattccggtggcgaacacaggcagtggccggtggcgtcagaggggcagccagaggcgcagccgcaggccaaagggactacgatttgctggtcgtgggcggagggtcgggtggactggcctgcgcaaaagaagccgctcagctgggccgtaaagtggcagtcgtggactacgtggagccaagcccgcaaggcacccggtggggtctggggggaacatgcgttaatgttggctgcattcctaagaaactcatgcaccaggccgcactgctcggcggacttatacaggacgcacccaactatggatgggaggtcgctcagcctgtgccccacgattggcgcaaaatggcagaggccgtgcagaaccacgttaagagcttgaactgggggcacagggtccagcttcaggatcggaaggtcaagtatttcaatattaaggcatcttttgttgacgagcacaccgtttgtggggtcgcgaagggcggaaaagagatactcttaagcgctgaccacattattatagcaacaggagggcgaccgaggtacccaacacacatcgagggagcccttgagtatggcattacatccgatgatatcttctggctgaaagagtcccccggaaagactctcgtggtgggtgcctcatacgttgctctcgagtgtgcaggatttctgacaggaatcggcctggacaccacaattatgatgcggagtatccccctgagaggatttgatcagcagatgagctctatggttatagagcacatggcctcccacgggacccggttcttaagggggtgtgccccatccagagtacgtcgactccccgacggccaactccaggtgacctgggaagacagcaccactgggaaagaagatacaggtaccttcgacacagtgctgtgggctatcgccccttgtatttcggcctgcctacctaccaccgtggggcatgcaggcaagaaccagaggcgcgattag

SEQ ID NO: 243947 - DNA, 1485 bp, Artificial Sequence
  Description of Artificial Sequence: Synthetic coding sequence
  Description of Combined DNA/RNA Molecule: Synthetic coding sequence
atggaggatcaggcgggacaacgcgactacgatctgcttgtggttggtggcggatcaggcggactggcctgcgccaaagaggccgctcagttgggaaggaaggtagcagtcgttgactacgttgaaccatcccctcaggggacgaggtggggactcgggggtacctgcgtcaatgtgggctgtatcccaaaaaaactaatgcaccaggcagctttgctgggcggattaattcaggacgctcccaattatgggtgggaagtggcccagcccgtgccccatgactggagaaaaatggccgaggccgtgcagaaccacgtgaagtcattaaactgggggcatcgtgtacagctgcaggacagaaaagtgaaatatttcaatatcaaagcatctttcgtcgatgagcacaccgtgtgcggggtcgctaagggcggaaaggagattctgctgagtgccgatcacataatcatagcgactggcggaaggccaaggtatcctacgcatatcgagggagccctagagtacggaataacttccgatgacattttctggctgaaggaatccccaggcaagactcttgtcgttggagcgagttacgtcgcactggaatgtgccggattccttaccggtatagggctggatactaccatcatgatgagatctattccactgcgcggattcgatcaacagatgtcgtctatggtgatagagcatatggcctcccacggcactcggtttctgcgtggctgcgccccatcccgggtgcggcgactgccggatggacagctccaagttacttgggaggactctacaacaggcaaggaggataccggcacctttgacacagtgctgtgggccatcggacgcgttccggacacaaggtctctgaacctggaaaaggctggggtggacacctcccctgacacccagaagattctggtggactcaagggaggcgacctctgtaccacacatctacgcaatcggtgatgttgtcgagggcagaccagagctgactcctattgcaatcatggctggtcgtctgctcgtacaaaggctcttcggaggtagctctgacctgatggactacgacaacgtgcccacaaccgtgttcactcctctggaatatgggtgtgtgggcctgtcagaagaggaagccgtggcccgacacggacaggaacatgttgaggtttaccacgcccattacaaacccctggaatttactgtcgcgggacgcgatgcatctcagtgttacgtaaaaatggtttgccttcgagagcctcctcaactggtcttaggcctgcactttttaggcccaaatgccggtgaggtcacccagggcttcgctcttggaattaagtgtggcgcaagttacgcccaggtcatgcgcacggttggtattcaccccacatgctccgaagaggtggtaaagcttagaatcagcaaacgatcaggtctggatcccaccgtgacaggttgtugaggctag

SEQ ID NO: 243948 - DNA, 1575 bp, Artificial Sequence
  Description of Artificial Sequence: Synthetic coding sequence
  Description of Combined DNA/RNA Molecule: Synthetic coding sequence
atggccgctatggccgtggcactacgcggattgggcggtcgtttcagatggcggacacaggccgtggccggtggggtacgaggtgctgctcgcggagctgctgccggacagcgcgattacgatcttctcgttgtgggcggaggctccggcggacttgcctgcgccaaagaagccgctcagctcggcaggaaagtggccgtggtggactacgtggaaccttcccctcagggcaccaggtgggggcttggaggaacctgtgtcaatgtgggttgtatccccaagaaactcatgcaccaggcggctctgcttggcggactgattcaggacgcccctaattacggctgggaagttgctcagcctgtaccccatgattggcgaaaaatggccgaagcagtccagaatcacgtcaagagtctcaactggggacatagggtgcagttacaggaccggaaggtgaaatacttcaatatcaaagcctcctttgtcgacgagcatactgtgtgcggggttgccaaggggggaaaggaaatacttctgagcgctgaccatatcattatcgcaaccggcggacggcctagatatcctacacatattgaaggtgcattggaatatggcatcacgtccgatgatatcttttggttaaaggagagtccaggcaagacattagtcgtcggtgcctcgtacgtggctttggagtgcgccggtttccttacagggatcggccttgatacaaccataatgatgcgatccatcccacttcgcggatttgatcagcaaatgtcatccatggtgattgaacacatggcttcgcacggcacgcgctttttgcgaggctgtgccccatccagggtgaggaggctcccagacggacaacttcaggtcacctgggaagatagcacaacaggcaaggaggatacagggaccttcgacaccgtgctgtgggcaatcggtcgggtgccggatacgcggagtctcaatttggaaaaagcaggtgtggatacatcacccgatacgcaaaagattctggttgactcgagggaagcaacgagcgtgccccacatttatgcaattggagacgttgtcgagggcagacctgaactcacaccaatcgcgattatggctggacgcctactggtgcagcgcctatttggtggcagtagcgatctcatggattacgataacgtgccaaccactgtgtttacgccccttgagtatggatgtgttgggctgagtgaagaagaggccgtagcgaggcatggccaggaacacgtcgaagtctaccacgctcactacaaacccttagagtttaccgtggccggacgggatgcgtcacagtgctatgtgaagatggtgtgcttgcgtgagccccctcagcttgtcttgggacttcactttttggggccaaatgctggagaagtgacacaaggtttcgcactgggtattaaatgtggagccagctacgcccaggtgatgcgtacggttgggatccaccccacatgttctgaggaagtggtgaaactgaggatttccaaacgatccgggttggatcccacggtcacaggatgcugagggtag

SEQ ID NO: 243949 - DNA, 1566 bp, Artificial Sequence
  Description of Artificial Sequence: Synthetic coding sequence
atggcggcaatggcggtcgccttaagagggctcggcggacgcttcaggtggcgcacccaggctgtggctggcggagtgcgcggtgcagcacgcggtgccgctggacagagagactacgatctgctggttgtcggaggtggaagtggaggactggcttgcgcaaaggaagccgcacagttggggcgtaaggtggcagtggtggactacgtcgaaccaagcccgcagggcactcgctggggccttggaggtacgtgcgttaacgtgggctgcattcctaaaaagttgatgcaccaggcagccctcctgggtgggttgattcaagacgcccctaattatggatgggaagtggcccagccagtacctcacgactggagaaaaatggccgaggcagtccagaaccatgttaagtctttgaactgggggcatcgagtacaattgcaggaccgcaaggtcaaatactttaatatcaaggcctccttcgtggatgagcacactgtgtgcggagtggccaagggtggtaaagagatcctgctgagtgccgatcacatcatcattgctaccggcggacgcccacgttatcccactcacatcgaaggagccttagagtatgggattacatccgatgatatcttttggctcaaagagtccccaggcaaaactctggtggtcggcgcatcttatgtggctttggagtgtgcaggctttctgactggaatagggctggacacaaccattatgatgcggagcatcccgctccgcggttttgaccagcagatgtcctcgatggtgatcgagcacatggcttcccacgggactagattcctaaggggttgcgccccatcgcgcgtccgcagactccctgatgggcagctacaggtcacgtgggaggactccacgacagggaaagaggatactggcactttcgatactgtcctctgggcgattggcagagttcctgatacgcggagccttaatctggagaaagctggggttgacacaagccccgacacccagaaaatactggtggactctagagaagctacaagtgtgccccatatttacgcgattggcgacgtggttgaaggccgacccgaactgacgccaattgccataatggccggaagattactcgtgcaacggctgttcggaggttcaagtgacctcatggactatgacaatgtaccgaccacagtgtttactccgttggagtatggttgcgtcggcctaagcgaagaggaggctgttgccaggcacgggcaagaacacgtagaagtgtaccacgctcattataagcctttggagtttaccgtcgctgggcgagacgccagccagtgttatgtcaaaatggtctgtctgcgcgaacccccacaattagttcttggactacacttcctcggcccaaacgcaggggaagtcactcagggcttcgccctcggaatcaaatgtggcgcttcttacgcacaggtgatgcgcacagtagggattcaccctacttgttctgaggaagtagtaaaactgaggatctctaaacggtcggggctagatcctactgttaccggttgttag

SEQ ID NO: 243950 - DNA, 1569 bp, Artificial Sequence
  Description of Artificial Sequence: Synthetic coding sequence
atggcagcaatggccgtggccctgcgcggacttggcggtaggttccgttggaggacgcaggctgttgcaggcggtgtgcgaggggcagccaggggcgctgccgcaggccaaagggactacgatcttttggtcgtaggcggaggcagcggaggcctggcgtgtgcaaaagaggcagcacagcttggacggaaagtggcggtagtggactacgtggagccatccccacagggaactagatggggcctgggtggcacttgcgtgaacgtcggctgtattcccaaaaagctgatgcaccaagcagcactgctgggagggttaatccaggatgcacccaactacgggtgggaggtggcccagcccgtcccccacgactggcggaaaatggcagaggccgtgcagaatcatgttaagagcctcaattggggacatcgcgtacagctgcaagacaggaaggtcaaatattttaacataaaggcatccttcgtcgacgagcacaccgtttgcggcgtagcaaaagggggaaaagaaattctgctcagtgccgatcacatcattatagctaccggaggaaggcccaggtacccaacacatatcgagggtgccctcgagtatggcataaccagcgatgatattttttggttgaaggagtctcctggcaaaacgctccccgtttccgtctcctatgtagctctcgaatgtgcaggattccttaccgggatcggattagatacaactatcatgatgaggagtataccacttcggggattcgatcagcaaatgtcatctatggtcatcgagcacatggcctctcacggcaccagatttctgagaggctgtgctccatccagggttcgcagactaccggacggacagctgcaggtgacttgggaggatagtaccaccgggaaagaagacacaggaaccttcgacaccgtcttatgggccatcgggagagtgcctgacacacgatcattgaacctcgagaaggccggagtcgacactagcccagatacacaaaaaattctagttgactctcgtgaggctacttcagtcccacacatttatgcaatcggagacgtggttgaggggcgtccggagctgacccccattgccatcatggcaggacgcctcctggtccagcggctgtttggtggcagctcagacttaatggactacgataatgtgccaacaactgtgttcacccccctagagtacggatgtgttggactctctgaggaggaggctgtggcaagacatggacaggaacatgtggaagtgtatcacgcccattacaagccactcgagtttaccgttgctggcagagacgccagccagtgctacgtgaaaatggtgtgtttacgtgaacctccacagctggtgctggggctgcatttcctgggccctaacgccggagaagtcacccagggatttgccctgggcataaaatgcggagcctcttacgctcaggtgatgaggacggtgggaatccatccgacttgcagcgaggaggtcgtgaagctcaggatttcaaagcgtagcggactcgatccaacagtaactgggtgctag

SEQ ID NO: 243951 - DNA, 1281 bp, Artificial Sequence
  Description of Artificial Sequence: Synthetic coding sequence
atgcatcaggccgctcttcttgggggactcatacaggatgctccaaattacggatgggaggtggcgcagcctgttccccacgactggaggaaaatggcagaagcagtgcagaatcatgtgaaaagtctcaattggggccatcgtgttcaactgcaagaccggaaggtgaaatacttcaatattaaagcttcatttgtcgatgaacacactgtgtgcggggtggcgaagggtggtaaggaaattctgctcagcgctgatcacatcatcatcgcaactggcggacggcctcggtatccaacgcacatcgagggcgctctcgagtacggtatcacaagtgatgatatcttttggcttaaggagagtcctgggaaaacatgcgtggtcgcacatgcatatgtagccctggagtgcgccggattccttacaggcatcggcctagatacaacgattatgatgaggagcatccctttgcgcggattcgaccagcagatgtcaagtatggttatcgagcacatggcaagtcacggcacgcggtttttaagaggctgtgccccttcgagggtgcgcagactgccagatggacagcttcaagtcacctgggaggacagtacaacggggaaagaggacaccgggaccttcgataccgtactctgggccattggcagagttcctgacacccggtccttgaacttagaaaaagccggtgtagatacgtctcctgatactcagaagattttggtagattcaagggaggcaacctccgtaccccatatttacgccatcggtgacgttgtcgagggacggccagaacttacacctattgcaataatggccggtcgcctgttggttcaacgcctgtttggtggtagcagcgatctgatggattatgataatgtacccacaacagtgtttactccccttgagtatggttgtgtcgggcttagtgaagaggaggccgtggcacggcatggtcaggagcacgtcgaagtgtaccacgcgcactacaaacccctggagttcaccgttgctgggcgagatgccagccagtgctatgtaaaaatggtatgcctgcgtgagccccctcaactcgtgttaggactgcatttcctcggaccaaacgcgggagaggttacacagggatttgcactcgggattaaatgcggggctagctacgcacaggttatgaggaccgtgggcatacatccgacctgttcagaggaggttgtgaagctccggattagcaagcggtctggactcgatcctactgtaaccggctgctag

SEQ ID NO: 243952 - DNA, 1479 bp, Artificial Sequence
  Description of Artificial Sequence: Synthetic coding sequence
atggaagatcaggccggtcaacgcgactatgacctcttggtggtaggtggtggatcaggagggttggcctgcgctaaagaagccgctcagctggggcgtaaagtcgctgtagtggactatgttgaaccttctccacaaggcactcggtgggggctgggcggaacctgtgtcaatgtggggtgcatccccaagaagttgatgcaccaagccgctctcctcggtggcctgatacaggacgcacccaactacggttgggaggtcgctcaacccgtgccgcacgactggcgtaaaatggccgaggccgtgcaaaatcacgtgaaatctctaaactggggacaccgtgtccagctccaggatcggaaggtgaaatacttcaatatcaaggcctcgtttgttgatgaacatactgtgtgcggcgtggccaagggtggtaaggagattctcctgtccgccgaccatatcattattgctactggcggacggcctaggtatcctacccatatcgagggggctctcgagtatgggattacatcggatgacatcttctggcttaaggaaagccccggaaagactttggtggtaggggcttcgtacgtggccctggagtgcgcaggtttcctgactggtattggacttgacactactattatgatgcgatccattcctctaaggggattcgaccaacaaatgtcatccatggtgatcgagcacatggccagccacggaacaagattccttcggggttgcgcaccatcccgcgtgaggcgcctcccggatggccagctgcaggtgacctgggaggacagtacaacaggtaaagaggacaccgggacatttgacactgtgctgtgggccattgggcgagtgcccgatactcggtctttaaatcttgagaaagctggggtggacacttctcccgacacacagaagatactcgtggattcccgtgaagccacgtccgtgccccatatctatgcgataggtgatgtggtggaagggaggcctgagctgacgccaatcgccattatggccggacgcctcctggtgcaacggctattcggaggctcttcagatttgatggactacgacaacgtgcctactactgtatttactcccctggagtacggatgtgtcggactgtccgaggaagaggccgtggcgagacacggtcaagagcacgtcgaggtatatcatgcacactacaaacctctagaattcaccgtggcgggtcgtgacgcctctcagtgctatgtgaaaatggtctgcctgcgagaaccgccacagctggtgttggggctacacttcctgggacctaatgccggagaggtaacccaggggttcgcccttggtatcaagtgcggggcatcttatgctcaggttatgcgcaccgtcggaattcatcccacgtgctcggaggaggtcgtgaagctgagaatcagcaaacggtccggcctggacccaactgttactgggtgctag

SEQ ID NO: 243953 - DNA, 429 bp, Artificial Sequence
  Description of Artificial Sequence: Synthetic coding sequence
atgagctatatgctgcctcatttacataatggatggcaagttgaccaggcaattctgagtgaggaggacagagtcgtggtgattcggtttggccatgattgggatcctacttgcatgaagatggacgaagtgctgtacagcattgctgaaaaagtgaaaaatttcgctgtgatctatctggtggatattaccgaggtaccggactttaacaaaatgtacgaactttacgatccctgtactgtgatgttttttttcaggaataagcatatcatgattgatcttggaacaggaaacaataacaagattaactgggccatggaagacaagcaggaaatggtggacattattgagacggtttaccgaggggctcggaaagggcgaggtctggttgtgagccccaaggactactccactaagtaccggtattag

SEQ ID NO: 243954 - DNA, 276 bp, Artificial Sequence
  Description of Artificial Sequence: Synthetic coding sequence
atgagctacatgttgcctcacctgcataatggttggcaggtggaccaagccatcctcagcgaagaagacagggttgtagtgatcaggttcggtcacgattgggatccgacctgcatgaaaatggacgaggtattgtactcaatagccgagaaggttaaaaattttgcagtcatctacctcgtggacataactgaggtgcctgactttaacaagatgtatgagctttacgacccatgtacagtcatgttttttttctcttaccaccgtggttggtag

SEQ ID NO: 243955 - DNA, 894 bp, Artificial Sequence
  Description of Artificial Sequence: Synthetic coding sequence
atggtacaccaggtcctttaccgggctttggtcagcacaaaatggctggctgaaagcatccgaacagggaaactgggtcccggattgcgcgtattagacgcgagctggtattctcctggaacacgggaagccagaaaagagtacctggagagacacgtgcccggtgctagtttcttcgacattgaagaatgccgagacaccgccagcccctatgaaatgatgcttccctccgaggctggcttcgctgagtacgtgggtcgattaggaattagtaaccacacccacgtggtcgtgtacgacggggagcatctgggctccttttacgccccacgcgtctggtggatgtttagagtgttcggtcaccgaaccgtgagtgttctgaatgggggattccgtaactggctgaaagaaggacaccctgtcacaagcgagcctagccgtccagagccagccgtctttaaggccacactcgacaggtctcttctgaagacatacgaacaggtgctggagaaccttgagtccaagcggtttcaactcgtagattctcggagtcagggcaggttcctgggaaccgagcccgaacctgacgcggtcggcctggacagtggacatattcgcggagcagttaacatgccgtttatggatttcctcacagaggacggcttcgagaagggccctgaggagctccgtgccctattccagaccaagaaggtagacttgtctcagccattgattgcaacttgtagaaagggagtcacagcctgccacgtggccctggcagcctatctctgcggcaagcctgatgttgcggtatatgacggctcatggtctgagtggtttcgaagagccccacctgagtctcgcgtgagccaggggaaaagcgagaaggcttag

SEQ ID NO: 243956 - DNA, 894 bp, Artificial Sequence
  Description of Artificial Sequence: Synthetic coding sequence
atggttcatcaggtgctatacagagcgctcgtctccaccaagtggctggccgagtccatcaggaccggaaagctcggccctggcctgcgagtgctagatgcatcttggtactcacccggtaccagagaggctcggaaggaatacctggagcggcatgtacctggcgcttccttctttgatattgaggagtgccgggatacggcttccccatacgaaatgatgttgccttctgaagccggattcgcggaatatgtcggtcgtttaggcatcagcaaccacacacatgtggtggtgtatgacggggaacacctcgggagcttttacgcacctagggtttggtggatgtttagagtctttggccatcgtactgtgtccgtgctgaatggaggatttagaaattggctcaaggaaggccatcctgtgacttcggaaccgtcgcggcctgagcctgcagtgttcaaggcaaccctcgacagaagtctgctgaagacctacgaacaggttcttgaaaacctggagagtaagcgttttcagcttgttgatagtaggtctcaaggcaggtttctgggaacggagccggagcccgacgccgtcggattagatagcggccatatccggggagcagtgaatatgccattcatggattttttgaccgaggacgggtttgaaaagggacccgaagaactgcgagcgttatttcagactaaaaaggtggacctgagtcagcctctcatagccacctgtcggaaaggggtcacagcttgtcacgtggctctggctgcctacctgtgtggtaagccggacgtggctgtgtacgacgggtcatggtcagagtggttcagacgtgcccctcctgaaagcagagtttcacagggtaagagcgagaaagcttag

SEQ ID NO: 243957 - DNA, 735 bp, Artificial Sequence
  Description of Artificial Sequence: Synthetic coding sequence
atggtgcatcaggtcctgtatcgcgctctggttagcaccaaatggcttgccgaatctatacgcaccggcaagctgggacctggactgcgggtgctcgacgccagctggtatagtccaggaacaagggaagccagaaaagagtacttagaacgacacgtgccgggtgcttcgttctttgatatcgaggaatgtagagacacggcaagtccatatgagatgatgttgccatccgaggcgggtttcgctgagtacgtgggcagactcgggatttctaaccacacacacgtggtagtctatgacggggaacatctgggaagcttttatgctcccagagtctggtggatgttccgagtgttcggtcataggaccgtcagcgtactgaacggcggttttaggaactggctgaaagagggtcaccctgtgacgagtgaaccaagccgacctgaaccagcagtcttcaaagcgacgttggatcgctctcttcttaaaacttatgaacaagtcctcgagaatctggagtccaagcgattccagctcgtcgactcccggagccaaggcagatttctgggaacagagcccgagcctgatgccgtggggcttgatagcggtcatattaggggtgctgtcaatatgcctttcatggactttctcacagaagacgggtcttggtccgagtggtttcgcagggctcctcccgaatcacgagtatcccagggaaaatctgagaaagcgtag

SEQ ID NO: 243958 - DNA, 375 bp, Artificial Sequence
  Description of Artificial Sequence: Synthetic coding sequence
atggtgcatcaggtgttatacagagcactggtctccaccaagtggctggccgaatctatccggacaggcaaactgggtcccggactgagggtcctggacgctagctggtactcacccggaacaagggaagcgcgtaaagagtacctggaaagacacgtgcccggtgctagcttctttgacatcgaggaatgccgggacaccgcatccccgtacgaaatgatgctgccgtccgaggccggattcgcggagtatgttggtcgcctcggcatcagcaatcacacccatgtcgtcgtgtatgatggcgagcacctgggaagcttctatgcccctagggtgtggtggatgttcagggttttcgggcaccgaactgtgtag

SEQ ID NO: 243959 - DNA, 1974 bp, Artificial Sequence
  Description of Artificial Sequence: Synthetic coding sequence
atgagccccaccccaccactgttctccctccccgaggcccgaactagatttaccaagtccacccgcgaggcgttgaataacaagaacattaaacccttgcttagcaccttttcacaggtgcctggctctgagaacgaaaagaaatgtaccctggatcaggcattccggggtattcttgaagaggaaataataaaccactcaagctgcgaaaacgttctcgccatcatcagcctggctatcggcggagtgacagaggggatctgcactgcctccacaccctttgtccttttaggggacgtgctggactgcctgcccctcgaccagtgcgacactattttcacatttgttgagaaaaacgtagctacttggaaaagcaatactttttattccgcagggaagaattacctcctgaggatgtgcaacgatttactaaggcgtcttagcaagtctcagaatacagtgttttgcggtcgtatacagctctttttggctagactgtttcctcttagtgaaaaatccggcctgaaccttcagtcacagttcaatttagaaaacgtcaccgtttttaatacaaatgagcaagagtctaccctaggccagaagcatactgaggacagagaggaggggatggatgttgaagagggcgaaatgggggatgaggaggccccaacaacttgcagcatcccaatcgattataacctgtaccgcaagttctggagtttgcaggattattttagaaacccggtccagtgttacgaaaaaatctcctggaagaccttcttgaaatatagtgaagaggttctggcagtgttcaaaagttacaaactcgacgacacccaagcatcccgtaagaagatggaggaactgaaaactggaggcgagcatgtgtacttcgccaagttcctcacgtctgagaagctcatggacctgcagctgagtgattcgaattttcgcaggcatatcttactgcagtacttgatactgtttcagtatcttaagggacaagtcaaattcaagtcatcaaactatgtcctaacagacgagcagtccctgtggatcgaggatactactaagtctgtgtaccagcttctttccgagaatccgccagacggggagagattctcaaagatggttgagcacatcttgaataccgaggaaaattggaacagttggaagaacgagggatgcccctccttcgtgaaagaaaggacgtccgatactaagccgacccgcattatccgcaagcgcactgccccagaggattttctggggaaaggaccaaccaagaagatccttatggggaacgaggagttaactcgcctgtggaatctgtgcccggacaacatggaagcttgcaaatccgagacaagggaacatatgcctacattagaggaattctttgaagaggccatcgaacaggccgatcccgaaaacatggtggagaatgaatataaggccgtgaataactccaattatgggtggcgggctctgagactgctggctcggaggagtcctcatttctttcagcccacaaaccagcagttcaagtcactccctgaataccttgagaacatggttatcaaactcgcaaaagagctgccccctccatcagaggaaatcaagactggcgaagatgaagacgaggaggataacgacgccctgctgaaggaaaacgaaagtccagacgttcggagagacaaacctgttactggagagcagattgaggtattcgcaaacaagctcggagagcagtggaaaattcttgccccatacttagagatgaaggacagtgagattaggcagattgagtgtgatagcgaggatatgaaaatgagggccaagcagttgctggttgcctggcaggaccaagagggtgtgcacgctacacctgaaaacctgataaacgccctgaataaaagcggactttccgatttagcggagtcactgaccaacgacaatgaaaccaacagctag

SEQ ID NO: 243960 - DNA, 4782 bp, Artificial Sequence
  Description of Artificial Sequence: Synthetic coding sequence
atggccgctgctgccgtcgttgttccggcagaatggataaagaactgggaaaagtcaggcaggggtgagtttcttcacttgtgtcgaatcctgagtgagaataaatctcacgattcctcaacatacagagacttccaacaggcactttacgaattgagctatcatgttatcaaaggaaatcttaagcatgaacaggcaagcaacgtcctctccgatatatcagagttcagggaggacatgccctctattctggcagacgttttttgcattctggatattgagacaaactgtctcgaggagaagtcaaaacgggattactttacccagctggtcttggcttgcctgtatctcgtcagcgacacagtgctaaaggaacggctagatcctgaaacactggaaagcctaggactgattaaacaatcacagcagttcaatcagaaatccgttaagatcaaaacaaaacttttctacaagcagcagaaattcaacctgctccgggaggagaacgaaggctacgcgaagctgattgctgagcttgggcaggacctgagcggcagtataaccagtgaccttattctggaaaatataaaatcactgataggttgctttaatctggacccaaaccgggtgctggatgttattcttgaggtgttcgaatgcaggcctgagcacgatgattttttcatttccctgctcgagagctacatgagcatgtgcgagccgcaaacactttgtcacatcctcggcttcaaatttaagttttatcaggagccgaacggtgagactccctcctcactgtacagggttgctgccgtgctcctccagtttaacctcattgacctggacgatttgtacgtacatctgctccctgccgataattgtatcatggatgaacacaagagggagatcgctgaagccaagcagattgtccgcaaactaacaatggtggtgctgtcttccgaaaaaatggacgagcgcgagaaggagaaagagaaagaagaggaaaaagttgagaagccgcctgataatcagaagcttggattgctggaggctctgctgaaaattggtgattggcagcacgctcagaacattatggatcagatgcctccttattatgcggcttctcacaagctgattgccctggccatttgcaaactcatccacataacaatcgaacccctctatcggagggtcggagtgccaaaaggggctaaggggagcccagtgaacgcgctgcaaaacaaaagggcgcctaaacaggccgagtccttcgaggacctcaggcgcgatgttttcaatatgttctgctatttgggcccacacctgagtcatgatccaatcctctttgccaaagtggtgcgtatcggaaaaagttttatgaaggagtttcagtctgatgggagcaagcaggaagataaagagaagaccgaagtaattctctcctgcctgctttctattactgaccaggtcctcctgccttccctcagcctgatggactgcaacgcctgcatgtccgaggagttgtggggtatgttcaaaacttttccatatcaacatcggtataggctgtatggtcagtggaaaaatgaaacatataactcccatccactactggtcaaggtcaaggctcagacgatcgatcgcgcaaagtatatcatgaaacgcctcacgaaggaaaacgtcaagccaagtggacgccagataggtaaacttagtcatagtaatccgacaattcttttcgattacatcctgagccaaattcagaagtatgataaccttattacacctgtggttgatagcctgaagtacctcacaagccttaactacgacgtcttggcgtactgcatcatcgaggctttggctaatcccgagaaagagagaatgaagcacgatgacacaaccattagctcttggcttcagagcctggcttcattctgcggcgcagtgtttcgcaagtaccctattgacctcgccggacttctacagtacgtggctaatcaactaaaagccggaaaatcttttgacctgctgattctgaaagaagttgtgcagaagatggcagggattgaaataaccgaggaaatgacaatggaacagctcgaagcgatgactggcggagaacaactcaaggcggagggtggatatttcggacagattagaaatactaagaagtcttcccagcgattgaaggacgcattattggatcacgaccttgctctccctctttgcctcttgatggctcaacaacgaaacggggtgattttccaagagggaggagagaaacaccttaagttagttggaaagctgtatgaccagtgtcatgacacgctggtgcagttcgggggatttctagcatcaaatctcagtacggaggactacataaagagagtcccgtcaatcgatgttttgtgcaacgagttccacactccacatgacgcagccttctttctcagccgcccaatgtatgctcatcacatcagtagtaagtatgatgagttaaagaaaagtgaaaagggctccaagcaacagcacaaagttcacaagtacatcacctcatgtgaaatggttatggcaccagtccacgaggctgtagttagcctgcatgtgagcaaggtctgggacgacattagtcctcagttctacgccacattctggagtctcaccatgtatgatctggccgtgcctcatacttcttacgagcgggaggtcaataaactgaaggttcagatgaaagccattgacgataaccaggagatgcctccaaacaagaagaaaaaggagaaagagcgctgtactgcacttcaggataagttgctggaagaagagaaaaagcaaatggagcatgtccagagagtgcttcagcgtttaaaattggagaaggacaattggttactggccaagtcgacaaaaaacgagacaataacaaagtttttgcagctgtgcatattcccaagatgcatcttcagcgctattgatgcagtgtactgcgctagatttgttgagctcgtgcaccagcagaaaactccaaacttctccaccctcctgtgttatgatcgggtgtttagtgacattatttacaccgtagcttcctgtactgaaaatgaggcaagtcgctacggcagattcctgtgttgtatgctggaaacagttacccgatggcactccgaccgcgctacttacgagaaggagtgtggaaattaccccggatttttgacaatactccgcgcaactggttttgacggtgggaacaaggcagatcagctcgattatgaaaattttcgccatgtggtacacaaatggcattataagctgacgaaggcctctgtgcactgcctagaaaccggcgaatacacccatattcggaatattttgattgtccttacaaaaatcctgccctggtaccccaaggtgctgaacctgggacaagcactcgagaggcgcgtacataagatctgtcaggaggagaaggaaaagaggcctgacctttatgctctggccatgggttactctggccaactgaagtctcgtaaatcttatatgattcctgaaaacgaattccatcacaaggaccctcctccacggaatgccgtcgcaagcgtgcagaacgggcctggcggtgggccttcctcctcttctatagggtccgcaagcaaatctgatgaatccagcactgaggagaccgacaaaagtcgcgagcgcagccaatgcggagtaaaagctgtaaataaggctagttccaccaccccaaaaggaaacagctctaacgggaatagcggaagcaattctaacaaagctgtaaaggaaaatgataaagaaaagggaaaagaaaaggagaaggagaaaaaggagaaaaccccagcgactacccctgaagcccgagttcttgggaaggacgggaaggagaaacccaaggaagagcgcccaaataaagacgagaaagcacgcgaaactaaggaaagaactcctaagtcagacaaagagaaggagaagtttaaaaaggaggagaaagccaaagatgaaaaattcaaaaccacagtgcctaatgcggagtccaagtcaactcaggaacgcgagagggagaaggaaccgagccgggagcgcgacatcgcgaaggaaatgaagagtaaggaaaatgtgaaagggggagagaagaccccagtttcaggatccttgaaaagtccagtcccaagaagcgatatccctgagccagagagggagcagaagaggagaaagattgacactcatcccagccctagccacagctccaccgtcaaagattcactgatcgaacttaaggaatcaagcgctaaactatatatcaaccacacacctccccctctgagtaagtcaaaggaaagggagatggacaagaaggacctggacaaaagtcgggaacgtagccgtgaaagagagaagaaagacgagaaggacaggaaggagcggaagagagaccactctaataatgatcgcgaagtgccgccagaccttacgaagagacgtaaagaagaaaacggtaccatgggtgtctcaaagcacaaaagtgaatccccttgtgagtccccctatcctaacgagaaagataaggagaaaaataaatctaagtcctcaggaaaggaaaagggaagtgacagcttcaagtccgaaaaaatggacaagattagcagtgggggaaagaaggagagcaggcatgacaaagaaaagatagagaagaaggaaaagcgtgattcgtcgggtggtaaagaagagaagaaacaccacaaaagtagtgacaagcacaggtag

SEQ ID NO: 243961 - DNA, 4782 bp, Artificial Sequence
  Description of Artificial Sequence: Synthetic coding sequence
atggccgcagctgccgtcgtcgtgcccgcagaatggatcaagaactgggagaagtcaggacggggagagtttctccacctctgtcggatcctctccgaaaacaaatcccacgacagctcgacttatcgtgactttcaacaggccctatacgagctgtcatatcacgttatcaaaggaaacttaaagcacgagcaggccagcaatgtcctctctgacatatcagaattcagggaggacatgcccagcattttggccgatgtcttttgcatattagacattgaaacaaactgcttggaagaaaagtccaaacgggattacttcacgcagttggttctagcctgtttatatctggtaagcgacaccgtccttaaagagagactggacccagagacgttggagtccctggggctaattaaacaaagccagcagtttaaccagaaatcagtgaagataaagacaaagttgttttataaacagcaaaagtttaacctcttgcgcgaagaaaacgaaggatacgctaaattgattgctgaattgggtcaggatctctctggaagcattacctctgacctgattctcgaaaacatcaaaagtctcatcgggtgcttcaacttagatcccaatcgtgttttagacgtcatattagaagtctttgagtgtcgccctgaacacgacgatttctttatttcactcctcgagtcatacatgtctatgtgtgagccacagaccctgtgtcacatactcggttttaagttcaagttttatcaagagcccaatggggagacaccatcatccctgtatcgcgtggccgctgtcctcttgcagtttaacttgatcgatctagatgatctatatgtgcatcttctgcccgcagataattgcataatggacgaacataagagggagatcgcagaagcaaagcagatcgtgagaaaacttaccatggtggttctctccagcgaaaagatggacgagcgagaaaaagagaaagaaaaggaggaggaaaaggtggaaaagccaccagacaaccagaaacttggcctgttagaagcgctgctcaagataggggattggcagcatgcccagaatatcatggaccagatgccaccttattacgctgcatctcataaacttattgccctggctatctgcaaacttatccatatcacgatcgagcctttatacaggcgggtgggcgtacctaagggcgctaaagggagccccgtcaacgcacttcaaaacaaacgggcacccaagcaagccgagagcttcgaggacttaagacgcgacgtgttcaatatgttttgttacttgggtcctcacttgagccatgatccgattctctttgctaaggtcgtccggatagggaagagctttatgaaggagttccagtccgatggcagtaaacaagaggataaggaaaagacggaggttatcctgtcctgtctcctgtcaataaccgatcaggttctgcttcccagtctgagcctgatggattgtaatgcctgtatgtctgaagagctctggggaatgtttaagaccttcccctaccagcatcgatataggttatacgggcagtggaagaatgaaacctacaattctcatcctctccttgtcaaagtgaaggcacaaaccattgaccgggcaaagtatattatgaaacgacttaccaaagaaaacgtcaaacctagcggcaggcaaatcggtaagttgtctcactctaatcctaccatcctgttcgattacattctgagccagatccagaaatatgacaacctgattactccagtcgtagattcactgaaatacctgaccagcctgaactacgacgtgttggcttactgtatcatcgaagccctcgcaaatcccgagaaggagcgaatgaaacatgacgatacaactatatcaagctggctgcagtcattggcctctttttgcggtgccgtgtttcgcaagtatccaatcgatttggccggtctgcttcagtacgtagccaaccaactgaaggcgggaaagagcttcgacttgcttatcttaaaggaggtcgtgcagaaaatggctggtatcgaaataactgaggagatgacgatggagcagctggaagctatgacgggaggagagcagctgaaggccgaaggcggttattttggacaaataaggaatacaaagaaatccagccagcggctgaaagacgccttattggatcacgatctggccctgccattgtgtcttctgatggcccaacagcgcaatggcgtgatatttcaggaaggcggtgagaagcacctcaaactggttggcaaactgtacgatcagtgccacgacactctggtgcagttcggtgggtttttagccagtaacctgagtacagaagactacattaagagggtgccatctatcgatgtcctttgtaacgaattccacaccccacacgacgccgcttttttcctctcccggcctatgtacgcgcaccacatttcctcgaaatacgatgagctgaaaaagagcgaaaaaggcagcaaacagcagcacaaagtgcacaaatacattacgtcatgcgagatggtgatggcaccagtgcacgaggcagtggtctcattacatgtgtccaaagtgtgggacgacattagcccacagttttatgcaaccttctggtcattgaccatgtacgacttagcggtgcctcatacttcatatgagagggaagtcaataagttaaaagtgcagatgaaagccatagacgacaaccaggagatgccccctaataagaaaaagaaggaaaaggaaagatgcactgcactgcaagacaaactgctggaggaagagaagaagcagatggagcatgtccagcgggtcctccaaagacttaaactggagaaggataactggttgctagcaaagagcaccaagaatgagaccattacaaagtttttacagctttgtatctttccccgttgcatcttcagtgccattgatgcggtctactgtgctcgcttcgtggagctagttcatcagcagaaaactcccaacttctccacactgctgtgttacgaccgtgtgttttccgacattatttacaccgtggcatcttgtaccgagaacgaggctagtaggtacggacgctttctgtgctgcatgctcgagacagtaacaagatggcacagcgacagagccacttatgaaaaggagtgcggcaattacccagggttcctgacaatccttcgcgcaaccggcttcgacggtggcaacaaagccgaccagttagattacgagaatttccggcacgtggtgcataagtggcactacaagctgactaaggcttctgtgcactgcctcgagactggagagtacacccatattcggaacatactgatcgtattaacaaaaatcctgccgtggtatcctaaagtcctcaacctgggccaagcattagaacggagggttcataagatctgccaggaggagaaggaaaagagaccagatctttatgctcttgcaatgggctattcggggcagcttaaatctcggaaaagctatatgattcccgaaaatgaatttcaccacaaagatccgcctcccaggaatgcggtggcttccgtccaaaacgggccaggaggcggtccatctagtagctccatcggttctgcctcgaaatcagatgagtcgtctaccgaagagaccgacaaaagcagagagcgctcacagtgcggcgtaaaagcggtgaacaaagcgagcagtactactcctaaaggcaattcctcgaatgggaactccggctctaattccaataaagcggttaaggaaaatgacaaagaaaaaggaaaggaaaaggagaaggagaaaaaagagaagacccctgccacgacacctgaggctagggtactcgggaaggatggtaaagagaagccaaaggaggagcgtcctaacaaagacgagaaagccagagaaactaaggagcggacgcctaagagtgataaggagaaagaaaaattcaagaaagaggaaaaggcaaaggacgaaaaatttaaaacgaccgttccaaatgcggaaagcaaatcgacacaagaacgtgagcgcgagaaagagccttctcgcgagagggacattgcgaaagagatgaagtcaaaagagaatgtcaaggggggtgagaaaacccccgtgtccgggtcattgaaaagccctgtgcctcggagcgacattcccgaaccagagcgtgagcagaagagaaggaagatcgatactcaccccagcccatcccactcaagtaccgttaaagattcattaattgagctgaaggagtctagcgccaagctctatatcaatcacactcctcctcctttgtcgaagtccaaggaaagggaaatggataagaaggatttggacaagagccgggaacgcagcagggagcgagaaaagaaggatgagaaggaccgaaaggagcggaagagggaccattctaacaacgatagggaggttccaccagatttaacaaagagaagaaaggaggaaaacggaacaatgggagttagcaagcataaatccgagtccccgtgtgaatctccctaccctaatgaaaaagacaaagaaaagaataaatccaagtccagcgggaaggagaagggcagcgattccttcaagagcgagaagatggacaaaatcagcagtggagggaagaaggagagtaggcatgacaaggagaagatagagaagaaggaaaagagggattcttccggtggcaaagaggagaagaagcaccataagtccagtgacaaacatcgttag

SEQ ID NO: 243962 - DNA, 2547 bp, Artificial Sequence
  Description of Artificial Sequence: Synthetic coding sequence
atgccaagtatccttgccgatgtcttttgtatcctcgacatcgagaccaactgtttggaggagaagtctaaaagggattactttacccagctggtgcttgcttgcttgtacctcgtctcagataccgtcctaaaagaaagactggaccctgagaccctggaatccctgggcttgatcaaacagtcacagcagttcaatcagaagagtgtgaagatcaagactaaactattttacaaacagcagaagtttaatctccttagggaggagaacgagggatacgccaaactcattgcagagctgggccaagacctttctggaagtatcacttccgatctcattctcgaaaatatcaagtccttaattggctgttttaatctagatcccaaccgggtgcttgacgtgatcctcgaggtgttcgaatgcagacccgagcacgacgacttctttatcagcctgctggagtcgtacatgtctatgtgtgagcctcaaacactgtgtcatattctcgggttcaagtttaagttctaccaggagccgaatggggagacccctagtagcctgtatagagttgctgcagtactgctgcagttcaatcttatcgacctagacgatctctatgtgcatctgctccccgcagataactgcatcatggacgaacataagcgggagattgcagaggccaagcagatcgtgagaaaactgaccatggttgtcctctctagcgagaagatggacgagcgcgaaaaagagaaggagaaggaggaggagaaggtggagaagccaccggacaatcagaagctcggtctgcttgaggccttattaaagattggtgactggcagcatgcccagaacatcatggaccaaatgcccccatattatgccgcaagccataagctgattgcattggcaatttgtaaactgatccacatcactattgaacccttatatcgcagagtgggcgtacccaagggggctaagggctctcccgttaatgcattgcagaacaaaagagctcctaagcaagctgaatccttcgaagatctgagaagggacgtctttaatatgttttgttaccttgggccacacttgagccatgatcccattttgttcgccaaggtcgtgagaattggcaagagttttatgaaagaatttcagtcagacgggagtaaacaggaggataaagagaaaaccgaagtgattctttcttgtcttctgtccataacggaccaggtactcctgccctcactcagcctcatggattgcaatgcttgtatgagcgaagaattgtggggcatgttcaagaccttcccataccagcaccggtatagactatacggccagtggaaaaacgaaacctacaattctcaccctctgcttgttaaagtgaaggcccagacaattgaccgggctaaatatatcatgaagcggctgactaaggagaacgtgaagccatctgggagacagatcgggaagctgagccactctaacccgacaatactgtttgattatgtctgcttcgagatactgtcccagattcagaaatacgataaccttatcacccctgtcgtggattcccttaaatatctgacctctctgaattacgatgtgttagcgtactgtattatcgaggctctcgcaaaccctgagaaagagcggatgaaacacgacgataccacaatctcgtcctggctccagtccctggcaagcttctgcggagccgtgttccgcaagtatcctattgatctggcaggccttctgcaatatgttgctaatcagctcaaggccggtaagagttttgatctgctcatactgaaggaggtagttcaaaaaatggcgggaatcgaaatcaccgaggagatgaccatggaacaattagaggccatgacaggcggtgaacagctcaaagccgaaggtggctactttggacagatccggaacacgaaaaagagctcccagagactgaaagatgccttactggaccacgaccttgcgcttccgctttgtctgttgatggctcagcagcggaacggtgttatatttcaggaaggcggtgaaaagcatctgaaattagttggtaagctgtacgatcagtgtcatgatactttggtgcagtttgggggatttctggcctcaaacttatcaacggaagactatattaagcgcgttccgtccattgatgtactctgcaacgaatttcacaccccccatgacgctgcatttttcctgtctaggccgatgtatgcccaccacatctcctctaagtacgacgagcttaagaagagcgagaagggttctaaacagcagcacaaggtacataagtatattacttcctgcgaaatggtgatggcacccgtgcacgaggctgttgtttcccttcacgtgagcaaagtttgggacgacatcagtcctcagttctacgccacattctggagcctgactatgtacgacctagctgtgcctcacacgagctatgagcgagaagtaaataagctaaaggtccaaatgaaggccatcgacgacaatcaggaaatgatcccccctcagtag

SEQ ID NO: 243963 - DNA, 570 bp, Artificial Sequence
  Description of Artificial Sequence: Synthetic coding sequence
taagagcagaaacggcgtaagatcgatacacacccatctccaagccattcatcaacagtcaaagattcactaattgagctcaaagagtctagtgccaaactttacatcaatcacacgccacctcccctctccaaatccaaggagagagagatggataagaaggacttagataaaagtcgggagcggagcagagagagagagaagaaggacgagaaggaccggaaagaaaggaagagagaccactccaacaacgaccgggaggtccctccagatttaactaagcggaggaaagaggaaaacgggaccatgggtgtttctaaacataagtctgaatcaccctgtgaatccccttatcctaatgagaaggacaaagagaaaaataagagtaagtcctccggaaaggaaaaagggagtgattcatttaaatccgaaaagatggacaagatcagttctggtggtaagaaagaatctcgacacgataaggagaagatagagaagaaggagaaacgcgatagctcaggtggcaaggaagaaaagaagcaccacaaatccagcgacaaacacagatag

SEQ ID NO: 243964 - DNA, 1056 bp, Artificial Sequence
  Description of Artificial Sequence: Synthetic coding sequence
atggccgtgcccgcagccgcaatgggaccttccgccctgggacaatccggccctggaagtatggctccgtggtgttccgtatccagcgggccatctcggtatgtcctcggaatgcaggagcttttccgtgggcacagtaaaactcgagagttcctcgcccattctgctaaagtgcactcagttgcatggtcctgcgacggtcggaggctcgcctctgggtctttcgacaaaacggcctctgtgttcctgctggaaaaggaccggctggtcaaagagaacaattaccgcggacacggagattccgtagaccagctgtgctggcacccatctaatcccgatctatttgtgaccgcgagcggagacaagacaatccgtatatgggatgtgcgaacaacgaagtgcatcgccacagtaaatacaaagggggaaaatatcaatatatgctggtcaccagatggacagacaatcgccgtgggcaacaaggatgacgttgtgacatttattgacgcaaagactcaccggagtaaggcagaggaacagttcaagtttgaggtcaacgagatttcatggaataatgacaataatatgtttttcctgaccaacggaaatggttgcattaacatcctgtcctatcctgagctgaagccagtgcagagtatcaacgcccatccaagcaactgtatctgtatcaaattcgacccaatgggaaagtattttgcaacaggctctgccgatgccctcgtttccttgtgggacgttgacgagctcgtgtgtgttagatgttttagtcgtctggactggcccgttagaacactgtctttctcacacgacgggaaaatgctcgcctccgctagcgaagatcattttattgatatcgcagaggttgaaactggcgataagctgtgggaggtgcagtgcgagtctcctacattcacagtcgcctggcaccctaagcggccactcctcgctttcgcctgtgacgataaggatggaaagtatgattcttcgcgcgaggcagggactgtcaagttgttcggactgccaaatgacagctag

SEQ ID NO: 243965 - DNA, 2052 bp, Artificial Sequence
  Description of Artificial Sequence: Synthetic coding sequence
atgtcctccgagtccagtaaaaagcgaaaacccaaagtgatccggtccgacggggctcccgctgaagggaagaggaatcggtccgacaccgagcaagagggaaaatattattccgaggaagcggaagtcgatttgcgcgacccgggaagggactatgagctgtataagtatacctgccaggagcttcaacggctgatggctgagatccaggatctaaaaagtagaggaggcaaagatgtggccattgagatcgaggagcgcagaatccagagctgcgtccatttcatgactcttaagaagctcaacaggttagcacatattagactgaaaaaaggcagggatcaaacccatgaagccaagcagaaggtagacgcttatcatttgcagctgcagaacctactttatgaagtcatgcatctccagaaggagattaccaagtgcctagaatttaagtccaaacacgaagaaatcgaccttgtgagcctagaggagttctataaagaggctcctccagatatttcaaaggcagaagtgactatgggagatccccaccagcagacgctagcccgtctggactgggagcttgagcaaaggaaacgcttggccgagaagtacagggagtgtctttccaacaaggagaagattctgaaagagatagaggtgaaaaaagagtatctcagctctttacagcccagactgaatagcattatgcaggcgtctctgccggtgcaggaatacctatttatgcctttcgaccaagcccataagcagtatgaaacagccaggcatctgccaccgcctttatatgtgctctttgtgcaagccacagcttacggccaggcttgtgataaaaccttgtcggttgccatcgaggggtctgtggacgaggcaaaagctctgttcaagccgcctgaggacagccaggatgatgaaagcgattctgacgctgaggaagaacagacaaccaagcggagaaggcctacactcggagtacagttagatgacaaaagaaaggagatgctgaagagacatccactctcagtcatgctggacttgaagtgtaaggacgactcagtattgcacctaacattctactacctcatgaatctgaatatcatgaccgtgaaagccaaggtgactaccgcaatggagctgattacacctatttccgccggagacctgttgtcacccgatagcgttctctcatgcctctatcccggagaccacggaaagaaaactccaaaccctgcgaaccagtatcaattcgacaaggtcgggattctaacgttatccgactatgtgctcgaattaggtcacccatacctgtgggtgcagaaactgggcggtctgcacttccctaaagagcaacctcagcagacggtgatcgccgaccattccctgtctgccagccatatggaaactaccatgaagctgctcaagacccgagtccaaagccgcctggcactgcataagcaatttgcctctttggaacacggaatcgtgcccgtcacaagcgattgccagtacttattccccgctaaggtcgtctccagactcgtgaagtgggtcaccgtggctcatgaagactatatggaactacacttcactaaagacatcgtggacgccggtttggcgggtgacacgaacttgtattatatggcactgattgagcgaggcacagcaaaattacaggccgcagttgtgctgaatcccggatattccagtattccaccagtcttccaattgtgtctgaactggaaaggcgagaaaacgaactctaacgatgataatattagagctatggaaggcgaggtgaatgtttgttataaagaactttgtggcccatggccgagtcaccaactgttaaccaaccagctgcagagattatgcgtgctcctcgacgtctacctcgaaacagagtctcatgatgactctgtggaaggccctaaggagttcccccaagagaagatgtgcctccggttgtttagggggcctagcagaatgaagccattcaagtacaaccacccccagggattcttttcacaccgatag

SEQ ID NO: 243966 - DNA, 2052 bp, Artificial Sequence
  Description of Artificial Sequence: Synthetic coding sequence
atgtctagcgagtcgagcaaaaaacggaaaccaaaagtgatccgcagcgatggggcacctgccgagggaaagagaaatcgctccgataccgaacaagaaggcaaatactattccgaagaggcagaagtggatctacgcgacccagggagagactatgagttgtacaagtatacttgccaggaacttcagcgcctcatggccgaaatccaggacctcaagagcagggggggaaaagacgtcgccattgagatagaggaacgtcggatccaaagttgtgtgcactttatgaccttgaaaaagcttaacaggctggcacacatccggctaaagaaggggagagaccaaacccatgaagcgaaacagaaagtggacgcctaccacttacaactgcaaaacctgctgtacgaagtgatgcaccttcagaaggagatcaccaagtgtctggagtttaaatcaaagcatgaggagattgacctcgtgagcctggaagagttctacaaggaggctccacccgacatctctaaagccgaagtgactatgggtgatccacaccaacagaccttggccaggctggattgggagctggagcagaggaaacgactcgcggaaaaatacagggaatgtctgagcaacaaggaaaagatcctgaaggaaatagaggtcaaaaaggagtatttatcttcccttcagccccgactgaacagcattatgcaggccagcttacccgttcaggaatacctttttatgccattcgaccaagctcacaagcaatacgagacggcccgacacctaccgccaccgctctatgtgcttttcgtgcaggccacggcctatggtcaggcttgcgataaaacgctaagcgtggctatcgaaggttccgttgacgaggctaaggctctctttaagccacctgaagactctcaagatgatgagagcgattctgatgccgaggaggaacagacaacaaagaggcgtcggccaactttgggggtgcagttagatgacaaacgaaaagagatgctgaagaggcacccactgagcgttatgctggatttgaagtgcaaggacgacagtgtactgcacctgactttttattacctgatgaatctcaacatcatgaccgttaaggcaaaggtaacaaccgccatggagttgatcactccaatttccgccggagatctgttatcccccgacagcgtgctcagctgtctatatcccggagaccacgggaaaaaaactcctaaccccgctaatcaataccagttcgacaaggtcggcatattaacactgtccgattacgtactagaactaggacatccatacctatgggtgcaaaagctggggggtctccacttcccgaaagagcagccacaacagaccgtgattgctgaccacagtttgtcagcttctcatatggagactacaatgaagcttctgaagacaagagttcagtctcgtctggcactgcacaagcagtttgcctcactcgaacatgggatcgtgcccgtgacatccgactgccaatatctgttccccgcaaaagtggtgtctcgccttgtgaaatgggtcaccgtggcccatgaggactacatggaactgcacttcacaaaagacattgtcgacgccggactcgccggagataccaatctgtattacatggccctgattgaacggggaactgccaaactacaggccgcagttgtgttgaacccaggctattcttcaatacctccagtttttcaactgtgcctgaattggaagggtgaaaaaacaaactctaacgacgataatatccgggctatggaaggagaggtaaatgtgtgctataaagagttgtgtggaccctggccctcccaccagctgttaactaatcagctgcagaggttatgtgtgttactggatgtgtacctcgaaacagagagtcacgatgattcagtggaaggccctaaggaatttccccaagaaaagatgtgtcttagactctttcggggacccagtagaatgaagcccttcaaatataaccacccgcagggcttcttttcacacaggtag

SEQ ID NO: 243967 - DNA, 2052 bp, Artificial Sequence
  Description of Artificial Sequence: Synthetic coding sequence
atgagctcggagtcgtcaaaaaagcggaaacctaaagtaattcgatcagacggcgctccggcagaggggaaaagaaaccggtcagacactgagcaagaaggcaagtactactctgaagaggccgaagtggatctgcgcgatcctggccgtgattatgaattgtataaatatacttgtcaggaactgcaaaggcttatggctgaaatccaggatttgaagagtcggggtggaaaggacgtcgcaatcgaaatcgaggagcgtagaatccagagttgtgtccatttcatgacactgaagaagctaaatagacttgctcatattcggcttaagaagggacgggaccaaacacacgaagctaagcagaaagtggacgcctaccacttgcaactccaaaacctgttgtacgaagtgatgcatctgcaaaaggagattacaaaatgcctcgaattcaagagtaagcacgaggagattgaccttgtgtctctggaagagttctacaaagaggcgcctccggatatctccaaggcggaggtcaccatgggggatccccatcagcagacacttgctcgtcttgattgggaacttgaacagaggaagcggctcgccgaaaagtaccgcgaatgccttagcaacaaagagaaaattcttaaggagatcgaagttaaaaaggaatacttgagttcactgcagcccagactgaatagcataatgcaagcatccctcccggtacaagagtatcttttcatgcccttcgaccaggcgcataagcaatacgaaaccgcacgccatctccctccgcctctgtacgttttattcgtccaggctacagcatatgggcaggcctgcgataaaaccctctccgtcgcaattgaaggaagcgttgacgaagcaaaggccttatttaagcctcccgaggatagccaggatgatgagtctgattccgacgctgaggaggagcagaccactaagcgcaggaggccaaccctgggcgtccagctggacgacaaacgtaaggaaatgctgaagcgccacccgctgagtgttatgctggatctgaagtgcaaagacgactcagtattgcacctgaccttttattacctgatgaacttaaatattatgactgttaaagccaaggtgacaacagccatggaactgatcacccctatttctgccggagaccttctaagccctgactctgtcctcagttgcctgtaccctggagaccacgggaagaagactcctaatcctgctaatcagtatcagtttgacaaggtcggtatcctgactctgagtgactacgtcctggagctgggacatccatatctctgggtgcagaagctcgggggactacattttccaaaggagcagcctcaacaaacagtgatagctgatcactccctgtctgcctcccacatggagaccacaatgaagctcctcaagactcgtgttcagtcaaggttggctctccataagcaatttgcgtccctggaacacggcatcgtgcccgtgacaagcgattgtcagtacctgtttcctgcgaaagtggtcagccggcttgtcaagtgggtgacagtggcccacgaggattacatggaattgcatttcacgaaggacatagtggatgcaggacttgcaggtgacacgaacctgtactacatggcactaatagagaggggcacagctaagttgcaggctgcggtagtgctgaatccgggatatagctctattcctccggtctttcaattatgcctgaactggaagggtgagaagactaattctaacgatgacaatatccgtgcaatggaaggcgaagtaaacgtgtgctacaaagagttatgtgggccatggccatcccatcaacttctgactaatcagctgcagcgattgtgcgtgctcctggatgtttacctggagacggagagtcacgacgactctgtcgaggggccaaaagagttcccgcaagagaaaatgtgtctgaggttgttcagagggccatcacgcatgaagcccttcaaatacaaccacccccagggctttttttcccaccggtag

SEQ ID NO: 243968 - DNA, 282 bp, Artificial Sequence
  Description of Artificial Sequence: Synthetic coding sequence
atgtcaagtgagtctagtaagaagagaaagccaaaggtaatccgatccgacggagcgcctgccgagggcaaaagaaaccgcagcgacacagaacaggagggaaagtactactcagaggaggcagaagtcgacctccgcgaccccggacgggactatgaactgtataagtacacctgccaggaactgcagcggctgatggcggagatccaagatctaaaaagtcgcggtggcaaggacgttgccatcgaaatcgaggagaggcgcatccagagttgtgtgtag

SEQ ID NO: 243969 - DNA, 486 bp, Artificial Sequence
  Description of Artificial Sequence: Synthetic coding sequence
atgagcagcgaatccagtaagaaacgtaagcctaaagtgattcgcagcgatggagcccctgccgagggaaagaggaatcggagtgacacagagcaggaaggaaaatattactcagaagaagcagaagtcgacctccgggatcccggtagagattacgaattatacaaatacacatgccaggaattgcagaggctgatggccgagattcaggacttgaaatcccgcggagggaaagatgtggctatcgaaattgaagaaagacgaatccagtcttgcgtgcacttcatgaccctgaaaaaactgaatcggctcgcacatatcagattgaagaagggacgggaccagacccatgaggctaagcagaaggttgatgcctatcaccttcagctgcagaacctactctacgaagtgatgcacttacagaaggagataactaaatgtttggaattcaagagtaagcatgaggagatcgatctcgtgagctag

SEQ ID NO: 243970 - DNA, 672 bp, Artificial Sequence
  Description of Artificial Sequence: Synthetic coding sequence
atgagctccgagtcttccaagaagagaaagccgaaggtgattagaagcgacggagctcccgctgagggaaagagaaaccggtctgatacagagcaagaagggaagtactactcggaagaggctgaagtcgatttgagagaccctggcagggactacgagctgtataagtatacatgccaggagctccaaagattgatggcagagatccaggatttgaaaagccgcggagggaaggacgtcgccatagaaattgaagaaaggcggatccagtcatgcgtgcatttcatgaccctaaaaaaattgaaccggctagcacacattcggctgaaaaaaggtagagatcaaacccacgaagccaaacagaaggtcgacgcataccaccttcagctgcagaacctgctatatgaggtgatgcacctacaaaaagaaattacaaaatgcctcgagtttaaaagtaagcacgaagaaattgatctggtgtctttggaggagttctacaaggaagccccacctgatatcagcaaggccgaggtgactatgggagacccccatcagcagacgctcgctaggctcgattgggagctcgagcagaggaaacggctcgccgagaagtacagggagtgcctgtctaataaagagaaaatcctcaaggagatcgaagttaagaaatag

SEQ ID NO: 243971 - DNA, 2052 bp, Artificial Sequence
  Description of Artificial Sequence: Synthetic coding sequence
atgagcagtgagagttccaaaaagagaaagccaaaagtgatccgatccgatggtgcacccgctgaagggaagcgcaaccggagtgatactgagcaggaaggcaaatactacagtgaagaagctgaggtggatctcagagacccagggcgagactatgagttatacaaatatacatgtcaagagctgcaacgattgatggccgagattcaagatctgaaatcgcggggaggaaaagatgtcgctatcgaaatcgaggaacgacggatacagtcctgcgtgcacttcatgacactcaagaaactgaatagactcgcgcacattaggcttaaaaaaggcagagatcagacacacgaggctaaacagaaggtagatgcatatcatttgcagctccagaatctgctgtatgaggtcatgcacctgcaaaaggagatcaccaagtgccttgaattcaagagcaagcatgaggaaattgatcttgtgtcgctggaggaattctacaaagaggcgccacccgacatctccaaggctgaagtaaccatgggagacccacaccaacagactctggccagattggactgggagctcgaacagcgcaagcgcctggctgagaaataccgagaatgcctgtcaaacaaagagaaaatcctgaaggagattgaggtgaagaaagaatacctgagcagtctgcagcctcggcttaatagcattatgcaggcctccttgcccgtgcaggagtacctgttcatgccattcgaccaggcccacaaacagtatgagaccgcaagacacctgcctccacccctatacgtgttgtttgtgcaggctactgcttacggccaagcctgcgacaaaactctgtctgtggccattgaaggaagtgtggatgaggccaaagctctcttcaagcctccagaggactctcaagatgatgagagtgatagtgacgcggaggaggaacagaccactaagcgacgcagacctactctcggggtgcagctggatgataagcggaaggaaatgctgaaaaggcaccccctaagcgtgatgctcgacttgaagtgcaaagacgactctgttctgcacctgaccttttattatctgatgaatctgaacatcatgactgtgaaggccaaggtgactacagcgatggagttaatcactccaatatctgctggagatctcctgtcgccggacagcgttctgtcttgtctgtatcctggtgatcatgggaagaagaccccaaatcccgctaaccagtaccagtttgataaggtgggaatactgacgctgtctgattacgtcctggagctggggcacccttacttatgggtgcagaagctcggcggactgcacttcccgaaggagcaaccccagcagactgtcatcgcggaccactctctgtcagcttctcatatggagaccaccatgaaactgttaaagactagggttcaaagcagactggctttgcacaagcagttcgcatctttagaacatggtattgttcccgtgacttcagactgtcagtatctctttccagctaaagtcgtttcccggctggtgaaatgggttaccgtcgcccatgaggattacatggagctacactttactaaggatatcgtcgacgcaggccttgccggagacactaatctctactacatggcccttatcgagcgaggtacagcgaagctgcaagccgctgtagtgctgaatcctggctacagttctattccacccgttttccaactctgtcttaactggaaaggcgagaagactaactcgaatgacgacaatatccgcgctatggagggggaggtgaacgtgtgctacaaggagctgtgcgggccttggccatctcaccagctactgactaaccaactccagaggctgtgtgttctcctggatgtatatctggagacggagagccatgatgatagcgtggaagggccaaaggagttcccacaggaaaagatgtgtttaaggctgtttcgcggaccttctcgcatgaagccgttcaagtacaatcaccctcagggctttttctcgcacaggtag

SEQ ID NO: 243972 - DNA, 615 bp, Artificial Sequence
  Description of Artificial Sequence: Synthetic coding sequence
atgggcgctgtgaccgacgacgaagtgatacggaaacggttattaattgacggtgacggggctggtgacgacaggaggatcaatctgctcgtgaaaagcttcatcaaatggtgcaattctggctcccaggaggagggatactcacagtaccagagaatgttaagtacgctcagccagtgtgagtttagtatgggaaagaccctcctcgtctatgacatgaaccttagagaaatggagaactacgagaagatctataaggagattgaatgcagcatagcgggtgcacacgagaagatagccgagtgcaaaaaacagatcctccaggcaaagagaattcgaaagaatcgccaggaatatgatgctctggcgaaagttatccagcatcatcccgatcggcacgaaacccttaaggagttggaggctctgggcaaggaattagaacacttgtcacacatcaaggagtccgtggaggacaagcttgaactgcgccgtaagcaatttcacgtgctgcttagcacaattcatgaactgcagcagacgctggaaaatgacgaaaagcttagcgaggtggaagaagctcaggaggcctctatggaaacggatcccaagccttag

SEQ ID NO: 243973 - DNA, 711 bp, Artificial Sequence
  Description of Artificial Sequence: Synthetic coding sequence
atgtccgaagcaccacgggctgagacttttgtatttctggatcttgaggcaaccggtctacccagtgttgagcccgagattgcagaactatcgctgttcgccgtccacaggtcttctctggaaaaccccgagcatgatgagtccggggctctggttcttcctcgggtattggataaactgactctgtgtatgtgccctgaacggccattcacagctaaggcctcagagatcacagggttgtcctcggaaggccttgcgcgatgtcggaaagccggattcgatggggctgttgttagaacactgcaggcatttctcagtagacaggctggaccgatctgtctggtggcacacaacggattcgattatgattttcctctgctgtgtgccgagctgcgaaggctgggagcgcgtctgcctagagacaccgtgtgtttggatacactgcctgccttacgcggactcgaccgcgctcactcccacggtactagggcccgaggtcggcagggatacagcctgggtagtctctttcatcgttattttcgcgcagagccgtccgctgcacactccgcagaaggggatgtgcacacactacttctgatttttttacacagagcggctgaattactcgcctgggccgatgagcaggctcggggatgggcccatatcgagcccatgtacctgccacctgacgatcctagcctggaagcctag

SEQ ID NO: 243974 - DNA, 840 bp, Artificial Sequence
  Description of Artificial Sequence: Synthetic coding sequence
atgggcagagctggttcacccttgcccagatcctcttggccacggatggatgactgtggaagtcgttcccgctgtagcccaaccctctgttcgagtctgaggacgtgttaccccaggggaaacataaccatgtcggaggccccaagagccgagacatttgtgtttcttgacctggaagcaacaggcctcccctctgtggagcctgagatcgcggagttgagcctgttcgctgtgcacagatcaagcctcgaaaatccggaacatgacgaatctggcgctctggtcctacccagagtcctagataagctgacgctgtgcatgtgccccgagaggccgttcacagccaaagcatccgaaatcaccgggctgtcatcggaaggcctagccagatgtcggaaggcaggatttgacggggctgtggtccgaaccctccaagcgttcttatcgcgccaagccggacctatctgcctagtggcccacaatgggttcgactatgacttccctctgctgtgtgccgaactgagaaggctgggagctcggctcccaagggatactgtgtgcctggacaccctccccgcacttagggggctcgatagagcacactcacacggtacacgcgctcggggaagacaaggctattccctcggatcactgtttcaccgatacttcagggctgaaccctccgctgctcactctgccgagggtgacgttcacacactgttgctaatcttccttcatcgggctgccgagctcctcgcttgggcggacgagcaggcacggggatgggcacatatcgaacccatgtatctgccacctgatgacccgtctctagaggcatag

SEQ ID NO: 243975 - DNA, 711 bp, Artificial Sequence
  Description of Artificial Sequence: Synthetic coding sequence
atgtccgaggccccacgtgcggaaactttcgtgtttcttgatctggaagccaccggtcttccatcggtggaacccgagattgctgaactctcattatttgcagtgcacagatctagtctggaaaatccggaacatgacgaatcgggagccctcgtcctgccccgagtgttggacaaattgactctgtgcatgtgcccggaacggcctttcactgccaaggcctcagaaattaccggcctgtcaagtgaagggctggctaggtgtaggaaggctggcttcgacggcgctgtggttcggacactgcaggccttccttagcagacaggccggacccatctgcctcgtggcacacaatggctttgattacgatttcccgctcttgtgtgctgaattgagaaggttgggtgcgagactgcccagagatacagtgtgcctggacaccctgccagccctccgcggactcgatagggcacacagtcatggaactcgagcacggggacggcagggatactcactgggatcccttttccaccgctacttccgcgctgaacctagtgcagctcattccgccgaaggagacgttcacactcttctcttgatcttccttcacagggcggcagaactgctggcctgggctgacgagcaggccaggggctgggctcatattgagcctatgtatctgcctcccgatgacccctctctggaggcctag

SEQ ID NO: 243976 - DNA, 711 bp, Artificial Sequence
  Description of Artificial Sequence: Synthetic coding sequence
atgtctgaagcccctcgggcagagacctttgtctttctggacttggaagccaccggcctgccttctgttgagcccgagattgctgagttgtccctgtttgctgtccatagaagctctcttgagaatccagagcatgatgaatctggggctctggtgctgccaagggttcttgataagctgactttgtgtatgtgtcctgagcggcctttcacagcaaaggcctctgagataactgggctatctagtgaaggcttggctaggtgccgcaaagccggattcgacggcgctgtggttaggacccttcaggcgtttctctcacgccaggctggtccaatctgtctggttgcacacaatgggtttgattatgacttccccctactctgcgctgaattgaggcggctaggggcacggcttcctcgcgacacggtttgtctcgacactttaccggcactacgcggtctcgacagggcccatagtcacggaacccgggcacgagggaggcagggctattccctcgggagcttgtttcatcggtacttcagggcggagccctcagcagcccactcagccgaaggtgacgtacacacactgctcttaatttttctccacagagctgctgagttgctggcgtgggccgacgaacaggcaagagggtgggcccacatcgagcctatgtaccttccgcctgatgatccctctctggaggcttag

SEQ ID NO: 243977 - DNA, 840 bp, Artificial Sequence
  Description of Artificial Sequence: Synthetic coding sequence
atgggaagggcaggatcccccctgccaagaagctcctggccccgaatggacgattgcggtagtcgcagcaggtgttccccaactctctgcagttccttgcgtacctgttatccacgcggaaatatcactatgtccgaggcacccagagccgagacatttgtgttcctggacttggaagccacaggcctgccgagtgtggagcccgaaatcgccgagttgtccctgttcgcagtgcacagatcctcactggagaatcccgagcacgacgaaagtggcgctctagtcctccccagggtgttggacaaactgaccttgtgtatgtgccctgaacgccctttcacagccaaagcctctgaaatcactggactttcttccgagggtcttgccagatgtcggaaagccggttttgatggagccgtcgtgcggaccctccaggccttcctgtctagacaagctggtccaatatgcctggtcgctcacaacgggttcgactatgatttcccattactctgtgccgagcttaggcggcttggagctcgtctgccccgtgatacagtgtgcctggacaccttacctgccctaagagggctggatagagcacactctcatgggacacgtgccaggggcagacagggatactcgctgggcagccttttccaccgatattttagagccgaacctagcgcagcccactctgccgaaggagatgtccatactctgctgctcatcttcctccatcgggcagccgaactgctggcgtgggcggacgagcaggcaagagggtgggcccatattgaacccatgtacctccccccagatgacccgtccctagaggcatag

SEQ ID NO: 243978 - DNA, 711 bp, Artificial Sequence
  Description of Artificial Sequence: Synthetic coding sequence
atgtccgaggccccaagggccgaaacattcgtcttcctagatttggaagccactggacttcccagtgttgagcctgaaatcgccgaactttcattgtttgccgtacatcgatcatccctggagaacccagagcacgatgaatcaggcgctttggttctgccaagggttcttgacaagctcaccctgtgtatgtgccccgagagaccgtttactgcaaaggcaagcgaaattactgggctgtcttccgaggggctggctagatgtagaaaggcgggttttgacggtgcagtggtccgcacgttgcaagcttttctgtccagacaggccggtcccatctgtctggtcgcccacaacggcttcgattacgactttccgcttttgtgtgcggagctgcgtaggctgggcgctcgccttccacgcgacactgtgtgtctggatactttacctgcgctccgtggcctggaccgcgctcatagtcatggaacccgagctcgcggacggcaggggtacagtctcggatctctctttcatcggtattttagggcagagccctccgctgcgcattccgctgaaggagatgtccacacactattgttgattttccttcatagagccgcagagttacttgcttgggcggacgagcaggctcgtggctgggctcacattgaacccatgtacctcccccctgatgacccgtcactcgaagcctag

SEQ ID NO: 243979 - DNA, 840 bp, Artificial Sequence
  Description of Artificial Sequence: Synthetic coding sequence
atgggcagagcaggttcgccactccccaggtcatcttggccacggatggacgactgtggatcccgctcgcggtgttctccaaccctttgtagttcactgaggacctgttatccacggggtaacatcaccatgtctgaggcaccgagggccgaaacctttgtctttctggatctggaagccacaggattgccctcagtggaacccgagatagccgagctttccctcttcgcagttcatcgctccagtttggagaatcccgaacacgacgagtccggggcacttgttttgcccagagtgctcgacaaactcaccctgtgcatgtgtcctgaaagaccttttaccgcaaaggcctctgagatcacagggctgagcagcgagggcctggctcgctgtaggaaggctggctttgatggagctgtggtcaggaccctgcaggcctttttaagtcgccaagctggccctatttgcctggttgcccacaatggcttcgattacgacttccctttactgtgcgccgaattgcgcagactgggcgcacgactgccaagagatactgtctgcctggacaccctgccggcactgcgtggtctcgatcgcgctcactcacacggtacgagagccaggggaagacaggggtatagcctaggctccctgtttcaccggtacttcagagccgaaccctccgctgcacacagcgcggaaggagacgtgcataccctactgctcatcttcctacatcgggctgcagagcttctggcttgggcggacgagcaagcacgcggatgggcccacatcgaaccaatgtatctgccccctgatgaccccagtttagaagcttag

SEQ ID NO: 243980 - DNA, 837 bp, Artificial Sequence
  Description of Artificial Sequence: Synthetic coding sequence
atgatcgttgcagcagaggccgtagccgctccccgttgtgctttggtcggggaccggagcggcgctgatgcgcctagggccaaaggtcactctctcagaacatgctatccacgcggaaatattactatgtcggaggcccctagggcagaaacatttgtgttcctcgatttggaggctactggcctcccctccgtcgagccagaaattgccgaattgtccctctttgctgttcatcgatcgtcgttagagaacccggaacacgatgagagcggtgcccttgtcctgcccagagtcctcgacaagctgactctgtgtatgtgtccggagcggccttttacagccaaagcctcggagattacagggctttcttctgagggactcgcacgctgtagaaaggctgggttcgacggtgctgtggtccggactcttcaggcgttcctaagccgccaggctggtcccatctgcctcgtggcacacaacgggttcgactacgacttcccccttctgtgtgccgaactccgcaggctcggcgctcggctcccaagggacaccgtatgccttgacacactacctgcccttcgcggactggatcgcgctcattcccacggaacccgtgctcgcggtcggcaaggatactcgttagggagcttgtttcataggtatttcagggcagagccaagtgccgcacatagcgctgagggtgatgttcacacactcctcctgatcttcttgcatcgcgctgccgagcttttggcctgggccgatgagcaggcaaggggttgggcccatatcgagcctatgtacctcccacctgacgaccccagtctggaggcctag

SEQ ID NO: 243981 - DNA, 2172 bp, Artificial Sequence
  Description of Artificial Sequence: Synthetic coding sequence
atgtttgaagaaaaggcaagttctccaagcggaaaaatggggggagaggagaaacctatcggcgctggtgaggagaaacagaaggaaggagggaagaaaaagaataaagaagggagcggcgatggagggagggctgagctgaacccttggccagagtatatctatactcgtctggagatgtataatatactgaaagccgaacacgactccatcctcgccgaaaaggccgaaaaggacagcaagcctattaaggtgaccctgccagatggaaagcaggttgacgccgagtcgtggaaaacgacaccttatcaaattgcttgcggcatttcccaaggcctggctgacaacactgtgattgctaaagtcaacaatgtggtgtgggatctcgacaggccgctggaagaagattgcacactggagctcttgaaattcgaagacgaggaggcccaagctgtgtattggcattcctctgcccatatcatgggagaggccatggaacgcgtttatggcggatgcctctgctacggccctcccatagagaacgggttctactacgacatgtacctggaagagggcggtgtgtctagcaacgatttcagctcactggaagccctctgcaagaaaatcatcaaagagaaacaggccttcgagaggctggaggttaaaaaagaaacactattagcaatgtttaagtataataagttcaaatgccggatcttgaacgagaaggtcaatacaccgacgacaacagtgtacaggtgtggccctctcattgatctatgtcgaggtccacatgttaggcacaccggaaaaattaaagcactcaagattcacaaaaatagttcgacatactgggagggcaaagccgacatggaaacccttcaacgcatctatggaataagtttcccagaccccaagatgctgaaggaatgggagaagttccaggaggaggctaagaacagagaccacaggaagataggacgtgaccaggagctgtactttttccacgaactgtcccctggcagttgtttcttcctgcccaagggagcctatatttacaacgcccttattgaatttatcaggtcggaatataggaagcgcggttttcaggaagtggtgacccccaacatattcaactcgagactgtggatgaccagcggacactggcaacactactccgagaacatgttctcattcgaagtcgagaaagagttatttgcgctcaagccaatgaattgcccaggccactgtctgatgttcgaccaccggccaaggagctggcgagagctccctctcaggttggcagactttggagtcctacaccgcaatgaactatccggggctctgaccggcctgactagggtccgacgcttccagcaggatgatgctcacatcttttgcgctatggagcagatcgaggacgagattaaggggtgtctcgatttcttacgtacggtctattcagttttcggcttctcgtttaagctgaacctctcaacgaggcccgagaaattcctgggtgacatcgaggtgtgggaccaagctgagaaacaactggagaacagcctcaacgagtttggggagaagtgggagttgaattccggcgatggtgcattctatggtccaaaaatcgacatccagattaaagacgccattggacggtaccatcagtgcgctacgatccagctggatttccagctgcctatccgctttaacttgacatacgtgtcccatgatggggacgacaagaagagaccagtgattgtccatagggctatcctcggtagcgtggaacgcatgatcgccatcctcactgaaaactatggtggcaagtggcctttttggttgtctcctcggcaggtgatggtcgtgcccgtgggccctacttgtgacgagtacgcacaaaaggtgcgccagcaatttcacgacgccaagttcatggccgatattgatttggaccccggttgtacactgaataagaagatcagaaatgctcagctcgctcagtacaactttattttagtcgtaggcgagaaagagaaaatctcaggcaccgttaatatccggaccagagacaataaggtgcacggagaaagaaccataagcgagactatagaacggctccagcagctgaaggaattccgatcgaaacaagctgaggaggagttctag

SEQ ID NO: 243982 - DNA, 1809 bp, Artificial Sequence
  Description of Artificial Sequence: Synthetic coding sequence
atgatccctttctggcaaaaacggcagaaaaagatagcatcccaactgaaatctctgtgccttatggttaataggctaatgaggaatctggggaagcttcatcacattaaattaccggtcgaactggccatggagagggtgtatgggggatgtctctgttatggcccacccatcgaaaatggcttttactacgacatgtacctggaagagggaggtgtcagctcaaatgatttctcctcactcgaagcactatgcaaaaaaatcataaaggaaaaacaggcttttgaaagactcgaggtgaagaaggagaccctgctggcgatgttcaagtacaacaagttcaagtgtcgaatcctcaacgaaaaagtgaacacacctaccacaaccgtttaccgctgtgggccactgattgatttgtgcagaggccctcacgttagacacactggtaagattaaggccctgaagatacataaaaatagcagtacctattgggaaggcaaagccgatatggagaccctgcagcggatctatgggatcagcttccccgacccgaaaatgctgaaggagtgggagaaattccaagaggaggccaaaaatcgggaccacagaaagattggtcgcgaccaagagctgtacttcttccacgaactgagccctggctcatgcttcttcctgccgaagggtgcttacatctacaacgctttaatcgagtttatcaggagtgaataccgaaaaaggggcttccaggaggtggttacccctaacatttttaatagccgtctctggatgacaagcggtcattggcaacattatagcgaaaatatgttttcgtttgaagtggagaaagagctattcgcgcttaagccgatgaactgcccaggacactgcctgatgtttgatcatagaccaagatcatggagggaactgccgctgaggctggccgacttcggggtgctacaccgaaatgagctatcaggcgctcttacggggttgacccgcgtaagaagattccagcaggatgatgcgcacatcttttgcgccatggaacagatcgaggacgagatcaaaggttgcctggattttctccggacggtgtacagcgtgttcggcttctcttttaagctgaatctgagtacccgcccagagaaatttctgggcgacatagaggtttgggatcaagcagaaaaacagctggaaaattcgctcaatgaattcggagagaagtgggagctcaatagcggtgatggcgcattctatggcccaaagattgacatacagattaaggacgccatcggcaggtatcaccagtgtgccaccattcagctggacttccagctccccatcaggttcaaccttacgtacgtctcacacgatggagatgacaaaaagcggccagtcatcgtgcatagagcgattcttggaagcgtcgagcgcatgatcgctatcctcaccgagaattacggagggaagtggcccttttggttatctcctcgccaagtaatggttgtcccggttggcccaacgtgcgatgagtacgcccagaaagtgcgccagcagtttcacgacgccaaatttatggctgatatagacctggatccagggtgcaccctgaacaaaaagatacgcaacgctcagttggcacagtataactttatcctggtggtgggagaaaaggaaaaaatttctggcacagtcaatatcagaacccgagataataaggtgcacggggagaggactatttctgaaacaattgaacggctgcagcaactcaaagaatttaggtccaaacaagcagaggaggaattttag

SEQ ID NO: 243983 - DNA, 2271 bp, Artificial Sequence
  Description of Artificial Sequence: Synthetic coding sequence
atgtttgaggaaaaagcgagtagtcctagcggcaagatgggcggagaggagaagcctattggtgcgggagaggagaagcagaaagaaggcggaaaaaagaagaacaaagaagggtcaggggacggcggtcgcgctgagctgaatccatggcccgagtatatttatactcgactggaaatgtataatatcctgaaagccgaacacgattccatccttgccgaaaaggcggagaaggacagtaagcctatcaaggtcaccttgccggatgggaaacaggtggatgccgaatcttggaagactacaccgtatcaaatagcttgcggaattagccacaccgcatcgtgtaaaaatctcagttctctcgcatctctgctggcatcggtggccattccctcgagtggtatgccatggcccccactcttcttcctgcaggggttggcagataacacggtgattgccaaggtgaataatgttgtctgggacttagacagaccacttgaggaagactgcaccctggaactgttaaagttcgaggatgaggaggctcaggcagtgtactggcactcatctgcacatatcatgggagaggccatggagagagtttacgggggatgcctgtgttacgggccacccatcgaaaatggattctactatgatatgtatttggaggaggggggagttagctccaatgacttctcatccctggaagcactctgcaagaaaataattaaggaaaagcaagccttcgagcgcctcgaagtgaagaaggagacattactcgctatgttcaagtacaataagttcaaatgccggatcctgaatgagaaggtgaacactccaactaccaccgtttaccggtgcggcccattgatagatctatgtagggggcctcatgtgagacacaccggtaagatcaaagctttgaagatacacaagaatagtagtacttactgggaaggtaaagcggacatggagaccctgcagaggatatatggcatctcttttcctgacccaaagatgcttaaggagtgggagaagttccaggaagaagctaaaaatcgcgatcaccggaagatcgggagagaccaggagctgtattttttccacgagctttcaccgggatcttgttttttcttgcctaagggcgcttacatctataatgccctcattgagtttatcaggagcgaataccggaagagggggttccaggaggtagtcacacctaatatcttcaatagcagactttggatgacttccggccactggcagcactatagcgagaatatgtttagcttcgaggtggagaaggagctgtttgccctcaagccaatgaattgtcccggacactgcttaatgtttgatcaccgaccgaggagttggcgcgagctgcccctgagactggcagattttggggtgttacacagaaacgaactttcgggggcattgaccggcctcactcgagtgaggcgctttcagcaggacgatgcgcatatcttttgtgctatggagcagatagaggatgaaatcaagggctgtctagatttcttgaggacagtctattccgtctttggattcagtttcaagctcaacctgtctacacgccctgagaagttcctgggggatattgaagtgtgggaccaggcagagaaacaacttgagaactccctgaatgagtttggggagaagtgggagctcaattccggggatggcgcattctatggccctaaaatcgacatacagataaaggatgccattggaagatatcaccagtgtgcaacgatacagttggactttcagctgcccattcgcttcaacctgacgtacgtgagccacgatggagatgacaaaaaacggccagtcatcgtacacagagcgatcctcggctctgtggagaggatgattgcgattctgacagagaattatgggggtaagtggcccttctggcttagccccagacaagttatggttgtgcctgttgggccaacttgcgacgagtacgcccagaaagtgaggcagcagtttcatgatgctaaatttatggctgatatcgacttggacccgggttgtacacttaacaagaagatccggaacgcccaacttgcgcaatacaatttcatactggtcgtaggagaaaaggaaaagattagcggtacggttaatattaggacacgagataacaaggttcacggagagagaaccatttctgaaacaatcgagcggctgcagcagcttaaggaattcaggtcgaagcaggccgaggaggaattctag

SEQ ID NO: 243984 - DNA, 2172 bp, Artificial Sequence
  Description of Artificial Sequence: Synthetic coding sequence
atgtttgaagagaaagcctcgtctccctccggaaaaatggggggagaagagaagcccattggagctggggaagagaagcagaaggagggaggtaaaaaaaagaacaaggagggctccggtgacggcggacgcgcagagttaaatccttggccggagtatatttacactcgacttgagatgtataacattctgaaagctgagcacgactccatactggccgaaaaagccgagaaggactctaagccaatcaaagtgaccttgccagacgggaaacaggtggacgctgaaagttggaagacaaccccttatcagattgcctgtggaatcagtcagggacttgcggacaacacagtgatcgccaaggtgaacaacgtggtttgggacctcgataggccccttgaagaggattgcaccctggaactgctgaagtttgaagacgaggaggctcaggctgtgtactggcattcatccgcccatattatgggggaagctatggagagggtttacggcggatgcctctgctatggcccaccaatcgagaacgggttctactatgatatgtacctggaggaggggggtgtcagcagtaacgacttcagttcccttgaggccctgtgtaaaaagatcattaaggaaaaacaggcatttgagcggctggaggtgaagaaagagaccctgctggccatgttcaaatataacaagttcaagtgccgaattttgaatgagaaggtcaatacccccacaaccacagtgtatcggtgcggccctctgattgacctctgcagaggccctcacgtacgtcacacgggtaagattaaggcactgaaaatccacaagaactcgagcacttactgggagggcaaagccgacatggagactctccagcgcatctacgggattagctttccagaccccaagatgttaaaagagtgggagaagttccaagaagaagctaaaaaccgggatcaccggaaaatcggcagagaccaggaactgtactttttccatgagttatcgccagggtcatgtttctttctgccaaagggagcttacatctataatgcgcttatcgaattcatccggtccgagtaccgaaagcgcggttttcaggaggtggtgaccccaaacattttcaacagtagactgtggatgaccagcggacactggcagcactacagtgagaacatgttctctttcgaggtcgagaaagaactgtttgctctgaagccaatgaattgtcccggacattgtttgatgttcgatcaccgcccaaggtcctggcgggaattgcccctccggctggcggacttcggtgtactacatcggaatgaactttcaggcgcattgacaggcttaacgcgcgtccgacgattccagcaggacgatgcgcacattttttgtgcgatggagcagatcgaggatgaaatcaaaggctgtctggattttctccggactgtgtacagcgtcttcggattttcttttaaacttaatctgtcaacaaggccggaaaaatttcttggcgatattgaggtatgggaccaggccgagaaacagcttgaaaattctctgaatgaatttggggagaagtgggagctaaacagcggagacggcgcattttacggtcccaagatcgacatccagatcaaggatgctattggacgttatcatcagtgcgcaactattcaactggatttccagcttcctatcaggttcaacctgacctatgtgagccacgacggcgacgataagaagcgcccagttatcgtgcaccgtgccattctaggcagtgtcgagagaatgatcgcaatactgactgagaattatggcggaaagtggcccttttggttaagtccgagacaggtgatggtggtcccagtcggtcccacgtgtgatgagtacgctcaaaaggtccgtcagcagtttcatgatgctaagtttatggctgatatcgatctcgacccaggatgtacccttaacaagaagatacggaacgcacagctggctcagtacaatttcatccttgtggtcggagaaaaggagaaaatttcagggacagttaacattagaacacgagacaacaaggtccatggcgaacgcacaatttctgaaacaattgagaggcttcagcagctcaaggaatttagaagcaagcaggcagaagaggaattttag

SEQ ID NO: 243985 - DNA, 390 bp, Artificial Sequence
  Description of Artificial Sequence: Synthetic coding sequence
atgtttgaggaaaaggcctccagtccctccggtaagatgggcggagaggaaaaacccattggagccggagaagaaaaacaaaaggaggggggaaagaagaaaaacaaagagggatccggagacggaggacgagccgagctgaacccatggcccgagtacatatatacccgcctggaaatgtacaatattctcaaggcagaacatgactctatcctggccgaaaaagctgagaaggacagtaagcctatcaaggtgacactccctgatgggaagcaggtggatgcagagtcctggaaaactactccctaccagattgcttgcggtatctcccaaggcttagctgacaacacagtaatcgccaaagttaataacgtcgtctgggatctatag

SEQ ID NO: 243986 - DNA, 1860 bp, Artificial Sequence
  Description of Artificial Sequence: Synthetic coding sequence
atggaagtggagctgtctcaggggcttgctgataacaccgtgatcgcgaaggtgaataacgtggtgtgggacttggaccggccactcgaagaggattgcacgctcgagctcctaaagttcgaggatgaagaggcgcaggccgtatattggcactcctcagcgcatattatgggtgaggctatggaacgcgtctacggcggatgcctttgttatggccctccaatcgagaatggcttttactatgatatgtatctggaggaggggggagttagctcaaacgattttagctcgctcgaagccctttgtaaaaaaattataaaggagaaacaagcctttgaaaggctcgaggtgaaaaaagagacacttttggctatgtttaagtacaacaaatttaagtgtcggatactgaatgagaaggttaatacgcctactactacggtgtataggtgtgggcctcttattgacctttgcagaggcccacatgttaggcatacaggtaagatcaaagcgctgaaaattcataaaaactcaagcacctactgggagggtaaagcagacatggagactctgcagaggatctacgggatatctttcccggaccctaagatgcttaaggagtgggaaaaattccaggaggaggctaaaaaccgagatcaccgtaaaatcggccgtgatcaggagctgtatttcttccatgaactgtccccaggaagctgttttttcctccccaaaggtgcctatatttacaatgcactaattgagttcatccgatccgaatatcgcaaacgcggatttcaggaagtggttactccgaacattttcaactcgcggctctggatgaccagtgggcattggcagcactattcagaaaatatgttttcattcgaggtcgagaaggagttgttcgctctcaagccaatgaattgtcccggacattgtctgatgtttgatcatcgtccacgatcatggagagagctgccactccgattggccgatttcggagttctgcatcggaacgagctatccggggctctgacaggcctgaccagggtgcgccgtttccagcaggacgatgcccacatcttctgcgcaatggagcagattgaagacgagattaaagggtgtcttgacttcctgagaactgtgtactccgtctttggtttttctttcaagctgaatctgtcaacccgcccagagaagtttctgggagatatagaggtctgggatcaagctgagaaacaactagagaatagcctgaacgaatttggcgagaaatgggaactgaatagcggcgatggcgcattctacggacccaaaattgacatccaaatcaaggatgccatagggagataccatcagtgcgctactatccaattggattttcagttaccgataagattcaacctcacgtacgtgtctcatgacggagacgacaagaaacgccctgttattgtacatcgtgcgatactgggcagtgttgaaaggatgatcgccattctgacggaaaactacgggggtaaatggcccttttggttatctcctcggcaggtgatggtcgtccccgtggggcctacctgcgatgaatacgcccaaaaagtccgccagcagttccatgacgcaaaattcatggccgacatcgatctggaccccggatgtaccttgaacaagaagattagaaatgctcagctggcgcaatataatttcatccttgtggtgggagagaaggaaaaaataagcggcaccgtgaacatacggaccagagataataaggtccacggagagaggactatctcagaaaccattgagcgtttacaacagctcaaggagttccggtcaaagcaagccgaggaggaattctag

SEQ ID NO: 243987 - DNA, 1332 bp, Artificial Sequence
  Description of Artificial Sequence: Synthetic coding sequence
atggaacacaatccattacccacatccccagctgaccagtttaacaccggcagatactgtagtggtccaagcaccgagtacggtttctaccatgacttttttctagggaaagagaggtgtggcacgctggtcgatttgtgccagggcccacatcttcgccacaccggacaaattgggggactcaaactactgagcgcggaatatgcacacagagggttcagcgaggtgaaaacaccaactttgttctccactaaactgtgggaacagtcgggtcactgggaacattaccaggaggacatgttcgccgttcagccaccagggagcgaccgacctccttcctcgcagagcgacgatagcactagacacatcacagacaccctagctctgaaaccgatgaactgccccgcacactgccttatgttcgctcaccggccacggtcctggcgagaactcccactacggctagccgatttcggggctctgcatcgggctgaggccagcggagggttaggtggactgactcggctcagatgcttccagcaggatgatgcccacatcttttgtaccaccgaccagcttgaggcggaaattcagtcctgcctcgatttcctaaggagtgtgtacgctgtccttgggttttcgtttagactagccctgagtactcggccatctgggtttttgggagatccctgcctttgggatcaggccgaacaggtgctcaagcaagctctgaaagagtttggagagccctgggaccttaatagcggagacggggctttctatggcccaaagattgacgtgcatctgcacgacgcattgggccgaccccatcaatgtggtactatacaactcgacttccaacttcctctaagattcgacctgcagtataaaggacaggctggagccctggagagacctgtgcttatacatcgagccgtactcggatccgttgagcgactgctcggagtgctagcggagtcctgtggcggaaagtggccgctctggctaagccctttccaggttgtggtgatccctgtgggctcggagcaggaagaatacgccaaggaggcccagcagtctctgagagccgctggcctggtttcggacctcgacgcagatagcggcttgactctgagccggaggataaggcgcgcacagctcgcacactacaactttcagtttgttgtgggccaaaaagaacagtctaaacgcactgtaaacattcggactcgtgataatagacgactaggggagtgggacctccctgaggccgtgcagcgcctcgtggagcttcagaacacgcgggtgccaaatgcggaagaaatattttag

SEQ ID NO: 243988 - DNA, 1332 bp, Artificial Sequence
  Description of Artificial Sequence: Synthetic coding sequence
atggaacacaatcccctacctacctcccccgctgaccagtttaacacgggccgttattgccgaggaccgagtacagagtatggcttttatcatgacttctttctcggcaaggaaagatgtggaacgctcgtagatctgtgtcagggtccccacttgagacacaccggccagatcggtggtttgaaacttctgagcgcagagtacgctcatcggggattcagcgaggtgaagacgcctactcttttttcaactaaattgtgggagcagtccgggcactgggaacactatcaggaagacatgttcgcggtacagccaccagggagtgatcgccctccttcgtcacaaagtgatgatagtaccaggcacatcactgacacgcttgcactgaagccaatgaactgtcctgcgcattgtctgatgttcgcccatcggccacggtcctggcgagagctgcccctgagactcgccgattttggagcccttcatcgggcagaggcctctggcggattagggggacttactcggctgcgatgcttccagcaggatgatgcgcacatcttttgcaccaccgatcagctggaagcggagatccagtcttgtctagatttcttgcggtccgtctatgccgttctcgggtttagtttcaggctcgccctgtcaacacgacccagcgggtttttaggtgatccctgcctatgggatcaggcagaacaggtgttgaagcaggcactaaaagagttcggcgaaccttgggatctgaactctggtgatggcgcattctatgggccaaagatagacgtccacctgcacgatgcactggggaggccgcaccaatgcggcacaatccagctcgatttccagctcccgctacgctttgatctgcagtacaaggggcaggcaggtgctcttgaacggcctgtcttgatccaccgggctgtcctgggaagcgtggaaagacttctaggagttcttgctgaatcttgtggcggtaaatggcccctttggctgtcccccttccaagttgtggtgattcccgtgggtagcgaacaggaagagtacgctaaagaagcccaacagtccctcagagccgctgggctggtgtctgatctcgatgccgattcaggactgacactgagtcgccgtattcggagagctcaactcgcgcactataattttcagttcgtagtagggcagaaggagcagagtaagcggactgtaaacattcggacaagggataatcgcaggttaggagagtgggatctgcccgaggccgtacagagactggtagaactccagaacacccgagtgccaaatgccgaagaaatcttttag

SEQ ID NO: 243989 - DNA, 537 bp, Artificial Sequence
  Description of Artificial Sequence: Synthetic coding sequence
atggctctgtaccagagatggaggtgtctgcgtctgcagggacttcaggcctgcaggctgcacaccgctgtggtgtcaacaccaccacgctggctggccgaaaggctgggcctgtttgaggagctctgggctgcgcaagttaagcggctagcctcaatggctcaaaaagaacctcgtacaatcaagatttcactgccgggtggacagaagattgatgcagtggcatggaataccacaccatatcagttagccaggcaaatctcaagcacgctcgccgatacagccgtggcagctcaggtgaacggggagccttacgacctcgagagacccctagagaccgactccgatctgcggtttctgactttcgatagtcccgagggcaaagccgtttctttcttcctgattagaaatacagtgaccactaagcctagggatatcgaggctggcaactccaacatcctttttttttgcaggagtttcagtatctgcagctgggagggagaccttcctcaaacagttctgactatctctggatag

SEQ ID NO: 243990 - DNA, 1767 bp, Artificial Sequence
  Description of Artificial Sequence: Synthetic coding sequence
atggcactatatcagcggtggcgatgcctgcggctgcaagggctgcaagcctgcagacttcataccgccgtcgtctctactccccctcggtggctggccgagcgtctggggctgttcgaagaattgtgggctgctcaagtgaaacgactggcttcaatggcgcagaaagaaccgaggacgataaagataagcctgccgggaggtcagaagatcgatgccgtcgcttggaacaccacgccctaccagctggcacggcagattagttcaacccttgcagacactgccgtggctgcccaggtgaacggcgagccatacgatctggagcgccctctcgaaacagatagcgacctgcgcttcttaacctttgactccccggaggggaaagctgttttttggcactcttcaacacacgtcttgggagccgctgcagagcagttcctcggtgcagtcctttgcaggggaccatccaccgagtacggattttaccacgatttcttcttgggaaaggagaggactatccgtggaagcgagctgcccgtactggaaaggatttgtcaggaacttacagccgctgcacggcctttcaggagactggaagcgtccagagatcagctgaggcagcttttcaaagctgaatacgcccaccgcggattctctgaagttaagacccctacactattctctactaagctgtgggagcagtctggtcactgggagcactaccaggaggatatgttcgccgtgcagcccccaggttcagatcgccctcctagcagccagtctgacgacagcacccggcacatcactgacaccttagctctgaaacccatgaattgtccagcccactgtctcatgttcgcacacaggccacgcagttggagggaactgcctttaagacttgctgacttcggagctctgcaccgggcagaagcatcggggggtctaggtgggctgacaagactccgctgtttccagcaggacgacgcccacatattctgcacaaccgaccagttggaggccgaaatacagtcttgtctggattttttgcgaagcgtctacgcagtcctgggtttcagtttcaggttagcactgtctacgaggccctcaggcttcctcggggacccttgcttgtgggaccaggccgagcaggtgctaaaacaggcattgaaggagttcggtgagccctgggacttgaactccggcgatggcgcattttacggtcccaaaatcgacgtccatctgcatgacgctctgggtcgaccacatcagtgtgggacaattcaacttgatttccaactacccctacggtttgacctgcagtataaagggcaggctggagcgcttgagcggcctgtgctgatccacagagccgtcctagggagtgtcgagaggctgcttggcgtgttagctgaatcgtgcgggggtaagtggcccctctggctgtctcccttccaggttgtcgtgatcccagtcgggtcggaacaggaagagtacgctaaggaggctcagcaatctctgcgggctgctggcctggtctctgacctcgatgctgactcagggctcactctgagccgtaggatccgcagagcacagcttgctcactataatttccagttcgtggtgggtcagaaggaacaatccaaacgcacagtgaatatccgcactcgagataatagacgactgggcgagtgggacttgcctgaagcagtgcaacgtttggtggagttgcagaatacacgcgtgcctaacgccgaggaaatcttttag

SEQ ID NO: 243991 - DNA, 2157 bp, Artificial Sequence
  Description of Artificial Sequence: Synthetic coding sequence
atggcactgtatcagcggtggagatgcctccgacttcagggtctccaggcttgcaggctgcacaccgctgttgtaagcaccccacccagatggctggctgaacgtttaggtctgtttgaagagctatgggctgcccaagtgaaacgactagcaagtatggcacagaaggagcccaggacaatcaagatctccttgcctggagggcaaaaaatcgatgcggttgcttggaacacgaccccttatcagcttgctcgacagatcagctctactctggcggatacagctgtggcagcgcaagtgaatggggaaccttacgatctggaacggcctttggagacagactccgatcttcggttcctgaccttcgattcgcccgaggggaaggcagttttttggcactccagtacccatgtcctgggggctgctgcagagcagtttctgggggcagtgctctgccgcggaccctctaccgaatacggtttctatcacgactttttccttgggaaggaaaggactattcggggaagcgaactgccagtgctggaacgcatctgccaggagctcacagctgccgctaggccatttaggcgtctggaggctagcagggaccaattgagacaactgttcaaggataatccattcaagctccaccttattgaggagaaagtgacagggcctacagctaccgtgtacggatgtggcactttagtggatctgtgtcaaggaccccatctgagacacactggtcagataggaggtctaaagttactgagtaactccagctccttatggaggtccagcggtgcacccgaaacattacaaagagtgtctggcatttctttccctacaacggagttgctcagagtctgggaagcttggagggaagaagccgagctcagagaccacaggcggattggcaaggaacaagagttgttctttttccatgagcttagcccaggtagctgcttttttctgcccagaggtacacgggtgtacaacgccctggtggcttttatccgcgcagagtatgcccaccgtggcttttctgaggtgaaaacccccacgctgttcagcaccaagctgtgggagcagtccggccactgggagcattaccaggaagacatgtttgcagtccagccgcctggatctgatcgaccaccgtcaagccagtcagacgactctacacgccatatcacggatactttggcccttaagccgatgaattgccccgctcactgtctaatgttcgctcaccggccaagatcatggcgggagcttcctctaaggctcgcggacttcggagcccttcaccgggctgaggccagtgggggtttgggcggtcttacccgactcagatgcttccagcaggatgacgcacatatcttttgtacaacagaccagctggaggctgagatccagtcatgcctggatttccttcggtccgtctacgcagtccttggcttttcatttcgactcgctcttagtacaaggccttccgggtttctcggtgatccttgtctgtgggatcaagcggaacaagtcttgaagcaggcactgaaggagtttggtgagccatgggacttgaattctggggatggggctttctacggacccaaaatagatgtgcaccttcatgacgccctgggaaggcctcaccaatgcggcacaattcagctggactttcaactaccactgcgtttcgatttgcaatataaggggcaggctggcgcactcgagcggccagtgttgatccatagagccgttctcggatctgtggagaggctgctgggcgtcctggctgagtcttgtggtggaaaatggccactatggctgtctcctttccaggtggtcgtgatacccgtgggaagtgagcaggaagagtatgcaaaggaggcccagcagtctctgagggcggctgggttggtgagtgacttggacgccgactcaggacttactctcagcagacggattaggcgcgcacagttagcccattataactttcaatttgtcgtgggccagaaggaacagtccaagcggaccgtcaacattagaacgagggacaatcgtaggctgggcgagtgggacctccctgaggccgtccagcggctagtggaactgcagaacacccgtgtgccaaatgcggaggaaatcttctag

SEQ ID NO: 243992 - DNA, 510 bp, Artificial Sequence
  Description of Artificial Sequence: Synthetic coding sequence
atggccctctatcaacgctggcgctgcctacgccttcagggcctacaggcgtgtagactacacaccgccgtcgtgtcgaccccacctaggtggctcgccgaacgactcggattgtttgaggaattgtgggctgctcaggtcaagagactagcttcgatggcacagaaagagccgagaacaattaagatatccttgccaggtggtcagaaaattgacgccgtggcctggaacaccacgccttatcaactggctaggcagatcagctccaccctggccgacaccgcggtcgctgcccaggttaatggggagccttacgatctcgaacgtcctttagagaccgacagcgatctcagatttcttacatttgattctcccgaaggcaaagccgacaatcctggcctgagggccgcatgcttcggcgctgacctccccggtacatactcctgctgcagcacattgcccgaggcccgtggcttcaccggatccgcgagcccagtggtacagggctag

SEQ ID NO: 243993 - DNA, 4974 bp, Artificial Sequence
  Description of Artificial Sequence: Synthetic coding sequence
atgggactgcaggcaaggcgatgggcctcagggagccgtggcgcagccggtccgaggcgtggcgttctgcagctgctcccactacccctgcccctgcccctgctgctgttgctcctgctgcgaccaggagcagggagagccgctgcacagggggaggctgaagcacctaccctttatctctggaaaaccgggccatggggcaggtgcatgggcgatgaatgtgggcctggcggtatccagacacgggctgtctggtgcgcacatgttgagggttggacgactctgcacacaaactgcaaacaggccgagcggcctaataatcagcagaactgtttcaaagtgtgtgattggcacaaggagctgtacgactggaggcttggcccatggaaccaatgccagcccgtcatcagcaaaagcttagagaagcctctggagtgtattaagggggaggaaggtatacaagtgagggagattgcttgtatacagaaagataaggacattccagccgaggatatcatatgcgaatatttcgagcccaaacccctgctggagcaggcctgtctgattccttgccaacaggactgtattgtcagcgagttcagtgcttggtccgagtgctccaagacttgtggatctggtttgcaacataggacccgccatgtggtggcgcctccacaatttggcggaagcggatgtcctaacctaactgagttccaggtgtgccagagcagcccttgcgaggccgaggagctgcgatatagcttacatgtcggcccatggtcaacatgctccatgcctcactctcggcaggtacggcaagctcggagacgcggtaagaacaaagagagggaaaaagatcgatctaagggcgtgaaagaccctgaggccagggaactgatcaaaaagaagcgcaatcgaaatcggcagaaccggcaggaaaataaatactgggacatccagatcgggtatcagacaagggaggtaatgtgtattaataagaccggcaaggcagctgacttgagcttttgccagcaggagaaactgcccatgacctttcagagctgtgttatcacaaaggagtgccaggtgtccgagtggtctgaatggtctccatgttctaagacatgtcacgacatggtttcccctgccggaacaagggtgcgcacacggacaataaggcaatttcctatcggctcagagaaggagtgccccgagtttgaagagaaggaaccttgtctctctcagggcgatggggtagtgccctgtgcgacttatggatggcgcacaacggagtggaccgagtgcagagtggaccctctgctaagccaacaggataagagacggggaaatcaaactgcactatgtggtggaggaatccagaccagagaggtgtactgtgtgcaggctaatgagaatttgcttagccagctgtccactcataaaaataaagaggccagtaagccaatggatctcaagctgtgcacaggccctattcctaacacaacacagctgtgtcacattccttgcccgactgaatgtgaggttagtccgtggtctgcctggggaccttgcacctatgagaattgtaatgaccagcaagggaagaagggtttcaagctccgtaagagacgcattaccaatgagcccacagggggaagcggagtgaccggaaactgcccccatctactggaagctattccttgtgaggagccagcttgttatgattggaaggccgtgagactgggcaactgcgaacctgacaacgggaaagagtgcgggccagggactcaggtgcaggaagttgtgtgcattaatagtgacggcgaggaggtagaccgtcagctctgccgcgacgccatcttcccgatcccagtcgcctgtgacgcaccttgcccgaaggattgtgtgctcagcacgtggtccacgtggtctagctgttcccacacctgttcaggtaaaaccaccgaaggcaaacagattcgtgcacgtagcatcctggcctatgctggagaggaagggggaattcggtgtccgaatagttcagcgctgcaggaggtgagatcctgcaatgagcacccatgcacagtgtatcactggcagacaggtccctggggccagtgtatcgaggacacatccgtctccagttttaacaccacaactacctggaacggtgaggcatcttgtagtgtgggaatgcaaacccggaaggtgatctgtgtccgcgttaatgttgggcaagtgggaccaaagaaatgtccggagagcctacgcccagagacagtgcgaccttgcttgctgccatgtaaaaaggactgcatcgtgacaccctactctgactggacgtcctgtcccagcagctgtaaggagggagacagtagcatacgcaagcagtctaggcaccgggtgatcatacagttacctgctaacggtggcagagattgtaccgacccgttatatgaagagaaagcttgtgaggcgcctcaggcttgccagtcatacagatggaaaacccataagtggcggcgttgccagctggttccatggtctgtgcagcaagattcaccgggtgctcaggagggctgtggtcctggacgccaagcccgagcaattacatgtaggaaacaggacgggggacaggcaggtatacatgagtgtctgcaatatgcagggccagttccggcattgacacaggcgtgtcaaatcccctgtcaagatgattgtcagctcacttcatggtccaagttctcctcgtgcaatggggattgcggagccgtgagaacaaggaaaagaacactggtgggcaagagcaagaagaaggaaaaatgcaaaaactcgcacctttatcccctcattgaaacacagtactgtccatgtgacaaatataatgcgcagccggtggggaattggtccgattgtattctcccagaggggaaggtcgaggtcctcctgggcatgaaggttcaaggggacattaaagaatgcgggcaggggtatcggtatcaggctatggcttgctacgatcagaacgggagactcgttgagacttcccggtgtaattcccacggctacatcgaggaggcatgtatcatcccctgtccaagtgattgtaaactttctgaatggtccaactggtctaggtgcagtaagtcctgtgggagcggggtgaaggttcggtctaaatggctgagagaaaagccatataatggcggacgaccatgtccaaagttggaccacgtcaaccaattccaagtctacgaggtagtcccgtgccacagcgattgcaaccagtacctgtgggtgacagagccctggagcatctgcaaggtgacattcgttaacatgagagagaactgcggcgaaggagtccagaccaggaaggttaggtgtatgcagaatacggccgatgggccatccgagcatgtggaagactatctatgcgacccggaagagatgcctctaggttcccgcgtttgcaaacttccatgccccgaggattgcgtgattagtgaatggggcccttggacacaatgtgtgctgccatgcaaccaaagcagctttcgccagagaagcgctgatcctattagacagccagctgatgagggtcggagctgccctaacgccgtagaaaaagagccctgtaaccttaataaaaattgctaccactatgactataatgtgacagactggagcacttgtcagctaagcgagaaagccgtctgtgggaacgggatcaaaacccggatgttggactgtgtgagaagcgatggaaagtccgtagacctgaaatactgcgaggctcttgggttagaaaaaaactggcagatgaatacatcatgcatggtagagtgccccgtgaattgccaactaagtgactggtccccctggtccgagtgctcccagacatgcggcctgaccggcaagatgattcggaggcgaaccgtcacccagcctttccagggggacgggaggccctgtccttccctcatggaccagagtaagccttgcccggtcaaaccttgctataggtggcagtacggccagtggtctccctgtcaagtacaggaagcccaatgtggggaaggaacaaggacaaggaatataagctgtgtagtatctgacggctctgccgatgacttctccaaggttgtagacgaggagttctgcgctgatattgagctgatcattgacggaaacaaaaacatggtgctggaggaatcatgtagccagccctgccctggcgattgttacctcaaggactggtcctcttggtccctgtgccaactgacctgtgttaatggggaggaccttggtttcggcggaatccaagtgaggtcccgtcctgtgatcattcaggagctggagaatcagcacctctgtccagaacagatgctggagaccaaaagttgttatgacggacagtgttatgagtataagtggatggcttcggcctggaagggcagctcaaggacagtgtggtgccagcggtccgacggcatcaacgtgactggcggttgtctggtgatgtctcagccagatgctgatcgctcctgcaaccccccttgttcacagcctcattcttattgcagtgagactaagacctgtcactgcgaagagggatatacagaggtgatgtcaagtaactcgaccctcgagcaatgtactctaatccctgtggtggtgctgcctactatggaagataaacggggagatgtgaagaccagtcgcgctgtgcacccaactcagccctcctcgaatccagccggtcgcggaaggacatggtttcttcagccgttcggaccagatggcagactcaagacttgggtttacggagtggcagccggtgcattcgtcctccttattttcatcgtctcaatgatttatcttgcatgtaaaaaaccgaagaagccacagcgacgccaaaataaccggctgaagcctttgacactcgcctacgatggagatgccgacatgtag

SEQ ID NO: 243994 - DNA, 4973 bp, Artificial Sequence
  Description of Artificial Sequence: Synthetic coding sequence
atgggactgcaggcaagacgctgggcatctggctctcgtggagcagccggtccacggagaggcgttctgcagcttttgccactgcccctgcctctgcctctactactcctgttgctgctccgccctggagccggacgggcagcagcccaaggggaggcagaggcccctacattatacctctggaaaaccggaccttggggaaggtgtatgggggacgagtgtggtccaggcggaatccagacgcgagccgtgtggtgcgctcacgtggagggatggaccacactacacaccaactgcaagcaggctgaacggccaaacaatcagcagaactgctttaaagtgtgtgattggcacaaggaactgtacgattggcggctcgggccttggaatcagtgtcagccagtgattagcaagtccttagagaagccgttagagtgcattaagggcgaagagggtatacaggtgcgtgagattgcttgtatccagaaagacaaggatatacccgctgaagacattatttgcgagtattttgagcctaagccactgcttgaacaggcatgcctgatcccttgtcaacaagactgtattgtgagtgagtttagcgcttggtctgagtgttctaaaacatgtggctctggcttgcaacataggactcgccacgtggtggctccaccgcagtttggcggatcaggatgccccaacctgaccgaattccaagtgtgccagagttccccctgcgaagccgaggaactccggtattctctgcatgtcggcccatggagtacatgctccatgcctcatagccgccaagtccgtcaggccagaagaaggggaaagaacaaagagcgggagaaggacagatcaaagggcgtgaaggacccagaggctcgggaactgattaagaaaaaacgaaatcggaatcggcagaacagacaggaaaataaatactgggatatccaaatagggtatcaaacccgggaggtcatgtgtatcaataaaaccggaaaggctgccgatctttcgttctgccaacaggagaaactcccaatgacattccagtcctgcgttatcacaaaggagtgtcaggtgagtgaatggtctgaatggtctccctgctctaagacgtgccacgacatggtgagcccagccggaacgagggtgaggacacgaacaattcgccagtttcctatcgggtccgaaaaggaatgccccgagttcgaggaaaaggagccttgcctgagccagggagacggtgtggtgccatgcgccacgtacggatggcggaccacggagtggaccgagtgtcgggttgacccactcctgtcccagcaggacaagcggagaggcaatcaaaccgccctctgtggcggaggcattcagaccagggaggtgtattgcgttcaggcgaacgagaacctgctgagtcagctaagcacgcacaaaaataaggaagcttccaagccaatggatctgaaactctgtacaggcccaattccaaatactacccaattatgccatattccctgtcctacagagtgcgaggtctccccctggtcggcgtggggaccttgcacttacgagaattgtaacgatcagcagggtaagaagggctttaagctccgaaaaaggcgtattacaaatgagcctaccgggggtagtggggttacaggaaactgccctcacctgcttgaggccattccgtgcgaagagcctgcttgctacgattggaaggctgtgagactcggtaattgcgagcccgataacggaaaagaatgtggccctggaacccaggtccaggaggtggtatgcattaatagtgatggcgaagaggttgatcgccagctctgtcgagacgctattttcccaatcccagtagcgtgcgacgccccttgtcctaaggactgtgtgctgagtacctggtctacctggtcctcttgctctcatacgtgctctgggaaaaccaccgaggggaaacaaatcagggctagatctatcctcgcctatgcaggtgaggaggggggtatccggtgccccaacagctcagctctgcaggaagtgcgaagctgtaatgagcacccttgcactgtttaccactggcagaccggtccctggggacaatgtattgaggatacaagcgttagtagtttcaacaccacaactacatggaacggggaagcctcttgctcagtgggcatgcaaacaagaaaggtgatctgtgtgcgcgttaacgttggtcaggttggtccgaaaaagtgtccagagagcctccggccagagacagtgcggccatgcctgctgccctgtaaaaaggactgtatcgtgactccatacagtgactggactagctgtccctcctcctgcaaagagggcgacagttctataagaaagcagtcccgtcaccgagtcattattcagttgccagctaatggtggcagggactgcacagatcctttgtatgaggagaaggcatgtgaagcccctcaggcctgccagtcatacagatggaagacccacaagtggagacgatgccaactggtgccttggtctgtgcagcaggactctccaggagcccaggaaggatgtggtccagggcgtcaggcccgtgccattacttgccggaagcaggacggaggccaggccggaattcacgagtgtttgcagtacgccggtccagtgcccgcattaacccaggcttgtcaaatcccctgccaggatgactgccaactgacttcctggtctaagttttcgagttgcaacggagactgcggggctgttagaactagaaagaggacccttgtcggtaagtccaagaagaaagagaagtgtaagaacagccacctctatccccttatcgagacacagtattgcccttgtgacaaatacaacgcccaaccagtcggtaactggagtgactgtatactacctgagggaaaggtcgaggtgcttcttgggatgaaggtgcagggcgatataaaagaatgcgggcagggctataggtaccaagccatggcgtgttacgaccaaaacggcagactggttgagacatcccggtgcaatagtcacggctatattgaggaggcatgcatcatcccatgtccttccgattgcaaactgtctgagtggagcaattggtctagatgttccaaatcatgtggaagtggagtcaaggtcagaagcaagtggctgagagaaaagccctataatggcggacgcccttgccccaagctcgatcatgtgaaccaggcccaggtctatgaggtggtgccctgtcattccgactgcaaccagtacctctgggtcaccgagccttggagcatatgtaaggtcactttcgttaatatgagggagaactgcggtgagggcgttcagacgaggaaagtgcggtgtatgcagaacaccgccgatggaccttcagagcatgtggaagactacctttgcgatcccgaagagatgcctctgggcagccgcgtctgcaagctcccatgccccgaggactgtgtaatcagtgagtggggaccctggacacagtgtgtgctgccctgcaaccagtcgagcttccggcagcggagtgccgacccaatccggcagcccgctgacgaaggaagaagctgtcccaacgccgtcgagaaagaaccttgcaacctgaataaaaactgctaccactacgattacaacgtgactgactggtccacatgtcagctcagcgagaaagccgtatgtggaaatggtatcaaaaccagaatgctggactgcgttcgttccgatggtaaatctgtggatttaaagtattgcgaagccctgggtctcgagaagaattggcagatgaatactagctgtatggtggagtgtccggtcaactgccagcttagcgattggagcccatggagcgaatgtagccagacctgcggattaactgggaagatgatcaggcggaggaccgtgacccaacccttccaaggcgacggcagaccctgcccctccttgatggatcagagcaaaccctgtccagtgaaaccttgctacagatggcagtatggacagtggtctccctgccaggtacaggaggcacagtgcggtgaaggaacacgcactaggaatatcagctgcgtggtttcagacggcagcgcagacgattttagtaaagtcgttgacgaggagttttgtgcagatatcgagctaattattgacggtaacaaaaacatggtgctggaggagtcctgttcacagccatgccccggagattgctacctgaaagattggtctagctggtccctgtgtcagctgacttgcgtgaacggtgaggacctgggattcgggggaatccaggtgcgttctcgtcccgtcatcattcaggagctggaaaaccaacacctatgcccagaacaaatgcttgagaccaagtcgtgttatgatggtcagtgctatgagtacaagtggatggccagcgcctggaaggggagtagccggaccgtctggtgccagcgatcagacgggatcaatgtcacaggtggttgcctggtaatgagccagcctgatgccgaccgctcctgtaatcctccctgctcccaaccacacagctactgctcggagactaagacctgtcattgcgaagagggctataccgaagtcatgagctctaacagtacattggagcagtgtaccctgattcctgttgtggtgctcccaactatggaggacaaacggggagacgtcaaaacatctcgtgcagtacacccaacgcagccttcatctaatccagccggtagaggacggacctggttcctccagccatttggtccagacggcaggcttaagacctgggtatatggagtcgcagctggggctttcgtgctcctcatcttcatcgtcagcatgatctatttggcttgtaagaaacctaaaaaaccccagcgcagacagaacaatcgcctcaaaccgctgacactggcatacgatggcgatgccgatatgta

SEQ ID NO: 243995 - DNA, 2010 bp, Artificial Sequence
  Description of Artificial Sequence: Synthetic coding sequence
atgtccgctctccttagcctatgctttgtactcccactcgccgcacccggtcatggcacccagggctgggaaccctgcacagatcttcggccactggacatccttgctgaggtggtgccttctgatggtgcaacatcaggcatcaggatcgtgcaggttcacggcgctcggggactccagctgagtgtggccgctcctaggaccatgtcctttcctgcatcccgcatcttcagtcaatgcgatctctttccagaagagttttcgatcgtggtaacgctcagagtgcccaatcttccgccaaaacggaatgaatacctactgactgttgtggcggaggaatccgatctgcttttactcgggctgaggctgagccccgctcagctgcatttcctgtttctaagagaggacactgccggagcgtggcagactcgagtgagcttcagatcacccgcactggttgacggcagatggcacaccctggtcctggctgttagtgctggcgtgttttccctgaccactgactgcggccttccagtggacatcatggctgacgtgcccttcccagccactttgtccgtgaaaggcgctcgtttctttgtgggcagccgacgccgtgctaagggactgtttatgggactcgtcaggcagcttgtgctgttacccggttctgacgctaccccacggttgtgccctagccggaacgcccctcttgccgtactatccattccacgggtcctccaggctttaactggcaagcccgaagacaacgaggttctcaagtatccgtatgagaccaatatacgcgttacactggggccacagcccccatgtaccgaggttgaggacgcccaattttggtttgacgcctcgcgtaagggactgtacctctgtgttggaaacgagtgggtatccgtgctggctgctaaggagcgccttgattacgtggaggagcatcaaaacctctccactaattctgagactcttgggatagaagtgtttcggatcccccaggtcggactttttgtggccactgctaaccggaaggcaactagtgctgtgtacaaatggacagaggaaaaatttgtttcataccagaacatccccacccatcaggcccaggcatggcggcattttacgataggtaaaaagatattcctggcagtggcaaattttgaacccgacgaaaaggggcaggagttctctgtcatatataagtggtcgcacaggaagctgaaatttacaccctatcagagtatcgccacccattctgccagagactgggaggccttcgaagtcgatggtgagcactttcttgccgtggccaaccacagagagggagataatcacaatattgacagtgtcatttataagtggaatccagccacaaggctcttcgaggctaaccaaaccatagcgacctccggtgcttatgattgggagttcttctccgtagggccttactcgttccttgtggtggcaaacactttcaatggtacctctaccaaagtgcacagtcacttgtacatcagattactgggcagcttccaactcttccagagctttcccacgttcggcgcagctgactgggaagtgtttcagatcggcgagagaatctttctagccgtggccaacagtcattcctatgacgtggagatgcaggtgcaaaatgattcctacgtcatcaactctgtgatttatgagctaaacgtgacagcccaagctttcgtcaaatttcaggacatcttaacatgctctgctttggattgggaattcttcagcgttggggaagattactttctggtcgtggcaaacagttttgacgggcgaacgtttagcgtcaatagcattatctaccgctggcagggttacgaaggcttcgtggctgtccattctcttccaaccgtcggatgccgcgattgggaggcatttagcacaacagccggagcatatctcatatatagcagtgctaaagagccgctctcgcgggtgctgagattgagaactagatag

SEQ ID NO: 243996 - DNA, 1800 bp, Artificial Sequence
  Description of Artificial Sequence: Synthetic coding sequence
atgtctgccctgctctctctgtgttttgtactgccacttgccgctccgggacacggtacccaagggtgggagccatgcacagatttgcgccctctggacattcttgccgaagtggtcccatcagacggggctacctcaggaattcggatcgtgcaagtgcacggcgcacggggactgcagctgagcgtcgccgcaccacggacaatgtcctttccagcctctcgcatcttctctcagtgcgacctatttcctgaggagttcagtatcgtcgtaacactcagggtccccaatctgccccctaaacggaacgagtacctactgactgttgtggcggaggaaagcgacctgctgctgcttgggttgcggctgagcccggctcagcttcactttctgtttctcagggaagacaccgccggagcctggcagacacgagtgagcttccgcagtcctgcattagtcgatggccgatggcacaccctggtcctggctgtcagtgcgggtgtgttcagcctgacaacagactgcggcctgcccgtggacatcatggctgatgtgccatttccagctaccctgagcgttaagggcgctagattttttgtaggctctcgacgacgtgccaaaggactatttatgggccttgttaggcagctagttttactgcccggaagtgatgctacccctcggctgtgcccctctcgaaacgccccactggccgttctgtcaatccccagagtcctgcaagccctgaccgggaaacctgaagacaatgaagtcctcaaatacccctatgagacaaacatcagagtgaccctgggtccgcaacctccatgcactgaggtggaagacgcacaattttggttcgatgctagccgcaagggactgtacttgtgcgttgggaacgaatgggtgtcagtccttgcagaggcaaaagagaggctcgactacgtggaggagcatcagaatttgtccaccaacagcgagactctcggaatcgaagtgtttcgaatccctcaagtcggcttgttcgtggcaactgcaaaccgcaaggccacttcagctgtgtacaaatggaccgaagagaaattcgtgtcatatcaaaatattccgacccatcaggcccaggcctggaggcatttcaccatcggaaaaaagatttttttggccgtcgcgaactttgagcccgatgaaaaggggcaggagttctccgtgatttacaaatggtcacaccgcaaactcaaattcacaccataccagtcgatagccacccactccgctagagactgggaggcattcgaggtggacggggaacatttcctggcagtggcaaaccacagagaaggtgataatcacaatatagattccgtgatctacaagtggaacccagccactcgtctgttcgaggcaaatcaaaccattgcaacctccggagcttacgactgggagttcttttcagtaggtccgtactctttcctggttgtcgccaacacattcaacgggacatcaactaaggtccactcacatctatatatcaggctcctgggttctttccagctcttccagtccttccccactttcggggctgcagactgggaagtgtttcagatcggtgaacggatcttcctcgccgtggctaatagccactcctacgatgttgagatgcaggtccaaaacgattcttatgtaatcaattctgttatctacgagctgaatgtaacagctcaagcctttgtgaagttccaagatattttgacatgcagcggcggaagaaggggattacatgccagacgggcagaagggtag

SEQ ID NO: 243997 - DNA, 1569 bp, Artificial Sequence
  Description of Artificial Sequence: Synthetic coding sequence
atgtctgcactgcttagtctgtgctttgtgctccccctagcagccccaggccatggcacgcagggctgggagccatgcactgatctgcgccctttggatatactggccgaggtcgtgccaagcgatggcgcaacctctgggatcagaattgttcaggttcacggcgctcgcggattgcagctctccgtcgccgcaccaaggacaatgagcttccccgctagtcggatcttttctcagtgtgatctgtttccagaagaattttctattgtggttactctgcgtgtccctaacttaccaccaaagaggaatgagtacttacttaccgtggtcgccgaagaaagtgacttactgctgctcgggctaagattgtctcccgcacagccgccttgtacggaagtcgaagacgcgcaattctggtttgacgccagtaggaagggtctgtatttatgtgtagggaacgagtgggtgagcgtgctggcagccaaggagcggcttgattatgtggaggaacatcagaacctgtccaccaattcagagaccctgggcatcgaggtcttcaggattccccaggtcggcctcttcgtggctactgccaataggaaagcgacttcagcggtgtataagtggactgaagaaaagttcgtgtcctatcagaacatccccacccaccaagcacaggcatggcgccacttcactattggcaaaaagatattcctggcggttgctaatttcgaacccgacgagaagggtcaagaattcagtgttatttacaaatggtctcaccggaagttgaaattcactccctatcagtcaattgcgacgcactcggctcgagactgggaggcattcgaagtggatggggagcactttctcgccgttgccaaccatcgggaaggagataaccataacattgattctgttatatacaaatggaacccggctaccaggctgttcgaggctaaccaaacaatcgcaacatccggtgcttatgattgggaatttttttcagtgggcccttactctttccttgtggttgctaacacatttaacggaactagcaccaaggtgcactctcacctctacattcgcctgctagggtctttccagttgtttcaaagttttcctacttttggcgcagcagactgggaggtattccagattggcgagagaatctttttagccgtggccaactcacactcgtacgacgtggagatgcaagtgcagaatgatagttatgttatcaattcggtgatttacgaactgaatgtaaccgctcaggctttcgtcaaattccaggatatcctgacctgttctgccctggattgggagttcttctccgtgggagaagactactttttggtcgtcgcaaattcttttgatggccgtactttctctgtcaattccattatatataggtggcaagggtacgaaggattcgttgcggtgcacagcctacccaccgttggctgtcgcgactgggaagcgttttccactactgcaggagcatacctaatctactcgagcgccaaggagccattgagcagggtgctgcgactgaggaccaggtag

SEQ ID NO: 243998 - DNA, 1605 bp, Artificial Sequence
  Description of Artificial Sequence: Synthetic coding sequence
atgatggaggccctcggcttcctgaaactggaggtgaacggacctatggtgactgtggcactgtctgtcgccctattagccctgcttaagtggtattctacgtcagcctttagccggctcgaaaaattggggctgcggcacccgaaaccaagcccatttatcgggaaccttaccttcttcaggcaggggttctgggagagccaaatggagctgagaaaactctatggcccactgtgcgggtactacctgggtcggcgaatgtttattgtaatctcagaaccagacatgattaagcaagtactcgtggagaacttcagtaatttcactaaccggatggccagtggattagagttcaaatccgtggcagacagcgttctattcctgcgcgataaacgatgggaagaggtgcgtggagctctgatgtccgccttttctcccgagaaacttaacgagatggttccactgatctcacaggcttgcgaactgctcctggcccacctgaagagatacgcggaatcaggggatgcgtttgatattcagcgctgctactgtaattacactaccgatgttgtcgcctctgtcgcatttggaactcccgtcgacagttggcaggcaccagaagaccccttcgtgaagcactgcaagcgcttcttcgaattctgtataccgcgtcccatattggtactgctactgtccttcccctctattatggtacccctggcaagaattctgcccaataagaaccgtgacgagctcaatggctttttcaacaagctgattaggaacgttatagcactgcgcgaccagcaggccgctgaggagagaaggcgcgacttcctgcagatggtgctcgatgcacggcactctgcttcccctatgggcgtgcaggacttcgacattgtgagggatgtcttcagctctacagggtgcaaacctaacccaagccgacaacaccagcctagtcctatggccaggccactgaccgtggacgaaatcgtcgggcaggcttttatatttctcatcgcgggttacgaaattatcaccaacaccttgagctttgcaacctacttactcgcaacaaaccctgactgccaggaaaaactcctccgcgaagtggatgtcttcaaagaaaagcacatggccccagaattttgttctctggaagaaggtctcccctatctggatatggtcatcgccgaaacactgagaatgtatccgcctgcttttcgctttactcgcgaagcggctcaagactgcgaggtccttggccagcgaattcccgctggtgctgtcctggaaatggccgttggcgcactgcatcacgatcctgaacattggcccagcccggaaactttcaaccctgaaaggttcacggctgaagcaagacaacaacaccgcccttttacttacctcccctttggcgcaggccctcgctcctgcctcggcgtgaggttggggctgctggaagttaagctgaccctgctgcacgttctccacaagtttcggttccaggcgtgccctgaaacacaggtgccgttgcagctggagagcaaatcagcgttgggccctaagaatggggtgtacatcaaaatcgtttcaagatag

SEQ ID NO: 243999 - DNA, 1602 bp, Artificial Sequence
  Description of Artificial Sequence: Synthetic coding sequence
atggaggcccttgggtttttgaagcttgaggtaaacggccctatggtgacagtagctctgtccgttgctctcctggcgctccttaagtggtactcgacatccgcctttagcagattagaaaagcttggacttcgtcatcctaaaccatcccccttcatcggcaatttaacatttttccgccaggggttctgggagtcgcagatggaattgagaaagctttacggaccattgtgcggctactacctaggccgtagaatgtttatcgtgattagcgagcctgacatgattaaacaggtactggtcgagaacttctctaatttcaccaacaggatggccagcgggctggagtttaagtcagtggcagacagcgtgttgttcctcagagataagaggtgggaggaagtcagaggggctctgatgtcagcgttcagccccgaaaaactcaacgagatggtccctttgatctctcaggcgtgcgagctgcttctggcccacttaaaaagatacgcagagtcaggcgatgcctttgatattcaacggtgctattgtaactacacaacggacgtagtggccagcgtcgcctttggtaccccagtcgacagttggcaagcccctgaggaccctttcgtgaagcactgtaagaggttctttgagttctgtatccccaggcctattttagtactcttactcagctttccctcaatcatggttcccttagcacgaattctgcccaacaagaaccgtgatgagctgaacgggttctttaataaactgattcggaatgtcatcgccttacgggatcagcaggcagcagaggagcgacgaagagattttctccagatggtgcttgacgcgagacattcagcgtcacccatgggggtgcaagactttgacattgtgcgggatgtgttctcctccactggctgcaaacctaacccttccagacagcaccaaccaagcccaatggccagacccctgacagtcgatgagatcgttggccaagctttcattttcttaattgctggatacgagataatcactaatactctatcgttcgctacgtacctcctggccacgaacccggattgccaggagaaactgctacgtgaagtggacgttttcaaggaaaagcacatggctcccgaattctgttccctcgaagagggcctgccgtacttggatatggtgattgcggaaacactccggatgtatccccctgcatttagatttactagagaggccgcacaggactgcgaggtgctcgggcagaggatccctgcaggtgctgttctggagatggctgtaggcgctctacaccacgacccagagcactggcccagtcctgagactttcaacccagagaggtttaccgcagaggctaggcaacagcataggccgttcacttaccttccatttggcgcaggaccaaggtcttgcctgggggtgcggttgggactgttggaggtcaaacttacacttttacacgtgctccataaatttcggtttcaggcctgccccgagactcaggtgcccctgcagctggaatctaagagtgcactgggtcctaaaaacggggtgtacatcaagattgtgagcagatag

SEQ ID NO: 244000 - DNA, 1380 bp, Artificial Sequence
  Description of Artificial Sequence: Synthetic coding sequence
atggaagcgctaggttttcttaaacttgaagtgaacgggcctatggtgacagtcgctctttccgtcgcgctccttgcgttactgaaatggtattctacgtctgccttcagccgactggaaaaactcgggctgcgccatcccaaaccctcgcccttcatcggtaacctgactttcttccgacaggggttctgggaaagccagatggagctgagaaagctttacggacccctgtgcggttactacctgggacgcaggatgttcatcgtaatttctgaacccgacatgattaaacaggtgctggtcgagaacttttctaacttcactaatcggatggcatcaggacttgagttcaagagtgtagccgatagcgtgctattcctgagggacaaacgatgggaagaggtacgcggtgccctcatgagtgccttctctcccgagaagttgaatgaaatggttccattaatatcgcaggcctgtgagttgctcctcgctcaccttaagcgctatgccgaatccggcgatgcgttcgatattcagagatgttattgtaattacactacggacgttgtcgcttctgtcgccttcggaacaccagtagactcttggcaggcaccagaagatcctttcgtaaagcattgtaaaaggttttttgaattctgcattccccgacctattttagtcttgctcttgtctttcccctccatcatggtgccactcgctaggattctgcctaataagaacagggacgaactgaatggctttttcaataagcttatacgcaatgttatcgccctgagagaccagcaggctgccgaggagagacgccgagatttcctgcagatggtgctggacgctcgacattccgccagtcctatgggcgtacaggactttgatatcgtccgggatgtcttcagcagcacaggctgtaagccgaacccatcgcgccaacatcagccttcaccgatggcccgtcctctcaccgtagatgagattgtgggacaagcctttattttcctcattgccggatacgagatcatcactaatactctgtcattcgccacctacctactcgccactaacccagactgtcaagaaaagttgctgcgcgaagtggacgttttcaaagagaaacacatggcccctgagttctgttcactagaggagggtctgccgtacctggacatggtaatagccgagacacttagaatgtatccccctgctttcagattcacacgcgaggccgctcaggattgcgaggtgttggggcagcggatccccgctggcgctgtcctcgaaatggcagtaggtgcacttcaccatgaccctgagcattggccaagtccagagacgttcaacccggaacgctacagatgcagctag

SEQ ID NO: 244001 - DNA, 1383 bp, Artificial Sequence
  Description of Artificial Sequence: Synthetic coding sequence
atgatggaagccctgggcttcctgaagctggaagtcaacggtcctatggtgaccgtggctttatccgtggcactgcttgccttgcttaaatggtacagtacaagtgctttctcacgcttagagaagctcggccttcgtcatcccaagccttccccgttcatcggaaacttgaccttttttcgtcagggattttgggagtcccagatggagctgcgcaagctctatggtcccctgtgtggatactacttgggccgtagaatgtttattgtaatttcagagcccgatatgatcaagcaggtcctagtggagaatttttccaatttcaccaaccgaatggctagcggcctcgaatttaagagtgtagccgactccgttctcttcttgagagacaaaaggtgggaagaggtgcggggagccctcatgtcggcgttttctccagaaaagctcaatgaaatggtaccactaattagtcaagcctgtgagttgctgctggcacatctgaaaaggtatgccgaaagcggcgatgccttcgacatccagcgctgttattgtaattataccacggacgtcgtggcgtcggtcgcttttgggacccctgtggacagttggcaagctccagaggatccatttgttaaacattgcaagaggtttttcgaattttgcatcccaagacccattctcgtgctgctgctgtcatttcccagcatcatggtcccgttggcccgaattttgcctaacaagaacagggacgagttgaatgggttcttcaataagctgatacgcaatgtgatcgccttacgcgaccaacaggctgcggaggaacgccgaagggatttcctgcaaatggtcttggatgccaggcactccgcctcgcctatgggcgttcaagattttgacatcgtccgggatgtgttctcctccaccggttgtaaacccaaccctagccgtcagcaccagccatcccccatggctaggccattgaccgtcgatgagatcgtggggcaggcgtttatctttcttatagccggatatgagatcatcacaaacactctttcattcgccacgtacctcttggcaacaaaccccgattgccaagagaaactgttaagggaggtagacgtgttcaaggagaagcatatggccccagagttttgtagcctggaagaaggcctgccatatctagacatggtcattgctgaaacgctgaggatgtatcctcccgcattcagatttaccagagaggcggctcaggactgcgaggtgctcggacagcgcatacccgctggtgctgtcctcgagatggccgtgggcgctctccatcacgatcccgaacattggcccagcccagagacctttaacccggagaggtaccggtgttcttag

SEQ ID NO: 244002 - DNA, 1743 bp, Artificial Sequence
  Description of Artificial Sequence: Synthetic coding sequence
atgatggaagcgctcggctttctgaaattagaagtcaatgggccaatggtaactgtggctttgagtgtggctcttctcgctctgctgaaatggtacagcacatccgctttctccaggttagagaagcttggactaaggcaccccaaaccaagccccttcatcggtaatctcacatttttccggcaggggttttgggaatcacaaatggagttgcgcaaactgtacggaccgttgtgcggctattatctgggaaggaggatgtttatcgttatatctgaacctgacatgatcaagcaagtcctggtggagaatttctccaacttcactaaccgtatggccagtggacttgagttcaagtcggttgcagatagtgtattgttcctccgcgataagcggtgggaggaggtgaggggagctctgatgtcagccttctcaccggagaaactcaatgaactgggactcctaataatgcaggaaaggattaaaggccacatggggggacagcaggcccctcagcgcattccaccgacccgcctgagtaaaccaagcggcatctacgtgaatctgcattacgctacactgcccttttgcatggtccccctgatctctcaggcctgcgagctgttgctcgcccaccttaaacgctacgccgagagcggagacgcctttgatatacagaggtgctattgtaattacacaaccgacgtggtggcaagcgtggcattcggaacaccagtagactcatggcaggctccagaggaccccttcgtgaagcactgcaagcggtttttcgagttttgtatcccacgcccaattttggttctgctgttaagtttcccctccattatggtgccactggctagaatcctgccaaataaaaacagagacgaactcaacggtttctttaacaaattaattcgaaatgtgattgctctgagagatcaacaagcagccgaggagagacgaagagatttcctgcagatggtgctggatgccaggcactctgcatcccccatgggggtccaagatttcgatattgtacgagatgttttcagctccaccggctgcaaaccaaacccatctagacagcaccaacctagtcccatggctcgcccactgactgtggacgagattgtgggacaggcctttattttccttattgccggttacgagatcatcaccaacacattgtcattcgcaacctacctgctggccaccaatcctgactgtcaggaaaaactgctgagggaggtggacgtgttcaaggagaagcacatggcccctgagttttgctcgttggaagagggactaccttatctggacatggtcattgcagagaccctgcggatgtatcccccagccttccggttcacacgcgaggccgcacaggactgtgaagtactcggacagcggattccagccggagcagtcctggaaatggctgtgggtgcattacatcatgacccggagcattggcccagccctgagacattcaaccctgagagattcactgctgaggcgagacagcagcatagacccttcacataccttccattcggagctggacctagatcttgtctaggggtcagactgggactgcttgaggtcaagctcactctgctacatgttttgcataagtttaggttccaggcgtgtcctgagacacaggtcccactacagctggaaagcaagtctgctctgggtcccaaaaacggagtctatattaaaattgtctcccgatag

SEQ ID NO: 244003 - DNA, 1605 bp, Artificial Sequence
  Description of Artificial Sequence: Synthetic coding sequence
atgatggaagcactcggcttccttaaactcgaggtgaacggacccatggtgaccgtggcactgtccgtggcactgttagctctgttgaagtggtactccacctctgctttctcaaggctcgaaaagttggggttgcgacatcccaaaccatcaccatttatcggcaacctcacattttttcgccaggggttctgggagagtcagatggaactgcgaaaactgtacggtccactgtgcggctactatctcggccgtaggatgttcatcgttatcagcgaacccgatatgatcaagcaagtcctcgtggagaacttctccaacttcaccaataggatggcgagtggcttagaattcaagagcgtagcagatagcgtgctgttcctccgcgataaacgttgggaggaggtcagaggggctcttatgtccgccttctcgcccgaaaagttgaacgaaatggtgcccctcatctcacaggcctgtgaactgctgctcgcccatctgaagaggtacgccgaaagcggcgacgctttcgatatccagaggtgttactgtaattacaccacagatgtcgtggcgtccgtggcctttggaacacctgtcgattcctggcaagcccctgaggatccatttgtgaagcattgcaagagattcttcgagttctgcatacctagacctatcttagtgttgttgttatcctttcccagtatcatggtaccactcgcaagaatccttcccaacaaaaatagagatgagctgaatggtttctttaataagctgatcaggaatgtaattgcactgcgcgaccagcaggccgctgaggaacgaaggcgcgacttcctccagatggttctcgacgccaggcattccgcttctcccatgggtgtacaggacttcgacatcgtgcgagacgttttcagctcgactgggtgtaagcctaacccctccaggcagcaccagccctcacccatggcccgacccttaacggtagatgaaatagtggggcaggcatttatttttctgatcgctggctatgaaattataaccaacacactgtctttcgcaacatatctgctcgccaccaaccccgactgccaggagaaactgttgagggaggtagatgtttttaaggaaaagcacatggccccagaattctgttcactagaggagggcctgccgtatctggacatggtcatcgcggaaaccctccgcatgtaccccccagcattccggttcacccgcgaagcagcccaagattgcgaagttctaggccagagaatccccgcaggagctgtcctggaaatggctgtcggggcattgcaccatgatcctgaacattggccaagtcccgagaccttcaatcccgagcgcttcaccgccgaggcgcgtcagcagcacagaccattcacgtatttgcccttcggcgctggcccacgtagctgcctgggagtaaggctgggtcttctggaagtgaagctgacacttcttcacgttctgcataaattcagattccaggcatgccccgagacacaggtccccctacagttggagtccaaatccgctctggggcctaaaaacggtgtatacattaagatcgtctcccgatag

SEQ ID NO: 244004 - DNA, 453 bp, Artificial Sequence
  Description of Artificial Sequence: Synthetic coding sequence
atggaagctctaggatttctcaagctggaggtaaatggccctatggttaccgtggccctctccgttgctttgttagccctgctgaaatggtactctacatccgccttcagtcggctggaaaagctgggtctcaggcaccctaagccctcaccattcattggcaacttaacctttttccgccaaggcttctgggaatcccagatggagctgcggaagctttatgggcctctttgcggatattatcttggtagacgcatgtttattgtgatctcagaaccagatatgatcaagcaggtgctggttgagaattttagcaactttacgaatagaatggcaagtgggctggaattcaagtccgtggctgacagcgttctgtttttgcgagacaaacgttgggaagaggttcgtggcgcattgatgtcagcttttagccccgagaagcttaacgaatag

SEQ ID NO: 244005 - DNA, 1602 bp, Artificial Sequence
  Description of Artificial Sequence: Synthetic coding sequence
atggaagctctgggtttcttaaaactcgaggtgaatgggccaatggtgactgtcgctctgagtgttgctctgctggccttactgaaatggtactcgacaagcgcattttcccgtcttgaaaagttaggcctcaggcaccccaaaccctccccattcatcggcaacctaaccttcttccgccagggcttctgggagagtcaaatggaattgaggaagctttacgggccattatgtggctactaccttggcagaagaatgttcattgtgatttccgaaccggatatgatcaagcaggtactggtggaaaacttcagcaattttaccaatcggatggctagcggcttggaatttaagtctgtcgccgattcagtgctctttttacgtgataagaggtgggaggaagtgcggggagccttgatgtctgcctttagccccgagaaattaaacgagatggtacccctgatctcccaagcctgtgagcttctgctagcccacctgaagagatacgccgagagcggcgacgctttcgatattcaacgatgttactgcaactacacaacagacgttgtggcctccgttgcttttggtacgccagtggatagctggcaggccccagaagatcccttcgtcaaacactgcaaaagattttttgagttctgcatcccacggccaattctggttctgctcctgagttttccatccattatggtaccccttgccagaatcctgccaaacaaaaatcgggatgagctcaatggattttttaacaaactcatccggaacgtgatcgccctgcgggaccagcaggccgcagaggagcggagacgagacttcctccagatggtgttggacgcgcgacattccgcaagtcctatgggagtgcaggacttcgacattgtgagggatgtattcagttccacagggtgtaagcccaacccatcgcgacagcatcagccatccccgatggcccgtccgctgactgtggacgagattgtgggacaggcttttatctttctcattgccggatatgagataataaccaataccctgtctttcgccacatacttgcttgctaccaatcctgattgccaagaaaagcttttgagagaggtcgatgtctttaaagagaagcacatggcacccgagttctgttcactggaggaaggtcttccatatctcgatatggtgattgcagagaccctccggatgtatccacccgcattcagattcacccgagaagccgcacaggactgtgaggttctcggccaaaggattccagctggtgcggtgttggaaatggctgtgggagcactgcatcacgatcctgagcattggccctcccccgagaccttcaatccggaaagattcacagctgaggccagacaacagcaccgtccttttacctatttgccttttggtgccggacccaggagctgtcttggggttaggctgggcctgctggaggtgaagctcacgctgctgcacgtgttgcataagtttaggttccaggcctgcccagagacacaggtgccgctgcaactggagtctaagagcgcgttgggaccaaagaatggagtctacataaagattgttagccgttag

SEQ ID NO: 244006 - DNA, 459 bp, Artificial Sequence
  Description of Artificial Sequence: Synthetic coding sequence
atgatggaggctttggggtttttgaaactggaagtgaacgggcctatggtaaccgtggcactgtccgttgctctactggcactgctcaagtggtacagcacaagcgccttcagtagacttgagaaactcggtttgaggcaccctaaaccaagcccgtttatcggtaacctgaccttcttccgacaggggttttgggagtctcagatggagctgaggaagttgtatggaccactgtgcgggtattacttgggcaggagaatgttcattgtcatatccgaacctgacatgattaagcaggttctggtggagaacttttcaaactttacaaataggatgccacaaagcataatgccaaatagtcggcaccacgtggcctctcgcggtatgtggccgggtggacggcgtttagcatgctacttgcacccttttcgaatggccgaaggcattgctgaggtttag

SEQ ID NO: 244007 - DNA, 1401 bp, Artificial Sequence
  Description of Artificial Sequence: Synthetic coding sequence
atggaactcagaaagttatatgggcctctgtgcgggtactacttgggcagacggatgttcatcgtgatttcagagcctgatatgattaaacaagtcctagtggagaatttttcgaattttacgaaccgtatggccagcggcttggagttcaagtcagtcgcagatagtgtgctgtttcttcgagataagcgctgggaggaggtgcgcggtgcccttatgagcgcatttagcccggaaaagttgaatgaaatggttcctctgatatcccaggcgtgcgagctcctgctggctcatctcaaacgctacgccgaatcaggggatgcattcgatatacagcggtgctattgtaattacacaaccgacgtcgtagcgtctgtagcttttggcacaccggtggatagctggcaggctcccgaggacccttttgtgaaacactgcaaacggttcttcgagttctgtatccctcgcccaattctagttttactgcttagcttcccatccatcatggtgccgcttgctaggatccttcctaacaagaatagagacgagctgaatggctttttcaacaaacttattaggaacgtgatcgctctgcgagaccaacaggccgcagaggaacgaagaagagactttttgcagatggttctcgatgcccgtcattctgcctctccgatgggggtccaggatttcgatatagtgagagatgtcttctcctccaccggttgtaaaccaaacccatctcggcagcaccagccgtcgcctatggccagaccgttaactgtcgacgaaatcgttggccaggcattcatttttctaatcgccggatatgagattattacaaacacattgagttttgcaacctacctgctggctacgaacccagattgtcaggagaagctcctccgcgaagtcgacgtctttaaagaaaaacatatggctcccgaattctgcagcctggaggaaggacttccctatctggacatggtcatcgcagagacattacggatgtatccaccagctttcagattcacaagggaggccgcacaggattgtgaggtgctagggcaacggatcccagctggcgctgtgcttgagatggctgtgggagcgcttcaccatgatcctgagcactggcccagccccgagacttttaaccctgaaagattcaccgcagaggccagacagcagcaccggccattcacttatttgccatttggagccggacccagatcgtgtctgggagtccgccttggcctgctggaggttaagttgaccctcctgcatgtgctgcacaaatttagatttcaagcatgcccggaaacccaagtccctctccaactagagtcaaaaagcgccctgggccctaaaaatggcgtctacatcaaaatcgtcagtaggtag

SEQ ID NO: 244008 - DNA, 1032 bp, Artificial Sequence
  Description of Artificial Sequence: Synthetic coding sequence
atgtggccgaatggcagtagcctgggcccatgcttccggccaacgaacatcacactcgaagaaagacggctgatcgcttctccatggtttgccgcatccttctgcgtggtgggcttggcttcaaacttgttggccctgtcggtgctggccggtgctagacagggcggtagtcacacaagatcgtctttcctgacatttctctgcggcctcgtcctaactgactttctgggcctcctcgttaccgggacgatagtggtgtcacagcatgctgctctgtttgagtggcatgctgttgaccccggatgtcggctgtgcagatttatgggtgtggtaatgatattcttcggcctctctcctcttctgttgggtgctgccatggcctcagagaggtacctgggaataacccgcccttttagcagaccagccgtagcctcacagcgcagagcttgggcaaccgtaggactagtttgggccgcagcactggccctgggcttacttcccctcctgggggtgggcagatataccgtgcagtatcccggatcttggtgtttcctgaccctgggcgctgagagtggtgatgttgctttcggccttctcttttcaatgctgggcggtctatctgtggggctatctttcctgctgaatactgtctctgtggccaccctttgtcatgtctatcatggccaggaggccgctcagcagcggccacgagactctgaggtggagatgatggcacaactcctgggtatcatggtggtggcttccgtgtgttggttaccactgttagtgtttattgcacagactgtcctacgtaatccccctgctatgagccctgccggacagctgtcacgaacaacagaaaaagagctcttgatctacctgagagtcgcaacctggaatcaaatactggatccctgggtgtatatcctctttcgcagagccgtgctgcgaaggttgcagcccaggctgtccacacggcctcgtagcctcagtttacagcctcagcttactcaacgcagcggacttcagtag

SEQ ID NO: 244009 - DNA, 1224 bp, Artificial Sequence
  Description of Artificial Sequence: Synthetic coding sequence
atgtggcctaatggcagtagccttggcccatgctttaggcccacgaacatcacattggaagagcgcagattgatcgcgtcaccgtggttcgctgcaagcttctgtgtggtcggacttgccagcaacctcctcgctctgagcgttctggctggcgcacgccaagggggttcccacacccgaagctccttccttacattcctatgcggactcgttttaactgattttctgggcctgctggttacgggtactatcgtggtcagtcaacacgccgctctcttcgaatggcatgccgtggaccctggttgccggctttgtagatttatgggcgtcgtgatgatctttttcggtctatctccacttttactcggagcggctatggcatctgaaagatatctgggtataacacgtccattctcccgccctgccgttgcatcacaacggcgtgcttgggctacggtaggactggtgtgggccgcagctttggctcttgggctgctgccgctccttggcgtggggcgatacactgtccagtaccctggatcctggtgttttctcacgctgggggctgaatctggggatgtggccttcggtctgctctttagcatgcttggcggtctttctgtaggactcagtttcctattgaacaccgtttcagtcgctaccctctgtcatgtatatcatggccaagaggcagcacagcaacggcctagggattcagaagttgagatgatggcccaactgctgggcattatggtcgtggcctccgtttgctggctccctcttttagtgttcattgcccagacagtgctcaggaaccctccagccatgagcccggctgggcagctgagtaggactacggaaaaagaacttctgatttacctgcgcgtggccacctggaaccagattctggacccttgggtgtacatcctgtttagacgggctgtcctgcgcaggctgcaacctagactctcaactcgtcccaggcgatctttgactctgtggccgtctctggaatattctgggactatcagcgctcactgcaatttacgcctgcctggaagttctgactccagagcgagtgcttcccgtgctgccggtattaccggcgtttcacattgcgccaggccctgcatgctcttcgatcccgagttcgacttgttggccggagtccagcttttgccattcgaacccccaacagggaaggcactctccaggaaggactag

SEQ ID NO: 244010 - DNA, 1422 bp, Artificial Sequence
  Description of Artificial Sequence: Synthetic coding sequence
atgagggaggtgagggcgcgtttagctgcaacccaggtggaatacatctctgggaaagtcttcttcaccacttgctcagacctgaacatgctgaaaaagcttaaaagcgcagagagactatttctactgattaaaaagcagttccccttaatcatctccagcgtcagcaaaggaaagatcttcaacgagatgcaacgcctgatcaatgaggaccccggaagctggttaaacgccatttcgatctggaagaatctgttggaactagacgctaaaaaagagaaactcagccaacgtgacgacaatcaattaaaaaggaaagtgggagagaacgagataatcgctaagaagctcaaaatcgagcagatgcagaagattgaggagaatagagactgtcagttagagaagcagatcaaagaagaaactctggaacagagagattttacaactaagagtgaaaagtttcaggaggaggagttccaaaacgacatcgagaaggcaattgatacacacaaccagaatgacctcacttttagagtgagttgcaggtgctctggaactattggaaaagccttcacagcgcaggaagttgggaaagtgatcggtattgcgataatgaagcattttggatggaaggcagatctccgaaacccacagttggaaatatttatccacctgaacgacatctattctgtggtcgggatcccagtcttcagagtgagcctggcctcccgggcatacattaaaactgctggactgcgatcgaccatcgcttgggccatggcatcactggcggatatcaaagcaggcgcatttgttttggatcctatgtgcggcctgggcacgattttgcttgaggccgctaaggagtggcccgatgtgtattatgtgggtgctgacgtgtcagatagccaactgctgggcacatgggacaatctgaaagccgcagggctggaagataaaatcgaactccttaaaattagcgtcatcgaactgccactgcccagcgaatcggtggacatcattattagtgatatcccattcggtaagaaattcaaacttggcaaggacatcaagagcattctccaagaaatggagcgggtgctccacgtgggcggaaccatagtcctcctactctctgaagaccatcacaggaggttgaccgattgtaaggagtcaaatatccccttcaatagcaaagattctcacaccgacgaacctgggattaaaaaatgcttaaaccctgaagagaagactggggcttttaagaccgcttctacctcatttgaggcctctaaccacaagttcctggaccgaatgagccctttcgggtctttggtcccagtggagtgttacaaggtctctcttggcaagacggacgcatttatctgtaagtataagaaatcacactcatccggcctgtag

SEQ ID NO: 244011 - DNA, 873 bp, Artificial Sequence
  Description of Artificial Sequence: Synthetic coding sequence
atgagagaggttcgcgcacggttagccgcaacgcaggtggagtacatttcaggcaaagtgttctttacaacctgtagcgacctgaatatgcttaaaaaactaaagtccgctgagcggctctttctcctgattaaaaaacagttccctctcataatttcttctgtctccaagggaaagatttttaatgagatgcagcgactgatcaacgaagaccccggttcgtggttaaatgccatctctatttggaaaaacctgctggagcttgatgcgaaaaaggagaagctcagccagagggatgataaccagctaaagagaaaagttggagaaaatgagataatcgcaaagaagctcaaaatcgagcagatgcaaaagatagaagagaatcgcgactgccagttggaaaaacagatcaaagaagagaccctggaacagagggatttcacaacaaaaagcgagaaattccaagaggaagaatttcagaacgatatcgaaaaagccatagatacgcacaaccagaatgacctcacgtttagagtgtcatgcaggtgctccggcaccatcggaaaggctttcactgctcaggtgctttacatggggctgtcccccggacccagattgcagatgcatatgcggagccaacagtgtcgcgaggaacgaactccacagaccgtcgccattacccgcccacaccagctggcacttactaagttctcagatgttaagggccattggtccgagtattttattaacttaaaaatttcccagactctcaagggcggacgcaagtccaattggaattgttactatgagacactctggatggagtctcgcctggaggagtcgacgatacgagatctctacacctccaagtag

SEQ ID NO: 244012 - DNA, 1512 bp, Artificial Sequence
  Description of Artificial Sequence: Synthetic coding sequence
atgtcagaggctaggggtgaacctgggtctgggccagaagcaggcgcaagattcttttgcactgctgggagaggattagagccttttgtgatgagagaggtgcgagctcggctcgccgctacccaagtcgaatatataagcggtaaagtgttcttcaccacttgtagtgacctgaatatgctgaaaaaattgaagtctgcggagaggctgttccttctgataaaaaaacagtttcctctgattatcagctccgtgagcaaggggaagatatttaacgagatgcagaggctgattaacgaagacccaggtagctggcttaacgcaataagcatctggaaaaatctgctggagctggatgcaaagaaggagaagctgagccaaagagacgataaccagctgaagcgcaaggtgggcgagaatgagataattgctaaaaagcttaagatagagcagatgcagaaaatagaggagaacagggactgtcagcttgagaaacaaattaaggaagagacactcgagcagcgcgactttactacaaaaagtgagaagttccaggaggaagaattccagaatgatatagaaaaagcaatcgatacacacaatcagaatgatttgaccttccgcgtctcttgtagatgctccggcaccatcgggaaggcatttactgctcaggaggtcggcaaggtgattggcatcgctataatgaaacatttcgggtggaaggccgatctccgcaaccctcagctcgagatctttatccacctaaatgacatctattcagttgtaggaataccagtgtttagagtgtccctggcatctagggcttatatcaagacagcgggattgaggtctaccatagcctgggcaatggcatcactggctgacataaaagcgggtgcatttgtgttagaccctatgtgtggtcttggcactatattgctggaggccgcaaaggaatggcctgatgtgtactatgtgggagcagatgtctctgactcacagctactgggcacctgggacaaccttaaggctgctggactggaagacaaaattgagttgctcaaaatcagcgtcatcgagctccccctcccttctgagtccgtggatatcattatcagtgacatccccttcggaaaaaaatttaaattggggaaggacatcaaaagcatcttgcaggagatggaacgagtgcttcacgtcgggggtaccatcgtgctcctgctgtctgaagaccaccatcggagactcactgactgcaaggaatccaatatcccctttaacagcaaagattctcacaccgacgagccaggaattaaaaaatgcctgaatccggaagaaaaaaccggagcctttaagactgcctcaaccagcttcgaggcctccaaccataaatttctggaccgaatgagtccgttcggaagtctagtccctgtagaatgttataaagtgagcctgggcaagacagacgctttcatctgtaagtacaagaagtcccactctagcgggctgtag

SEQ ID NO: 244013 - DNA, 486 bp, Artificial Sequence
  Description of Artificial Sequence: Synthetic coding sequence
atgaatctggccatttccatcgctctgctgctcacagtgctacaagtatcccgaggacagaaggtgacctcgttgacagcttgtctggtggaccaatctttaaggctcgattgcaggcacgaaaataccagttctagtccaatccaatatgaattcagtctgacacgtgagactaaaaaacatgtcttgttcgggacggtgggcgtgccggagcatacatatcggtcacgaaccaacttcacgtcaaaatacaatatgaaggtgctgtacttgtctgcatttaccagcaaggacgagggcacttatacttgcgccctacaccattccggccatagtccccctatcagcagccagaatgtaacagtgttacgtgataaactcgttaaatgcgagggcatctcgttactggcgcagaacacatcttggttgctgctgctgctattgtctttatctctcctgcaggccactgactttatgagtctctag

SEQ ID NO: 244014 - DNA, 486 bp, Artificial Sequence
  Description of Artificial Sequence: Synthetic coding sequence
atgaacctagccatctcaattgctctgctgctcaccgtgctgcaggtgagcaggggacaaaaggttactagcttaaccgcctgtctcgtcgatcagtctctcagactggactgcagacacgagaacacatcatcttcccctatacagtatgagttcagtctaacgcgggaaactaagaagcacgttctctttggcacggtgggggtgcccgaacacacctatcgtagccggaccaattttacatctaaatacaacatgaaggtgctgtatctctcagcttttactagcaaggacgaggggacttacacctgtgccttgcaccactccggccactcaccccctatttccagccaaaatgtgaccgtgctgcgagataagctagttaaatgcgaaggcatctccctactggctcaaaatacctcatggttgctgcttctgctgttatctctgtccttgctccaagccacagacttcatgtcactctag

SEQ ID NO: 244015 - DNA, 480 bp, Artificial Sequence
  Description of Artificial Sequence: Synthetic coding sequence
atgttcccttttgctcttctttacgtgctgtccgtctcttttagaaagatcttcatcttgcaacttgtgggactggtgctgacttacgactttaccaattgtgattttgagaagattaaagctgcctacttatcgacaattagtaaagatcttattacgtacatgtccggcaccaaatccacagagttcaataatacagtatcatgtagcaacaggcctcactgtcttacagagatccagagtctcaccttcaaccctaccgcagggtgcgcgagcttagccaaagagatgttcgcgatgaagacgaaggctgcactggccatctggtgccccggatacagcgagactcagatcaacgccactcaggctatgaaaaagcggagaaaacgcaaggtgactaccaataaatgcctggaacaggtctcccagttgcagggcctctggcgaaggttcaaccgaccgctcctcaaacagcagtag

SEQ ID NO: 244016 - DNA, 192 bp, Artificial Sequence
  Description of Artificial Sequence: Synthetic coding sequence
atgttcgctatgaagacaaaagccgctctagctatttggtgtcccggttactccgagacccagatcaatgctacgcaagccatgaaaaagagaagaaagaggaaagtcacgactaacaaatgcctggaacaagtgagccagctgcagggcctctggcgtaggttcaaccggccactgctgaagcagcagtag

SEQ ID NO: 244017 - DNA, 705 bp, Artificial Sequence
  Description of Artificial Sequence: Synthetic coding sequence
atgtcttgcattaacctccccactgtgctaccgggttctcctagtaagactaggggccagatccaggtcattctggggccaatgttctcagggaaaagcaccgaactcatgcgaagagtgcgcagatttcagattgctcaatataaatgcctggtaattaaatacgccaaagacacacggtattcttcttctttctgcactcatgaccgtaatacaatggaagctctgccagcttgcttacttagggatgtagctcaggaagcactgggagttgctgtgatcggtattgacgaaggccagttctttcctgacattgtggaattttgcgaagctatggccaatgccggtaagaccgtgatcgtggctgcgctagacggtaccttccaaagaaagccctttggagctattttaaatctggtccccctggctgaatccgtggtgaaactgactgctgtatgcatggaatgcttcagggaagccgcttacaccaagcgcctgggcacagagaaagaggtggaagttattgggggagctgataagtaccatagtgtttgtagattatgctatttcaagaaggccagcggccaaccagctggcccagacaataaggagaattgccccgttcccggtaagcctggagaggctgtggccgcaagaaaactgttcgcgccacagcagatcctgcagtgcagtcccgcaaactag

SEQ ID NO: 244018 - DNA, 705 bp, Artificial Sequence
  Description of Artificial Sequence: Synthetic coding sequence
atgtcgtgcataaatctgcccacagttcttcctggatcgccctcaaaaacacggggacagatccaagtcatcttggggcctatgttcagcggtaagagcaccgagctaatgaggcgggtgcgcaggttccagattgcccagtataagtgtctggttatcaagtacgctaaggacacccgctacagctcctctttctgtacacacgatcgcaacactatggaagcgttgccagcgtgtctgttgcgggacgtggcccaggaggccctgggtgtggcagtgattgggattgacgaagggcagttttttcctgatattgttgagttctgcgaagccatggcaaatgccggaaagaccgtcattgtggccgctttggacggaacctttcaaaggaagcccttcggggctatccttaacctggtgccgctggcagagagcgtggtcaagctaacagcagtctgtatggagtgtttccgcgaggcagcgtatactaagcggttaggcaccgaaaaggaagttgaggtgataggaggcgctgataagtatcactctgtctgtaggctgtgttactttaagaaggcatcagggcagcccgcaggtcccgacaataaggagaactgtcctgtccccggtaaaccaggagaagctgtagcagcccgaaaattgttcgcccctcagcagatactccagtgcagccccgctaattag

SEQ ID NO: 244019 - DNA, 924 bp, Artificial Sequence
  Description of Artificial Sequence: Synthetic coding sequence
atgagacctggcctgtttaaaggccaagccccaggatcacggaggcgccctacagctggactcgctgtggtccgcgctgacagccataaaaaagaacccagggcatcaggctcggcccgaccggctatgctgctctggcctctgcggggatgggccgcacgggctctccgatgttttgggcctggctctagaggttcacctgcaagcggacctggccctcgaagagttcaacggcgtgcctggccaccagacaaggaacaggagaaggaaaagaagtctgtgatatgtgtggagggcaacatagcttctggcaaaaccacttgtctggagtttttctctaacgccactgacgtggaagttcttactgaacccgtaagcaaatggagaaatgtgcggggtcataatccactggggttaatgtaccacgacgcttcccgttgggggctcaccctgcaaacttatgtccagctgaccatgctcgacaggcatactaggccccaggtgagcagtgtgcggctgatggaacgaagcatccattcagcccgttatatattcgtcgagaatctgtatcggtccgggaaaatgccagaagtggactatgtcgtgctaagcgaatggttcgactggatcctgcgtaatatggatgtatccgtggacctgatcgtgtaccttcggaccaatccagagacgtgctaccagaggttaaagaagaggtgcagggaagaagagaaagtgatccctttggaatatctcgaggccatccatcatctccacgaagagtggcttatcaaggggtcactattccccatggccgcacccgtgctcgtaatagaggctgaccaccacatggaaagaatgcttgagcttttcgagcagaatagagaccggatactaacccctgagaacaggaaacactgtccatag

SEQ ID NO: 244020 - DNA, 744 bp, Artificial Sequence
  Description of Artificial Sequence: Synthetic coding sequence
atgttgctgtggcccctacggggttgggcagcacgggcacttcgctgctttggacccggttccaggggcagccccgcttcggggccaggccctagacgagtccaacgacgtgcatggccccctgataaagagcaggaaaaagagaaaaagagtgtgatttgtgtagagggaaacattgccagtggtaagacgacctgcctggagttctttagcaacgctacagatgtggaaggactaatgtaccacgacgctagtaggtggggactaacccttcagacgtatgtgcagctgacaatgctagataggcacacgcggccacaggtgtctagtgtgaggctgatggagcggtccatccacagcgcaaggtacatattcgtcgaaaatctgtaccggagtggtaaaatgcctgaggttgactatgtagttcttagcgagtggttcgactggatcctgcgtaacatggacgtgtctgttgatctgatagtttatttgcgaacaaaccctgaaacatgctaccaaaggctaaaaaagcgctgcagggaagaggagaaggtaatccctcttgaatacctcgaggccattcatcacctacacgaggagtggctcatcaaaggctcactttttccgatggctgccccagtgctggtcattgaggctgaccaccacatggagagaatgctggagctgttcgaacaaaatagagacaggattctaacccctgaaaataggaaacattgcccctag

SEQ ID NO: 244021 - DNA, 798 bp, Artificial Sequence
  Description of Artificial Sequence: Synthetic coding sequence
atgttactgtggcccttgaggggttgggccgctcgggctctgcggtgcttcggaccaggctcccggggaagcccagcctccggacccggtccacgcagagtgcagagaagagcatggccaccagacaaggaacaggagaaggaaaagaaatcagtcatttgtgtggaaggaaacattgcatccggaaagaccacatgcctggagttcttcagcaacgctacagatgtggaggtgctcaccgagccagtgtccaagtggagaaatgttcggggacataacccactgggactaatgtaccacgacgcttcccggtggggattgactctgcagacatatgtgcagctgactatgctggaccgtcatacccgaccccaggtgtcatctgtgagattaatggagaggtcaatccattccgcccgttacatctttgtggaaaatctttaccgcagcgggaaaatgcccgaggtggactacgtggtattgtcagagtggtttgactggatcctcagaaacatggatgtttccgtagatctcattgtgtacttgcgtacaaatcccgaaacatgttaccagcgactcaagaaacgatgcagagaggaggagaaagtcattcctctcgaatacctggaggctattcaccacttacatgaagaatggctgataaagggaagtctatttcctatggcagctcctgtgctggtgatcgaggccgatcaccacatggaacggatgctcgaactgtttgaacagaatagggatcggatcctcactcctgagaaccgcaagcactgtccatag

SEQ ID NO: 244022 - DNA, 507 bp, Artificial Sequence
  Description of Artificial Sequence: Synthetic coding sequence
atgtatcacgacgcatccagatgggggctgacactgcaaacatacgttcagctgacgatgctcgacagacatacccggcctcaagtttccagtgtcaggctcatggagcgcagcattcacagtgcccgatatattttcgtcgagaatctatatagaagtggcaagatgcccgaggtggattacgtagtgctctcagaatggtttgactggatcctccggaacatggatgtttccgtggatctcatcgtgtacctgagaactaacccagaaacttgctaccaacgtctgaaaaagcggtgccgggaagaggagaaggtgattcctctggagtatctggaggccatccaccacttgcatgaggaatggttgattaaaggcagtctgtttcccatggccgcacccgtcctggttatagaggccgatcaccacatggaacgaatgttagagctgtttgagcagaaccgcgaccgcattctcactccggaaaacaggaagcactgcccatag

SEQ ID NO: 244023 - DNA, 705 bp, Artificial Sequence
  Description of Artificial Sequence: Synthetic coding sequence
atgggcgcattttgtcaacgcccttcgtccgacaaggagcaggagaaagagaagaagtcagtgatatgtgtagagggcaacatcgcatcagggaagacaacttgtctcgaatttttttcaaatgccacggacgtggaggtcctcactgaaccagtttcaaaatggcggaatgtgcgcggtcataaccctctaggcctgatgtatcatgatgctagcaggtgggggctcaccctacagacctacgtgcaactgactatgctcgaccggcatacccgcccacaggttagcagcgtgcgtctgatggagagatccatccactcagctcgatatatcttcgtcgaaaatctgtatcgaagcggaaagatgcccgaggtagactacgtcgtgctgagcgaatggttcgactggattctccgcaacatggacgtcagcgtggatctgatcgtctacttgaggacaaaccccgaaacctgctaccagagacttaagaaacgatgtagagaagaggagaaggtcattcctcttgagtacttggaggcaattcatcatctgcacgaggaatggctgataaaagggagcctattcccgatggctgcaccggttctcgtgatcgaggccgatcatcatatggaacgaatgctggagttgttcgagcagaatcgggataggattcttacaccagaaaaccgcaaacactgtccctag

SEQ ID NO: 244024 - DNA, 507 bp, Artificial Sequence
  Description of Artificial Sequence: Synthetic coding sequence
atgtaccacgatgcctcacggtggggcctgaccctccagacttatgtgcagctcacgatgttggatagacacacaaggcctcaggtgagttccgtcagactgatggaaaggagtatacatagtgctaggtacattttcgtggagaacttatatcggtctggtaaaatgccagaggtggattacgtggtgctcagcgagtggttcgattggatcttgagaaacatggacgtgtccgtggatcttattgtgtacctgcgcacgaatcccgaaacatgctaccagagactgaagaaacgttgccgcgaggaggagaaagtcatccctctcgaataccttgaagccatccaccacttgcacgaagaatggttaataaaaggcagcttgttccccatggcagcacctgtgctcgtcatcgaagcggaccatcatatggaaagaatgctggagctgttcgaacagaatagggatcgaattctgaccccggagaatcggaaacactgcccatag

SEQ ID NO: 244025 - DNA, 651 bp, Artificial Sequence
  Description of Artificial Sequence: Synthetic coding sequence
atgacgtctatctgtgtagagggcaatatagccagcggtaaaaccacatgtctggagttcttctctaatgctaccgatgtggaagtactgactgagcccgtaagcaagtggcggaacgtcagaggccacaacccactgggccttatgtatcacgatgcaagccgctggggcctaacattgcagacctacgtccagttaacaatgctcgatcgtcacaccagaccacaggtgtcctcagtgcgactcatggaacgctcaattcatagtgcccgttacattttcgtcgagaacttgtaccgatccggcaagatgcccgaggtggactacgttgttctgagcgaatggttcgattggattctgcgcaacatggacgtgagcgtggacctgatcgtttaccttcggacaaatccagaaacctgctatcagagactgaagaaaagatgcagggaagaagaaaaggtcatcccactggaataccttgaagccattcatcacctgcatgaggagtggctgattaagggctctttgtttcctatggctgctccagtactggtgattgaagccgatcaccatatggagcggatgctggaacttttcgagcagaacagagatcgcatcctgaccccagagaatagaaagcattgcccatag

SEQ ID NO: 244026 - DNA, 723 bp, Artificial Sequence
  Description of Artificial Sequence: Synthetic coding sequence
atgctcctgtggcccctgcggggttgggctgccagagccctgcgctgctttggcccaggatcccgtgggtctccagcaagtgggccagggcctcgcagggtgcagagacgagcttggccaccagataaggaacaagaaaaagaaaaaaagtctgtggttttgaccgagcccgtgagcaaatggcgaaatgtcagaggacataaccctctggggctcatgtaccacgacgcttctcgctggggtctcacactccagacttatgttcagttgacaatgcttgatcgacacaccagacctcaggtgagttccgtccggctgatggaacgttccattcattctgccaggtacatcttcgtggagaacttatatcgctcagggaagatgcccgaggttgattatgtcgttctgagtgaatggttcgattggatcctgcgaaacatggatgtttctgtggatctcatcgtgtaccttaggacaaatcctgaaacatgctaccagagactcaagaaaaggtgtagggaagaagaaaaagtgattcctctggagtacctagaggctatccaccatttgcacgaggagtggctaatcaaggggtctctgttccccatggccgcacccgtcttggtgatcgaggctgaccaccatatggaaagaatgctggaattgtttgagcagaacagggaccgaatcctgaccccagaaaacagaaaacactgcccatag

SEQ ID NO: 244027 - DNA, 840 bp, Artificial Sequence
  Description of Artificial Sequence: Synthetic coding sequence
atgcccgtagcaggttccgagctgcctcggaggccactgccccctgctgcccaggagagggacgccgagccgagaccacctcacggtgaactgcaatacctgggccagatacagcacatcctgcgctgtggggtgcgcaaggacgatagaacgggtaccgggactctgtcggtctttggaatgcaggccagatattccctgcgtgatgagtttccgttattgaccacgaagcgtgtcttctggaagggggtccttgaagaactactatggttcatcaaaggctcaaccaacgccaaagaactttcgagcaagggagtgaaaatctgggatgcaaacggctcccgggactttttggattctctgggcttttctacccgggaggagggagatttaggccctgtgtatgggttccagtggcgacactttggggcagagtaccgagacatggagtctgacctccccctcatggcactacccccttgccacgcgctgtgccagttctatgtggtcaatagcgagctgagttgccagctgtatcagcgcagtggagacatgggactcggagtgcctttcaatatcgcaagttacgccctgctgacatacatgatcgctcatattaccggcttgaaacctggggacttcatacacactctgggtgatgcccacatatacctcaatcacatcgagccgctcaagatccagttacagcgcgagcctaggccattccctaagctgcgaatcttacggaaagtcgaaaaaatcgacgacttcaaggctgaagacttccaaatcgaggggtacaacccgcatcccacgattaaaatggagatggccgtgtag

SEQ ID NO: 244028 - DNA, 693 bp, Artificial Sequence
  Description of Artificial Sequence: Synthetic coding sequence
atgcccgtcgcgggttccgaactgcccaggcgcccactgcccccagccgctcaggagcgggatgcggaacctcgccctccgcatggcgaactgcaatacctcggccaaattcagcatattctccgatgcggcgtgcgaaaggacgataggaccggcactggaacacttagcgtgttcggtatgcaagcacgctattctctcagagactattccggccagggcgtcgaccagctccagcgggtgatcgatacaatcaaaacgaacccagatgaccgccgaattatcatgtgtgcctggaacccccgtgacctgcctctgatggctctgcctccctgtcatgcactgtgtcagttttacgtggtcaatagcgagctgagttgccagttatatcagaggtcgggtgatatggggctcggcgtcccattcaatattgccagttacgcgcttctgacctacatgatcgcccatattactgggctgaagcccggagattttatccacacactgggtgacgcacacatttacctcaatcatattgaaccactcaaaattcagcttcagcgggaacctagaccctttcccaagctgcgcattctgaggaaggtggaaaaaattgatgacttcaaagcagaagatttccagattgaaggttacaacccccacccaaccataaaaatggagatggccgtatag

SEQ ID NO: 244029 - DNA, 942 bp, Artificial Sequence
  Description of Artificial Sequence: Synthetic coding sequence
atgcctgtggcaggttccgagctccctcggaggcctttgccgcctgctgcccaagagcgcgacgcagagcctcgccctccacacggggaattgcagtacctgggccaaatccagcacatattgagatgcggggttagaaaggacgacagaactggcaccgggaccctgtctgtctttggaatgcaggctcggtattcgctacgagacgagtttcctttgctgaccactaagcgagtgttttggaagggcgtcttggaggagttgctctggttcatcaaaggcagcactaacgctaaagaactgagtagtaaaggtgtcaaaatctgggacgcaaacgggtcacgagactttctagactcactgggtttttccacccgcgaagagggagatctgggaccggtatacgggtttcagtggaggcatttcggagctgagtatcgggacatggaatctgactactcagggcagggcgttgatcagttacagcgggtgatcgacactattaagacgaatccagacgataggaggatcatcatgtgcgcgtggaatcctagggatttgccattgatggcattaccaccttgtcatgccctgtgtcagttttacgtggtgaacagtgagctctcgtgtcaattgtatcaacggtctggcgatatgggcctgggggtgcctttcaacatagcctcctatgcgctgctaacatacatgatcgcgcacatcacaggtctgaaacccggagattttatccatacattgggcgatgctcacatttatctgaatcatattgaacccttaaagattcagctccagcgagaacctcgacccttccccaagttgagaatcctacgcaaggtggaaaagattgacgattttaaagctgaggatttccagattgagggatataacccccatccaactattaagatggaaatggccgtgtag

SEQ ID NO: 244030 - DNA, 678 bp, Artificial Sequence
  Description of Artificial Sequence: Synthetic coding sequence
atgtccagaccccgaaagaggctagccggaaccagcggctcagacaaaggtctgagtggcaagcgcaccaaaacagaaaattctggagaggctctggccaaggtggaggattctaacccacaaaagacctccgctacaaagaattgtctgaaaaatctcagcagccattggctcatgaagtctgaacccgagtccagactggagaaaggggtggacgtgaaattttccatcgaggatctgaaggcacagcccaaacagaccacgtgctgggacggcgtccgcaactaccaggcaaggaattttctaagggccatgaaacttggcgaggaagctttcttctaccacagcaattgcaaggaacctgggatcgcaggtttaatgaaaatagtgaaagaagcctatcctgatcacacacagtttgagaagaacaatcctcactacgaccctagcagcaaggaagataatccaaagtggtccatggtcgatgtccagtttgttagaatgatgaaaaggttcattcctctagctgagctgaaatcataccaccaggcacacaaggctacaggcggtcccttaaaaaatatggtgctgttcactcggcagaggctgtccattcagccactaacccaggaggaattcgattttgtgctatccctggaggagaaggaaccatcttag

SEQ ID NO: 244031 - DNA, 501 bp, Artificial Sequence
  Description of Artificial Sequence: Synthetic coding sequence
atgtctcggccacgtaaaagattggccggtacttcagggtccgataagggtttatctggcaaacggaccaaaacggagaactccggggaggcgctggcaaaagtggaagactccaatccccagaagactagcgccacaaagaattgcctcaaaaatctatctagtcattggctgatgaagtccgagccagagagcagactcgagaaaggcgtcgacgttaagttctccattgaggatctcaaagctcaacccaagcaaaccacctgctgggacggggttcggaattatcaggcccgaaactttctgcgcgcaatgaagctcggggaagaggcctttttctaccatagtaactgcaaggagcctggaatagcagggctgatgaaaatcgttaaggaagcgtacccggaccatacgcaatttgaaaaaaataatccacattacgacccttcaagcaaggaggacaatcccaagtggagtatgaagtctctcatattgttttag

SEQ ID NO: 244032 - DNA, 678 bp, Artificial Sequence
  Description of Artificial Sequence: Synthetic coding sequence
atgtcccggcctcggaagaggctggctgggacgagcggtagtgacaagggactgtccggaaagaggactaaaacagaaaacagcggcgaggcactggctaaagttgaagactctaacccgcagaaaacttcagccactaaaaactgtctcaagaacctgagttctcactggcttatgaaaagcgaaccggagtccagacttgagaaaggtgtggacgtcaaattcagcattgaggacctgaaggcccagcccaaacagaccacctgctgggacggggttcgcaattatcaagcacggaacttcctcagagccatgaagctgggcgaagaggcctttttttaccatagcaattgtaaggaaccagggatcgccggacttatgaagatcgtcaaagaagcgtatccagaccatacacagttcgaaaaaaacaatccccattatgaccccagcagtaaagaggacaaccccaagtggtccatggtggacgtacagttcgtgcgcatgatgaagaggtttatccctctggctgagttgaaaagctaccaccaggcacataaagcaaccggcggtcctctcaaaaacatggtgctgttcacgagacaaagactatctattcagcccttaacccaagaagagttcgactttgtactgagcctagaagagaaggaacccagctag

SEQ ID NO: 244033 - DNA, 678 bp, Artificial Sequence
  Description of Artificial Sequence: Synthetic coding sequence
atgtccagaccacggaaacggttggccggaaccagcggtagcgacaaaggattgtcgggaaagcgcacaaaaaccgagaactccggcgaagcactagctaaggtggaagacagtaatccacagaaaacctccgccactaaaaattgtctgaagaatctcagcagccactggctaatgaaaagcgaacccgagtcacgactggaaaagggagttgacgttaaattctctattgaagatctgaaggcacagcccaagcagacaacatgctgggatggcgtgcggaattatcaggcaaggaatttcctgcgggcaatgaagctaggtgaggaagcctttttctaccattctaattgtaaagaaccagggattgctggcctgatgaaaatcgtaaaagaggcataccccgatcacactcagtttgagaagaacaacccccattacgatccctcttcgaaagaagacaaccccaagtggtctatggtcgacgtgcagtttgtcaggatgatgaagagatttatccctctggctgagctgaagtcataccatcaggctcataaagcgaccggcggtcctcttaaaaacatggtcctcttcacacgtcagcgccttagcattcaacctcttactcaagaggagtttgacttcgtactatctctggaggagaaggaaccatcttag

SEQ ID NO: 244034 - DNA, 1926 bp, Artificial Sequence
  Description of Artificial Sequence: Synthetic coding sequence
atggccttgagcctggaagaattcgtacacagtctcgatctccgcacattgccgagggttcttgagatacaggccggtatttatcttgaaggcagcatttatgaaatgtttggtaacgagtgttgtttttccactggtgaagttattaaaataactggcttgaaagtgaagaagattatcgcagaaatttgcgagcagatagaagggtgcgagtccctccagccttttgaactccccatgaatttcccgggtttgttcaagatagtcgccgacaaaacaccttacctgacaatggaagaaatcacaagaacgatccacattggcccttctaggctcggacacccatgtttctatcaccaaaaagacatcaagcttgaaaatctcatcattaaacagggtgaacagatcatgctgaacagcgttgaggaaatcgacggggagataatggttagttgcgcagttgcacgcaatcaccagacacactccttcaacctgcccctttcgcaggagggcgagttctacgagtgtgaggacgaaaggatctacactcttaaagagattgtcgagtggaaaatcccaaagaatcgtactcgtacggtcaacctgaccgacttttcaaacaagtgggactccacaaatccatttccaaaagatttctatgggaccttgatcctgaaacctgtgtacgagatacagggagtgatgaaattcaggaaagacataattaggattctgcccagcctagatgtagaagtcaaagatatcactgatagttacgacgccaattggtttctgcagctgcttagcacagaagatttgtttgagatgacaagcaaggagtttcccattgtgactgaggtgatcgaggctcctgagggtaatcacctcccgcagtcaattttacaacccggaaaaaccatcgtgatacacaaaaaatatcaggcctctcggatcctggccagcgagattagatctaactttccaaagcgacatttcttgattcctacctcatacaagggtaagttcaagcgcagacctcgtgagtttccaaccgcatatgacttagagatagcgaaatccgaaaaggaaccactccacgtcgttgccactaaagcctttcacagtccacatgataagctctctagcgtgagtgtgggggatcagttcctggtgcaccagtccgaaaccacagaagtgctttgcgagggcatcaaaaaggtggttaatgtcctggcatgtgaaaagatcctgaaaaagagctatgaggcggcactcttacctctctatatggagggtggatttgtggaggttattcacgacaaaaaacagtatcccattagtgaattgtgtaagcaattcagactcccgttcaatgtgaaagtcagcgtaagggacctgagtattgaggaagatgtgttggctgccacccccggacttcagctggaggaagatattactgacagctatctgctcatttccgactttgcaaatcctactgagtgttgggaaatccctgtcgggagattaaacatgactgtacagcttgtgtcaaacttcagccgtgacgcagagccgttcctcgtgcgtacactggtcgaagagatcacagaggagcagtactacatgatgaggcggtatgaatcgtccgcctcccatccacctccgagacctcccaagcacccttccgttgaagaaactaagctgactcttcttaccctggctgaagagcgaacagtggacttacctaagtcccctaagcgacaccatgtcgacatcaccaaaaagctgcaccccaaccaggccggattagacagtaaagtactgatagggtcacagaacgatctggtcgatgaggagaaggaacggtctaatagaggagctacagcaatagccgaaacctttaagaacgagaaacatcagaagtag

SEQ ID NO: 244035 - DNA, 1689 bp, Artificial Sequence
  Description of Artificial Sequence: Synthetic coding sequence
atgaattttcctggcctattcaaaattgtggcagataaaaccccatatttaacaatggaggagatcaccagaactatacatatcggaccatcccgtctagggcatccgtgtttctatcatcagaaagacattaagctagagaatcttataattaaacagggagagcagattatgctgaacagcgttgaagagatcgatggcgagatcatggtctcctgtgccgtcgccaggaaccaccagacacactccttcaacctcccactgagccaggaaggagagttctacgagtgcgaagatgagcgcatctacaccctgaaggagattgtcgaatggaaaattcctaagaaccgcacccgaacagttaacctgacagacttttcaaacaagtgggacagtactaacccattccctaaggacttttacggtacacttatcctgaagccagtgtacgagattcagggggtgatgaagttcaggaaagacatcataaggatactaccttccctggatgttgaagtgaaggatatcacagattcatatgatgcgaattggttcctccaactgctcagcaccgaagacctgtttgagatgacctccaaagagttccccattgtcactgaggtgatcgaggcccctgaagggaaccacttaccacagtcaatactgcaacccggaaagacaatcgttattcacaaaaaataccaggcatctcgcatcctggcctctgaaatccgctccaactttcccaaacgtcactttctgataccaactagctacaaaggcaagtttaagcggaggcctcgtgaatttccaactgcctacgatctggagatcgcgaagagcgagaaggagccacttcatgtggttgccaccaaggcttttcattctccacacgacaagctgtcttcggtctcggtcggagatcagttcctggtgcatcaatcggagaccaccgaagtgctctgcgaagggattaaaaaggtggtgaatgtgctggcttgcgagaaaattctgaagaagagctatgaggctgccctgctccctctgtatatggaggggggtttcgtagaggtcatacatgataagaagcaatatcccatctccgagctgtgcaagcagttccgattaccattcaacgtgaaagttagcgtccgcgatttgagcatagaggaggacgtgctcgccgcaactccagggctgcagcttgaagaggatattacagattcctacctgcttatctcagacttcgccaatcctacagagtgctgggagattcccgttgggagactgaacatgaccgttcagctggtcagcaatttctcgagggacgcagagcctttcctggtgcgaactctcgtggaagagatcactgaagagcaatactacatgatgcggaggtacgaatctagcgcatcacaccccccacctaggcctcccaaacacccatccgttgaggagacaaaacttaccctgcttaccctggccgaagagaggactgtggatctacccaaatcacctaaacgtcaccatgttgatattaccaagaagttacaccccaatcaagccggactagattccaaggtgctgattggctctcaaaatgacctcgtggacgaggagaaagaacggtctaaccgcggagccacagctatcgccgagaccttcaaaaacgagaaacaccagaaatag

SEQ ID NO: 244036 - DNA, 372 bp, Artificial Sequence
  Description of Artificial Sequence: Synthetic coding sequence
atgaacttcccggtccggaaagacatcatccggatactgccttccctggacgtcgaagtaaaggacatcactgactcctacgatgcaaattggttccttcagttgttgtccactgaagatctgtttgagatgacatccaaagaatttccgattgttacagaagtgatagaggcacccgagggaaatcacctgccccagtcgatattgcagccaggtaagacaatcgtgatccacaagaagtaccaggcaagccgcatactagcaagcgagatacgttctaacttcccgaagagacacttcctcattccaacatcctataaaggaaaatttaagaggcgccctagggaattcccgaccgcatacgatctatag

SEQ ID NO: 244037 - DNA, 1821 bp, Artificial Sequence
  Description of Artificial Sequence: Synthetic coding sequence
atgttcgggaatgagtgttgcttctctacgggggaggtcatcaagataacagggctgaaggtcaagaagatcattgccgagatctgtgagcagattgaggggtgcgagagtctgcaaccattcgaattgcccatgaactttcccggactctttaagatcgttgcagataaaacgccatatctgactatggaggagataaccaggaccatccacataggcccttcgaggctagggcacccctgcttctatcatcaaaaggacatcaaactcgagaacctgattattaagcagggagaacagatcatgctcaacagcgtggaggagatcgatggagaaattatggtttcctgcgcagttgcccgtaaccaccaaactcattccttcaatcttccactctcccaggagggagagttttatgaatgcgaggacgagcggatctacacccttaaggagattgtggagtggaagatccctaaaaacagaaccagaaccgtaaaccttaccgatttctcaaacaagtgggattccactaatccctttccaaaagacttttacgggaccctgatactcaagccggtatatgaaatccagggggtcatgaagtttagaaaggatattatccgcattctgccatccctggacgtcgaggttaaggacattactgactcttacgacgctaattggttccttcagcttctctctaccgaggatctctttgaaatgactagcaaagagtttcctatagtaactgaggtaatcgaggcgcctgaggggaaccatctgccccagagtattcttcagcccggtaagactatcgtgatccataaaaaatatcaggccagtagaatcctcgctagcgagatcagaagcaactttccgaagaggcacttcttaattcctacgtcatacaaaggaaagtttaaacgacggcctcgcgagttcccaaccgcatacgatctggagattgctaaaagcgagaaggagcccctacacgtagtggctaccaaggcttttcacagtccccacgacaagctcagctccgtctccgtaggcgaccaatttctggtgcaccaatctgaaactactgaagtgttgtgcgaaggtattaaaaaagtggtcaacgtcttagcttgtgagaagattttaaaaaagtcgtatgaagcagctcttctgcccttgtatatggagggagggttcgtagaagtgatccatgataaaaaacaatatcccatttctgagttgtgcaaacagttccggctgccgtttaacgtcaaagtgagtgtgcgggatttgtccatcgaggaggatgtgctggccgctactcctggcttgcagctcgaggaggacatcaccgacagctatcttctcatctccgatttcgccaaccccactgagtgttgggagatccccgtcggccgactcaatatgaccgtgcaacttgtttccaactttagtagagatgccgaaccatttttagtccggaccttagtcgaagaaattacagaagagcaatactacatgatgagacgatatgagtcctctgccagtcatccgccaccacgccctcctaagcacccctcagttgaggagaccaagttaacactactgactctggcggaggaaaggactgtggacctgcctaagtctccgaagagacatcacgtggacattacgaaaaagctgcatcctaatcaggccggtctagacagtaaagttttaattggatcccagaacgaccttgtggacgaggagaaagagcgtagcaaccggggagcaacggccattgccgaaaccttcaagaacgaaaaacaccaaaaatag

SEQ ID NO: 244038 - DNA, 2043 bp, Artificial Sequence
  Description of Artificial Sequence: Synthetic coding sequence
atggcgttatctcttgaagagtttgtgcacagcctggacctccggactctcccacgcgtgctggagatccaggccggtatttacctggagggtagcatctacgaaatgttcgggaacgagtgctgcttctccaccggcgaagtgatcaagataaccggtctgaaggtcaagaagattatcgccgagatttgtgaacagatagagggctgtgagtccctgcagccctttgagcttcctatgaactttccagggctatttaaaatcgttgcggacaagacaccctacctaactatggaagaaatcacaagaacaattcacatcggcccttcccgtctgggacatccctgcttctaccaccaaaaggacataaagctagaaaatctgatcatcaaacagggcgagcagattatgctcaactccgttgaggaaattgatggggaaattatggtgtcatgcgctgtggcacggaatcatcaaacccattcattcaacctccctctgtcccaggaaggggagttctatgaatgcgaagatgaacgcatttacaccctgaaagagattgtggagtggaaaatccccaagaacaggacacgaacagttaacctgacagacttcagtaacaaatgggattctactaaccctttccccaaagacttttacggcactcttatcctgaagcccgtgtacgaaattcagggagttatgaaatttcggaaagatatcattcgtatacttccttccctagatgtggaagtgaaagatatcaccgacagctatgacgctaactggtttttgcagctcctctccaccgaggacctgtttgaaatgacgagtaaggaatttcctatcgtgaccgaagtaatcgaagcaccagagggcaaccacttaccccagagcatccttcaaccgggaaaaactatcgtgattcacaaaaaatatcaggcttcacggattttggcttcggaaattcggtccaactttcccaagaggcatttcctcattccaacttcgtacaagggcaagtttaagcgacggccacgcgagtttccaacagcttatgacttagagatagccaagtccgagaaagaaccattgcatgtcgtcgccactaaggctttccactcaccccacgataaactaagcagtgtgtccgtgggagaccagttccttgtgcaccagtcagaaaccactgaggttctatgtgagggaattaaaaaagtcgtcaatgtcctcgcctgtgaaaagatcctcaagaagtcgtacgaagccgctctgctgccgctctacatggaaggaggattcgtggaggtcatacacgataaaaagcagtacccaatctctgagctctgtaagcagttccgcctgcccttcaacgtcaaagtatcagtaagggacctgtccatcgaagaagacgttctcgcagcgacaccgggactgcagttagaagaagacatcaccgattcatatttattaattagtgattttgctaaccctactgaatgttgggagatacctgtgggacgactaaacatgactgtgcagttggtttccaattttagcagagatgccgagcctttcttagtccgaacattggtggaggagatcaccgaagaacagtactatatgatgagacgatacgagtctagcgcctcccacccaccccctaggccaccaaagcatccaagcgttgaggaaacaaagctcacattgttgacgcttgcagaagaaagaactgtcgacctgccaaagtccccgaaagccggtgtccaatggagggatctgggcagcttgcagcccctgcctcctggctttaagcagttttcggcctccgctagccacgtggctggaataaccggaaccccacaccatgtacaaagacatcatgtggacattactaaaaaactacaccccaaccaggcaggacttgacagcaaagtgttaatcggttcacagaatgacctagtggatgaagaaaaagagaggtcgaaccgaggagcaactgcaatcgctgaaaccttcaagaatgagaaacatcagaaatag

SEQ ID NO: 244039 - DNA, 1581 bp, Artificial Sequence
  Description of Artificial Sequence: Synthetic coding sequence
atggacgtaagattttaccccccaccggcacagcccgctgcagcccctgatgcaccctgtcttgggccttctccttgcctcgacccctactactgcaacaagtttgatggggaaaatatgtacatgtccatgaccgagcctagtcaagattatgtcccagcctctcagtcttatccaggaccgtcactggagagtgaagacttcaatatcccacctattacacctccctccctgcctgatcactccctggtgcatcttaatgaggttgagagcgggtatcactctctgtgtcaccccatgaatcataatgggctgctgccttttcatccacagaatatggacctccctgaaatcaccgtgtctaacatgttgggacaggacggaaccctcctgagcaacagcatcagtgtcatgccggacatccgtaatcccgagggtactcagtatagttcccacccacagatggcagccatgcgtcccaggggacaacctgctgatatccgccagcagccaggcatgatgccccacggtcagcttacaaccattaaccaaagccaactctccgcgcagttagggctgaacatgggaggcagtaacgtgcctcacaactctccatccccgcctggctctaagagtgccacgccatcaccttccagcagcgtgcacgaagacgaaggcgatgatacgtccaaaatcaatggaggagagaagaggccagcgtctgacatggggaagaagccaaagacccctaaaaagaagaagaaaaaggaccctaatgaaccccagaagcccgtttccgcgtatgccttgttctttcgggacacgcaggcagctattaaggggcaaaatcccaatgctacttttggagaggtgtcaaagatcgtagctagcatgtgggacggcttgggggaggaacagaagcaggtgtacaaaaagaaaacggaggctgccaagaaggagtacctgaagcaactggcggcttatcgcgcttcactcgtaagcaagtcctactcagaaccagttgacgtgaaaacctcgcagcccccacaactgatcaacagcaagccctccgttttccacggacccagtcaagctcactctgccctttacctgtcctcacactatcatcagcagcctggcatgaacccccatctgactgctatgcaccctagccttccacggaacatcgctccaaaaccgaacaaccagatgccagttacagtctcaatcgcgaacatggccgtgagccctccgcctccgctccagataagcccacccctacatcagcacctgaatatgcagcaacatcagcccctgactatgcagcagcccctcggaaatcagctcccaatgcaggtgcagtccgcgctacacagtcccacaatgcaacagggcttcaccctccaacccgactatcagacaatcatcaatcctacgtccaccgccgcacaggtggtgacacaagcaatggagtatgtgcgctccggctgtaggaatccaccccctcagcctgtggactggaataatgactactgctctagcggaggcatgcagcgcgataaagcgttgtacctcacttag

SEQ ID NO: 244040 - DNA, 831 bp, Artificial Sequence
  Description of Artificial Sequence: Synthetic coding sequence
atggggaagaaacctaaaactcctaagaaaaagaagaaaaaggacccaaacgagccacagaagcccgtctccgcctacgccctcttctttcgggacactcaggctgctattaagggacagaatccaaacgccacctttggtgaggtcagcaaaattgtggcatctatgtgggacgggctgggggaagaacagaagcaggtgtacaagaagaaaacagaggccgcaaaaaaagaatacctaaaacagctagccgcttaccgtgccagcttggtaagcaagagttactctgagccagtggacgtaaaaacatcacagccccctcaattgattaactctaaaccctctgtctttcacggaccctctcaagcccattatcatcagcagcctgggatgaatcctcatctgactgcaatgcacccctccctgcctcgaaacatcgcaccaaagcccaataaccagatgccggtaactgtatccatagcaaatatggcggtgtcgcccccaccccctctgcaaatttctccaccactgcaccaacacctaaacatgcagcagcaccagccattaaccatgcagcaacctctcggcaatcagctgcccatgcaggtacaatccgcccttcactctccaactatgcaacaggggtttactctccagccagattaccagactatcataaaccctacgagtaccgctgcacaggtggtcacccaggccatggagtacgtgaggtccggctgcagaaaccccccaccccagcctgtggactggaataatgattactgctcgagcggaggaatgcagcgcgacaaggccttgtatttgacgtag

SEQ ID NO: 244041 - DNA, 747 bp, Artificial Sequence
  Description of Artificial Sequence: Synthetic coding sequence
atgccagaattcctcgaggacccaagcgtgctgaccaaagacaaactgaagtcagaattggtggctaacaatgtgaccctgcctgccggagaacagaggaaagacgtatatgtccaactgtatctccagcatttgacagcgaggaataggccacctttgcctgctggaaccaattctaaggggcctcctgacttttcaagtgacgaggagcgggagcccaccccagttttaggctccggagctgcagccgctggcaggagtagggcggcagtgggaagaaaagctactaaaaaaacggacaaaccacgccaggaggataaagacgacttggatgtgaccgaactcacaaatgaagatctgctcgatcagctcgtgaagtacggggttaatcctggacctatcgtcggcaccacaaggaaactatatgagaagaaactgttgaagctaagagaacagggcacagagtcccgtagcagcaccccccttcccactatctcctcatcagcagagaatacccggcagaatggatctaatgattctgacaggtactctgataacgaggaggacagcaaaattgagcttaagctggagaaacgcgaacctctgaaaggccgtgccaaaactccggtaactctgaagcaacggagggtggagcacaaccaggtttctctcgtgctcctcccaccttgtactggtattaacaatctcttaactacattgatacacgttctggcattcaatggctag

SEQ ID NO: 244042 - DNA, 2085 bp, Artificial Sequence
  Description of Artificial Sequence: Synthetic coding sequence
atgccagagtttctcgaagaccctagtgtactgactaaagacaagctcaagagtgagctggtagctaataacgtgaccctgcctgctggggagcagcgtaaggacgtgtacgtccagctgtatctgcagcacttgacagcccgaaacagaccccctttgcctgcagggactaacagcaaggggcctccagacttctcatctgacgaggaacgtgaacccacaccagtgctcggcagtggcgctgctgctgcaggccgtagtcgggcagccgtaggcagaaaggctactaaaaaaacagacaagcccagacaggaggataaagacgatctggatgtcaccgagctgacaaacgaggatctgttagaccagttggtgaaatacggggtaaaccctggacccatcgtcggaaccacacgcaaactctacgagaaaaaactccttaaactgcgagaacaggggactgaatctcggagctctaccccactgcctacaatcagtagcagtgccgaaaacacacgacaaaatggcagtaacgactcagatcgttatagtgacaatgaggaggggaagaagaaggagcacaaaaaggtaaagtcaacacgcgatatcgtcccgttcagcgagcttgggaccacacccagcggcggtggattcttccagggtatctctttcccagaaatttctacacgacctcccttaggatctactgaactccaggcagctaaaaaggtgcatacttccaaaggagacctgccacgggagccacttgtggccaccaatttacctggcagagggcagctccagaagctggcatcagagaggaatcttttcatctcctgtaagtcatcacatgatagatgtttagagaaaagttcctcctctagttctcaacccgaacactcagctatgctcgtgtccacagcagcttccccttccctgatcaaggagactaccaccggatattataaggacattgttgagaacatttgcggaagagagaagtcaggcatccagcctctatgtccagagcgaagccatatttccgaccaaagccccctctcaagcaagaggaaggccctcgaagagtcagaaagtagtcagttgattagcccaccgcttgcgcaagccatacgagattatgtcaacagcttacttgttcagggcggagtgggctccctccccggaaccagtaatagtatgccaccactggacgtagagaacatccagaaacggatcgaccagtcaaagtttcaggagacggagttcctttcccccccaaggaaggtgcctagactctctgagaagtccgtggaagaacgggatagcggcagtttcgtcgcattccagaatatcccaggcagtgagctgatgagctcctttgccaaaaccgtagtctcccacagtctgaccactctcgggctggaagtggctaagcagtctcagcacgataagattgacgctagtgaactgtccttccctttccatgaatccatactcaaggtgatagaggaggagtggcagcaagtggatcggcagcttccaagtttagcctgcaagtatcctgtctcctcacgggaagctactcagattctctcagtgccaaaagttgacgatgagatattaggatttatctctgaagcaaccccactgggcggtattcaggcagcaagcacagaatcctgcaatcagcagctggatctggccctttgcagagcatacgaagccgcagccagcgccctacagatagctacgcacactgcatttgtggcgaaggccatgcaagctgacatcagccaggctgctcaaatcctctcttcagacccgtcccggacacaccaggcgttgggaattctcagtaaaacgtacgacgcagcttcttatatctgcgaagccgcttttgatgaagttaaaatggccgctcacaccatgggaaacgctacagtggggagaagatacctgtggcttaaggactgtaaaataaacttagccagcaagaataagctcgctagcaccccatttaaaggcggtaccctgtttggaggggaagtttgcaaagttattaaaaaacggggtaacaagcattag

SEQ ID NO: 244043 - DNA, 1245 bp, Artificial Sequence
  Description of Artificial Sequence: Synthetic coding sequence
atgcctgaatttctcgaagatccgtcagtgctgacaaaggataaactcaagagtgagctggtcgcaaacaacgtaacacttccagccggagaacagaggaaggacgtgtacgttcaactgtatctgcaacatctgaccgcaagaaacaggcccccattgcctgctggcactaatagcaagggcccacccgatttctcttccgacgaagagcgggagcccactccagttctcgggtctggcgctgctgccgctggccgaagccgagcagccgttggccgtaaggccaccaaaaagacagacaaaccacggcaagaagataaagatgacctggacgtgacggagctgacgaatgaggacctgctggatcagctggtgaagtatggggtaaatccaggaccgatcgtgggaacaaccagaaaattgtacgagaagaaactgctgaagctgcgagagcaagggacagaatcgaggagcagcacccctctcccaacgatctctagcagtgctgagaatacccgtcagaacggaagcaatgacagcgatcggtattccgataatgaggaggactcaaagatagaattgaaactggaaaaacgcgagccactgaaggggcgagcgaaaacccccgtgaccctcaaacagcgaagagtggaacataaccaggtggaaacgtcagagcatttcaggattgatggcccagtaatttccgagtctactcctattgccgagaccataatggcctccagtaatgaatccctcgttgttaaccgtgtaacaggaaacttcaagcacgcctccccgatcttgcccattacagagttttctgatatcccgagaagggcacccaaaaagccactgactagagccgaagttggtgaaaagactgaggagcggagggtggaacgcgacatcttaaaggaaatgttcccctatgaggcaagtacgcctaccggaattagcgcgtcatgccggagaccaataaaaggcgctgcgggtcgtccactggagctgtcagacttccgaatggaggagtccttttcctctaaatatgtgcctaagtatgttccactggccgacgtgaagagcgagaaaactaaaaaaggtaggtcaattcctgtctggattaagattctattatttgtggtggtggcagtgtttctgtttctcgtataccaggctatggagaccaaccaggttaatccatttagcaactttctccacgtggatcccaggaagagcaactag

SEQ ID NO: 244044 - DNA, 1038 bp, Artificial Sequence
  Description of Artificial Sequence: Synthetic coding sequence
atgccagagttcctggaggatccatccgtgctcaccaaagacaaactgaagtccgagctcgtagcaaataatgttacccttcctgcaggggaacagcgcaaagacgtgtacgtgcagctgtacttacagcacttgaccgccaggaaccgccctccgctgcctgctggcaccaactctaaggggccacctgacttcagcagtgacgaagaacgggagccaacgccagtcctaggatccggagcagccgcagcgggaagaagccgcgctgccgtaggtaggaaggcaaccaaaaaaacagacaagccccgacaggaagacaaagatgatttggatgttacagagctgaccaacgaagatctgttggatcaactggttaagtacggggtgaaccccggtccaatcgttggcacaacccgcaaactgtatgagaaaaaactcctaaagttgcgtgagcaaggtaccgagtcacggagtagtacacctctgccaaccattagctctagtgccgagaacaccagacagaacggaagcaacgattcagatcgctattcggacaatgaggaagactccaagatcgaactcaagttagaaaagagagagcctttgaaaggccgtgcgaagacacctgtcacactcaaacagcgtagagtcgagcacaaccaggtgggagaaaaaacagaagaaaggcgagtggaacgggacattcttaaagagatgttcccctacgaagctagtactcctactggcattagtgcctcctgccgtcgccctattaaaggagccgctggccgaccgcttgagctatcagatttccggatggaggagtccttcagttccaaatacgtgccgaaatacgtaccactggcggacgtcaagtccgagaagaccaaaaagggtagaagcatccctgtctggattaaaatcctcctcttcgtggtagtcgccgtgtttttattccttgtttatcaggccatggagacaaatcaggtgaaccctttttctaacttcttgcacgtggacccacggaagtcgaactag

SEQ ID NO: 244045 - DNA, 1365 bp, Artificial Sequence
  Description of Artificial Sequence: Synthetic coding sequence
atgccagaatttctggaagatccctctgtcttgaccaaagataagctcaagtctgagctggtcgccaacaacgtaaccctccctgcgggtgaacaaaggaaagatgtttatgtgcagttatacctacagcaccttactgccagaaacagacctccgctgcccgctgggactaatagcaagggtccgccagacttctcctcggacgaggagagggagccaacccccgtcctcgggtctggtgccgcagccgcaggacgctctagggccgcagtcggtaggaaggctaccaagaaaactgataaacccaggcaggaggacaaggatgaccttgacgttaccgagctcactaatgaggacctcctcgaccagctggtaaaatacggcgtcaaccccggacctattgttggcacaacccgcaagctctatgaaaagaagctgctcaagctcagggagcagggcaccgaaagtcggtcaagcacccctttgccaaccataagttcaagcgcagagaacacacgccaaaatgggtccaacgactcagaccgttatagtgacaacgaggaggactccaagatcgagttgaagcttgaaaagcgtgaaccacttaaaggtagagccaagacccccgtgacactaaagcagagaagagtggaacacaatcagtcatactcccaagctggtataacagaaacagagtggaccagtggctcctctaaaggaggtccgttacaggccctcacgagggaaagcactagagggtcaagacgaactccccgaaagcgggtagagacttccgagcactttaggatagacggtccagtcatcagcgaaagcactccaatcgccgaaaccattatggcttcttccaatgagagtctcgtggtgaaccgggtcacagggaactttaaacacgcgtccccgatactcccaatcacggagtttagcgacatcccgagacgtgctccaaagaagcccctgactagagctgaagtgggagagaagacagaggagagacgggtggaacgcgacatcctgaaagaaatgttcccttacgaggcttctactccaacgggtatctcggcttcatgccggagaccaatcaagggtgccgcaggtcgcccactggaacttagtgattttaggatggaggaaagcttttcctctaaatatgtgcccaagtacgtcccactggcagacgtaaaatcagaaaagactaaaaagggtaggagtatccctgtttggattaagatcctcttgttcgtggtggtggccgttttcctgttcctggtgtatcaggccatggagaccaaccaagtcaacccttttagcaatttcttgcatgtagaccctcgaaaatccaactag

SEQ ID NO: 244046 - DNA, 135 bp, Artificial Sequence
  Description of Artificial Sequence: Synthetic coding sequence
atgtcagacaagccagatatggcggaaatagaaaagttcgataaaagtaagctgaagaaaacggagacgcaagagaagaatcccctgccctcaaaagagacgatcgagcaggagaaacaagcaggggagtcttag

SEQ ID NO: 244047 - DNA, 135 bp, Artificial Sequence
  Description of Artificial Sequence: Synthetic coding sequence
atgtctgataagcccgatatggctgagatcgaaaaattcgataaaagcaagctcaaaaaaaccgaaacacaggaaaaaaatccacttccctccaaggaaaccatcgaacaggaaaagcaagccggagagtcctag

SEQ ID NO: 244048 - DNA, 135 bp, Artificial Sequence
  Description of Artificial Sequence: Synthetic coding sequence
atgtcagataaacccgatatggcagaaattgagaagtttgacaagagcaagctcaaaaaaacagagacccaggagaaaaatcccctgcctagcaaggaaaccatcgagcaggaaaagcaggcaggtgagtcctag

SEQ ID NO: 244049 - DNA, 135 bp, Artificial Sequence
  Description of Artificial Sequence: Synthetic coding sequence
atgtcagacaaaccggatatggcagaaatcgaaaagttcgataagtcaaagctgaagaaaaccgagacacaggaaaagaatcccctgcccagtaaggaaaccatagaacaagagaagcaggccggtgagagttag

SEQ ID NO: 244050 - DNA, 135 bp, Artificial Sequence
  Description of Artificial Sequence: Synthetic coding sequence
atgagcgataagcccggtatggcggagatcgaaaagttcgacaagtccaaactgaaaaagacagagacccaggagaaaaatcctctctcatccaaagaaacgatcgaacaggagagacaagccggtgagtcttag

SEQ ID NO: 244051 - DNA, 1299 bp, Artificial Sequence
  Description of Artificial Sequence: Synthetic coding sequence
atggggccagcagggtcacttctaggcagcggccagatgcaaattaccctctggggctcacttgccgcagtcgccattttttttgttatcacatttctcatctttctgtgttcctcctgcgatagagaaaagaagccaaggcagcactctggggaccacgagaacctcatgaatgtaccttccgacaaggaaatgttctcaagatcagtaacatcactggcaacagacgcccctgcctcttctgagcagaatggggcattgaccaatggcgacatattgtctgaagattccacactgacatgtatgcagcactatgaggaggttcagacctccgccagcgaccttctggattcacaggactcaacgggaaagccaaagtgccaccagtctagagaattaccacgtatacccccagaatctgccgtcgacacgatgcttacagcaagaagtgtggatggcgaccaggggctggggatggaaggtccctacgaggttctgaaggactcctctagccaggaaaacatggttgaggattgtctgtacgagacggttaaagagatcaaggaagtggcagctgcagctcacttggagaagggtcattccggcaaggcgaaatccaccagcgcctcaaaggaactcccgggaccccagaccgagggcaaggctgaattcgccgaatacgccagcgtagacagaaataaaaagtgccgccagagcgttaacgtggaatccatacttggcaacagctgcgaccctgaagaggaggcccctcctccggttcctgtgaagttgctcgacgagaacgagaaccttcaagagaaggaggggggagaggctgaggaatccgcaaccgatacaacttcagagactaacaaacggttcagctccttgtcatacaagtcgagagaagaggatcccacccttactgaagaggagatctccgccatgtatagttcagttaacaagcccggacagctcgtgaacaagtccggtcagagcttgactgtacccgagtccacttacacctctatccaaggcgacccacagaggagcccttctagctgcaacgacctttacgctacagtaaaggacttcgaaaagaccccaaattcaacattgccaccagcaggtaggcccagcgaagaaccggagcccgactacgaggcaatacaaacgttgaatcgcgaggaggagaaagctactctaggaaccaatgggcaccacggactggttccaaaggagaacgactatgaatcaatttccgacttacaacagggacgggacattaccaggctctag

SEQ ID NO: 244052 - DNA, 8135 bp, Artificial Sequence
  Description of Artificial Sequence: Synthetic coding sequence
atggcccttgtgctggaaatcttcacgctcttggcctcgatctgctgggtgagtgccaatattttcgagtatcaggtggatgctcagccacttcgtccttgcgagttgcagagggagaccgctttccttaagcaggcagactacgtcccccagtgtgccgaagacggtagtttccagactgtgcagtgtcagaacgacggtcgctcttgttggtgtgtaggagcgaatggatcggaggtcctgggtagtcgccagccaggcaggcctgtcgcatgtctgagcttttgccagctccagaagcagcagatcctgctgtctggatacatcaactcaaccgatactagctacctcccccagtgccaggattcaggtgattatgctcccgttcagtgcgacgtccagcaggtgcagtgttggtgcgtggatgccgaaggaatggaagtgtatggaacacgacagctgggcagacccaagcggtgcccgaggtcatgtgagatccggaaccggcgacttctgcatggggtgggcgataaatcccctcctcagtgtagtgcagaaggtgaatttatgcccgtgcaatgtaagtttgtcaatactaccgacatgatgattttcgatctggtccattcttacaaccgcttccccgacgcttttgtcacatttagctcatttcagcggcgatttcctgaggtgtccggttactgtcactgtgctgactcacagggcagggaactcgcagaaaccggtctggagctgctgctggatgagatttatgacaccatctttgcgggattggacttgcccagcacattcacagagacaaccctgtacagaattcttcagcggaggttcttggctgtgcagtctgtcatctcaggccgttttcgatgccccaccaagtgtgaggtcgagcgcttcaccgcaacaagttttggccatccttatgttcccagttgtcgcagaaatggtgattatcaggcagtgcagtgccagaccgagggtccctgctggtgcgttgacgctcagggaaaggagatgcatggcacacggcaacagggggagcccccaagctgcgccgaaggccagtcatgcgcatcagaacggcaacaagccctgagcagactgtactttggcacaagcggctatttttcccagcacgacctgttttcaagtccagagaagagatgggctagcccacgggtggccaggttcgcgacctcttgccctcctaccatcaaagagctgtttgtggactctgggcttttgcgcccaatggttgaggggcagtcacagcagtttagcgtgtcagagaatctgttgaaggaagctataagggccatcttcccttcaagaggacttgccagactagccctgcagtttaccacaaaccctaaacgcctccagcaaaacctgttcggagggaaattcctggttaacgttggccagtttaatctcagcggcgctctcgggacccggggaacctttaatttttcacagtttttccagcagctgggcttagcttcatttctcaacggcggaagacaggaagacctagctaaacccctctccgtaggcctggactccaatagctccaccggaactcctgaagccgctaagaaggacggaactatgaacaaacccaccgtcgggtcctttggcttcgaaatcaatctacaggaaaaccagaacgccctgaagttccttgcctccctgctggaattaccagagtttctcctgtttttacagcatgcaatctccgtccccgaggatgtagccagggatctgggcgacgtgatggaaaccgtgctgtcttcacagacgtgtgaacagaccccagagcgcctgtttgtacctagttgcaccactgaaggaagttacgaggacgttcagtgtttttcaggggaatgctggtgcgtaaactcgtgggggaaggagctgcccggttcaagggtccgtggtggccagcctagatgtccgactgactgcgagaaacagagggctaggatgcagtcccttatgggcagtcagccagccggtagcacattattcgtaccggcttgcacaagcgagggccattttctccccgtccaatgcttcaacagcgaatgttattgtgtagatgccgaggggcaggccatccccggaactcgcagtgcaatcggtaagccaaaaaagtgcccaaccccctgtcagctgcaaagtgagcaggcattcctgcgtaccgtgcaggccctgctgagcaactcaagcatgctgccgaccctgtcggatacatacatcccacagtgctctactgacggccagtggcggcaggttcagtgtaacggtcctccagagcaggtgtttgagctgtaccagcgttgggaggctcagaacaagggtcaagacctaactccagctaaactgctagtgaaaatcatgagttatcgcgaggccgcttccggaaacttcagtctttttattcagtcgctctacgaagccggacagcaggatgtttttccagtactgtcacaatacccatctctgcaggatgttcccctggcagcactggagggaaagaggccacagcctcgtgaaaacatcctgcttgagccataccttttttggcagatacttaacgggcagctcagccaatatcctgggagctattcagacttctccactcctctggcgcacttcgatctcagaaattgctggtgtgtggacgaggctgggcaagaactggagggcatgcgcagcgagccatctaagcttcccacttgtcccggaagttgtgaggaagccaagttacgcgttttgcagttcatccgcgagactgaggaaatcgtgtcagcttccaattcttcccgttttcctctcggcgaatcctttctggtggctaaggggataaggctccgaaacgaggatctcggactacccccacttttcccaccacgtgaggccttcgctgagcaattcctgcggggaagtgactacgccataaggttagcagctcagagcactttgagcttctatcagcgtcgtaggtttagccccgatgactctgccggagcgtccgcccttctccgctctggcccatacatgccacaatgtgacgcttttggctcgtgggaacctgtgcagtgtcatgccggtacaggtcactgctggtgcgtcgatgagaagggaggcttcattccaggatcactgaccgctaggtccttacaaatacctcagtgtcctacaacatgtgaaaaatcccgtacttctgggctgctgtccagctggaaacaggcgaggtcacaagagaatccgagcccaaaagatctctttgtgccagcatgcctggagaccggtgagtacgccagacttcaagcgtctggggcagggacctggtgtgtggatcctgcctcaggcgaggagctgcgcccagggtcgagcagctccgcccagtgtcctagcctgtgcaacgtccttaagtccggcgtcctgagtaggcgagtgagtccaggctacgtgccagcgtgtcgtgcagaagatggcggtttttcccctgtccagtgcgatcaggcacagggctcttgttggtgcgttatggattccggcgaagaggtgcctggtacacgggtaacagggggacaaccagcttgtgaaagccctagatgcccactccctttcaacgccagtgaggtcgttggcggaactatcctctgcgagactatcagcggacctacgggatcggccatgcagcagtgccagcttctctgccgacagggaagttggtctgtgttcccccctggcccactgatctgcagcctggaatctggtaggtgggagtcacaacttccgcagcccagagcctgtcaaaggccccagctgtggcagaccatacagacgcagggacatttccaacttcagctgccaccgggaaagatgtgttcggcagattacgccgatttacttcagaccttccaagtgtttatcctggatgaactgaccgccagaggcttttgccagatccaggtcaagacgtttggtacgctggtgagcatccctgtatgtaacaacagctccgtgcaggtggggtgtctaaccagggagcgcttgggtgtaaacgtgacctggaagtctcggctggaggatattcccgtagccagccttcctgatctgcatgacatcgagagggccctggtgggaaaggatcttctgggacgattcacagacctgatccagtccgggtccttccagctccacctcgattctaagactttccctgctgaaacaattcggtttctccagggagatcatttcggcacttcccctcggacctggttcgggtgcagcgaaggtttctatcaagtcctaacatcagaggcatcacaggacggactcggctgtgtaaaatgccccgaggggtcttactcgcaggatgaggaatgcatcccatgccccgtaggtttttaccaggaacaggccggatcattagcttgcgtcccctgtccagtggggagaaccacgatctccgctggcgcattctctcaaactcacctaatgcagaaattcgagaaggtgccagagtctaaggttattttcgacgcaaatgctcccgtcgcagttcgctcgaaagtgcccgacagcgaatttcctgtcatgcagtgtctaaccgactgcacggaagacgaagcttgcagcttttttacagtaagcacaaccgaaccagaaatctcctgtgatttttatgcctggacaagcgacaacgtcgcttgcatgacatcagatcagaagcgcgacgcactgggcaatagcaaagctacctcatttggctctttgagatgccaggtgaaagttcggagccatggtcaggacagccctgcagtctacctgaaaaaaggacaagggtccacaaccacattgcaaaagcgttttgagccaacaggtttccaaaatatgctgagcggcctctacaaccccatcgttttctcggctagtggggcaaacctgaccgacgcacacttattctgtttattggcttgcgatcgagatttgtgttgcgatggctttgttcttacccaggtgcaggggggagccataatatgcgggctgttatcgagcccgtcagtcctgctttgcaacgtgaaggattggatggatcctagcgaagcttgggccaacgccacctgccctggagtgacgtatgatcaggagtctcatcaggtgatactgagacttggggatcaggagttcattaagtccctgactcctcttgaggggacccaggacacattcacgaattttcagcaggtgtacctgtggaaggacagcgatatgggatcgaggccggaatcaatggggtgtaggaaagataccgtgcctcgcccagcgagccctacagaggccggattgaccactgagttgttctcacccgtggacctgaaccaggtgatcgttaatggaaatcaatctcttagttcgcaaaaacactggctgttcaaacatcttttctcagcccaacaggctaacctctggtgcctcagcagatgcgtgcaggagcactctttttgtcaactggccgagatcactgagtccgcatccctgtacttcacctgcacactgtacccggaggcccaggtgtgcgacgatatcatggagtctaatgcccaaggatgtagactgatcctgcctcaaatgccaaaagctctgttcaggaagaaagtgatcttggaagataaggtcaaaaacttctacacaagactgcctttccagaaactgatgggaatcagcattcggaataaagtgcccatgtccgaaaagtcgatctcaaacgggttctttgagtgtgaaagacgttgcgacgctgatccttgctgcaccggattcggctttctgaatgtatctcagttaaaaggaggcgaggttacatgcctcacactcaattccctgggcatccaaatgtgctcggaggaaaatggcggagcgtggaggattctggactgtggctcacccgacattgaggtccacacttatcctttcggttggtaccagaaaccgatcgcccagaataatgccccttccttttgccctctggtggtgctgccttctctgacagagaaggtatctttggattcttggcagtcacttgcattatccagtgtcgtggtggacccctccataagacatttcgacgtcgcacatgtctcaaccgctgccacctccaacttttctgctgtgagagatctgtgcctgtccgagtgttcccaacatgaggcatgtctcatcaccactctccaaacccagcccggtgccgtgcgctgtatgttttatgccgatacccagagctgtacccacagcttacagggccagaactgcagactgctgctacgcgaagaggccacccacatctaccggaaacccggaatctcgttgctttcatatgaagcttcagttccatcagttcccatttctacacatggcagattgctcggcagatcgcaggctatccaggtggggacatcatggaaacaggtggatcagttcctgggtgtgccatatgctgctccacctctggcagaacggcgtttccaggcccctgagccgctgaactggacgggaagctgggacgcatccaagcccagggctagctgttggcagcccggaaccagaacgtccacgagtccaggcgtctccgaagattgtttatatctgaacgttttcattccgcaaaatgttgccccaaacgccagcgtgcttgtatttttccataacacaatggatagagaggaaagtgagggatggcctgcaattgatggctcatttctggccgcagtgggtaacctcatagtggtgactgccagctatcgggttggggtttttggcttcctgtcatccgggagcggggaagtgtccggtaattggggcctccttgaccaagtcgccgcactgacatgggtccaaacccacattcgcggattcggtggagacccccgaagggtttccctggcggctgatcgaggcggagcggatgttgcgtccattcatctcctcaccgctcgcgctaccaatagccagttgttccgcagagccgtccttatgggcggaagcgcactctccccagctgctgtaatctcacatgaaagggcgcagcaacaggccattgcccttgccaaggaggtcagctgtcccatgtcctcttcccaggaagtggtcagttgtctgagacagaagcccgcaaacgtgctcaacgatgcacagactaaacttttggcagtgagtggtccatttcactactggggccctgtgatagacggccactttctcagagaacctcctgccagggcactgaaaaggagtctgtgggtggaggtcgatctattgattgggtccagtcaggatgacggactcattaaccgcgcaaaggccgtgaagcaattcgaagaatcaagagggcgaacaagctcaaaaacagcgttctaccaggctctgcagaacagtctaggaggggaggattccgacgccagagtggaagccgcagccacgtggtattattctcttgaacattctacggacgactacgctagcttttctagagccctggagaacgccacacgggattactttatcatctgtccaataatcgacatggcctcagcctgggcaaagcgtgctcgcggtaatgtgttcatgtaccatgctcccgagaattatgggcacggcagcctggaactcctggccgatgtgcagtttgcactgggcctgcccttttaccccgcatatgagggccagttcagcttggaggaaaagtcactgtcccttaagataatgcaatatttctcgcactttatcagaagcggtaacccgaattacccttacgaattctccagaaaagtccctacattcgccacaccctggcctgactttgtgcccagggccggaggcgagaattataaggaatttagcgaactgctgcctaatcgccaggggttaaagaaggcggactgctcattctggtctaagtacataagttctcttaaaacctctgccgacggagccaagggtggccaatccgctgaaagtgaggaagaggagctgacagccggatctggtttgcgagaggatcttctgagcctgcaggagcccggatccaaaacatattctaaata

SEQ ID NO: 244053 - DNA, 2664 bp, Artificial Sequence
  Description of Artificial Sequence: Synthetic coding sequence
atggctctggtacttgaaatctttaccttgctggccagtatttgctgggtttccgcgaacatctttgaataccaggtcgacgcccagccacttcgcccatgcgagctacagagggaaaccgcctttttgaaacaggccgactacgtccctcaatgcgctgaggacggaagttttcaaacagtccagtgtcaaaacgatggcaggagctgctggtgcgtgggcgcaaatggctcagaagtgctcggcagcagacaaccagggaggcctgttgcttgtctaagtttctgtcagctgcagaaacaacaaatactcctctccggctacatcaactctactgataccagttatcttccccaatgccaggattccggggattacgctcctgtacagtgcgatgtgcaacaggttcagtgctggtgtgttgacgcggagggcatggaggtttacggaacccgacagttgggcagacccaagcggtgccctaggtcatgtgagatccgcaacaggcggctcctgcacggagttggagacaagtctccgccacagtgtagcgcagagggggaattcatgccagtccagtgcaaattcgtcaacacaacagatatgatgattttcgatctggtacacagttataacagattccctgacgcattcgtgaccttcagctctttccagcgtagattccccgaagtgtccggctactgccattgcgccgacagtcaaggacgcgagctggcggaaacgggcctcgaattgctcctggatgaaatttatgacactattttcgcagggttagatctgccatccacttttactgagacaacgctctatcggatcctccagcgccgatttctagccgtacagagtgtaatctccggcaggtttcggtgccccaccaagtgtgaggtagaacgctttacagctacctccttcggccacccatatgtgccgtcctgtcgcagaaatggggactaccaagcagtccaatgccagaccgaagggccttgctggtgtgtcgatgcccaggggaaggaaatgcacggcacaagacaacaaggcgagccaccatcctgtgctgaaggacagtcatgcgcaagtgagaggcagcaggcattatccaggctttatttcggtacatcgggctacttttcgcagcacgacctgttctcctcaccggagaagcggtgggcctccccacgcgttgccaggttcgctacgtcctgcccccctaccatcaaggagttgttcgtggactcaggccttctgagaccaatggtcgagggccaatcccagcagttcagtgtgtctgagaacctgcttaaagaggctattagggccatattcccttctcgcggacttgctagactggcactccagttcacaacaaatcctaagagacttcagcagaatttattcggcggaaagttccttgtgaacgttggacagtttaacctcagtggagcactcggtacaaggggcacatttaacttttcccagttcttccagcagctgggcctggcttccttcctcaacggcggaagacaggaagacctcgcaaagccactatccgtgggactggattccaacagttcgactgggacccctgaggcggctaagaaagatgggaccatgaacaagccgaccgtaggcagtttcggatttgagataaacctccaggagaaccagaatgccctgaagtttctggcttcgctcctggaactaccggaatttttattgtttctacagcatgcgatcagtgtgccagaagatgtcgcgagggacctaggggatgtaatggaaaccgtcctctcatctcaaacttgcgagcagacccctgaacgcctcttcgtgccttcatgcacaacagagggaagctacgaggacgtgcagtgtttttcaggcgaatgctggtgcgtgaattcctggggaaaggagcttccaggcagcagagttcgcggagggcagccaaggtgtcctaccgactgtgaaaagcaacgggctcggatgcaatcccttatggggtctcagcccgctgggtcaaccctgttcgtcccagcttgcacaagcgaggggcactttctcccggttcagtgttttaattcagagtgttattgcgtcgatgcagagggccaagcgattccgggtacccgctccgcaatcggaaaacccaaaaaatgccccacaccctgtcagctgcagagcgaacaagcatttctgcgcaccgtgcaagcactgcttagtaacagcagtatgctgcccacactgagtgacacttatgagggacagtttagtctggaagagaagtccctcagtttaaagattatgcagtatttttcacacttcatcagatcaggaaaccccaactacccctatgaatttagccgtaaagtgcctacctttgcgacaccttggcccgattttgtgcccagagccggtggtgaaaactataaggaattttctgaacttttgcctaaccggcaggggcttaagaaagcggactgttctttttggtctaagtatatttcctctctcaagacttctgctgatggcgcaaagggaggccagtccgctgagagtgaggaagaggagcttactgcgggaagcgggctacgagaagacctgctttccttgcaggagcctggcagcaaaacttattccaagtag

SEQ ID NO: 244054 - DNA, 3417 bp, Artificial Sequence
  Description of Artificial Sequence: Synthetic coding sequence
atgatgcagaagttcgaaaaagtcccggagtccaaggtcatctttgatgctaatgccccagtggctgttagatccaaggttcccgattccgaatttccagtgatgcagtgcctgacagattgtacggaggacgaagcatgctcattctttacagtgtccaccacagagcctgaaatttcgtgtgacttctacgcctggacctctgacaatgtcgcttgcatgacgtccgaccagaaaagagatgctttaggcaatagcaaggcgacatcgtttggaagcctgagatgccaggtgaaagtgaggagccacggacaggacagccccgctgtctaccttaagaaaggcgcaatcatttgtggcctcttgtcttcgccatcagtactgctttgcaacgtcaaggattggatggatccctccgaagcatgggctaacgccacgtgtcccggtgttacatacgaccaagaaagccatcaggtcatcttgcgccttggtgaccaggagttcatcaagtctctgacccctttagaaggcacacaggataccttcaccaactttcagcaagtttacctttggaaagattccgatatgggatcaaggcctgaaagtatggggtgtaggaaagacaccgttcccaggccagcatcgcctacagaagctggactcacaacagaactgttcagccctgtagatttgaatcaagttattgttaatggcaaccagagcctgtcctcccaaaagcactggttgtttaagcatctattctctgctcaacaggcaaacctctggtgtctgtcacggtgtgtgcaagaacattccttttgtcagctcgccgagatcactgaatctgcatccctgtactttacgtgtacgctttaccctgaagcacaggtctgtgacgacattatggagtctaacgcccaaggatgccgtcttattctgccccaaatgcccaaggcactgtttcggaagaaagtgatactggaggataaagtcaagaacttctacacgcggctccccttccagaagctcatgggtattagcatcaggaacaaggtgcctatgtccgagaagtctatatcgaatggcttttttgaatgcgagcgccgttgcgacgccgacccttgttgcaccgggtttggcttcctgaatgtttcgcagcttaagggcggagaggtcacatgtttgaccctcaactccttaggtatccagatgtgcagcgaagaaaatggaggcgcatggagaatcttggactgcggttcccctgatatcgaggtccatacatacccatttgggtggtaccagaaaccaatagctcagaacaatgctcccagcttttgccccttggttgtgctgcctagtctaacagaaaaggtgagtctcgattcatggcaatccctcgctttgtcttctgtggtggtagatccctccatccggcacttcgacgtcgcccacgtaagtactgccgctacgtctaacttttccgcggtgagggacctctgcctctctgagtgttcacagcatgaggcttgtctgatcaccaccctgcagacccaaccaggggcagttaggtgcatgttttacgccgacacccagagctgcacgcattctttgcaaggtcagaactgcaggttactattaagggaggaagctacccatatctatcggaaacccggaattagcctgctgagttatgaagcctctgtcccttccgtgcctatctctacccacgggaggctccttgggaggtcccaagctatccaggtggggacttcctggaagcaagttgaccagttcctgggggtcccctacgctgcgccacctctggccgagagacggtttcaagcacctgagcctctgaactggactggtagctgggacgcctcaaaacctcgggcatcttgctggcagcccggtacccgcacaagcacatcgcctggtgtgagcgaagactgtctctacctgaatgtattcattcctcagaatgtggcaccaaatgcctctgtgctggtttttttccacaatacaatggatcgcgaggaatctgaaggatggccagccatcgacgggtcatttctggccgcagtcggcaatttaatcgtggtgaccgcttcctatcgcgtaggggtctttggatttctgtcctctggatctggtgaagtatcaggaaactggggactgctagatcaggtggcagcgcttacctgggtacagacccacatccgcggtttcggcggtgacccacggcgtgtgtccttggccgcagaccgtggcggagccgatgtggcctctatacaccttctgactgcacgcgcaactaactctcagctgttcagacgtgctgtgctgatggggggtagcgccctctctcctgccgcagtgatttcccacgagagggctcagcagcaggcgatcgcattggcgaaggaggtgtcatgccctatgagttcctcacaggaagtggtgtcctgcctgcgccagaagccggcaaatgtgctgaacgacgctcaaaccaagttgctggctgtttcaggtccctttcattactggggtccagttattgatggccactttctgagggaacccccagcccgagccctgaaaaggtctctctgggtggaagtggatctgctaattgggagctctcaggacgacggactgatcaacagggcaaaggctgtaaagcagtttgaggaatccagaggcagaacaagctccaaaacagccttttaccaggctctgcaaaactcactgggcggagaggattcggacgcaagagtagaggcagcagcgacttggtattattcccttgaacactcaacagatgactatgcttcctttagtagagccctggagaatgccacccgggactactttattatatgtccgatcattgatatggcgagtgcctgggcaaaacgcgcacgagggaatgtatttatgtatcacgcacccgagaactacggacacgggagcctggagctgcttgccgacgtccagttcgccttagggctgcccttctacccagcctatgaaggacagttcagccttgaagagaaatcactgtcacttaagatcatgcagtactttagtcattttatcagaagtgggaatcctaactacccttacgagttcagccggaaagtcccaactttcgccaccccttggcctgactttgtgcctcgggctggaggagaaaattataaagaattttcggaacttttaccaaaccgacaaggcctgaagaaagcggactgtagcttctggtcaaaatatatcagcagcttgaagacgtcagccgatggcgcaaagggaggacagtctgctgagagtgaagaggaagagctcactgctggctctggactccgcgaagacctgctttcattgcaggagcctggatccaagacctactctaaatag
